United States Patent 11,866,728 (ENGINEERED RETRONS AND METHODS OF USE) - sequence listing, part 2

SEQ ID NO: 2523 - protein, 342 aa, unidentified
  source 1..342: note = Related to JAFYBR010000063.1; note = Lachnospiraceae bacterium
MSEEKKCPQIGRPRELCSLLGHKAEYVYGIANETHKYYQHSRIPKKRGGFRELYEPLPELKKMQTWILHHILDLLEPSPYAKAYRKGYSVKDNAKFHRRQKKVLSLDIEGFFDHIRRYPVFRVFLDAGYKKDVAMLLAALCCRNGCLPQGAPTSAALSNLVMLGFDAKVGAFCRERGIRYTRYADDMTFSGDFEETEAIRFVKEECGKLSMKLNREKTRVRKQGQQQEVTGIVVNEKTQLPESERKKIRQEMYYIRKYGLESHLRHLREGLASGKNHLQEASGNGKESCLRETGTSRDLSKERYLSQLLGRISYALFINPRDEAMREYKKAVIEWMKTDIIK

SEQ ID NO: 2524 - protein, 346 aa, unidentified
  source 1..346: note = Related to NZ_LT635539.1; note = Blautia sp.
MDWNKYREDFLIKAKNQKKDKKYCDKWLSYAHNLYEQELPIIYNQEHFCKLVGYMPEYVYAASNSADHFYRTFFIPKKSGGLRKICEPLPNLKEIQKWILETILSKMQVSVYAKAYIKGKNVKENARFHRAQKKVLSLDIQDFFSKISPFLVYETFINVGYNKDVSMMITMLCCKEGGLPQGAPTSALLSNIIMKNFDNVIGDYIIKNKIRYTRYADDMTFSGEFDELEIIRLVRHELKKYGFCLNGKKTRLRQEGQRQEVTGIIVNKKLQISKDQRKKIRQEIYFIKKYGLQSHLTYTNEQRKGYIEHLFGKISYALYINPKDEELKEYREFLLQYKSNSEISLN

SEQ ID NO: 2525 - protein, 349 aa, unidentified
  source 1..349: note = Related to NZ_CP028101.1; note = Fusobacterium nucleatum
MEWIEYREQFITTAKKASKNSGYIKKNLKYAEKLYNQKLPIIYNASHFSKLVGYSLQYLYAASNDSSKFYREFEIKKKNGGSRKISEPLPSLKEIQKWILENILNKIQKEKVSKYAKAYQKKISIKENVKFHRGQKKVLSLDITNFFLNIKIDKIYEVFYNLGYSKSLSTLFSNLCTLNYSLPQGAPTSPILSNIVMLNFDNEIEKIVLEKRIRYTRYADDMTFSGDFLEKEIIKYVKENLNKIGLKINNKKTRVRKNWQQQMVTGIIVNEKIQISRKKRDELRQTMYYIEKYGIDSFLKYKGIKNKVYYLSHLKGILEYAYFINKNDKKLFNYIEYLKNNFFKEKSSI

SEQ ID NO: 2526 - protein, 341 aa, unidentified
  source 1..341: note = Related to WWTL01000016.1; note = Clostridium sp.
MNWKNYCVEFRKEAALKGKNEEYCDTWLQYAKVLFDKGLPIIYNQEHLCLLLGYKEEYVFAVSNSASNFYRNYEIPKKNGGVREISEPLPSLKEIQRWILDNILSSINISVYAKAYVKKKSIKDNARFHKRQEVLLTLDVSNFFDSISSDKIYNLFLDLGYKEDVVVMLTNLCCLNGWLPQGAPTSPMLSNIILRQFDNVMGKYTNEKKIRYTRYADDMTFSGTFNPGQIISVVRKELFRLGLQLNENKTRVRRKGQCQEVTGIVVNEKLQLPKNVRKKIRQDLYYIRKYGLESHMEYCDISKEKYLQHLKGRIQYGLFINPYDYELQGYLSYLENMYGQY

SEQ ID NO: 2527 - protein, 341 aa, unidentified
  source 1..341: note = Related to NZ_LT635469.1; note = Blautia sp.
MNWDKYCNEFCKEAEHNGKNATYCNTWLQYAKSLYEKKLPIIYNQKHLCLLLGYKEEYIYAASNSAINFYRTYKIPKKNGGTREISEPLPSLKEIQRWILDNVLAPVNISVYAKAYVKKKSIKENARFHKRQPIVLSLDVERFFDSITSDKIYSLFLKLGYKEDVSVLLTNLCCLNGCLPQGAPTSPMLSNIVLTEFDNIIGKYTNEKKIRYTRYADDMTFSGDFKPGQIISFVKYNLSNLGLKLNERKIRTRKKCQRQEVTGIVVNEKMQLPKPVRKQIRQEMYYVRKYGLESHMQYCDISKENYLQHLKGRIQYGLFINPYDYELQDYLGYLDKVYGKY

SEQ ID NO: 2528 - protein, 339 aa, unidentified
  source 1..339: note = Related to QTVG01000007.1; note = Eubacterium sp.
MDWEDYKNEFIRVAKKNEKNEDYCDKWLKYAKKLYDKRLPIIFNQEHLCLLLGYKKQYVYSVSNSPADFYRYYKIPKKNGNFRQISEPLPSLKEIQKWILDNILVNVDTSVYAKAYIKKKSIKDNARFHRKQKVLLSLDIKNFFDSISSDKIFDLFWNLGYKEDVVVMLTNLCCLNGSLPQGAPTSPMLSNIVLEDFDNEIGLYTMEQKIRYTRYADDMTFSGDFHPGKIISKVKRQLNDLGLKLNDEKTRTRGRGQRQEVTGIVVNEKMQLPRPERKKIRQEMHYIIKYGIESHLEYCKIEKANYLSHLKGKIEYGLFVNPYDYELKEYLSYLNNIKD

SEQ ID NO: 2529 - protein, 352 aa, unidentified
  source 1..352: note = Related to VMKF01000001.1; note = Geobacter sp.
MTILLVLVEGSFFIMQWEIYKRKFTHKAKSARFDEGYIERCLNYAENLHKQGVPIIYDIEHFSHLVGYDVSYLLRASNAQARFYRHFTIPKKNNTERSISEPLPSLKEVQRWILDNILDKLALSRFAKGFVKNRNIKENARFHRKQRYVLSLDIKNFFPSIKYKQVFHLFSSIGYCESVSTLLSNLCTLDNSLPQGAPTSPAISNLVCRRVDSRLSGFALKNKIRYTRYADDITFSGDFDPGRILRFTSKVLSESKFTVNKTKTRLMEQHQRQEVTGIVVNSKMQAPRELRKKLRQQIYYIKEFGLESHLKATNNKRANYLSHLKGLAGFVLFINNKDSDAKEAIDFLETFS

SEQ ID NO: 2530 - protein, 348 aa, unidentified
  source 1..348: note = Related to QZJW01000035.1; note = candidate division WS5 bacterium
MGLVEKKFNWEDYSEKFTVLARNEGRDAIYAELCLSYAHRLYSNNIPIIYDVEHLCKLVGYDKYYVLGASYETEKFYRKFKIPKKSGGFRTIHEPLPSLKEIQRWILDNILYNINISKHAKGFIHDLSIKDNAKYHRNQPCVLSLDIKDFFPSIMRHRVYGIYRSIGYTQLISNILSRICTLNESLPQGAPTSPALSNIICFNLDRRLAGFSKKYDYRYTRYADDITISGNIVAGRVIRFVKKILGDYDLFLNDNKTRLMQRHQRQEVTGIVVNEKMQTPKEIRRHVRQEVYYINKYGMDSHLDKIKDVRSNYVKHIIGIVNYIKFVNPNDRHAAQALSILMENYNKK

SEQ ID NO: 2531 - protein, 345 aa, unidentified
  source 1..345: note = Related to JAEINN010000002.1; note = Maridesulfovibrio ferrireducens
MPSSLIWKKYSQAFAKKGKKEGHSKEYIHTCLNYAEQLYKRSAPIIFDPVHFSLLVGYSPKYIMAVTNSPDNFYRQFSISKKNGGSRNITEPLPSLKEIQHWILTNILNNIPVSKYAKAYISKESIKSNARFHRKQPTVLCLDIKDFFGSIHGGIIFNLFRTIGYRSSIASLLTNLCIYDDALPQGAPTSPALSNIIMKGFDQRAAGFCKKREIRYTRYADDLTFSGTFFPKEIIRFITSALSDLKMDLNPTKTRILGQGQQQRVTGIVVNEKMQVPRKTRRNLRQSIFYIKKYGISSHQNHEKIYKSNYVRHLLGIANHILFINPKDADALNALSVLKPLLNKK

SEQ ID NO: 2532 - protein, 341 aa, unidentified
  source 1..341: note = Related to NC_020304.1; note = Desulfocapsa sulfexigens
MNWKKYRKEFTIQATAKSLDEKSMQHALSYARGLYKANLPIIFSQNHLSRLVGYNIDYIRNASSTKSDQFYRCYKIKKKSSDTMRTICEPLPSLKEIQRWILDNILSQVTISKFAKAYVVGFSIKDNARFHLRQKQVLRIDVKDFFPSIKGQNVFHIFKNIGYSAEVSAMLTGLTTLKNCLPQGAPTSPTLSNIFMNRCDARIAGYCLARKIRYTRYSDDLTFSGEFDVGKLISFINMVFKDSGLLLNKTKTKQMFKHQRQFTTGLVVNERINVCREKRRKLRQEIFYIKKYGLDGHLIRTEEKRTNYIMHLLGLSNFITHINANDRDALEAKEILRKYIT

SEQ ID NO: 2533 - protein, 342 aa, unidentified
  source 1..342: note = Related to NZ_CP040896.1; note = Hymenobacter sp.
MEWQQYKALLIAEAQAKGYSDEKLLETLDYANNLINKSLPVIYDLKHLSLLVGYKTAYIQRATHRSQFFYRRFEIRKKSGATRVIFEPLPSLKEIQLWILKNILNNCPISKYAKAYVRKKSIKDAARFHKNQKYVVTIDIVQFFEFINYPTVLGKFILMGYSREVSTILTKLCCKNDSLPQGAPTSPSLSNIVFADIDFEISEYCYANNIRYTRYADDLIFSGDLEPKLLIGKIEGILLNNGFILNNSKTRIMRPWQRQIVTGLIVNEKSKVQVPIEARRKLRQEMYYINKFGLDSHLSYTKNYKAKYLIHLLGVAKYMFFINPNDTKVANYIYQLESYINN

SEQ ID NO: 2534 - protein, 370 aa, unidentified
  source 1..370: note = Related to SEFI01001149.1; note = Sphingobacteriaceae bacterium
MMPLRLRLRDYIISYNHCNAAVSSSIMVWQTYQADFTAKALAARRPIAETEILLAYAKNIHDKGMPIIYDIGHLSLLVGYKVDFLVAASTYPRAYYRNFRIKKKSGASRVISEPLPSLKAIQTWILENILEKFEVSLYAKAYVKGRSIKENARFHRNQNNVLTIDIKNFFGSITKVRIISFFSSLGYSRQVALLLARLCCKNSRLPQGAPTSPTLSNIVLVAFDEKLFNVCSLNKVRFTRYADDITFSYENKNLTGPLIEYARELLRGEGLVLNRDKTRLMERHQRQEVTGVIVNKKLQVPIEIRKDLRQIFYYINKFGLDSHIERIQEKRSRYLYHVLGLCNFVLFINPNDKEVKGYLITARDYLTSEE

SEQ ID NO: 2535 - protein, 345 aa, unidentified
  source 1..345: note = Bacilli bacterium; note = Related to JAFVUY010000108.1
MKWEVLKDKIIKECKFANKSEKYTSAYLEYCRKLYEKELPIIASPKHFSLLVGIDHEYVCKMAYSQNLFYRSFKINKSNGKKREIKEPLPDLKYVQKWILNNILNKVEVSDYAKAFVKNRTLKHNAKFHKKQNVVVTLDIKDFFPSITLYDVADIFKDLGYFENVALFLANLCCYKKQLPQGAPTSPYLSNLRFRKIDDSISSYTKELNIRYTRYADDMTFSGDFNPHQLIKKISDIIHNSGFNINSKKTRVAYKNARQEVTGIVVNSHMQVSKNKRRDIRQQVYYIKKFGLDSHLTHIQETRANYLNHLLGQINFCLFVNPKDNEMKQYFGQIKDLMQKQNSDD

SEQ ID NO: 2536 - protein, 342 aa, unidentified
  source 1..342: note = Related to SVPN01000006.1; note = Oscillospiraceae bacterium
MKWEVVEKNIKKECKARHKDSVYIQKYIAYSKNLFDNDLPIISSPEHFSLLIGMEHQYVCNMAYAADRFYRHFTIPKSNGKKREIDEPLPDLKFVQSWILENILEKCPISEYAKAYYKGRTLKHNARFHRAQSIVLTMDIKEFFSSISVRDVTKIFEDMGYFHELSCFLAYLCCLNNVLPQGAPTSPYLSNLRMRILDNKISQYTSQRKIRYTRYADDLTFSGDFNPHHVIKDISKLVYDEGFVINPDKTRVARRNARQEVTGIVVNSHMQISKEKRKQIRQQVYYIKKFGVESHLERINESRANYLNHLLGQINFALFVNPKDEEMKEYFNVIKTLLVDQN

SEQ ID NO: 2537 - protein, 346 aa, unidentified
  source 1..346: note = Related to NZ_CP060696.1; note = Caproicibacterium amylolyticum
MEWSTLRNAIIRKCKEHRKGDEYSEALLSYSEKLFVQNLPIITCPAHLSLLIGLEHDYVCRMAFSPEHFYRHFTIKKANGKDRSIDEPLPDLKFVQQWILSNILENVPVSTYAKAFIKKRGVKENARFHRAQTVVVTMDIKDFFPSINLQQIVNIFCTLGYSNDVSNFIAHLCCYHYSLPQGAPTSPYLSNIRMREFDKKVVDYSSPLKIRYTRYADDISLSGNFNPHTAIKYLSSLVFKEGFSINAEKTRVAYQNARQEITGIVVNSHMQVPKAQRKKIRQEVYYIKKYGLDSHLSHISETRENYLNHLLGKINFARYINPKDQEMQEYYETIKKILILFRNESF

SEQ ID NO: 2538 - protein, 363 aa, unidentified
  source 1..363: note = Related to NZ_FOAT01000022.1; note = Ruminococcus albus
MYAKNSLVVQSIKCYVALLGDYMKKNYYDKIILECKKHNKSQEFVDTYLAYYENLTQKGLPVISSPKHFSMLVGMDHDYICSMAYSPKHFYRTFYIEKANGMKRKISEPLPDLKYVQKWILKNILEKVKVSPYAKAYVSNSSVKHNARFHRKQKVVLSMDIKSFFPSVKVKSIVDIFKSFGYTENVSCFLAYLCCNNYCLPQGAPTSPYLSNLRLLKFDSIISQYTSLRKIRYTRYADDLTFSGDFDPSNLIRFVSKCVWEEGFKINSDKTRVAYGNTRQEVTGIVVNDKMQIPKTGRKKIRQEVYYIRKYGVSSHLSHINETRVHYLNHLLGKINFALFVNPNDIEMKGYYDYIISIIEDVD

SEQ ID NO: 2539 - protein, 347 aa, unidentified
  source 1..347: note = Related to NZ_BQKV01000037.1; note = Faecalibacterium gallinarum
MMDWDKFKTQAIQKARVDRIRDIELRSYLSYAEKLVKQNLPVIVDAASLASFVGIDLLYLCQMAYGTEYFYRRFQISKKSGGMREIAEPLPDLKAVQNWILTNILNYTSVSKYAKAYVKNQSIKSNARFHREQKVLVSMDVKDFFPSIKIEDVFKIFVNLGYIENVSWFLAHLCCLNGELPQGAPTSPYLSNLRMRNFDSEVGTYALENGWRYTRYADDLTFSGDGNVKELIRTVSGLLLKNHLYPNTKKTRVARQNTRQEVTGIVVNKKIQTAKQYRKKIRQEVYYIKKYGLDSHLTFCQISQKNYLNHLQGKILYALFVNPKDKELLEYKEFISDLLIKTKSSLK

SEQ ID NO: 2540 - protein, 344 aa, unidentified
  source 1..344: note = Related to WKQN01000003.1; note = Faecalibacterium prausnitzii
MDWNEFCNHAKFQASVDGINEEELKKYLQYAKRLVRKDLPVIVDPYSLAKFIGIDFHYLCNMAYGTEHFYRNFLIPKKSGGTREISEPLPDLKQVQHWMLNNILNYIEISKYAKAYVKKQGVKSNARFHRGQKVLVSMDVKDFFPSIKKIDIFHVFHGLGYDENVSWFMAYLCCLNGELPQGAPTSPYLSNIIMSSFDKDVASYAIEKKWRYTRYADDLTFSGDGNVEELIRVVSELLLKYHLYPNTKKTRVAYQNARQEVTGIVVNKKLQAARQYRRKIRQEVYYIKKYGIESHIAFCQISQKNYLEHLQGKIGYALYVNPKDIELLEYQKFLHEVSDSLQNQ

SEQ ID NO: 2541 - protein, 351 aa, unidentified
  source 1..351: note = Related to DUPM01000091.1; note = Clostridiaceae bacterium
MQNKNCTWDQYRSAFIELAQKSNKSKPYIRRCLEYAEPIFERGLPIIFDVHHLSKLTGRSAKHIFSLSRFARCHYRSFSITKKSGGERRIDEPVEDLKYIQRWILHEILERLPVSPYAKAYVPGLSVRDNARFHQNQDKILTVDIKDFFPSVRSKSVFFVFRNAGYSDTVATILSNLCCLEHRLPQGAPTSPMLSNLVFSDLDKVIADFSIQRGLRYTRYADDLTISGSLDIRETLHFLYPLLNNRGFRLNPEKTRVLSRNMRQAVTGIVVNQYLQVPLNIRKNIRQDVFYIRKFGLKSHMEHIDETGDNYIDRLIGIVGYAIFVNPHDNEMKDYFSYLRSLKNDEKVQTA

SEQ ID NO: 2542 - protein, 356 aa, unidentified
  source 1..356: note = Related to NZ_QGNY01000001.1; note = Pedobacter sp.
MKESNYSWNEYKFRFEQKAIDFGHPLSKIEGLLLYAQKLFAANLPVIYDLRHLSYLTGYREEYMLRATSRPENFYRYFRIAKKNGHSREISEPLPGLKEIQYWLLDNVIKKLPPNKLNNAYLEGRSIISNAKFHTKQQKLLNIDIEKYFNNITKKQVEGFFSSLGYNLEVSSLIAGLLTMKDGLPQGSPSSPYLSSIMTVQIDVTLLAECRALGLRYSRYADDISISGEFNTEEVVKKVNAVLLANGFKANSRKTTVKKSHQRQMVTGVVVNKKLSVKKKVIKELRQELYYIHKYGLEQHLRRKEIQRRNYLNVLEGKLNYFCSVKRNNAELSYIRRMLSEIKIRESAEQLRSAFE

SEQ ID NO: 2543 - protein, 347 aa, unidentified
  source 1..347: note = Related to NRSW01000001.1; note = Mucilaginibacter sp.
MQESIFSKNEYLFKLEKKAQELGLPNQSVLGLLSYAKTLQEKNLPVIFDIKHLSYLTGFKVDYILRAIKSPDKFYRTFFIRKKNGRSRQIKEPLPGLKSIQYWILNNIIKKVPTSRFNNAYSIGKSTVSNAKFHTKQQFVLNLDIEAFFDNITASMVSLFFSNLGYNSDVVSVLSSLCTLNGSIPQGSPSSPYLSSILTIDIDENLYKYCRERNLRYSRYADDITISGSFHAGVVIAGVRKLLNSLNFSINDSKTRVKSQHQRQLVTGLVVNKKIAVKRSDLKEFRQEMYYIMKFGIESHVIKQNVTKNNYIDHLLGKANFYLFVRKKDSDLFKYKTYLIDVLKGKK

SEQ ID NO: 2544 - protein, 347 aa, unidentified
  source 1..347: note = Related to CDNR01000033.1; note = Paeniclostridium sordellii
MNYNKYSIIFKQEANNQGLSEDEIEVYLTYAKVLLDKSLPIIYNQDHLSKLLGIHPIYLYTLTNSSDKFYRKFKINKKNGKKRNIEEPLSILKEAQYWILEHILLKCSCSNYTKAFKANSSIKENAKFHKKQNIVINLDIEDYFGTIKGHKVYEFFRTLGYNNEVSIMLTKICTNKDSLPQGSPTSPYLSNIITENLDNKLAELAKKEEYGLRYTRYADDITFSTNNKINITNLIIDTKYVLKQEGFKINYKKTKVISSNKRQMVTGIVVNDKLQVSKQQRRKVRQAMYYIEKYDLESHIRNIGWQKGKDKYLRHLLGNINFVLFINPKDKEHLKYKSQLIQKLKEI

SEQ ID NO: 2545 - protein, 346 aa, unidentified
  source 1..346: note = Related to SEFT01000010.1; note = Sphingobacteriales bacterium
MFTTKPSLSEYKLSFSKEARRKDYNDYDIKEFLDYAEILYLKDLPIIYNIKHFSLLVGYKETYLARAAETTFNFYRSFDIRKRNGKLRKIDEPLPSLKEIQTWILTNILYKLDCSKYSKAYKKKNSIKTNAKFHRDQDVVLSLDVKDYFGSIRVEDVEFFFADLGYEENLSGMLASLCCLNGSLPQGSPTSPYLSNLITIELDNDLSELAKLYNVRYTRYADDITFSGTFTVGVLINKAKEVATRYGFEINDKKTRAMGKHEQQLVTGIVVNTKKLQVSRERRKDLRQQLYYIQKFGLENHLAKRNINKRNYLQHLLGLTNHILMVNPKDEEALRYKQVIFSYMND

SEQ ID NO: 2546 - protein, 346 aa, unidentified
  source 1..346: note = Related to JAFYNR010000020.1; note = Clostridia bacterium
MNFLTYEQKFKEQAELSGKSEYYIDECLNYARNLNKNGLPIIYDDVHLSKLLGIRLDFLISISNSQKDYYRFFSISKSNGKSRKIAEPLPLLKEIQHFILDNILLKVPCSVYSKAYKPGAKLKSNAKFHRNQPVLIKMDLKDYFPSLDEHRVYKFFHHLGYKDSVSVLLAKLCTLNKALPQGAPTSPYLSNLLTRELDEDIYLFCKENGNLRYTRYADDISISGNMIPTNIIKGVVKIIAKHGLKINKEKTAVIPNSNRQVVTGVVVNQKLQASKPYRHSIRLEMHYCMRYGIEDHIKKSKKISNNTNKRKYCQQMLGKVNHCLQLNPNDSEMKSYRDFLLQKIVE

SEQ ID NO: 2547 - protein, 351 aa, unidentified
  source 1..351: note = Related to JAKNGR010000030.1; note = Flavonifractor plautii
MNFSTYQREFIAEARKHDKNDEYIEKCLAYAKNLVDKRLPIIYDEKHFSQLVGIDLDYLLSAANSPKHFYRYFTIPKRNGKIRRISEPLPVLKEAQYYILNNILKKVPCSIYAKAYKPGATLKGNAKFHRKQPILVKLDLKDYFPSLHESRVFQLFHQSFGYGKSVSILMSKLCTLDGGLPQGAPTSPYLSNLLTSEMDDKIYQFCSSNGNLRYTRYADDISISGSMNPSDIISGVSRIVSEHHLQINKSKTAVFRPHKRQVVTGVVVNNKIQAPKDYRRSIRLEMHYCMKYGIESHILRATKRSSDAVDRVKFCQSMLGKINYCLQLNSKDTEMQRYRDYMLEQLHGNAQ

SEQ ID NO: 2548 - protein, 360 aa, unidentified
  source 1..360: note = Related to QUJF01000028.1; note = Butyricicoccus sp.
MNFITYEKMFTEAARKAGKSDDYIKNCINYAKALADKHVPIIFDIHHFSQLIGIRLDFLLAISNSPRNFYRYFTIPKASGKFRKIAEPLPILKDIQHYILHNILKKIPCSIYAKAFKPRASLKGNAKFHRNQQTLIKLDITDYFSNLHESKVFYLFFHTVGYSKSLSTLLTKLCTLNGGLPQGAPTSPYLSNLLTIDMDTAIFQFCSENGGLRYTRYADDISISGAMNPSSVIHAVTKIVSDNGLKINKLKTAVIKHHSRQIVTGVVVNQKLQAPKNYRKSIRLEMYYCQKYGLISHLQKSGKSSTPLDAANYCQSLLGKINYCLQLNAYDTEMKKYREYMLKQFHHYNQSLYSASQALK

SEQ ID NO: 2549 - protein, 303 aa, unidentified
  source 1..303: note = Related to NZ_CP028107.1; note = Fusobacterium necrophorum
MEFTIYDVLKFNPFIIKKILANKDKYYKIFIIKQRNGKTRQITAPVRELKVLQKNILKSLLEKMEYSKFAKAYTKQKSIKDNANFHQKQALVICLDIKNFFDNIRFNSVKDVFQKISIGKAEILAEICTYHGKLPQGGVTSPYLSNLIMEPIDKKISNFCFKYDLNYTRYADDITISTHLLSKNERERFVKLVIENINNILSEYSFTLNEKKIKVQYAYQQQRVTGIIVNNTMQVPKEYRMKIRQEIYYIKKYGLDSHLMRNHQEKQKYINILKGKINYVLFVNPKDEKMKEYLHYIENHLRC

SEQ ID NO: 2550 - protein, 346 aa, unidentified
  source 1..346: note = Alphaproteobacteria bacterium; note = Related to JAFVWM010000017.1
MDLNEYIEQFTKNAIHKLNPEEINVCVRYATNLMNKGLPIIYDLKHLSYQTKYETGFLYLCINFKDKVYRQFSIKKRNGSDRNISEPLPNLKNIQTWIKKNILEKLSVHKVAKAFRKNQSIKNNAYFHKNQDTVLALDIKDFFNNIDGKTVYLLFRRCGYSRRVSNILKELCTFNDCLPQGAPTSPIISNLIFAAIDNRIYNFTRKENLYYTRYADDITISGNDIKIKKVISFISMVLKENNFELNQDKIKIMRKNSCQLVTGIVSNNSVLNAPKYKIKDLRKEIYYIRKYGIDDHMAYVGIKKAHYIEHLMGIANFILFINKNNKIATEALDFLRELQKQRNHPF

SEQ ID NO: 2551 - protein, 346 aa, unidentified
  source 1..346: note = Related to JAFWOM010000088.1; note = Fibrobacter sp.
MNWTDYKKQFELKCDLKKIPQVQVDVWITYARCLWEKSFPIIFDKAHLSKLLGYECSLLDKIIHRPGKFYRSFSISKRNGEFRELNAPYPTLNEIQKWILVNILEKKKVSPYAKAYIKRKKILDNIRFHTNHEVVIKLDVDDFFGSIHKSAIIKIFNSMGYSRQLSFDLASLCCLKKSLPQGAPTSPCLSNIFCEQIDARLSKYLKKLNLCYTRYSDDITISGNISDVQIPQIMSFCKYLLSDYGLNLNEKKTKVLRQHQKQYVTGAVVNKKMSADIKLKKDLRQQMYYIQKYGLNSHMVYKRIDQQNYVYHLMGKIQWVLALEKSNQEFLRYKEHLTEILKNLKF

SEQ ID NO: 2552 - protein, 346 aa, unidentified
  source 1..346: note = Candidatus Saccharibacteria bacterium; note = Related to JAFXYS010000380.1
MNWISYKEKFKETCQKKNISEIQIQKWLGYASVLYQNGLPIIFDKKHLAGLLGFKWELLRNIIHSQTKFYRTFYIPKKSGGRRCLKEPYPSLKEIQNWIKDFILKKCSISRFAKAYAPKRSVYENVRFHKKHAVVMKFDVEDFFGSINKWQVTSLFEKMGYNQDLAEILAGLCCLDNHLPQGAPTSPYLSNIFAKDIDNRLSKYLLKRGLYYTRYSDDITISGNISDKQVPQIISFCKYLLSNYGLRLNNEKTKILRQHQKQYVTGAVVNENVSVESKTKKKLRQQMYYIQKFGLESHMNHLEIKKQNYVYHLMGKICWVLTLEKKNEEFKRYKDVLKELLDAPKN

SEQ ID NO: 2553 - protein, 346 aa, unidentified
  source 1..346: note = Spirochaetaceae bacterium; note = Related to JAGBFB010000015.1
MDWGNYQKRFKISAKKRNLPDSFISECLDYAKKLYDNKVPIIFDTEHLSLLLGCKIQFLYKITNNLNKNYRIYKIPKHNGKMRTITEPYSDLKNIQQWILVNILQKMPVSIYAKAYISNTSLKSNVRFHVKQPVIIKLDVQDFFPSIHQISLVKLFRKYGYELNLSRMLSRLCTYEGVLPQGAPTSPYISNLYCRRIDNRIGKYITNAGFRYTRYSDDITISGNISDKQIGTIIQFCRKCLAEEGLKLNEGKTQILRSHHRQLVTGVILNQKISAGTKKKKDIRKQVYFIKKYGLESHIEHEKIEKQNYIYHLAGLINWVLFLENNNKEFLEYKKFVNEIIKQINS

SEQ ID NO: 2554 - protein, 350 aa, unidentified
  source 1..350: note = Related to NZ_VTYX01000020.1; note = Prevotella copri
MDFFKYISDFTLAATESGYNEEEILSFLQYARTLYDKSLPIIYDQEHLSLLVGFDYYCCLLPISNWQVDFYKKYEIPKKNGGIRIIEEPYPALKEIQTWILKHILEPASLRYVSPVAKAFMPGKNLRENARFHRKQELVVALDLHDFFGSVKAVSIFQLFRKFGYNKSVSMMLSKLCTLRNSLPQGAPTSPMLSNLIFYELDKKLFRYCQARNIRYTRYADDMTFSGDSFSVSHLIAYVKMLVGTRHYKLNEEKTNVMRKGCCQKVTGVVVNDKIQVSKSYRDKIRQEVYYCIKFGVADHMRKISLPGWITTPTIYLHHLLGKVNYVLQINPKDKVFLEYRKCLCDLLLN

SEQ ID NO: 2555 - protein, 345 aa, unidentified
  source 1..345: note = Related to JAGZTO010000032.1; note = Prevotella sp.
MNFKKYRSEFLKRALEHGYQRSEVDSLLVYAKVLFDKNLPIIYDQEHLSLLLGYDYDYLLALCNSQTMFYKQYEIPKKNGAKRLILEPFPNLKDIQTWILKSILEPASVKMVFPQAKAFMPGKNLRDNARFHRNTNVVVALDIHDFFGSVKEKYIYNVFYTMGYKMPIVVMLTKLCTLNGFLPQGAPTSPMLSNMVFSNIDNKIFKYSRKRSIRYTRYADDMTFSGKEIDVENLIRYIRSLIGHKQFLLNEEKTKVMRRGCRQIVTGVVVNKVLQVPKKYRDKVRQEVYYSMKYGFTSHMRSIELPSWISTVEVYKHHLLGKVNYILQINPKDTEFLRYRDWLRA

SEQ ID NO: 2556 - protein, 349 aa, unidentified
  source 1..349: note = Bacteroidales bacterium; note = Related to SUXO01000014.1
MDFKEYKKAYIEQALAFGISTNAIDIAIEYAEHLHNRKLPIIYDQQHFFQLVGYDEAYVMAIVNQPKSFYKEYSIPKRNGDRRIIHEPLPSLKEIQTWILKYILNPGAKIFVSSVAKAYIPKQSVRDNARFHKRQKYVLCLDLKDFFDSISFQQVFSVFRNMGYSKALATLLSNICILNNSLPQGAPTSPMLSNMVFKYYDDKIFDYCKSRNIRYTRYADDLTFSGDFNCKAVVSFIRKVLSKTSFAINDNKTKFVSRGNRQEVTGVVVNEKLQTAAIYRKKIRQEVYYIIKFGVDKHLEAIEWKRPIIEYLHHLLGRINFTLTINKNDSEMRKYYEYIHSVLKEYKEE

SEQ ID NO: 2557 - protein, 327 aa, unidentified
  source 1..327: note = Related to MKRS01000610.1; note = Bacteroidales bacterium 45-6
MELLLNYAQSLNSHNFPIIYDQSHFSKLVGYRYGYILCICNSPDVFYKEWKITKRNGKLRTIHEPLPSLKEIQNWILKEILNTAVNEFVSPVAKAYTPDRNIRDNARFHKNKKIVVCLDIVDFFGTVTYKQVYSIFRQFGYNKSIATLLSNLCILEGSLPQGAPTSPMLSNLIFYHIDTAIFKFCKERKIMYTRYADDLSFSGDFNVGLLISYISNLLSYHGFSINEKKTKVLSRGRSQQITGIVVNEKIQVSRRYRKRIRQEIYHIIKYGLENHLKKIAYPKSSIQYLHHLMGKINFVLLINKSDNEAIRYMEYLKSIYNSYKTLI

SEQ ID NO: 2558 - protein, 343 aa, unidentified
  source 1..343: note = Related to NZ_JAJJWI010000010.1; note = Pontibacter silvestris
MNWVKYQTNFINRASDRGLDEGTINFLLAYAKALYDNELPIIFDKYHLANLVGYKVSYLERATKNTSRFYKTYEVPKKQGGKRIISEPLPSLKHIQKWILVEILNKLKPSKYAKAFIKRRNTKSNAVFHRNKNIVLTIDIKDFFGSIKAPAIIDLFKKLGYTNHLSCLLGDLCTLNGKLPQGASTSPALSNLIFFEVDNKISDYCSSNNIFYSRYADDLTFSGDFNVGKMITFVRECFNEANFTINEEKLRTRRPHQRQEVTGIVVNQKLQAPKDYRRHFRQEVYYIKKYGLQGHLEFIKEKRNNYLLHLIGKGNYIYFLNKNDIYVKESLIFLKELYFKMMR

SEQ ID NO: 2559 - protein, 342 aa, unidentified
  source 1..342: note = Related to JACIGQ010000001.1; note = Rhizobium leguminosarum
MLNFRFSKEYVQLDLFDDFGNEDRGAVVQQYIKCISDNKAKPILDTQHLSKLVGYTEQFLFSVSASPLHFYREYKIAKKNGGVRTLNEPLPTLKAVQKFIAGEILNDVEPHKVAKAFRKNHTLRGNAVIHRRRPFMLKIDIKDFFSNITEHAIYTMFFEIGYTRQVSRLLTGLCTLNNGLPQGAPTSPMLSNLVMREFDHTVFEHCVQNDIFYTRYADDMAFSASDDRVKSLIPFIRSELKKYGLEINQKKTSYSGPGARKYVTGIVVNERLNVLRIDRKNIRQEMYYIRKFGINGHLRKTNNSSPNYVDRLMGRLNFAFFVTKEPHFLEDMRYLKELKKVL

SEQ ID NO: 2560 - protein, 342 aa, unidentified
  source 1..342: note = Related to JACYUZ010000001.1; note = Rhizobium sp.
MLNFRFSEEYIQLDLFHDFGLADRESVVSEYIERISSNRAKPIFDTQHLSHLVGYSEQFLFSVSASPVHFYREYKIAKKSGGLRTLNEPLPTLKAVQKVIVHDIFRDVEPHKAAKAFRKNHTLRGNAVIHRRRPFMLKVDIKDFFSNIDQHAIYTLFYETGYTEQVARLLTGLCTLNGCLPQGAPTSPMLSNLAMRSFDNAVFEHCVQNEIFYTRYADDMTFSAVDERVRNIIPFIRSELKKCRLQINEKKTSFSGTGARKYLTGVVVNERLNILKEDRKNLRQEMYYIRKFGINGHLRKTENHSSNYIDRLAGRLNFAFFITKEAHFQEDMRYLQELKKVL

SEQ ID NO: 2561 - protein, 342 aa, unidentified
  source 1..342: note = Related to NZ_LJIB01000039.1; note = Rhizobium sp.
MLKFQFAQEYVQLDLFSDFGSEDRYEIVQEYIDGIAINNAKPVLDSLHLSKILGLSEYFLHSVSASPENFYREYKVPKKSGGMRIINEPLPTLKLVQKSIVDDLLRNVEPHKAAKAYRKNHTLRGNAVIHRKRPYMLKVDIKDFFPNIDTHSIYQLFFGLGYTAQVARLLTGLCTLNNGLPQGAPTSPLLSNLVMRGFDAAVFGHCIEKEIFYTRYADDMAFSSKAPDLPSLLPFLRQELKKCRLQINDKKTDFAGKGARKFVTGIVVNERLNILKDERRKLRQEMYYIRRFGLNGHLRKTDNDSANYIDRLLGRLNFAYFVTKEAKFQDDMRYIIQLKRVV

SEQ ID NO: 2562 - protein, 345 aa, unidentified
  source 1..345: note = Related to NZ_LSVB01000004.1; note = Brucella anthropi
MSKFKITQSLTHTQLDLFNNSSFLDHEEIVTRYGNNIRSNGAVVIYDTKHLSRIIGYAESLLHAISSSPQHFYRTFEIPKKSGGVRVINEPLPTLKEIQRFIIDYILRGVEPHKSARAFRKNYTLRGAAVIHKSRNYMLKLDIKDFFGSIKSFGVYDIYYNLGYTSQVAGLLSGLCTLDGELPQGAPTSPLISNLFLKDFDEYIFDYCKNNSIFYTRYADDMTFSSNEDTMKHIIGIVRSRLSKHGLKLNQKKTSLSGKGARKFVNGIVVNEKPNILRSERRSLRQTMYYIKNYGIDGHIRVAKIDTPNYLDHLLGKLTFAHFVTKEEVYKNYIDYIRSIKSILK

SEQ ID NO: 2563 - protein, 342 aa, unidentified
  source 1..342: note = Related to JAAXMM010000032.1; note = Agrobacterium sp.
MPDFRFSQEYVQLDLFNDFGSLDRREIVATYVTELTRNKALVLFDVSHFSRLVGFSEGLLHAISAAPFYFYRRFDVPKKSGGLRTICEPFPTLKLIQRFIAEQVIANSEPHKAARAFRQNHSLRGAAVIHKARPYMLTLDIRDFFPTISGFSVYRVFFDLGYTAQIARLLSGLCTLENGLPQGAPTSPALSNLVLRRFDEVIFNECKSRGVFYTRYADDMTFSSREDNLADLIGVVRKELRTDGLKLNSKKTVMAGKGARKYVNGVVVNERPNILREKRRNLRKDLYYIKKYGINGHVRFSNIDIPNYLDHLIGKLTYAHFITKDQKYKEDAAYLYELKKLT

SEQ ID NO: 2564 - protein, 343 aa, unidentified
  source 1..343: note = Related to NZ_VZDO01000003.1; note = Aureimonas leprariae
MSTFAFDKDLQQLDLFDSFKNENREVIVAEYSRIILENGAAVIFDTEHLSRLLGFSQELLFSISAASNKYYREYTVLKRSGGRRVINEPLPTLKMIQRFILAELLDGVRLHKAARGYRKNHTLRGGAIIHRGRPYMLTLDVQDFFPSINQYQVFQALLKLGYTKQISRLITGLCTLHDGLPQGAPTSPLLSNLVLYQADKAIFDHCVVRGLFYTRYADDMTFSSKEDNVVEIIPVVRTQLSNVGLRINPRKTNVSRRGSRKYVNGIVVNVKPNILKTERRSLRQEMFYIKKYGIEGHIRWSKVEAPYYVDKLIGRLTFALFVTKDKRYSQEIRYLSALKKAMQ

SEQ ID NO: 2565 - protein, 343 aa, unidentified
  source 1..343: note = Related to CP015231.1; note = Tritonibacter mobilis
MTPSALNIRFDDGVDENHRELVYLYASRIESKGLTVILSPEHLGHLLQMRLEDIYAISNAPQHFYREYRAKKKSGGTRKISAPLPLLLSIQRWVLKNILEPQAIHPAAKAYLKKSSIKQNARFHRGQRHLFKSDVRDFFGSISSRWVYSHFQSLGYSRAVSMVLTAICCKENALPQGAPTSGYLSNIYMTSFDKAVFSYCTERKFRFTRYADDISISGSGINFSELSAFVNRELRDIDLKMHSGKTRLIRSHQRQKVTGVVVNEKLGPGRDFIRKLRQEYYYISKYGVEEQSRVSGWNNSIAYLNNIHGRIAHAIFLTGHDARLLEMKNAVESLLRKSEYIRG

SEQ ID NO: 2566 - protein, 343 aa, unidentified
  source 1..343: note = Related to NZ_KI421513.1; note = Leisingera caerulea
MNFSDLKIKFDDGVEDGHKDLVHQYISRLESQGLSVILSPEHFGHLLQIRLEHIYAISNSPRHFYREHQAKKKGGGTRKISAPLPLLLFIQRWVLKNILEPQAIHPAAKAYLKKSSIKHNARFHRGQAHLFKSDVKDFFGSISSGWVYNHFLGLGYSRAVSMLLTAICCKENCLPQGAPTSGYLSNIYMTNFDQVVFSHCLKRKFRFTRYADDISISGSEINFKELSTFIDRELRNIDLKMHTGKTRLIRSHQRQKVTGVVVNEKLGPGRDFMRKLRQEYYYISKFGVNEQARVSGWNSSTAYLNNFHGRVTHALFLTGHDEKLSEIKNAVENLLQRSEYILG

SEQ ID NO: 2567 - protein, 339 aa, unidentified
  source 1..339: note = Related to JADCGC010000017.1; note = Roseomonas sp.
MTSSGIKIVFAEAMKPEQSAAVRAYIKHFEEKNLPAILSGEHLSLQLGIKQSTLYAISNSANAFYRTFYVQKKNGGKRQISAPLPLLLATQQWILSKILQSVTVHPAAKAYKKGSSIKENARFHKGQESLFKSDVEDFFGSISQFWVYEFFHSLGYTTAISRLLAGLCCKDGVLPQGAATSGYLSNIYMCVFDDAVFTYCQTNRLRYTRYADDIAISGAGIDFDKTKDIVSTLLENHKLRINLRKTRIQRRNTRQKITGVVVNDRLGPDRQFLRRIRQDLHYIRKFGVHGHARQRGFKSPLFCINNLLGRITHAKFLLGRNTPLEGEKKYLERLLDQIS

SEQ ID NO: 2568 - protein, 339 aa, unidentified
  source 1..339: note = Related to NZ_WWEN01000004.1; note = Thalassobius mangrovi
MSLLSDNFEFGGKIGIAEREAVEKYAQRLIDKGLPVIFSPEHLSHITNIRLEALYAMSNSQESYYRSFDIPKKSGGRRRIDAPLPSLAFLQRWTLDNILNSVPLHASAKAYRKGNSIFDNARFHRKQRVVLKVDVKNFFGSIEEHSAFLIFKGLGYSKRLSKLLSMTASLHGSLPQGAPTSGALANIYMKTFDDAVFNACKESKVRYTRYADDLTFSGSDFDTDAQIRLVDKQLSKIGLSVNARKTRVLLPHVRQDVTGLVVNEKISVPQDYRRRLRQECYFIQKFGIHGHAREVNAANPRVRLEEVIGMLSYVKSIHKNEPYWSDAHSRMLEIRASFF

SEQ ID NO: 2569 - protein, 339 aa, unidentified
  source 1..339: note = Related to JAEPMN010000068.1; note = Shimia sp.
MDFQVERIEFGEKIGLAEREAVNKYAQFLASQSLPVIFSPGHLSYITNMRIESLYAMSNSQESFYRRFEIPKKSGGRRRIDAPLPSLAHIQRWILDNILQGVALHPSAKAYRKGYSTFDNARFHRKQSIVLKVDVKNFFGSIEEHSVFSIFHDLGYSKRLSKLFSMIATLDGVLPQGAPTSGALSNIFMRAFDEKIFADCKRQGIRYTRYADDLTFSGDAIDLREHIRLVDKEFSKVGLTLNSKKTRVLFPHMRQEVTGLVVNDSVSIPQAFRRQLRQECYFIKKFGIHGHAREVNARNPRILLEEVIGKLSYVKAVHAKDPWWAKNHAIMLEVRKNLI

SEQ ID NO: 2570 - protein, 359 aa, unidentified
  source 1..359: note = Related to RZOF01000138.1; note = Mesorhizobium sp.
MQKSELISRNINVIFDGLTEAQIAAVQSYSASLADRDLPTIYSPVHLCQVVGVSPQYLFAVSNDPKRFYRGFSIPKRNGGRRFIQEPLPLLKAVQRWLLANILEKVGVSPFVKSYIKGINLKHNSRFHIGQDFVFKLDLESFFDRILTKDVVEVFYKAGYTRDVSIFLAKICVSNGRLCQGSPTSGAISNIVLLEFDLTLFEFCRSRGFRYTRYSDDITISGKMDAGTNFHEILLFISELASANGHKINKGKSQVLYRHNRQKVTGIVVNEKLTVPRPVRRRFRQELFYFERYGPRGHAERIGEGLDQCVARLIGQASHLLFVRPDDEFVRVKKDLLLRVLRQMDADPQFGFDLGGRPL

SEQ ID NO: 2571 - protein, 354 aa, unidentified
  source 1..354: note = Related to SIPE01000001.1; note = Rhizobium leguminosarum
MLITREIDLVLDENLGVAAKENISAYCGKLSERGLPAILSADHFSLMIGVDGRYIYGVSNNADRYYRVFQLPKRREGFRTICEPLPILKMIQRWILDNILSKIPPAKCVNSYIVGRSIKSNARLHLGQESLIKLDVKDFFGSISSHHVYKLFFDLGYTKAVSVFLSRLCTYKGFLPQGSPTSGSISNLVLRGVDEALLTFCTERKIRYTRYADDMCFSGTNIAAPDLIEFVRKNLGELGLKLNNDKMRILKQSHRQIVTGIVVNKRLAVPRLRRQRLRQEIYYLKKFGFVSHAMNTDDSDPVALLRRLIGECAFLMHIHSKDVVDIRDIEFLKALLREELARQRHWTNGDEDLF

SEQ ID NO: 2572 - protein, 342 aa, unidentified
  source 1..342: note = Related to JAJBAV010000004.1; note = Candidatus Cloacimonetes bacterium
MNWSEYEAAIRRACREIHGIPPDRTRLLLERARRLYDQELPVILDQKNLAWFLGFDISLVMCIANRPHKYYRCFRIPKRNGGFRELHEPLPTLKEMQRVILDLILARLPVDPAAKAYQPGSSVKDNANFHTRQPLLLKLDVSDFFGSLREYQVYQVFHGVGYHPQVATLLAKLTCLNGSLPQGAPTSPTLSNLIFREADQRIFHFCRQANIRYTRYADDLTFSGDFKPGLVIRRVASVIETLGLRLNPEKNRVIRRHRRQEVTGVMVNNGLRAARSRRMHLRQQLYYLSRFGLADQAAKHGTKTHLWINHLLGLAGYIRFLDPSDREAARAIAMLKTLRGST

SEQ ID NO: 2573 - protein, 351 aa, unidentified
  source 1..351: note = Related to NZ_CP090423.1; note = Stenotrophomonas maltophilia
MTAHSLQSLPDFNEYSARFTEALISRDGEDYDPSYLSRCLSYAKGLLERRLPVIFDREHLCALTGYSSRFIESAVGSPHLFYRNFEIPKKSGGFREISEPLPSLKDVQRWIYQNLLLRIPVSVAAKAFVPGKKLRDGVRFHVGQKFVIRVDIADFFPSITRGRVFGLFRSLGYSSEVSGDLASLCCVCDCLPQGGVCSPYLSNIIMRSADRRLLAYARENSLRYTRYADDFTVSGQKFSKSIIEEVMSVIKSEGFTVNQKKTRVSRSGGRQVVLGHVVNGKVNAPREYRRELRKVAYYVDRFGLDNHLAYLNERRSSASDYYLGKASFVLSANHRDRDALDLKRILLDEVE

SEQ ID NO: 2574 - protein, 313 aa, unidentified
  source 1..313: note = Related to NZ_KL638873.1; note = Xanthomonas arboricola
MKYSKKLLDKGLPVIFNREHLCALTGYTPHFVESAVGSPHLFYRHFNVPKKAGGVRLISEPLPSLKDVQRWIYENILLRVQVSVAAKAYVPGRKLRDGARFHVGQKFVVRVDISDFFPSITRKRVFGLFRAMGYSPSVSADLSNLCCSEECLPQGGVCSAYLSNIILRSADARLLKYARARGLRYTRYADDFTISGEAFSPSILNDIQWVIRSEGFEINPKKTAVMRAGGRQMVVGHVVNSRVNAPREYRRGLRQAAHYIEKFGLDNHLARLGETRGSAREYYLGKVSFALSANRSDRDALKLSEVLSVGGSE

SEQ ID NO: 2575 - protein, 354 aa, unidentified
  source 1..354: note = Related to NZ_JVIE01000007.1; note = Stenotrophomonas maltophilia
MNAHSLHALPSFEEYKKLFVERYVMRYGNGSDDGFLERCLEYSKNLLSNGLPVIFSRQHLCALLGYEEGYIDAVANSPHLYYREFEIPKRSGEKRLISEPLPSLKEVQRWIYKEILLRVPVSSAAKAFVPRRKVRDAARFHARQKHVLKIDIADFFPSITRDRVFGIFRLIGYSSEVSSTLARLCCVNESLPQGGVCSAYLSNVVLRSLDGDILKYCRGRSLRYTRYADDFIFSGDSIDYGFVKFISSLIVSHGFNVNPKKTTVMGRACRQVVVGHVVNDRVNAPREYRRRLRQIAYFIAKHGMDSHLSHISENRSGAREHYLGRASFVISANPRDRDALFLRNVLTCRMVDIE

SEQ ID NO: 2576 - protein, 352 aa, unidentified
  source 1..352: note = Related to NZ_CP029551.1; note = Methylobacterium sp.
MISSIRHVKQSSNYETEWRRYAAAFLSAAKAKKLSQDDIDACLQYAKPLTLGGFPVIYDTDHFCGLVGYTPHYVLGAIKSTDRYYRQFSIKKKSGGDRTILEPLPSLKEIQHWILRNVLERVAIHRAAKAFQKGTSIRDNARFHRGQACVLTIDIKDFFPSIGINRVFSVYHRIGYSKQISSLLADLSCFELSLPQGAPTSPYISNLICRSLDERFFAYARSAKLRYTRYADDLTFSGADIGSSFVSNAYEIIREYGFEPNLSKTRLLRQHQKQMVTGVVVNSKLQADRALRRQIRQYAYYIERFGLEGHAAATSVQRRNFERHLMGLAQFVCSLNPYDRDARNLIELLKID

SEQ ID NO: 2577 - protein, 344 aa, unidentified
  source 1..344: note = Related to NZ_CP039546.1; note = Methylorubrum populi
MNADEKETEWRIYSASFFEEALDVGLTANEIEICLAYAQPIFERGLPVIYDNDHLSNLVGYKIKYIQRAAKAPVNFYRNFTISKRSGKPRTISEPLPSLKEIQLWVLRNLLDKMPVHPAAKAFVAGRSIKNNARFHRGQRRVLTVDVKDFFPSISSDRVKAIFVKAGYNSRISSLLANLCCLNGKIPQGSPTSPAISNIVCLDMDEEFFQYARSRKLRYTRYADDMTFSGDVIRHSDIKHIYRIMRSYHFEPNLEKTRLMRPHQRQQITGIIVNNHMQVSREYRRELRQNAYFIGKFGIEEHAVVNEITHIRFRDHLLGRANHALHVNSSDRDAIRLKEALKRF

SEQ ID NO: 2578 - protein, 344 aa, unidentified
  source 1..344: note = Related to JAGQPV010000303.1; note = Planctomycetaceae bacterium
MQDASTAPSFEEYSAIFRSTAGADALQPEYVERCLQYARKHLQDGRAVVYSANHLSSLVGYDISYLYGVANSGGNYYRTFSVPKKSGGKRRISEPLPSLKEIQRWILTYILSPVQVHTHVKSFRMGYGLRANARFHRAQKIVLRLDVLDFFGSIRVKRVADFFLKLGYAKPVATLLAGVCTLNGKLPQGAPTSPALSNLVPWPVDVRLSTFARNEGIRYTRYADDMTFSGEFKPGKVISMASRVLRENGFQLNVKKTNVMGEHQRQLVTGVVVNEKLQVPRGVRRGLRKEVYYIEKFGLTEHVRRMGVSDPKYVSRLRGMAAHILAVNPNDEEAKNALRFLGSL

SEQ ID NO: 2579 - protein, 354 aa, unidentified
  source 1..354: note = Related to NRRE01000008.1; note = Rhodovibrio salinarum
MRTHRDLASSWAAYEAAFIIEARRRGYSDDDVRTCLSYAKKLHLSNLPVIYDQAHFSDRVGYDISYIRRASNDPEHFYRTFNVPKKSGGVRQINEPLPSLKEIQRWILDNILGAMSVNPCAKAFVVGRDVRDNARFHRNQRIVINVDVKDFFPSITHRQIRMIFLKAGYSPEVGELLTQLCCLDGVLPQGAPTSPYISNLVCRPLDERLFGYAKKNGLRYTRYSDDISVSGDMEPAEVLQFVKKVCREHGFKIHPDKIRVLGPGRQKRVTGIVVNKHLQVPRKKRRVLRQSVYYIKKFGLDEHLSKTKNNRRNFLDHLMGQVNYVLFVNPKDREAQDWLRQLREIKNGAIDYRD

SEQ ID NO: 2580 - protein, 354 aa, unidentified
  source 1..354: note = Related to NZ_JACDIT010000005.1; note = Chthonobacter albigriseus
MNSLYTPEYFVKVAEHCSNAGFAADAIEDVLVYAIQIANQGLPIIYDDQHFSQLVGYDLQYIYGVTNDQSKFYKSFTKKMRSGKKREIDQPYPSLMEIQYWILHNILEKIECSPYAKAYIKGRTLKDNARYHVGKNFIVKVDIKNFFPSIKTGSVYKLFYDCGYTKQLATLFSRVLTLNGHLPQGAPTSPAISNLVCRSLDEVLSTIAHDRKLSYTRYADDIAFSANEYPKFLIREIRSCMRDHGFELNETKTRVMRQSGRQQITGIVVNKKMNVSKERRRRIRQELYYIEKYGIEDHIRYINETRKNTIAHLAGSLSYAIWIQPRSAELKKYSKMLATLHKDLEGEDDIQTEQ

SEQ ID NO: 2581 - protein, 347 aa, unidentified
  source 1..347: note = Related to NZ_AP022332.1; note = Methylosinus sp.
MTTLDLPYVTDRYKEIALQCGLSSKDILSIERYAQKLEANGLPVIFDEKHFSALVGYDISLLYAISNDQRKFYRSFNIPKRNGKLRQIDEPLPTLKEIQRYILDNILSNVEISKASKAFSRHSDIKKNARIHIRQPEILKVDIKDFFPSVNISSVYKALYALGYTDSLAMLFAQICCLDKSLPQGAPTSPALANIVCRDLDHDLLKYCTDRNLRYTRYADDITISGERIKKETITEVRFMIKSFKFKLNEEKTSIMRSGSRKVVTGIIVNTRMQAPRETRREFRKNVFFIRKFGVDGHISQIEEDRNNYLRHIIGVGEFILWVDNKNKEVVSDLNFLKRLLKSESVV

SEQ ID NO: 2582 - protein, 373 aa, unidentified
  source 1..373: note = Related to JALLPZ010000001.1; note = Thalassospira xiamenensis
MKRKYRHDWTAYAARFKRAAKSINKDDEYIANCLSYAKKLYEKNLPVVYSQEHFSFLCGYEYNYILSACNSEKYFYRKIVIKKKNGGNRILNEPLPSLKDIQRWVVENILEKVEVHPAAKAYVPKKSIKDNARFHVNQNVVISVDIKDFFPSIHISRVYNIFSSLGYSAAVSKMLAEICCYKNCLPQGAPTSPYLSNIVMHDLDDDLFAYARRNGLRYTRYADDITFSGDIKPSKLIATLYQLITEYGFKLNKQKISVMRRGARQIVTGIVVNQKMQFQRVRRKKLRQDVYYINKYGLNSHCIREGINKRNYLSHLIGVANSILFINPNDKDAQDAYQIIIDLLKDESKLDGQGRLDLRVSVEDSRTESPKTH

SEQ ID NO: 2583 - protein, 332 aa, unidentified
  source 1..332: note = Lentisphaerae bacterium; note = Related to SUWI01000086.1
MISGITVERIAEETGLNRRFLLLLSNNIPDYYRIYRIPKKNGNFRTIEAPASVLKRIQQYILWTILPRQIPCTPEKLAETAEILKGNGISFHRSNLARMLSAATAFEPRSSIKKNAQEHCGKPVVVSLDVKNFFPSLKYDLVRSLFQRIVHEDGVAVMLSKFCTLNGHLPQGAITSPHLSNLLLHDFDIKLRQYCLAHKLAFTRYADDLTFSGDPGNEEITGLIRYVKQELGKLGLRLNHEKIRIQRQGMRQEVTGVVVNAKTSAPREVRRRLRQQMYYLNKHWEREWRKLDEHSLNVLLGQANFIWDMDRDNPEFTEYRRQLLEIKHFFHN

SEQ ID NO: 2584 - protein, 317 aa, unidentified
  source 1..317: note = Related to JAFSTP010000085.1; note = Lentisphaeria bacterium
MNSKFLYLLGNHIPDHYRIYRIPKKNGNFRTIEAPAPILKLIQRYILVRVLPVRLPWGESRLRETEARLRENGIRFRPGEIPRMLSAARAFERGCSIGRNAAAHCGKPIVVSLDVKNFFPSLKYGPVRAIFQELAEDDASAVMLAKFCTLNGHLPQGAVTSPHLSNLLMRDFDAALAEYSLLHGLAYTRYADDLTFSGDPSNEEITELIRRCRSELATLGLRLNRDKIRIQRKGMRQEVTGVVVNAKVSAPRKIRRELRQRMYYLNKHWETEWRKLDEHSLNVLLGKANFIWDLNRNDPEVAEYRRQLLEIRRFFHN

SEQ ID NO: 2585 - protein, 453 aa, unidentified
  source 1..453: note = Lentisphaeria bacterium; note = Related to DNXH01000048.1
MNGDGESLSLTGSCRKGMSGKQMFTRIPCAPLARTSTPIICVISPWNFLGGHTLRCAQVRSAAVNSKSLCRKASEYLFRALFAKFVFSDKTAVSGFLRVFMKQNTFTIQKMAEDLGINVKFLYLLSNRTQEFYKIYRIPKKNGKFRTIEAPCAILKRIQEYILRFVLPDKISLGGTRCTKALQSLRRQDPEADVTRNEITGLMSAATAFEPGTSIKGNAENHCGRPVVIALDVKDFFPSLKYSRVLALFRRYTETENAAVMLAKLCTLYGHLPQGAVTSPHISNLLLHDLDFTLKLYALDHNLEFTRYADDLTFSGNPDNGEISGLIQICRQELRKSGLRLNNDKIRIMRKGMRQEVTGIVVNSKMNAPREDRRHLRQQMYYLNKHWEHEWRKLDEHSLNVLLGKANFIWDLNRENPEIAEYRRQLLEIKRSFQREAKKAICSAPQDSAEQAN

SEQ ID NO: 2586 - protein, 317 aa, unidentified
  source 1..317: note = Related to JAFXSU010000015.1; note = Victivallales bacterium
MKMATFLLTMYCKIPKTLSELTQCLGSTTEFLYWLSNHIQEQYTIFQIPKKNGKTRTIEAPSQLLKKIQRRILSKILFQRAERSAMAFEKRRNIRKNASAHLGAAVVLCMDVKDFFPSLKFSQVTDYLESLGMQRNVSVLVAKICTLQGHLPQGAVTSPHLSNLLLAPLDKAIRNFCKVKKYHFTRYADDLTISGKMNDEDIREAIAVCKKNFMTIGLKLNPDKTHVMRNGNRKMVTGITVNQKLSAPKSLRKRLRQRMYYLNHFWEKDWHRLTEEELNNLLGLVNFVWSIDRENQEFSQYRTQLLEIKRFWNSVPR

SEQ ID NO: 2587 - protein, 314 aa, unidentified
  source 1..314: note = Related to JAFTIQ010000013.1; note = Lentisphaeria bacterium
MINGKLSEKLTSVNMLARKLGLTVKQLFFIVYNLEKFYTVYQIPKKNGKFRTIEAPDPLLKKIQGRILQKLVSRHTSKTATAFEKKRNIIQNAQIHLNQPVIVGLDVKDFFPSLKFELVWKYFRDQNIAREPARLIATLCTFKGHLPQGAVTSPFLANRLLHDFDEVMSQHCRQVKVNYSRYADDITLSGNISDALKEKLISFAREGLYLYGLQLNNEKIRILRRNNRQEVTGIVVNEKLQAPRELRRILRQKIYYLNRFWENDWQKLTENDLDKLLGQVNFVWSIDKTNSEFTEYRKQLLEIKHYFTLSTKEK

SEQ ID NO: 2588 - protein, 328 aa, unidentified
  source 1..328: note = Kiritimatiellae bacterium; note = Related to JAFRDO010000027.1
MGGPLLSCAFSLFFVGGSVMVRFPDGSLSIATVEAIADVLQVSPKFLYYLSNNVGKHYRITKIPKKNGKFRTIEAPDSYLKHIQRMILDNLLPQSVGEIATAFEPGVGLMDNVVQHVGNPVVLALDLKDFFPSLRLHRIVRVLRELDFPRASAVLLAKLCTLNGHLPQGAPTSPHLANLAMRTFDDRLSLLCRQENLAVTRYADDITISGNIDRHCAESLIASCRVMLKEIGLRINYRKLRILRQNARQEVTGVVVNEKPSVPRHIRRELRKKMYYLRRHGVVGYEPVTLEALRSLLGSVMFVNYVDPDNFEFRQYAEELKVRIKECA

SEQ ID NO: 2589 - protein, 306 aa, unidentified
  source 1..306: note = Related to JAFTIA010000086.1; note = Lentisphaeria bacterium
METLPIIRTVDELAELLCTDARLLYAISNETPAWYKCFQIPKNNGSMRNIEAPRPYLKTIQRRIQKKILSCFTVHDCATAFLPGKNIRRNALFHVNKSVVLNCDIKNFFPSLKSRAVFEFFRRRTGYEPDVCMMLSRLCTLYGHLPQGAPSSPMLSNLLMFEIDETICQWCAKHYLSYSRYADDMTFSGEIDVRVQADILQMVKRNLTLLHLKLNIAKTKVYRSNRRQLVTGLVVNEYVGVPREKIREFRTWLYYTELDIINENFYYDSDEIESRLGLLNFYYSINCNENLLRWRDRLLEIRRMYS

SEQ ID NO: 2590 - protein, 330 aa, unidentified
  source 1..330: note = Related to JAGZDB010000161.1; note = unidentified bacterium
MFEKVHWEYSEFLPVLPTVRDLAGCLDADPRLLYRISNHSAEFYTIHTIPKRNGGCRTIEAPHPILKRIQQRILRKILMQVSTHPAATAFEPGRSIRDNAIRHVGRPVVISLDIRNFFPSLKAGVVYAFFRKLGYDVPVAVLLTRLCTLYGHLSQGAPTSPRLSNLLLLPVDCGLAAWIGTKPVVYTRYADDLTLSGALEREDVSEAIGVCRAALARMGLRLNSRKTKVRRRGSRQTVTGLVVNESVRVPRETKRALRQFMYYLDCFGWESCREHFGPGDEMLLDRVIGFVNFMWDMDKTDLVLREWLDRLLLLKLHPEQVPPPAYRAFQ

SEQ ID NO: 2591 - protein, 321 aa, unidentified
  source 1..321: note = Related to NZ_QEKH01000020.1; note = Victivallis vadensis
MDAEETASGLPELPDVEALSELLQIAPKWLYRISNHTPRFYRVYAIPKRNGKFRIIEAPRPLLKRLQRRILTSLLNPVEASPYATAFERGRSIADNARFHLNQPVVLKLDIRNFFPSLKSPPVYRLFFELGHPPPVAALLTRLCCLCGHLPQGAPTSPRLANLLLRPADYRIAAWIGRRPIQFTRYADDITLSGDFGPEHIAEAIQVCRHELGRLGLRLNRGKIRIERRCRRQTVTGLTVNETLHAPRQMIRKLRQEMFYIRKYGWEDRPESELHRLIGIANFIRDVDPGDAACTAHLEKLHAILWNRRQKQLSEQFRRGL

SEQ ID NO: 2592 - protein, 1424 aa, unidentified
  source 1..1424: note = Related to RGCV01000062.1; note = Flavobacteriia bacterium
MKERISPEVLERQVLDASVFEDLFAFLYLLDIESPLDERYYLQHVIPRSDGTKRVLYEPKPVLKALQQKLLQVLYDVLEKPQPYTEYYRFQQKYLLSPCATAYRPKMSVIQNANFHQGNEVVLKVDIHDFFGSIPAAKMKSTWVELLYFCSNRLIQSGLLVHRMKREFVAQVINTLADKIIYITSLNGALPQGSPTSGAIANLYMVQLDRKILHYSVRNRLNYSRYSDDMTFSGEAEDLKTGKILHFLNGLLGRNGLRLKRSKTQVLRKHKRQTVTGIVVNASKNAGRTYQRSVRQSMHYFKKFGKEHALRTHRTLDAFLREITGQVAWILQVQKSNTEFLRYKAELNIISRFHRQGKPVAEAMDYLRNLAQQAEQWKANETVVIGGLEWKKESEVYEGEDMDGIYTFQRRGQKRSFFTRKALEKYVNNHPEWRLPTLHEYERYFDETRYHDRIQLGLTLPSDPRYNGIVNGTEFLHFNRVGAYWTCDLRPRMTLRMAKNRLGRKVLCVAAKNWPFQHHLAKIRCDLSYVRHDHVMDLRVPVNVPGTMEYSSSSDDTQVLLPEEAFSVKLVREIRPNEPMTNFQGMDFALRKLSNSRFSTNFKGLQLTEIPKEVLASWQSSSMLFANNQIEHFDLRNVPPVKLLNLENNRLKGFDFSALHPGLRHLLLKGNPGLKGVEIPWIQLMRQLHELSLDDLPDLVGTMPLESIYLQALGGEVWTILENEQELDALIGQQKPVSHLLVRYRVGIDTLDSRTLFEKLNRIAPKHLYVCFEPQDEGLRRRLDRLKYMTASWEKEIEELDGYIKNLSLRKDIETRVTLFPQHLDNNRIKHLMIDFSWLPNLCFEGDFRIKPDSYHLLHPGIPTLLLPAISQRFHRPTVLMKIIGNKIVPTQHEFPEAVSLDVCYPLAKKHRKIRLSNLHTLVPMHQEHVGDLVLVLSEDAGKQLEQGRIEEVYPRAYELRSGSQFWHDVMAHSKSEKTTFRQRISSIPLLGLSMQFDVYSLSLPIESVPKINRFGVLNLTEVGENNTMTYNDTDLKQFLERSSPSTEFAYLSIFAHKTPAILQLVRDSKRKRNADLPYVIRKNIYATEPLERSQTIDALRAGELLAISLSKPNRRDREIMLAAVEANPFAMAFAHKALKQDAGFILAAMNISLRTLVFLSKDLFKSRNHPNSALQQVLKALMERYNPEDFNFIVGRLSRHINIEKEPVYRFVLEPKPLDSSAVLMSFEQEKKILNNRFCQRSGMYKPIRNYFFKEAERRGFINVNGYFNDIFKALSQNTSVRFLDLSFAGGRTLYALDRLGDIPGLRKLKLTECKFINSLPGLKTLEVLNINRTSNFWSYHDGKTMHQSLPNLKRLEAKYIHISMQEIEDLMVHHPCLEYLAISVTYDDELAEINAIIEKVSAQGKVIEIVLDKSEYIGELPF

SEQ ID NO: 2593 - protein, 1417 aa, unidentified
  source 1..1417: note = Bacteroidetes bacterium; note = Related to VGML01000001.1
MIDQNNQIVQISVNDFLKTDFNVTRLKFNALKLLHELELSEELSEECYIKHVIPKHDGTKRILYEPKPLLKEIQKQLLNLLYTLKKHRDYPVLSRNIKYKYLPTRSSTAYLKGSSVVKNANFHIGKDVVVKLDISNFFNSIPKNKIELFWFDILNLKVKYLIHLGIIEKDETEDKKQLIISGLAKKVLSSTTLNGFLPQGSPTSGYIANSYLVSFDKKMLEFCVNKSLCYSRYSDDITVSGSNSELVSKQVIKFVQHQLYKKSLKLKKSKTKVLKRHKRQTVTGIVVNEKRSAGRAFKRGLRMQMYYLKKFGLDHVSRTHSNINSFLLELAGKVNWVLQVNKVDPEFKRYKGELSIIKRFLALGKTVGDATNYISELENKDFKIKNNSVFIAGLFWRISDDDTQTDYPSIDRKNKSVQLFTEESIELALKNNPGWRLPTMDEFNNFIKETNFEDRRVLGIRYPFDPHFNGLADENGYRYYNRVGLYWTSDLAHLSKERSTKGRIARKAICFLSFDQRIKKKINHNTACYISSKTFSLSVNKKQKFELTNNRSIDYYLNPPLNEDFQAIVGACSIRLVMSEEMTKKPMISKTLWDSIQLSKFSVDLSNLNFEEFSFSLKNVNASSILLYNNNLKHVNLTEIAPVKRIDLRNNKLESIKLNNLPKGVKHIRLEENKDLKLLDIPWKRLLQSSHELTADQLIFERQKSLGEIYLSALGGESWRTVSSDHELNELIDSKNAVEFLKVRFEIGTNKIDSKELFNRLSKLEAIHLFIEFETNHEQINQLIHRLKMSFGSITPLNEHLNSLERDNNHQENIFLKQYVFNASDLKNIHLKSLIIDFSWIPNIKFIGDFHVKPDLYHLLHPGTSFTSLPATSVEFHRPNILVKVLGEKRIGNEQTYLHVTYPFDSIEERHQNIQTIIPKNQIFIDELILVLSNENEKELKKGQIEEHFPKLYAINRYNSKPHASKLTTNLIYSKRVSGFPLLGFALQFDVHKLSVPLESFYKKDKLLFNPERFKREKGPIMDWTEVNFNQKIHSEKKTRLGKENLLSDLDIFSHKKESKPPTIPPSDDRPLNRPYIIKHGVFAKHKLYSASDNSRNKVMTMLASGEIAAKHLPSKLKNDEEVMLIAIKRNPYSMVFASKRLKENPAFLLKACKISARTLVFLPKKLATKQVKSDSIFNQLIDYLLSFLTPAEFHFVIHKLGTHISQSDGEYRYFTCEETALEKSHVISSFESEVFYQESTTRAGMPNIIRKTFLSEATKQGIFNSNGYYNSLELAKQNKENCRYLDLSFSGYHHDLTALESFKNLKTLNLSYTSVNCKLPNIPSLENLFVDNTRNFFSYNTPTLLNPIFPNLKIIYARETGYLSLKEITSLLNLLTKIEIIDLRPYFYINEKEILALQQQLIQQGRTLEIPIKTPK

SEQ ID NO: 2594 - protein, 1231 aa, unidentified
  source 1..1231: note = Related to JAJTDX010000087.1; note = Cryomorphaceae bacterium
MNNSELTHRSFTADFLKSDKIEYTFNALRLIHDLTLPEHFDESYYNKHVIPKSDGSSRVLFEPKPVLKEIQHQLLEFFNSILEQVPRGYRQKDRIRKKYLPSSCATAYRKGKNVVTNANFHIGNEALLKADIENFFDSIDVSEMSSMFMDFLYIKSGYLSLIGILDENWSDIEKAKVRLSLAKKIVTVSSLNGGLPQGSPTSGILANFYLAKFDRKFLNYCIRHKLNYSRYSDDLTVSGNQKDLAPGALLHQMNKLLKPLKLRLKKSKTKILRRNKRQVVTGIVLNEKRSAGRLLKRSLRQEIYYLKKFGESHVSKHSSSTKKYLRELSGKVSWVLQVQSADNEFRRYSGELQIISRMVRSGKTLADAASYIQFLENKAKELKGPEPLMVCGLEWRKNDLFYARDLYNLFEREMYAGRVGGNKEEPGLVFTRRGVEKKLYTEEMMLRVVSRLIKWRLPTSEDFADYIRETFYEDRALLGLRVPSDPQYNGIAENHGLCFYNKMGAYWTADMVHVKDPKSSVRAKVGRGVFYVKSRHWSTKNRLDLFGGEWMSKTTGIKPVNAVYYFLDQRFHKNLATNVPIKDRPWVESTQLACSIRLVRTQSIEWEAHHISDKFWQSVSSTRFSSDLSGKHISSVPTTYLKNWNSSSLLLARNKLDQFDLTACPPVKRIDLSGNKLKHFDFSSLPKGLRHLLIDDMDALEGAKLPWDKLFSSLHELTIKNPHDEPQLTDISELYALGFGYSDCVEVTSDEELQALIQNGEKIKFLKVKVLLGSGAISNEGLFGLINQIAPLTVLITFLCLDQGLQQTLDRLKMASGNIQPYMEELEAYLQTVYSTSLEEYNWLHKPLVLNPDQLNSNRIRHLILDLSWFPNIVFNGDFGIKPDLYHILHPGVDSLQLPSTSTEFHRPGILMKILADSYQPVPQEYPFIVTYQPLNRWNKRVAKKHMLTLLPANQNHVSEIVIVVAGKSAKEFQIGRINVNFPRAAHVMFEKEFLFYFTREKYSFTVSRKTFEFPLLGYSRRFDVHKLNFPPESIFRNGRWSSLISDVLEQDSEHESAVHWLDFYSQNMGYFEGGEPNNNVPHKSFNNNFEFAIFPAFKDPDFSRLNSRNLEKFGFPYSVKDGVRFSGVDYRSLSREELLTGLNSGELNPKYLPSKYKKDAELMLAAIRFNSFAFLYAHKGLKGDSDFVIKAMQISLRVLVFLTKDTFKNRLHPNGLLQQIFSILSAKFSP

SEQ ID NO: 2595 - protein, 1452 aa, unidentified
  source 1..1452: note = Related to JAJTDQ010000005.1; note = Cryomorphaceae bacterium
MRVRRVSQVSLVNYQDLGKEVLSFDNIPNLPTFNALCLVHQLEIDGPLTEEFYTKHTIKKQNGKLRILHEPKPVLKEVQGQLLQFIYTNENKEWKNRRYPRKVNKFILRDCAVAYRPGISVVRNANFHVANELVMKLDIKDFFGSVKTDKLLPFWLNLLSTKSHYLYQLGILARELSQEEKLVELTKLSKKLVNVISLNGFLPQGSPTSGILANHYLVRFDKFFLDYCIRNGLNYSRYSDDITVSGSKDKLKPQAVLGTINRLIKLEQLQLNRTKTRVLRKHQRQIVTGVVVNEKKSVPKTLKRGLRQQMYYLKKFGEEHIEKLKTTRPKYLQKIKGEISWVLSVEKANAEFHRYFGELSIIIRFCEANKKITEAVDYIESVEALAAKLNTQEFTIIGDVEWKKEDELAVEQSGTATEGLVQLSKWGKNRTLYTEASMIEIVSKLNDGWRLPSTDEFELYLKETLYEDRQRLGLRIPMDPQYNGFFNSITHARAFNKVAAYWTSSMTHLPHMSQSNTRLGRNVFLFLPKKGGYKASLNRRFKKCSRTSGYIPVNDFLSLSGTVSDGDGHFYPRLFSLYRKTQTYSSAFSLRLVRSLNIEAKLKTIDLSVHFWNSVSTAKHSTDLGNLGIASVPSNVLINWQSSSILLANNKLTSIDLEQLAPVNRIDLSNNELENFDVNLLPSSVKHLILHQNTKLVDMVVPIKKLIPRLHEFTLDAPELPTLDFSELYENALELMFYRCDSDEELDQLIQQQITVVALQVTVQIGSNKIESTRLFERLNQVKGLETLSILFEPFHEDLRNRLTILKNAEVFHLSSLLELNEFVGLDQSQSELFVDPIDAELLSKKHVFYPEHLQSNCIHSLIIDFSWLPNLVFNGNFNVKPEKYHLLHPGIQVTDLPATSESYHRPNLLLKIIGVRGACPSDYFSNGQFQNLTIFYPLNSLLFEQETNVLFDILPTKQFHVENFVLVCANNEKRSVRRGNVLSLFPGSKAFKGVAQSQGRSYNKIVGLGKSKTFFNFPLVGYSLKYDVYKLSVPFRTMFRVVSEYRNSLVLNEETGLLKRMSEGRTEFSVFHSSTKYDLSQMNQLNRISIFPMLYDDAAKRLQVLPSILRKKYVIKRKQHANDPMIGSLNREDLLANLKQGAIDPFKLSRRMFKDEEIMLAAIYGNPFSFILAHPSLKLNSSFVLAALERSLRILVFLNQTIREEKRRKNAVLPAVANYLTEKYAAQDLYYILNQIYRRVSYDTKGMYTFVHEGNEHSKLSDLQSIEQELFTFFLGNRAGMSVKYYDYFVKYAIEKKYFNANGFYMSLNISDEAALDCVCLDLSYLKLSQPLTLPSMPNLKTLKLSFTRFFNIANVPLFPSCEELYFDGLNASNLGDINIFCSKFPKLKKLYARCSNFLMPEHFKTIIEHCLELNFIDVSHFNEFDSMGKELRELCKKLDRTIEIREDIKK

SEQ ID NO: 2596 - protein, 319 aa, unidentified
  source 1..319: note = Spirochaetia bacterium; note = Related to DNNR01000174.1
MIRLISPVPQINSLLDLTVVLKTQVPIINEILRNVKNEYNCFSIYKRNGKKRNIFAPNPLLKDIQKNILTKILDKCRISRYAYGFKKNYSIIDNARMHIGSKKLVKMDIKDFFPSIRHNRILRIFMEIGYSRNISLYLTKLCCLDNKLPQGAPTSPALSNIFFKDIDNEIIGFSICRNIIYTRYADDLAFSGNIHPHSIFDKISXLQRYKLKVNQKKCVLRRPYQQQKVTGIIVNEKLNTQKKYRKKIRQEMYYIKKFGLRAHCQNINNKILRKKYLMGLYGRINFVLRVNPNLQEFSEYKQYLLSLYDLNHYDLLRVG

SEQ ID NO: 2597 - protein, 408 aa, unidentified
  source 1..408: note = Related to QTRC01000029.1; note = Burkholderia cepacia
MGTYCSPTTRAQVRAQLVATLWPADKFFIRENLDQNIKASFNVVGKAAPKMTANSEELLRLVGATYKSQKKISQYKNYINTLTNRGLPVIFSFRHLADVLGVAPATLHTMSFRTDLYYKRFDIPKRSGGIRKISAPHETLAAIQRWILENIISRAYQIISPSVVGYVKNKSIKDHVTVHAQSKQLVKFDLKDFFPSISVENVKHIFSEIGYSHSVSRTLAALVTLEGGLPQGASTSPAISNVFMQSFDNAMTTFCDEKCFLYTRYADDIVVSGESGVTESLFDLKAKFSEFGLTLNHGKTRVYADLQRVKFVTGLILCDGNVRLPKSMRRRIRVQCHLFLTQLERMTGLGPTEDNVSVPSSWRSRERVFDPTFPERVLGKLNYWLFIEPDNAYANRMKASILERLEAL

SEQ ID NO: 2598 - protein, 358 aa, unidentified
  source 1..358: note = Related to NZ_UGHR01000001.1; note = Iodobacter fluviatilis
MLSNADLLELVKAKYKTEKKINLYAEYISKLEERSVPVIFSFYHFSDILGISPKTLRAMSFDTHLFYKSFEIPKRSGGIRNIYAPYPSLESVQRWILTNILEKAFCDFLPMVVGYQKNKSIKDHVSPHASSECILKFDLKNFFPSILFDHVYLIFKNIGYCHSVSKILSSLVTFNGSLPQGASTSPCLSNIYMKIFDAELTLYCEQKGFFCTRYADDIAVSGGVELINCLKSIKKLFNDNGLSLNHAKTKVYDRAKEVRFLTGLVVNKGVVRIPKEMRRRIRAQCHLFIKEIDCLVSNLPRPEYKLPSESWKNKELVFDPIFPERILGKLNFWLFIEPDDKYALSMKKMIEEKLNEIV

SEQ ID NO: 2599 - protein, 350 aa, unidentified
  source 1..350: note = Related to NZ_JAJAVF010000002.1; note = Methylobacillus methanolivorans
MLEINEEIYEHLSSHMELDQRDDLLKLIQKFDDMQIPAIITFDIFARTVNINKKSLAAMCYGAEKFYRTFKIPKRSGGMRQIDSPFPSLSLVQKWISNNILEKLDIDNESACAYIKEKSIKNHVEKHIDSAFILKIDLQDYYPTISTRDIIYTFSEIGYPVNISTSIAHILSLNGGLPQGAPSSPLLSNIITLGLDVKIKEYCQKNNFLYSRYADDLAISGENISEDNILEIYRLISSEGFIVNTSKSKLYTPKQPVRHLTGLIINNGKIRIPKQTRKMVRQKLFYIRNYYLSDLESSSNHNLFSLHDPLLLERVLGYLNFWLWIEPDSEFATVSIQEIKSIKTKLLESI

SEQ ID NO: 2600 - protein, 342 aa, unidentified
  source 1..342: note = Related to JAAXXU010000024.1; note = Geobacteraceae bacterium
MNWEEYKSKFQDQAIIVGLPLGDVEECLSYAFGLYERGLPVIYDQAHLSYLVGYDVKFILKASNSNGPFYRTYEIPKRNGGLRIIDEPLPTLKSIQRWILDEILSQVEISEHAHAFAKNCSIVKNARPHLASKKILSLDIENFFGTIDFPRVYSLFTRLGYNSVVATTLSHLVTIRGVLPQGAPTSPAISNIVTLKMDRRFSGYAKKLKLEYTRYADDITFSGEFTSGTVISFARRVVEEEGFKLNEAKTRSMGRHQAQEITGIITNVKLQVPRQTRRKLRQIAYHISTYGLDDHLRMTGELRVNYISHILGLASHVLHANPQDKDAMFLKSVVCVNQTDSF

SEQ ID NO: 2601 - protein, 363 aa, unidentified
  source 1..363: note = Related to JAGBVG010000074.1; note = Alistipes sp.
MDFPRDSFIKEINSARPEYKKAVLDYADNLLSKNLPVIFSLNHFAELFGIDINELRFMLNNIDEFYAYYLIKKKHGGKRRIVSPYRNLKRIQEWILHEILDKIQVHPQCKGFVRGSSTLQNAKPHIGQQYIRKFDLKDFFESITIDRIYGIFHSIGYSPAVSYDLATICTLKLSDYKYVSMSRLQKNWFGYLYSKEKPVLAQGAPTSPALANIACRRLDARFWKYALSNNVQYTRYADDLTFSSEQIRSLPNTAFVNKVIQEEGLTLNYSKTGTYGRCSRQMVTGILIDGEKPRVPQKFKRQIYRHLHFCKKFGAKNHFEHIMPQHTNARQWLYGKIMYVYSIEPEEAKKMLKLAESLEWGIM

SEQ ID NO: 2602 - protein, 363 aa, unidentified
  source 1..363: note = Related to CZAO01000003.1; note = Bacteroides uniformis
MDFSRDSLLKELENTNVEYKKVIIEYTDNLLKKDLPVIYSLNHFAGILGLDLSELKTIIHNIDGYYAYYLIKKKHGGKRRIVTPYRNLKMIQTWILHEILNKIPVHSQCKGFVKGSNTLQNAKPHISKQYIRNFDLKDFFESITIDRVYGVFLSLGYSTAVSFDLASLCTLKISDYKFENLSRYKKNYFRYLHVKPQAVLAQGAPTSPALANLICRHLDERFWKFSLSRGIQYTRYADDLTFSSNQLELLPNTSFVNKIVNEEGLQLNYQKIGTYGKSSRQMVTGILINGESPKLPQKFKRQIYRHLHFCKKFGTYSHFNHIMPNYAHARQWLYGKIMYVNSIEPDEAKKMLSIANSLDWGLL

SEQ ID NO: 2603 - protein, 321 aa, unidentified
  source 1..321: note = Related to NZ_LR134384.1; note = Prevotella oris
MAGIVSVEYSELISIKDHIDGYYAYFTIKKKHSSKRRRIVVPYQNLKCIQRWILHEILDKIPVHPQSKGFVKGGSTFQNASPHVGMSFIRKFDFKDFFESITVQRVYGIFLEIGYSPAVSHDLATLCTLKLKEEKYQSLRGYKQSCFRYLYNKPKAVLAQGAPTSPALANLICRGLDSRLAKFADLNGIHYTRYADDLTFSANELEKLPTQSFLKKIVEEESLKLNYSKTGTYGPESRQMVTGILIDGEKPRVPQKFKRQIYRHLHFCEKYGTQAHFDHVMPGYSHARQWLYGKILYVYSIEPEIAKDMIAKANALDWGLL

SEQ ID NO: 2604 - protein, 364 aa, unidentified
  source 1..364: note = Related to JAFBIU010000027.1; note = Parabacteroides distasonis
MEFPRDSFIQQLNGCTPEYRSAIIQYTDNLLAKKLPVIFSLKHFAGIVGMDEGEIRRILDHTDGYYAYYTIQKKHSKKRRRIVVPYQNLKRIQRWILQEILDKVAVHRQAKGFVKGGNTLQNALPHLGKKYLRKFDFKDFFESISAERVYGLFYELGYSPAVSHDLAALCTLKLSDYKYISLKGYKQRCFKYLYDMNKAVLAQGAPTSPAIANLICRGLDGRFAKYADLNGIQYTRYADDLTFSADSLDLLPSFGFVNKVVREEALKLNYSKTGTYGPESRQMVTGILINGVKPRVPQNFKRQIYRHLHFCEKYGAQEHFSHVMPGYSHARQWLYGKILYVYAIEPEVGKDMLVKANSLDWGLI

SEQ ID NO: 2605 - protein, 363 aa, unidentified
  source 1..363: note = Bacteroidales bacterium; note = Related to JAGHRT010000012.1
MEFPRDSFLSLIKDSPDEYKKATTEYADRLLSKGLPVIFSLKHLGVLLNVEYRDMCMLVHFPDGYYAYFLIKKKKGGYRRIVVPYDNLKHIQRWILHNILSKIPVHKQCVGFMKGKNTLDNAKAHVGKKYIRKFDFKNFFESINARQVYYVFRNVGYSPSVSRCLASLCTLKIEDNKYDYLPPYKKIWFKDLHDTTIAVLPQGAPTSPALANIICNNLDKRFFSYAFKKNLTYTRYADDVTFSCDDPSLLPNVSFVKKVVESEGLSLNEKKTGTYGQDSRQMVTGILIDGEKAHVPQKFKREIYRHLHFCKKYGTHEHFRHIAPDKSNPRAWIYGKIHYVNAIEPEEAKKMFALADELDWGIL

SEQ ID NO: 2606 - protein, 367 aa, unidentified
  source 1..367: note = Bacteroidales bacterium; note = Related to JAAVFK010000042.1
MTMEFPRNDFITKAKKAGHSADFIKATLRYADSLDEKGLPVIFDRNHLAFLLMMDIQELLCFVRESSCFYKYFAIKKKRGGLRRIIAPYSNLRKIQVWIKECILDKIEQPYYVTAFAKNRNTLKNARIHEDKKYILKFDIADFFESICFKQVNSAFCNMGYLPEVSSCLARLCTSKIDEYKYSQLEEQKDIQALFDDLKTKNEAFLIQGAPTSPALANIVCYRMDRRIIGLSKGIKFNYSRYADDMTFSADRLSDLPKVGMIRRIVESEGFHLNDQKTQLLHVGKRQIVTGLLVDGHVRVPGRYKKDIWRHIHFCLKYGGRDHFNRIAPGLAYGKEWIEGRIRYVHSVEPDVAKKMWVEFEKIDWGY

SEQ ID NO: 2607 - protein, 365 aa, unidentified
  source 1..365: note = Related to JAFQIH010000031.1; note = Alistipes sp.
MGFPRNDYLTAAKDKKHSDEFISETLSYADGLDSKGLPVIFDQQHLSYLLCMEHRNLRQLVKSASSYYKYFAIKKRRGGLRRIMSPYSELRDVQIWIKENILDKIELPNCVKAFVKGRNIMENAKMHEGRKYILKVDITNFFESIGVRQVYVAFRKMGYDRSVAAWLANLCTAKIEDYKYEQLEDQEEIQKLFNDLYHKSEPFLVQGAPTSPGLANIICNRMDKRMMGLANKHGFTYSRYADDMTFSADKKDRLPKVSMIRKIVETEGFHLNEEKIELLHEGNRQIVTGLLVDNHVRVPGRYKKDIKRHIHFCLKYGGREHFHRIAPGKAFGKEWLAGRIRYIHSVEPETAKKLWAEFERIDWGY

SEQ ID NO: 2608 - protein, 365 aa, unidentified
  source 1..365: note = Related to SUYB01000005.1; note = Bacteroidaceae bacterium
MGFPRNDFITEATLQGRSQQFITEALRYADVLDGKGLPVIFDTSHLAFMLNMSHRDLVHIAFMASVFYKYFAIKKRSGGYRRIMAPYMHLRQIQVWINKNILSKVQQPEYVTAFVKGRNTQMNAKMHENRAYVLKVDLSNFFESINVRRVCAAFMWMGYESSVASCLAKLCTAKIDDYKYDMLEEQPEIQTLFDELMQRHEPFLIQGAPTSPALANIVCGRLDKRMKRLSQEMGFNYSRYADDMTFSADDRAMLPKIRLIRKIVKEEGFTLNEKKTELVHQGNKQMVTGLLVDGRVRVPGSYKRDIMRHIHFCQKYGGRGHFDRVMHGKAYGREWLEGRIRYVYSVEPEAAKKMWAEFEKIDWGY

SEQ ID NO: 2609 - protein, 362 aa, Flavobacterium sp.
  source 1..362: note = Related to BJSX01000096.1; note = Flavobacterium psychrophilum
MNFPRNLFIENANAEKRSAEYLTKTLNYIDRLSAQNLPVIFSTKHLAQLLNIEYHELNNIIENRTYFYTYYLIKKRTKGHRRIIAPYSNISEVQNWIKNNILDNLTTNINSTAYQKGNSISNNAKIHENNQVIFNIDLENFFETITERRIYGVFKSIGYTKNVAIDLAKICTTIISQEKFDDLNDDVKTHFEDYIKLNECVLPQGACTSPTLSNLICRKLDIRLSKLANKLGIQYSRYADDITFSGSLEKLPNIKLLKKIIEEEKFKVNDNKVKLLKKGNRQMVTGLLVDGKVRVPQKYKKEIFRHLRFCEKFGGFTHFNKINPEKSFRKEWLHGKICFVHSVEPEIAKIMFQKLKDINWEK

SEQ ID NO: 2610 - protein, 362 aa, unidentified
  source 1..362: note = Paludibacteraceae bacterium; note = Related to JAGPFU010000113.1
MDFPRNLYIETANNEGHSPEFLTSTLGYIDNLTSKNLPVIFSLKHFSLLIGMELSDVIKIIHNRNYYYSFYLIKKKKGGYRRIVAPFKKLKLMQSWIKENILDKLEVSQHATGFIKGRSILNNAKSHENNDVILNLDLSNFFETIVERRVYGIFSSLGYSKNLAVEFAKICTAQMPKEKYDEIDPEKQEYFNKLYRLKESVLVQGAPTSPTLSNLICRRLDLRLSMLANKLGLIYSRYADDITFSGKASNLPSIELLKKIIEDENFEINWEKVGKYKKGQRQMVTGLLIDGKVRVPKSFKKEIYRHLHFCSKYGAFSHFQRICPDKAYRKEWLLGKIYFVYAIEPEEAKKMLKIANAINWEI

SEQ ID NO: 2611 - protein, 362 aa, Flavobacterium sp.
  source 1..362: note = Related to NZ_CP016907.1; note = Flavobacterium anhuiense
MDFPRNIYIEAAKNEGHTSTFLENTLSYIDNLRSKNLPVIFSLKHFSILIGMELSDVIKIIQNRNNYYSYYLIKKKKGGLRRIVAPYKDLKFMQSWIKENILDNLEVHQLATGFIKKKSILNNAKNHENSDVILNLDLRNFFETINEKRVYGIFSSLGYSANLCVEFAKICTAQIPEDKYEIMSSEEQEYFEELYNLKESVLVQGAPTSPILSNLVCRRLDLRLSKLANKLVVNYSRYADDITFSGDRNNLPNIGILKKIIEDENLKINWDKVGKYKRGQRQIVTGLLIDGKVRVPKKFKKEIYRHLHFCSKYGAYSHFKRICPEKSYGKEWLLGKIYFVYSIEPEEAKKMLKIANSINWEI

SEQ ID NO: 2612 - protein, 362 aa, Flavobacterium sp.
  source 1..362: note = Related to JAEUTX010000024.1; note = Flavobacterium lindanitolerans
MNFPRNTYLELANTSGKSPEFIESTLNYADNLIHYNLPVIFSLKHFSQIIGVDFHQLLNVIENRGHYYSYYLIKKRKGGYRRIIAPHKNIRYLQDWIKINILDKVKIHSSATGFTKGKSILDNAKSHLDSEVLLNIDLENFFESITEKRIYGVFKWLGYHKNLAIEFAKICTVKMPEEKFDNLNDISQEYFFDYYLLKEAVLVQGAPTSPSLSNIICIKLDNRFNKLANKRGISYSRYADDITFSGNKDSLPSYNLVKKIIESENLKINWTKVGRYKKGQKQVVTGLLVNENIRVPKKFKKEVLRHLFFCEKYGAASHFNRIAPDKSFRKEWLIGKILYINSIEPEVAKSMFERIKKISWEI

SEQ ID NO: 2613 - protein, 362 aa, unidentified
  source 1..362: note = Related to AP023049.1; note = Alistipes indistinctus
MNFPRNLYKQEAIRLKRSAPFITSTLNYIDNLISCNLPVIFSRQHLAILTGMSRYDMDKILENREYYYKYYLIKKKRGGFRRIIAPYKQLKELQRWIKENIIDQVDINQFATGFVKDKSIYHNAKIHEDANVILNIDLKNFFESITEKRVYGLFKSLGYAHNLAVDLAKICTSPICDEKLDELDESALPYFQDIQMQFESILIQGSPSSPAISNLICRRLDRRLSKLANSTGANYSRYADDITFSGSEDNIPKVSLIKRIIEGEGFSINWEKVKRHKKGQRQIVTGLLVDNEIRVPKKYKKDIYRHLHFCEKWGSRSHFEKINPGKGYGKQWLLGRIMYVNSIEPTEAKKMMALVKQIDWDR

SEQ ID NO: 2614 - protein, 350 aa, unidentified
  source 1..350: note = Lewinellaceae bacterium SD302; note = Related to PDLQ01000082.1
MAFLRSLFINEAKKKGRSEEFLKTTLEYADFLDGKGLPVIFSPLHFSLLVQTDYHYLKHLISVRSDFYANYYIRKRRGGKRKISVPFVPLRIVQKYINDFILNKVDVHPKAFAFVRNKSIVDNAKVHVNQEWILNIDIKDFFTSIGVDKVYTTFRSLGYVDNLCYDFAKLCTAKLEAKSKREFLPQGAPTSPNLSNIIMRNVDRRFENFSIKNDICYSRYADDITFSGKKSKLPKISFLRKVFKEEGFQLNEKKTQYYGPNSNRRFVTGLIVKDDVKIPNRFINSTSRQIYMCEKHGVDNHIDWLKKNHGITGNYYYEWLMGKIAFINMVEPSEAKFLYDRVNRIDWGLK

SEQ ID NO: 2615 - protein, 364 aa, unidentified
  source 1..364: note = Related to NZ_FNBN01000017.1; note = Chitinophaga filiformis
MSSPRNLIIQEAEETHHSKEYLNDILAYYDKLYNQGLPVIYSIHHLCLLMGDLDKKVPKIITSRNSNYATFKIKKRSGGKREISAPFVPLRNIQQWIYQNILSKVPIHPSAYGFVKHKSIMDNAKVHVNQDFILNIDLLDFFTSIPEKRVYGIFKSLGYHPNLAVYLAKACTKNLVKEIDIEVLDWLNQAPFHQNNSVLPQGAPTSPQLSNLVCRRLDKRLNNYAVKNGCKYSRYADDITFSGSEVNNIKLGVIFRIINDEQFNVNLDKVKFFHKSSNRKIITGLIVSDKIRIPKKFKREIARHLHFTTMNGTQNHIQHLRQYHNFDKVNYRDWLYGKICYIKMIEPDFGLKLMTKFKSIDWGI

SEQ ID NO: 2616 - protein, 364 aa, unidentified
  source 1..364: note = Related to PPEG02000004.1; note = Chryseobacterium viscerum
MTFNKDLFIKVSRLRNHSNEFIKETVDYANNLLEKDLPVIFSLKHFSLLANVDYDELVKIINIRSSLYKFYQIKKKNGKGFRQIVVPYNNLRCIQDYIKTEILDKVQIHDNATGFVKGKSIYDNAKKHSNQQEILNIDLFKFFDSITERRIYGIFKSLGYAKNLALDFAKLTTVALPEEYLSSFKFDERRLYDEIVRKGECVLPQGAPTSPILSNLITRRLDLRMSSLADKLKVNYSRYADDLTFSGNYGTVPTFTLLDKIINDEGFRINWSKAKISKKGRLQMVTGLTVSNDIHVHRKFKKEVKKHIYGCLNFGVNNHLAHIQKDDIGYYKEWLAGKIYFIYSVEPDYAKKLLDDYNKIIWPL

SEQ ID NO: 2617 - protein, 364 aa, unidentified
  source 1..364: note = Related to JAAALB010000001.1; note = Cellulophaga sp.
MPFSQDEYIATAKSHGHSQEFIDITVAYAQNLVAKNLPVIFTTEHLSSILDMPILELKTIINHRSSFYKFYQIKKRNGNGFRQIVSPYNNLRVIQQYINEEILSKIPLHESATGFTKGKSILNNAVPHKNKKAILNLDLLKFFDSICERRVYGIFKSLGYAKNLSIDLAKLTTVELPEDYLKTFEEKELKSYRELVPKDSCVLPQGAPTSPTLSNIILRRLDFRLSKLAEKLKVDYSRYADDITFSGDLENLPKIKLLRSIIRDEGLNINWKKVGIYKKGRKQLVTGLTVSNDVHIHRDFKKEVKKHIYACCNFGVETHLRFMELENTHLYKEWLLGKIYYINSIEPETAKKMMNDFNKIVWTI

SEQ ID NO: 2618 - protein, 364 aa, unidentified
  source 1..364: note = Related to JALKBC010000033.1; note = Arenibacter sp.
MAFPFSEKSTSEPVNHSDEFLTDINNYGDNLKKNKLPVIYTLYHLCQMAEVPVKEILRVCESTRIEHYKRFKIRKKRGGFRVIQTPSDSLKYLQRWILVNILNELDSHERCFGFEKKSSILKNASVHLNQPAILKLDLQRFYDSINEKRIYGVIQSFGYHSNLSVYMAKLLTVLPNDYFFESFKKTESNLKNKLQKLNQGVLSQGAPTSPKISNLVCRRLDQRMYELAIKNGLNYSRYADDITFSGNIEVLRKVKKAAYYIINDEKFFVNYGKTKFIKAGGKFLVTGLNIENGSVTVPKKKKMEIEHHLYHCLNNGVINHLKTSKMPQRNFKDWLLGNIAFVHSIEKNVAKVYFEQFNKINWPI

SEQ ID NO: 2619 - protein, 351 aa, unidentified
  source 1..351: note = Related to NZ_LXTT01000008.1; note = Muricauda sp.
MDHSQEFLSDIKEYRERLDEKGLPLVFSIHHLCLLAGVSVTEILEICKSDRIRYYKRFKLKKKRGGFRVIQTPENTLKFLHRWILKNILNRVESHEKCFGFDKESSIVKNASAHLGQPAILKIDLQRFYDSINEKRIYGVILSFGYHPNLAVYMAKLLTVRPDSYFLSTFKKKESSLKDKLEMLNEGVLSQGAPTSPKLANLVCRRLDERLNKLALKNQLNYSRYADDITFSGNLVQLEKIKKTVYFIVRDENFYVNYSKTRFIKSGGNFFVTGLSIKDGVVKVPGKKKKEIEHHLYHCLKNGVINHLKSAGVSQRNFKDWLLGNIAFVHAVEKDVAKDYFEQFNKINWPI

SEQ ID NO: 2620 - protein, 365 aa, unidentified
  source 1..365: note = Related to NZ_FNQK01000016.1; note = Bizionia paragorgiae
MTYPFYHIKRNQEPIVHSSEFNQDIKIYSDLLAKKGLPVIYSVPHLCLLAGVHIERILTITKSNRIESYKRFKLKKKRGGFRVIQTPNDELKYLQRWILKNILEKVPSHPSCKGFDKNTSIKHNADTHLKSEALLKLDLLRFYDSINERRIFGIFKSLGYHPNLAVSLAKICTIVPDEMFISSFRKKETELKEYIVSKNEGILAQGSPTSPKLSNLITINLDKRLAGLANKNGLNYSRYADDLTFSGNFKQLQKVKKVVYRIIREESLFPNYSKTKFIKLGGKFLVTGLNIQNNVSTVPKKKKKEIEHHLFHCIENGVENHIKTAKINNRNFKDWLYGNICFVFSIEEKKGIQYFKEFEKIQWPI

SEQ ID NO: 2621 - protein, 360 aa, unidentified
  source 1..360: note = Related to NZ_WNKF01000001.1; note = Cyclobacterium roseum
MTSPLNKTLENHSAEYQNEIKAYQHVLEKNGLPVIYSLNHLCLMAGVNLEHIKNCCISNRQENYKRFKLKKKRGGFRVIQTPQDELKYLQRWILENILNKKNSHNACKGFDPDTSIKLNAEKHLKQEGILKIDLLRFYDSINEKRVYGLFKSLGYHPNLSVSLAKICTIVPDNTFLSSFKQKEQHLKQKIKQDGLGVVPQGAPSSPKISNLITISLDNRLQNLADKHNLNYTRYADDLTFSGTIETLSKIKKVVYRIIREENLYPNYSKTKILKRGNPFFVTGLSVHNDTVTVPKKKKLEIEHHLHHCIKNGVQNHLTTSKITNRNFKDWLLGNIAFVNGVEKELGKKYFKQFNEIQWPI

SEQ ID NO: 2622 - protein, 364 aa, unidentified
  source 1..364: note = Related to MENU01000192.1; note = Bacteroidetes bacterium GWE2_29_8
MTSPLDNISEETPPIHSVEFLADIMAYDLKLNSKNLPVIYSLQHLCLLAGVNIKNITKVCNSTRISEYKRFKLRKKRGGFRVIQTPTDELKYLQKWILVNILEKVPSHSSCKGFDKTLSIKLNAEVHLNKESILKIDLLRFYDSINEKRIYGVFKYIGYHPDLAVSLAKICTIVPDNKFLSSFKKKELDLKCIIIKKTEGLLPQGAPSSPKLSNLISISLDNRLSKLALKNELGYSRYADDLTFSGSLETLKKVKSTIYRIVEDENLFVNYSKTKLLIKGNPFFVTGLSVNNDHVTIPKKRKIDIEHHLFHCIKNGVEAHITRCEIKNKNFKDWLLGNIAFVYSVEKELGEKYFTDFNKIQWPI

SEQ ID NO: 2623 - protein, 367 aa, Flavobacterium sp.
  source 1..367: note = Related to NZ_CP030261.1; note = Flavobacterium fluviale
MTIPSIIKNSIPKEIPAPPSPEFLNDIAQYRAHLIDQGLPVIYSVHHLGLISKFNINNMIHLCNMPRDGFYKRFKMKKKKGGYRVIQTPSSELKYLQRWILKNILENRPSHECCKGFDLKASIKNNAESHLNKEAILKIDFLRFFDSINEKQIYRIFKGMGYHGNVAFALAKICSVVPDKMFFKSFKKNEKHLKKVVLEHDGGILPQGAPTSPKLSNLFCLSLDHRLTLLASKNNLSYTRYADDLTFSGDYETLISVKKTIYKIIKDEKLFVNMGKTKILKRGSLFFVTGLSVNNKKVTIPRKKKKDIEHHLHHCIKNGVENHMQKSNITNRNFKDWLFGNIAFVYSVEKELGAEYFKIFGSIQWPI

SEQ ID NO: 2624 - protein, 366 aa, Flavobacterium sp.
  source 1..366: note = Related to NZ_JADHEC010000003.1; note = Flavobacterium soyangense
MTFPFNKLIPISNEEIVHSEEFYEEIRKYGSFLSDKKLPIIYSLPHLCLLSGVNINNIKKLCGSNRIDDYKRFKLKKRRGGFRVIQTPNEELKYLQRWILFNILDKITVHDSCTGFEKEKSIKQNAEIHLKSEAVLKIDLMRFFDTINEKRIYGLFKNFGYHKNLAVSFAKICTIEPNEKFMKSFKKNEIGIKNFIIENEEGILPQGSPTSPKLSNLVAFKLDKRLYGLALKSKLNYSRYADDITFSGNLDTLKKIKSIIYKIINEERFFVNHSKTKLLIRGNPFFVTGLSVNNNYVTIPKKRKIDIEHHLFHCLENGVEEHMKICEIKKRNFKDWLLGNIAFVYSVEKELGQKYFDSFNKIQWPI

SEQ ID NO: 2625 - protein, 365 aa, unidentified
  source 1..365: note = Related to NZ_CP074436.1; note = Polaribacter sp.
MTYSLDIYKKRAAELKRSEEFIKETSEYIELISKKGFPPIFSLPHLCLTSSVSIKNTITICESNRRVFYKRFKLKKKKGGYRVIQTPVSELKFLQRWILDNILEKIPSHHSCKGFDKNTSIIKNAECHLNSECILKIDLLRFFDSINEKRIYGIFKSLGYKENLCVSFAKICTIEHEEKFYDSFEKSEQKLKSYLTNKKEGVLPQGAPSSPKLANLILRRLDHRLSKLCEKRKINYSRYADDLTFSGNSIELQIIKKIVYKIIHNENLFVNFSKTKFLKRGSPFFVTGLSVHNSEVKVIRRKKKEVEHHLFHCLKNGVMGHLTKAKITNRNFKDWLFGNICFIYSVEPIIGQEYFDKFNKVDWPI

SEQ ID NO: 2626 - protein, 365 aa, unidentified
  source 1..365: note = Related to NZ_LR824569.1; note = Chryseobacterium sp.
MTFLLDKYKEHALASNHSNEFISETIQYANFLSSKNLPVLFSLPHLCLASAVSIKNTLEICNSSRIEYYKRFKIKKRRGGYRTIQTPTNELKYLQKWILRNILEKFPSHKSCTGFDKLSSIKKNAEIHLNAECILKIDLLRFFDSINERRIYGIFKSFGYQNNLCVSLAKICTVKQNETFYNTFKKNEDNLKQYLLSKDEGILPQGAPTSPKLANLILRNLDKRLERLCSKYNVNYSRYADDLTFSGKKENLLYLKKIIYKIIYSENLFVNIGKTKFIVRGNPYLVTGLSVHNEEVKVIRRKKKEIEHHLYHCIKNGVILHLIKSNIGNRNFKDWLFGNICFVYSIEPKVGQNYFNDFNKIEWPL

SEQ ID NO: 2627 - protein, 365 aa, unidentified
  source 1..365: note = Related to PASE01000008.1; note = Muricauda sp.
MTFPLDNFITKAKFQRHSDEFIDDAKNYIQKLEKAELPILFSIFHLCLSAKISIKLILALCRSDRIHYYKRFKIAKKRGGYRIILSPNNELKYLQKWILINILEKIPSHKSCQGFDKNKSIKKNAEIHIGSECILKIDLLRFYDSINEKRVYGIFKSLGYHKNLAVSMAKICTVEVKENFLKAFTKNESDLKNKISSQKEGILPQGAPSSPKLSNLILRRLDQRLHCLAKKNGINYSRYADDLTFSGKEEKLKELKKIIYMIIKDENFFINYGKTNFLKRGNRFFVTGLSVHNEKVTVPKKFKSNIEHHLYHCIKNGVIAHTKKNGIENRNFKDWLLGCICFINSVEPELGEDFFEKFNEINWPI

SEQ ID NO: 2628 - protein, 365 aa, unidentified
  source 1..365: note = Related to NZ_FSRA01000001.1; note = Chitinophaga niabensis
MTYPLDVFFEYAKEMDHSPQFTEEVEKYVSSLLNRNLPVFFSLPHLALAASFSINHVERIVKSNRRDYYKRFKLAKRRGGFRIIQTPDQELKYLQKWILLNILNKVNSHPACKGFDPKSSIILNAQDHLNKEAILKIDLLRFFDSINEKRIYGVFKGLGYHPNLAVSLAKLCTLKPDNTFFIAFKKNELMLKELIKKRDEGILPQGAPTSPKLSNLIARNLDIRLDKLCKKHGISYTRYADDLTFSGEKTKLMLLKKVVYKIVKTEGFYINYGKTKFLTRGNKYFVTGLSVHNKTLKVPRKKKLDIEHHLHHCLKNGVHVHMIKSKIKNRNFKDWLLGSICFVWSVEQELGQKYFDEYNKIEWPV

SEQ ID NO: 2629 - protein, 365 aa, unidentified
  source 1..365: note = Related to JACCBZ010000002.1; note = Mucilaginibacter sp.
MTFPLDDFLIKAQAAGHSDKFIAETTAYIHKLSKDNLPVLFSLEHFALEAQVNIGRLGMIVRSDRTFYYNKFKLKKRNGGFRTIQIPNSDLKYLQKWLLINILNKITSNAACKGFDPGTSIKGNAEIHLNKQAILKIDLLRFYDSINEKRIYGIFKSIGYHANLAVYLAKACTIKPDNTFFIAFKKNELLLKQVIEKRDDGVLPQGAPTSPKLSNLIARSLDKRLQGLCDKHDVNYSRYADDLTFSGDKATLAKIQKIIYSIVEKEGFFINYGKTKMLVRGNKYFVTGLSVHNNAVKVPKKQKKEIEHHLYHCLKNGVHLHILKSGLKKRNFKDWLLGSICFVNSIEQNLGSKYFELFQRIEWPI

SEQ ID NO: 2630 - protein, 364 aa, unidentified
  source 1..364: note = Related to VFPL01000001.1; note = Arcticibacter tournemirensis
MDYPLDDVLEAARDEGHTTLFVADIEAYVKYLTARQLPVIYSLAHLAISMGMNIDMMVRLAESNRRDYYKRFKLQKRAGGFRTIQSPDNPLRYIQRWILANILNKIPSHPACLGFDPTTSILKNATVHVNQKAILKIDLLRFFDSINEKRVYGIFKSIGFHPNLSVSLAKLCTIVHGKNFFSEFREHEVEIRDRIISDSTGILPQGGPTSPKLANLVARRLDSRLQGLCEKNGLKYSRYADDLTLSGDKDILERVRKTVYKIIRDEGFFPNLSKTRLLLRGQKFMVTGLDISNEKPRVSRKKKKEIEHHLYHCQKGVQRHIQKAKITQRNYKDWLLGSICFVHGIEPSVGKLYFSEFAKIEWPL

SEQ ID NO: 2631 - protein, 369 aa, Bacillus sp.
  source 1..369: note = Related to CP095875.1
MNGDFPRNDFIHQAKAEGHSKEFIQSTTEYAEKLENLGLPVLYSLKHLALTLDIPYIQLREIIRNRRKYYGLFKISKKVKGYREIRCPQNTLKDIQHWILYSILAKVRTHKSCIGFKKGDSIKKNATIHLGQPAILKLDLYCFFDMVTEKQVYNVFKSLGYHPNLAVDLAKLCTVPETGEYVKKLYQDTCPTNFIYHDNPFLPQGAPSSPALANLVLYHLDVRLKGLADFLGIQYTRYADDITFSGEDDRLPKISLIDKIVRDEGFYLNHSKILLRKKGQQQKVTGLIVSGTSLRVPRKYKRDIWKHLLFLKKRGVKEHLEYIKNKNGSNKSAYRDWLLGKIMFVKSIEPTVGNKMLFEFNQIKWPFYD

SEQ ID NO: 2632 - protein, 365 aa, Bacillus sp.
  source 1..365: note = Related to JAJPGG010000002.1; note = Bacillus toyonensis
MNNIFPRDAFEKVAEARGHSKEFILSALEYADKLIKSELPVLFSTKHFCEVIDITYGELKKIILNRTNQYGNFKIRKKSGGFREIRSPKEKLKNIQKWILNNILSKVSPHGSCIGFKKGDSIIKNALPHLGKEAILKFDLFHFFDTVTEKRVYSIFKSLGYHSNLAVDLAKLCTVPSFPSHKKKFLENFNISDNPFPFDSFLPQGAPTSPALANLVAGHMDKRFKGLADFLGLDYSRYADDLTFSGNYECLPNVNFVKKIILEEGFYINESKTCLRREGQQRKVTGIIVSGDTSKVPKAYKKDIWKHLYFLNKFGVKKHLRNIKNNKSSFQDWLLGRIMFVRSVEFEEGNRMLYKYNQVNWPFYE

SEQ ID NO: 2633 - protein, 377 aa, unidentified
  source 1..377: note = Related to VFNO01000006.1; note = Brevibacillus sp.
MNCEFPRNDFVKEAIKQGHSQEFINECLLYADNLTYKGLPVIFSTKHFCELLDISFKQLNYILDNREDFYGTFNLRKKRGGYRRIQYPLPILKNIQRWILDYILTRVPLHSSCKGFRRGESILTNATPHLTKKTILHLDIEDYFGSITQKQVFNVFSKLGYNKSLAHDLSKLCTIHKVEIEKTIETDSFLATEQKEFLESIKRYSQKKIDFILPQGAPTSPTLANLVSVKLDKRLFSLAEKLGVTYTRYADDLTFSTDTEILPRLAIIKKILSEEGFQLNKSKTATRKQGQRQIVTGLLVSGEKAKVPKKYKQDILKHLFYADKYGPKDHSMEIQKNPATFQEWLLGRIMFVRSIELETGNMMLEKYNQIEWGFNLK

SEQ ID NO: 2634 - protein, 350 aa, unidentified
  source 1..350: note = Related to NQMO01000005.1; note = Paenibacillus sp.
MDIRFPRDAFVQEAQNQGRSQLFIEECLLYADGLQYKNLPVIFSTKHLSLLLELEYKELNNIILNSYRYYKTFSIAKKRGGERQIKCPNHILKSLQRWILNNILINVRVSSACKGFRKGESIITNADTHLGCQAILRVDLENFFDTITENQVRKSFIRIGYSTNLSVDLAKLCVTSRLDSTTGEYVSSLPQGAPTSPMLANIVAYRLDKRLSSLANKLGVRYSRYADDLVFSGNTTQLPKIELLKKIITEEGLKINNQKTLLRREGQKRMVTGIIVSGDKLRVPKKYKKDIWKHLHYALLYGPDGHTSRIKVNPATFKEWLLGRIMYVRSVEKDAAEDMLKVFNEISWGF

SEQ ID NO: 2635 - protein, 344 aa, Bacillus sp.
  source 1..344: note = Related to CP026036.1; note = Bacillus subtilis
MNFPRNDFEKYARDEGKSQQFIDATLSYVDKLNSMQLPVIFSIKHLALTLDYPYNKILDIANHSEKYYKSFKIRKKRNPQQFRRILAPNPDLKVIQRWIYNNILKNIEPDESSVGFSQGCSIQKAAAMHTNQEVVLRVDLSNFFENITQKQVYYVFRNLGYHKNLAVDLAKLTTIYTKEGSYLPQGAPTSPALSNLVVRKMDKRLRCLSEKLGVNYTRYADDLIISGNKKDIPRLGLIKQIIKEEGFKLNSEKTAIQRAGNKQLVLGLTVTNGVHVPKDFKKEIWTHLRYCKKYGPIDHLRYINKSDKGAFKDWLFGKISFVKSVEPAVGEKMMNLFNEINWPL

SEQ ID NO: 2636 - protein, 344 aa, Bacillus sp.
  source 1..344: note = Related to CP043830.1
MNFPRDVFEQQARKEGKSDSYIKSALVYIDRLNSMEIPVIFSLKHLALILDFPYKKISDMANNPNTYYSTFKIRKKRGGFREIQAPQPEMKIIQKWIYQTILKEIRTDSSCMGYSKGSSIRENANVHKNQEVILRVDIYKFFENISFKQIYYVFKSLGYTKYVAIDLAKLTTVKSEGSNVRYLPQGAPTSPALSNLVVRKLDKRLRSLSNKLQVNYTRYADDLIFSGEKGCLPQIGLVTKIIKDEGFKINPNKTAIQKKGNRQIVLGLSVTNGVHIPKKYKKEIWTHLKYCKKFGPIKHLENIGESNKAAYKDWLFGKICYVKSIEHEVGKKMMAAFNDISWPL

SEQ ID NO: 2637 - protein, 346 aa, unidentified
  source 1..346: note = Related to NZ_JAIZAP010000009.1; note = Aquibacillus sp.
MYFHRDIFEEKAREQGKSNAFIESSLAYVDKLNSMQLPVIFSLKHLAVTLDISYKKISHMIKFPNEYYNTFRLRKKSGGVRIIQAPKPELKIIQKWIYVHILKNIKVDSSCTGFTVGSSTSKVARMHQNKEVVLKLDLENFYDNIDRNQVYYVFKSIGYKDHVAIDLAKLTTVNPIKTQRNVFILPQGAPSSPSLSNLVSRNLDRRLRLLSEKVNVIYTRYADDLTFSGEKKNMPSLKLVTKIISEEGFQVNNKKTSYQKKGNKQIVLGLTVSNDVHVPKKFKREIWTHIKYCKKYGPVKHLININQANRASYKDWLYGRICYVKSVELKVGEKMMEEFNLIDWPF

SEQ ID NO: 2638 - protein, 315 aa, unidentified
  source 1..315: note = Related to NZ_JAEQNB010000004.1; note = Tumebacillus amylolyticus
MAGVDRTRLLRITEQRDRNYHRFLLEKRAGGFREILTPKPLLKRIQRLIYVNILATVELDQSCLGFREGRSIKDNAQIHANQDAVMKVDLYRFFDTISEKRVYGMFKSLGYHTNLSVDFAKLTTLHPSEQYYLEIMNDKNLPDHYPDPHFARLPQGAPTSPVISNIIARNLDFRLRKLAEKLGVNYSRYADDITFSGVLTKLPKIHLINDIVRSEGFFINGSKISLRKKGTKQLVTGLTVSNGVHVPKKYKQETWRHLYYSKKYGAKDHLRRIGKTGISGFEEWLLGRIHFIRSIEPEVGDAMLEKYEVIDWSLI

SEQ ID NO: 2639 - protein, 366 aa, Bacillus sp.
  source 1..366: note = Related to JH792281.1; note = Bacillus cereus
MSTNIPRDEFVLVSKESGHSKEFISKALSYINTLENKNMPVIFSIKHLSQILNLNYSLVLDIIKTREQYYRGFKLKKRRGGFRYVQSPNSNLREIQTWIHNNILLNVPIHENCFSFIKQKSIRDNASLHANAEAILKLDLYRYFESIDQRKIYKVFLDFGYTKNVAIDLSKLTTILPNQYYEDIISKDKLTPEKFVLSKHGFLPQGSPTSPILSNIVAEKLDIRLNGLAKALNVKYSRYADDITFSGKRDKLPKVSFVEKILNEEGFYLNNKKTKLRVKGQRQIVTGLSISNGVHIPKHYKRKIRQHLYYCKVLGPKRHLQNINLEKSNFKDWLYGSICYIRSIEKNLGDKMLEDFDKINWLFYYD

SEQ ID NO: 2640 - protein, 402 aa, unidentified
  source 1..402: note = Related to NZ_VATY01000001.1; note = Maribacter algarum
MTLPLKHILKNIKFNIQERVTATMSFPFNQFALEAKEQNKSQEFIDACLAYASNLSEQGYPVTFSIEHLAMQIGVQSDYLRNLIGDGKRDITYDYEHKYKRYNYFKLKKRDGNFREIMSPAKDLKFIQKWILVNILSKYRLAESCKGFRKRISIYDNAKVHENSEIILKVDLLKFYDTITEKRVYGLFKSLGYATNLSFSLAKITTAKHRKNYWRDFNNSSKEILSELVQTKPAILPQGSPTSPMISNILATKMDYRFEGMAKKQNFRYSRYADDLTFSITKEGSLPSLNVISKIITQEGFFINHKKTQYLKKGCKQYVTGLTTTNGINVNKKYRKQISEHIYFCRKYGVKSHLARRKKDFPNSNSLSFHNWLYGHLCFINSVNSKASKTLLEEFNKINWSV

SEQ ID NO: 2641 - protein, 378 aa, unidentified
  source 1..378: note = Related to NZ_CP058986.1; note = Polaribacter sp.
MSFSFKQFEIEAKKQEKSQEFIDACLVYAKKLTQNDYPVTFSLEHLAMQIGIQSDYLRNLIGDDKNGITNNYEHKYKRYNYFKLKKRHGGFREIMSPAKDLKFIQKWILVNILSKYKLADSCKGFRKGISIFHNANVHENSELILKVDLLKFYDTITEKRVYGVFKSLGYAKNLSYSLAKITTAKHRDKYWRNFDDDSKERLKELVMAKPPILPQGAPTSPMLSNILATKMDYRFEALSKTQNCRYSRYADDMTFSITKEGKLPSLKLITKIISDEGFFINDKKTRYMKKGCKQYVTGLTTTNGTNVSKKYRKEISEHIYYCRKHGVDGHLERRVDFSGYNNIKFHNWLYGHLCFIKSVNEEASKKMLDSFNKINWYI

SEQ ID NO: 2642 - protein, 379 aa, unidentified
  source 1..379: note = Related to NZ_QREI01000003.1; note = Winogradskyella pacifica
MSFPFKQFEEQARKQEKSQEYIDFCLAYARKLSENGYPVTFSLEHLAMQIGVQSDYLRNLIGDDKNNIEYNYELKYKRYNYFKLKKRDGGFREIMAPAKDLKFIQKWILVNILSKFKLADSCKGFRQGVSIYDNAKVHENSEIILKVDLLKFYDTITEKRAYRAFRLIGYVKNLSYSLAKITTAKHRDSYWRNFDDISKETLKELIIVKPPILPQGAPTSPMISNILATKMDYRFDALAKKQNCRYSRYADDLTFSITKEGKLPSLKLITKIITDEGFFINDKKTRFMKKGCKQYVTGLTTTNGINVSKKYRKEIYEHIYYCRKYGVSSHLSKREEEFSGFNSIKFHNWLYGHLCFIKSVNKAASNKMLEDFNKIDWFV

SEQ ID NO: 2643 - protein, 379 aa, Flavobacterium sp.
  source 1..379: note = Related to NZ_VLKO01000001.1; note = Flavobacterium tiangeerense
MSFPFEQFIIQAREQNKSLEFIDACLSYGKALEEKELPVIFSLEHLAIQIGIQSVYLRNLIGDGKWDINYEYEHKYKRYNYFKLKKRDGKFREIMAPAKDLKYIQKWILVNILSKYVLADSCKGFRKGISIKDNAKVHENSEVILKVDLLKFYDTITEKRVCSVFKSLGYVSNLAYSFAKITTAKHRESYWKDFDENSKEILNELVDNKPPILPQGAPTSPAISNILATKMDYRFEALSRKLNFRYSRYADDLTFSIKNGGKLPSLKLITTIISDEGFFINSKKTKYMKRGCKQYVTGLTTSNGTNVSKEYRKTITEHIYYCRKYGVNSHLERRKEEFPKYNNIKFHNWLYGHMCFIKSINEKASKKMLEDFNKINWYV

SEQ ID NO: 2644 - protein, 379 aa, Flavobacterium sp.
  source 1..379: note = Related to NZ_MUGY01000012.1; note = Flavobacterium hydatis
MSFPFEQFIIESKEQNKSQEFIDACLTYGKKLDDKEFPVIFSLEHLAMHMAIQSDYLRILIGDDKKNLVYGSEYKYERYNYFKLKKRDGKFREIMSPSKDLKYIQKWILVNIVSKYVLADSCKGFRKNIFIAHNAKVHENSEVILKVDLLKFYDTITEKRVYGLFKSLGYINNLAYSFAKITTAKHRDSYWNDFDENSKEILKELIENKPPILPQGAPTSPMISNILATKMDYRFEALARKLNCNYSRYADDLTFSIKREGKLPSLKLITKIISNEGFFINDKKTKYMKKGCKQYVTGLTTTNGTNVSKGYRKTITEHIYYCRKYGVNSHLEKRIKDFPKYNNIKFHNWLYGHMCFIKSINENASKKMLEDFNKINWYI

SEQ ID NO: 2645 - protein, 379 aa, unidentified
  source 1..379: note = Related to JABXHT010000077.1; note = Tenacibaculum sp.
MSFPFKEFTEKAKEENRSQEFINACIQYAKKLSSKKLPVIFSLEHLAMLMGVESNYLRTLIDDGKNDFVYSYEHKYKRYNYFKLKKRDGGFREIMSPAKDLKFIQKWILVNILNKYKLRNSCKGFRKEISIYHNAEVHQNSETILKVDLLKFYDTITEKRVYGLFKSLGYANNLAYSFAELTTAKHRDYYWRSFDANSKKVLNTLYNHRPPILPQGAPTSPMISNILAAKMDVRFEKLAEKLNCNYSRYADDLTFSIKNEGKLPSLKLIYKIISDEGFFVNEKKTKYMKKGCKQYVTGLTTTNGVNVSKAYRKSIKEHIYYSRKLGVKKHLKNRNEEFGGYNNIQFHNWLLGHLCFIKSVNQEAYKKMIKDFNKINWYI

SEQ ID NO: 2646 - protein, 379 aa, Flavobacterium sp.
  source 1..379: note = Related to NZ_MUGW01000002.1; note = Flavobacterium hercynium
MSFPFEKFIIKAREHNKSEEFINACLVYGKNLVEKKLPVIFSLEHLSIQIGVKSDYLRNLVGDGKNDIIYNYEHKYKRYNYFKLKKRNGTFREIMAPAKDLKYIQKWILVNVLENYPLAESCKGFRKKVSIYDNAKVHENAEVILKIDLLKFYDTITERRVYGIFKSMGYVENLAFTLAKITTARHRESYWIDFDRNSQEILSKLLKEKPSILPQGAPTSPMLANIIATKLDYRFEALARKINFNYSRYADDLTFSIQKKGKLPPLKLINKIISEEGFFVNTEKTKYMKKGSKQYVTGLTTTNGVNVSKKYRKEISEHIFYCRKYGVVSHLKRRENEFPKYNSMNFHDWLYGHLCFIKSINETASKNMLEDFNKINWFV

SEQ ID NO: 2647 - protein, 381 aa, unidentified
  source 1..381: note = Flavobacteriaceae bacterium; note = Related to DTTW01000005.1
MSFPFKEFISKAKEENRSQEFIEATISYADKLDKNNFPVIFSVEHLAMLMGIQSSYFRHLIGEPKKHHYQDEPHKIFRYNYFKLKKKREGYREIMSPSKDLKFIQKWILVNILEKKNLQNSCKGFRKGISIKDNAMPHENSDLILKIDLLKFYDTITENRVFGVFADMGYRKNLAVSLAKITTAPHRFQYWKNIPKAELDIMGYKHNNFPSILPQGAPTSPMLANIVASKLDLRFEKLSEKMGFNYTRYADDLTFSIKGNQRLPNLKLIRKIISDENFFINETKVKYLRKGGKQYVTGLTTANGINVSKKYRQEIDSHIYYCRKYGVKGHLSWIGEENEKSQRVLPFHDWLYGHICFIKSINPKAAEKLLKDFSRIDWLFD

SEQ ID NO: 2648 - protein, 383 aa, unidentified
  source 1..383: note = Related to NZ_RAQH01000007.1; note = Epilithonimonas arachidiradicis
MKPFPFEQFITNAIKEDRSNDFIEECLRYAYKLEVKNYPVLFSIQHLAMAMGVKSQFLLALIGEDKRNIFDYLTDNRATIKHYNHFFIKKKRGNYREIMAPHKDLKYIQKWLLFNILSKFPLAESCKGFRSGISIYDNASLHNNAKIILKVDLLKFYDTITEKRVYGVFAKMGYAKNLAYSLAKLCTAKHHEKYWSDFNLNDKEVLSYYLEFKPPILPQGAPSSPTLANIVATNMDKRFEGLSKKLKFSYSRYADDLTFSIKDIGTLPSLDLIRKIINEENFYINEDKITYMHRGSKQYVTGLTVTNGVHTSKKYRKKIARHIYFCRRYGVENHLIKNIDHFPNYNILKFHDWLYGHICFINSVDKEASKRLLNDFNKIIWPL

SEQ ID NO: 2649 - protein, 382 aa, unidentified
  source 1..382: note = Related to CP015199.1; note = Chryseobacterium glaciei
MKSFPFEQFIKNANSEGRTQNFIEACVQYAHNLEDRDYPVFFSIQHLAMAIGIQSDFLTALIGENENSRYLYENEGVKLKKYNHFFIKKKRGSYREIMAPHKDLKYIQKWLLFNILSKVPLAESCKGFRSGISIYDNASIHSNAKIILKVDLLKFYDTITEKRIYGVFEKIGYAKNLAYSLAKLCTAEHHDKYWSDFNQNDKKILSYYLEFKPPILPQGAPSSPTLANIVATKMDKRFEGLGEKLKFSYSRYADDLTFSINHIGTLPPLNLIRKIIEEENFYINEDKITYMHRGSKQYVTGLTVTNGVHTSKKYRKKIARHIYFCRKYGVENHLLKNIEQFPTYNSLKFHDWLYGHICYINSVDKEASKKMLSDFNKITWSI

SEQ ID NO: 2650 - protein, 382 aa, Flavobacterium sp.
  source 1..382: note = Related to CP059431.1
MSFPFEQFIQNAREENRSEKFIDACVKYAEKLESNNYPVIFALPHLAIVMGVQSDFLKALIGESKDIRYILQSNEGFKIKKYNHFFIKKRNKGFREIMAPHKDLKYIQKWLLFNVLSKYPLTDSCKGFRKGISIRDNALVHSDAKVVLKVDLLKFYDTITERRVFGVFEKMGYAKNLSYSLAKLCTAKHHDKYWLDFSYSDKQTLTELYKERPSILPQGAPSSPTLANIVATKMDKRFDALAKKMNFSYSRYADDLTFSIKDEGRLPNLKLIREIISDENFYINENKISYMYKGSKQYVTGLTVANGVHTSKRYRKEIERHIHFCRRYGVEEHLSRNKKKFPYYNSLKFHDWLYGHICFIHSIDRKASEKLLNDFNKINWFI

SEQ ID NO: 2651 - protein, 382 aa, unidentified
  source 1..382: note = Related to NZ_JAFLHF010000002.1; note = Chryseobacterium scophthalmum
MKSFPIEQFKEVAINQGHSQEYIDFCLKYANQLIDKNYPVIFTIEHLAVVIGVESDYLRFLVGDIKHEQFEFDRFEYKEKRYNYFKFTKKRGGYREIMAPHKDLKYIQKWLLFNILDKYPFKNSCKGFRQGISIKDNALPHEKSDVILKVDLLKFYDTITEKRIYGVFKTMGFHGNLAVSLAKLCTAKHQSDYWENFTEKEKLILSEFIKTSPSILPQGAPSSPALANIVATRMDGRFDALSKKMNFSYSRYADDLTFSVKEKAVLPPLKLISKIIQEEGFYINEDKIQYMKRGNKQFVTGLTIANGVHTSKKYRKQIARHIHFCRKYGVENHLDKNNKEFKGYNILNFHDWLYGHICYINSVDKEASKKMLNDFNKITWSI

SEQ ID NO: 2652 - protein, 382 aa, unidentified
  source 1..382: note = Related to NZ_JABBGF010000003.1; note = Chryseobacterium cheonjiense
MKSFPIEQFKEAAKEQGHSKEYIDLCLKYANQLIDKDYPVIFTIEHLAVVIGVESDYLRFLVGDIKWEEVEFDRFEYKEKRYKYFKFKKKRSGYREIIAPHKDLKYIQKWLLFNILNKYPLKESCKGFRQGISIKDNAKTHEKSDIILKVDLLKFYDTITEKRVYGVFRAMGFHGNLSVSLAKLCTAKHQPDYWEAFTEREKLILSELVKTKPSILPQGAPSSPALANIIATKMDSRFEALSKKMNFFYSRYADDLTFSIKGDGMLPPIKLVLRIINDEGFYINEDKIQYMKKGTKQFVTGLTITNGVHTSKKYRKQIARHIHFCRKHGVENHLNKNYNEFKGYNSLNFYDWLYGHICYIHSIDEKYSNRLLNDFNKINWFI

SEQ ID NO: 2653 - protein, 383 aa, unidentified
  source 1..383: note = Related to NZ_JALDNB010000003.1; note = Chryseobacterium aahli
MNSFPIERFKILAKEQGHSDEYIRICLEYALKLTEKKYPVLFTLEHLAIAIGVKSSFLRLLIGDLKTEEKISKLKYPLKEKRYKLFFIKKRRGGKREIMAPDKDVKYIQKWILFNILGKYPLRDSCTGFRPNISIKDNALMHEGAFKILKIDLLKFYDTITEERVYGVFKSMGYRSNLAVSLSKLCTYKHKPEYWNSFNSKEKELLAYYVKEMPAILPQGCPSSPMLANIIASKMDYRFEELGKKMSFSYSRYADDLTFSIKGNGILPTLSFINKIITEENFHVNTDKTRYMLKGQKQYVTGLTITNGVHTSKKYRKKIARHIHFCRRFGVEVHLNRIRKDFLGYSTLNFHDWLYGHICFINSVDKEYSQKLLTDFNKINWFI

SEQ ID NO: 2654 - protein, 376 aa, unidentified
  source 1..376: note = Related to NZ_PVSS01000003.1; note = Brumimicrobium mesophilum
MEFPLNEFIELAKTKDKSQEYINSVIHYVKNLESNDFPIIFTRQHWASMMQIQSTFIDYLLNDYGEDFEDVLQSKYSCFTLRKRNGGERLIMAPKEDLKYLQKWIQFNILNNYKFEDSCTGFIIGKSIKDNAKKHEFAETILKIDLLQFFDTIKVERIYYCFKKMGYIGNVSHDFANLCTVVHPKEYWKKVDSEVKSVIGQTINSSSRVLPQGAPTSPLLANIVASKMDKRFGGLSKKLGFNYTRYADDLTFSIKKGQKLPSLNVIYQIIESEGFYVNKKKTKFINKGCAQYVTGLTIANGVNVNKKYRKMIERHLYFCRKYGVDNHLNKNKKTLFGFNRLSFHDWLYGHICYIKSINENCYKKLIEEYKKITWTI

SEQ ID NO: 2655 - protein, 371 aa, unidentified
  source 1..371: note = Related to MDJS01000005.1; note = Mucilaginibacter sp.
MPFDFEEFRKIAKSNNHSEEYIFETIKYAEKLNKKDLPVIFSTVHLAIELKIPSNILNSLLKSYNYTFFNLHKRSGGFREIMVPNEKLKYVQRWINFNILQKLPLEKVCTGFRPNYSILTNANIHANSKMVLKVDLLRFFDTITDRRVYGYFKSLGYLKPLSYDLAKLVTARHKKSYWDFVSKDNCPQLADIANSNSPVLPQGAPTSPMLANLLASRMDERFIILSQKLNFRYSRYADDLTFSITEEGQLPFTRVIKKIIEEEGFFMNDSKTKIFSRGMKQYVTGLTVTHGVHVSKKDRKDIFMHLHFCKKLGPNEHLKNWSKKNGLNREPYGFQDWLLGKISFIYSIDKIIGTKMFKEFDKINWSFENSN

SEQ ID NO: 2656 - protein, 377 aa, unidentified
  source 1..377: note = Related to NZ_FNDW01000013.1; note = Chryseobacterium taeanense
MPFPLELFILEAEKQGKSKEYIDVCVEYIKKLDSNGFPVIFSLHHLAQEIGVQYKYLRFLIGENDNKYEHKYKRYNYFSIKKKRNGYREIMAPSKDLKYIQKWILLNILYVYKLEDCCKGFMPNQGILNNAIVHENSEKILKVDLLKFYDSITFDRVVQVFESVGYIKNLAISIAKIVTASNRESYWNCFDEYSKLKLSSIRNAKTPVLPQGAPTSPMLANIIATNLDKKIINLSKKLNFRYSRYADDLTFSVKKNEGVLPYSKLIIKLIESEGFFVNPSKTIIKKKGQRQYVTGLTVTSDVNLSKKYRKEIFKHLHYCRKFGVNNHLERNKDFRKYNIIQFHDWLFGHICYTNSINKDVANKMFDIFRKINWSISE

SEQ ID NO: 2657 - protein, 393 aa, unidentified
  source 1..393: note = Related to NZ_UYXD01000050.1; note = Aquimarina sp.
MIYSPETFAISARNQGHSEPFIELCLAYLNKLNNRGYPVLFSIHHLAQEIGIQTSFLNELIGDTYYFYDGEEKIVVRSKVDYFDQGRYRYYKKFKIKKRTGGYREIMAPQGELKYIQKWIYINILLKYQLTDNCTSFRKGRSIYDNAKPHERKKYILKIDLLKFYDTISEERIFGLFKAMGYVENLSFALARICTAKHSRDFWNSISGDSAKILKTLIENKPAILPQGAPTSPTLANIVANRMDKRFVKLGQIRDFEYTRYADDLTFSSNNFNSLPSISFIKEIVKEEGFFVNQKKTKLFKAGGKQYVTGLTVTNGVNVSKKYRKNIFQHLYYAKKFGPRNHLIKWAKDNKKNPDIMAFQDWLYGHICFISSINKIAGKKMLSEFNKIDWTIL

SEQ ID NO: 2658 - protein, 377 aa, unidentified
  source 1..377: note = Related to DPWF01000030.1; note = Chitinophagaceae bacterium
MPFLFEEYIEEARKKQRSEAFIESTVQYAKKLDDNGLPVIFSRAHFASLVGMPSREIFTILHYRVTQYVQFSIKKKNGGLRHIMTPEKKLLYLQKWINKNILQQVSVLDCCTAFVPGTSLATNAYTHRNAHRILKVDLTRFFDTINEKRVFGLFKYLGYHPNVAYDLAQLTTAFPSYQYWKSQSLKDLRQTVEKITFYDAFLPQGAPTSPQLANLIAKPLDSRLLMLSEKFGCRYSRYADDLVFSTNKPEGKLPPLHLVKRIIESEGFLVNEDKTAYLKKGMKQYVTGLTVTHGFHVSKKQRQEIYKHLYYARKYGPFEHLKRWTTDNWGDERKTPYGFKDWLLGKISFINSIDRKNGIRMLDEFNKIHWGFECEDG

SEQ ID NO: 2659 - protein, 363 aa, unidentified
  source 1..363: note = Related to CP068086.1; note = Sphingobacterium multivorum
MSFDRKLFIEECKNQEKSEQYIVNTLKYADNLVNRGFPVLFSLKHMAYELGINYEDLKTIEDHRENYYKHFHIKKKKGGLRHLSVPFTNLKLIQSWIYHNILLHHHPTSSAYGYIKNRSIKENADQHVAKRFILNVDLLKFFETITEHKVFKLFVEIGYTKTLSWSLSKLVTVPIKEDYYLQLSHIEQKLFNKTFEQEYGVLPQGAPTSPSISNLVLRNLDGKMVELAELKGSTYTRYADDITFSGNDIKNIPTKTEIMRVVMSENLLINWNKWTLRKKGMRQKVTGLNTTHGLSVPKSYRKDVKRHIHFCLKYGPESHQKKIGVDKQFYRYWLLGRIHYIRFISPEIGNKMLKDFNNIQWPL

SEQ ID NO: 2660 - protein, 373 aa, unidentified
  source 1..373: note = Related to BMFQ01000008.1; note = Bizionia arctica
MSNEIVNSVMSSSLYKIVEQISKSNHGDDYKKSLIEYSQNLSSKNLPIIFDAYHLAYSIGIQPYRIINIIKDRDHLYNTYRVRKKTGGHRWIMSPIEELKTIQTWIKINILDKIQTHNSANGFVKEKSIVTNAEKHINKETILNIDLYRFFDTITEKRIYQLFKKLGYTNKLSYDLSRILCVNPPKKYWKELKKENKLKKKFIKMKPSILPQGAPTSPIISNLLCIKLDEILFKYCEKSHLSYTRYADDITMSGDNKNMPELKKIKSIIRHNGFTVNIKKIRFISKHKKQTVTGITVNNGLFVDKKIIKEISQELYYCIKYGYKSHLEYKFKKSKIKANYKDWLYGKICFVYSVEKEKGESFFKKFNMIDWNI

SEQ ID NO: 2661 - protein, 373 aa, unidentified
  source 1..373: note = Related to SJXJ01000003.1; note = Tenacibaculum sp.
MSNEIVNFIMSTSLHKIVEQINQSNHGNDYKEKLIEYSQNLSSNNLPIIFDAYHLAYSIGIEPYRLINLIRDRDDLYNTYKVRKKSGGYRWIMSPMEELKIVQTWIKVNILDKVNIHESANGFIKDRSIVTNANKHVKKETILNIDLYRFFDTISEKRVYHLFKKLGYTEKLSYDFSRLLCVNTPKKYWKEIKRENRLRKKVIRMKPSVLPQGAPTSPIISNLLCLKLDQVLYKYCEKSNLDYTRYADDITISGNKKSMPKLKKIKSIIRQNGFTVNINKIRFTSKHKKQTVTGLTVNDGVYVDKRIIKEINQELYYCIKYGYKSHLEFKFKDSKIKSNYKDWLYGKICFVYSVEKEKGQQLLKKFNMIDWNI

SEQ ID NO: 2662 - protein, 364 aa, Flavobacterium sp.
  source 1..364: note = Related to MUFX01000009.1
MSTSLYKTVELINNSDHSLEYKTLLINYSQDLTSKNLPIIFDAFHLAVMIGIQPYRIINLIRDRDALYHTYKIRKKSGGYRWIMSPQNDLKNIQNWIKTNILEKVEIHESANGFTKDKSIITNANEHIGKEIVLNIDLYRFFDTITEKRVYGLFKMLGYTEKLSYDLARLMCVNAPKKYWKEIKKENKLNKKIIKLKSPVLPQGAPTSPIISNLLAKNLDISIFEYCNKSNLSYTRYADDMTISGDKKDLPNLKLIKGIIRKNGFTVNIKKIKYISNHKKQTVTGITVNNGLFVDKKILKEVNQELYYCIKFGYINHLKFKFQNSKIKSNYKDWLYGKICFIYSVENKTGEELFKKFNLIDWSI

SEQ ID NO: 2663 - protein, 365 aa, unidentified
  source 1..365: note = Related to QSQY01000003.1; note = Parabacteroides sp.
MSSPLLHILEQVENSNHSTEYKRLIKDYSIRLASRNLPIIFDIYHLSYLIGIQPYRMINMIKDRHSLYNVYKIRKKAGGYRWIMSPIDDLKRVQYWIKLNILDNINICDSACAFIKGKSIRDNAQKHVGKELILNVDLYRFFDSITEKRIYGVFKSLGYTEKLSYDLAQLVTAQPPKAYWKEIKKENRFKKKHIKSTPAILPQGAPTSPSLSNIISIKMDEIFDKYANECKISYSRYADDLTFSGERGSIISLLAVKKIIRQQGFTINLKKTKYLRNSGKQSVTGITVNNGLFVDKSVINMIKQELYYCLKFGYKAHLKYKQAKGESIKSGYKEWLFGKICFIYSIDKNRGVNFFKIYNQINWDI

SEQ ID NO: 2664 - protein, 305 aa, unidentified
  source 1..305: note = Proteobacteria bacterium; note = Related to SEDT01001166.1
MVNDTANYYKTFKLRKKTGGYRWISVPNEELKLLHRKLNLMIFMRIRPSESVHSFVKKSSIRTNAEVHVNAKTCLNVDLYRFYESITDKRVFGYLCKLGYHPNVSYVIAALVTIQLPKAFWQEVRKENKFRSKYIRRKPKARVLPQGSPCSPFLSNLVLTHLDFRIEQACKGLGFSYSRYADDITISSKGDNFFALTTLKKIIRSEGFTINIQKISFRRSSSRIQVTGITVNNGIFVNKSLYKKVVSHLYYCKKYGVRDHLEKVKLTNKSNYKDWLLGNILFINSVEPDKAKKLFTEFNQIDFLL

SEQ ID NO: 2665 - protein, 366 aa, unidentified
  source 1..366: note = Bacteroidia bacterium; note = Related to JAEUTP010000018.1
MTSPLDNILDKAKAEEHSPEYISDITAYAKNLIDKKLPVIFSRTNLALSIGIPRSHLEFLLANREMKYKFYKLRKKHGGYRWISSPEKELKYIQGWIKVNIFDNIEIHPAACGFSKGTSIKKNATAHQKQDLILNIDLYRFFDSITENRVFGILNWLGYHKNIAIDMAKLLCYQPTDKYFEEVAKEGIFSKSILDQKPSILPQGSPASPVISNLLSYKLDVRLSKMASKLGINYSRYADDITFSGERKNMVSLNTVKKIITEEGFYINKDKIKYLAQNRRQDVTGIVVNKGLKINSKYKKKVLTEIYFSEKYGVKNHLGYLIDRKGAEKKANYKDHLLGKIYFIYSVEPEVGKKMLEKYDQIKWEI

SEQ ID NO: 2666 - protein, 366 aa, unidentified
  source 1..366: note = Related to NZ_LBIQ01000028.1; note = Mangrovimonas sp.
MPSQLDNIKNSLDEANASKDFKIEIINYSQNLEKKGLPIIFSLPDLSFKIGLPFHVIQEILKNKSNHYKTFKIQKKTGGHRWITSPDEQLKRIQRWIYENILKNVPEHDCSFGFVNERSIIDNAKKHVNQDTILNIDLYRFFDSIEQKRVAGVFKHLGYQPNLAYSMAELLTAKMSRAYWKEIEDEKVLSDTFIEECPQILPQGSPASPRIANFIAHSLDTRMAKLAKKLDVNYSRYADDLSFSGDYKKLPSIKTLRKIIMNEGFFLNEKKVKYFKRSHRQIVTGVVVNDRISVPREFKEKLRTELYHCIKKGPAAHLNWLMSNKDFKIKTNYRDHLLGKACFVYAVEPETGKDFLEMYNQIKWEL

SEQ ID NO: 2667 - protein, 349 aa, unidentified
  source 1..349: note = Related to SUYI01000044.1; note = Prevotella sp.
MTMTDTWESLFKERAVEEKHSEEYIAQCIEYAGKLHERNLPVIFDFVHLAYYLGIYSDKLRGIVANAETHYRAYEIKKKTGGTREIEAPDEILKDVQRWIYANILCRDKSVQSCVHGFVPRLSEADKVRGVLSNAVPHSGHDWLINLDLKNFFPTVTLTMVRDYYDSLGYEEEVSKTLTALCTYKSRLPQGAPTSPMLSNIIATKMDIALLEYCKKYGITYTRYADDLTFSANLDVEVPPLKDLYAIVFKHGFIVNRQKTKIRGRGYKKEVTGLTVTEGVHVPKKYRKEVWRELYFCKKFGVYEHYHNMGTNKGLYKDWLRGRIMFIRQIDPACGNKMLEKFNELNWLV

SEQ ID NO: 2668 - protein, 347 aa, unidentified
  source 1..347: note = Related to JAGCRH010000046.1; note = Prevotella sp.
MTETWESLFKEQALEEKHSDEYIVQCLEYAGKLHERNMPVIFDFLHLASYLKCLAKQLQGIVANVESHYQEYDIKKKSGGKRRIEAPDYLLKNVQRWIYVNILCRDKSLQNCVHGFVPVLTENDRARGILTNAMPHSGHDWIINLDLKNFFHAVTLDMVKDYFDSLGYEEEVTKTLTALCTLKSRLPQGAPTSPMLSNLIAAKMDKAMLEYCKERGITYTRYADDLTFSANLDVEMPPLKELYAIVFKHGFIVNRQKTKVRGRGYKKEVTGLTVTDGVHVPKKYRKEVWRELYFCKRFGVYEHYHNMGTDKGLYKDWLRGRIMFIRQIDPACGNKMLEQFNELNWLV

SEQ ID NO: 2669 - protein, 347 aa, unidentified
  source 1..347: note = Related to JAGCCF010000043.1; note = Paludibacteraceae bacterium
MTETWESLFKERALEEGRSEEFISQCIEYAGKLHEKNLPVIFDFVHLAYYLGFYSEKLQGIVANVEGHYRTYHIRKKSGGTRMIEAPDAMLKDVQHWIYGNILCRDKSIKDCVHGFVPALTEKDKVRGILSNAAPHSGHEWLINLDLKDFFHTVKLDMVKAYFDSLGYVEEVSKTLTALCTMKSRLPQGAPTSPMLSNLIATKMDEEMMAYCGKRGITYTRYADDLTFSANYDVEMPLVKELYAIIFRNGFIVNRKKTKIRYSGYKKEVTGLTVTNGVHVPKKYRKEVWRELYFCKKFGVYEHYHQMDTDKGLYKAWLRGRIMFIRQIDPACGNKMLEQFNELNWLV

SEQ ID NO: 2670 - protein, 347 aa, unidentified
  source 1..347: note = Related to NZ_RBXN01000012.1; note = Coprobacter fastidiosus
MTDTWESLFKECAVENNHTENYLKECFEYAGSLHQRNLPVIFDFVHLAMYFECCAETLKGMVANVEKHYTEYKIRKKSGGDRLIEAPDFLLKNMQRWIYINILCKDLSINDCVHGFIPAFKNRDKVRGILTNAAPHAGHDWLINVDLKNFFHTVELDNVNNYFHSLGYEDEVVKTLTALCTYKSRLPQGAPTSPMLSNIIASRMDEMMLEYCKKRGIVYTRYADDLTFSADYDVKIPALEDIYKIVYLNGFKVNRMKTKVRYKGCKQEVTGLTVTNGVHVSQKYKKEILRELHFCKKFGVYEHYQHLKTTKGLYKDWLRGKIMFVRQIDPACGNKMLEQFNELNWLV

SEQ ID NO: 2671 - protein, 346 aa, unidentified
  source 1..346: note = Related to MKTD01000020.1; note = Bacteroidia bacterium 43-41
MEETWESLFKKQAVKKKHSDEYINECMQYAFHLHEKNLPVIFDINHLSEYWNLDIDLIKSIIECPPRYYAEYDIRKKSGGTRHLCAPHQVLKYIQRWIYHNILLKDITISEHVHGFIPKDQFDSKRTILSNAQAHEKCKWLINMDLKDFFNTIKQERVKKYFLSIGYTEDICELLAKLCTLHYRLPQGAPTSPTLSNLIAREMDKELECLCAKNHWCYTRYADDLTFSGIYIDETPSINELEKIIIQNGFLVNRQKTKFRLRGNCQMVTGLTVTHGVFVPKKYRKEVWKELYCCKKFTPYAHCQYRYPDKGFYKDWLKGRIMFIRSIDPACGNKMLDAFNQLKWVL

SEQ ID NO: 2672 - protein, 346 aa, unidentified
  source 1..346: note = Related to VZAS01000054.1; note = Prevotella copri
MEQTWESLFSEQAGIEGHSQQYISECLAYAGILHSHNVPVIFDKCHFFSFFPDIKKGRMEMFLLNLCCYKNYSIKKKAGGVRMISAPYSDLKRVQRWVYENILLKDLYSVSPCAEGFMPKDKDDIRNIVTNARRHARSKWLINVDIQNFFDSIKYDSVWEYFSKLGYEKEVADVLAKICTYQFRLPQGAPTSPMLSNLIVRSMDDAFVELASKCKCFYSRYADDITLSGNSDSIMPSMRDIYQIVYAHHFRPNKKKTKISFSCDRQMVTGLTITDGVHVPKKYRKDVWKELYCCKKFGVASHIAYRHPDQGMYRYWLLGRIMFIKSVEPECGEKMLQEFNSINWGI

SEQ ID NO: 2673 - protein, 305 aa, unidentified
  source 1..305: note = Bacteroidaceae bacterium; note = Related to JAGBLT010001022.1
MKDTWESLFKKEAKKQGHSDAFIQECIGYAAKLHANNVPVIFDFKHLSAIFDMESRDLFFMCKHLGQQYTTYSIKKKSDPKAIRLLTAPGWQLKKIQLCILRNILMRDNSVSEHAHGFVRKKSIVTNAKAHEGARWILCMDLKDFFGTVRKGKVYDYFESLGYEKSVVETLATLCTYENHLPQGAPTSPCLSNLMAKGMDEEIEAYSEQNGFVYTRYADDITISSKTDIKPEKNTINAIVRKHGFRVNHDKTKLRHNGQRMEVTGLTVGRGVHVPKAYKKALFRELYFCRTQGPKEHSEMVYKGK

SEQ ID NO: 2674 - protein, 304 aa, unidentified
  source 1..304: note = Related to NZ_FUFJ01000030.1; note = Porphyromonas gingivalis
MEHLLDYYWTGQFPRANACCQFDWAYRDYRIQKKTGGFREISAPNPTLKWCQHWIQHNILEHVVNRLPSSVHGFVQNRSIQTNALPHVNSEWIINIDLKDYFDSIFQKKVLDFFLQLGYEDSVSEFLSNVCTKFSCVTYQRALPQGAPTSPLLANFLTINLDKDLERLAQELDMRYTRYADDITFSGLQKTCPVTPRDIENIIYEHGFRPNKSKTRIRHKGSRMMVTGLTVGNGVHVPKEYRKQVLRELHFAKKYGPENHCRKVRNEKGYFREWLLGRIMFVRSIDKEAGARMLEIFNEINWMM

SEQ ID NO: 2675 - protein, 316 aa, unidentified
  source 1..316: note = Related to WSNW01000001.1; note = Coprobacillus cateniformis
MEDLGNEFIKKLPVILDIYHLSNLVGIKYNLLKDILSNKDKYYHTFYISKKMGGKRKIEAPNEVLALLQKYIKNEILDNILVSEYAFGFVKEKNILLNAKRHLNQEMILNIDLENFFPTIKEKRVFYIFYKLCKYDYHISKVLTNLVTLQGRLPQGACTSPVISNIAAYKLDKRLSTYAKKLNLIYTRYADDITFSGSKKIINNFFLKNIQNIIKECGFVINDKKTRFCSQYGRQEVTGLIINDNYIHINKKYIREIRQELYYINKFGISNHRNNKDFSNMYYREHLLGKILFVKSIHQDIGLSFFNQFQNIDWEK

SEQ ID NO: 2676 - protein, 348 aa, unidentified
  source 1..348: note = Firmicutes bacterium; note = Related to DPQP01000004.1
MSKKNIYEQYKAKVSNNENYTDEKKKKYLEQIEILKAKNSEIILNTYHFSNLVGIKWNTLKKIIDDPDKFYYNFQISKKTGGKRTINVPNNSLELCQKYIKEKILDNVKLHSAAHGFVNNKSIITNAKVHVNSEMILNIDLKNFFPSISRKKVFYIFNKICGYDNSLSHCLTKLVMYKNGLPQGACTSPIISNIVTFKLDLRLKKLSDKLGLNYSRYADDITFSGNKNVINSKFLDFVKTIINECGYQINDKKTRFESKCGRQEVTGLIVNNGKVSIPKQYIQNLRKDLYYIKKYGIEEHKKRNNIYNAFYQEHIKGQIMFVYSVSKNKGIKLLKKYNLIFDDTKYGN

SEQ ID NO: 2677 - protein, 354 aa, unidentified
  source 1..354: note = Tenericutes bacterium; note = Related to CP074573.1
MENKNLYRKKIENSDISFNEKQKLLSNLGNIKDDYPIILNGYHISNKVGIKWNDYLKLLKNTNKYYHVYYMAKKSGGRRKITIPDQILMDIQYFIKNNILENIKIDESAFGFRKQKSILANATYHREGEKVLIMDIENFFPSIHKGRVYYVFNKICGYSREVSYDLTRLVTYNNGLPQGAPTSPIISNIVAYKLDLRLKGLSYVIGIKYSRYADDLTFSGAENKINDKLLYTVSNIIEDEGFKLNLKKIRFYGKNSTKIINGLVINNGYVTIQKRYIDKIKQELYYIRKFGLESHLNYVGFKNKHYAEHLKGKILYVYSIDKEKGKQLFSLYNELNIENKPNLVRGGFDEMPVL

SEQ ID NO: 2678 - protein, 361 aa, unidentified
  source 1..361: note = Candidatus Izimaplasma sp. ZiA1; note = Related to NZ_NQYJ01000016.1
MFTRLRMFLMSLLEKKKKYTKSIKVTQIKNENVTPLKKHTPLKYDLPAISNALHLSNKIGIKWEVYKDIARHPENHYHVFHIKKKNGGFRTIAAPNEELSMIQNYINENILFAYKIHKSAFGYVKGKSIIDVANHHLKSENFLSLDLENFFPSIGAERLYYYFGKLGGYDKSISDNLVRFCMYGTGIPQGACTSPQISNIIAYKLDLRLGELCQSKGLKYSRYVDDLTFSGETEHINDKLLFTVQKIIADEGFKLNSKKTRFGNNRNGFIITGLMIRNNSICVPSSYIKKIKNELYYINKYGLLDHKKREKIENSNYLEHIKGKINYVMHVDESKGLLVKEQFDKTILKINSMESDMRGLL

SEQ ID NO: 2679 - protein, 336 aa, unidentified
  source 1..336: note = Related to KE150412.1; note = Paenibacillus sp.
MDLNLLESSLTQKGYGKRYKKICINYAKALNEQGLPVIFDNNHLSLLMGIESKILGHYIMNSNKFYKEYQIAKSNGSLRTISTPSYNMKTIQRWVLDNVLSSFAIHSNAFGFVKGRNIKDNALLHTKKKVVLNIDIKNFFPTIKFDRIFYMFYHHGYTKELSYTLAALTTYNGSLPQGAPTSPYISNILCQRMDKRLLALAKKMNADYSRYADDITMSGDENVRQYIETIKSIIINEGFDINYKKLRLQTDNNMQEVTGLIVNEDVKVKRKYKKRLEQHIYYCKKFGVYSHLKKIESESKSYFKEYLYGIANFIKMIEPDEGLEFLKKLDEINWGN

SEQ ID NO: 2680 - protein, 331 aa, unidentified
  source 1..331: note = Related to NZ_MKQM01000043.1; note = Paenibacillus odorifer
MEAMLIKKGYGQRYKETCMQYAQELADHGLPVIFDNKHLSLLMGIESNILGYYIISSNKFYKEHQIAKSNGSLRTISTPSYNMKTIQRWILDNILSSFAIHSNAYGFVKGRNIKDNAIIHTKKKLVLNIDIKNFFPSIKFERVFYMFYHNGYTKEISYSLAALTTFNGALPQGAPSSPSIANIICQRMDKRLLALAVKMNADYSRYADDITISGDENIRKYIETIKSIIINEGFDINYRKLRLQTNKNMQEVTGLIVNEDVKVKRKYKKRLEQHIYYCKKFGVYSHLKKNESESKSYFKEYLYGMANFIKMIEPDEGMEFLEKLDEINWGS

SEQ ID NO: 2681 - protein, 338 aa, Bacillus sp.
  source 1..338: note = Related to NPDG01000102.1
MDYIAALQEALIQKGYGNKYQKLCVDYASNLLNNRLPVIFDKKHLALLMGVNYQTLTYYLINTDNFYKEHKIIKSNGGYRTISAPSFNLKAIQRWVLDNILYKYQVSDNANGFVKGKSIKNNAESHIGKEIILNIDIKNFFPSITFQQVFYLFYNSGYTKEMSFTFAKLLTFKGRLPQGSPASPYLANILCKKLDSRLNGFAIKIGASYSRYADDITFSGDADIYRHISFIRNIIESENFKINEKKLRVQKSNSKQEVTGLIISNGEVKVKRNYKKKLEQHIYYCKKFGVFNHLKYTGASDKSYFKEYLYGMASYVSMIEPDTGKSYLNSLNEIIWDY

SEQ ID NO: 2682 - protein, 337 aa, unidentified
  source 1..337: note = Related to NZ_JAERMG010000001.1; note = Priestia flexa
MDYINSLREALIQAGYGRRYQKLCLEYADNLLNNQLPVIFDKKHLSLLMGVEPSILGYYIFNSDNFYKEYKIPKSNGDLRVLSAPSFNLKSIQRWILENILYNYQVSNNANGFVIGKSIRDNAEPHIGKEIVINIDIKDFFPSINFERIFYLFYNSGYTKEISYTFAKLLTYNKLLPQGSPASPYLANIICNRLDKRLSGLASKIKASYTRYADDITFSGEANIVNYIKTLRNIIESENFSINENKLRIQKQNSMQEVTGLTVNNGVKVKRKYKKNLEQHIYYCKKYGVYSHLEHTGAKDKSYFKEYLYGMASYIKMIEPDVGEYFLRNLDEINWDY

SEQ ID NO: 2683 - protein, 337 aa, unidentified
  source 1..337: note = Related to JALMMK010000003.1; note = Clostridioides difficile
MDYLSRLEKKLIELDYDNNYKSICIKYAKKLLDNEALVVFDKKHLSLLMGIDLKILNYYIVNTDEFYNEKKIPKKNGRYRIISMPSYNLKRIQRWILDNILYKLRVHSNATGFIRNKSIVDNASCHVNKDVVVNIDISDFFPSIDFDKVFYMFYNLGYTKELCYALSKLLTYKGILPQGAPSSPYIANVIMINIDLRLDGLTKKINSNYTRYADDITISGNKYIVLQLPFIKTIIESQGFKVNLEKLKIQYRKSRQEVTGLVVNDRISVKREFKKNLRQHIYYCKRFGVYEHLKYTGNEEKSFYKEYLYGHAYFIKMVEPECGERFIKELDSINWDS

SEQ ID NO: 2684 - protein, 337 aa, unidentified
  source 1..337: note = Related to NZ_NOJY02000076.1; note = Romboutsia sp.
MDYLNRLEKKLNELEYDDYYKSACITYAEKLIDNEVPVVFDKKHLSLLMGINLATLNYYLVNTDEFYNEIKIPKKNGRYRVISMPSYNLKKIQRWVLDNILYNIKVHNKATGFVRNRSIVDNAKYHVKKDVVVNIDISNFFPSIDFNKVFYMFYNLGYTKELCYVLSKLLTYKDTLPQGAPSSPYIANIIMMNIDLRLDGLAKKINSDYSRYADDITMSGNRDIVVHVPFIKSIIESQGFKVNLDKLKIQYRKSRQEVTGLVVNDRLSVKKELKKSLRQHIYFCKKFGVYGHLKYTGNEGKSFYKEYLYGHAYFIKMVEYECGKRFINELDSINWNS

SEQ ID NO: 2685 - protein, 339 aa, Bacillus sp.
  source 1..339: note = Related to JAIUKX010000001.1
MDYLSKLELKLTDNGYSKKYKELCISYASALQNRNLPVIFDIKHLSKLMGVRYSVLFYYITKSEEFYKEFKIPKKMGGIRAIYAPSLNLKKIQRWILENILTYFDVDDSAKGFKRSMGIVENAAIHTNKSLVYNIDIRNFFPSISYEKIYFLFYNAGYSSEVSFAISRLVSYQGYLPQGSPCSPILSNIVCRKMDEEMKRLAFKVGASYSRYADDMTISTDDIRLFVSKKEAFKEIIERNGFILNNKKERMQYYNQPQFVTGLLVNEGVKIRRSFKKEIEKHIYFCEKYGIFNHLKQIGMEEKSFYKEYLYGKVNFIRSVEPETGKYFLERLNKLDWTY

SEQ ID NO: 2686 - protein, 339 aa, Bacillus sp.
  source 1..339: note = Related to NZ_HG428741.1
MNYLDELKVKLIAKGFSDKYIKRCTQYAENLYNENFPVIFDVKHLSMLMGINYNTLFYYIINTETFYKEFKIPKKSGDYRIIEAPSLNLKKIQKWILDNILLHFPVNACATGFKKQTSIVDNAKVHVNKELVYTIDIKDFFPSISFKDVYFLFYNVGYSSQISYAFACLTTHCGKLPQGSPCSPTISNILCNKMDESMKVMANEISANYSRYADDMTISTNDIPLFLSKRKAFKQIVEFYGFNLNNKKERMQFKNQAQFVTGLLVNNGVQVKRAFKKEVEQQIYYCEKYGIYGHLRAKGMAEKSFFKEYIYGKVYFIKSVEPEVADQFLERLNRLHWSY

SEQ ID NO: 2687 - protein, 339 aa, unidentified
  source 1..339: note = Related to NZ_CP038015.1; note = Paenisporosarcina antarctica
MDYVDELKMKMINRGFSTKYIDKCTTYAENLYNKNSPIIFDIKHLSKIMGISYPILFHYIYNNQKFYKEFKIPKKSGSYRVIDAPSLNLKKIQRWILDNILVNFSISKYAMGFKKQVNIVENAQIHTNKELVYNIDIKDFFPSISFENVYFIFYNIGYSSEVSYAFAKLMTYKGYLPQGSPCSPIISNILCINLDESMNSLSKNIGANYSRYADDMTISTNDIPTFLVKKGAFKNIIEFYGFKLNDKKERMQYKNHPQFVTGLLVNNKVRVRRVFKKEVEQQIYYCEKYGIFNHLKELGLEDRSFFKEYIYGKVNFIKSVEPEVAERFLERLNRLKWSY

SEQ ID NO: 2688 - protein, 340 aa, unidentified
  source 1..340: note = Related to NZ_CP009286.1; note = Paenibacillus stellifer
MQNTFLDELKQKLYDNGFDDAYIGLCLDYSKRLIANRLPVIFDKIHLSMLFGMEVKELTVLVKSIENQYTIRNIPKKNGDTRELYIPSLKLKEIQRWILDEILYNIKVSPYCTGFMKEKSILENARIHENKACVMNLDIRNFFPSIRFESIYRVFYYYGYTSEVSYYLARLCTVHNFLPQGAPTSPYLSNIVCLRLDKRLSSLASKYDANYSRYADDITLSGTGSSIVPRLPLIKIILDSEGFKINYKKVRVQKQQERQIVTGLVVNNKARVPREVERELRQQIYYCKKFGVNEHLKRKKKNKLSGFKEHLYGLAMFIKMIDNRKGERYVSDLNEISWDY

SEQ ID NO: 2689 - protein, 340 aa, unidentified
  source 1..340: note = Related to NZ_MPTF01000003.1; note = Paenibacillus odorifer
MKEYEYISRLKAALIQENYDDDYIKLCNDYSYRLLENSLPVIFDKEHLSRLLGLEERYFFQLFMMADGFYKEVQIPKKKLGQFRNISVPTEVLKYVQRWILDNVLYNIRVSEATTGFVKGKSIVDNAKKHVRKECVINMDLKDFFPTITYDSVFRLLKYYGYTNEIAFILSKLCTFRDVLPQGAPTSPFISNIVCYKLDIRFIKLCNKIGADYSRYADDLTISGPRYIVGYLNLFSDIIVEEGFQINESKTRIQYPNNRQEVTGLIVNDKISVPKETKKYLRQQIFYCKKYGVNSHLRKINIQKSNYKEHLYGIAFFIKMVELELGEKFLEQLNEIEWDY

SEQ ID NO: 2690 - protein, 300 aa, unidentified
  source 1..300: note = Related to NZ_MDER01000051.1; note = Paenibacillus sp.
VIFDKNHFAKLIGLKKEYIFQILMVTEMFYKEISIPKKRLGEYRDISIPAQGLKYIQRWILDNILYNIPVSEVCTGFVKEKSIIDNAKKHINKDCVINMDIKDFFPSITYNDVFFIFKYYGYTNEVSFLLSKLCSYKGSLPQGAPTSPYISNIISYKLDVRFMLLAKKLKADYSRYADDITISGNKYLVKYLKVFKNILIEEGFKVNERKTRIQYSNKRQEVTGIIVNNKLSVPKETKQYLRQQIYYCKRFGVNSHLARIGIQKSNYKEHLYGMAFFIKMIQQEEGENMLNNLNDIDWDY

SEQ ID NO: 2691 - protein, 338 aa, unidentified
  source 1..338: note = Related to SADX01000003.1; note = Lysinibacillus sp.
MSSYIESLVSGLREKGYRDQYINLCVEYCERLINNNLPVIFDKDHLALVMGIRDEYLAKLFMFPEKFYKQARIPKKKKGEYREISIPYQTLKHLQRWILENILYRLKVSDSSKGFVPKLSIVENANKHLQKECVINIDIKDFFPSIQFNEIFNIFYYYGYTKEISFILARLCTYEGRLPQGSPASPYLSNLVNVKLDRRFENFCKKIGADYTRYADDITISGPKYITKYIHQLKEIITDEGYNLNEEKTRILFKHQRQEVTGLIVNDVLGVPIKMKKYLRQQIHYCKKFGVSNHLMKIGNQRSNFKEHLFGLAYYIKMVEKEKGEKFIEDLNTLNWDY

SEQ ID NO: 2692 - protein, 338 aa, Bacillus sp.
  source 1..338: note = Related to NUBN01000013.1; note = Bacillus wiedmannii
MDTYTHRLKYEMNLHNYDENYIKLCCDYSKRLETNNLPVIFDKVHFSLLLGIEENYLAKLFMITEHFYKLARIPKRKPGMYREILVPFKNLKEIQRWILHNILYNIDVSSATTGFKPDSSILENAKPHVNKPCIIKLDIKDFFPSIGFDQVYRIFAYYGYTNEVSYLLAKLCTYKGYLPQGSPTSPYISNIICLKLDKRFKELCKTLNADFTRYADDITISGDSFIAKYIDTFKSIIESEGFVVNEDKLKVRYSNERQIVTGIIVNTKLSIPRETKKSLRQQIYYCRKYGVYNHMLRTNLDRANYKDYLYGLAYFIKMVEKDVGQKFIDDLNTIYWGY

SEQ ID NO: 2693 - protein, 337 aa, unidentified
  source 1..337: note = Related to NZ_CP053893.1; note = Clostridium beijerinckii
MEDYINRLKEEIELREIEESYGQLCIEYAERLIENNLPVIFDREHIALLLGINYDYVNKIMLFTDKFYKVYKMKKKNGDYREISIPNVRLRYIQRWLLDNILYKISVSEHVTGFVPKKSIVDNAIKHVNKELVLAMDIKEFFPSVKFEKIFNIFYYYGYTKEVSYCLARICTLDGSLPQGAPTSPYLANIVCKRMDMRIESLCGKINAIFTRYADDITISGKRNIIEYLSLMQNIIKDEGFEINNKKTRAMYSNRQQRITGLIVNEKVNVPKNKIKYLRQQIFYIKKFGVTRHLEKNGYCYGNLKEHLYGLAYFIKMVNEEKGIKFIEELDGINWES

SEQ ID NO: 2694 - protein, 337 aa, unidentified
  source 1..337: note = Proposed Desnuesiella massiliensis; note = Related to NZ_LN879457.1
MSDYLYKLKEALNFEKVDIKYSELCIEYASRLINNNMPVIYDKKHFSLLLGIEQQYINKLVLCTDRFYKKFSIRKKNGGDRIISIPNIRLRCIQRWILDNIIYNIRVSENVTGFIPNKSIVDNARAHVDSDAILALDIKDFFPSISFDKIFRLFNYYGYTTEISYCLARICTLNNTLPQGAPTSPYLANIVCKKMDKRISSLSKKIGAKYTRYADDITISGKKNITSYSKLIKDIIRDEGFLVNNEKTRVMYRNRQQRVTGLIVNKKITVPKEKIRYLRQQIYYINKYGVVGHREKSKVKHRNIKEHLYGLAYFIKMVDEIKGEKFLNDLNKINWES

SEQ ID NO: 2695 - protein, 337 aa, unidentified
  source 1..337: note = Related to JABSWM010000001.1; note = Clostridium beijerinckii
MENHIEKFIDKLKVMQYSDDYINLCIEYAERLTDNNLPIIFDIEHFSFLVGLEKEYINYIIHKKKHFYIEFTIKKRKGGNRLLSIPSKKLKYIQRWILDEILYKIPVNEHAKGYIPNKSIVDNAKPHVKKKCIIKLDIKDFFDNIDYNRVFRIFYYYGYTKNMSYKLAELCTYENKLPQGAPTSPYISNIVCLKMDKRFSKLCNKFNATYTRYADDITISGDNSITKYFKAYVRIIESEGFEVNAEKVISIKGNRTKRVTGIVVNEKLSVGREMKRKLRQQIYYCKKYGVRDHLKKIECEKSFYKEHLYGIAYYIKSVEPIDGEKFLEELDEIMWEY

SEQ ID NO: 2696 - protein, 344 aa, unidentified
  source 1..344: note = Related to NZ_CP017603.1; note = Clostridium formicaceticum
MECYRMDYIERLREQLIKQGYGKRYIYLCEQYCTRLLQNGLPVIFDNIHFSLLLGMTTQDLGKMIFLTDSLYNSISIPKKSGGKREISIPTVNLKYVQRWILDNILYNIRVSSQATGFVKGLSIVDNARPHVNKECVITIDIENFFPTISFETIFRLFYYYGYTKEMSYVLAKLCTYEGKLPQGAPTSPYLSNIVSLKLDKRFNSLVNKLSDLNASYSRYADDLTVSGDKKIVKYVPLFKEIIQDERFIVNEKKFRVQNKPDRQMVTGIIVNEKISVPIQTKKYIRQQIYYCKKFGVDRHLEHIKSIRSNYKEYLYGIAYFIKMVENDYGTSLLEELNTIVWDY

SEQ ID NO: 2697 - protein, 338 aa, unidentified
  source 1..338: note = Related to CP013121.1; note = Fusobacterium nucleatum
MDEYIKKLKLLLENSDYEEEYKRKCIEYAERLLLNGLPVIYDLEHLILVLGIKKKILTKMIFAYHNFYSTVEIPKKSGGSRKLQIPSVELKYIQRWILDNILKKIKISKHAIGFCNEKSIVDNAKIHIGNKCILNMDIKDFFPSVNFEMVFRIFIYYGYTKELSFIFTRLCTYDGFLPQGSPASPYISNIVSLKIDKRLSRLAEKYHANYSRYADDITFSSNSSMKKLPEIIQKILLEEGFMVNKKKTRFQYFYQRQEVTGLIVNNGRVRVKKSYKKELYQTIYYCQKFGVNNHLEKINCYKNFYKEYLYGKAYFINMVEPEEGKKIFKLLEEIQWDY

SEQ ID NO: 2698 - protein, 338 aa, unidentified
  source 1..338: note = Related to JABXYS010000002.1; note = Peptostreptococcaceae bacterium oral taxon 081
MENYIYKLKILLKKSGYGKHYSEKCVEYANRLIENNLPVIFDIQHFSLVSGAPKELIGKMLFADSKFYSLALIPKKSGGVRELHIPSAELKYLQRWILDNILSRIHVSQFAMGFCNNKSIVDNAKMHIGNECILNMDIKDFFHSITFKMVFRIFAYYGYTKELSFVFAKLCTYEDVLPQGSPASPCISNIVSLRIDKRLSLIAEKYQACYSRYADDITFSGNRGIKKLIEITSNVLEEEGFSLNNKKTRMQFPHQRQEVTGLIINGGMVRVNKKYKRDLYQACYYCKKFGVDSHLKKIKCDKSFYKEHLYGKAYFVNMVEPDEGKKLFNLLDKIHWDY

SEQ ID NO: 2699 - protein, 338 aa, unidentified
  source 1..338: note = Related to NZ_JAHLDH010000001.1; note = Clostridium algidicarnis
MENYLESLKIEITEQGYDEYYTTKCIEYAERLLSNGLPVIFDTDHLSLVTGAPKQLILKMIFANSCFYSEARLPKKSGGIRVLNIPSIELKYVQRWILDNILKKINVSSYATGFCDNKSIVDNAKVHIGRECILNMDIKDFFPTITFKMIFRIFVYYGYTKEVSFTLARLCTFENFLPQGSPASPYLSNIVSLKIDKRLSLLAKKYKANYSRYADDITFSGNHGIKKMSSIVSEILEDEGFKVNDGKTRLQYSYQRQEVTGLVINNGKVRVNKHYKRELYQILYYCIKFGVNSHLQKINSTKTFYKEHLYGKAYFVNMVEPDEGRKLFDLLECIQWDY

SEQ ID NO: 2700 - protein, 341 aa, unidentified
  source 1..341: note = Clostridia bacterium; note = Related to JAFUNX010000099.1
MNKEEYLQELKNGLAYQGYDSRYIQACFEYAQNLLIHGLPVVFDVHHLSLLLGMTTKQLNAYIFGSGKRLYSTKHISKKDGGVRVLSIPCETLKYIQRWILDNILKRMYISECCKGFVDDCSILDNASCHLGAEVILNMDIKDFFPSISLLQVYRVFRYYGYTQELSYVMAKLCTYRDQLPQGSPASPYLSNIIALKIDKRLMALAESYGAHYTRYADDITISGFGCLEKMIPIISSVISEEGFVVNSKKTRVARKGQRQEVTGLIINSGKACVPKEYKRKIFQEIYYCQKFGVTNHQEHIGDDHRYYKEHLYGKAYYVHMIEPHIGKKMLSELDKVNWEV

SEQ ID NO: 2701 - protein, 341 aa, unidentified
  source 1..341: note = Clostridiales bacterium; note = Related to CP042469.1
MDKEKYISELRIQLESMEQSQKDIDSCISYAIRLIDSSLPVIFDKRHLSLLLGIELEELTTILATLEENYYNEMSIPKKSEGYRTLNVPAMKLKMIQRWILDNILEHIPVSDHVTGFCKERSIVTNAKKHIGKQCVISFDIKDFFPTIDIESIFMVFYYYGYTKEISYALARLCTYDGYLPQGSPASPYISNILCLKLDKRLSLLAEKYVADYTRYADDITFSGNYGLSNIINIVKNIIQEEGFTVNERKIRVKYKHQRQEVTGLIVSDNKVSVSKLYKRKLWQEIYYCQKYGVSSHLEHINCKKSFFKEHIYGKVYFIYMVEPEEGRKLLIALDKIAWDY

SEQ ID NO: 2702 - protein, 341 aa, unidentified
  source 1..341: note = Related to NZ_CP065321.1; note = Acutalibacter muris
MDKERYLKKLEEALSESSSSIPESLACIRYASNLLTFDFPVIFDRTHLAHLLGIKPSDLSALIYSIDSYCYHEFHLAKKSGGMRVINIPSVDLKDIQRWILDNIISKMHISEFANGFCKGKSILTNALSHIDQECVINLDIKDFFPSVGIDRVFMLFKYYGYTKEVSFALAKLCTYRGILPQGSPASPAISNVICLKLDKRLSKLAESYNGVYSRYADDLTLSGTKNITQLIPTVIAIVEEEGFCVNAQKTHIAYAHERQKVTGLLVNEGKVRVSQKYKRRLRQEIYFCQKFGVSDHQKYCNENFQFFKEHLYGKAYFVSMVEPEVGNAFLEALDNIAWEY

SEQ ID NO: 2703 - protein, 341 aa, unidentified
  source 1..341: note = Related to JABMAY010000023.1; note = Dialister sp.
MDKIKYLASLRSAIIASGKSEKYSIVCCNYASSLLNSNLPVLFDNSHLARALGITPLDFGKLLYSIDDYCYHEIKIPKKNGGVRTLDIPSMDLKYIQCWILDNILNKMHVSDYANGFVKNRSILTNAQNHINSECVVNIDLKDFFPTVKFEQVFRIFKYYGYTKEVSYTLSKLCTYRGILPQGSPASPAITNIICLKLDKRLSALGQKHEATFSRYADDITFSGKKAIVHLLPYAINIIRDEGFAVNLDKTHTSFKHQRQEVTGLIVNGDKVHVSQKFKKRFRQEIYYCKKYGVQSHLKHINDHHAFYKEHMYGQAYFINMVEPSLGQELLRLLDSISWEY

SEQ ID NO: 2704 - protein, 341 aa, unidentified
  source 1..341: note = Related to JAHRFW010000235.1; note = Erysipelothrix sp.
MDKTNYLKEIEILLKNNDESNENISNVLKYAANLLNLDMPVIFDKSHLATLLGLSVSDFNHYVIGSNDSQYNTLMIPKKSGSFREISIPSVELKKMQRWILDNILYKIEVSEYATGFVRKKSIKDNAKCHLENNCVINLDLKNFFPTIHFDRVFKIFYYSGYTKEVSFLLSKICTYKSILPQGSPASPQISNIACLKLDYRLSKLSKCFRASFSRYADDLTFSGDYGITKIIDTVKKIVNDEGFEVNEKKIRIQFKHQKQNVTGLTVNDFKVRVSREYLRKFRQEIYFCQKFGIRDHLRFINSDRRYFRDYMYGKAYFINMIDVDEGKLLLNKLNQINWEV

SEQ ID NO: 2705 - protein, 340 aa, unidentified
  source 1..340: note = Related to PGZS01000061.1; note = Firmicutes bacterium HGW-Firmicutes-3
MNNNPYVKELYSVLSQKGEKQEDIDAACKYAENLIALNLPVVFNKEHFSLLVGRKYKEITTLMATLETNYYHLAYIKKKNGGERTLNIPAVSLRIIQRWILDNILKNMYISQYAMGFCKNKSIVTNAKYHLGKTCVINVDLKDFFPSITQKQIFNIFYYYGYTIDVSYMLSRLCTCEGRLPQGAPTSPCLSNIVCLKLDKRLSEVSKRFKAEYTRYADDITFSSNSDISNILPIVKEIIQDEGFQLNEKKTRILFKHQKQEVTGLLVNGNQIRVDKKYIKKFKQEIYYCKKYGVEDHLEHIDCKKHFYRDHMYGKAYFVKMVDEKVGKKLINELDSIDWE

SEQ ID NO: 2706 - protein, 341 aa, unidentified
  source 1..341: note = Related to JAJFDX010000002.1; note = Proposed Lachnoclostridium pacaense
MNNEGYLENLEKELIDSNEKVKDIEAAKKYAKNLLNLGLPVIFDKQHFALLVGRELSEITKMMAMIETNYYHEANIVKKSGKMRTLNIPAVSLRLVQKWILDNILYKIRVSQYCNGFCKKKSICTNAQNHLNQDCIVNMDMSDFFPSISQKQIFRIFYYYGYTVEVSYILARLCTYDGYLPQGAPTSPYLSNIACLKLDKRLAGLAKKYESTYSRYADDITFSGKCGIQKIIPVAEKIIQDEGFSLNVNKTRIAYYYQRQEVTGINVNGKKMHVDKRYVKGFCQEIYYCEKFGVHDHLQHIKCNKHFYKEHMYGKAYYINMVDKDLGRKLLSRLDNIDWDD

SEQ ID NO: 2707 - protein, 353 aa, unidentified
  source 1..353: note = Related to QUMM01000064.1; note = Lachnospiraceae bacterium OF09-6
MGNRCTETWRLYMKTEEYLNELRTVLVAADECEADIVAAEQYAENLMQLGMPVIFDLHHFAKLVGKEARDIGNMMMHQEDFFYRQVQIEKKHGGYRTLDIPAMNLRNIQKWILKNILYQISVSEHACGFCKKRSIVTNAERHVGKECVINVDIKDFFPSVHGDQIFKIFYYYGYTTEVSYLLSRLCTYRDYLPQGAPTSPYLSNIVCLKLDKRLSRLAKSYQAEYSRYADDITFSGNAGIKAMLPIVEGIVNEEGYLLNKDKTRIAYKHQRQEVTGLLVNGTTVRVSKQYLKKFSQEIYYCKKFGVRSHMEHIHCEKRFFRDHMYGKAYFIQMVDRDMGKRYFAELEQIDWES

SEQ ID NO: 2708 - protein, 337 aa, unidentified
  source 1..337: note = Related to QVIB01000063.1; note = Dorea longicatena
MNYIQKLQEKMRESEQSEQYIKTCSTYAQRLIDNGVPVVFDFSHLALLLGFKTADIAFYLFAEDDLFYKEIEIPKKRGGYRKIDIPSERLKCIQRWILDNILDNMEVHECCYGFCKGKSIYDNALLHVGKKCVLNMDLKDFFPSIKQKDVFNIFYKKGYTKKVSYYLSKLLTKNGELPQGSPASPMVSNIVAEHLDTRLSALAKRYCAEYSRYADDITFSGALNVKNMIPIITGIIEDEGFNINEKKTRYAYYYQRQEVTGLIVNKKVSIPKEYIKELKKEIYYCEKFGVTSHLERTNMHKSFYKEHLYGKAYFVNMIDKNMGQQILKHLDTIMWEY

SEQ ID NO: 2709 - protein, 337 aa, unidentified
  source 1..337: note = Related to JAGZKG010000016.1; note = Roseburia hominis
MGYVQKLKDKMIEQGADENYVELCVSYAQKLCSNSVPVIFDFKHLSLLLGYEPSELAFYLFAPEDSFYTQMKIPKKSGGMREIEIPSDKLKSIQRWILRNVLENIEVHEACYGFTKGKSIYDNALLHVGKECVLNMDLKDFFPSITQKDVFNIFYQKGYTKRVSYYLAKLLTKDGVLPQGSPASPKISNIVALHLDKRLSELAKCYRATYSRYADDLTFSGASNIKNMIPIINKIIHEETFLVNEKKTRYSYYFQKQEVTGLIVNKKVSVPKEYLKELNKEIYYCKKFGVSSHLKKTENHKSFFKEYMYGKAYFINMVDKELGQKILRELDTILWEY

SEQ ID NO: 2710 - protein, 337 aa, unidentified
  source 1..337: note = Related to WQOO01000018.1; note = Eubacterium ventriosum
MEYCQELQKMMREQEMDETYIELCTSYAKRLLKNDMPVIFDFKHLSMLLGIEPYEMAFYLFADEKLYYTEIQIPKKRGGVRIIDIPSERLKDIQKWILDNILSRYTVHECCYGFIRGKSIYDNALQHVNKRCVLNLDLKDFFPSITQEQIFKIFFSVGYTKKVSYYLAKMLTKNKKLPQGSPASPMLSNIVAKKLDSRLNGLAKKYGAVYSRYADDITFSGEGNIKNMIPIVEKTIQDEKFQVNKSKTRYSYYFQRQEVTGLIVNKKVSIPKEYIREINKEIYFCKKFGVSSHLEKIQNYKSFYKEHLYGKAYFIKMINKRKGNQILEQLDEIEWDY

SEQ ID NO: 2711 - protein, 338 aa, unidentified
  source 1..338: note = Related to JAAVHR010000078.1; note = Clostridiales bacterium
MIRIDLEKYKEFLSKKNIKKKNKELLIQYAERLTNNNLPIIWDIRHFSIITDIPYKRILSYIYETEKFYHEIDIPKKRGGVRTLEIPSLELKTLQRDILHELLECINTSEQAYGFLKGKSIVDNARQHVGKRYILGIDIENFFATINVDRIFKIFYYYGYTKEVSFMLSRIVCKDGYLPQGAPTSPYLSNIVCRKLDRRLLGVAKKYGATYTRYADDITFSGEIHPDVYVDLIKKIIVEEGFCINSNKTRILGNNQRQEVTGIIVNKKVKVNKKYKEYLRQQIYYCNKYGIDSHLEKIGNNVTGFKEHMYGIANFIKMVEPDEGEKWINKLNEISWYY

SEQ ID NO: 2712 - protein, 344 aa, unidentified
  source 1..344: note = Related to NZ_CAKODJ010000004.1; note = Adlercreutzia muris
MTYDAQSDQYLLELDSLLEANGTPFEDRAICIEYATNLRRSGLPVIFDRDHLAFLLGITLHDLMYFVMQQDDHYARYYLSKKRGGRRPVDAPSERLKSVQRWILSSILEKMRVSDYAFGFVKGRSLLENARVHLGKHCVVNVDIEDFFASVQADNVFRVFSYYGYSKEVSFCLSRLCTLSGVLPQGAPTSPCISNLVFLKVDKRLARLAKTYEASYSRYADDLTFSGRGNLGNIIPAVEHILREEGFTLNDAKTRVAFSHQRQEVTGLNVNGDSVRVPRSFKRDFFQQVYFCKRYGVDSHLDRTNQLFAFYKEHMYGKAYYLCEIEPEVGRRALGELDAIEWTY

SEQ ID NO: 2713 - protein, 392 aa, unidentified
  source 1..392: note = Related to QSJW01000007.1; note = Blautia obeum
MCCVSSAWQHIAHGASPIVGLPIVSLAFHAKDGFATGTVGTGTITVIVDSNVCFYMEEENLQIALEKGIIEPAVYERVIAYKERLEENQVPVIYNLRHLRKIFRIYKKEQDFFFGDKKEELYRTFKIPKKSGGYRTIEAPCERLKQIQRWIKDEIIDKLVMSEYATGFRKNLSIVDNAKKHVGKELVIGMDLKDFFPSVTYEEIFLMFRYVGYRKDVAHLLSKLCTNAENVLPQGSPASPSIANHVLLKLDKRLGILAETIGADYSRYADDITFSGKKSIASIIPLVEKIVAEENFTINKTKTRLQYKNQRQEVTGLIVNNKISISREMENEIKNAIYFIGKYGVCEHMRHIECNKSFYKEHLYGIAYFINMVDREKGQKYLRQLDLLEWEY

SEQ ID NO: 2714 - protein, 336 aa, unidentified
  source 1..336: note = Related to JAFTTZ010000019.1; note = Lachnospiraceae bacterium
MEKNNLQIALQQGVITQDAYNSITEYKQRLNDNNVPVIYNLRHLRKIFRIKKREQDIFFGENKRSLYRSFSIPKKSGGVRQIEAPCKRLKEIQRWIKDEIVDKFVVSEYATGFRKNMSIVDNARKHVGKELVINMDIKDFFPSVTYADILLMFMYIGYRKDVAHLLTKLCTNAENVLPQGSPASPSISNHILLKLDKRLGRLAESVGADYSRYADDITFSGKRGISTIIPLVEQIIEEEGFLVNENKTRLQYSNQRQEVTGLIVNNKIAVSTAIEDEIRNAIYFIKKYGVDDHMKHIGCNKSFYMEHLYGIAYFINMVDRDKGKKYLAQLDEIIWA

SEQ ID NO: 2715 - protein, 336 aa, unidentified
  source 1..336: note = Related to JABLYG010000002.1; note = Ruminococcus sp.
MGNDKLYEASRRGVISEKTYREILKYKERLQKNGVPVIYNLRHVRKIFQIRRKEQELFFGAQREALYYQFEIPKKSGGKRTIEAPCDRLKKIQRWIKDEIIDSFYPSEYATGFRKGISIVDNAMPHIGKELVINFDLKDFFPSVTYAEILKLFVYMGYRLDVAHLLTKICTNSENVLPQGSPASPSISNLVLLKLDKRLSSLAKTISCSYSRYADDITFSGNKSIKSIVPLVIQIIIDEGYTVNENKIRLQYANQRQEVTGLTVNTKLAVSKNITDEIEKAIYFCNKFGVSSHMKHIACDKHFYREHLYGIAYFIMMVDPQKGKIYLKELNDLNWV

SEQ ID NO: 2716 - protein, 336 aa, unidentified
  source 1..336: note = Related to JAFXDF010000036.1; note = Clostridia bacterium
MARQEELLAAVEKGIITEDSANRILEYNARLDEHGLPIIYNLRHLRKILKIRKRDQEIFFGPRRNELYREFQIPKKSGGIRKIQAPNEELKAIQTWIKAEILDKYSASKYATGFRKGYSIVDNANRHVGKELVINLDIKDFFPSITYADVIKIFSYMGYKLEVAHLLTQLCTNGENVLPQGSPASPALSNLAVIKLDKRLGTLADSLNCDYSRYADDITFSGKKNIRSIVPLVKKVISEEGFEVNESKVRLQYAHQRQEVTGLIVNKKVSVSESVVSELKNAVYYCGKYGVESHMQHIGCDKAFYKEHLYGLAYFVKMVEPAKGRAYLNKLDSIVW

SEQ ID NO: 2717 - protein, 333 aa, unidentified
  source 1..333: note = Related to NZ_FRFD01000005.1; note = Anaerocolumna xylanovorans
MYEDAKEKSIISQDAYQLIKIYIGRLEDNDIPVIFNLRHLRKILKIPKQKQSAYFGVNRNEMYRKFMIPKKSGGYRKIEAPSEELKLRQLWIKENIIDKFKISDSAQGFRKNHSIYGNALPHVGKELVINIDIKDFFPSITYQKVFKFFRYIGYTNQVSHLLTKMCTNVDNVLPQGSPASPSLSNIVLLKMDKRLSKLAGAVECDYTRYADDITFSGKKVIKSLVPIICKIIEEEGYDVNKGKLRLQYSNQRQEVTGLTVNKKVSLSKRTIKEIENAIYYCKKYGVQEHMTRIKCDKSFYKEHLYGIAYFIKMIDKEKGKKYLEELNRIEWLY

SEQ ID NO: 2718 - protein, 310 aa, unidentified
  source 1..310: note = Related to JAGAKL010000084.1; note = Clostridia bacterium
MATKEKIDNALQKGIITAETANELKEYNDRLTRNNMPIIYNLRHLRKILKIKKKEQNKYFGNERNEYHTFYIPKKNGSKRMIEAPSDRLKSFQLWIKENILDKINVSTNARGFRKNYSILDNAKEHVNKDLVINIDLKDFFPSITYNRVYKIFAYVGYTNEVAHLLTQLCTNKENVLPQGSPASPVISNIVALKLDKRLGALANKFNCSYTRYADDITFSGCVGIKNMLSTVERIIIEENFSINDAKVRLQYKNQRQEVTGLIVNKKIAVSPKIIKEIDNAIYYCLKFGVASHMQKIGCDKSFYKEHLYG

SEQ ID NO: 2719 - protein, 336 aa, unidentified
  source 1..336: note = Related to MNSK01000018.1; note = Eubacterium sp.
MMEHIEKAYQAGVITEEEKRLIEEYNQRLTDNNVPVIYNLRHLRQLLGIHKSAQDRLFGDKKCDSYRVFHIPKKNGGLREIEAPNEELKRIQLWIKENILDKFSVSQFAKGFVKGVSIYDNAVQHTGKELVVNIDLKDFFPSIQYREIYKIFKYIGYTDSVSKLLTNLCTNARSVLPQGSPASPTISNLVSLKLDKRLGRLADKIGASYTRYADDITFSGKKTIQKYIELIRKIIYEEGYEINEGKFRLQYAHQRQEVTGLIVNKEVAIPQKRINELENAIYYCKKYGVVDHMSHIGCEKGFYKEHLYGLAYFIKMVNPEKGLKYLLQLNEIEWPI

SEQ ID NO: 2720 - protein, 330 aa, unidentified
  source 1..330: note = Clostridiales bacterium; note = Related to SVIM01000022.1
MASTKELQKAYESGYITQGDMSLIEEYNQRLLSNNVPIIYNLRHLRQLLGIRKKDQDKLFGKDRKDSYRNFKVPKKSGGFRSIEAPNEQLKKIQLWIKENILDKFTVSEHAKGFKKGFSIYDNALPHVGKELVINFDLKDFFPSIDYCDIYKIFKYIGYTDGVSKLLTKLCTNPENVLPQGSPASPVLSNLVSLKLDKRLGELAKRIGASYTRYADDITFSGEANIQKYEILIREIIFEEGYRVNEDKFRRRLYFQKQEVTGLIVNDKVSIPKRKIKEMENAIYYCKKYGVTNHMKHINCEKGFYREHLYGLAYFIKMVNQPQGEKYYKN

SEQ ID NO: 2721 - protein, 330 aa, unidentified
  source 1..330: note = Related to JAFVRR010000006.1; note = Clostridia bacterium
MAFDKGIIDECQKKLLTEYIERLHMNNVPIIYNLRHLRKLFDIPRDEQNKFFGHERSLLYKTFYIPKKNGGYRKIEAPNEKLEKIQCWIKEKILDNFNVSEYAKGFKKGTNIVDNALPHCSKEVLINIDINNFFPSIKYSSVFRMFNYMGYTKEVCHLLTRLCTNAENVLPQGAPTSPAISNLVNLKLDKRLSSLAISGGAAYTRYADDITFSGDKLILKYIKLIKRIINEEGYSINDKKFRIQFKNQRQVVTGLIVNSRVKANKQIFNELDKAIYFIKRYGIQDHMAHENINRSAYKEHLYGLAYFINMIDRTQGKYYIEQLNSIEWLY

SEQ ID NO: 2722 - protein, 335 aa, unidentified
  source 1..335: note = Related to JAHZTB010000004.1; note = Planococcus glaciei
MSNYIEKLKKRMLQQELPNDYIEECISYATKLLNKGLPVIFDSEHFAKLVGINYEDLRKLTISDNYKEVKIPKKNGIRTLLIPNQDLMFVQKWMLVNLISKVKISKHSRGFIKNTSLVDNAKHHVKKEYVITLDIKNFFSSIHNVVVYRIFRSLGYTKELSGLFTKLLVTKDGLPQGAPTSPYLSHIVCKKLDRKIFIELKSLKNCDFTRYADDITISGEYDITEKIENIIGIIESLGFEINLKKKRHQLRSQQQMVTGLVVNDKVNIPKSYIRKLKQEIYYCKKYGVNSHMNKTNINNSNYKLFLFGKAYYIKMINKDLGEKFLKELDEIDWPY

SEQ ID NO: 2723 - protein, 335 aa, unidentified
  source 1..335: note = Related to NZ_CVRB01000003.1; note = Neobacillus sp.
MHDYLIKLKSAMQSQGCPPNYINDCTKYASKLLNKGLPVIFDREHFSRLIGFKLEELEELLKKDNYRVVKIPKKDGHRDLYIPNPRLKLIQKWMLMNLISKVKISKHARGFITDTSLVDNAIEHVNKDFVVSLDIRDFFPSINKYRVYRIFRSLGYCNDLAGIFTALLVTNNGLPQGAPTSPYLSHIVCKKLDSRISKELKHFEGCSFTRYADDFSISGGNEILEKISNIIYIISSEGFELNFSKTRIQSNSQKQLVTGLVVNEKVNVPSSYKRRLKQEIYYCKKYGVNSHMKRLGINKSNYKLYLYGKAYYIKMINQKLGEKFLSELNEIDWPY

SEQ ID NO: 2724 - protein, 363 aa, unidentified
  source 1..363: note = Related to RQPI01000007.1; note = Paenibacillus rhizophilus
MVLNLSFVFFCNNPLLCCLKSSLGSGTMSEYLDSLRGKMVSTGYSTEYIELCIKYANDLENNNVPVIFDKAHFLLLTGLKTSELRNILTNKPEHYHEFELLVNYRLRNILAPNPLLKQVQKWIQVFILKPLKVSSWATAYKPGTSIIKNAKVHVKQDCVINLDLKNFFDSITSVRVHKIFRSAGYTKELATLFTQICTLEKCLPQGAPTSPYLSNLICRNLDQDLAIFCQSRAIRFTRYADDMTFSGGVEIENYIPNIRKTITKHGFVINEDKSQVLFRNQRQVVTGLVVNDKVAIKKEFIRKLSQEIHYCLRFGVSNHILNSRINKSNYKDHLFGRVYYIRMVNKPLGDILLKKLESIDWEY

SEQ ID NO: 2725 - protein, 336 aa, unidentified
  source 1..336: note = Related to AP019308.1; note = Paenibacillus baekrokdamisoli
MSEYTDNLRKSMLELGNSNDYIELCINYARKLEKSHVPIIFDKIHFLVLTELKSSQLNDFLNNRAGYYREFELIINNRKREIHAPNNILKELQKWIQLYILKPLRVSDWATAYIPGTSIIKNAAIHIGQECVVNLDLKNFFNSISAVKVHRVFRVAGYTKELATLFTKICTVNNCLPQGAPTSPYLSNLVCIKLDQELADFCQSLGIRFTRYADDMTFSGGKEIVKVLPQIYKIISKQGFLINNDKTKILNCGQRQEVTGLVVNDKVSVKKEFIRKLSQEIHFCLRFGVSNHILRTGIRKSNYKDHLFGRAYFINMVDKSLGDDLLKKLQSIDWEY

SEQ ID NO: 2726 - protein, 340 aa, unidentified
  source 1..340: note = Related to NZ_CP075175.1; note = Paenibacillus sp.
MSNSLNYLILLEEQMVQEQYPTDDIQLVKLYAQRLISNSVAVIFDFDHLCYLLECSPEDMRSYMYNKEYNYHSFEIPKKSGGTRQLEAPSYPLKMIQRWILDHITCQVPISSHAFGFRKKRSILDNAKIHEGQECIVNIDIANFFPSIKGIQIYKLYRYLGYTKQVASILTTLCTKDDCLPQGAPTSPYLSNIVCKKLDKRISGLANAIGAKYSRYADDITLSGSSSITNYIGTLKKILTDEGFIINYKKLRIQFNNQKQMVTGLVVNQKVNVPNEMIRSLRQEIYYCKKYGVNGHMRQRNIRNSNYKEHLYGKAYFIKMINPDLGLDMIRQLDQILWEY

SEQ ID NO: 2727 - protein, 323 aa, unidentified
  source 1..323: note = Related to VIVN01000020.1; note = Neobacillus bataviensis
MYKQNCNSQYIKLVIDYAENLLKNNVEVIYDLDHISLLTNKSIGDFLDINNYYKEIQISKRNGETRTLAIPDDNLKSVQKWILKSILEKMPISNSAKGFKKGLSIVENAKPHTNKDCVLSLDLKDFFPSITQGSVYFIFKEIGYTEEVSRLLTRLCTYQGQLPQGAPTSPYIANLVCRKLDIKLQEFACNQNIAYTRYADDLTFSANKELSEYIPRIKEIVIIQGFKVNDSKTRCRYRHQRQLVTGLVVNNEKVSIPRELKRKLRQEIHYCKKFGVHGHLYWGIKYYSNYKDYLLGMALYVKMVDKNLGKKLLEEIKSINWEY

SEQ ID NO: 2728 - protein, 354 aa, Bacillus sp.
  source 1..354: note = Related to KB976825.1; note = Bacillus cereus
MWLIKDFLVGSPLIGVENMDNYLEKLEREMRNRNFDLEYINLLKDYAKRLLDHKVAVIFDQEHFSLLTEVPVDTIKALLNNFNSYNEIQIPKKNGGNRTLLIPNEELKSIQRWILNNILNSIPISDYAKGFKKGLSIVKNAEVHTNKECLLNIDLTDFFSSIESQRVYKAFRYIGYTKEISAMLSRLCTYNNFLPQGSPTSPYLANIICKKMDKRLFSLCKDKGIDYTRYADDLTFSGDIKLSKYLPIISEIVEDEGFQINTTKTRISYQHHRQVVTGLTVNKGLNIPRDMKKKLSQEIYFCKKYGVQGHLAQTGQTYSNYKHYLLGKAYFIKMVNKELGEKFIRRIAEIAWDY

SEQ ID NO: 2729 - protein, 335 aa, unidentified
  source 1..335: note = Related to JAJNAF010000001.1; note = Peribacillus sp.
MNLLSLEKEMIKQNYDKEYINIVKVYAHRLVENNIPIIFNFEHLCFLTNYSTEKLRYFIHNNQSLYKEIEIEKKSGNTRLISIPNNELKVIQRWILDEILSKIPLSPHAKGFRKGQSIINNAQLHTNKECVMNLDIQDFFGSVTQKQVYKIFRYVGYTKQVSSILSLLCTKDGVLPQGAPTSPYIANLVCKKLDKRISNLFINKPINYTRYADDITVSGEATIKDYLPILIKIITDEGFEINTNKTRIQYSYNRQIVTGLVVNQKINVPKKMIKQLRLEIYYCKKYGVAGHIDKRHIEYSNYKHHLFGKAYYIKMVNPKLGQKFLNELNEINWDY

SEQ ID NO: 2730 - protein, 335 aa, unidentified
  source 1..335: note = Related to NZ_CAJGBF010000001.1; note = Rossellomorea arthrocnemi
MNIDTLKKMMENEQLSEDYINLCVTYARSLEDKGLPIIFDSIHLAKLIGIGTKELYSYYELAQTLYSTAVIPKKTGGSRKLNAPSENLKYIQKWIVENVLYRLDTSKVATGFVPQKSIVDNAKPHVGKECVINLDLKDFFPSIKYVWIYNLFISLGYTRHLSMLFTGICTLNNELPQGAPSSPYLSNLICEKLDSRLSSLAENMGASYTRYADDLTFSGDKEITKYIKLIKRVIKEEKFELNEKKVRVRFSYHQQMVTGLIVNEKLSVPQKTKKYLRQQIYYAKKYGVSSSLQKQGVTKSNYNGHLFGLAYFIKMVEPDCGTKFIEELKQIDWET

SEQ ID NO: 2731 - protein, 335 aa, unidentified
  source 1..335: note = Related to NZ_VTEU01000001.1; note = Sutcliffiella horikoshii
MKIDTLKTKMEDEQFSEDYINLCVSYARNLEEKGLPIIFDSIHLAKLIGIETKELYSYYELAQILYRTAVIPKKTGGSRKLNAPSENLKYIQKWVVENVLYRLDTSKVATGFVPQKSIIDNAKPHVGKECVINLDLKDFFPSIKYIWVYNLFKNLGYTRHLSMLFTGICTLNNELPQGAPSSPYLSNLICEKLDSRLSGLAEHIGASYTRYADDLTFSGSKDIVKYIKLIKRVITEEKFELNEKKVRVRFSYHQQMVTGLIVNDKLSVPQKTKKYLRQQIYYAKKYGVSSSLEKQGVTKSNYNGHLYGLAYFIKMVEPDSGTEFIEELKQIDWET

SEQ ID NO: 2732 - protein, 335 aa, unidentified
  source 1..335: note = Related to NZ_JACSLM010000003.1; note = Exiguobacterium sp.
MDIKSLAAEMMKKNYDKEYIDLCISYAINLEKNGMPIIFDSIHLAKLIGIETKELYSYYEFAPRLYKVAVVPKKSGEKRFLDLPSENLKYIQKWILENILYKIKVSDYATGFVPQKSIVDNAKPHIDKECVVNLDLQDFFPNIKYIWVYNLFYNIGYTKHLSMIFAGICTLENKLPQGAPSSPYISNLICHGLDTRLSDLAIHIGAQYTRYADDITFSGNKEIAKYISLIKRIIKEEHFIVNERKVRVQFKHHQQIVTGLVVNTKLSVPKKTKKYLRQQIHYAKKYGVNDSLIQQGINKSNYIDHLYGLAYFIKMVEEKCGSEFIEDLDTLDWES

SEQ ID NO: 2733 - protein, 326 aa, unidentified
  source 1..326: note = Related to JADCLJ010000021.1; note = Cytobacillus luteolus
MVEEQFSEEYIKLCVTYATNLIENGLPIIFDARHLSCLIGIDTKELYSYYQLASTLYRKAVIPKKSGGSRTINAPSENLKYIQRWILENILYKINSSQEATGFVPQKNIVDNASYHVGKECVINLDMKDFFPSISFVQVYNLFNRSGYTKHLSMILTGLCMYNNELPQGAPSSPYISNLVCKNLDLRLSKLASQIGAKYTRYADDITFSGEKVIVKYIKLIKRVIKEENFNINHKKVRVQFSYHQQMVTGLVVNEKIRIPPKTKKYLRQQIYYAKKYGVTSSLSKQGQTKANYKGHLFGLAHFIKMVEQEYGDNFIRELKEIDWES

SEQ ID NO: 2734 - protein, 335 aa, unidentified
  source 1..335: note = Related to VENA01000064.1; note = Firmicutes bacterium
MDINKLKNNMLTEEYDKEYIDLCISYAYNLEKNGFPVIFDSTHLAMLIGIKVKELYSYYELAQSLYKKIIIPKKTGGNRILNAPCENLKYIQKWILDNILNNSESLDVSTGFVQGKSIVDNAKQHIGKECVINLDIKNFFPSIRYIQIYNIFRSFGYTRHLCMVFTGLCTYKNVLPQGAPTSPLLSNLVCKRLDTKLLDLANHIGASYTRYADDITFSGEKVITKYIKLIKRVIKEEYFQVNEKKVRVQFKHHRQMVTGLVVNTKLSVPKKTKRYLRQQIYYAKKYGVNNSLDRQEVSKSNYEGHLFGLAYFIKMVEPKNGVEFIEQLKQIDWES

SEQ ID NO: 2735 - protein, 335 aa, unidentified
  source 1..335: note = Related to LFJO01000006.1; note = Alkalihalobacillus pseudalcaliphilus
MDIIKLEQSMRLEGHRADYIKLCKDYAINLKRNELPVIFNIEHLAKLIGINADECYAYYQLSSNLYNELLIPKRTGGQRVINAPSENLKYIQRWILDNILSNVSISVHANGFINERSIVTNAIQHIGKKCVINLDIKDFFPSITYIQVYNLFNRLGYSRHLSMVFTGLCTLDNKLPQGAPTSPYLSNIICKNLDDRLSLLASHINASYSRYADDITFSGDRGITSYIKLIKKVVQEERFLINEKKVRVQFQYHRQMVTGLIVNEKLSIPKKTRNYLRQEIYYCQKYGVKDHMSKKGLYKTNYQGHLTGLAQFIKMVDSKLGEEYLKSLDKIDWES

SEQ ID NO: 2736 - protein, 378 aa, unidentified
  source 1..378: note = Related to SMZU01000020.1; note = Rhodococcus qingshengii
MTLFRRALNKVIPQRRSFWGMRKKKPSSVVNWKEPVENILERKMDLQKLYEELQNGNHDEDYTELCINYARTLLNNGMSVIFDTDHLSKLIGISSHELYSYYLFANNLYTEVKLPKKNGSFRTINAPSENLKYIQKWILDNILYNKNCSHFANGFIKDKSIVDNARPHVGKPCVINLDIKDFFPTIKYIDIYKLFKGFGYTSHLSMVLTGLSTYNNVLPQGAPTSPYLSNLICRNLDVKFESLANRISASYTRYADDITFSGEKSITKYIALIKSIIKSEGFTINEKKVRVQYQYHKQMVTGLIVNEKLSVPKSTKMYLRQQIYFSIKYGVTNNLERQNINKSNYKDHLYGIAYFIKMVEPLVGEQYIKQLNGIDWES

SEQ ID NO: 2737 - protein, 337 aa, unidentified
  source 1..337: note = Related to NZ_CP060287.1; note = Sporosarcina sp.
MNNYISTLTDRMIKEGYETDYIKTVVGYSERLMQKDLPVIFDLAHLALYLDESEETLSEMVNNSTSFYSKAKIKSKKGKVRNIYIPYEKLKKIQIWILYKILYKVETPKCVKGFKLGSSIVDNAIPHVNKNYVLNLDFKNFFETIKEKQIITVFTSLGYNKIVSSALSKICNYNGSLPQGSPSSPYLSNLVCRNLDNKIIELIKFEDVTYTRYADDLTFSSNQKLDSLIPLLEELIVSEKFKINESKTRMQLKNQRQLVTGLVVNSQVSVPRKYIRELRSEIYYCKKYGVSGHMDRKGILYSNYKLHLYGKALYIKMVDKSKGESFLKELDKINWQY

SEQ ID NO: 2738 - protein, 337 aa, Streptococcus sp.
  source 1..337: note = Related to PKIG01000001.1; note = Streptococcus oralis
MSQLEELKKLDIPVFCNLEELRENIGTNKKFFYKVLYSHNKLYKEITIPKRNGGNRVLNVPNIALKSMQRWILDNILYKVQSDPSATGFMPMKSIVLNASIHLKKKYILKMDIKDFFPSIDFRKVRSLFFELGYNKDVATALANICVFRGQLPQGAPTSPYLANLVCRELDKRIDNLCRKYRLSYTRYADDITISGNSKIFWIKGIVEEIIRSYQFSLNNEKTIFLKPGDRKRVTGIIVNEKLSVPRSVTRNLRKEIYFIKKFGLEEHLDKNSFTGSKEQYIAHLYGVASYIKMVELTKGIFFINQLNSIFSGNEQLETGKNLHIEFASIDWTIFGE

SEQ ID NO: 2739 - protein, 340 aa, Streptococcus sp.
  source 1..340: note = Related to APLR01000002.1; note = Streptococcus sanguinis
MSEKINLTVLSIESITSLEDLRKKMGVKKKYFYRVLFSHDKFYREIEVPKRKSGQFRKLSVPSMALKNMQRWILDSILYKISVNENAMGFVPSKSIVTNAYNHLAKKYILKLDIKDFFPSIGFGKVLDIFQKLDFPAEISSALANICIYKDELPQGAPTSPYLANIICKQMDFRIGSLCKKYELNYTRYADDITISGDRRVFWIEKQIEKIVNSCHFTLNKEKTVRLKPGDRKRVTGIIVNEKISVPKNIKRTLRQNIYYIEKYGLESHLDKIQFTGLSNQYIRHLYGMASFIQMVEIERGIEFIDKLNSLFNQKNDTDYQISEDDLLSFDHIDWSILDI

SEQ ID NO: 2740 - protein, 341 aa, unidentified
  source 1..341: note = Related to NZ_JAGYWS010000004.1; note = Lactococcus piscium
MRHLDFSFSNENIPVFSSLEDLRKKMGISTAFFYKAIFASDFFYKEILIPKRKVGKFRTLKVPPVFLKNMQRWILDNILYFISCHRNATGFIPNKSIVDNALVHVRKKYILKMDIEDFFPSINFYLVREVFIKMHYSKVISNALASLCICEGQLPQGAPTSPYIANLVFIDIDIRISQLCLKHNLNYSRYADDITISGSSNIFWVRKVVEKILKEKKFKVNKDKTVIIKPGDKKQVTGLIVNDQLSVPKSTIRELRKNIYYIKEFGIDSHLNKIKYEYAKEKYIDSLYGTASFIKMISPEKGINFFNELNSIFRRGNQYNSEQIEPSFIDFSETQWTVFEN

SEQ ID NO: 2741 - protein, 405 aa, Streptococcus sp.
  source 1..405: note = Related to JYOW01000001.1; note = Streptococcus parasanguinis
MDESSYLSINGYKYLSLYEAPLPITRAKFCKFLPWGVLLRGGPQPHCPTGKGFYKVKLVLVTQKRFNMIKFDKIISLDIPVFLTLEALRKNIDIDKKYFYRTLFYRNNLYKSIQILKKNGSDYRQINAPILPLKRIQRWILENILYKIPIEDCAHGFVRGKSIITNAYPHVNSKYILKMDIVDFFPSIHFGLIKKFFYDLGYSNTIACALANLCTFNSQLPQGAPTSPYLANIICIEMDKRIQGLCKKNRLKYTRYADDITISGNSNVFWIKDIVEKIVNCYGFQINQNKTVVIKPGDRKKVTGIIVNEKLSVPKSIVRKLRQDIYYIKTFDLESHMERISFTGTKQQYISQLYGVASFIKMVDIDKGLYFISTLDSIFKPFSPSIAEVDLELDDYFDNLFNDLF

SEQ ID NO: 2742 - protein, 332 aa, unidentified
  source 1..332: note = Related to NZ_PZJH01000006.1; note = Macrococcus epidermidis
MKYKVEVFPAIDSIEDLRNMIGVQSNYFYKCLYSNEYFYKTVKIPKRRNDEYRELTIPTMALKNIQRWILDNILYKFSVHPCAKGFVPGKSIIDNAIPHINKKYVVKMDVKNFFPSISFKDVRILFLNLGYKIEVAIALANLCTYKNTLPQGSPTSPYIANLIFYKIDKRISGFCNKNNLTYTRYADDITISGKSNISFSIKIINQILTQNRFELNDKKTKVLKPGDRKIVTGIIVNEKLTIPKDFIRNVKRDLYYINRFGLLNHLNFISIAEDNSEYYLNSLSGKISFIKMVDYKQGYILQNELDNIIGYNDKHEEKYIDLEDIDIKWEKL

SEQ ID NO: 2743 - protein, 313 aa, unidentified
  source 1..313: note = Related to nan
MIGIKSDYFYKCLYSNEYFYKTVKVPKKRNDGYRELTIPTMALKSIQRWILDNILYNFPVHHCAKGFIPGKSIIDNAIPHINKKYIAKMDIKNFFPSISLKDVIMLYLNLGYNYKVATALANLCTYKNQLPQGSPTSPYIANLIFFKIDKRIFGFCKKNYLTYTRYADDITISGRTNIAFSIKIINQILNQNKFELNDKKTKILKPGDRKIITGIIVNEKLTVPKDFIRNVKKDIYYIKKFGLASHLNFIDFPIENSEYYLDSLYGRISFIKMIDYKLGNMLQNKLNNFIDYSKRREEKYIDLEDIDIKWKKL

SEQ ID NO: 2744 - protein, 331 aa, Staphylococcus aureus
  source 1..331: note = Related to JAJHOZ010000001.1
MVNKTYLAINSLEELRNMIGIKSDYFYKCLYVNDHFYNVIKIPKRKKDEYRELMIPNMALKNIQRWILDNVLYRRQVHKCATGFVPRKSIVNNAIPHVGQKYILKMDIENFFPSITFKQVRKIFSEMGYKFELATALANLCTVNNQLPQGAPTSPYIANIIFYNIDKRIFSYCQKNNLRYTRYADDITISGSNKVSFSKEIIREIVNQYNFRINESKTIMFKPGDRKKVTGIIDNEKISVPKTLIREVRKQIYFVNKFGLEEHLIRNNYSLDYEQQFIMSIYGKISFIKMIDFKKGVSLQKKFNEVLGNIESSNMYRDNIDFDDIELHWIN

SEQ ID NO: 2745 - protein, 315 aa, unidentified
  source 1..315: note = Related to JAAECV010000003.1; note = Lactococcus piscium
MKLIDNGLDDLSRPVFLCTKDIQQAIGIDPKIFYTFLNPKNISYIKIKIPKRKKGEYRELSIPSPALKNLQRWVLEHILYSFPCHGSANGFIPNKSIVTNAIPHISKEYILKMDLKDFFPNITFSMVKNQFLTMGYNDHVSHSLALLCTYNDSLPQGAPSSPYLANLLFSPFDELIYTHCSKNNLSYTRYADDLTISGGKYILNIPQYVKDILRDSDFQINNSKTLIIKKGDKKQVTGIVVNEKISIPKNYLRELRQIIYYINKYGLDSHLKKIDYKGSKYKYINSLYGKASYIKMVDFKKGIKIFTELNKISLD

SEQ ID NO: 2746 - protein, 333 aa, unidentified
  source 1..333: note = Related to NZ_CP045040.1; note = Carnobacterium maltaromaticum
MSSDKNPLSLKEEWSAEDIKKYSSMLKRNNVPVIFDTEHFRRLLGLEKTDFYNILFKLEYQYHEVEIPKKKQGELRTLFLPSIKLKYMQRWILDNILYSQECNNEVTGFVPSKSIIDNAKPHIGQKYILKLDIQDFFPSISKIRVFLMFKHFGYTNDLSNTLSNICIYKNELPQGAPSSPYIANLICKKMDNRFLGLCKKNNLKYTRYADDITISGGKSVYKFKQFFINIVTDEKFFVNKKKVKLLKNGDRKQVTGIVINEKLSVPKNVIRDLRRDIYYITKYGLNSHLKRTGNIASSNYKAHLFGKAKYIYMVDREKGALYLEQLDAIDWET

SEQ ID NO: 2747 - protein, 332 aa, unidentified
  source 1..332: note = Related to KQ130593.1; note = Listeria newyorkensis
MNSDDKLSKLKENWTAMEIENYSSSLKKKGVPVIFDVEHFRRLLGLRSEDFYSILFKLEYHYHKLEIPKKIVGTYRQLLLPSIKLKYIQRWILDNILYTQSCITEVTGFIPGKSIVNNARPHLKQKYILKLDIEDFFPSIDEKRVFNLFKNFGYTNRLARTLSRFCSYENELPQGAPSSPYIANLICRKLDARLTALCAKYALNYTRYADDITISGGRMVFKLKKHIINIISDENFSINKSKIKLLTAGDRKKITGIIVNEKLSVPKKVVRELRQEIYYIKKFNLESHMKKTGNVSKSNYKGHLFGIAKYIFMIDKDLGTYYLDKLNGIDWE

SEQ ID NO: 2748 - protein, 327 aa, Streptococcus sp.
  source 1..327: note = Related to NZ_LS483375.1; note = Streptococcus gordonii
MKKWTDQDIREYRNKLEANGVPVIFDLEHLRRLIGIEKKYFYKVFYKLEYQYREITIPKRKPGQFRILSVPSRNLKLIQRWILDNILYCIECGEIVTGFIPLKSIADNAKPHTQKKYIYKFDLKDFFPSIPRRKVYYLFRNLGYSSDLSNALATLCCFNNYLPQGAPTSPYIANILCGKLDRRINSFCQKNNFTYTRYADDLTISGDEKLVHYKSLFRKIINDSGFCFNEDKARLIRCGQRKLITGIVVNEKVTVPRSYVRSLKKELYYIHKYGLKGHLEHCDIKTPPNIYSKEIIGKINFISMVDSKLGEEFKSLFKDALKKNKIF

SEQ ID NO: 2749 - protein, 319 aa, Streptococcus sp.
  source 1..319: note = Related to AJMM01000006.1
MNWTEENITNYKNRLIEKGVPVIFDIEHFRRLLGIKKSYFYKLFYGLKYQYKEVEIPKRKIGEYRKLTVPSKNIKKIQRWILEFILYSNLCDDCVTGFIPTKSIVENALPHIGHDYIYKFDLKDFFPSIPRSKVFYLFKDLGYTAELSNYLASFCCYNDCLPQGAPTSPYIANLVCKRLDKRLKILCERNGFTYTRYADDITISGDFKIVHFRNLFETIIEDSGFIINELKTKLIRNGQRKIVTGVVVNEKPTISREYVRELKKEIYFINKFGIENHMKRIGEAGSVKDYRRKIYGKINFVKMVDRELGLELRRKVNSF

SEQ ID NO: 2750 - protein, 357 aa, unidentified
  source 1..357: note = Related to VTZR01000027.1; note = Paenibacillus sp.
MDLDLLKSKLIEKNIPLNDIEATISYAQTLKNNGVPIIFDMQHLRRLLKLTESDFKRLYYARDLQYRTIEIPKNNGSGTRTLSLPSIDLKYIQRWILDNILYNVHVHEYAIGFVTGKSTVLNASHHINQEYVLKMDIKDFFPTISGGRVYGLFKCLGYSSSVALTLTNFCIYQNSLPQGAPTSPYISNLVCRKLDQRLELLSRKRKLKYTRYADDMTISGGRKIKKTIPYVKQIIEEEGFRCNESKTKLIYKSNRQQITGIVVNEKLSIPKSMFKSLRQEIYYMKKFGVSSHLDKKGLKHKSHVKEHYFGLANYIMKVDREKGKQILNDLNAIDWISKSHKGNKQFTAQEKNKDIYE

SEQ ID NO: 2751 - protein, 334 aa, unidentified
  source 1..334: note = Related to NZ_JACXZA010000007.1; note = Paenibacillus sp.
MIERNVPNEEIESTLSYAHILQENGVPIIFDSQHLRRLLKLTDTDFKRLYYSKEMQYRTREIPKNNGSGTRTLCIPSLDLKYVQRWILDNILYKVKINEHAIGFVKGKSTVSNAGYHMNQEYVLKMDIKNFFPTISNSRVFGLFKSLGYSSSVAMTLTNFCTYNNELPQGSPTSPYISNLVCRKLDRRLELLCRTRGLQYSRYADDITISGGRKIKKTISFVQRILEEEGFKNNENKMNLIYKSNRQQVTGVVVNEKLSVPKVIYKSLRQEIYYIRKYGLESHLDKKGLNRKSHVKEHYYGLANYMMMIDKDKGQQFINELNAIDWKRKSLGRD

SEQ ID NO: 2752 - protein, 356 aa, Bacillus sp.
  source 1..356: note = Related to NZ_CP084677.1; note = Bacillus safensis
MKDSMGSVIYALLNKKDGKMDLAILESKMIEQNIPTMDIESTISYARALKDNGVPVIFDIQHLRRLLRITKSDFKRLYYAKKNQYKTVEIPKNNGTGSRLLSIPSIDLKYIQRWILDNILYKVEINNLAIGFAKGKSVVVNASYHIKQEYVLKMDIKDFFPNITANRVFGLFKSLGYSSSVAITLTNLCTYNDSLPQGAPTSPYISNLICRKLDSRLKNLCQKRNLNFSRYADDITISGGKKVKNTIPCVEKILEEEGFNVNEQKTRIIFKSKRQQVTGIVVNEKLSVPKSIYKNLRQEIYYMSKFGVESHLDKKGLKNKSHVREHYYGLANYFLMVDRVKGEKVLSELNSINWND

SEQ ID NO: 2753 - protein, 336 aa, unidentified
  source 1..336: note = Related to LKPY01000055.1; note = Lysinibacillus sp.
MNLEVLESKMSEENISLEEIESTLSYARNLKENGVPVIFDIQHLRRLLNLNKTDFKRIYYARQHQYNTIEIPKNNGKGTRTLSIPSLDLKYVQRWILDNILYKIEVSEYANGFVKGKSVVTNANYHVKQEYVLKMDIKDFFPTITAGRVFGLFMSIGYSSNVAIVLTNLCTYNNSIPQGAPTSPYISNLICRNLDLRLSLLCNKRNIKFSRYADDITISGGRKVKKTIPFIRKIINEEGFIVNQEKTKLLYKSGRQQVTGIVVNDKLSIAKEILRKLRQDIYYIKKFGLNSHLEKKNMINKSHVREYYYGMANYILMVDQNKGQKLFNELNKINWK

SEQ ID NO: 2754 - protein, 337 aa, unidentified
  source 1..337: note = Related to LR733429.1; note = Exiguobacterium sp.
MDLSILKQELMSRDLNSVDVEFIISYAQSLLDKDIPVIFDLEHLRRLLGLKRSDFKQVYYANSNQYHNIEIPKNNGSGTRKLSLPSDKLKKVQRWILDYILYNFEVNEKATGFTLDKSIVTNANFHTNQKFVLKIDIKDFFPTITSNRVYGLFKSFGYNNSISLALTKLCTHENCLPQGAPTSPYISNLICRHLDIRLNGLAKKNNLNFSRYADDITFSGEFIPSNIVEMVQWILIEEGFWINELKTKLLNKSQRQKITGIIVNQKLSVPKEITKTLRQEIYYMKKFGVQSHLERKNLQTKTNVKEHYFGLVRFILMVDNEMGKKLSYELKKINWDS

SEQ ID NO: 2755 - protein, 382 aa, unidentified
  source 1..382: note = Related to FNHY01000009.1; note = Psychrobacillus sp.
MDLILLEQELKAMELDNDIINNYISYASNLKNNNVPVIFELEHLRKLLHISREEFFGIYYSIKYQYHTIYIPKSKIKYETNKGITRQSKKYILPKVYYDNEVRHKFKRYNKVITDLTNNKSSYYRKLDLPSKKLKYIQRYILDNILYRVDVHNAAHGFVPGKSTISNARVHVGNEFVAKLDMRDFFPAITAQRVYGLFRSFGYNKSLSFTLTKVCTYNGSLPQGAPTSPYISNLICRKLDYRISTLCIKNNLNFSRYADDITISGGRKVKRVLPIIKDIIKNEGFRINDEKTKILHNSHKQKVTGVVVNQKVSIPKSFYRNLRQELYYMNKFGVSSHLLEKQTMFKSNTKAYYFGLVHYCYMVDPIKGEKLLQLLEKINWNS

SEQ ID NO: 2756 - protein, 332 aa, Streptococcus sp.
  source 1..332: note = Related to VFSH01000008.1
MWTKESIKIYERQLESNRLPVIFNIEHLRRLIGVEKKYFYKLTNSVDASYISRFIDKRNGGKRKLLIPGFNLKLIQTWILHNILYTQPVFTSATGFIKQKSIIDNATPHIGKKYIFKTDISDFFPSIKFKNVFLLFLNFGYTKEVSNVLAILCTYEGYLPQGAPTSPYLSNLIFRDFDKKLENICSLSEYKYTRYADDITISSNEKISSIEVDYLSKTIEQSLQTINNFLKLNLDKTTVLRPGQRKIITGVLVNETLNVPKKILSEIRLEIYCLQKYGASNRIEAYNQKHNTNLDKYSYRQKLYGKICFVNMINPKKAEKFYEQFYDINWIK

SEQ ID NO: 2757 - protein, 332 aa, Streptococcus sp.
  source 1..332: note = Related to NZ_JVKT01000024.1; note = Streptococcus parasanguinis
MWTEESIENYERLLESKGLPVIFDVEHLRRLIGVKKKDFYKLTNSIDACYTCRLIDKRNGGKRELLIPSFNLKIIQTWILNNILYTQSVSSSATGFIKGKSIVDNAEPHIGHKYIFKTDILNFFPSIKLRNIFLLFFYFGYTVEVSYILASLCTYEGYLPQGAPTSPYLSNLILRDFDIKLQNICSSLNYTYTRYADDITISSDTKITKFYIEYLLDTISQLLNSITYFLKLNLDKTKVLHPGQRKIITGVLVNKRLNVPKELLSEIRLEIYCLQKYGASNRLKAYNLKNNTDLNIASYRQKLYGKICFVNMINPIKAEKLYDQFYDINWMK

SEQ ID NO: 2758 - protein, 332 aa, Streptococcus sp.
  source 1..332: note = Related to JAGZIK010000037.1; note = Streptococcus salivarius
MMWNEQSIRNYIGLLESKGLPVIFDLEHLRRLIGVEKQYFYKLTNSINESYSFFTIRKRNGGSRTISIPFSNLRTIQNWILNNILTTQQVAESATGFIKGKSIVDNAKPHIGHKYIYKTDIVDFFSSIKFKSVLALFLRLGYVKEVAYILARFCTYDGYLPQGAPTSPYISNLILYNFDIELQKICCLSKFSYTRYADDITISSNGEHLIDSNLLSATITKLLQDISFELKINFKKTKVLHPGQRKIVTGVLVNEKLNVPKEIISDIRLELFCLNKHGLSKRIKHYNEKHKTALSVALYRQKIYGKICFVNMINPKKAEKLFQEFYKIKWLL

SEQ ID NO: 2759 - protein, 340 aa, unidentified
  source 1..340: note = Related to JABBEA010000018.1; note = Paenibacillus sp.
MIKQVIFNIQLSDLPEQEKKDLIYYAENLYFKQCPVIFDNQHLMKLFELQDHDLKRFMTENTNHYSIKKRNGDLREVWKPNYKLKTIQKWILKNILNEIKVSECAHGFVKSKSILTNAETHQYKEQFWVFSMDIKDFFPSIKYHEVKRIFMGIGYSNEVSEALSLLTTVHGKLAQGFPTSPMLSNLFFRDIDEEFQQIASRYHIRYSRYADDITFSGVQKKGYLVLSEKLKQIVTSVLSKHNFIVNEAKTRLMKGKHPKIITGLVVTSQGVRIPQKYIRRLNKEIYYCRKFGVNGHLKYQGLITIANYKGYLIGLARFIYMVDPVKGAKFIKMIKDLDWD

SEQ ID NO: 2760 - protein, 340 aa, unidentified
  source 1..340: note = Related to NZ_AVBF01000002.1; note = Pontibacillus yanchengensis
MFDKILDNIKKSSLLEKEKEAYIQYARNLHLKNSPIIFDINQLVMLFDLPNDNIKEFVLENTNQYTISKRDGSSREVWKPSYKLKTIQRWILKNILFNIKVSESAHGFVKNKSILTNAEVHQYNEPFWVYSTDIKDFFPSIKQNEVKKIFLEIGYTEKVSEALSSLTTINESLVQGFPTSPMISNIYCREIDEEFKKQANKLNISYSRYADDITFSGPQKNGYLKLIKNIKNIVLHNFRENNFLINEKKTRVRKNKHTKIVTGIVVSQYGVRIPQKYYRRLNKELYYCQRFGVNEHLKYHGLITISNFKGYLIGLARFIYMVDPDKGSEYIKKIQKLDWE

SEQ ID NO: 2761 - protein, 340 aa, Bacillus sp.
  source 1..340: note = Related to JH792149.1; note = Bacillus cereus
MIKQVLHNIVLSDLSEEEKKFFMQYAKDLHSNHCPVIFDINQILRLFELPDDDLEKFVIDNTNHYYVSKRNGEPREVWKPNYKLKTIQKWILKNILNKIEVSACAHGFVKSKSILTNAEVHQHQEPFWVFSTDIKDFFPSIKYKEIKKIFIGIGYSDAVSEAFSLLTTVNKELVQGFPTSPMLSNIFFREIDEEFQQLASRYNIRYSRYADDITFSGVQKKGYLKLVKKIKEIVSCVLSKYNLIINNKKTRLMKDRHTKIVTGLVITPQGVRIPQKYIRRLNKEIYYCQKFGVNEHLKYHGLITIANYKGYLIGLARFIYMVDQSKGIELIKKIQELDWD

SEQ ID NO: 2762 - protein, 340 aa, unidentified
  source 1..340: note = Related to NZ_FODJ01000007.1; note = Amphibacillus marinus
MLNKVINNIRLSDIEEVEKRELIHYSEQLYSKNCPIIFDVNQLLLLFEIESDDLENFVLNNTLHYFVKKRNGEMREVWKPNYKLKAIQKWILNNILYNIKVSPHSHGFVKKKSILTNAQVHLHEDPFWVFSTDIKDFFPSIKQNEIKSIFMEIGYSKPVSEVFCLLTTVNQKLVQGFPTSPYISNIFFRNIDEKFREIEYKYSIRYSRYADDITFSGIQKKGYLTLVNKLKQIISNTLSKYNLTINEKKTRLMKDKHTKIVTGLVLTSKGVRVPQKYIRKINKEIYYCERFGVNEHLKYHGLITRANYRGYLIGLARFIYMVDSIKGAELLKKIEDLDWN

SEQ ID NO: 2763 - protein, 340 aa, Bacillus sp.
  source 1..340: note = Related to CP035226.1; note = Bacillus subtilis
MIKQVLHNIELSDICEEEKRKLIHYAEQLYSIHCPVIFDVDQLLLLFEIKVDELEKFVTDNTNHYFISKRNGKSREVWNPNYKLKAIQKWILKNILNNIEVSNCSHGFVKNKSILTNAQVHLHQEPFWVFSTDIKDFFPSIKKNEIKKIFMGIGYSESVSEALCLLTTANESLAQGFPTSPAISNIFFRKIDEEFQQVASKFSIRYSRYADDITFSGIQNNGSPSLVKKLKRIISYTLSRYNLYINETKTRLMKNKDTKIVTGLVVTSQGVRVPQRYIRMINKEIYYCQKFGVNEHLKYHGLITIANYKGYLIGLARFIYMVDSIKGAELIKKIQDLDWN

SEQ ID NO: 2764 - protein, 340 aa, unidentified
  source 1..340: note = Related to JACHHE010000004.1; note = Planococcus koreensis
MIKQILHNIISSNLSKEDKEILTQYAENLYLKNFPIIFDVNQFFLLFELTDNDLEKFIIDNTNHYHINKRNGELREVWQPNHKVKIIQKWILKNILNKIEVSPYAHGFIKNKSILTNAEVHLYQEPFWIFSTDIKDFFPSISYNDVKKIFMEIGYSDKVSEAFSLLTTVDGKLIQGFPTSPMLSNIFLRDIDEEFQKIAVRYNIRYSRYADDITFSGIQKKGYLTLVKNIKRIVSFILEKHDLAINNEKTRLMKDKHTKIVTGLIVTSKGVKIPQRFIRKLSKEIYYCQKFGVNDHLKYQGIITIANYKGYLIGLARFIYMVDKIQGAKFIKEIYDLDWD

SEQ ID NO: 2765 - protein, 340 aa, Bacillus sp.
  source 1..340: note = Related to NVGO01000019.1; note = Bacillus toyonensis
MINDILKNIKLSKLSEENRASLTRYAISIHNNNCPILFDKNHVLLVFNLVEEDLQKFIKENSNKYFIKKRNGSLREVWQPSYKVKEIQKWIYKNILNDIQVSECVHGFVKNRSILTNAQNHIHEDKFWVFSMDIKNFFPSIRIERIEQIFLKLGYSLEVSKALSLLCTVDGKLVQGFPTSPSLSNIIMREIDEEFKTIADRYNLKYSRYADDITFSGDQKKGYLILVKRLEKMICFILKNADFEINNSKTRLMKNKHAKIVTGLIVDSDGVRIPKKYIRKLKKEIYYCKKFGVNEHLKYIGLITIANYKGYLFGLARYIYMVEKELGIMFIKQLNDLEWD

SEQ ID NO: 2766 - protein, 345 aa, unidentified
  source 1..345: note = Erysipelotrichia bacterium; note = Related to SAAR01000159.1
MDNIVFQNINRSSLTDNEKNHLTIIASSLIIKGVPVIFDIHQVRLLFGIDGEIGIFVQKNCAKYSILKKNRDERTIYQPSYKLKKIQRWIVSNILSKIKISKSCHAFVPEKSILTNAKAHVHEDPFWIYKTDIINFFGEINFITVKDIFFSVGYSQDVSEILTSLCMYDGVLAQGFPTSPIISNIVLSNFDEELDVISQRYNFVYSRYADDITISGTQLRNKDIEKIKNIITYKLHHLGFEINKNKTKFFGFKADKKVTGVVIKNGQLFCPQKYKKLLNKELYYINKYGVDSHLIHNEKTLISNYIGYLYGYAGYIKMIEPDVGDEYVKKLNSIFWISNSEQAPS

SEQ ID NO: 2767 - protein, 309 aa, unidentified
  source 1..309: note = Related to BJZH01000076.1; note = Companilactobacillus nantensis
MNFTNTKQIKSVFKISQDMTVEKFVSKNINQYYFIKKKSKNPRQIYIPSIQLKTIQKWILKKILTKEFSSSEVAHGFISGRSIVTNAREHLYKEPSWILTMDITNFFDSIRFDSIEHLFRQHGYTKEVSRTFATLCTYRGKLVQGFPTSPFLANLYLKSFDVYLKSNLQKYNVKYTRYADDLTFSGNIEKNYESFILESERMVEKGLTKLQLRVNSKKTNIQTKERKIVTGIWLYKNKLSVSNNYLKKFRREIYYCKKYGVIDHLIHTNKVEISNFHGYMYGKAYFVKMVDENLGMKLLKELNDLNWPM

SEQ ID NO: 2768 - protein, 310 aa, unidentified
  source 1..310: note = Related to PZPN01000074.1; note = Lactiplantibacillus plantarum
MKLKNTNQIKKLFKITGNDISSFVTDNIASEFKIKKSNKERIIVVPSLHLKSIFRWLLDNIFEKEFIPHECVHGFVKNKSIVTNAKAHLYHSPNWVYTIDINNFFGSITRNDVLSIFIEKGWPTSVANAFADLCTYKNTLPQGFPTSPCLANAFLNKFDTHIHDFCKTYGIRYTRYADDLTFSSTDFVSVKKINEEVSCTLKKQNLFLNPKKEHLQKGKHKKITGININGHKLVSSRRFRKKFDNEIFFCKKYGIMDHLARTGTLTRSNFKSYMYGKACFINMIDQDLGQQYFRKLQHLNWPEIPNNAYF

SEQ ID NO: 2769 - protein, 339 aa, unidentified
  source 1..339: note = Related to LZRJ01000059.1; note = Solibacillus silvestris
MLETILNNINLGNIDKENKNILIENSKYLYSKGLPIFLDERHVSLVFNIEGNIKSFVENSTSHHIIKKHNGDSRDVFVPSEHLKEIQNWLLVNILEKKMISNSTYSFVKGKSIIDHALNHIYLKDFWLVTFDVKDFFPSIRKDAIKNIFFELGYTSDISDTLSSFCSIKNNLVQGFPTSPIISNIYLNELDSVLQEFCQSHNITYSRYADDLAFSGEGEKIQKSLYDKLYQLVVNTLAIYELKLNKNKIKIYDYNHPKKLTGIMLTTNGIRVPLKIKKKILKEIYYCEKYGVEDHLKKTGRLELANYKGYIYGIAGFIRMVEPETGIQLFRRLDNIYWG

SEQ ID NO: 2770 - protein, 311 aa, Streptococcus sp.
  source 1..311: note = Related to SSXP01000002.1; note = Streptococcus suis
MNSILVSEQQIKLLFKIAMTEDVIDFVKDNNLVYSKCKYNGETRFISSPSEHLKIIQRWIVDNILVQKSISDVAHAYVREKSIFTNARVHVGNKAILKMDISNFFDSIPITKVKEIFLSLGYNSAVSQVFAELCTNNGYVRQGFVTSPFISNIILKDFDDKLINTLKKSCYSKYEFKYTRYADDITISSKYKVKSKLKEIEQEVMDILEVSGFSANLGKTRLIIGESPKKITGIIVKESSISVPNRFKKELLKELYYCRKFGVISHLIYTGNYGKLNYIEHLKGLAMFIKNTDQKFYESVISQISELDLNS

SEQ ID NO: 2771 - protein, 311 aa, Streptococcus sp.
  source 1..311: note = Related to NCUR01000009.1; note = Streptococcus oralis
MIPKLISVQQLKKLFKIELTSNIEDFVENNNQVYPRIKKNGEIRFISSPTIHLKSIQKWIVEHILSKKDCSEFCHAYVKEKSIFTNAGTHIGNQNLLKMDIHNFFDSIPHISVKNIFITMGYNLEVSHSLALLCTYKGYVRQGFVSSPMISNIIMKEFDDWIIKSLHEEEYLKFDFKYSRYADDIAISSKKKAVAPLVIIKENISDYLEKYGFIVNNDKIKLIKGKGPKLITGIVVKDNSISVPNKYKRKLLKELYYCEKYGVESHLLYTGQYGKTNYKEYLLGIAMYIKNTDNQFYNTIRERIDALNIDY

SEQ ID NO: 2772 - protein, 336 aa, unidentified
  source 1..336: note = Related to CP023565.1; note = Ligilactobacillus murinus
MLVFQRPSSKRMAFCVGGFIVKVSRSISVKQVSEAFGINENIDEFVDNSSWFYPIEKKNGDIRYIFIANNQLKAIQSWILENILEDVKISDAANAYVSKKSIFTNAQCHVGYKGMIKLDIMNFFDAINRDDISKIFENLGFSKDVAMLFGKLCSNKNILNQGFSTSPMLSNIFFYKYDKLIEKILNEKYGKNTFVYTRYSDDITISTSKTFTFDDLMKLSSEIENLLLPKFKINKMKKKIILGKYPAKVTGINVFKEYMSVSKKIRRRIKREIHYCEKFGVSGHLKYVGEYNRQNFFGYLRGTAHFIGNTDKKLALKLLERIDMLEFRDRVTQKKL

SEQ ID NO: 2773 - protein, 330 aa, unidentified
  source 1..330: note = Related to SVLF01000041.1; note = Oscillospiraceae bacterium
MANSYIKRLEAAMTEQGAENEAISRAVDYAFNLLNQNLPVLFDDIHVAEVLLLSRLSLYSYHTFPVSQIDKTRIITAPSLNLKQRQKWILSEILNKIPSSEHAHGFESGHSIKTNALIHANNDYVFCMDIKDFFPSISRQSVCEIFRNVGYSPKASDMLSKVCCYNNCLPQGAPTSPKLSNIFFAKIDAELANLAKLNNAIYSRYADDMTFSSKHDIPALHKAVEEIIGKYNFTLNHKKTRVFYPGQPKRITGLIVQNGCIRVPKHFKRRLRQEIHYCRQYGVTVHLENTNASHCINYREHLYGKAYFVHMIEPDTGDKLLNMLDEIDWM

SEQ ID NO: 2774 - protein, 335 aa, unidentified
  source 1..335: note = Related to JAFSGO010000067.1; note = Clostridia bacterium
MDYVYITNLMHGLFQKGYDDKFVIRCCKYAEKLMRKNLPVFFDEEHIYEVLRTRGISLEDSYHTFDLIHDNKVRTILAPSKKLKARQRWILDNILNNIKVSKYAHGFELNRSIKTHAQLHANHDFVICMDIKDFFPSISEEKVFTLFKQIGYTTRASQELTRLCCFKGALPQGAPTSPKIANIICKRMDREIQRFAKENGITYSRYADDLTFSSNSEMPQLIPEITAIVNKYDFSINTEKTQSFVCGEPKFITGLVVQNGTVRVPKRYKRELKKEIHYCQKFGVLIHLENSNATHFVNYREHLYGKAYYVHMIEPDIGEKFLDELDKISWPEYMV

SEQ ID NO: 2775 - protein, 351 aa, unidentified
  source 1..351: note = Related to NZ_JHXF01000028.1; note = Ruminococcus flavefaciens
MEQNVKDMYIERLCHTLNDSKLSDMHKNKIISYAQQLLDKNMPVLYDKKHIAMIFDLRNIRLISSNYNKFYIDEKHKKRLIEAPSKKLKSIQKWILNNILEQLDTSEYAYGFRKGRSILQNALCHLGKKNVLCLDIKDFFGSIDEKTVFWLFRNIGFTSEASKTLKKLCCYKKALPQGAPTSPCIANIVCINMDKKLAQLAKKYNAVYSRYADDITFSSDEDISFLNKEVEKIIRKYNFFLNDKTKYYSGDHPKFITGLVVHKDKIRVPKKIKRELSKEIHFCRKFGVDMHLNNSGAEKRVNYREYLYGKAYYIKMVEHETGEKFLGMLNMIDWPDWALGSSNTSDNESVL

SEQ ID NO: 2776 - protein, 334 aa, unidentified
  source 1..334: note = Related to NZ_CP094682.1; note = Anaerotruncus colihominis
MEPNDYVNRLRHAMEISENPRFSPEYIAQCCTYAENLLKQGLPVLFDQTHIRKVLGMAAPRLCDYHRFTIPKHNGSRIITAPSRKLKLRQQWIYQNILIRKEASPYTHGFVPERSIVTNAILHIGYAYTYCVDITDFFPSITKKQVLPIFRNMGYSGSAANTLCDLCCCDGVLPQGAPTSPYLSNMICRDLDDELGAMARRFRGIFTRYADDIAISANQQQPQLLDALGLILGKHGFSMNLDKCRIYNPGQPKRITGLTVHNRVSVPKAFKRKLRQEIHYCQKFGVTAHLENTKAARSIHYREHLYGKAYYVKMVEPELGAHFLDELSKVDWPE

SEQ ID NO: 2777 - protein, 424 aa, unidentified
  source 1..424: note = Related to CABHNM010000079.1; note = Dorea longicatena
MGKYKYIDRLRQAMGGKYSEEYINYCAEYAAKLLDKNLPVIYDARHVDEILRLHGIKPDCYHIFVIAGKNKERKITAPSREIKQRQQWILEEILEKQDVSDNCHGFVKKRSILTNAKMHMGHKNILNLDIRNFFPSITETMVIFQFQQMGYSKSAAEALAGVCCYEGKLPQGAPTSPYMSNLILKKMDQDLENFCQKKGITYTRYADDMSFSSNEEIEGFFKDIKFIIGKYSFEINEKKTCYYQDPYRKIVTGLLVKENEVCIPKKFKRKFRQEIYYCRHLGVQRHLENTGNQERTGFREYMYGKAYFIAMVEPEAGKKYLEANTFDTFKVEPSLMTVFEQSHTWDELICHFVDSYVVETDKKAVSAFYDRGYIAEKLKGLETELALECRITLNGEERWIRNVIIRGEIEDSEYAMIFLRDEKT

SEQ ID NO: 2778 - protein, 331 aa, unidentified
  source 1..331: note = Related to JAFVDW010000052.1; note = Lachnospiraceae bacterium
MDKKAYIVRLENAMKGTYSKEYIDVCTKYASSLLDKDLPVIFDETHLYEILQLYAIKPDVYRKFHILGKRGKLRTICAPSRSLKLRQRWILDNILEKIPVSECCEGFRKDHSIYTNAKKHIGYEQMLNIDIKDFFPSIAEKTVIEIFHEIGYSRAAADELGAICCHDGCLPQGAPTSPYLANLACREMDRELLEFAQNHKLIYTRYADDMTFSGNVEMDKLIKGIVQIVYAHGFMVNTRKTRISTGNQRRLVTGIIVKKDGLAVPRNYKRKLRQEIHYCKQFGVANHLENTSSERKANFREYLYGKAYYIKMIEPKTGEQFLRELDEIQWQ

SEQ ID NO: 2779 - protein, 353 aa, unidentified
  source 1..353: note = Lachnospiraceae bacterium MD335; note = Related to VIRA01000076.1
MDEYIVNLKKELIKKEKSIEYIDRCCKYAKKLLDNGKPIIFDATHVKIILKMEGIKRNGYHYFNAGNIYKQRLIEAPSVNLKARQRWIAKNILENEPLGDWIHGYVKGKSIITNALVHAGKKRILHMDIKNFFQSITDEMVENEFAKMGYSESAAKELTSICTFSAEMVYWQEVEKLEDISSSQKYLPHGAPSSPWLSNLVFQNIDLQILDILKNKNIQYTRYADDLMFSSNSDKLVWLKDEIEKLVSKNGFAINVGKTKLFEEKDQKLIMGLNLTNGIKIQNSYKRKLRQEIYYCKKYGIENHLQKVGASNRSNFVAYIYGKVYFVKMVEPELGKELLENLDQIFQEEPLFY

SEQ ID NO: 2780 - protein, 351 aa, unidentified
  source 1..351: note = Lachnospiraceae bacterium; note = Related to DNJW01000315.1
MNEYIIRLEEELRKNNKEEAFITACCTYARKLLEKNKPVLFDADHVDKVLRMEGIKRDGYHTFNAGTRKKARIIEAPSVSIKKRQRWIVKNILEGEELGGWIHGYVKGRSIVSNAKVHAGKKRILRLDIKNFFPSITKGMVEKIFSAMGYSPSAAGELAAICTFSSDMLYQVKGRTEEEEASEEYRYLPHGAPSSPYLANLIFQNTDLEILESLQGREIRYSRYADDMFFSSDTEELQQLDEEIEGILSKHGFRLNKNKTKLMAEKDQKLVMGLNITNGIRVQNSYKRKLRQEIYYCNKYGIQDHLERTGNKGKSNFMGYLYGKAYFVNMVEPAEGKRLLEELDRLFADEQ

SEQ ID NO: 2781 - protein, 331 aa, unidentified
  source 1..331: note = Related to NC_015275.1; note = Cellulosilyticum lentocellum
MYNYEYTIRLCETLKSLSADDVYISKCCNYAEGLLDKELPVIFDPTHLKQILRLDDISLDEYHIFYIDKKNGGSREINAPSEELKKRQRWILKNILEKISISHNVHGFIKGKSIVSNARKHLNKEYVLNIDIKDFFPSVTKYSVEKIFRRMGYCNSVAQLLARVCCYRGGLPQGAPTSPYLANLAFDEVDQEIINVVRNRDITYTRYADDMTFSANYDLSTFKKEVYKSLGKYRFSPNIMKTHQMSGEKRKLVTGLIVDDKVKVCKKYKRKLRQEIYYCKKFGVTNHLRNCHSEKSINYKEYLYGKAYFIKMVEEIVGEKFLADLDSIDWY

SEQ ID NO: 2782 - protein, 328 aa, unidentified
  source 1..328: note = Related to QULM01000001.1; note = Coprococcus sp.
MENNYIYRLKINMFEQGFSTSYIDKCCSYATLLISQSLPVIFDKNHLDQILMLDTLKLDCYHEFEIYTKGKSRIILAPSKPLKSRQRWILDEILNKLPTNQCCHGFVQQHSIKTNAEMHVNKAQVLCMDIHNFFPSINIDQVFEVFHRVGYTSDVAQALAQLCTHNGILPQGAPSSPDLANIIFNPIDQQILNSISTKDITYTRYADDLIFSSSHEIDFLIPLISEIISTNGFKINNDKTHLMKNPYRKMITGLIVTDTVKVPKYYKRKFNQELFYCEKYGVASHLKNCRTHKKVNFKEYMYGKAYYIKMIEPDLGEEYLRRLDAIRW

SEQ ID NO: 2783 - protein, 393 aa, unidentified
  source 1..393: note = Lachnospiraceae bacterium KM106-2; note = Related to AP018794.1
MLKANELIILSYINKFQRIDLYEIQKTINEPLVQLMDSIYRLYENKYIVNDGIDKFSVTEKAKEENIGSWNIWTLKYKEKNINNNVFKYNKKYTGEFCDNGVPKISSVHQINDILELNHIDIESYHGFVLSYGGKNRMILAPGLNLKERQKWILHNILEKIPVEDCAHGFVKGRSIKTNAEVHVNKKEIVCLDIKDFFPSIKRVQVENVFLELNYSEEVAKKISSLVTYNDELPQGAPTSPYLSNLVFRNVDMGLKKLAKENDLEYTRYADDITFSANHSIDNIIKEAEEIIERAGFIVNEDKTHIMKDNYRKMVTGLVVNHKVRIPSAYKKKFRQEIYYCKKYGVSQHLRAIGRENAVNFQEYMYGKAYYIKMIEKELGEKLLLQLDSIFGV

SEQ ID NO: 2784 - protein, 374 aa, unidentified
  source 1..374: note = Related to CP016086.1; note = Clostridium saccharobutylicum
MRKEVQKALEDYISYFGIQKAKEQLKSYKKHSEKYNKKGYVFFDENHFDKIVESNTQIGVYQVDYYYDVYKIPKKRGGYREIASPSLELKSIQEFINENILLYGDVSDYCHGFVKERSIVTNALNHCNKELVICMDIKDFFKSIKIEDIISVFSNMGYNKEISNALGMWCSFKGALVAGSPSSPALSNLVFSKLDEIINDISIKYKFIYSRYADDMVFSTNKKNANYNQLIEEVEKCVNNFNFSINAEKTKIYPKCGKQEVTGLIVNNTVKVKSKIKKEVLTHIYYCEKFGFENHLSRYDKEYILKNSIEQIKIKRHFINYIRGKINFIKMVEPLNGGNVEKRYLEVFAEEEAKLKLEEKPIEIGFEELDDIYI

SEQ ID NO: 2785 - protein, 332 aa, unidentified
  source 1..332: note = Related to NZ_CP067364.1; note = Carnobacterium sp.
MSNNLSKHNEKNDYEKKIKSYSQKIHENGVPLIFDSEHLRRIIGVNKKSFLEIINSIDIQYHTIYVPKKREGFREINKPSINLMIIQRWILENILYKKKVHNNSFGFEPKKSVISNAKEHLNKKTVLSVDIEDFFHSIKEDYIKKIFLDMGYTKKLSELLAKICCFNGMLPQGSPSSPYLSNIYCIELDKDIYKLCQNYDLKYSRYADDITISSNNHINSEEVITNLIKIFNKYGFEMNSSKTRVSLKGNRQIVTGILVNDKLNVSKKYRNDLRQEIYYLNKYGLENHLDKRDDIMRRSNYKEYIYGKVNYLKLFDIEKANNYYEVLNRIDW

SEQ ID NO: 2786 - protein, 329 aa, Vibrio sp.
  source 1..329: note = Related to JAJSDZ010000009.1
MEISAHPQALSKLKNLGLPAVSNLNELSSQMRLSSGLLQQLIYKSDDHYHVYYLDKKSGGKREIAQPSRAMKAVQSWILRKILYRLSSSGNSKGFEIGESILSNAKPHVGAHVLLNIDLEDFFHSVPASNVYSIFHSIGYNKNISYILTSLCTFNGRLPQGAPTSPKLSNLACQRLDSRIQGYSGPKGIMYTRYADDITLSARNEAKIRKAQPMIEEIIQDEGFIINHKKTKICGTRKRKEVTGLVISPNSVGIGRSEYRRIRAEVYSMLTSDNSKLPTINGRIAHIKSVDKNNYEKITKYILSLKKKHPENDLFNLIVCIKGHISQGV

SEQ ID NO: 2787 - protein, 327 aa, Vibrio parahaemolyticus
  source 1..327: note = Related to MIQX01000067.1
MTTLQDSKNLSRLKNLGLPPVTNLDELSSQMRLSTGLVQQLVYKSDDHYKVYHLDKKTGGKREIAQPSRAMKAAQSWILRNVLSRLNSSQNSKGFEIGESILSNAAPHVGAHVLLNIDLEDFFHSVPASHVYSIFHSIGYNKSISHIFTCLCTFNGRLPQGAPTSPKLSNLACQRLDSRIQGYSGPKGIMYTRYADDITLSAFNEAKIRKAQPMIEEILQDEGFILNPRKTKICGTRKRKEVTGLVISTDSVGIGRKKYRQMRAEIYTMLKSDTSKLAQVNGWLAYIKSVDESNFNRLIKYIIALKNTFPNNDIFDSIPFIKATSPK

SEQ ID NO: 2788 - protein, 332 aa, unidentified
  source 1..332: note = Related to CP076406.1; note = Providencia rettgeri
MTQYSNINNLSRLKNLGLPPIGDLNELSNQMRLSSGLIQKLAYLSDEHYKVYYLKKKSGGQREIAQPSRAMKAVQSWILRKILYRLSSSQNAKGFEIGESILSNATPHIGAHVLLNIDLEDFFNTIPASHVYSIFHSIGYNKTISNIFTRLCTFKGYLPQGAPTSPKLSNLACQRLDSRIQGYSGPKGIMYTRYADDITLSAFNETKIRKAKPIIEEILKDEGFFINDSKTKICGTRKRKEVTGLVISIDGVGIGRRKYRQIRAMIYTMLKSDGSKIEQVNGWLAYIKSVDEKNYFRLVKYILTLEKNFPENKIFESISSIREKRVDKGNYL

SEQ ID NO: 2789 - protein, 324 aa, unidentified
  source 1..324: note = Related to NZ_WTLA01000004.1; note = Pseudoalteromonas sp.
MPNHQIVTSLSRLKNLGLPPVTNLKELASQMRLSSGLLQQLVYKSDEHYKVYYLDKKSGGKREIAQPSRSMKAVQAWILRKILYRLFSSQNSKGFETGESILNNATPHIGAHVLLNIDLEDFFHSIPASHIYSIYLSIGYNKKISNILTSLCTFKGRLPQGAPTSPKLSNLVCHRLDARIQGYSGPKGIIYTRYADDITLSAFNESKIRKAHPIIRSILVDEGFTVNQSKTKICGTRKRKEVTGLIISKDSVGIGRKKYREMRSEIYTMLQTDPSKLPKINGWLSYIKSVDTTNYNRLIKYITKLKTTFPDNLLFEKILFIQKK

SEQ ID NO: 2790 - protein, 323 aa, unidentified
  source 1..323: note = Related to CP034073.1; note = Shewanella psychromarinicola
MGSQYTNNLSQLKNLGLPAITNLAELASQMRLSVGLVQTLVFKSNEHYRVYFLDKKSGGEREIAQPSRAMKAAQSWILRKILYRLNSSQNSKGFEIGESILSNAAPHIGAHILLNIDLEDFFHSVPASHVYSIFHSIGYNKLISQKLTSLCIFKGRLPQGAPTSPKLSNLACQRLDSRIQGYAGSKGIMYTRYADDITLSAFNESKIRKAKPMIEKIVLDEGFSINHKKTKLCGTRKRKEVTGLIVSANGVGIGREEYRKMRAEIYTMLQSDPSKLAHINGWLAYIKSVDTTNYARLIKYIRTLKKIFPDSEVFNLIPAIKKN

SEQ ID NO: 2791 - protein, 324 aa, unidentified
  source 1..324: note = Related to JAESPX010000111.1; note = Colwellia sp.
MTIPSSPTDLSRLKNLGLPPITNLKELSSEIRLSKGFLQKLNYKSDEHYLVYTLDKKSGGKREIAQPSRAMKAVQSWILRKILVRLKSSKNSKGFEIGESILSNASPHIGAHVLLNIDLEDFFHSVPASHVYSIFHSIGYNKLISHIFTNLCTFNGRLPQGAPTSPKLSNLACQHLDSRIQGYAGIKGIIYTRYADDITLSALNESKIRKAKSMIEEIVVDEGFIINKKKTKICGTRKRKEVTGLVISKDSVGIGRKKYRKMRTEIYTMLKSEPAKLPQVNGWLAFIKSVDIKNYNRLKKYILTLKKVFPENDIFELIPSIQKK

SEQ ID NO: 2792 - protein, 328 aa, Vibrio sp.
  source 1..328: note = Related to JAKEUX010000001.1; note = Vibrio brasiliensis
MSDTNTSNNLSQLRNLGLPPVATLADLASHMRLSVGLLQLLSYKSDEHYKVYYLKKKSGGRRQIAQPSRAMKAVQSWILRKILSRLSSSANSKGFEQGESILSNALPHAGAHVILNIDLENFFNTVPASHVHSVFRSIGYNKTISQILTNLTTYNGRLPQGAPTSPKLSNLTCQQLDARIQGYAGPRGIIYTRYADDITLSAFNESKIRKAQPMIEEIVNSEGFTINDKKTKISGTRKRKEVTGLVISIDGVGIGRQEYRRMRAEIYNMLTEDSDKLSQINGWLSYIKSVDKTNYHRLIRYILKLRGHIKNEAVFSEIACLNKYTNQS

SEQ ID NO: 2793 - protein, 323 aa, Enterobacter sp.
  source 1..323: note = Related to FKGF01000007.1; note = Enterobacter kobei
MTTLSKNYPLRNFGLPVISSLEDFASSTRLSVSFIKYYLFQTDSHYKVFSIPKKKGGERIIAQPSRNLKAIQSWILRNILDRLSSSENSKGFEKGDSILNNALPHSGASYILSIDIEDFFPSISANKVHSVFRSLGYNSDVCKILTTFCTYKGRLPQGAPTSPKLANLVSQQLDARIQGYAGPKGIIYTRYADDLTLSSNTVKKLEKARDIIGLISKSEGLKINSLKTKLTGSRSRKSVTGLIVTKEGVGIGRAKYRELRSHIYNLFKDNNGDINKLTGHLSYVYSVDKRNFKRLKTYINNISKKYPNPIYFLHLSKIANVKK

SEQ ID NO: 2794 - protein, 320 aa, Acinetobacter sp.
  source 1..320: note = Related to DADBIP010000003.1; note = Acinetobacter baumannii
MTGIYRLKNIGLPVIKNIDDLAHFTRLSSTKLNYLSNSSKFLYKVYALPKKGSGIRIIAQPSRELKAVQAWILRNILDRLSSSDCSKGFEIGSSILDNAKPHIGSNYILNIDLKNFFPSISANKVYSVFSSLGYEKKVCILLTNFCVYNGFLPQGAPTSPKLANLICSKLDSRIQGYTGPRGLTYTRYADDITISANTIKKIINARDFLETIINSENLSVNKNKTQISGVRKAKKVTGLIVNQANVGIGRGRYREIRAEIHYVYLNKKTNLHRINGHLAFVYSVDKKMYNKLVAYLNKLIEKNPHCLLKDLNIFKNLIKK

SEQ ID NO: 2795 - protein, 339 aa, unidentified
  source 1..339: note = Related to CU207211.1; note = Herminiimonas arsenicoxydans
MQLDNRKFQLKIFNLPVIETIDDLAECTRLSPPLIKYLTYRADHLYKVFHIPKKIGEFREIAHPCRELKAIQGWILRHILDKLSPSENSKGFELGSSTLENASPHIGSNFLLNIDLKDFFPTIVASKVYGVFHSIGYNKKIAGALTSLCVFKGRLPQGAPTSPKLANLVCLKLDARIQGYAGPRGIVFTRYADDISLSAQTLKKIQNAKNLIHTIVASEGLEINNRKTSISGTRKRKKITGLVITENSVGIGRDLTRQIRAKIHHLFIEKSTNFSHVNGLLAYTYSVDKKSYRKLDSFIEKLKLKYPLCPATTELYKIKNSTITQFTKVCYRTSRIKKL

SEQ ID NO: 2796 - protein, 320 aa, unidentified
  source 1..320: note = Related to SNWT01000002.1; note = Idiomarina sp.
MPQDSHIYRLRNLGLPVMKSSEDFANYTKLSASRIRLLHLRADKFYKVYRLPKKSGGTRLIAQPSRELKALQGWILRNILDKLRASDQSKGFEIGSSILDNAAPHTGANFILNIDLEDFFPSIKANRIFSIFRSIGYNKELCVLLTNLCTYSGRLPQGAPTSPKLANLTCAQLDARIQGYAGPKGIIYTRYADDITLSAQTATKIYKARYFLDYLIADEGFTINRQKTRVYGTMSRKCVTGLVVSESAVGIGREKYREIRAQIHHLFSGKADSYRYLNGLLAFCFSVDTKSYRRAYKYMRKLQEKYPNSNAMNSIIPEKE

SEQ ID NO: 2797 - protein, 323 aa, Aeromonas sp.
  source 1..323: note = Related to NZ_CP047155.1; note = Aeromonas veronii
MMTTQNIYRLRNLGLPAMKSLEDFASFSRLSPSKIRHLSRSSEFLYKTYKVPKTNGSYRLIAQPSRDLKAVQAWILRNILDELSCSSYSKGFESGMSILDNAKPHIGSQYVLSVDLQDFFPSVSANKVYGVFSSVGYNKEMCVLLTNLCVFKGGLPQGAPTSPKLANLVCSKLDSRIQGYAGPKGITYTRYADDITLSSNSALKIQKAKSFLGTIISDEGFKINKPKTTLSGVKKQKKITGLVLSDNNVGIGSLKYREIRAEIHYLFAGKSNNYRRVNGLLSFVYSVDKKMYTRLHAYISSLKKKFPQSPAASSLNKEIVISR

SEQ ID NO: 2798 - protein, 324 aa, unidentified
  source 1..324: note = Related to JAHKPR010000010.1; note = Colwellia sp.
MTINNIYRLKNIGLPVMQSIEDLAKHARLSIEKIRYLSVRAEFIYLTYELPKTNGKTREIAQPSRELKAIQSWILRNILDKLSPSIYSKGFEKGTSILDNAFPHIGSTFVLTIDLENFFPTVKASKVFTLFKSVGYNKEMCVLLTNLCVYKGGLPQGAPTSPKLSNLICDKLDSRINGYAGPKGIVYTRYADDITLSANNIQKLQKAKDFIGTIISDENFKINKSKTKLCGTKRQKMITGLVLSESSAGIGRVKLREIRAKIHHAFVGKHNEFDHINGLLSFTYSVDKSSYKKLYRFIDKMNKDYPDSLAVLELHKNLLKKQLQ

SEQ ID NO: 2799 - protein, 319 aa, Vibrio parahaemolyticus
  source 1..319: note = Related to CP006004.1
MTSNSIYHLKNLGLPALTSLDEFAHAMKLGSNTVRSLSISSNSLYKTYKEPKKSGGFREIAQPCRELKAVQSWILRNILDKLNCSPYSKGFEKGKSILDNAQPHAGASYLLSMDLENFFPSIGSYKVYGVFSSIGYNKEMCKLLTNLCTYYDSLPQGAPSSPKLANLTCSRLDARIHGYAGPKGITYTRYADDITLSANTAVKIEKAKAFIGTIVHDEGLKVNKTKTKICGTKRQKKVTGLVLSGNSVGIGQKKYRELRSALHRIFVGRSTEYSFVNGWLSFTYSVDKKAYNQLYLVIDSLSKKYPQSDALEHLYAKKG

SEQ ID NO: 2800 - protein, 319 aa, Vibrio sp.
  source 1..319: note = Related to NZ_AP018689.1; note = Vibrio aphrogenes
MTSKNIYSLKNIGLPAMASIDDFANEARLSPGKIRYLSATAESHYRIYPIPKVGGKSRLISQPSRELKAVQAWILRNILDKLSSSPCSKGFEIGTSILDNARPHIGSNYVLTIDLEDFFPNVSASKVFGVFSSIGYNKELSILLTNLCTYSGGLPQGAPTSPKLANLVCAKLDARIQGYTGPRGIVYTRYADDMTFSAHTASKIRKVKHFIGTIISDEGFKINHKKTAICGTKRQKKVTGLILSESSVGIGRVKHREIRAKLHHLFTGKSAEFSHVNGLLSYTYSVDRRSYNKLYSYIAGLSKKYPNSNAIIEISPKIV

SEQ ID NO: 2801 - protein, 319 aa, Proteus sp.
  source 1..319: note = Related to NZ_CP034105.1
MTSKNIYSLKNLGLPAMVSVDDFANESRLSSAKIRYLSATADLHYKVFSIPKVTGKSRLISQPSRDLKAIQAWILRNILDKLSSSSCAKGFERGSSILDNARPHIGSNYILTIDLENFFPSIAASKIYGVFSSIGYNKQLSVLLTNLCTYKGGLPQGAPTSPKLANLVCAKLDSRIQGYAGPKGIVYTRYADDMTFSANTALKITKTKQFIGTIISDEDFKINSQKTVISGTKKQKKVTGLILSENSLGIGRVKYREVRVKLHYLFTDKLSNFSYMNGMLAYIYSVDKKSYNKLLSYIAKLKNKYPNSIAVNFINSKNK

SEQ ID NO: 2802 - protein, 322 aa, unidentified
  source 1..322: note = Related to NZ_BAEK01000003.1; note = Paraglaciecola agarilytica
MSSNNIYSLKNLGLPALKKIEDFAFVTRLSQGRITYLAYRTEHLYKTYDVPKKSGKKREIAQPNRELKAVQAWILRNILDKLSSSPHSKGFDLGTSILENAVPHQGANYILTLDLEDFFPSISANKVYSIFSSIGYNKEVSSLLTNLCVFKGGLPQGAPTSPKLANLVSAKLDARIHGYAGPKGIVYTRYADDLTLSAQSVQKLEKAKNFIDKIITDEDLVINRSKTKLCGTKRQKKITGLVLSQNNVGIGREKLREIRAKIHYLFIGKNIDYSHVNGFLAFTYGVDKKSYTKLYRFIEKMKAKYPSSEAVTELHNKAIKRI

SEQ ID NO: 2803 - protein, 324 aa, Nitrosomonas sp.
  source 1..324: note = Related to FOFX01000033.1
MPNKAHLYRLKNLGLPAIESIEGFADKTRISLEKIKYISYRSGHLYKVYEIPKINGKKRRIAQPNRELKAVQSWILRNILDKLSTSEHCKGFETGTSILDNAVPHVDSNYVLTVDLEDFFQSVKASSVYRIFNSIGYNKQVSSILTNICTSDGGLPQGAPTSPKLANLACAKLDSRVHGYAGQKGIVYTRYADDITLSAQTPKKIYNAKQFIGTIISDEGFAINKAKTRISGTRSQKKITGLILSENRAGIGRNKYREIRCKIHYLFVGKNKDYSHVNGLLSFTYSVDKKAYKKLYSYIKMLKNTYSDSKAGDLLVAEITKIPA

SEQ ID NO: 2804 - protein, 323 aa, unidentified
  source 1..323: note = Related to BMLH01000001.1; note = Rheinheimera tangshanensis
MSNKSYIYRLKNLGLPAIESIDDLADACRLSLGKVKYLSYRTEYLYKVFCIPKKTGKTRTISQPNRELKALQAWVLRNILDKLSSSEHSKGFDKGASILDNASPHVGANYILTIDLEDFFSNVKASHVYKIFHSIGYNDKISAILTNICTFKGALPQGAPTSPKLANLVCAKLDSRLHGYAGPKGIVYTRYADDLTLSGQTPQKIYKASQFIGTVISDEGFSVNKAKTNICGTQKQKKVTGLVVSEHHAGIGRQKYREIRSKIHYLFEGKSNDFHQVNGLLAFTYSVDRKSYKRIYSYVNKLKLRYSGSEASKKIAAEIGIKA

SEQ ID NO: 2805 - protein, 322 aa, unidentified
  source 1..322: note = Related to NZ_VBVC01000001.1; note = Halomonas sp.
MNEKQKKYGLKNLGLPAIETISDLANEIRLSDNKIRYLAYRAQHLYKVYSIPKKSGGSRLIAQPSRELKAVQGWILRNILDKLSASEHSKGFEKESSILDNAMPHVGANYVLTVDLQDFFPSIKANKVYSIFYSVGYNKLISSVLTSICTYDGRLLQGAPTSPKLANLICAKLDSRLSGYSGPLGIVYTRYADDITLSGQAARKIYKARDFINVIISSEGFKVNEKKTKICGTQRQKRITGLVVNENHAGIGRKRYREIRVKLHRLFVGKSDDYNHVNGFLSFVYDVDYKSYKKLFLYINNLKEKYPSSSAGLNIFPEINKS

SEQ ID NO: 2806 - protein, 324 aa, Escherichia coli
  source 1..324: note = Related to UGCT01000004.1
MTSATPSQVFRLRNLGLPVMSSLEDMSREMRLSVDILRLYIYRADKYYKVYSLPKRDGKRSRIISQPSRELKALQAWVLRNILDKLHSSPFSKGFEKGQSILNNASPHVGANYVLNIDLEDCFNTILIEKIYTVFHSLGYNSTISNALARLCSFNGSLPQGAPSSPKIANLVLTKLDYRIHGYAGSKGIVFTRYADDLTLSAQSLKKILKAKSFVCSIIPSESLKVNYNKVAIHGPKARKEVTGLVLSIDNVGVGRIRYREIRSKIHYLAVKRNSDFEHVKGLIAFVKSVDKKNYRKLMTFSNKMSETYGVDLSVLFPKNKKAI

SEQ ID NO: 2807 - protein, 321 aa, unidentified
  source 1..321: note = Related to NZ_SOZF01000025.1; note = Serratia oryzae
MTSIIQSQVFRLRNLGLPVMSTLDDMSREMRLSVEILRMLIYNADKYYTVYSVPKKDGRRVRVISQPSRKLKSLQSWILRNILDKLYSSPFSKGFEKGQSILNNASPHIGANYILNIDLEDFFDNIPSRKIYTLFHSLGYNSLVSNALTRVCSHKGSLPQGAPSSPKIANLILTKLDYRIQGYAGGKGIVFTRYADDLTLSTQSLKKIVKAKKFLCTIIPTEDLKVNYRKVVINGPRAKKSVTGLILSIDNVGIGREKYREIKSKIHHLAVGRTSDYEHIQGLVSFVKSVDKTNYRRLLAFSKKMSSIYKLNINQLFPSKK

SEQ ID NO: 2808 - protein, 321 aa, unidentified
  source 1..321: note = Related to NWTM01000001.1; note = Pectobacterium sp.
MNNFSSTDVFRLRNFGLPVMSSLTDMSREMRLSVELLTLLITRADDFYKVYSVPKTGTEKGERVICQPSRRLKALQAWVLRNILDKLNSSPFSTGFERGQSIKDNANPHVGSNFVLNIDLEDFFPSISSNKIYTVFNSLGYNKYISSVLTKICCFKNKLPQGSPASPKLANLVCMRLDHRIHGYAGIRGIIFTRYADDITLSAQSLKKIEKAKDFLFSIIPTEQLIVNYNKVIISGPRKQKKITGLVLSIDDVGIGRQKFREIKSKIHYLSVGRSENYAHVGGLLAFTKSVDEKNYRRLIVFAQKLNKKFNLDLDKLFKHG

SEQ ID NO: 2809 - protein, 319 aa, unidentified
  source 1..319: note = Related to NZ_CP033893.1; note = Serratia liquefaciens
MKSTEHLNTFRLRHLGLPVMNDLHDMSKATRISVETLRLLIYRADFRYKIYSIKKKNSHSIRTIYQPSRELKALQGWVLRNILDKLSSSPFSIGFEKNQSILNNATPHIGANFILNIDLEDFFPSLSAKKVFGVFHSLGYNRTISSSLTKICCYKNLLPQGAPSSPKLANLICSKLDYRIQGYAGSRGLIYTRYADDLTLSAQSMKKVLKAKDFLFSIIPTENLVVNTKKTCISGPRSQKKVTGLVISQEKAGIGRLKHKELRAKIHHLFSGRSKNIEHVRGWLSFVLSVDSKSYRRLFVYIGKLEKKYGWNPLSKTKT

SEQ ID NO: 2810 - protein, 320 aa, unidentified
  source 1..320: note = Related to NZ_CAAGXM010000002.1; note = Klebsiella quasipneumoniae
MENEHYMNTFRLRNLGLPVMSDLSDMSKETRVSVEALRLLIYRADYRYHIYTLDKKGPGNKKRTIYQPSRELKALQGWVLRNILDKLSSSPFSMGFEKKQSILNNATPHVGANFILNIDLEDFFPSLTAHKVFGVFHSLGYNRAIASSLTRLCCYKNLLPQGAPSSPKLANLICSRLDYRIQGYAGRRGLIYTRYADDLTISAQSMKKVVKAKDFLFSIIPSEGLAINKEKTCISGPRGQKKVTGLVVSQDKVGVGKRKSKEIRAKIHHIFVRRSNEVEQVKGWLAYILSVDVRNHKRLVAYINKLEKKYNWNPFKKEDH

SEQ ID NO: 2811 - protein, 319 aa, unidentified
  source 1..319: note = Related to JADTXC010000013.1; note = Serratia ureilytica
MPSATNSHVYQLRNQGLPVMSSIVDMAREVRLSVEMLRFLTYRTDYLYKTFEIEKKGTTSKRVICQPSRKLKAIQGWILRRILDNLRSSEFSKGFEKGQSILDNAVPHVGANFILNIDLKDFFPSVDASKVYGVFSSLGYNKEISSILTNLCTYKGKLPQGAPTSPKLANLTCARLDARIQGYAGSKGIIYTRYADDLTFSAQTLKKIIKTRFFIQTIIPTEKLSVNNHKTLLCGPRKQKKVTGLVISHDKTGIGRQKLREIRSKIHKIYTGEKTNTNHVYGLLSYVYSVDKRNYRKLIIYIEKLNKKYNKSEFLKIKK

SEQ ID NO: 2812 - protein, 319 aa, unidentified
  source 1..319: note = Related to NZ_CGCI01000022.1; note = Yersinia frederiksenii
MTLVTATHSHVYQLRNQGLPVMSTISDMAREVRLSVEMLKFLTYRTDYLYKTYEIDKKGKGSPKRIISQPSRKLKAIQGWILRHILDHLSSSEFSKGFEKGQSILDNAVPHIGANFLLNIDLKDFFPSISASKVYRIFRSLGYNKEISSVLTNLCTYKGKLPQGSPTSPKLANLICSRLDARIQGYAGRRGIIYTRYADDLTLSAQTLKKIEKAKFFIKTIIPTEDLKVNNSKTLLCGPRRQKKVTGLIISHDKAGIGREKLREIRSKIHKIFTEESLEYNHVRGLLAYVSSVDKKSHRKLVMYIDKLTKKYSGVEFII

SEQ ID NO: 2813 - protein, 327 aa, unidentified
  source 1..327: note = Related to NZ_JAENGP010000011.1; note = Advenella mandrilli
MKTESTANIYRLKNLGLPPLATIEDIANATRLSPEYIKYLAFRTNFLYKTFTIPKRSGGNRKIANPSRALKGIQGWILRNILDKLSSSEFSMGFEKGTSILDNALPHTGSTFILTIDLEDFFPSITGEKIFGVFNSIGYSRSISHILANLCLFEGRLPQGAPTSPKLANLVCSRLDSRINGYTGPKGIVYTRYADDITLSSQSLNKLYKAYNFIPFILQDEGFSLNPNKTIFSGTRKKKSVTSLIISGDTVGIGREKYREIRSKFHKEFTGITTNKEHLHGWISFINSVDRKSSIKLKNYIACLIEKYPDSEASKNFLKITEKNKTQ

SEQ ID NO: 2814 - protein, 330 aa, Aeromonas hydrophila
  source 1..330: note = Related to NZ_CP065651.1
MQKNTIYTLKNLGLPAITTLDDLSFLTRISRERIILLSTQHKRFYNTFLMPKKSGGHRQISQPSRDLKALQSWILRNILDKLSASKFSKGFEKGSSTLDNATPHIGANYILSLDLEDFFPSIKSGYVFSIFRSIGYNVPVSHTLTNLCVYNGGLPQGAPTSPKLANLVCSRLDARISGYAGKKGITYTRYADDITFSAQTAKKITKVYSMAKFIIHDEKFVINKNKTYFSGTKKNKRITGLVVTERSVGIGRVMLRSIKAKIHHLLVGRNDDLPHIIGLLSYIYGVDKKNYKHLIRYIQKLSLKYSGVPQELKDMVAKHNNLAASTLSEV

SEQ ID NO: 2815 - protein, 326 aa, unidentified
  source 1..326: note = Related to NZ_BBUL01000097.1; note = Cellvibrio sp.
MTKKIIFKLKTPPKINDIHDLARETRLSEKLISYIAYRSNFLYRTYYVPKKSGGKRLIAQPARELKAIQSWILRNILELRPSSNQSMGLERDQSILTNALPHIGNGYLLNIDLENFFPSIKSKRVFHLFKKMGFNNNISTIFTRICTFNDGLPQGAPSSPKIANLICSKLDARIQGYVGKRGINYTRYADDLTFSAPSYEKINKLEIFIKKLISDEDLFINSNKTTFSGPRKQKKVTGLVLTNDSVGIGRGKYKAIRARIYYYFLGIEKDIASINGYLSFIYSVDQKRYSMLQHYISSLFERFPVIPSANFGQFTNIHFLPQSALG

SEQ ID NO: 2816 - protein, 328 aa, unidentified
  source 1..328: note = Crocinitomicaceae bacterium; note = Related to JAESQK010000141.1
MKDSKTAKKYRLKSLGLPIIESADDFTRLLKISSSIIQQISKQTTKDRFYKEYRIPKKSKGFRQIAQPVRKLKALQIWILRNILDKLTTSDSSKGFEKGTNIKDNVRPHVGARVIMSLDLESFFPSISSNKVFGIFYSLGYNTEASWLFTNICTYKNKLPQGSPSSPKLSNLICWKLDFRIEGYTNKRDIVFSRYADDLTFSSKSIKKIIKAKNMVKHIIEDEGFVINEDKTRIMGPSRQKKVTGLIVSGHKVGIGRKKYREMRVKIINLFTHESDDFSHVMGWMSYINSVDKSVYKRLILYIEKLSIQFSNSIAVEEFKALIKNGNL

SEQ ID NO: 2817 - protein, 319 aa, Flavobacterium sp.
  source 1..319: note = Related to SMGE01000001.1
MSNNGIIKLNMFGLPVIQTLDDFSFISHISKYTIYQLSKNSDYYYKIYFIKKKSGKHRKICQPSRKLKGLQSWILVNILEKIKVSNSCKGFEKNSSTLDNAIPHAGANTILTLDLKDFFPSITSNQIFNIFKTLGYNDLISTVFTNICTFDGCLPQGSPCSPKLANLTAWKLDSRIQGYVGKRGISYTRYADDLSFSGLNPVKVVNIIPMIKEIIEDENFLINNSKTRISSSGRAKIVTGLVITDEKIGIGKKKFNNVRSKIHHLSMPRENGNIKLLNEVQGWLSYLNSVDRERLIKTQKYIDHLNQKYPNSMIKFLVK

SEQ ID NO: 2818 - protein, 321 aa, Flavobacterium sp.
  source 1..321: note = Related to NZ_JAGFBU010000005.1
MSNNGIIKLNMLGLPVIQTLDDFSLITHVSKYTIYQLSEKSDFYYSIYSIPKKSGKPRIICQPSKKLKGFQSWILVNVLDKIKVSSSCKGFEKKSSTLDNAIPHKGANTILTLDLKDFFPNITSKQVFNIFKTLGYNDLISTIFTNVCTYKEFLPQGSPCSPKLANLTAWKLDLRIQGYVGKRGINYTRYADDLSFSGLNPANVVRILPMISNIIESENFIINHSKTRIASSARAKIVTGLVISDDNIGIGQKKYKNVRAKIHHLTKPIEKGNVKLLNEVAGWLSYLNSVDKNRLAKANKYINELYKKHTKSMIQYLIKLD

SEQ ID NO: 2819 - protein, 319 aa, Flavobacterium sp.
  source 1..319: note = Related to NZ_FOJT01000006.1; note = Flavobacterium swingsii
MSKSEIIKLNMLGLPVIQTIDDFSLITHISNYTIFQLSKNSDNYYKTYDIPKKSGRPRQICQPSRKLKGFQSWILVNILDKTKVSSSCKGFEKKTSTLDNALPHKGANTILTIDLKDFFPTITSKQVFNVFKTLGYNNLISTIFTNICTYKGFLPQGSPCSPKLANLSAWMLDLRIQGYVGKRGINYTRYADDLSFSGLNPSNVVNIYPMIKTIVESEKFKINNSKTRVASSARAKIVTGLVISDEKIGIGKQKYKNVRAKIHHLTLPSEMGNVKLLNEVGGWLSYLNSVDKERLSKARKYINELHKKNPKSMIQYLVK

SEQ ID NO: 2820 - protein, 319 aa, unidentified
  source 1..319: note = Related to JABHCC010000144.1; note = Bacteroidetes bacterium
MSQTNSIKLNMLGLPVIQSIEDLSMLTHISKYTIYQLSIHADKYYKTYEIPKKSGRNRTISQPNKKLKGFQSWVLRNILDKVKVSDSCKGFEKGSSTVENALPHRGANTVLSMDLKDFFPTITIQRVFSIFKVFGYSDLISTILANITTYAGALPQGSPCSPKLANLSAWKLDLRIQGYVGKRGMNYTRYADDLTFSSLNPSNVVKIIPMIKEIIESESFFVNHSKTRIAGSSRAKIVTGLVISGENIGVGKQKYKRIRAKIHHLTLPAEQENSRLLYEVSGWLSYLNSVDKNRLLKAKEYIKELSEKHPDTLIANLNN

SEQ ID NO: 2821 - protein, 319 aa, Flavobacterium sp.
  source 1..319: note = Related to NZ_VOGZ02000014.1
MAKTEIIKLNMLGLPVIQSIDDFSVVTHISKYTIYQLSHHSDKYYKTFEIPKKSGGKRTICQPSKKLKGLQSWILVNILNKIQVSPSCKGFRKGSSTLDNALPHIGANTILNLDLKDFFPTVSSKQVYNVFKTIGYNKLIATVFTNICTYNDMLPQGSPCSPMLANLTAWNLDLRIQGYVGKRGISYTRYADDLSFSGLNPTKVVKIIPMIKTIINDENFEVNHKKTRIASSARAKIVTGLIVNEDSVGIGKQKYKDLRAKIHHLILPTEQKNEKLLYHVGGWLSYLNSVDKLRLQKAKKYISELTKKYPTTLIARLDK

SEQ ID NO: 2822 - protein, 334 aa, unidentified
  source 1..334: note = Related to NZ_CP042433.1; note = Flavisolibacter ginsenosidimutans
MSKSDKFKLSMAGLPVMENLNDFSRLTHISNYTLFQLSKYSDKYYKHYYIPKKSGKPRLISQPCRKLKGIQSWILNNILDKLCVSNSCKGFSKGTSIIDNVDPHKHSSVVLTIDIKDFFPSIRRDKVYNIFKAIGYNKFMSTIFTNLCTCNGALPQGGPCSPKLANLSAWTLDVRIQGYVGRRGITYTRYADDLTFSTTNPQKLIKRISTITSIIEDEKLHINPSKTRIAGSARARKVTGLIITNESFGIGRQVYLKVRAKIHHLTLNREQKNFDLINEVQGWLAYLKNVDKLRYKKAADYIRSLKEKYPATLISQIILPPLILEVATVITAVE

SEQ ID NO: 2823 - protein, 319 aa, unidentified
  source 1..319: note = Related to JACRII010000139.1; note = Planctomycetes bacterium
MSKTDNIKLHMLGLPVIQMVDNFSQVTHISKYTIYQLSKHSDKYYKTYTIPKKSGKLREISQPSKKLKGLQSWILANILNKLKVSNSCKGFEKGSSIADNAEPHKDANTILTLDLEDFFPTVKRNQVYSIFKTIGYNKAISTILTNICTFQGILPQGSPCSPKLANLSASKLDARIQGYVGKRGINYTRYADDLSFSGLSPAKVVKIIPMIKSIIENENFVVNPEKTRIAGAARAKKVTGLIISNNTFGIGKQKYKDLRAKIHHLTLPSEQTNTKLLNEVIGWLSYLNSVDKKRLSKANKYITKLTDKHPTTLVAKLKR

SEQ ID NO: 2824 - protein, 329 aa, unidentified
  source 1..329: note = Related to SEFI01000651.1; note = Sphingobacteriaceae bacterium
MVESTSGLIKKGSKDNFRLNMLGLPLIQTMGDLSSLTHVSEYTLYNLSKNADFHYRIYDIPKKNKTPREISQPSKRLKGLQSWILVNILNKLRVSNHCKGFEKGSSIADNAEAHIGANTILTIDLKDFFSSIDSIRIYNIFKSIGYNSLIATALTNICTFRGVLPQGSPCSPKLANLSAWMMDVRIQGYVGQRGISYTRYADDISLSGLHPSKVVKLLPMIESIINDEKFVVNSDKTRIAGSARAKKVTGLVLSDNSYGIGAKKLKNIRAKIYHLVLPEEQKNIKLLNELKGWLSYINSVDKRRLEKLHLYIKKLLNKNPETLLAQLSI

SEQ ID NO: 2825 - protein, 322 aa, unidentified
  source 1..322: note = Related to NZ_JHXV01000023.1; note = Crocinitomix catalasitica
MVKNENIRLNMLGLPIIQSIDDFSHITHLSKYTLYQLSEKSNFHYKKFPLKKKTGGTRTICQPSKNLKGLQSWILVNILNKLKVSDSCKGFEKGSSIGDNARPHINANCILTIDLSDFFGTVTDIQVYNVFKSIGYNKLISTMLTNICTCDGSLPQGSPCSPKLANLVTWKLDKRIQGFVGKRGITYTRYADDLSFSGLHPANTVQILPVVKSIVEDEGFIINPKKTRVAGASRAKIVTGLVISNNKFGIGKTKYRILRSKIYHLTKPKEQKNTDLLNEVNGWIAYLKSVDKSRFNKVFKYVTKLKKEHPKTLVNQITISNN

SEQ ID NO: 2826 - protein, 323 aa, unidentified
  source 1..323: note = Related to NZ_CP040710.1; note = Proposed Aggregatimonas sangjinii
MIKNENIRLNMLGLPIIQSINDFSHITHLSKYTLYQLSEKSDFHYKKFPLKKKAGGTRTICQPSKNLKGLQSWILVNILNKLKVSDSCKGFEKGSSIGDNARPHINANCILTLDLSDFFGTVSDIQVYNVFKSIGYNNLISTMMTNICTSDGSLPQGSPSSPKLANLVSWKLDKRIQGFVGKRGITYTRYADDLSFSGLHPANTVQVLPVVKSIIQDEGFRINPRKTRVSGASRAKIITGLVISNNRFGIGQTKYRILRAKIFHLTKPKEQNNIDLLNEVNGWIAYLKSVDKLRFNKVFKYVSKLKKEHPKTLINQMTIANIV

SEQ ID NO: 2827 - protein, 320 aa, unidentified
  source 1..320: note = Related to JAJMPA010000005.1; note = Pedobacter sp.
MNKSNIIRLKMLGLPVMEKVDDFAELTRLSRSIIYQMSSFANEYYITYQRPKKTGGKRTISQPSRKLKALQAWILVNILNKLSVSPSCMGFEKGTSTYQNAKAHIGATAILTVDIQDFFPSISQRHVFNIFRAVGYNNLISIILSKICTFENKLPQGGPCSPKLANLVAWRLDNRLQGYVGKKGISYTRYADDLSFSGPMPSKVVRSLPFIKSIITSERFEVNDKKTRIAGPSRAKIVTGLVVGNDGVGIGREKYKLFRAKIHRLTKQTEQTNLKLLSEVHGWLAYLHSVDVKRLNKAKKYIANLKNKYPESLVSKINWK

SEQ ID NO: 2828 - protein, 326 aa, unidentified
  source 1..326: note = Nitrospirae bacterium; note = Related to WPIF01000004.1
MARKTLKKTDNVRLNMLGLPVIGTLDDFSALTHLSKYSIFQLSKNSGKYYKVYEIPKKSGKKREIAQPSRKLKALQSWILVHILNKLKVSPSCKGFEKGQSILENANPHVGSNAILNIDLKDFFPSVKSNYVFNIFKSLGYDHTISTILTNICTFQGKLPQGSPCSPKLANLACWQLDNRIQGYVGKRGITYTRYADDLTFSGLSPNKVIKIAKTVDKIIQNEGLLINTDKTHFAGTAKAKKVTGLVINDKSAGIGKKKYHELRAKFCNLAKPENQEKKDKLYHAIGWLSFLKSVDIVRYKRILHYIAALKTKYPNTQLDMIKTDQ

SEQ ID NO: 2829 - protein, 321 aa, unidentified
  source 1..321: note = Related to NZ_FSRK01000003.1; note = Epilithonimonas zeae
MTSTIRLKILGLPNITDLEDFAYLINLSKNSIYQLSKNSEYYYKTYQIAKKNGKLRDISQPNKQLKGIQLWILNNILNKLKVSEYSKGFEKGQSISDNVRPHIFSNCLLNIDIKDFYPSINSIKVYNLFKSIGYNNLISTLLTNICTYKNSLPQGSPCSPKISNLICWKMDSRLQGYVGKKGIIFTRYADDITFSSIMPDKLIGVLPFVEKIIIDEGFTLNKYKTRFTGKLRRREITGLVIYDNNFGIGRKKLRIIRSKVYNFTKTTDNVNHKALHHLYGWMNYIKSVDEVRYKSLLEYIKLLYQKNPKTDIKTLYNYYNS

SEQ ID NO: 2830 - protein, 333 aa, unidentified
  source 1..333: note = Ignavibacteria bacterium; note = Related to JAIBBL010000001.1
MKRKNNFKLNLFGIPIINTLDDLSLLTHITKSTLFRLSKKSYLYYKEYTVPKKNKGVRKISQPSAKLKGIQSWILQNILEKLKVSPSCKGFEKGTSTADNTKPHVGANAILVVDIKDFYPSIKGNFVFSLFKLIGYNNLISTILTNLCVLNDSLPQGSPCSPKIANLVAWKLDIRIQSYVGKRGIIYTRYADDLTFSSINPANLIKILPIVKDIIESENFEINKNKTRFIGISRCRKITGLVLSDNNFGVGKRKYKNIRSKVFKLKDIEKIEDDKEKRKIKEMKEVYGLIAYLKSVDKERYLRILDYIRTLSVKYPNSILTNISFNTKTTIAK

SEQ ID NO: 2831 - protein, 321 aa, unidentified
  source 1..321: note = Related to JABHDM010000238.1; note = Nitrospina sp.
MASPSQTSKLRMLGLPIFDDLESFAQVTRLSKKFLYLHSSFSDQHYKKYFIPKKSGGQREISQPSKAHKAIQGWILRNILDLLQVSQASKGFAKKQTTADNAIPHIGANAILSLDLEDFFPSITANKVYSIFHSLGYSKPISIMLTSICTCGGKLPQGSPCSPKLANLVCIRLDNRVQGYVGARGVTYTRYADDLTFSAAHPGKLMHIFNFIRRIITEEGFSLNESKTRLAGTRLRKKVTGLVVTEGAVGVGRIKYRELRSKVFNLTKTQDIFYDQKEINEIYGWLGYLKSIDSKRYEKLVSQIETLKKNHKETSLDYLLV

SEQ ID NO: 2832 - protein, 337 aa, unidentified
  source 1..337: note = Related to JACDNW010000012.1; note = Candidatus Marinimicrobia bacterium
MNTKMRLHLLGLPSISSIDELSDTTHLSKSLIFRLIKYNDKFYRVYKLPKRNGGYREIAQPSKELKALQAWINRNILDRLEVSPACKGFERDTSILDNATPHVGSNAVLILDIEDFFPSITANKVCSLFKRIGYPSQAAAILAKLCTFKGRLPQGSPASPKIANLVCLRLDLRILGYVGKRGIVYTRYADDLTFSGPSTSSLLKLLYVVKTIINDEGFEINNYKTRIIGPSRQHKITGLIVNNSFAGIGHRQMRVIRSKVHRLCKYDAYSVPQKELNHVMGWLAFVKGVDTKRSLILYRYIQGLKEKYPDSGIQKLKIDFLLNKPSKRSIASGEPDL

SEQ ID NO: 2833 - protein, 317 aa, unidentified
  source 1..317: note = Related to JAHJJL010000216.1; note = Candidatus Eisenbacteria bacterium
MSSDRIRLGLIGLPKLVSISDLSDAIRLSKGLLFRCAKYPNKQYYTYTIPKKTGGTRVISQPSAELKAVQGWILRTILDRLSVSPACKGFVPGASTRDNATPHIGAKAIMCLDIQDFFPNVKASHVYSLYRTIGYSTQVASILTSLCTFHGGLPQGAPTSPALANLTCVRFDARILGYVGKRGIVYTRYADDLTFSAYSYSSLPRALPMITKIIESEGFLVNRQKTRIRGPARRHTVTGLVVTQNNVGVGRKTYRELRAKLHRLATMPIKAVKRKEIAKVKGSMAYLNSVDKVRRDRLDDYLIHLKMNYPKSILTKM

SEQ ID NO: 2834 - protein, 323 aa, unidentified
  source 1..323: note = Related to QQUH01000007.1; note = Chloroflexi bacterium
MSSDKYRLSLFDLPKIDSLEDLSYLSRLSKGQLYRFAKYSDWFYKSYRIPKKSGGERIIYQPSFKLKAIQAWILRNILERLSISSASKGFSIGSSIKDNVKPHVGANAILAIDIENFYPSIPANRVWFVYRTAGYSPQIAAVLTSLTTYNSFLPQGAPSSPRLSNLVCWSLDKRMLAFVGKREITYTRYGDDLSFSASSYQVLSKSFHTIKSIVRNEGFSLNESKTRFMGPAKQRRVTGLILYENQFGIGRKQYRILRSKIHKMCFIPSDEIDSFLLNHIAGWLSYVKDVDTNRYNKLAKYILDLKKKFNSSAVSLLNVEISA

SEQ ID NO: 2835 - protein, 334 aa, Bacillus sp.
  source 1..334: note = Related to WBOQ01000050.1
MDNNNNIASYFLGIPTINNQKDLANHLNLSEYTLHKVIKCTDKYYKEIRIPKKNGGTRRLACPSKKLKAVQAWILRNILDHLSVNPSATAFKKRTNITSNIERHTDNQFFLCLDIDNFFESIPQKNINNFFKALGYNKHVSFILAKICTYKGFLPQGGVTSPALSNLINIKLDKRISGYCSKRNIVYSRYADDFTFSSNNPNKLIQSIKILKKIINEENYQLNNNKTRIIRPGNAKKITGLLITDEGKISIGRKQRKTLRATIYNSLNNDNLTIQEKIDIENHINGWLSFLKGIDYNSYQQLLKWKEEFEKKAQTNKIAKQLEKEEFEEMLRSF

SEQ ID NO: 2836 - protein, 329 aa, Bacillus sp.
  source 1..329: note = Related to JAIUXW010000030.1; note = Bacillus toyonensis
MDNNNNIASYFLGIPTINNQKDLANHLNLSEYTLYKIINYSDKYYKEINIPKKNEGIRKLACPSKNLKAIQAWILRNILDPLSTNPSATAFKKETNITSNVERHLDNQFFLCLDINNFFGSIPQKNINNFFKTLGYNKHVSLMLTKICTYKGFLPQGGVTSPALSNLINIKLDKRISGYCSKRNIVYSRYADDFTFSSNNPNKLIQSIKTIQKIINDENYELNNKKTRIIRPGNSKKITGLIITDNKKISIGRKQKRILRATMYTLYNNDALTQKEKIEMENHINGWIAYLKGIDYNSHKQLLKWKKKFSHERDQKVMKELLKQFQMEL

SEQ ID NO: 2837 - protein, 351 aa, Bacillus sp.
  source 1..351: note = Related to NTXH01000057.1; note = Bacillus cereus
MVSMFIDPLKNHKKRLNMDNNNNIASYFLGIPTINNQKDLANHLNLSEYSLYKVINFTDWYYKKVQIPKKDGTFRNLACPSQTLKAIQAWILRNILDPLSVSASATAFKKETTIKFNVERHSDNQFFLCLDISNFFESIPQKKVISFFKALGYNKHIALILSTLCTYEGSLPQGGVTSPALSNLINTKLDKRISGYCSKKNIVYSRYADDFTFSSNNPNKLIQARNIIKEIINDEGYQINKKKTRFIRPGNSKKITGLVISDDNKIGIGRKQKKILRAKIHQYFLKDQLTPQDKEELKNHIEGWISYLKGIDYNSFKQVQKWQREFSLKAKKEKRKKAAEKKEFQELLRSF

SEQ ID NO: 2838 - protein, 319 aa, unidentified
  source 1..319: note = Related to NZ_NPBP01000019.1; note = Terribacillus saccharophilus
MNIAAYTLGIPKIDSLLDLSNAINLSEYTLQRILNSVDDQYYLIKIPKKDNSFREVYSPSPALKAIQKWILENILQPIAVDPSATAFQKGVTIRNNVELHIDNQFLLCMDIKDFFPSIKKNRVYQLFRSVGYDEHISLVFSRFCTYKEFLPQGAVTSPSISNIISIKLDRRLNGYCSLRNIVYSRYADDFTFSSNNTDKLRKSINILKAIIEDEGYTLNTSKTRLLIPGNKRKVTGLIISDSKSISIGRKQRRILRAKIHHSIFKMEKNTDSWRLFNKHINGWLSFLKGIDYESYISLLKYRENLKQKKKEQEDIISVF

SEQ ID NO: 2839 - protein, 323 aa, unidentified
  source 1..323: note = Bacillaceae bacterium JMAK1; note = Related to JIBW01000002.1
MNIAAYSLGIPKIENLKDFSNEINLSEYTLQRVLSSVNKQYNVGKIPKKDQSFRTIFIPSNALRAIQTWILRNILDLISIHPSAMAFRKNTTIKNNVEVHIDNQFYLCMDVQDYFPSVGKNKVYQLFHSIGFNKQMALIFSNFCTYENFLPQGAVTSPSISNLVNIKLDRRINGFCSIRNIVYTRYADDFVFSSNNSDKLKKSISTLKTIIEDEGYKLNDSKTRLLSPGNKRKITGLIVSDKNKISIGREKRRKLRARIHHSIFKLEEDKNLASWYEMHINGWLSFLKDVDQISYQHLVDYKMKLEDKKKKQDELMDELTSVF

SEQ ID NO: 2840 - protein, 312 aa, Bacillus sp.
  source 1..312: note = Related to NVKL01000039.1; note = Bacillus cereus
MNITAYSLGLPRVDNIEELSYKINLSEHTLHKVLKTVDLQYKTIHIPKKSGFTRTVHSPSMVLKAIQAWILRNILDPILVDPAATAFVKNTNIKDNVKRHNGNRFFLCMDIEDFFHSIGQNKVYQFFKGLGYNSHMSLVFSKFCTYDDYLPQGAVTSPSLSNLINIKLDRRIFGYCSSKNIVYSRYADDFTFSCNNPHKLIKAKYMLEKIIEDEGYELNENKTRILRPGNARKITGLIVAEDGKIGIGRKKKRLIRANIYNLYNKDLPDDEYKKLENHIQGWFNYLYSVDQVAYHQLKNYQSEVKLNSIFAF

SEQ ID NO: 2841 - protein, 324 aa, Bacillus sp.
  source 1..324: note = Related to PYWO01000004.1; note = Bacillus subtilis
MNIATYSLGIPKIENIEELSHKINLSEYTLHKILKSTDQHYKIIKIPKKNGEFRELSCPSFILKGIQKWILKNILTPNSIDPSATAFIKTKGIKNNVNRHQGNQFFLCLDIDDFFPSIQQNKVYNLFKSIGYNPHISLVLSSLCTYRGVLPQGGVTSPTISNLVNIKLDRRISGYCSSRNIVYSRYADDFTFSSNNPHKLTKSIATIKSIIQDEGYKLNNKKTRFLKPGNKRKITGLVLSDETGEFGIGRKQKRILRAKIHTLVFKLNENDKSWKALNEHINGWLSYLKGIDFEAYSQLSTYKEDLKDKKATLSAKQRELFDLF

SEQ ID NO: 2842 - protein, 333 aa, Bacillus sp.
  source 1..333: note = Related to NZ_MJEH01000025.1; note = Bacillus solimangrovi
MSNIASRFLNLPTINNLKDLSLLMNLSEHFLNQLSRNVDYQYKEVKIKKKDGSKRLLACPTQRLKAVQAWILRNILEKLSCDSSATAYIKGYNLKNNAQMHTGSSFFLCLDIKDFFGTIPQKHVYQLFRALGYNEHVSIILSNFCCYKGVLPQGGVTSPILSNLINIRLDRRIQGYVSKRNITYTRYADDITLSANNPDKLIKVKGFVEKIIKNEGYILNENKARFLRPGNLVKITGLVISTDGSISIGRKKKRLLRAKIHKLYFDTNLSKLEKDKLSLHINGWFSFLRSIDPDGLNQLKLYTKKLKQKKIKQKKYKISQKMNKQKEHQLSIF

SEQ ID NO: 2843 - protein, 317 aa, unidentified
  source 1..317: note = Related to NZ_JAGXBY010000001.1; note = Ornithinibacillus sp.
MSNLFGIPNIEGINDFSNKTNISSYTLFKMSSKPDLNYKKVLIPKNLGRGTRVLACPSYKLKAIQAWILRNILDNIQSHRNATAYNGKSLDVNLKGHVGNKFLICIDIVNFFPSTKRERVYDLFKSLGYNEQSAIMLTKFCTFEGGLPQGGVTSPALSNLINKDLDDEISKYCNAKSIAYTRYADDITISSNNKNKLDEALKYIEKVIQGHGYQINRDKTRHLHPGKQRKITGLVYSNDQKVGIGRRKRRILRSKIYNYENKEKFSSESTMIYNQIIGWLSFLKSVDSESYKYLKTYWKTLRNNDLETEVAATKQDK

SEQ ID NO: 2844 - protein, 370 aa, unidentified
  source 1..370: note = Armatimonadetes bacterium; note = Related to VGFC01000313.1
MAVRRPGRKQTLTAVSRRQVAPRAALASLLVFVMCFWARAGPPPKPGGARVASDSYRLRVFGLPVIESVAELAAATHLSPALLYHLCQFPDRFYRRFSIPKKSGAGARQIRCPARPLKALQAWLLRAILDSVKVHPAATAFRKGHGLRSNVTPHRENRYFLCLDIEDFFPSIGYAKVWTVFRTLGYNAHMSHVFASICTCDGVLPQGGVTSPALSNIVCFRMDARLAGYCGKHNVAYTRYADDMTLSATSPRVLVAARRMCTRITRDEGFALNERKTRVMGPRQCRHVTGLVVSDRGTVGVGRRRERVLRAAIARGATRDTGLTDAEGRRLRHRIRGWLDYLQDVDRPRADRLKRYRTALLERWQVSDQA

SEQ ID NO: 2845 - protein, 316 aa, unidentified
  source 1..316: note = ANME-1 cluster archaeon GoMg2; note = Related to QBUM01000164.1
MSGNRYRLRMAGLPLMEDLKDLADYVHLSAGLLYRLSKYNDKFYKSFQLPKKSGGFRIISCPSKDMKAVQAWILRNILDQIHVADSATGFRTGKNILDNAKYHEGNRYFLCLDIENFFPSIQYAKVYTVFKTIGYNTHISHIFASLCTCRGKLPQGGVTSPALSNIICIRLDHRISGYVGKRNVAYTRYADDMTFSSLSPGRLVGIKRVALKIIRDEGFELNERKTRFLGPCRQRKVTGLIISDDSLGVGKKRKRILRATIHRLVTADLSEIERQKLRNHIDGWFAYMNSVDPKGFEQLKTYEERLSLACSGEDTI

SEQ ID NO: 2846 - protein, 336 aa, unidentified
  source 1..336: note = Related to MGVG01000053.1; note = Elusimicrobia bacterium RIFOXYA2_FULL_53_38
MTDKSKKSYLLQLFSLPILNNLEDLSVCTHFSKKILYRLSKFNSKHYARFSIPKKSGGNREILCPSLEMKAIQVWILRSILEKIQVSKAATAFRPKTSIAQNVDQHLGNQYVYCLDLENFFPSISYSKVYTIFNTIGYIPHVAHILASLCTCDGKLPQGAVTSPALSNIICLRLDNRLNAYVGAKNISYTRYADDICFSALSDSRLWGIRNTVKRIIESEKFVINKQKTRMQGPTGCRKITGLVFNKDSYGVGRKKKRVLRAKIFNYISTFTSMSPDVQLKTAQHIHGWISFLNSVDSQGCQQLTKFSKIVFNQAVVAKKIDPAKIPAPFLKVLSR

SEQ ID NO: 2847 - protein, 318 aa, unidentified
  source 1..318: note = Related to MZGT01000125.1; note = Clostridium chromiireducens
MLDTTDILRIPRIKDLKDLAFQTKLSIGLLYKMVNIPDKFYIQIEIDKKNGRKRKIECPSKKMKAIQAWILRNVLDKIDVNPSAKAFRRRMNLSSNVKPHDNNNYFLCLDFKDFFCSINFGSIYNIFSVLGYDDSMCFILTRLCSYNGRLPQGGVTSPTLSNIACIKLDERLSNYLGIRDIVYTRYADDITLSAKQPDKLLKALPTVKQIIEEEGYTLNNDKTRILGPKLQRKITGLIYDGSKFGIGREKKRTLRSAIYNYVYGRDEEDERERKFQWINGWMNYLKSVDKNSYNILKNYWIQLSCKAEVAVTNENTFD

SEQ ID NO: 2848 - protein, 318 aa, unidentified
  source 1..318: note = Candidatus Marinimicrobia bacterium; note = Related to JAIPIQ010000092.1
MSEVKHRLRLLDLPFFETIEDLAALIRVDAGRLRLLSSHPEKFYRTYRISKRSGGWRKICSPSKELKAIQAWILRNVLDKLSPSQYATAYVSGKRLLDNVSPHANNRYFISMDIRNFFPSVTSFRVRAIFEALGYSMLAGSTLARLCCYFHGLPQGGVTSPALSNLVCLRLDRRLAGLAARRNIVFTRYADDITFSSNNRNALCRMLPITYKILISERFQPNEDKLRVMGPRVRCSITGLVKDASVGRFGIGRHKKCAMRAVMHNLLARHEASPDYTDEASIVGWLSFLQSVDGESYRQMTRYWKQQKDKWLCSVRPV

SEQ ID NO: 2849 - protein, 313 aa, unidentified
  source 1..313: note = Related to RPRI01000079.1; note = Desulfobacteraceae bacterium
MNNIVHRMQLIGLPFFDTVEELAALIRIEPGRLKLLSIHPERFYRTYHIRKKSGGWRKISSPSKELKAIQAWILRNILDKLSPSPFATAYLKGKKLIDNVSPHASNRYFLSVDIKDFFPTVMKDRVCLLFEALGYSNRAALALTRLCSYFSGLPQGGVTSPALSNLVCLRLDRRLAGLSSRRNIVFTRYADDMTFSTNNRNALCRLLPLVCEILRSEWFEPNENKHRFLGPRVQCRITGLVKNASEARFGIGKAKKIRMRAIIHNLLAENRPHPDYPTELSIIGWLSYLKSVDPDSHRQMMQYWEKQKSKYKH

SEQ ID NO: 2850 - protein, 316 aa, unidentified
  source 1..316: note = Related to JACQVI010000042.1; note = Ignavibacteriae bacterium
MLENIQRLRLLGLPVFDNIENLAALIRVDSKRLTILVLQSERFYRTYRIPKRSSGWRKISSPSKEIKAIQAWILRNILDKLSPSAYATGYILRKRLVDNVNPHASNRFFLSVDIRDFFPMIGSWRIRRLFEVLGYSEMAAVTLTRLCTYFGGLPQGGVTSPALSNLVCLKVDRRLGGLASHRNMVFTRYADDITFSTNNRNALCRVLTLVFEIIRNEGFEPNLEKVRLLGPRTQCRITGLVKNSSEARFGIGKKKKIRMRAVMHNLLVKGRHDSTYPDGASIEGWLSFLKGVDPGSHEQMTRYWNTLKAKYGSKTR

SEQ ID NO: 2851 - protein, 314 aa, unidentified
  source 1..314: note = Related to JAGGWH010000150.1; note = Bacteroidales bacterium
MKSNSELLRLLNLPVFSDEEELASLMHITPERIKMLSKFPHRYYKKYKIPKSNGKLREIRQPRKDLKAIQAWILRNILDKLSPTTFATAYIKNRNISDNVTPHSNNRHFVLLDLEDFFSSISIRRAAKVFLLIGYSKKAASILARLCTCDGSLPQGAVTSPSLSNLIAAKLDRRIAGYTSRRNIIYTRYADDITLSSNNPATLSLSLPRIIKIIKSEHLKPNMDKLRVLGPRKRCSITGLVKNNSEPEFGIGKKKKKQMRAVIHHFLFNLSKDDKYTNKASIIGWLNYLKSVDKESFEQMNNYWNQLIKKSNSV

SEQ ID NO: 2852 - protein, 324 aa, unidentified
  source 1..324: note = Bacteroidetes bacterium; note = Related to JAHJUE010000035.1
MSSPRVWTSLPNIIMSTTELLRLRDLPVFDNIEEFASLCHISKIDISAIQYNAYPFYRRYPMLKKNGKIRIVYQPNPTVKAIQCWILRHILDKVNPSEYSTAFRKNKSTLDNVSPHKHNRFFFRTDIVDFFPTINRSRVFFLFKNIGYDTKQAILLARLCTCSNLLPQGAVTSPSISNLVVNKMDRRLAGYANKKNIVYTRYADDLTFSSNNRSVLNNSIRLIKRIIEEEEFIVNLEKTNFIGPSKSCKITGLIKNTSEPSFGIGKKKKNRMRCVMYYHIVKKITIDPNYSSDNSIIGWLSFLNSVDKASFKYMNNYWLSLKAL

SEQ ID NO: 2853 - protein, 325 aa, unidentified
  source 1..325: note = Related to JAGROQ010000226.1; note = Proposed Cephaloticoccus sp.
MRSNRTVLRLFDLPPFSSLNEFCALAHFNTARVRVIATESKRFYKRYNIPKRSGGEREILQPTAEVKAIQAWILRNILDKLKASNSATAFTRGVSLMLNVQPHASNRYYLCMDIENFFPSVSSFQVQQVFSAIGYSPNVSYWMTKICTVGGRLPQGGVTSPSLSNLVCLKLDRRLSGYAASKGLVFTRYADDMTFSSNNPKLLRNSVATVRRIVQAEGFIINTKKTHLAGPNLRCVVTGLVKNASMPAFGIGRKRYRMVRAEIHNFVMRGGAKRYNSKESISGMISFIEGINRAQGESLRKYWYGLEQCSRAQVIIDPETDRPTQ

SEQ ID NO: 2854 - protein, 310 aa, unidentified
  source 1..310: note = Related to JH603153.1; note = Klebsiella michiganensis
MAKYSQSLYTQRLLSLPILQSIEDLSVKTRLPSPLLSQYLNDNSRYYCHISVPKKNGGYRPIDSPNRQLKAIQRWILRHILEKLQPSVYATGFVPGIALKRNAIPHTGNQYILKLDLKDFFPSIKASYVYSVFRAAGYSKQIAYSLTSICTLNGYLPQGAPTSPCLSNLVCLRLDQRIGKYCDRHALTFTRYADDISISGNKLSIVKKAWVVIKLILSEEGYVINKKKEMLSGPRSKREITGLVVTPKLGIGQRKYNMYRNKIFHLCHKNDNESILIIQGILAYIKGVDHDRYSKLKRYYDALKTKEVTE

SEQ ID NO: 2855 - protein, 303 aa, Enterobacter sp.
  source 1..303: note = Related to CP017087.1
MAKHSQSLYTQRLLSLPILQSIEDLSVKTRLPHALLSQYLTDNSRYYCHIKVPKKTSGYRSIDSPNRQLKALQRWILRNILEKLQSSPYATGFISGISLKQNVQPHSGNQYILKLDIKDFFPSIKASYVYSIFRAAGYSKKIAFHLTSICTLNGYLPQGAPSSPCLSNLVSLRMDQRIGKYCDRHALTYTRYADDISISGNKLSVIKKAWTVVKLIICEEGYSINKKKEMLSGPRSRREITGIIATPKLGIGQNSYNSYRNKIFHLSKKGDPNSKEIILGILAFIKSVDLERHDKLLRYYKKL

SEQ ID NO: 2856 - protein, 305 aa, unidentified
  source 1..305: note = Related to NZ_CP066552.1; note = Pectobacterium carotovorum
MVNHSQSLYTQRLLSLPILQSLEDLSVTMRLPVSLISQYVNNNTRYYYNIPLAKKNGGLRSIDSPNRQLKAIQRWILRNILENLSPSGYAKGFVPKLSLLDNALPHGGNQYVLKIDLKDFFPSIKATHVYSVFRAVGYSKNISYYLTSFCTLNGYLPQGSPCSPYLSNLVCLRLDQRVGKYSDKNALIYTRYADDITISGNKLSTIKRAWKVIRMIIEDEGFVINKNKEMLSGPRSKREVTGLITHPVVGLGTKKYNFYRNKIFHLTKKNSCESHEVINGILAFVASVDSKKYEKLKLYYDGLNI

SEQ ID NO: 2857 - protein, 312 aa, unidentified
  source 1..312: note = Related to JADTQF010000001.1; note = Serratia marcescens
MANRYQGLFTQRLLSLPILQSIDDLAIRTRLPVSLISKYLRNNTRYYRHLVLKKKTGGLRPIDNPNVELKALQRWILKNLLINLSPSIYAKGFIKGISITENAAPHSGNQYILSIDLKDFFSTVKASHVFTVFKSVGYSKKISYALTSICTLNGVLPQGAPTSPALSNLVCLRLDQRIGKYCDNKALTYTRYADDITISGNKLAVIRKAWRIVRLIIESEGYFINKNKEILSGPQSQRKVTGLIVTPKVGIGREEYNHYRKEIFILVKKDDEYSTYKIQGILSFIKSVDIERYKKIKEYYESIVKKPTKKSE

SEQ ID NO: 2858 - protein, 306 aa, unidentified
  source 1..306: note = Related to NZ_PEHC01000003.1; note = Serratia marcescens
MASRYQGLFTQRLLSLPILQSVNDLAIRTRLPVNLVSKYLRDNHRYYTRLPLKKKTGGFRPIDSPNTELKALQRWVLRNLLANLSPSIYAKGFIKKSSITDNAAPHAGNQYILSIDLKDFFTTVKASYVFTVFKSVGYSKKISYALTSLCTVNGALPQGAPTSPTLSNLVCLRLDQRIGKYCENKALTYTRYADDITISGNKLTVIRKAWGIIKLIIKDEGYTINKKKELLSGPQSQRKVTGLIVTPRIGIGRDKYNYYRGEIFKLVKKGDTYSIDRLNGILSFIKNVDKDKYNKLNEYYKKITTS

SEQ ID NO: 2859 - protein, 308 aa, unidentified
  source 1..308: note = Related to JACHAQ010000011.1; note = Pectobacterium brasiliense
MPNQYQGLYTQRLLSLPILQTLDDLATKTRLPKTLLVKYIHDNERYYNSSYIKKKSKDLRTISNPNRELKAIQRWILRNVLSSLSPSPYANGFIPKKSIIDNARPHRGNQYILSIDLKNFFTTVKASYVFTVFKSVGYASKMAYYLTSICTLNGVLPQGAPTSPMLSNLVCLRMDERIGKYCENKALTYSRYADDITISGNKLAVIKKAWIIIRKIISEENFTVNKKKEMLSGPQSQRKVTGVIVTPEIGIGREKYNYFRKRIFILVKKNGDNMSNVVNGILAHVKSIDLGKYKKLNDYYEQLINKTI

SEQ ID NO: 2860 - protein, 310 aa, unidentified
  source 1..310: note = Related to CTIP01000008.1; note = Yersinia enterocolitica
MMKNQGIYTQRLLSLPSLNDLNDLSIHTRLSHDLISKYVSNNKRYYHHFNMTKRSGGVRPIENPDEELKAIQRWILRNILDKLFPSIYAKGFVKKMSILNNAKPHLDHQYILNIDLKDFFSHVKASHVFTVFNALGYSKMMSYYLTSICTLNGYLPQGAPTSPSLSNFVCLRLDHRIGKYCENKALSYTRYADDICISGNKLTVIKDAWHMLRVIIESEGFIINSKKEKLSGPKSRREVTGLIVNPSLGIGRSKYNYYRKKIFILLMANDPKREQIISGILSYVKSVDAKRHIYLCKYYDSIKLKASTSI

SEQ ID NO: 2861 - protein, 315 aa, Vibrio sp.
  source 1..315: note = Related to CP053744.1; note = Vibrio cholerae
MTYISNKQKTNNSGLYTQRMLALPELQSLNDFAAKIRVTPELLTKYTGNNKHHYAVHQEEKKTPGQYREISSPTSELKALQRWILRNILDKLSPSPYAKGFIKKKCLFDNAKPHEGKQYVLNLDLKDFFSSVSSKNVCTLFKSLGYPPLLSYQMTNICTLNGCLPQGAPTSPALSNLVTIRMDYRIGKYCEKYALTYTRYADDMTISGNKLSIVKKARIMINKIIREEGFYIHPKKNKLSGPSVRREVTGLVVNESLGIGREKYNFYRTKMFKLHKEQHPNFESVSSGIIAFVRSVDIVRAQKLHAYFEKLRIKN

SEQ ID NO: 2862 - protein, 309 aa, unidentified
  source 1..309: note = Related to NZ_ML762925.1; note = Dickeya oryzae
MNTHQGKYTQQLLSLPILENVDDLSQSLRLPKEVISKFSLNNDKYYHRIEMKKKTGGIRHIESPLRELKAIQRWILRYILDKLAPSIYAKGFVRKKSIIDNAKPHEGNQYVLNLDLQDFFTNVPASHVYTLFRNIGYNNNIAFILTSFCTKSGYLPQGAPTSPALSNLVCLRLDHRVSTYCKKRALTYTRYADDLCISGNKILILQKASYLIKMIIADEGFTVNTKKEKFLGPKVRREVTGLTVTPRITISKKNYCVYRKRIYDLVRNEVQNKNEIIRGILSFVQSIDKEKGKKLSTFYQKQISLITDI

SEQ ID NO: 2863 - protein, 307 aa, Escherichia coli
  source 1..307: note = Related to JNMO01000114.1
MNTHQGKYTQQLLSLPILENMDDLAQFIRLPKEVISKFSFNNHRYYHRIEMEKKSGGIRYIESPVKELKAIQRWVLRYILDKLSPSVYAKGFVRKKSILDNAKPHEGNQYILNLDFKDFFNNVQASHVYTLFKNIGYNNNISYILTSFCTKEGYLPQGAPTSPALSNLVCLRLDHRLSTYCNKRALIYTRYADDLCISGNKILILQKSSYLIKEIIRDEGFTINTKKEKFLGPKVRREVTGLTVTPKITISKKDYCVYRKRIYDLVRNEVPNKHEIIKGILSFVRSIDKDKEKKLTAFYNKQTSIIR

SEQ ID NO: 2864 - protein, 312 aa, unidentified
  source 1..312: note = Related to nan
MNNHQGKYTQQLLSLPIIENMDDISLSSRLPVEVIAKFSFKNDRYYHRIEMKKKAGGVRLIESPIRELKAIQRWILRNILDKLSPSIYAKGFIKNRSILDNAKPHEGNQYILNLDLKDFFTNVKASHVYTLFKNIGYNNTVAFALTSFCTKGGYLPQGAPTSPAISNLVCLRLDHRISTYCKKRALTYTRYADDLCISGNKLLTIEKASYLIKEILGDEGFSINEKKEKLLGPKVRREVTGLTVTPKITISKKIYCLYRKRIYDLVRNKIPNKHEIILGIISFVQSIDKGKGKKLTAFYEKQKSLILPSLIV

SEQ ID NO: 2865 - protein, 313 aa, unidentified
  source 1..313: note = Related to WLUC01000011.1; note = Providencia alcalifaciens
MNAYQGKYTQQLLSLPIIESVEDLSYLMRLPKETIIKFSTKNDKYYHKIEMVKKNGGIRLIESPIKELKAIQRWILRNILDKLSPSVYAKGFIKNKSILDNAKPHEGNQYILNLDLKDFFNNIKASYVYTTFKSIGYQSNIAFILTSFCTKGGYLPQGAPTSPALSNFVCLRLDYRISTYCKKRALSYTRYADDLCISGNKIHTLQKSSYLIKEILLDEGFIINIKKEKFLGPKVRREVTGLTVTPKITINKKNYNIYRKRIYDLVRNTVPNNVDIINGIISFVKSIDNDKANKLNNFYKKQLDEIKNSTIKV

SEQ ID NO: 2866 - protein, 315 aa, unidentified
  source 1..315: note = Related to JAJAXF010000024.1; note = Laribacter hongkongensis
MVYSSKNSTSSTYRARMTGLPEIRSVKELSHLLRIPESTLHSFSKKNHTIGYVEFCIPKKPNGFRVIHAPVRTLKYIQAWILQNILYHFKSHKSATGFEKGCSILENAKPHAGQSYAINVDIKDFFNSISSDKVFNLFSTIGYEREIAWILTNLVTFKGHLPQGSPCSPKIANLICHRLDARIYGFCKTKNMQYSRYADDITISTSHRKNISQTLRFINNVIEYENFSLRNEKTNVFGRGNAKIITGLVVSNEIRVGREKYREIRAKMYKAIKEDDKYEKEYLDGYLNFLKGVDAKTHQLLITYQEKITKKLKSI

SEQ ID NO: 2867 - protein, 378 aa, Bacillus sp.
  source 1..378: note = Related to CP035974.1; note = Bacillus mycoides
MKELGLFCSIKSYNCSFLGTIEIVPFLFRRIFTNMNSDALYNLSQQMDTKYPIITDVLRNKKHHYNQLDAKKRNGKIRKLYSPSKILKYYQKWIATEILSKTMIHECCTAYQKGISLNENLIPHQKHMYFLCVDIEDFFQSINFKRILHLFKKLTNDTQMAYSLSELCTLHKTLPQGAVTSPVLSNAVNYRLDKRIHGYAKKHGLVYTRYADDITISGNDMGAIKSAYYTVKCIIESEGYKFNKEKTRILKPGVKRKVTGLLINEEQEIRIGREKYRELRSMIYTYKNSRAITGVEKEHLFLRIKGWISYLKHVDFKTCKMLLEYINKIYVNDEKNPFSFLDKRSDEMGYIIPQLQQLESNMNFLTSENTHVNLVIKN

SEQ ID NO: 2868 - protein, 344 aa, Bacillus sp.
  source 1..344: note = Related to CP036026.1; note = Bacillus mycoides
MNSDALYNLSQQMDTKYPIITDVLRNKKHHYNQLDAKKRNGKIRKLYSPSKILKYYQKWIATEILSKTMIHECCTAYQKGISLNENLIPHQKHMYFLCVDIEDFFQSINFKRILHLFKKLTNDTQMAYSLSELCTLHKTLPQGAVTSPVLSNAVNYRLDKRIHGYAKKHGLVYTRYADDITISGNDMGAIKSAYYTVKCIIESEGYKFNKEKTRILKPGVKRKVTGLLINEEQEIRIGREKYRELRSMIYTYKNSRAITGVEKEHLFLRIKGWISYLKHVDFKTCKMLLEYINKIYVNDEKNPFSFLDKRSDEMGYIIPQLQQLESNMNFLTSENTHVNLVIKN

SEQ ID NO: 2869 - protein, 313 aa, unidentified
  source 1..313: note = Related to NZ_JABWTK010000005.1; note = Planococcus chinensis
MGELVFTKVTKDLKTKYPILKDVINFKEKHYQTISIRMKNGKLRTIHNPSKALRYYQRAIVEKFLNEVPIHICCTSYQKGKSLKANVLPHANNMYFLHVDIANFFDHIKFSQVHKLFTDLIEDKYEAKFYAELCTLKGTLPQGAITSPSISNAVNFRMDSRIFGYSKKHNIVYTRYADDITLSSNDFASIQRSLYVVKQILQDEGYQLNTRKVRITKPGIQRKVTGLLINEDQEVRVGRKKYRELRSMIYNYKNNTSVTRKENRALFRKIVGWLSYLNVVDEKTYSLMVMYIKKLYGNTKNPFETMLISKEKI

SEQ ID NO: 2870 - protein, 685 aa, unidentified
  source 1..685: note = Candidatus Bathyarchaeota archaeon; note = Related to JAGGZR010000020.1
MGKHNKGKVIKKYYNPLTPLEVFFNELNSFLRVYGLKFSYEDYCNFIKNKNEYYTTFTIKKKNGGLRRIDSPNRLLKHIHRYILFKHLYNFKAHPSATGFIRGRSIFDNANYHVNKNHVYKLDLVDFFPSITKDMVFNVFISKGYNSEISTVMSELCTLNNVLPQGAPTSPAISNLVCYRLDTRLSSLAKKCKLSYTRYADDITFSGWYIKKGVTKLIEKIITDEGFKVSKEKTKLIKNKKNFRQVVTGVVVNKKLSMGEKRYLMLRAMIHNCKVKGIYQVQMETKEKHGKGYFARRDLYSAKVDMFNYLLGIVELFRQMKDYKRYLTMLRDLYYLDWVRYYVEAGELNANELGIMRKKIIERRIKKFVRSELKDIKSRSDSLNNKLKRYNSRLERLKEYIRQNTYSEKERLIDEFLRLQERIDTLTQETNNMSRFLSFVSDFISKNWGRSLMKLLNSVTEEVEETMSTKYTVQNNFIKLGNEFLEKNINVNLSVNYNNINVEGSLSKHISPDKPFSNISYFWGLIRSNRGYIKWLDKYFNKSGFRLLTDEIGDDPKYKSISILMSIYPFVGGENKESAIRKVERFIDIFKRFKEEMRNKGISVELRILDKDSSAEIHDRVIIFEENAYTVPSIDTLMRGQHSYIFPINPIDFPFDEYWNRSFDILSDRNKINELIDKYVNNKKK

SEQ ID NO: 2871 - protein, 592 aa, unidentified
  source 1..592: note = Candidatus Woesearchaeota archaeon; note = Related to JACJVW010000001.1
MVKKFINRNSESKFLDDLRRHIDFELTQEDLDIFFQDKYNKKNKLHYSSYSISKHSGKKRRINAPSRELKKVQEYILYKHLYYFPVHKNTYGFIKNKSYVDNAKQHIRKPHVFKTDVEDFFPNIRHERIFSFLVNGFSSKDYDSVFDSNPQLEIRKQRRGYSEKIATLITELVTLDGSLPQGAPTSPALSNLICFPLDYRLSRFAKKGRLTYTRYADDITFSGKYIRKDFISKIKTIIVDECFKINEDKSKFISRKRARIEVTGLVVNTKLSYGRERYRKIKAMLDQCKKNGISSLNKDNNDETGIKNHIDFYQHIIGKIDIFNQIKHYKKHMVLLKILFQINWADYYTKQEDLLESYNKHNHSSFTSTELGEIRKKSIEKLTHKAVLKQEREDKKRDTRRAAYYAKKNKSILEDIKTKLSQQDQLISVYSETLSKEYEDKYNLIEKIQADRLKIQELEKNLEDANKKAKQAEKFNTDLTKILDRVDKNSKTLERLEKQGQKTQDIVTSIDKKIDSIADRLGKNMVSLFDAIKESKEAITKEIKANHISLEKGIEEIHKATQMLVEIQKDKDPDLWERCREKVQKRLSWWKV

SEQ ID NO: 2872 - protein, 541 aa, unidentified
  source 1..541: note = Related to NZ_CP009524.1; note = Methanosarcina sp.
MEQLSPICGRVKVLNEADYNNEFQYFKQLKSKKLPYIYDIDHFCKLIHLSSNQVKFFLSHKEKAYVTFRVPKKNGDFREINAPSKKMKYIQRWILDEILYKLNPGEYAHGFIPGKTVYTNAESHVNKDLVLGIDIKDFFPSIKFVSVYNVFKSAGYTEKVARQLADLCTYHWKLPQGAPTSPMLANLVALDLDKKISQYCKRANFGYSRYADDITISGSYDLAIHKETIVRIINGAGFEVNNQKVRMVSKGSRQKVTGLVVNHKVSIGRTKKKTIRAIVHNILMNGPVLENRCNDPFFRERIFGHLGCASAIDPEFALPLIDSLKKIDWSEYCEHIKEVKESEINKNRIKRINKVLIVKFDELGFFRKIGEVPRDAFTEEFKIKLGTLQEMCSKEIHGVVACSNCLNVKNEIYKSCMKYILGQYTGTTGGHHHGHEIYDMKAVTDYNGENIVVAFLMKSGTNSPTKENSVFTQAFDCAGYNENIDLISLVSNHNLSNKLCERLEIMIRDKNRGKEKEQLYCLIMKSEMERILYDFNKNKDC

SEQ ID NO: 2873 - protein, 560 aa, unidentified
  source 1..560: note = Related to NZ_CP009515.1; note = Methanosarcina lacustris
MTEKLTKNERLKVLFDDRIEEGVVPKLSEEDYNKEFKYFTQLKSKKLPYIYDIDHFCKLTNSSSKQVKFFLSNKEKAYATFKVPKKSGDFREINAPSKKMKIIQRWILDKILYKLNPGNYAHGFIPGKTIYTNAKAHVNKDLVLGIDIKDFFPSIKFVAVYDVFKFAGYTARVARQLAELCTYHWKLPQGAPTSPMLANLVALNLDKKISQYCIRENFEYSRYADDITISGSYNLAMHKEIIIKIINENGFEVNYKKVRMVSKGSRQKVTGLVVNDKVGMGRTKKKTLRAIVHNILMNGPVFENRDNDPFFRERIFGYLGCANAIDPEFTSPLIDSLKKIDWSEYEECIKEIKESEINVNHIKRINKVLLVKFDELGFFRKIAELPEGAFSEEFKTKLESLQEKCDVKIHGVEACSDCLDVKKVIYNKCMKYVLGHYTGTTGGHHHGHEIYDMKALTDYNGENITVAFLMKSANKPAKENNSNKENSLVVQTLDCTDYNDSINLISIVSNNNLSNKSCERLEKIIKGMSKGKEKEQLYCFIMKKEMKRILYDFYKNYQSS

SEQ ID NO: 2874 - protein, 564 aa, unidentified
  source 1..564: note = Methanosarcinaceae archaeon; note = Related to DUKH01000154.1
MTKRLTKNERLSILFDDCIEEGIVPVLNEAEYKEQFKYFKKLKSKKLPYIYDIEHFCKLSNSSSDQVRFFLSNKEKAYTTFKVPKKSGGFREINAPSKKMKNIQRWILDNILYKLNYGDYAHGFVPGKTIYTNAEVHVNKDLVLGIDIKDFFPSIKFGAVYNIFKSAGYSVRVARQLADLCTYHWKLPQGAPTSPMLANLVALNLDQKISQYCIRRNFGYSRYADDITISGSYKLPMHKEKIIKIINENGFEVNNKKVRMLSKGSRQKVTGLVVNDKVSIGRTKKKTLRAIVHNILMNGPVVENRNEDPFFRERIFGHLGYAKAIDPGFSTPLIESLKEIDWSEYNEHIKEIKENGINTNQLKRVYKTILVKFDELGFFTKIAELPEGAFTEEFKIQLNSLKEKCDAKTHGVEACSDCLDIKDEIYNKCMKYIIGHYTGTTGGHHHGHEIYDMKATTELYDDTIAVAFVMKSGDISNKKERRKGTDSENSAFRQFFKCTCYEDLDLISIVTNFNLNNELCEELKIMMRNNNKAKERDQFYCLIMRNEMKRILYDFNTKKAENLT

SEQ ID NO: 2875 - protein, 550 aa, unidentified
  source 1..550: note = Methanosarcinales archaeon; note = Related to CAJPFJ010000036.1
MEISNNEKLKILFDSYIETAIIPSLNEDEYRKEFKSFKRLKSKKLPYVYDIDHLSNLTNSSSKQVRFFLSNKDIGYTTFRIPKKMGGFREINASSKKLKIIQKWILNNILYKLDSSDYVYGFIPGKTIYSNAQIHVNHDLVLGIDIKDFFPSIKFGSIYHIFKSAGYSNKIAWTFADLCTYHWKLPQGAPTSPMLSNLAGKRLDMRIAKYCNRRHFTYSRYADDITISGSYKLPMHKEKIIKIIEGNGFTVNKKKTRLFSKGSRQKVTGLVVNDKVSIGRKKKKWIRAIVHNILMNGFVAENKENDPFFRERIFGHLGYTNMVDSEFARPLIESLKKIDLSEYNEAIIETRESEIKVNYLKRKSKSILIKFDDLGFFQKIAEFPEGAFNDDFKNQINNLLEKCEKHGVEACSDCLDIKNEIYKKCMKYIIGHYTGTTGGHHHGHEIYDMEAETRLFGKTIAVAFIMKSGTSDSTKENSIFRQVAKSFRFDGIDLIGIVTTSNLKSELLEDLKSLIMNHNNGKKKEQLYCLIMRPEMKRILYDFNKVVTNS

SEQ ID NO: 2876 - protein, 563 aa, unidentified
  source 1..563: note = Related to AE010299.1; note = Methanosarcina acetivorans
MVSVENKLTEDEKLQILFKNYTEEGIIPNLTEEEYEEQFKSFKRLKSKNLPYIYDINHFCKLTNSSLKQVNLFLSNKKKGYITFKLPKKNGDFREINAPSKKMKYIQRWILDNILYKLNSGDYAHGFIPGKTIFTNAKVHVNQDLVLGVDIKDFFPSINFRSVYYVFKSAGYTKKIAWTLADLCTYHWKLPQGAPTSPMLANLVALKLDKKIAKYCARRNFRYSRYADDVTISGSYKLPMHKEKIIGIIEDDGFVVNHEKTRMFSKGSRQKVTGLVVNDKVSIGRNKKKNLKAIVNNIQTNGPVAENRSNDPFFRERIFGHLGCANAVDPEFATPLIESLKKIDWSEYNEHIKEIKESEINTNQLKRVSKTILVKFDELGFFTKIVELPEGAFTEEFKKQLNNLKEKCSTKIHGVEACSDCLDVKNEIYKKCMKYIIGHYTGTTGGHHHGHEIYDMKATTEFYGDTIAVAFVMKSSDISDKNERRKNTDSENSTFRQFFKCTCYEDLDLISIVTNFNLNNELCEELKIMMRNNNKAKEKDQFYCLIMRDEMKRILYDFNKNCG

SEQ ID NO: 2877 - protein, 502 aa, unidentified
  source 1..502: note = Related to JJOZ01000022.1; note = Methanosarcina sp.
MSNKEKAYSTFKIPKKNGGLREINAPSKKMKNIQRWILNNILYKLNAGNLAHGFIPDRSILTNASIHVGQDLVLGIDIKDYFPSISFRSVYYIFKSAGYTKKIAWSLSDLCTYHWKLPQGAPTSPMLANLSTVDLDYEIDNYCTRRNFRYSRYADDITISGSYKLPMHKQKIIEIIERNGFVINEEKTRVLSRGSQQKVTGLVVNDKVSIGRRKKKILRAIVHNIQKNGAETENREKDPFFKEKICGELAFAKMVDPDFANPLIEKLKGFNWLSYDENLKNSRDSELIVRSLEKKHYFHPVDANNIIESESDFLKAIATTITELKHYIEDRRWTEPFWDEAREVEMDGKKYKIPAVPKKESKIQPTIHIFFCRNLLPFGIHVLRETDEGIGKLDFKFLVTIKGNIPVNVCAEFKLAHNEELEHGLTKQLPLYLKASPSKSGLFLVMWFKDEKEEYFKRPTNQNKTQMLKYLEETIKKINECGKFKIESVLIDASKRPSASHS

SEQ ID NO: 2878 - protein, 572 aa, unidentified
  source 1..572: note = Related to NZ_CP009524.1; note = Methanosarcina sp.
MANRLTKNERMKVLFDNYFEEGIISPLRDVEYNDNFKSFKKLKSQKLPYVYDVNHFCFLSNSSSKQVNYLLLKKEKAYVTFNLPKKAGGFREINAPSKSMKHIQRWILDHILYKMSLGDYVHGFVPKRSILTNASIHVSQNLVLGIDIKDFFPSIDFNSVFRIFTSVGYTQKAAHFLAALCTYKSKLPQGAPTSPMLANLAIASLDIIIDKYCRRRNFKYSRYADDITISGSHNLPMHKQKIIEIIEGNGFTVNEEKTRLHSRGSRQKVTGLVVNDKVSIGRSRKKTLRAIVHNILKNGYEIENREKDPFFKEKIFGELAFARMVEPDFANPLIEKLKCANWASYDEQTIDSRESELLMRSLEKKSYHKPVDATQIIESESDFLKAISSTIAELKHYIEDRRWIEPFWDDARVIEINGEKHKIPASPKKETKIQPTLHVFFNRNLLPLGVQVLRETDEGVGKLDFKFLVTLKGNIPLNVCAEFKLAHNEELEHGLTKQLPLYLKASPSKSGIFLVMWFKDDKGKYFSKPISQNKSQMLNMIEEAIKEINNKEEFKIESILIDASKKPSASNN

SEQ ID NO: 2879 - protein, 580 aa, unidentified
  source 1..580: note = Related to NZ_CP009517.1; note = Methanosarcina barkeri
MTRKVAENIKLKILFNDYFEDGIIPTLKGKEYSDNFNSFKVLKSQTLPYIYDVHHFCFLSNFSAKQILFFLKNKEKFYVTFSIPKKSGGFREIDAPSKQMKLIQQWILNKILYKISIGDYVHGFVPKRSILTNASNHINQNLVLGIDIKDFFPSIDIKRVTEIFLCMGYTQKTASFLAELCTYEGKLPQGAPTSPMLANLAVKELDIAIDDYCKKRNFKYSRYADDITISGSQKLAMYKQKIIGIVESNGFAVNEKKTRLHSKSSRQKVTGLVVNDKLSIGRENKKKLRAIVHNILMKGPIAENRNNDPFFRERIFGYLGYANTIAPEFATPLIESIKNIDWSEYYESIKEIKENEMNINHIKKMNKTILIKFNDLGFFRMVVEFPEGVFSEAFRNQLDNLQEKCGEHGIVACSDCLDIKKEIYSKCMKYVIGQYTGTTGGHHHGHEIYDMKSKTDLYGDSITVAFLMKSSAPKKESKTKNKANKTSNRRITAVDDSLFRQFYECTRYENIDVIAIVTNSNLNNELSERLEQLIKKINKADNKEQLYCLIMRNEMKRILYDFNKKTTNETGQYDNAFNNM

SEQ ID NO: 2880 - protein, 560 aa, unidentified
  source 1..560: note = Related to JABKBV010000155.1; note = Methanococcoides sp.
MTNKITENEKFKILFDDYFEEGVVPSLSKEEYNTNFKSFKKLKKMKLPYIYDLEHFCNLSNSSSKQIGFYLSHKDKAYSTFNLRKKTGGLREINAPAKNLKHVQRWILDHILHKIDVGTSAHGFVPGRSIVTNASIHVNQDLVLGIDIKDFFPSISANSVYYVFKRVGYAREVSRLLAEVCTHNWRLPQGAPTSPTLANLVALSLDSDIEKYCSKRNFKYSRYADDITISGSSNLPMHKQKILEIIEKNLFIVNEDKTRMFSQGSKQKVTGLVVNDKVSIGRNRKKKIRAIVHNILKNGPVRENRENHPFFKEKIFGELAFVKMVDPEFANPLIVKLKQLDWEDYNKKIEDSKEAKLRVNSLMRKSYAEPMYVNQKIESEDDFFKAITDIFEKLRWYVEDQRWTEAFWNDCNPPTPKKETKIQPTLKMFFKQELNPIGIHVERETHEGIGTLDFKFLITIKGSPLVVCAEFKLAHHKKLEHGLTTQLPLYLKASLSKSGIFLVMWFKDEKEEHFKEPTNKNKSEMLTYLEGKVKEINENEDFKIESILIDASKKPSASQS

SEQ ID NO: 2881 - protein, 659 aa, unidentified
  source 1..659: note = Related to NZ_JABKBV010000010.1; note = Methanococcoides sp.
MDKLPNDDKLKIMFNHYFEKGIIPKLSKNEHINNFNSFKKLNANNLPYIYDRDHFCSLSNSSSKQIGYYLFKKEIAYSTFNLPKKNGSLREISAPAKPMKYVQRWILNHILYKLDVGDFSHGFVPGKSIVTNASIHVNQDLVLGIDLKDFFPNIQFNSVRYIFKSAGYSPKVASLLAEICTYHHTLPQGAPTSPTLSNLVALKLDKKIATYCAKRNFKYSRYADDITISGSSNLPKHKQIIIEIIEKNGFIVNEDKTRMFSQGSKQKVTGLVVNDKVSIDRKRKKNIRATVHNILKNGPEMENRENNPFFKEKIFGELAFVKMVDPDFANPLIDKLKQLDWINYNKKLSNPREMELMVRSLQKKSCIDPETYNQPIESEGDFLQVICDVIAEMKRGIEKPRAYKAFWNEGSTEILDGNEHKISPTPKIEKNIQNIIVLFIEDRLLHQGIQTIEESDEEIGYFGFKFLFTTQKRKALNISTGFKLAHDSQLEHGLIKQLPSYLEASSSKSGIFLVMWFKDENGTFFNKPINRSKSEMLAYLRETVKEINENEDLKIESILIDVCEKSSASKTEYKNDHDDEGGKGKNISYYLSIIKCKIQKLWKIIIGLLVLIGLLADAINGWPVIKEFMTSISTSFINYSSYIFSLNIQLSSIFAVFFK

SEQ ID NO: 2882 - protein, 568 aa, unidentified
  source 1..568: note = Related to JAIOTP010000268.1; note = Desulfobacula sp.
MPESMILTVSQFEEFMESIKPPLSSEDIEFQRKHFEKLTYNKLPYFFNVDHLANSIGFSSPQLHLFISNKRVAYSTFKLPKKNRGFRLIDAPSKDMKIVQRWILDNILYKLNVGEYAHGFVPGKSIATNASIHVAQDLVLGIDLKDFFPSITLGRVIGLFRGIGYNEEIAHALGELCTFNWKLPQGAPTSPMISNLIAWNIDIKLSGFCKKRNLNYSRYADDITISGGKRLPKYKTLIFRKIEEEGFSINWEKVRLHDRGSSQRVTGLVVNDKVTLGRKKKKTLRAIVHNIVKNGPETENRENEPFFKEKIFGQLAFAKMIEPDFADSLLDSLKHVDWNSYDKKLTGLIEGELSVRSLEKKKYCIPVVEDQDIKSETDLLKVICDVITELRYYVEDRRWIDAFWDDSREVEVDGNKIKLPAFPKKETKIQPTLYVFFDRRLYPLGIHVSRETDEGIGKLDFKFMVTTKSHIPLLICAEFKLAHSTKLEHGITVQLPAYLKANRSTSGLFLVMWFKDEEEKFFDKPNDQNKLQMIEFIEDKINVIKYEEEIDIKSILIDASKKPSASNL

SEQ ID NO: 2883 - protein, 332 aa, unidentified
  source 1..332: note = Related to MT630658.1; note = Methanosarcinales archaeon ANME-2c ERB4
MRMTKDQILTEDQFKVFISSIKPPLSEEEHESQCSSFKKLKRNELPYILNIEHLAELTGSSPAQLHLFISDKRKAYSSFKLPKKRGGFRKIDAPSKKMKTVQRWILDNMLYKLDAGNYAHGFVPNRSIATNASVHVGQELVLGIDIKDFFPSITLKRVVGLFQSIGYNEEVSHGMGELCTFNWRLPQGAPTSPMISNLIAWHIDIKLSKFCNKRNLCYSRYADDITISGGTELPRYKTLIFRKIKEEGFSINDEKTRVHGRGSSQRVTGLVVNDTITLGREKKKRLRAIVHNIAKNGPIAENRDNDPFFRERVFGHIGFAKMVEPDFAKSLQ

SEQ ID NO: 2884 - protein, 548 aa, unidentified
  source 1..548: note = Related to JAIORO010000110.1; note = Methanococcoides sp.
MILIDSQFKKFMDSIKPQLSREEYDLQLTSFEKLKKNELPYILNIDHLAHLSGISPQQLHLFIKNKRIAYSSFKLPKKNGGFRSIDAPSKNMKLVQRWILDNILYKLNAGEYAHGFVPKKSIATNALVHVGQELVLGIDIRDFFPTITLNRVEGLFKSIGYNEEISYALGELCTFNWRLPQGAPTSPMISNLIAWRMDIKLSKFCEKRGLIYSRYADDITISGNKNLPRYKTLIFRIIEEEGFSINEKKVRLLGRGSSQKVTGVIVNDKISLGRKSRKRLEAIIHNILKNGPIAENLNNDPYFKEKLFGHLGFASMIEPDFALPLLQSLKKIDWEPYDCALETSKESELNYKSLSRDSHSNLIKFDNLGFFKDVETLPLKWKDELITQLDELKEKCEEQSIDACKNCMHVRKELYEKCIKYILGHYVGCTCGPHHGHEVFDVGGETDLYGDSVFVAFLAKAGKLDRKSKDSLFHQFFECTIQEGLDVISVVTPEILDNRLKMDLRILFRDCGKEKLFCLIMRDEMSRILYSFQRIISNNMCEDEKKAP

SEQ ID NO: 2885 - protein, 560 aa, unidentified
  source 1..560: note = Related to CP009514.1; note = Methanosarcina mazei
MNCSAICDEKQFEEFMDSLQPSISKEEYDTQYESFLMLSEKNLPYIYDLNHLSLLIGESTKQLDFFVRNKRKIYVSYRMKKKRGGYRTIDVPSKKLKFVQRWILQNILYNIKVSKHSHGFIPGRSIATNAKIHVGQELVMGIDLKDFFPSIKFNRVRGFFKSVGYNNHISTILADLCTFNWQLPQGAPTSPMISNLIASRLDRRLAGFCKKKELLYSRYADDITISGGKVLPRYKTLIFRIITEEGFEINCEKVRIQGRGSCQLVTGLVVNDKVSIGRRKKRIIKSLVHKISENGSIEANETENPFFKEMVYGLLSFTNVVDPEFAQPLIEKLNLIDWKEFTEAYSQYQKSEIIERSFKKCPTIRRILFNDLEFFKGIKLIPQNELTKEFLKELSLLKEKCSEHKKENCQDCLLTEEISDKTCMKYILGHYIGSTGGAHHGHEVYDIGEITEYKSQEVFVAFLMKSKDDTNSKNSLFTQFFDCTENGGIDIISVVSTEDLDHKTILRLQRVMKQFAKEHLYCLILRKEMASILYSFKKEFSKNNREKSLFHNGDQSSLLI

SEQ ID NO: 2886 - protein, 533 aa, unidentified
  source 1..533: note = Candidatus Lokiarchaeota archaeon; note = Related to JABXKB010000305.1
MDLERQKINFDIPYQSFNQYRRDFRFANKHLGTQCIKFCINYAKALKKKNLPIIYNLEHLSHHVKLSKKSLYFIIKQKEKFYQLFEIPKKKEGVRNITAPSKILKNVQRWILDCILYNIDIHKNATGFYLDKSIIKNANFHLNQKMVLNIDLKDFFPSIKNKRTYHIFSSCGYNHSVCKILSELCTFNNELPQGSPASPMISNIVCKSLDSRLFGFCKKNNLNYSRYADDITISGERNLTKYILFIFKIIENEGFKISTKKIRLTGRGNAQIVTGITVNDKISFDRKKLRKIRAIIHNCKKIGPEKANKNKHPFFREYLYGYVAFLKPIKPELSKKWKKELDSIDWGAYKKKYDVDIIINDSEKELSNPTAFISYSWDSKKHREWVIRFAANLIKNGINVLIDEWDLKDYNDDLNYFIECGIRDSNHVIIICTPKYAKKANKRLGGAGIETAIITGEIYEKTNAGKFIPIALNYQKSMKECLPTYLKNKFTFDFNEEERYEEKIELLLRKIYKKPKYKKPKLGTIPDFKSKDI

SEQ ID NO: 2887 - protein, 390 aa, unidentified
  source 1..390: note = Related to NZ_MWJI01000004.1; note = Paraclostridium bifermentans
MILESLNLPKIYNLESFSTEIGLSTTILYLLSQRQDKFYHQVIIPKRKSGNRTLSIPSMSMKIVQKWIKLKILDKIPVSNCAMAFRKGNSYGIKTNAELHKYNTYILRLDLKDFFNNIKKEKVFFLFREIGYNNYISNILSNICTFNESLPQGGITSPSISNLICKKLDIRLESLASKRDITYTRYADDLIFSCNDEVLLIKTKNAILDILKSEGMEVNKLKTKFIRPGSRKKITGLHIDKNRVIVPRDTKRKVRAMIHYSIATGDYSKLDEIKGYISFISSIEENYISKIKSYINKIANNEQYRLFEDIVESYNKNKIFKDLDTMNFIDEYIEEIDGIEYDLSSTYFYNRIDFLKKNELQEVIDNITNGEDNNVDDIATTYLDNETCPF

SEQ ID NO: 2888 - protein, 379 aa, unidentified
  source 1..379: note = Related to CP037830.1; note = Clostridioides difficile
MHLKYSNLMTLESLNLPKIYNLESFSTEIGLSTTILYLLSQKQDKFYHQVIIPKTKSGNRTLSIPSISMKIVQKWIKVKILDNIPVSNCAMAFRKGTNYGIKMNAELHKYNTYILKLDLKDFFNNIEREKVFYLFREIGYNNYISNILSNICTFNEVLPQGGVTSPSISNLICKRLDRRLENLASKRDITYTRYADDLIFSCNDEVLLIKIKNVILDILKSEGMEINKLKTKFIRPGSRKKITGLHIDKNKVVVPRDTKRRVRAMIHYAITKEDYSKLDEIKGYISFISSIEGNYISKIKSYINKIVNNGQCRLFGPIVESYNKNKIFKNLELVSCIEEMDWVITKGAFYNREKYELKEVIEKSTEYGEDNINGETSPF

SEQ ID NO: 2889 - protein, 378 aa, unidentified
  source 1..378: note = Related to NZ_CABIXZ010000002.1; note = Intestinibacter bartlettii
MFIIKDDIRKYGNLMILEALDLPKIYDLNSFGREIGLSNTILYLLSQKTERFYKQTKIPKKKSGTRQISIPSISMKIVQKWILINILEKIPISNYAMAFRKGSKYGIKTNAELHKYNECIIRIDLKDFFNSIEKEKVFYLFKSIGYNNLISNILTNICTLDGCLPQGALTSPILSNLICRNLDRRLEGLCSKRDMIYTRYADDIILSCNNEVLLIKTKKIVSAILCDEGFKINQSKVKFMGVSSAKRVTGLHIEENKVVVPRMLKRKVRTMIHHTIVVGDYSEIDKIKGYIAFISSIEPNYRKKVIEYINKITSKQQYRIFKEIVDGYNSNKILKECKDMEYFNEECNEDIENDFYSERENFINMLLKEKNDTGSYGE

SEQ ID NO: 2890 - protein, 402 aa, unidentified
  source 1..402: note = Related to NZ_BHYK01000003.1; note = Clostridium tagluense
MFTIKRVKYRNIIILEALNLPKIFDIKSFSISIGLTPTILYLLSKETERYYTSIKIPKKKVGTRQLRIPSFSLKLVQKWIKINILDKIPISDSAMAFRIGKDYGIKQNAELHKYDSYIFKIDLKDFFHYIHREKVFYFFYNLGYNNLISNILSNICTFNDVLPQGAVTSPSLSNLLCKKLDSRLEGVASKRGISYTRYADDLIFSCNDKVLLIKTQKMIYEIVEDEGFQVNSEKVKFMGPATRKSITGLLIVENKVIVPRSLKRKVRRMIHYMIATSDYSRLDVVKGYISYISSIEKKYIEKIKRYINNMVNNDQYKVFDDIVNLYNENIFLECNEMEHVSFESCIDIVDGTVLDFGEHYVDERITFFKKHNICGRLSSLGIEYEEIAATVNVTSENDGGGK

SEQ ID NO: 2891 - protein, 396 aa, unidentified
  source 1..396: note = Related to JACBEK010000003.1; note = Clostridium botulinum
MKVKYENTVVLGILNLPKIYDLYSFSEEIGLSTTIIYLLSKKTDRYYNTIHIPKKKKGRTRQIDIPSFSMRIVQEWIKNKILDSIPISDSAMAFRKGKKYGIKKNAELHKNNQYILKLDFENFFSNINKEKVFYIFKSIGYNNTISDILTNICTYNESLPQGAITSPSISNIVCKMLDSRLEGLSNKRNITYSRYADDLIFSSNDEVLLKRTTKVIFDIINDEGFYINKEKIRFIYPQMRKSITGLLIAENRVVVPKEMKRKVRAMIHNMIASADYTDIDKVKGYIAYISGIESEYIEKVREYVNKMIEKEQYKVFDDVVTEYNKNKLLKGTEDMELLPIGSCIEEDELGFYSQDFAEDYYEERIEFLQEKYPEKVKKLSITYKEANSENNEELLI

SEQ ID NO: 2892 - protein, 408 aa, unidentified
  source 1..408: note = Related to NZ_JZJQ01000041.1; note = Clostridium sporogenes
MLTINNLKYSNSIIIDTLGLPKIYDINSFSTEIGLSPTILYLLSQKQDLFYKDTYIPKRDGSNRQISIPSISMKLVQKWIKVKILDKLYISDMSMAFRRGNSYGIKKNAELHRYDLYILKIDLTDFFHSIDRMRIFYLFKGIGYNNLISNILTNLCTYKERLPQGAVTSPVLSNLVCEKMDKRLSGVASKRGISYTRYADDMYFSCDDEILLRKTQSMIYEIIKDEEFKINNKKVKFMGPSSRKCITGLVINDSKVVVPREMKRKVRVMIHHGIATGDYSKVDSIKGYISFISSIEKDYENRIKKYCQSLIDKDQYKVFDDLIEKYNQNKFIDTNEMKQVDEDELLYEFEGIELNHIDSYIYERIEFYKKNNLENKMKDFYIENKEIACVLNEEIIMNSDDNNEDFGF

SEQ ID NO: 2893 - protein, 353 aa, unidentified
  source 1..353: note = Related to NZ_FQXP01000010.1; note = Clostridium collagenovorans
MLTIKNLKYSNSMILETLGLPKIYDIESFSTEIGLSPKILYLLSQKQYLFYQNKQIPKKDGSSRQISIPSTSLKLVQKWIKIKMLDKLPLSDFSMAFRKGKSYGIKKNAELHKYDSYILKIDLKDFFHSINKTKVFYLFKGVGYNNLIANILTNICTYEDRVPQGAITSPVISNLICKKLDYRLSGVASKRGISYTRYADDMYFSCDDEILLRKAQNIIYKIIKEDDFIINNKKIKFMSPHSKKFVTGLIINDTKVLVPKEMKRKVRSMLHHAIATGDYNNIDSIKGYISFISSIEKDYRIKIEKYCEELIDKKQYRVSNDLVDKYNNNNFLKTKSMEYIQDTEFNEYEELIF

SEQ ID NO: 2894 - protein, 404 aa, unidentified
  source 1..404: note = Related to JAGZKV010000024.1; note = Clostridiales bacterium
MSQNIPTLLMNSLKLPYFETIEELSELTRLSTQLLYCLSTKTSKYYIIKKIPKKNGGLRELSIPSYTLRIVQRWILTEILNKILPSDRAMAFRKGKDFGHKQNAYYHANTLYGLSIDIKDFFPSITVNKVYTIFSTLGYNSFAATILTNLCTLEGKLPQGSPCSPAISNIICSSLDRRFVGLCEKRGIRYSRYADDMYFSCDDKILLLKNFPIITRIVESEGFILNTRKVHFHTPSNKKQITGITVSPTNIEDYVELKAPRTLKQKIRAEIFTCLISGQYQNKDHILGEIAYVDFIEKENKSKYLERIKNYIGKQLVKIQLFPELVMEYNNNKFYEDLPLAISIDINIVTEEDFDDIECLFRERKKFLQKNGIKDICKYSKWPDIIINSSYNIAENIADIECPF

SEQ ID NO: 2895 - protein, 344 aa, unidentified
  source 1..344: note = Related to PYLO01000002.1; note = Clostridium fessum
MSQKISPLLINSLKLPVFETLEELSEITRLSTRLLYCLSKKTDRYYNVIEIPKRNGKMREISIPSYTLHIVQRWILMEILNKLVPSSSAMAFRKGDNFGHKQNAIYHADTLYGLAIDLKDFFPSITANKVYTLFSNLGYNHFAAAILTNLCTLDGRLPQGSACSPAISNIICMNMDKRLIGLCEKRGIRFSRYADDMYFSCDDKLLLLKNYPIIKKIIEDEGFLLNERKTHFHTPSNKKQITGITISPGKAENAVELKAPRKLKQKIRAEIFTCLMTGDYKNREHILGEIAYVEFIERENKYPYKDRIRHYIEEKSTKIQYFPELVQAYNENRFFKDMPLLEGK

SEQ ID NO: 2896 - protein, 401 aa, unidentified
  source 1..401: note = Related to JAFQFZ010000002.1; note = Clostridia bacterium
MRKISQSLLINSLGLPRFSTIEQFSEITGLSTRLLFCLSNLTEKYYRNKKIPKRNGDMREIFIPSYTLRIVQKWILKNILNKIVPSNQSMAFRRGSSFGNKQNAAYHAYTLYGLSIDLKDFFPSISANKVYNIFSSLGYNEFAATILTKLCTLDSKLPQGSPCSPAISNLVCITLDNRLAGLCQKRGIIYTRYADDMYFSCDDKTLLLRYYYAFKQIIENEGFVINDRKTHFNTPSNRKRITGVTIVQHHLDEKFELKAPKEMKRKIRAEIFMCLMSGDYKNKGKILGEIGYVSFIEKDNNFNYISSIKQYITTTAEKIIYFPELVDAYNNNLFFDDLEEIESALIDPKDEEELYYYGDMYNSRKIYLNKRNLSDVCTYKDWPQVITSQNNSSTDNTDLPF

SEQ ID NO: 2897 - protein, 382 aa, unidentified
  source 1..382: note = Related to NZ_WIQR01000001.1; note = Pectinatus frisingensis
MKVNNLLIKSLNLPEFKNIKELSILIGVSSRLLYCLSQNTEKYYTHKIIPKKNGTNRCLSMPSYTLKIVQRWILKRIIEKIIPSKSAMAFRVGKNFGYKQNASFHSDTLYMLSIDLKDFFDNIKSFKVYCFFISIGYCEFAAMILTKICTLDNKLPQGGVCSPALSNLLLSSLDKRLIGLSEKRGIRFTRYADDMCFSCDNKVELLKIFPTIKKIISEQGFIINDHKTYFSTPSNRKKITGITISKKNNIIELKAPRKLKKQIRVEIFQCIVSGDYSKKNHIIGEIAHVNFIEKENKIKYINNMKKYIETTGKKISCSPELVTAYNENLFFNDINKLEIMPLINIACRRNAVDFFKNRKEYLGKRHIVDICKYNGLMIYCDI

SEQ ID NO: 2898 - protein, 408 aa, unidentified
  source 1..408: note = Firmicutes bacterium HGW-Firmicutes-4; note = Related to PGZR01000048.1
MSNLKRLNYIYINTLKIPAFQNIYELSRLTGISSRMLYCLSKNNVEYYKTFTILKKSGDPRTINAPLYSMAIIQKWILRNILEKITPSNRAMAFRKGSEFGCKMNAKYHVGTLYGLSIDLADFFTSIKSNKVYCLFRNLGYAETAATILTNICTLDGALPQGGVCSPTISNLICITLDNRLIGMCEKRGIRYTRYADDMYFSCDNKDLLKKTFPKIKTAIEDQNFTINNNKTRYHTPSNRNQITGVVIVKTNQYEEYELKAKRKLKQSLRAEIHNAIMTGDYKNKGHILGIISYINFVEKENSDNYLERIKEYIVKCANKIIFFEELIKAYNENLFFNNMEKIAYDKDQIVDFFKEEDSYLKLLDKRIEREAYLQKYHRDDICMYLDWPRGLDPNNNNDIGLMDDCPF

SEQ ID NO: 2899 - protein, 412 aa, unidentified
  source 1..412: note = Siphoviridae sp.; note = Related to BK019570.1
MQKNNLLLINSLGIPYFECLEEFSRIIGLSTKLIYLLTNKTEIYYSFKEIPKKNGKKRIIAIPSYTLKITQRWILKNILNKIRPSDYVMAFRKSSNNNKFDIKKNAYYHSDSLYGLSIDLSDFFPSINAAKVYRIFKGIGYNNTASAILTNLCTLENKLPQGAVCSPALSNLICMRLDRRLFGLCSKRGVLYTRYADDMYFSCDNKGLLLKMFPIIEKIIKSEGFIINQDKLHYHTPKNKHLITGVVISHSNDTSELKVSKEFKRKIRAEIFRCIMTGNYENAAHIKGEISYVCFIQSENRQDYKQSIIQYINRTSKKIEYFCELVDAYNENFFFDEQEPLEFLDINKLEIDCPEKDTDNYDQYLFETIEAIFQYRKEYIKNNNLTDICKYQNWPKNTTENEFDASSEETPF

SEQ ID NO: 2900 - protein, 393 aa, Bacillus sp.
  source 1..393: note = Related to NULM01000015.1; note = Bacillus thuringiensis
MNKNFTNSFILNALNLPIIRDLDTFSNSIGVSKRLLYLLSQSSEEYYRSFFICKKNGDQREIHTPTYSLKLVQRWILEEILEKIDVSEESMAFKKGPGNGIKKNAEIHLYSLYLLQLDLKDFFTSIKREKVFYLFKDLGYNIVVSNILASLCTYNGYLPQGGVTSPYISNLVCYKLDKRLKGLCAKRDILYTRYADDLTFSCDNRETLKKVQKVIEDIIEDEGFNVNSLKTRLLSPSSHKKVTGITVNEKTVKASKKLKREVRTMIHHAFVTTDYSSNDRIRGYIAFISSIEEGYKDTIYKYINKLVNNENYRMFRDIVEAYNNNKIFKNMEDMKDMKFEKSGYLVEEYLNDLAQERASFLRNRDIQTDLFTNSSADEIASTSMERKDFKDLF

SEQ ID NO: 2901 - protein, 395 aa, Bacillus sp.
  source 1..395: note = Related to NZ_CP035996.1; note = Bacillus mycoides
MKKSYTNSFILNALNLPIIRDLDTFSNSIGVSKRLIYLLSESTEDYYKNFLIPKKNGEQREINTPTYSLKLVQRWILEEILEKIGVSEESMAFKKGPGNGIKKNAEIHLYSLYLLQLDIKDFFINIKRKRVFYLFRDLGYNVAISNILANLCTYKDYLPQGGITSPYLSNLICYKLDKRLKGLCAKRDILYTRYADDLTFSCDNRESLKKVQKVIEEIIEDEGFKTNPLKTRLLSPSSHKKVTGITVNERYIKANKKLKKKVRAMIHHAFISADYSSNDCIRGYIAFISSIEEGYKDTICKYINKLVNNKNYRIFEDIVEGYNNNKIFKDMEEMRFKETVFLDPDYPLNSHLSDIVQVRTDFLQNRDIKIDVFPDSSEDEIASANMEEIEIDDLF

SEQ ID NO: 2902 - protein, 398 aa, Bacillus sp.
  source 1..398: note = Related to NVKK01000033.1; note = Bacillus thuringiensis
MKKHYTNSFILNALNLPNIRDLETFSNSIGVSQRLIQLLANSAHVYYNNFSIPKKNGTQREINTPTYSLKLVQRWILKEILEKIDVSEESMAFKKGLGNSIKKNAEIHKYSVYLLQLDIKDFFISIKKEKVFYLFRDLGYNIVVSNLLANICTYNGFLPQGGVCSPYISNLICYKLDKRLKGLCAKRDILYTRYADDLTFSCDNKETLKKVRNIIEDIIKNEGFEINPLKTRFLSPSSHKKVTGITVNDNRIKASKKLKKKVRSMIHHSFVSADYSSNDQIRGYVSFIDSIEEGYKDKICEYIDRLANDKDYKYFEDIVVAFNNNKIFKELADMPFEDLSFNDPDDPDDLVTYFISNSVEERYSFLKDRRIKIDAFPDEYEDEVAAANQNEIEVEDIF

SEQ ID NO: 2903 - protein, 369 aa, Bacillus sp.
  source 1..369: note = Related to NVCK01000005.1; note = Bacillus thuringiensis
MKNDFTNSFILYSLDLPIIKDFESLSNSVGISKTMLYLLSKKTDMFYNSFDICKKNGTKREINSPTYSLKLVQRWILAEILEKIKVSNESMAFRKGIGNGCRKNAEHHRYSLYLLQLDIKDFFTSINRERVFYLFKSLGYNSLVSNILANLCTYKGYLPQGGVCSPYISNLICYKLDKRLKGLCSTRDVLYTRYADDLTFSCDNKVILRKVKNVIEDIVIDEGFAINPSKTRLLSPSSHKKVTGITVNDNKIKASKQMKRTVRAMIHYALVNRDYSEKNVIRGYVSYIDSIEEGYIDKIKNYINKLTEKDYSSSSEIVESFNKNKLFNDLNDMVYNEASIIDEAFDWDIFELDTYKHISATKQEDDFNF

SEQ ID NO: 2904 - protein, 350 aa, unidentified
  source 1..350: note = Related to NZ_BHYK01000016.1; note = Clostridium tagluense
MTTDFTNSFILNSLKLPIITNIDSLANTLGLSKTIIFLLSQKTSYYYKPFKILKKDGNSRQIFSPSYSLKLVQRWILNEILEKIDVSHESMAYKKGNDNGIKKNAEMHKYNLYLLEFDLKDFFTSIKRERVFFMFKNLGYNNMVSNILTNICTYNDYLPQGGVCSPYISNLVCYRLDKRLSALCGKRGIVYTRYADDLTFSCDNKQSLKKVKDIIKDIIESEQFKINDSKTRLLSPTSHKRVTGITVNDNKLKANKNMKKLVRAMIIKSLFSMDYINNNIIKGYIAFINSIEDGYKCKIIEYINKTINKSLPYSNEMVIAYNENKFFKETNDMCYHGYDNIDDKYEDYEG

SEQ ID NO: 2905 - protein, 392 aa, unidentified
  source 1..392: note = Related to NC_016627.1; note = Acetivibrio clariflavus
MIQKDYTDSFILNALNLPTISDLDSLSDAFAISKRLIFLLTKKTENYYKRFYIKKRDGTSREILSPTYSLKLIQRWILKEILEKVSLSEQAMAYKKGKNNGIKKNAMHHRYSLYILEMDIKDFFHSIKRERVFYLFKNLGYNNMVSNILTNLCTYNGYLPQGGVCSPYISNLICYRLDNRLSGLCGKRDILYTRYADDLTFSSDNKQTLTKAINIIINIIEDEGFKVNKNKTRLLSPGSHKKVTGITVNDSKIKASKQLKRTVRAMIHQAIVTADYSQIDRIRGIVSYINSIEVGYREKVITYINSLSNKDYAFFEEIVERFNDNKIFKEIQDMNYKGYDYDDQVSLELEKIVSARQEYLGKIGKVDFLSAHIQSQQDEFKTNAAATKETYE

SEQ ID NO: 2906 - protein, 393 aa, unidentified
  source 1..393: note = Related to VOHC01000030.1; note = Planomicrobium sp.
MKSDFTNSFILNALNLPVMKDLNDISYLTGLSNQLLFLLSQNSESYYKKFYLDKKNGEVREINSPSYSMKLVQRWILSEILEKVKVSNESMAFKKDFGNGSIKNARYHQYSLYILQLDLESFFDSIDKERIFLVFKSLGYNTYISHVLTNICTLNGTLPQGGVCSPYLSNLICYKLDRRLTGLCSKRDVLYTRYADDLTFSCDNKLTLKKIKNIIEDIIIDENLKINHFKTRLLSPGSHKKVNGITVNNGNLKASKELKKKVRAMIHHSIVSEDYSKNNIIRGYVSYINSIEKGYLEKIKEYIINIFKKDYNHFSSTVNAFNENKLYRDIESAEYVEFVGAGYSDDYEWLYYEERRFEFLVEKGYLKGLRDYFKKAENLLVENKDDEDPTSIF

SEQ ID NO: 2907 - protein, 406 aa, Bacillus sp.
  source 1..406: note = Related to NFEK01000132.1; note = Bacillus thuringiensis
MNNKNNVTNSFILNALNLPIIKDLESLSNHIGISEKLIYLLSVRNSEFYESFTIPKKDGTERKIESPSYSLKLVQRWILKEILEKIPVSVHSFAFNPGRNGIKDNAELHKFSLYLLQMDIKDFFTSIEYKRVFYLFKNLGYNSFISKILTEICTHEERLPQGGVCSPYISNLICYRLDNRLQGLCSSRDIIYSRYADDLTFSCDNKEALRKIKKVIEEIIFDEGFKVNHKKTRYTSPSSHKVVTGITINDQKIKVQKDLKRKVRALIHHAIVCGDFSEINTIKGYVSYINSIEVGYREKVITYINKLLMEKDYKYYNDIVESVNGNLMMKEQISMVYDEYVDDEYVDDEYIPADIVFAETILRKRIDFFKKRGKELEIEDKYKEYFEDEVASTVVVDADDDDELPF

SEQ ID NO: 2908 - protein, 428 aa, unidentified
  source 1..428: note = Related to NZ_AWTC01000001.1; note = Sporolactobacillus laevolacticus
MNNTHSNTILLNNLQLPIIHDIFDLSDNTRISDGKLYLLFQFHNYYYNTFFINKKNGKKREISSPQRPLKLLQKWILEEILLNIKVSAESQAFIRKKNGILENALLHKDNLFLLQMDIENFFPSIDDKRIFYFFRQIGYNSFVSDILKNVCTFKGKLPQGGVCSPYLSNLICYSLDRRIAGLCARRDIIYSRYADDLSFSCDNKDNLRKIRPLVELILSKEGFKVNKSKTRFSFSHKTITGLNIAKDNNNMNVVKVPRKLKRKVRSIIHYSFVSGDFSNQNVVLGYIAFIYSIEPEYISKIIKYIQSLQNKDYKFFSDIVNAFNKSDLAKISNFCWNFDDTYESKIDVEKVLRKYKISDRKDLDLFAEYLPDEYWGFQEKFEKRFFYLKRHKVLTDHLVSIYQNKLYDLNFLNREDSTNSFHQDLFEF

SEQ ID NO: 2909 - protein, 414 aa, unidentified
  source 1..414: note = Related to BMCJ01000003.1; note = Thalassobacillus devorans
MSKDPTNIFILNSLKLPIIEDLYTLSNSTGISLKMIYLLSKNPGNFYTNHKIPKSDGTFRDIYSPNLSLKIIQRWILEEILCNIENSSEATAFKKGLNGPYENAAYHKDSLYFLQMDIKDFFPSITRKQVYYLFKNLGYNKFISNILANLSTLNNKLPQGGVCSPYLSNLICYKMDRRLKGLCSKRDILYTRYADDLTFSCNNKVALRKVKQVVEKIVINEGYLINHKKTRYSSPISPKKITGVTITSQKKLKADRQIKKKVRAMIHKAIVTGDYQHTNKILGYIAYINSIEKDYKEKIISYIEKLIDKQYKHFDKVVKAYNSNKFFRSLPDMTQVDINTQLADEKLKWELGIDVYDYYIFEEYKNMLEQRIDFMDKKGIFDQELKNEFERINDEVASSLEDEITPPKDDDIQF

SEQ ID NO: 2910 - protein, 372 aa, unidentified
  source 1..372: note = Related to NZ_ATVM01000016.1; note = Marinococcus halotolerans
MIKQQDQFYSSFQLLKKNGSYRNISKPKFSLKLTQRWILEEILYKIETSNEALAFKKNVNGPKDNAEHHKYSLYLLQIDLENFFPSITKKQVFYIFKNIGYDNKVSNTLSNLCTYKDVLPQGAVTSPYLSNLICYKLDRRLKGLCGKRGILYTRYADDLTFSCNNKNDLKKIFKVVQKIINSEGYQINSDKTRFLSPVSHKKITGITVDSKNKLKADKSLKKKVRAMIHKAIVSGDYSQSNKIKGYISYIDSIENGYYKKIIEYIHKLINKEYKSFHQVVDCYNSNRNKLLKDLEKMEYEDFIEEPPENLDESDIEDYIGEQFKDYVDILKERKKFLNKHNFSVKEIKHELSLLTIGEKPLPKNTGKPEDLF

SEQ ID NO: 2911 - protein, 408 aa, unidentified
  source 1..408: note = Related to NZ_JALIRM010000001.1; note = Lederbergia wuyishanensis
MKRDFTNTFILNSLELPVIDSLDTLSNQVGISKRMLYLLSQQTNKYYKQFQIPKKNNTFREISSPSYSLKLVQRWILEEVFYKINVTDEALAFKKGVNGIKQNATYHLYSLYILGIDIKDFFPSISREKVFYLFKNLGYNNFISNVLSNLCTLDNSLPQGAVTSPYISNIICYNLDRRIKGLCEKRDIVYSRYADDLTFSCDNKDTLKKMYKVLEGIIVDEGFEVNRSKTRFLSPISHKKLTGITIDHQKTKADKELKKKVRAMIHKSIVTGDYSNNNIILGYVSFINSIENGYKKKVINYINILIMKDYKHYPDLVDAYNKNKLFQELNNMVQIDFHTSFAFDIKTYYRQYFKHGFDLDEMEYYEYLNMLESRRVYLEKYHLKDTELEKELGTLQSAADIEEDTDLF

SEQ ID NO: 2912 - protein, 383 aa, unidentified
  source 1..383: note = Related to JAFVTV010000006.1; note = Clostridia bacterium
MIKEYINKTFIESLDLPMMKSFDDLVQNLRLSAKLMHWLTSSSSGKYKTFYLIKKDGSKRRIDAPARSLKIVQRWILDNILAKIKVSPYSFGFKSGEKGSPLVKCAEKHKNNLYILKVDLKNFYPSINKERVYYTFLDLGYNSSVANLLTDICVRDGYLPQGAVTSAYLANLICRDLDYRVAGYCNKRDIIYTRYADDLTFSCDNRETLHKSLFTIRRIIEGEKFQLNTNKIHFMTPKCKKSILGITLNDTSIKAPREMKRMVRSVIHYQVATGDYTDNDKIRGYISYINSIEETYKDQVLSYIQKLAESQLCLFEELVDAFNKNKLYQELPDMILRDAGDFVNAYEEDEFMTAVYYEHREFLIKYGLLEEETDTSNLEEIPF

SEQ ID NO: 2913 - protein, 370 aa, unidentified
  source 1..370: note = Related to FRCT01000015.1; note = Ruminococcus flavefaciens
MIDNKNKIILDSLGLPCLVSFEDLVKAIRLDSKLIYWLSSETENKYKTFEIPKKNGGVRIIHAPVYSLKQVQKWILCNIIYKIKTSPYSLGFKRSSNLGSPLYISAQNHKYNLYVLKLDLKDFYPSITKKTVYNLFLSIGYNSQIAFLLTNICTHHGALPQGAVTSAHLANLICRKMDYRLAGYCQKHDIVFTRYADDMAFSSDNRDTLKKAYKTICKIIKDEGFIVNDLKTRFMTPKCRKQILGITINDNQIKVSKDLKRKVRAMIHRSIATGEYNNNDVIKGYISYINSIEPGYLEKTKKYISELITNSPLELYPEIINRFNSNKIYSDLPNMELKEPSYFVESPYDTDYMNNEYELHQDYLEGIKCK

SEQ ID NO: 2914 - protein, 367 aa, unidentified
  source 1..367: note = Related to NZ_AUFC01000039.1; note = Anaerovorax odorimutans
MKKYINKTVLDSLNLPILTSFQDLVEQLRLTDKKVYWASSNHIIDKYNTFYIKKSNGNKRRIDEPKYSLKIIQRWVLENILYKIKVSPYSYGFKYTEGSPLVACSNKHRLNLFVLKMDLKDFYPSISKEKVYFQFLNIGYNTKVSNLLTNICTYNNSLPQGAVTSAYLANIVCRKMDYRIAGYCNKREIAYTRYADDLIFSSDNRELLHNTYGMIEKIITDEGFTLNKDKTTFMSPKNHKKVLGITINDNQVKAPKKLKREVRAKIHYQIATCDYSEQMKTKGYISYINSIEPNYKEKVTKYITGLSKSPLCLFPNVVKAYNDNKYFSELPNMILKSYGDFVQPSLIEEFEEHINSEYLKYLSEHSK

SEQ ID NO: 2915 - protein, 385 aa, unidentified
  source 1..385: note = Related to JAJEQN010000018.1; note = Lachnospiraceae bacterium CLA-AA-H224
MNKYSNKIVIESLGLPMLTCFDDLVKEVSLSEKLVYWLTKRDAEGRYNPFFIKKKDGNKRKINSPSLALKIVQRWTLENILYKIKTSQYSYGFKRDIRKGSPLVYCAEKHKNNLYILKLDLKNFYPSIKRESVYYIFKNVGYNADISNLLTNICVVNDELPQGAVTSPYLANLVCRKLDFRIAGYCNKRNIVYTRYADDLTFSCDDRELLRKIYGMIKKIVEDEGFCLNQRKTVFMTPKNHKEVLGVTINDGLLKAPKEVKKDIRAMLHYEVATGDYAMNDEIRGYVAYVDSIEKNYKNKCISYLKRLSESTLCLFPDVVKAYNSNKIYKELPDMKEKQVADFCEEDEDEFANMIYQEHEQYLILKGILNKTNEEDITDLQNPFW

SEQ ID NO: 2916 - protein, 383 aa, unidentified
  source 1..383: note = Related to NZ_JADPGV010000001.1; note = Blautia luti
MKKYSNKTVIESLGLPMLTCFDDLVKELSLSGKLVYWLTKQDAEGRYKTFFIEKKDGDKRKINAPSLSLKIVQRWVLENILYKIKASQYSYGFTKGDRKGSPLVYCAEKHKNNLYVFKLDLKDFYPSIKREKVYYAFANIGYNADVSNLLTNICVVDDELPQGAVTSPYLANLICRKLDLRIAGYCNKRNIVYTRYADDLTFSCDDRELLRKIYGMVKKIVEDEGFCLNQKKTVFMTPKSHKVVLGVTINDSLLKAPKEIKKSIRAMIHYEVATGDYTMNDKIRGYVAYVDSIEKNYKNKCISYLQKLSESTLCLFPDVVKEYNSNKIYKELPDMVEKRATDFVELKDADDFYDMIYYEHEEYLISNGLLNEKEDITDLEEPF

SEQ ID NO: 2917 - protein, 371 aa, unidentified
  source 1..371: note = bacterium 0.1xD8-82; note = Related to RAYQ01000024.1
MKQYSNKVIIDSLHLPMLTCFEDIVREVRLSGKLVYWVTKKDAEGKYKTFYIDKKDGTKREINAPSLSVKIFQKWILENILYRISASQYSYGFERGRRKGSPLVHCAEMHKNSLYVLKMDLKNFYPSIKQERVFFEFRNKGYNDEVSSLLTNACVRDDKLPQGAVTSAYLANLICRKLDARIAGYCNKRNIVYTRYADDLTFSCDDRDLLKRIFGTIKKIVENEGFLLNENKTIFMTPKGHKKVLGVTINDNLIKAPKELKRIIRAVLHYEVSTGDYSMNDKVRGYIAYIDSIENNYKNKCISYLIKLSQSTLSLFPDIVEAYNNNKIFKELPDMEEKNPIDFVDLEDVNDFSDMIYWEHEEYLISHGINK

SEQ ID NO: 2918 - protein, 370 aa, unidentified
  source 1..370: note = Related to JACOPD010000001.1; note = Lachnospira sp.
MKKYNNKMVIESLGLPMFEDIETLAEETRLTEKLVFFITKEDAKGRYKKFYIPKKDGTSREINSPCMSLKVIQRWVLENILYKVRVSQYSIGFVKNGKGSPLVQCAERHKNNLYILKMDLKNFFPSVERGRVYNQFLQLGYNTYASNLLTNICTLNGSLPQGAVTSPYLANLVCYKMDIRIAGYCNKRDITYTRYADDLIFSSDNRDLLRKIYGMIKKIVEDEGFVVNEEKTRFLSPKVHKEVIGVTVNDGVIKAPKEMKRMVRAMIHYEIVTGDYSDNEKIRGYIAYIDSLERNYRNKIIKYIEKYLDDTITLFPELVEKFNQNKLYNQIPDMKQHDISRFVNFEDEADYYSMVVNEREDYLSRHGIAI

SEQ ID NO: 2919 - protein, 354 aa, unidentified
  source 1..354: note = Related to JAFQRZ010000003.1; note = Agathobacter sp.
MFEDIETLAEETRLTEKLIYFLCKEDAEGRYVSFKIPKKDGRYRDINAPCMALKTLQKWVLQNILYKVRVSPYSIGFKKDGKGSPLLQSAERHKNNLYILKMDLKDFFPSVKREQVFNQFLQLGYNTYASNMLTNICTLNGCLPQGAVTSPYLANLVCYKMDVRIAGYCNKRDIIYTRYADDLIFSCDNRDGLRNIYGMIKKIVENEGFCLNEKKTRFLTPKSHKKIVGVTVNDGLVKAPKEMKKMVRAMLHYSIVSGDYSNNDRIRGYVSYIDSIEKNYRKKIVKYITNYINDSITLFPDAVKKFNDNKLFNEIPDMVPKKISDFVDYEEEDDYFQMITYEREEFLTKHGIEV

SEQ ID NO: 2920 - protein, 308 aa, unidentified
  source 1..308: note = Related to JADJOK010000004.1; note = Veillonella sp.
MQNILYKVRVSQYSIGFIKNGKGSPLVLCAERHKNNLYILKMDLKDFYPSICRAKVYNQFLQLGYNTYAANLITNICILDGKFSQGAVTSPYLASLVCYKMDTNWQDIVIKRDIVYTRYADDLTFSCDNRDELHKIYGMIKKIVEDEGFTLNQKKTQFLTPKGHKKVVGVTINDGMLKASKDLKRSVRAMIHYQIITGDYTKNEQIRGYIAYIDSIEKNYKKKIIKYVTGYCQDTITLFSDAVKAFNANKLFKEIPDMVQKDISSFAKWEEDQSDYMEMVMYERESYLAKHGLIESDIEDESNLEMFE

SEQ ID NO: 2921 - protein, 369 aa, unidentified
  source 1..369: note = Lachnospiraceae bacterium; note = Related to JAFUIR010000009.1
MKKYTNQNLITSLNLPFVTDIHSLSMQLRLSEKLVYFLTNERTYKKYRIFRIPKKDGTFRTISAPIASLKIVQRWVLENILYKIKVSDYSYGFSRNRKGSPLAACAEKHRNNLFMLKMDLKNFYPSIQRDQVFFQFLNIGYNTYAANLLTNICYNQDGLPQGAVTSPYLANMICYKMDVRIASYCNKRDITYTRYADDLAFSSDNRDSLRNIYGMIKKIVEDEGFSVNDEKTCFMTPKNHKVLLGVTINDANIKAPRQMKKMVRSMIHRAVITGDYSLKNVICGYVSYIDSIEKGYKDKIKKYIHKYYEDPITLFKDAVDAYNKNKFYEDMPDMKNRNIDFFLDGDEWDEDEVLTAFYEEREAFLITHK

SEQ ID NO: 2922 - protein, 337 aa, unidentified
  source 1..337: note = Related to FRDH01000006.1; note = Butyrivibrio hungatei
MIDKTNKLILDSIGIPYFWDINSFAQKVRYTNKLLFFLSNYKAVERYNIFYLTKKNGKMRKIMAPSFSLLMLQRWILHNTLYKIRVSEYSYGFVKSNSDSESPLVEVAGAHKNHKYILKIDIKDFYPSISRARVFFLFKNLGYNFCCANMLANICTNNNELPQGAATSARLANILCTRLDARISGYCNKRDITYTRYADDLIFSCDNRNVLHHIYKMINTIIQDEGFEINQSKTRFLSPKNHKVVLGVTINDGYCKADRKLKRKVRAMIHSSIVNGNYSERAIIQGYIAYFSSIEKDYTEKIKRYINKFYGTLPKDKAIAYNNNKFLNKMPDMSTQS

SEQ ID NO: 2923 - protein, 375 aa, unidentified
  source 1..375: note = Related to QUES01000001.1; note = Eisenbergiella sp.
MFMINQTNISLLKLRSLPIFNDLSSMSRVTGFSEQLLYYYAISDDAKKYTIFEIPKKDSCNTRKIYAPNYALKILQRWILENILYKIECSEYAFAFKRDMGSPLKKNALVHKEHVFLLEMDLENFFHSIKRQRIVYLFSNLGYNVPISNWLANICTYEDILPQGSVTAPYLSNLVCLQLDKRIAKYCSKRDIVYSRYADDITFSCSNKAVIKSIYGTIKKIIESEHFTINQKKTRFIGKSSRKSVTGVIIDNDCIKAPKEYKRLVRCLIHRAIISGDYSNINRIRGYIAYISSIEDDYMQKVVKYINTFKTKRDVIFLDSTVEMFNANIFLPGVDQISQIRMTMEEEDNFGDYVTERLEFLKKRHMKVPPELGKL

SEQ ID NO: 2924 - protein, 342 aa, unidentified
  source 1..342: note = Related to NZ_UFVT01000001.1; note = Blautia coccoides
MNIGNNVVLNTLGVPVINSFEHLCEQLSITEQLLYYLTYRKEHCYYETEIPKKNGKTRILHVPNLSLKVVQKWILTEILEKIFVSEQTMAFVPHKNGLRENAERHKKNIFLLEMDITNFFGTITEEQVYSLFCNIGYGSKVAGILANLCTYDNYLPQGAVTSPYIANLVCYHMDSRINGYCSRKDIVYTRYADDLTFSSNNRMLLNKVERFIKYIVVDEGFTINEKKTRYFSNDVKKTVTGITINDDDIHVDKNFKRNLRAQIYNSIKTRSYDNNSQILGKIAYVNSIEDGFRDKMEKYISSIIIRSEFVQDLDIVNAFNANKLFAKLPDMVFMNEDKNPFI

SEQ ID NO: 2925 - protein, 342 aa, unidentified
  source 1..342: note = Related to JACOPE010000001.1; note = Ruminococcus sp.
MNIGNSVVLNTLGVPVINSFEHLCEQLSVTEQLLYFLTYKKKYCYFEKKIPKKDKTERTLNVPSLSLKVVQRWILKEILEKIYVSEQAMAFIPHKNGLRENAERHKKNIFLLEMDITNFFGTITEQQVYRLFCNIGYNSKVAGVLANLCTYDGYLPQGAVTSPYIANLVCYHMDARINGYCSRKDIVYTRYADDLTFSSNNRTLLNKVEKFIKYIVADEGFKINDKKTRYLSNDVKKTVTGITVNDDSIHVDKKFKKDLRAQIYRSIKLKDYQNNSQILGKIAYVNSIEEGYRDKIFKYITDVITKPEFTGHIDIVNAFNDNKFFPDLPDMMFKEVWESPFD

SEQ ID NO: 2926 - protein, 342 aa, unidentified
  source 1..342: note = Related to JAJBQL010000016.1; note = Mediterraneibacter faecis
MNIGNSVVLNTLGVPVINSFEHLCEQLSVTEQLLYFLTYKKKYCYFEKKIPKKDKTERTLNVPSLSLKVVQRWILKEILEKIYVSKQAMAFIPHKNGLRENAERHKKNIFLLEMDITNFFGTITEQQVYRLFCNIGYNSKVAGILANLCTYDGYLPQGAVTSPYIANLICYHMDARINGYCSRKDIVYTRYADDLTFSSSNRTLLNKVEKFIKYIVTDEGFTINDKKTRYLSNDVKKTVTGITINDDSIHVDKKFKRDLRAQIYRSIKLKDYQNNSQILGKIAYVNSIEEGYRDKIFKYITDVITKPEFTGHIDIVNAFNDNKFFPNLPDMMFKEVWESPFD

SEQ ID NO: 2927 - protein, 339 aa, unidentified
  source 1..339: note = Related to MCGH01000001.1; note = Eisenbergiella tayi
MNLSNNVILNTLNVPIINGFTHLAEQLSLTQGLLYFLTYKKDYCYTLKEIPKKDGTFRKICVPNLSLKVVQKWILVEILEKIDVSPQAMAFVPKNNGLKSNAEYHKKNIFLLEMDIKNFFGTIKEGQVFKLFCNIGYNTKVSTILTSLCTFDGELPQGAVTSPYLANLILYHLDIRLNGLCSRKDIVYTRYADDLSFSSNDRAKLNGIENFVKNIVSDEGFEINEKKTRYLSNDVKKSITGITINNEEIHVDKKLKRDIRALIFSSIASKNYALNDKIRGSIAYVNSIEPGYQEKMINYIERIINKDELKNDLGVVKTFNENKLYKVLPDMKYEESPFI

SEQ ID NO: 2928 - protein, 339 aa, unidentified
  source 1..339: note = Related to FMFO01000004.1; note = Roseburia sp.
MNMSNNVILNTLNVPIINDFKHLAEQLSLTQELLHFLTYKKQYCYTQKEIPKKDGTSRTLYVPHLALKVVQRWILKEILEKINVSYQAMAFVPKRNGLRVNAEYHKKNIFILEMDIKKFFGSIQKKQVFQLFCKIGYNTDVSAVLANLCIYEDVLPQGAVTSPYIANLVTYHLDVRLNGLCSRKDIVYTRYADDLSFSSNNRTKLNSIEKIVKYIVKEEGFEINEKKTRYLSNDVKKTITGITINNEEVHVDKALKKKIRAMIFNSIVNKDYTRNDKIKGSIAYVDSIEMGYKEKILNYIIQITEKGQFKNNIDIVNAYNKNKFFKSLPYMQYEESPFY

SEQ ID NO: 2929 - protein, 334 aa, unidentified
  source 1..334: note = Clostridiaceae bacterium; note = Related to QXXC01000007.1
MNTNSNLILNTLGVPIIYDLESLSERLSITKTFLYMLSRKQHLFYETAEIPKKDGSTRKIHAPVLSLKVVQKWILVEILEKVRVSPYAMAFVPGKNGLKENAMLHKDRLFILEMDIHDFFGSITQKDVFQLFTKIGYNYTISAILANLCTYEEVLPQGAVTSPYIANLICYNLDMRLSALCNKRDIVYTRYADDLSFSSDNRTRLNRIERLLREIVQDEGFEINDRKTRYFSNDRKKTVTGITINDREIHADRKLKQRIRSKIFHAVSEADYSEAAQIRGLIAFVDSIEDGYRDQMACYLEGLALKESLRRSAKVVKAYNNNKLFQDLEDMMPL

SEQ ID NO: 2930 - protein, 304 aa, unidentified
  source 1..304: note = Related to FR902276.1; note = Clostridium sp.
MKNIKDFAKELSLDVKTIEKLTRDNFNYYHFTIPKGNGEKRLITAPKGKLKVIQKWILVNCLEKFAVAECATAFIKGKHGIRVNAESHQYNKYILEFDLKDFFPNISFWDVQNLFLRMNLSQKLSILFAKLCTYDGYLPQGAITSPYISNLICYDLDLKLLELCDYYDITYTRYADDLTFSSDELYLLLSLMQEISSIIHYYGFKVNYNKTKVLLPSNKQTITGITVNNGEIKVDKKLKRMVRAKLYYGIKNNDIKDFDILLGFISYICSIEIDYKSKMISYVQYLLNKFGRHDNWGLLKILNK

SEQ ID NO: 2931 - protein, 304 aa, unidentified
  source 1..304: note = Related to HF987425.1; note = Clostridium sp.
MKNIKDFAKELSLDVKTIEKLTRDNFNYYHFTIPKRNGEKRLITAPKGKLKVIQKWILVNYLERYAIAECATAFIKGEHGIRVNAEAHLNNKYILEFDLKDFFPNIKFWAVRDLFLRMNLTRKISLLFAKLCTYNKRLPQGAITSPYISNLICYDLDLELLELCNNYDITYTRYADDLTFSSNSLYLLFSLMKEISDIIRSHGFKINYEKTKILYPSAKQTITGITINNGTIKADKKLKRMIRTKLYYGVKNNNITELTKLIGYIAYVNSIESDYKLRLYDYFSSLLQKFSKEDSWGLLKILNK

SEQ ID NO: 2932 - protein, 333 aa, Acinetobacter sp.
  source 1..333: note = Related to MNTZ01000028.1
MVNFFYNSDKLQEYLQLPQIYTLDDLAYFLLFTKEQLHDFSYRKNEHYVTFLIPKKNSTEKRVINAPKKRLKMAQKLILKEILEKVPCSSASAAFIKKENGLLKNALTHKENLFLLKMDFKNFFQNINEAKIIQIFENLGYSPYIALQLAKLCTFSKKLPQGGICSPYLSNLACYEFDKDISSYCDEKNIAYTRYADDLLFSANDIDLLKNLKNDIYSYTKKHSVAGLNIQINHKKTKLIKNTSHKKVTGITINDQKIKASKKLKNTIRQNIRYNLIHNQFDNKLIGKIAFVISIEDKEYKNRIFKYCKRIENKFKLNKKENQLLKVLYKMTK

SEQ ID NO: 2933 - protein, 326 aa, unidentified
  source 1..326: note = Related to DMXX01000019.1; note = Cyanobacteria bacterium UBA10660
MNKIELLKLPKIENLKDLNHLLLFTEKQLNDFVRLKSEQYVSFKIPKKNSIEKRIINAPKKYLKLAQKIILNEILEKVPCSNAATAFIKNKNGLFENANMHKDNLYLLKFDFCNFFQSIKFERIRLLFIELGYNPKISKILAELCTYCKELPQGGICSPCLSNLICLELDNDLLEYCEGNDIKYTRYADDLFFSSNNKEVLLKLKEDIETLILKHRTEFFDIKINRQKTKFITEPWHKKVTGITINNNKIKTSKTLKRDIRRELYFTIIKNKTDYNKLIGQIAFVISIEKDYAEKIKKYALSICEKNNIHEHKIIQILDKMVKSQV

SEQ ID NO: 2934 - protein, 337 aa, unidentified
  source 1..337: note = Related to BMDT01000015.1; note = Enterococcus alcedinis
MNNVNSRPFLLGINGLPVMTNISDISRQIGISSRRIYEYTNYTSSFYHTFEIPKTDKSIRIINAPFSGLKMVQRWILETILYKIKVDTPSYGFLKGKKSPTKQNAEIHSNNLYLFQTDIINFFTNVDFKRVYSIFLKIGYNKEVSLTLARLCCLDGYLPQGGVTSPYLSHLVCFRMDRRIMGLCQKREIVYSRYADDITLSSDNKNDLKKARVYLEQIISDEGFEINPRKTRYSFQKKLVTGLTIHNNKVLVPRILKRELRSKIYNTIVFNDYSSCEVILGYVSYINSIENGYINKVKDYIETLLNNKSIEPERLSIIRLNYKKSPLGSWMENVHTQ

SEQ ID NO: 2935 - protein, 301 aa, unidentified
  source 1..301: note = Related to JAEHOK010000008.1; note = Salegentibacter maritimus
MNRLDKLILEIGLSRNVIENYITFADKHYKSHYLPKKGGGKRTIDCPGKNLKTIQRWILKEFLNKLEVNKRANGFVKNRGIKRNALYHLKKKHILTVDIKDFFYSISQRQVFETLNANYNDRDFALKIAKICTYQRYLPQGAPTSPALSNLVFKPIDDEIMKYCNSELIHYSRYADDLTFSSDNKQSLQYAYRFINDLLYKNGFNLNSKKTRYLSGKGNMSVTGVNINTGKPKADPKLKKQVRAELHHYIIKEKEINLNKLAGKISFIRSIEEDYSQNLDFYIKRLYKKKAFIQKMASKTH

SEQ ID NO: 2936 - protein, 300 aa, unidentified
  source 1..300: note = Related to NZ_LGTQ01000015.1; note = Jiulongibacter sediminis
MKKFENFILEIGLTKSAIENYVTFSDASYNTFYIPKKKKGEKRVIDCPNANLKAIQRFFLKKYLNKVEVNKRVNGFVPKRGIKRNALFHMKNKYLLTIDIKDFFPSISQKKVFEVLYEIYYDKDFALKMAKLCTYKRSLPQGAPTSPALSNLVFKGIDDEIMKYCNSEMVNYSRYADDLTFSSDNKNSLQYVYKFVSHLLYTNGFNINKKKTRYLSGKGKMSITGVYINSGKPKVSSELKKQLRAELHQYIINGKEINLNQVSGYISFISSIEDDYLKKVESYIEKLKKKKTLMLTLKAE

SEQ ID NO: 2937 - protein, 345 aa, unidentified
  source 1..345: note = Related to NZ_CABVRK010000001.1; note = Aliarcobacter butzleri
MNSFRDTYLYNYKDTLDEIISKIKDFLLTETYKKIFKDEDKLQYINHFTFLDILSNTKKFYTKRIIYTNKKERIVFEPSVELYLIQKFILYNYLIQRDSSLSENLTSYRKNYSVKNNAIKHINKRTIIKIDIKNFFPTINRYRIYKCLLNLNIEEKKAYLFSRLLSYQDKLILGTPSSPFLSNLVSRKLDLRIEGYIKAYQKSKVHISYTRYSDDMTFSFNQRINTQKFISFIYQIILDEGFVPNYEKTQIISSNHKQKVTGIIVNRDTISVSKKERDDVEFIIKLWLNYSKDIALQKYNKIFKKNYTNERDFHQILKSKILYIKFINDEQGKKLIRKFEEIKIG

SEQ ID NO: 2938 - protein, 322 aa, unidentified
  source 1..322: note = Candidatus Gracilibacteria bacterium; note = Related to SAAG01000082.1
MHRLKYNYGSENNSLDLLNLFGFTNNELRFFSMSKKRRYKKIIIPKRDGSNRILHAPVYKLKNAQRIILKNILYKKHNDLLIDNITGFIPNKNIKNNANFHVGKKYILKVDIKDFFPSITQDRVYGLLRKEYNLDHSTSMYLSSLCTYNNQLPQGAPTSPMLANLIARFLDYRIIGLLKSYNLNEGLELSYSRYADDLTFSFNKRIDINLFINYVISILIEEGFYPNYKKIHMISSGKQQKVTGLVVNDKVSVGRRYYKKFKSIFYNISKNGFDDELKKWNNINSKKIESVEKFKQVIGGYISFIKDISPDYYEKLKQFNVL

SEQ ID NO: 2939 - protein, 321 aa, unidentified
  source 1..321: note = Related to NZ_CP047218.1; note = Sphingobium yanoikuyae
MAQRKKIPQIPAEQSHLYGIKSPHALANRLGWELDKLRDLAKSGGYRIYNHRKTGREIQEPGAALQSLHKQIHKYLARIQAPDYLHSAVKGKSYLSNAQAHVGDIPLIKIDIAKFYQSVPQHKVMHFFRDVMNCATDVAGLLANLICFRGALPTGSSVSPIISFYTYKFLFDDLADLAAGHGLTMTCYVDDITMSGPMASREVLHEARTMIFRAGLRAHKDRSFSPDGPKIVTGVAVSKHGIGLPFGRWQKIRNQIRELERCDDDNQKLAIYQQLISRLYEATQIDPRCRISAEYHHARFRELKRVLAQAASEPVPLKLAA

SEQ ID NO: 2940 - protein, 321 aa, unidentified
  source 1..321: note = Related to SDYH01000014.1; note = Alphaproteobacteria bacterium
MTQRKRNQPIPIEQSHLYGIKSPHALANRLGWELDKLRDLTKSGDYRVYNHKKTGREIQEPGAALQSLHRQIHKYLSRIETPDYLHSTVKGKSYISNAQAHIGEVSLIKIDIAKFYQSVSQHKVMHFFRDVMNCAPDVAGFLANLICFRGALPTGSSVSPIISFYTYKLLFDDLAVLADSHGLTMTCYIDDITMSGKLASRKILHEARRTIFRAGLRAHKDRSFSPNGPKIVTGVAVTTYGIALPFGRWQKIRNQIRELERCSDDNKKLVIYQQLISRLYEATQIDPRCRGSAEYYHAQFKELKRVLALVGHGPIALSMTA

SEQ ID NO: 2941 - protein, 316 aa, unidentified
  source 1..316: note = Related to NZ_JACIJI010000005.1; note = Stakelama sediminis
MSTKSPKEKALVRIPIERCHLYKIGSPHALAKRLGWDLNKLDDLAAYGGYKVYKHKYTGRTIEEPGAALQSLHRQLHRYLSRIEVPPYLHSAVKGRSYLSNARAHVGDGRIIKIDIAKFYQSVPQHRVMHFFRDRMKCAPDVSGLLAALICYDGHLATGSAISPLISFYAFESLFDDLANIACKYDLEITCYVDDITMSGKRASFKVLHEVRRTIFRAGLRAHKDHAFAYNSPGIVTGVVVTGQGISLPFERWKKIKNQIRLLEACEIRDDKLEIFPSLVSRLYEAAQIDPACRSKAEYYHAAWRKLKYEKMARAA

SEQ ID NO: 2942 - protein, 325 aa, unidentified
  source 1..325: note = Related to JACYUG010000012.1; note = Sphingomonas sp.
MPKAKRKSSQPIPIERCHLYGIRSPHALANRLGWDLNKLDQLAAYGGYKVYPHKQTGRMIQEPGEALQSLHRQIHHYLARVEAPAYLHSAVKGRSYVSNAQAHVGAGGLVKLDIAKFYQSVPQHKVMHFFRDVMHCAPDVAGLLANLICFHGKLATGSAASPIISYYTYKSLFDELKALADCRGLTMTCYVDDITMSGPGAGRAVLHEARILIHRAGLRAHKDCAFQPGAPRLVTGVIVGDMGIDLPFSRWRKISEAVREVERCVDPVQRLEKYPKLVSRLYEAAQINSRCMTRARYHHERWRALKRSLQAAPLNAGGGQPVIAA

SEQ ID NO: 2943 - protein, 323 aa, unidentified
  source 1..323: note = Related to NZ_CP050137.1; note = Sphingomonas sp.
MSQGKQAKQPRIPIDRCHLYGIRSPHALAKRLGWELNKLDSLAAYGGYRVYNHKDTGREIQEPGAALQSLHRQLHRYLARIEVPVYLHSAVKGRSYLSNARAHVGDGKLLKIDIAKFYQSVPQHKVMHFFRDVLSCAPDVAGLLANLICYRGVLATGSSISPIISYYAYKSLFDGLAGLAAQHGLVMTCYVDDITMSGPGASRAVLHEARSAIFKAGLRAHKDRSFTGDTVKIVTGVVVGPDGIALPFSRWQKISHAAREIAACSDDAEKLRLYPKLVSRLYEAAQIDSRCRSRAEFHHCQWRDLKRRIAAGALIAAAVDKAA

SEQ ID NO: 2944 - protein, 323 aa, unidentified
  source 1..323: note = Related to FNWK01000001.1; note = Sphingopyxis sp.
MSTNRRRTDQRIPIDRCHLYGIRSPHALAKRLGWDLNKLDGLAAYGSYRVFQHKETGRLIQEPGPALQSLHRQLHRYLSRVQMPEYLHSAAKGRSYLTNARSHVGAGALIKVDIAKFYQSVPQHKVMHFFRDEMRCAEDVAGLLANLICFEGKLATGSAISPIISYYSYKNLFDSLANLANKHGLVMTCYVDDITMSGPNASNLVLHEARTMIFRAGLRAHKDRRFPSSAPKVVTGVVVTDQGVELPFSRWQKIRAQIREIEGLGNAADKLRLYPRLVSRLYEAAQIDSQCRARAEYYHAQWRQAKRQVAIGSMADGTEAVAA

SEQ ID NO: 2945 - protein, 320 aa, unidentified
  source 1..320: note = Related to JAERLA010000016.1; note = Acetobacter thailandicus
MSKARKKKLPQIPLNQCHLFRILSIHALAKRIGWELDTLNKIAKDGSYRIFKHRETGRQIQEPGPLLQNLHRQLHRYLSRVQTPEYLHSAVKGRSYLTNARAHIGCDNLIKIDIAKFYQSVSQHKVMHFFRDTMQCAPDVAGLLANLICFNGMLATGSSISPIISYFSYKKLFDDIHNIALRENLVMTCYVDDITLSGKNASGKTLHKVRTTIFQYGLRAHKDSQFSEGNPKLVTGVIVGKEDIALPFSRWKKIHLQIREIEGCSDIEQKLRLYPKLLSRLHEAMQIDPKCTALAKKHLTDFRLLKRRGVVKTLPLPRAA

SEQ ID NO: 2946 - protein, 313 aa, unidentified
  source 1..313: note = Related to QRDP01000004.1; note = Parasphingopyxis lamellibrachiae
MKTAKKHRPLIPLDRCHLYRIGSPKVLAKRIGWKLDTLEDLSMNAKYRVFRLKRSGRQVEEPPPPLQSLHRQIHGYLSRIETPNYLHSNRKGRSYISNAKPHVGALAMIKIDVKKFFPSVEQHKVMHFFRDDLKCAADVAGLLAALLCKDGKLPTGSSSSPIISYYAYKAMFDDIQSFAAKNHLVMTCYVDDITLSGANATLRQLHEVRKIIMRHGLRAHKAKWFMGLGAKPVTGVMVTKNGIELPHSRWKAIKADLKAIKQCANREEKLEIYPKLVSRLYEASQIDPGCRKLADIHHRLWKEALAGDVQLAA

SEQ ID NO: 2947 - protein, 313 aa, unidentified
  source 1..313: note = Related to NZ_LMAF01000001.1; note = Erythrobacter sp.
MSKTKNKTIVPIPLERSHLFRVRSIHLLAKKLGFTVDGLERLANDAKYRIFNLKESGRLVEEPPPVLQALHRRIHRYLAKIEVPEYLHSAVKGRSYITNAKAHVGVGPMVKIDVKKFFPSVPQHRVMQFFRDTMLCAADVAGLLANLLCRNGRLPTGSSASPIISYYSFKAMFDEIEGLCVANQLTMTCYVDDITISGAGANRALLHDVRQIITRNGLASHKAKFFDQSRPKEVTGVIVKGNGIDLPHSRWKAIKESIREVKKAGSDEERLALYPALISRLHEASQIDPSCRPIALHHNQKWRELRRAVVAHS

SEQ ID NO: 2948 - protein, 320 aa, unidentified
  source 1..320: note = Related to JACIHD010000001.1; note = Bradyrhizobium sp.
MTRKKARRDLEPEQCWLYAISSPADLAHRLSTPRHKLKASDLSPLARDTGNYRLFQIEDGNGKSRAIQWPKRRLQTLHARVHTLLSRVAVPAYLYSAVRGKSYVDNASAHNPLVPTIKIDVKKFFPSVSRAVIFDFFFQRMRCRRDVAGLLADILTFDAHLPTGGAASPIIAYYSFKPMFDEIHKFALSQGLIMTCYVDDLTLSGVRASKNTLHEIGKIISRSGLKSHKARAFAASQPKVITGVCNTKSGRRVPNKLHLKIKKGFDDLTAAKTPLEINRIAQPLLGRLRAAGQIDPKFRARADTVSANIAASSVQTKTSP

SEQ ID NO: 2949 - protein, 330 aa, unidentified
  source 1..330: note = Related to LT629750.1; note = Bradyrhizobium canariense
MTSCELVDPMRKKPRTDLPLSDCWLSAIDSPSTLARRLSTPGHKLCVDDLSSFARDTGNYRLFPIFNEKGKARPIQWPKRRLQGVHARIHKLLSRVAVPKYLHSAVRGKSYISNAAAHDPKMPTIKIDVKKFFPSVSRVVIFNFFAGPLKCRRDVAGLLADILTFDAHLPTGSAASPIIAYYSFKPMFDEIAQFAESLGLTMTCYVDDMALSGPRANKGVLYAIRGIIARHGLKSHKAHTFSGLQPKVVTGVCNTAAGPRVPNKLHLKIKNGFDALAKAQNAVEEGKILRPLLGRMEAAAQIDPAFKARAKTVRAKYSRPKDVGGLEKIE

SEQ ID NO: 2950 - protein, 321 aa, unidentified
  source 1..321: note = Related to nan
MLEISDCWLSAIPSPAILAARLSTDANKLTVATLQELTKDDGNFRVFPLVGNNGKVRIIQEPKRQLQRIHSRVHTLLSRVMAPDYLYSAVKGRSYVGNAQAHDPNHPTVKVDIKNFFPSIPRVAVYNFFHRQLKCRVDVAGILADLLTYDGHLATGSAASPILAYYSYEALFDEVHEFAKARGLKMTCYVDDMALSGPGADKSTLYEVKKIIARHGLRSHKAHAFSSAQPKVITGVCNTVSGPRVPNRLHLKIKNGFDALASASTQSEKLKALNPLIGRLEAAAQIEPIYKARVATLRADYADVLLTARRPVCAEPACVVG

SEQ ID NO: 2951 - protein, 309 aa, unidentified
  source 1..309: note = Related to JAHLJF010000013.1; note = Methylosinus sp.
MNKRRTNLKLSDCWLYALASPTDLARRLQTAKHPIKVAELSMLAKDAGNFRLFSQTNAAGKSRQIQEPKRRLQWVHGRIHALLSRVEVPGYLHSAVRGRSYISNAAAHDPSMPTFKVDVKKFFASVPRSAIFNFFVGPMKCRRDVARLLADILTFDAHLPTGSAASPILAFYAFKPMFDEIEQFALAHGLTMTCYVDDMALSGPRANKSTLFEVRKIIARHGLKSHKAHVFGANQPKVLTGVCNTPTGPRVPNKLHMKIKAGFDKLLAATTPDTRSEALRPLLGRLEAAGQIDPGFRARALTVRAAYSK

SEQ ID NO: 2952 - protein, 322 aa, unidentified
  source 1..322: note = Related to NZ_LCZM01000200.1; note = Rhodopseudomonas palustris
MTIAGPVKLRRRKRARLDLKLSECGLYALASPAHLAGILSTPGCKFSVEELQGLSRDEGNFRLFDLVSDGGKARRIEWPKRRLQQVQRRIHVLLSRVEVPDYLHSAVRGKSYLTNAAVHSAEMPTVKLDVKKFFVSVPRVAVFNFFATTMKCRPDVAGLLSDLLTFDAHLPTGGAASPIMAYYAFKSLFDEIYAFASSQNVTMTCYVDDMTFSGGAVGKRFLYEVRRIVARHGLKSHKSRMFDARQPKVVTGVCNTTDGARVPNKLHAKIKDGFDKLSKADGSAQKAKILPPLLGRLEAAGQIDPRFKARAVTLRAAHQSGR

SEQ ID NO: 2953 - protein, 322 aa, unidentified
  source 1..322: note = Related to NZ_JAHBGD010000028.1; note = Ancylobacter defluvii
MAPKNKASLRIEDCWLFAVASKEDLARRLSTDRQKISVSDLERLSADAGNYRLFSIRQGTKERPVQEPKRELQQIHARIHRLLSRVVVPEYLHSAVKGKSYLTNAREHGHGISIIKIDVKKFFPSVPRFRVFTFFKIVMKCRKDVSGLLADLITFDQRLPTGSSASPIIAYYAFKPMFDEISRFAESAGLKMSCYVDDMTFSGSNANRFNLYEIHKIISKYGLKSHKMKYFVDQEPKIITGVCNTPSGERVPNKLHLKISIGFEELRAAKSHTSAVKLLRPLLGRLDAAGQIDPRFRARALTLRSTFKTKSRISNGAIKGRV

SEQ ID NO: 2954 - protein, 310 aa, unidentified
  source 1..310: note = Related to NZ_JACHIJ010000007.1; note = Afipia massiliensis
MRKRRNDLRLDECFLFAIESPRDLARRLSTKSMQFSEADLLGLSAGIIGNYKLFKIDGRPIQEPKRRLQAVHLRVHRLLSKVAVPEYLHSAVRGRSYISNAAAHARDEPVIKIDIKKFFASVPHAAILRFLRTSLRCRSDVAKLLANLLTFEGKIPTGSSASPILAYYAFKPMFDEISALATSLGLTFTCYVDDMTFSGRAATNSTLMQIRTIVARYGLKSHKVRKFSANDPKVITGVCVASEGDRIPNKLHRKIAADFKSLEVGDEGMQREKTLSSLLGRLQAAGRINPVFKARASTLRASASRRRQSI

SEQ ID NO: 2955 - protein, 310 aa, unidentified
  source 1..310: note = Related to NZ_LVYV01000034.1; note = Tardiphaga robiniae
MKKIRRDLRLNECFLYAIDSPADLAWRLSSKAMKLDAKDIDFLVRGSANYKFFKIKDRPIQEPKARLQAVHLRVHRLLSRVAVPAYLHSAVKGKSYLSNALAHDASQPLIKVDIKKFFASVPEDAVVRFLRSDCKCRSDVARLFASMLVCNGKIATGSSASPILAYYAFKSMFDQIATLAGEHGLTFTCYVDDMTLSGPTATNAMVIKVRAIIAKFGLKSHKVRRFNASSPKVVTGVCIMPDGIRVPQKLHLAISRNFQERSTETDTKKREKITASLQGRLDAAGRIDAKFKSRADTFRASTKKAQPSVP

SEQ ID NO: 2956 - protein, 319 aa, unidentified
  source 1..319: note = Related to JADFZH010000009.1; note = Magnetococcales bacterium
MKRYALDQSPFFKLKSRQKLSKILDADLNELEVFARNDPVDNYKLFETSGGKPRPVQCPKHRLQVIHRRVCDLLARIDTPDYLHSAIKGHSYLSNAKAHAANVPMVKVDIKKFFPSVTINAVKRFFLKTMECSPDVAALLSKVLTVYGHLATGSSVSPILSYYAHRDMFEEIAHLSAGRGAVMTCYVDDMCFSGETVTRKFLSDVRVIIRSHGLKSHKIHYFSSNMPRIVTGVVVTNSGIKLPNIRHKKIVDGYAQLQAALSDEEKLKLLPSLIGRINEAAQIDPRWTPKAKQLTLEMKRISSIAASSMNPSSRPSSWA

SEQ ID NO: 2957 - protein, 312 aa, unidentified
  source 1..312: note = Magnetococcales bacterium; note = Related to JADGBZ010000028.1
MNRHPLNQSPFFKLRSRKKLANILGLGLKDLEVFAQNEADENYRLFEIRRGGKARPIQWPIPCLQRIHKRVCDLLARIETPNYLHSAIKGRSYLSNAKAHSGDTALVKVDIRKFFPSVTVQSVKSFFLKTMGCSPDVAAVLSKVLTVYGHLPTGSSVSPILSFYAHLDMFGEIEQLARKRGAVMTCYVDDMCFSGRSVTRKFLYEVRLIIHRHGLKTHKIHCFAPGVPRIVTGVVVTGDGMKLPNKRHQAIAEDFAKFQSSLDEKQKLKIFQSLLGRVNEASQIEPRWKNKATSLCQEVNKMLYCGRQNDGC

SEQ ID NO: 2958 - protein, 301 aa, unidentified
  source 1..301: note = Related to NZ_VEWK01000024.1; note = Brucella pecoris
MALHALNQSQLYKVMSPADLARRLGILAEDLEELANRTDNYKRFKVGAQKKRHVQEPKDRLKQAHNKVTRWLSRIETPDYLHSAVRGRSYITNAAVHSADSNLVKVDIRSFFQNVTTHAVYLFFAKTMKCRGDVAMLLAKLLTVDGHLPTGSSVSPILSYFAHKPMFDEIAKLASHVDLRFTVYVDDVCLSGEKASRSVLFQVRGIIAKHGLKSHKCHFFPTGVPRVVTGNALTLGGVRLPHVRHLKIKKAFDELDKMAEGPAREKALKALKSRLYEAAQLEPVWGARARSLFGRKAQVTS

SEQ ID NO: 2959 - protein, 316 aa, unidentified
  source 1..316: note = Related to NC_011420.2; note = Rhodospirillum centenum
MKNYPIDQSPLYKLHSKRKLENILCTNLDIEKMANYEGKNFKFFYITQGNKKRKVESPIPEIQELHRKIARLLCRIDPPDYLYSATKKRSYLSNAQRHIGRHALIKVDISKFFPSVSRLKVYNFFRFKMKCSPDVSAIIAKLLTVDGHLATGSSASPILSYYANIDMFEELYLLAKNRSATMTCYIDDVCFSGEHVSKKLLYEVQKIIRRHGYVNHKQKARYYSPGEVKLITGVAVTSLGVRLPLRRHRAIRDGYTHIFTAKTDSDRLTQLEKQVGRLFEASQIDPSFKDKAKRASQARANLKRRLLSKAFHPSSP

SEQ ID NO: 2960 - protein, 306 aa, unidentified
  source 1..306: note = Related to NZ_WTYG01000004.1; note = Qipengyuania citrea
MNTHKRVPLKGSALFRLTSPRRLAEMLLVPRATLERLVEAGDDNYLVRPDRKSGRIIEEPKPQLKLIHQRFARLLAQIETPDYLHSGVKGRSYITNANAHGADDACVKLDIKKFFPSSSSHHVQRFFEDVLEYPPDVASRAKQLLTHDGHLPTGGNASPILSFWAYKPMFDEIDTLARENDCEFTLYVDDMSITGVFANRKFQQAARKIIARYGLRAHKAKTFSPNQPRVLTGIAKTRRGREVPHRRAKGIAQLEQQEAEAETTADKLRVMPSLIGKLSEAAIVDPSWTARKNAAVQRRRKMKASG

SEQ ID NO: 2961 - protein, 312 aa, unidentified
  source 1..312: note = Related to QFPK01000008.1; note = Sphingomonas sp.
MSMSKHKRIALKGSALFRLTSPRRLAEVLLLSRSALERLIVAGDTNYIVRFDQKSGRIIEEPKPQLKLIQKRFARLLSQIETPNYLHSGVKGRSYITNADAHEANQSCVKLDIKKFFPSSNSHHVQRFFEDVLEYPPDVAARAKQLLTYGGHLPTGGNASTILSFWVYKPMFDEIEALSRQHNCKFTLYVDDISITGLFANRRCQQAVRKIVSRYGLRTHKTKAFSAGQPRVLTGVAKTRRGRELPHRRAKGIAELEQLETATDSTAKKMKLLSTLIGKLSEATIIDPLWAGRKEAAVKRRRKLKQEDRIKR

SEQ ID NO: 2962 - protein, 313 aa, unidentified
  source 1..313: note = Related to CP031357.1; note = Erythrobacter sp.
MSTHKRVPLKASALFRLTSPRRLANILMVTPTALERLVRWGDENYLVRPLAQVEGKAPRMIEEPKPQLKLIHQRFARLLAQIETPDYLHSGVKGRSYITNANAHTADKACIKLDIKKFFPSSSSHYVQRFFEDVLEYPPDVAARAKQLLTYDGHLPTGGNASTIMSFWAYKPMFDEIAALAVELGCEFTVYVDDMSITGVFANRKCQQAARKIIARYGLKAHKANSFSPGQPRVLTGIAKTRRGREVPHRRAKGIAELEQVEAAASTVEDKMKVLPSLIGKLSEAAIVDPSWTGRKDAAVHRRRRLKVGAGAE

SEQ ID NO: 2963 - protein, 308 aa, unidentified
  source 1..308: note = Related to NZ_CP009122.1; note = Sphingopyxis fribergensis
MSTHKRVPLRGSAVFKLTSPRRLAEMLLIPRSTLERLLDFGDSNYLVRHDRKSNRTIEEPKPQLKLVQQRFARLLAQIETPDYLHSGVKGRSYITNANQHGAEQACIKLDVQKFFPSSSSHYVQRFFEETLEYPADVASRARRLLTYDGHLPTGGNASTILSFWAYKPMFDEIDAAAKRLGCEFTLYVDDMSITGKFANRELQREAAKIVALYGLRTHKLKNFSPGQPRVLTGVAKTKRGREVPHRRAKGIADLEQEEASATTAVEKLRLLPSLIGKLSEAAVVDSSWSGRKNAMVLHRRRLKAGISR

SEQ ID NO: 2964 - protein, 321 aa, unidentified
  source 1..321: note = Related to NZ_CP082839.1; note = Sphingomonas sp.
MARRCAKRVSLRGSALFKLTSPARLAHILCISPGQLAYLVRNAEANYLVRTDRKTGRLIEEPKALLKQVHARVAKLLQQIETPDYLHSGVRQRSYVTNASQHGAKDSAVKLDIKKFFPSVRAAAVYSFFHELMEYPADVASRMTRLLTIGGHLPTGGNASCILSFWAYKPMFDEIAELAVAKSCAFTLYVDDMTISGRFASRSMQQAARQIVGRHRLRAHKNKVFVPNQPRVVTGVAVTVRGLELPNRRAKAIDDATQVVTHTADGSAKLALLPVLIGRVSEAAEIDPAWNGRKTAAVNLRRTLTGRIATASRPGGGEPPA

SEQ ID NO: 2965 - protein, 312 aa, unidentified
  source 1..312: note = Related to NZ_LARW01000108.1; note = Sphingomonas sp.
MKGKPHKRVSLRGSALFKLTSPVRLAQILCIPPAQLDRLLRRGNTNYCVRTDRKTERLIEEPKALLKQVHARVAHLLAQVETPAYLHSGIKKHSYITNAAEHRVEGGAVKLDVQKFFPSVRAAAVCHFFADVMEYPMDVASRMTKLLTINGHLPTGGNASCILSFWAYKNMFDEIAALAAAKGCTFTLYVDDMTITGQFATRAMQKEARAIIGRYRLKAHKTKIFSHRQPRIVTGVAITARGPELPNRRARKIAITMAGVEAAATDSQRLALMPSLIGRVSEAVEVDPLWAGRKAAAVGMRRTIRSRVEKSR

SEQ ID NO: 2966 - protein, 303 aa, unidentified
  source 1..303: note = Related to NZ_VMDU01000019.1; note = Rhodobacter flagellatus
MSHDRNQSILYKVTSPQMLADRLLISRGELHALLANADPYKRWIDKKSGRAIQEPRPKLAKVHRRIATLLTRIDTPAYLHSAKKGRSYISNAAAHSVDDGCVKIDVRRFYPSARAQAVYHLFLDRMACDGDVAGMLAKLLTVDGHLPTGSSASPILSYFAYEDLFHELAVLAEASGCKMTVYVDDIVFTGAGATRRLLFEARKAIGKRHLHGHKTKLFRPGQPRIVTGVAVTNNGLRLPNRRQVRIAEDQKLFDDLPLGREKLIVARRLTGRLFEASQIDAGWRVRAEAMAALRDDIQRKIGR

SEQ ID NO: 2967 - protein, 302 aa, unidentified
  source 1..302: note = Related to NZ_FOJU01000001.1; note = Poseidonocella pacifica
MSYPRNQSIFYKITSPQMLADRLRVTLDELNELCAASDNYKRWTDKKTGRPIQEPKPKLDKIHKRVAALLAKMETPDYLHSAIKGKSYITNASGHSVGTGCVKIDVRKFYPSVRSQAVHHFFLDRMLCTGDVAGILTKLLTVDGHLPTGSSSSPILSYFAYEDMFEALAALAKANGCIMTVYVDDVVFTGTGATRGLLYAARKVFASYRLYGHKTKLFRPGQPRIITGVAVTKEGMKLPNKRQRGIADDLATFDSLPNGREKLVVARRLTGRLFEASQIDPAWRSKAEAMAAERDSLQRIIS

SEQ ID NO: 2968 - protein, 308 aa, unidentified
  source 1..308: note = Alphaproteobacteria bacterium; note = Related to RFJA01000102.1
MPERRSYPRDQSRLYKVKSPAQLADIFFLQPHELDLLLDANENYIRWTDKKTGREIQRPKPLLEKVHRRAGMLLSRIETPDFLHSAIKGRSYISNAQRHMPDEPTAKIDVRKFYPSARAQAVFHFFRDRMLCDGDVAGMLARLLTVDGHLATGSSVSPILSFFAYEDMFTDIEALAIERGCEMTCYVDDMVFTGPGATRRLIYDIIQIVRQYRLWGHKTKLFKPGQPKVITGVAVIRVGQRLPNRRQKTIADEMDVLKSTRDDAERLAIIRRLLGRLYEAAQVDSSWYVTADAMADEKRGLERRSARA

SEQ ID NO: 2969 - protein, 342 aa, unidentified
  source 1..342: note = Related to AP014946.1; note = Variibacter gotjawalensis
MNMPKAKSSKKLKLEECFLHSVASPVDLARRLLIDLPDLERLANADHRFKQWTTKKGRKIQEPVRELQVVHGRVMRLLSAVEPPLYLYSAVAGRSYITNARQHVGAYPTVKLDLQKFFPSVKRAAIRNFFVREMKCAGDVASILAKILTCNGALPTGSRASSIMSFYAFKSMFDELGDLAIANNCTMTVYVDDIAISGEGARPRLLVKARRIIARYGLKSHKTKFFQALQARIITGVVVDPAGIALPHSRRVQIERGLAVLAAECDPKWKLEILTRLVSRVYEAAQIAPAEFLALATELSKARAELLKKASELAVASVAPDRRSHLRLVHSDASTSDRVASP

SEQ ID NO: 2970 - protein, 338 aa, Alcaligenes faecalis
  source 1..338: note = Related to MTBI01000002.1
MTHYRKSYAISNSPFFKLSSKKKLSELLGVSLHTITDIRQSGLHRQYRIFKDKKTRRLITEPVGELLRVHKKILKLFKRIQPPAYLHSAIKKRSYKTNAEAHLQNRRTLKIDLKKFFPSIRFHHVYGFFLKNMQCSSDIATILANLCTADTKSHGTHLPTGSCISPLLSYWINQNLFDQLHDITSQEGCHMTLYVDDITISGEKATPEFLNKIAIAINSHGYKYHKVACYGNGVATITGLIVNEGKLELPHVRAQKIRRLEKELMEAENDIDRKRILNSLMGRLTEAEQIVPAYTAKKNEIMKLFKNIWGDIVQQRAQRAQLKRRIKKQPVLADIAGG

SEQ ID NO: 2971 - protein, 337 aa, unidentified
  source 1..337: note = Related to JAERVK010000007.1; note = Methylomicrobium sp.
MMTSRRSKTPHRYEIEFSPLYRLSNKKKLAALLNVDVSIISSPDKSKLCSQYRIFVDKKTKRFITEPIGDLLAIHQRLLKFFSRIAPPEYIHSAIKKRSYLTNAEAHRKSSNILKIDIKKFFPSIKFQCIYGFFLNTLKCSSDIATILAKICTVQTNNYGTHLPTGSCISPILSFLANQQLFDSIKIICEKEKCKLTLYVDDITISGENASPALLTLIAMEIFKHGYGYHKIKIYKDQPAIITGLVVYNKKVCLPHERAKKIRELIDALKISVGPLRQKMLASLVGRLSEAEHIESQYKAKRVSIISQYRKEWDEVVANRNSKCKVSRNKKLAKNNT

SEQ ID NO: 2972 - protein, 333 aa, unidentified
  source 1..333: note = Related to QAJP01000003.1; note = Herminiimonas sp.
MTKNPTRGSKKYDLESSPLYRLSNKRKLADLLGVEPSKILGLKKSAICSQYKIFKDKQTSRFITEPHSDLLLVHRRLLDLLTRIQCPPYLHSARKKHSYKTNAEAHQHSSAVLKIDIRKFFPSVKFHYVYDFFKNEMSCAPDISTILAKLCTVTTLKFGIHLPTGSCISPLLSFLVNKVMFDEIDALCRAHDCKFTLYVDDMTISGDKASRALLTSIAMIIHRFGYGYHKIKTYHQVPTVITGLVVYKGMLRLPHRRAKLVRVASQALAQAVSGSMRKKLLGSLIGRLSEAEQINPLYKVRKEVLLTRYKSEWQTIMDERVEKSLKVRGTKSK

SEQ ID NO: 2973 - protein, 341 aa, Thiobacillus sp.
  source 1..341: note = Related to JAIBFA010000065.1
MKITKAKEPQRYEIERSPLYKLSSKRKLSELLEVELTTLSSLEKSGLTSQYRIFKDRKTRRVITEPIEQLAVIHKQLLKLFSRIAPPSYVHSAIKKRSYKTNAEQHKDPANVLKIDVKKFFPSIKFSHIHDFFLNGLCCSKDIAVILSKLCTVQTVKHGVHLPTGSCISPILSFLANRRMFDAVKKICDREGCVFTVYVDDITVSGVNATRALLSEITTVIHKHGYQYHKIKTYHGQPALVTGLVVADGRLRLPHERAKKIRELSKALKALRASKSTPLRSKMLASLVGRLSEAEHINKAYKPLRQKILSSYSAEWSGVIAYRLRKSRTKRLMRNCVITAS

SEQ ID NO: 2974 - protein, 353 aa, unidentified
  source 1..353: note = Proposed Chitinolyticbacter meiyuanensis; note = Related to NZ_CP041335.1
MTQKKKTGTPQQHRYTIDRSPLFGLSSKKRLSELLGVELRLIRDVEKAGLTRQYKIFVDRKSRRFICQPVDELEKIHRRLLKYLIRIAPPSYVHSAIKSRSYRSNANAHLLNGPVLKIDIKKFFPSIKYDRIHSFFFDTFKCAPDIATILAKLCVVCSKNHGVHIPTGSCLSPAISYLANIKMFDRIAEICAKAGCRFTLYVDDITISGAKANHQLLGEVASVIFQRGYKYHKTNVQQSGHALITGLVVTPQGLRLPFKRVKKIRDLSETLFAASVLNLAQARKREILASLVGCLSEAEQIESRYKLIRARIVEEHCDTWNEIVKNRTKRAALKRQQATRAVIPPAMKNCTSK

SEQ ID NO: 2975 - protein, 330 aa, unidentified
  source 1..330: note = Related to JACEZS010000033.1; note = Duganella sp.
MTSSLRKPKQYELEKSPFFQLKSKKKLAELLNVSLPSLSRTQIEKLASCYRIFVDRESRRFITEPVGELQVIHQRLLQYFSRIAPPDYLHSARKKRSYKSNAEQHIGNTNVLKIDIKKFFPSVQFSYIHDFFSNQLQCAPDIAAILARLCTVKTSRHGVHLPTGSCISPVLSFLANKPMFDRVAALCASQRCTFSLYVDDITISGAGATHALLTSIAVEINNAGYGFHKIKSYFSEPAVVTGLIVTHDRLCLPHERQKKIREVAEALRISIDTGIRERLLASLVGRLSEAEQIDTKYGNYRKIVLARYSADWKRVVAHRLARMKKSAKRP

SEQ ID NO: 2976 - protein, 355 aa, unidentified
  source 1..355: note = Related to PGES01000001.1; note = Janthinobacterium sp.
MKPSPRKPKQYELEQSPLYKLSSKRKLAELLQVDLVTLGVTELAKLTSNYRIFVHCETGRFITEPVGTLIPVHKRLLSLFSRVVPRDYIHSATKKRSYKTNAEKHIGNQNILKIDIKKFFPSVRFCYVHNFFANTLKCSPDLATILAKLCTVRTKKHGVHLPTGSCISPILSFLANRDLFDRIEKLCIEADCTFTLYVDDVTISGPNATRALLTRIAMEIHKNGYGYHKIKTYHAVPAMVTGLIVTEGRLILPHARCQKIRQYAEALECSVGGQIREKLLASLVGRLSEAEQIDAKYRTARQDVLKRYAVDWGRVMALRIASAKHRARKTASVNKPSTTLLDQQGDTVRSITASS

SEQ ID NO: 2977 - protein, 344 aa, unidentified
  source 1..344: note = Related to NZ_CAJNAZ010000001.1; note = Paraburkholderia domus
MANNPTHKRKQYIIAKSPFFRLHSRQALAELLGITLPQMEALASSPSDALYRMYDDEASGRYITAPLPELQRIHKRIARLFSRVIPPAYLQSATKKRSYKTNAAMHRKNLRIAKVDIRQYYPSITFGAVFNFFKKKMECSVDVSTVLTKICTVSARGRTHLPTGSSLSPILSYWVHSDLFNRIKLICDSAACVMSLYVDDITVSGTNATASLISKIEAEIAKAGLTSHKIKVFDRVPATVTGVIVHKGRLALPHERAKDIRLLRGIMAKLPLAEAEADATLSRLVGKLNEAEQFVTGYGAIKKNVLSEHASAWNRITAARVAKSKAAARRKRLKAAATRISKSS

SEQ ID NO: 2978 - protein, 341 aa, unidentified
  source 1..341: note = Related to KN150957.1; note = Burkholderia pseudomallei
MATILTKRNQYAITKSPFFRLHSRQTLAKLLGITLLEMETLASRPSNALYRMYDDSASKRHITAPLPELQRIHKRIARLFSRIIPPAYLQSATKKRSYKTNAAMHRDGQKIAKVDIRQYYPSITFGAIFSFFKNRMQCSPDVSTVLTKLCTVSTKGRTHLPTGSSLSPILSYWVHSELFDRIKSICDDLGCKMSLYVDDITISGKNADAALVTKIEREIEKTGLTAHKIKIFDGIPATVTGVVVHKGRLALPHDRAKDIRMLREALNKLPEKDADSTLSKLIGKLNEAEQFVAGYGAIKKNILSDHAPVWTRITTVRVEKSKAAARRKRLKAIGTSGSKTS

SEQ ID NO: 2979 - protein, 339 aa, unidentified
  source 1..339: note = Burkholderia phage KS5; note = Related to NC_015265.1
MAKSQTTRKQYTKNRSPFFRLESRRKLATLLATTLKSLEELAGLPSNQRYKMFFEQESGRYITEPIGELRRVHKRIAKLLCRVSPPDFLQSATKGRSYKTNAEAHIGGQNIIKLDIKEYYPSVTFGAIYHFFLNNLKCSQDVATLLTKICTVSACGRTHLPTGSSLSPILSYWAYSHLFDEINSLCAAKGCTMTLYIDDITVSGPNADKLLLAEIRNRIDATGLVAHKFKASQGMPIKVTGVIVLRDGITLPHDRARDIRKLQAELATTSPEEVDPTLSKLVGKLNEAQQFVATYGEIKRAVLRQHSNAWNRIVTERATQSRRAMLRRRRKTAVKKASG

SEQ ID NO: 2980 - protein, 309 aa, unidentified
  source 1..309: note = Related to NZ_LT592171.1; note = Thiomonas delicata
MSEQPKRYPIDQSPLYSLCGKGKFETVIGVSWDAVPELCSSSNYRVWTNENGREIQAPFKGLAATHRKIGLLLSRIDVPGYVYSQKGRSYADNARQHLGHHPVIKTDIQGFYPSISRARVYGMFRQDFHCAADVAARLADICSYQGLHLPTGSPLSGRVAFLAARHLFDDIAKLASASDCTFTVYVDDITLSGANATKRLLAEVRRLIEKHGLRSKRGKSKSFSPSSPKSVTGVILVGEDVRLPNSRHQKIWETRRALLTATGEERLKLERQLKGREQEANQVLCSPRNIEPPRVSWRLVGLSHAGMAC

SEQ ID NO: 2981 - protein, 300 aa, unidentified
  source 1..300: note = Related to JAGQDF010000002.1; note = Ideonella sp.
MSGFRNAMPSSAPRKAYALNQSPLFRLRGKGRFEDVIGVKWESVTDLLAAESFRVWKGPKDREIQAPIHWMAAVHKVIADLLARIEVPDYVFSQKGRSYADNARQHLGNHPVIKTDINKFYPSVTRAMVFRMFVRDFECAADVADRLADICCYRQLHLPTGSPLSGRVAFFAARGLFEDIAKLAVASGCKLTIYVDDIALSGPNATKRLLGEVRMLIARHGLKSKGKKSATFAAGAPKSVTGAVIVGEELRLPNERHRKLHETRSAYVAADGDERAKLGRQLRGRQQEAAQILRPVARAT

SEQ ID NO: 2982 - protein, 311 aa, unidentified
  source 1..311: note = Related to NZ_CADEWJ010000013.1; note = Burkholderia gladioli
MKSKGTPERYPLHQSPLYRLKGKGQFEKILGVEWSAVNRLLAAGNYRVWKNDKGREIQQPLGWLAHVHGRIGKLLSRIELPDYLYSQKGRSYADNAREHVGGVPLIKTDIHKFYPSTTRQMVYRMFVVDFMCAEDIAHCLADICCYRQRHLPTGSALSGRIAFFAAKHMFDDIADLANDEQCRMTAYVDDVTISGPAATKKLLGEVRKVVSKYGYKTKQRKSKTYAATSVKVVTGAVVVGRELRLPNERHRKIWQTKQELLRCEREEKAPLMRALRGRLQEASQILNNLSGDLHNSDLMLGRSLSNRDGSS

SEQ ID NO: 2983 - protein, 306 aa, unidentified
  source 1..306: note = Related to NC_014207.1; note = Methylotenera versatilis
MSESLSRLMPKQYAINQSPLYKLVGLRQLELCLGIDLERLDKLLKDGSYRTWVNDNDRAIQHPLGWLAQVHSKIAHYLAKIETPDYVYHKKGRSHVKNASEHTGYHLVAKTDISNYYPSITRAMLKSMFVKKFKCALDVAGILADICTYQRTHLATGSGVSGYLAFWASKDLFDAVYELSRARGCVFTLYVDDLTISGNAASKKLLTEVRAIVKRNGLKTKETKSKTFAAHATKMVTGVVLKGNESLLSNKRHKEIADNRIAIANTGNANIKATLQKSLKGRLMAAKQIIDSNEIKTVTSSDLIYS

SEQ ID NO: 2984 - protein, 304 aa, unidentified
  source 1..304: note = Related to FOLP01000049.1; note = Variovorax sp.
MQSKKTPDRPYPLASSPLYGIRGKGQFERAIGLTWDQTDRLLHRRYYRVWTTKKDREIQQPLYELEKLHARIANLLARIEMPSYVFSRRGRSYVENADRHKGLSPLIKTDLTKFYPSTSWPMVFRLLVSRFNCAKDVAHRLADLCCYQQKHLPTGSALSGYLAFFAAQPMFDRIADILGRHGCEMTLFVDDLTASGAGATKHALEEVRAEIRHHGFATSEAKSKVYRAAAPKLVTGAIVTPTRLMLPNKQHLKIWAARRSLPVLPKIMRAAALRALRGRIQQAHQVLNYSGPTFELAAPVEPSG

SEQ ID NO: 2985 - protein, 305 aa, unidentified
  source 1..305: note = Related to CABPST010000009.1; note = Pandoraea bronchicola
MSARPTYPLDQSPLFRLPSKRRAAEVLGIDLHQIEQLVGERNYRVFVNAKGRTIQHPVGELAGVHKRIASLLGRLDVPSYVRSVKGESYVSNAGSHVGNGPLIKTDIAQFYPGTNFSAVYGFFRRDMGCAPDVAHLLARLCCFRQRHLPTGSYLSGPLAFFAHRAMFDQIYCLAQDRGCVMTCYVDDIVISGPGASKELLYRVRGLIRAAGRTSKDDKSKTFPAHKPKTVTGVIVTSDALRLPNSRHKQIHEARAAIRAAGGDGEQMSLRASLRGRLQEAGQIANWNVRNPGGGVLVRGVVPDVS

SEQ ID NO: 2986 - protein, 341 aa, unidentified
  source 1..341: note = Related to NZ_CP045306.1; note = Legionella longbeachae
MVKQIDRYPLERSPLYNAKSLKKISCLLSLSSLKVNKNDRSKPMLQKLYKLTPTDLDNFAAQQNYTIKELIDKKGKSRSTEIPAIDLKWLHYRLEHLLKKIEPPPYLFSAIKGRSCKDNARMHATNTQLFKIDIKTFYPNINFGKVYNFYRHILHCEHHIATILTKISTYNGHLPTGSPLSPILSFYACKPMFDEIYQLALEHNCVMTLYVDDICVSGDKATKALLWKIKQIIHRYGLRYHKVKFYFQKQPKTVTGVIVTENSIKLPNRRHQAITERITYIQSPSITAKEKRQANNSLLGQLNEAMQLEPKLAKTKALLIQQGVLKPHMSLPRSNSKRKTK

SEQ ID NO: 2987 - protein, 317 aa, unidentified
  source 1..317: note = Related to NZ_SOBK01000001.1; note = Pseudodesulfovibrio indicus
MTSKYSLSQSPLFKLKSKKKLADLLGQSLGDLQSLAKSNDNYNVYTLSPKSKLDHPYFLRKERQVQEVRPHLKNVHERILNLLKRVQTPDYLHSATKGKSYRSNAEAHLSKDVIYTVDIKSFYESVTFGRIYHFFHSTLKCSPDISHLLTRLCAYKRNLPTGSCISPLLSFWTNVTMFQELDLFSKTNGLTMTLYVDDLTFSGTDLPKKTCFKIDKIIASYGYKPHKQQLYINKKAKIVTGLALCGARLDIPNKRRGKIRVLIEAIARERDAEKKEKLCNSLVGMTYEAAQFNRGYARLIAKQIRKKCPCTRQQINL

SEQ ID NO: 2988 - protein, 317 aa, unidentified
  source 1..317: note = Related to NZ_CP051216.1; note = Pseudodesulfovibrio sp.
MKTKYSLSQSPFYKLSTKKKLAQLLGQPLADLQALAKSNGNYNVYTLLPKSKLSHPYFVKKERQVQEVRPHLKTVHTRILNLLKRIKTPTYLHSATKGKSYKTNAESHLNRNALYKVDIKSFYESISFGRIYHFFHEIMKCNEDVAHLLTRLCAYQRNLPTGSCISPLLSYWTNVTMFDDLYIFSRAHGLTMTLYVDDLTFSGNEISKRTCFEIDKIIAGYGYKPHKQKQYSTKKTKIVTGLALCNDRLDIPNKRRGKIRVLLEAISQEKDAAKKEKLCNSLVGMTYEAAQFNLRYAQIIAKKVRKKCPCARQHITI

SEQ ID NO: 2989 - protein, 321 aa, unidentified
  source 1..321: note = Related to NZ_KI632512.1; note = Cupidesulfovibrio termitidis
MSRDRYAIDQSPLFKLKTKKKLATLLDSSVRELQALSVSSDSYRVFDLPAESLVQHPLFARKSRKIQQLKPELDAIHRTLHKYLSRINVPDYLHSAVKCKSYATNAKTHSGCLYLYRVDIKKFYESVNWRTVYRFFYKTLDCAPDVSALLTNICCYEDKLPTGSCLSPILSFFVNQEMFDELYEYASQRDLTMTAYVDDIVFSGREFHRINAHSIRGIINSYGYECHKERICPPRKSKIVTGLSVTRTGVAIPHKRMAKARVLLQELAKRMRQSHKEKLCASLTGMITEMSQFDRAKAKYLATLGKKYCRTIQNIHFKLCK

SEQ ID NO: 2990 - protein, 301 aa, unidentified
  source 1..301: note = Zetaproteobacteria bacterium CG_4_9_14_3_um_filter_49_83; note = Related to PFXG01000051.1
MQKKRQGNYPLNQSPLYKLCNKRNLAAEFNLTLRELDSLLKRQNNYRAFFLTQGEKKRPVEAPKPIIERVHRRLFQLLTRITPPEYLHSGVRGRSYVSNAEQHRKNPVLYKLDIVKFYPSTKQWHAFEFFRSTMKCSRDVAGLLAKIVTVDGHLPTGSCLSQIMAFYAHFDMFEALYGLATSYNLVMTCYVDDIVFSGNKIPKSFQLEAKKIIQSSGLLSHPRKEKLFFGEKPRIVTGVVISQSQLKIPNRQHLMIKEALFELPTLVADSPEREKLYRQVVGRIVSASQIEPKFFKHKKVK

SEQ ID NO: 2991 - protein, 307 aa, unidentified
  source 1..307: note = Alphaproteobacteria bacterium; note = Related to JAFLCR010000159.1
MKKEEKKRGNYALNQSPLFKLRSQRRLAQLLRTPLNDIYGLLNTGNNYRVFPQGNRTCHDPKPKMKGIHKRLQILLNRIAPPEYLHSATKGRSYVTNAAAHLGNDVLHKLDIRKFFDSTTYKHVHDFFKNTMQCSADVAALLSRITTYDDRLPTGSPISPILAYFAHKSLFDQINQEATATNVMMTCYVDDLSFSGSTVPKAVLRKAKKGIIQRGLEYHKEKRFQKGDTKIVTGVALRDEQMLLPNKRHKKIHEEKQRSLEIDDAKKKREIIHKLISQTGEAARIEPSQFEPLKQALMQVRRNLPKP

SEQ ID NO: 2992 - protein, 355 aa, unidentified
  source 1..355: note = Related to JACVAG010000005.1; note = Pseudoxanthomonas sp.
MAKTLKLHESPLYRLTSKKKLAALFGVKVADIKFLRKLDGNYRVWPLKQKHQDVLAGMPVSDKVRMVQQPKPTLDAFQRRLAKFLGAIEKPDYVYSATKKRSYLENALVHRHSQPALKVDIRSFYPSVKRRAVKSFFEEQLGCAEDVAHVLSELCCHEGKLPTGSALSPVLSYFSCAPMFARIAALADAKGLRFTLYVDDMVFSGTGLDDKFLAQVLNELNREGYSGHKVRFYKARRPKVITGAVVWPSRVDVPHKRRWKMRLYERALKVAKPEDKAILGRALLGQYRESSRINPSFKVAASRLQKFMDDMGGKTKAAKPRKRPRGRSSYSLFLSRISRLRAEVAAVRTVAGSAP

SEQ ID NO: 2993 - protein, 358 aa, unidentified
  source 1..358: note = Related to NZ_CBTJ020000001.1; note = Candidatus Competibacter denitrificans Run_A_D11
MVKNSGYSIDQSPLFRLSSKKKLAGLLGVSVKYLHSILTLDNYRIWEAPQKYQDILAGFPPPSKTRKIQEPKQLLLRLHKKLSIFLSRIKKPDFVYSATKGRSYVDNAREHMNFGRAIKIDIKDFYPSVRRKLVRDFFINDMQCAPDIAYVLSLLCCVKDSLPTGSPLSPVLSYFACSRLFCKIAHMAAVKNLKFTLYVDDMVFSGANATRSFCYQVVKELAYNGFIGHKITRFSSRQVKVITGVAVWPHKIGIPHKRQKRIRFFERAFKLNNNPDEIKILGGTLIGQYREAERLQPGSSMRARPIQERLNLINLQCVSVSPVTKKRRRRRLSSKLSKGIIDTLQTQKNKKKNDISSE

SEQ ID NO: 2994 - protein, 354 aa, unidentified
  source 1..354: note = Related to JADKCY010000002.1; note = Xanthomonadales bacterium
MMHSLCYPLDQSPLYMAGSKVRLCELLGITTKDLRLLLALENYREWTAKQKLADKLANLPAKSRNIEEPKPLLRLLHKRIALLLDKIEKPDFLYSARKGCSYFSNALQHQRSEGAVRVDIKSFYPSVRQRMVKEFFESQMRMPADVAHTLAKLCCHDGKLPTGSPLSPILSYFACSPFFSRVAAIADRLGLQFTLYVDDMVFSGKGANRALADQIKRELAGVALIGHKVSYFPAGGAKVITGAAVFPDRIEVPFKRQRRIRKFEEAFAKTTNVATRGAGTPWAAWGPGAGRPGPGPRARPVEVRLAALEARTPEIHGKANAKRRKKPVGKSIMREIARKAAVLREHRLEADVCS

SEQ ID NO: 2995 - protein, 313 aa, unidentified
  source 1..313: note = Related to NZ_LDIG01000020.1; note = Paenibacillus dendritiformis
MVEPRTYPLQQSPLYRLTSKKRLALLLGISASELKLLCDLQDYNFKRWELGQRERDKLIGLPAKAKKRSIQQPKTALHAVHKRIALLLGRIEKPAFVYSATKRRSYVDNAIQHQRDEPCVKVDVKEFYRHVKFGRVRRFFLENLQCADDVAHVLAILCCVDGALATGSAVSPVLSYFACASMFAEIEDFAQRRRLVFTLYVDDMVFSGAAANRAFADGVRYLLKGKGFVGHKVTCYRAHDVKVVTGVAVRAGFVDLPFSRQGRIRRTEVAFAKSTDPNELRILGRALLGQYREAERIRPGIKAKAAPVEARLR

SEQ ID NO: 2996 - protein, 372 aa, unidentified
  source 1..372: note = Xanthomonadaceae bacterium; note = Related to SCUI01000013.1
MANARAYPLTSSPFYRLASKQKLAAILGVSLRDLRLLLKQPDNYRLWDTRRRRRDELVGIPHKARAIQQPKPLLAIIHKRLAILIGRIEKPDYVYSATKARSYFDNARPHAIGEPTVKIDIKNFYSNVTRRFVRDFFERRLQCSPDVAHVLTELCCITTASSSALPTGSAVSPVLSFFACSEMFRRIAEIAKDHGLIFTLYVDDMVFSGSKANRHFTSKVVHELAKNGFVGHKITHFRGDATKVVTGVAVSAGRVDLPFRRQRKIRQFEEAFWAATNPEDISLLGATLLGQYREAERIKPGTKLRALAVAARLEKLGLSNGLPPSVKKRRGYPGKRLDAKRFDRLRSAVSLNPSTTSGGPETLVNTGVVMAA

SEQ ID NO: 2997 - protein, 368 aa, unidentified
  source 1..368: note = Related to LN647463.1; note = Xanthomonas citri
MKAPKRYPYHQSPLYALTSKRRLADILGVPLKDLVFLASLKDHNYQVWPLKQKRRDQLAGIKPPEKSRFVQQPMPLMRLLHDRIASLLGKIEKPQFVFSATKGRSYLDNALQHRDNIAQPAFKVDIRSFYPAVKSQWVRRFFEVDMKCAPDVARFLARLCCVNGALPTGSPISPTLSYFACAPIFRWMAEFAESNGLVFTLYVDDMFFSGAKASKDLSKLVLGHLAANGFRGHKVAHFRAGQPRVITGAAISQDGVSIPFKRQMRIRLYERAFASTNDPEAIQTLGKALLGQYREGERLQRGSRERAKPIQDRMDAINAVRFEELTQVQPKRKKRGPLSTAAMKNHVQKLRERRSGQLHPVTDTPQWQ

SEQ ID NO: 2998 - protein, 322 aa, unidentified
  source 1..322: note = Related to NZ_LR134378.1; note = Lautropia mirabilis
MISKKQYNKDQSPLYSIKSKRRLARILETDAKTIIRLASDTSKHYKLWETKQKPRDKICNITHTPRKIQEPKEDLLKIHKKIAKFLSRIKKEEFVYSATKGRSYLNNAEFHKDRIHEPSFKVDIEKFYPSVKIKKVHNFFQNEMKCAPDIARLLAKICCIHGALPTGSPISPTLSYFACKDMFSWIGNLARSNNLCFSLYVDDMFFSGEAASQELRNKVITHLKKNDLRGHKISHFSANKTRVITGVAITPKGLRITNKRHKKIRIYSNAFFRSKSPDNIQTLGKTLLGQYREASRVEPHLLQRTGKVQSRMDLFKDKSQNM

SEQ ID NO: 2999 - protein, 376 aa, unidentified
  source 1..376: note = Related to DQEG01000261.1; note = Stenotrophomonas sp.
MRPLGRFLFMLQGEQEMVRKKEEKRYSITSSPLYGLSSKKKFAELLKIDLADLRFLAKFGDSNFKVWSTAQKLVDEVAGLPAKKSRVVQQPKIVLSVVHRRIAEYLSRIERPEFLHSATKGRSYLTNAMVHAWNMPGCKIDIKEFYPSVKRNLVKSFFENRLKCTHDVASFAADLCTYNGALPTGSAVSPILSFFACLEMFERIDLLARQRDLRFSLYVDDMFFSGDKADKGMAKSVVDLLSRHGFVGHKVVCFSANETKLITGVAINGCETSIPNARQNKMRLFSRALRRERNRERAILLAQALVGQFREAERLQPGTKARALPFERRLIKLKGAEKKTVSVVRRRRRRSRPKVLTSTLLRAIALMRAAPKIVNV

SEQ ID NO: 3000 - protein, 317 aa, unidentified
  source 1..317: note = Related to NC_018012.1; note = Thiocystis violascens
MPNGYSINQSRLFKLANKRKLAGILGITIKELSLCANTANNYRLWSTKSKYPSKLQILSHKPRDIQEPIGLLRRIQDRLSDLLVRIETPEYLLSAKKGGSYVKNASLHMGFGQVIRIDIKGFYKNASEVFVFRFFWHDLQCSQDIARILTDLICWNGCLPTGSPVSPIISFFAYRPMFDELHALALAINAVMTVWIDDIVFSGDNVNGTLIPKAKIVIKKSGLQGHKISVFNRGQASVVTGVAITADGQLHIPNKRYRKIRALENEYCAASNQADRAIYGKALIGQYFEGSQLDPGLAKKAKVLQADMKCKNSNHPR

SEQ ID NO: 3001 - protein, 311 aa, unidentified
  source 1..311: note = Related to NZ_CP011129.1; note = Lysobacter antibioticus
MSKVLRKSYPAAQSPLFRLRSKARLAELLDETPRRVRELITDKNYCEWFTKAKYPDSTHPALVHKPRAIQQPLGALDMAQRRLNSLLSRIELPDYLHSARKGRSYRTNAAAHSSAGRAIKVDIRQFYRSINDSYIHAFFRDVMECSPDVTHILTELASFERYLPTGSSLSPIVSFFAYWPMFDKLNSVASSVGAQMTVYVDDVVISGPGVSGSLIPICKRIMKDHGLRGHKVAYYHSGKTRVVTGVAVSPRGLSIPNKRLMKIRALRQEMDAAVDPATKALYKQAVLGQLREGSPLDPSFRTYSQAIERMA

SEQ ID NO: 3002 - protein, 317 aa, unidentified
  source 1..317: note = Related to NZ_CP091716.1; note = Variovorax paradoxus
MSTAKGYQLDQSPLYKLESKRKLAKLLFWDLSRLQALANRTDNYRSKKTMHANKERSLEVPKPALENVQRRIYQLLDRIEKPDYLHSGRKQRSYITNAQVHAGAVWLIKLDIKKFYAAVSSARVYRFFQDVMRCSPDVASLLAKLCTARGHLAIGSRVSQLLAFFSAKPMFDELHARALEYSIKDTYYVDDLTWSGTRATAGFLWEVKKIVHRHGFEYHRARLYAPNNPKLVTGVQIIGDRIAVPPYRDRELWDAIRTLKKPSACTTLKVAETLLSKAAAYAQVEDRFQLQVRQLRALRASMKLTASTDHIDGPQGV

SEQ ID NO: 3003 - protein, 304 aa, unidentified
  source 1..304: note = Related to NZ_RXOE01000007.1; note = Variovorax gossypii
MPASRSYPINESPLYKIRSRRRLAAVLFSNLPKLEALANQTDNYRRFDVVYAGKKRSVELPKPALARLHRRIFQILNCIEKPDYLHSGCKQRSYITNARVHVGLVPLVKLDIKKFYASVSSAHVYRFFNSGLQCSPDVSGLLARLCTANGHLPIGSSASQLLAFFSAKPMFDELHRHSVRHEVRDSYYVDDLTWSGVNATPRFLWAAKQIVHRHGFRYHSDRVYTASQPKIVTGVLIAGDRIAVQPRRELELWNTINTLCMQDPAKRLETINSLIGKAVANAQIDERFLARVRQLRAYKIKMQL

SEQ ID NO: 3004 - protein, 313 aa, unidentified
  source 1..313: note = Related to NZ_KB905036.1; note = Variovorax paradoxus
MKSYALNQCPLFKMASRRKLASLLGFDAGVLQTLANRTTNYLCFDIAQGSKKRRVEVPKRALERVHRRLFALLERIEKPDYLHSGRKKRSYITNAQVHTGLAPLVKLDLKKFYPSVASSRIYRFFNEVLLCSCDVAAILTKLCTVDGHLPTGSCISQLLAFFAAKPMFDELHEYSFKLGNRDSCYVDDLTWSGSNATPAFLWAAKQIVHRHGFKYHKDLVYRADQQKVVTGVLISGGELTVQRSREHELWRSIHALGGQDPAKRLKAIDSLIGKVIANGQIENRFLLRVQGLRARRVMLMGSRAEVVSSLQRG

SEQ ID NO: 3005 - protein, 322 aa, unidentified
  source 1..322: note = Related to JAGPDY010000016.1; note = Rhodoferax sp.
MAIRKKSYAIHQCPLFKIASRKKLAALLGFDLSVLEGLSTATNNFRTFEIKQGIKLRKVEVPKRRLELVHRKVFSLLERIEKPEYLHSGIKGRSYITNAKVHVGPVPLVKLDLKKFYPSIDGARVYRFFQQALQCSPDVSGLLTKLCTIDGHVPTGSCVSQLLAYFSAKPMFDELHMLSSQWGLRDTCYVDDLTWSGERATPAFLWNAKKVVYRHGFKYHKDHVYTADEQKLVTGVMIDGDRIAVLPSRELKLWKDINALGMSEPVERLAAVNSLIGSVVANGQIEPRFLQRLRRLRDTRISLIRQLEVNFSRQPSLLPSDR

SEQ ID NO: 3006 - protein, 310 aa, unidentified
  source 1..310: note = Related to NZ_NIAZ01000004.1; note = Acidovorax sp.
MATRKTYALDQCPLYKIASRKRLAQDVFNVDLPFLERLAANEGNFRVFTIKQGDKDRQVEVPKVVLERIHRRLFNLLERIEKPDYLHSGVRGRSYISNAKVHVGAVPLVKLDLKKFYPSVDGARVSRFFTGTMRCSPDVAALLTRLCTFENHVPTGSCVSQLLAFFAAKPLFDELHALAESAGLRDSCYVDDLTWSGHGATPAFLWAAKQVVHRHGFAHHKDRCFAAGDRKLVTGVMLEGNRIAVLPSKEFDLWKNIQALGGFQPQERIVAVNSLIGSAVAAGQIESRFLRRLLRLRRVRAAAIAEAALT

SEQ ID NO: 3007 - protein, 315 aa, unidentified
  source 1..315: note = Related to JAHJNJ010000041.1; note = Gammaproteobacteria bacterium
MKSRKTYPIDQCPLYRLQSRKKLAKDVFNLELSHLESLAKNTSNYRIFKIPSGDKERQVEVPKPILERIHRRLFALLERIHKPPYLQSGVKGRSYITNAQLHVGLAPLVKLDVKKFYPSIDSARVYRFFNTILLCSPDVSGLLTKLTTCEGHVPTGSCVSQLLAFFAAKPMFDELDYLATKQSLRFSCYVDDMTFSGTLATPSLLWAAKQIVHSHGFGYHKDRCYTAEQDKLVTGVMVTSDRIAILPSREFELWRKTQDLGTGDIEQRIAAVNSLIGTVVAASQIEARLLSRLKRLKGIKAAFEQEASTSSPSQR

SEQ ID NO: 3008 - protein, 308 aa, Pseudomonas sp.
  source 1..308: note = Related to NZ_QJUP01000005.1; note = Pseudomonas kirkiae
MKVRKTYPLHQSPLYRMQSRKRLAAEIFNADIDLLERIAGHGDNFRVFHIIQGEKRRQVETPKPILERLHRRLFVLFERIEKPAYLQSGVKGRSYITNAQEHVGAVPLVKLDIKKFYPSVDAARVYRFFHEVMRCSPDVSGLLTKLCIYDSHVPTGSCVSQLLAYFATRPMFDELSALAESRGVKFTLYVDDMTFSGRSATPAFLWDVKKVVHSHGLQYHKDRIYAADSQKVVTGVLVSAQGIAVLPSKEFGIWLQSRNLGSGDLAERRAAIESLLGSVIAAGQIEKRLLSRVRGLRILHADALRSAG

SEQ ID NO: 3009 - protein, 335 aa, unidentified
  source 1..335: note = Related to NZ_LMDK01000001.1; note = Pelomonas sp.
MKRPYLSNQSPLYCLESRKRLAGEILGLSLPKLEGLAARANNYRECTRVTGGKQRTVHVPMPLLLAVHRRLAVLLNRIAVPHYLQSGQTHRSHLTNARAHETARNIAKLDIRHFYPSITKDRVWHLFVDGMLCSRDVASLLARLFTHQGSAPIGSPVSQVLAFHVVRPMLDELQELASRHRLRFTCYVDDLTFSGDGADHGFLALAGDVARRHGFLPHAEACYGPGEDKLVTGVMLTRDGLRVPAPQLRRIDAARQELLLAEGNESRRVLLSRLIGHLAAAASVDDSFRPELSSRCFAARKLAAALPARPSPSDSKVASVVPRLRPMRLSYGVGT

SEQ ID NO: 3010 - protein, 307 aa, unidentified
  source 1..307: note = Related to NZ_CP049919.1; note = Kinneretia sp.
MSYAFHQSPLYVMRSRRRLADEIFGISLTALEGLVENGNNYIESRRVTGGKERLVRAPKPLLRHIQERLAQLLNRIEAPDYLHSGRKQRSHISNALAHQGATRVLKLDIRKFYPSITRARVWNYFAGQMRCSPDVAALLAKICCFEGSAPIGSPVSQVLALQVVRPMLDEVDVLARAHGLTFTCYVDDLSFSGEKATPAFLWQIKQLIRRHGYRYHGGTAYGPDAERRVTGVLLTAQGPRVPPAHLQGIRAARHAFEAAKEASDREATLSVLIGRLAAAAAIEKRFLAQIGDLRRRRRRFRPPSFGG

SEQ ID NO: 3011 - protein, 317 aa, unidentified
  source 1..317: note = Related to JAFEEP010000236.1; note = Proteobacteria bacterium
MTDHPIHHSPLHGLRSSERLARRDVLGLSLERLSALAGDASSYRAFIRVTSGKKRAVTEPLGDLLAVHDRLYDLLDRIEKPDYLHSGVRGRSHVTNAGAHLGDKATVKLDIRQFYSSIDVPRVSRFFGRQMACSAPVTDLLTRLCTFRGHVPIGSRMSQHLAYFAARPMLEDLRRLSERQGVVFTCYVDDLSFSGTAATPSFLWQVKRLVHHHRFGYHNGCCYRAGESRIITGVVVTGEKLAVLREQAERIRQDVRDMDKLTVDDQRRALQRMIGRTAAAASIDLEYRKVMKQLVARRARLKSAPPSPCMVRPFDEV

SEQ ID NO: 3012 - protein, 337 aa, unidentified
  source 1..337: note = Related to NZ_CP024645.1; note = Rhizobacter gummiphilus
MAQSGNQTELEQSPLFGISDPRELAELVATPLPSLWRIARARDNYTALQMETGGKLRTVNRPCRALGAVQRRIQHLLSFIPLPDYLHSGVPGRSNLTNATVHRDGAWLCQIDLKAFFVQVTDAKVFHFFWQRMQCEPEIATLLTRLNTTNGHVPLGGHCSLQLAFLVAQPLLDDLDRTAREEDIRFSTYVDDLSFSGAKATPSFLWAVKQIIHRHGFRYHHDRCHRPGGRRLVTGVLLHKSCMEVRPQLVQRIWTDWSAMFTAPSDDASLRPLQGRLAVASQIEPRYREAHDSMKVMRKTLRDSPEPALAPASVSALANRKLVRARLSTSGSAHFDT

SEQ ID NO: 3013 - protein, 352 aa, unidentified
  source 1..352: note = Related to CP077683.1; note = Geomonas subterranea
MAQKNYDIKYDITQSPLYKLRSKKKLISLLNLGSLSDLKSIMRTDSPYRKFPIMSKGKLRPVEVPSRVLLPIHNRLFRLLKKIHLPSYLHSGVKGCSYLSNARAHRDRKEAYTLDIKKFYPSVTRAKVVTFFRETMKCEPDISAILANITTCDDHIPTGSSLSQVLAYLSCKEMFDALHDLSQEAGVTFTCYVDDLTFSGDRISKKWIYDRVKPMINKFGMRSHKDKHFRAGQVKEITGVIVDGCIVKVCNRMHQSIHKLTLQIAETEEPLLIDSLYDKLIGKLCAAGQIEERFKLQRVMATKTRRKLLGPKFGSSRIKLNNGNQEIRKKLTPILPSIWRPVDHLDESIPWD

SEQ ID NO: 3014 - protein, 300 aa, unidentified
  source 1..300: note = Related to CP018026.1; note = Alteromonas mediterranea
MVLKSRYALNQSPLFKLHSKKKLASLLRLDSKELLALAANPNNFHKFNVEKNGKLRSVQVPKKDLEAVHLRLFNLLRRLETPPYLHSGIKGCSHVTNALAHDGAVSTAKLDIKKYYPSTGREYVYNFFKISLCCSADVAKVLSDLSCVDGHIPTGSALSQLLAFFATQQMFDEIAVLASDSDICFTLYVDDLTFSGTRVNPNFIWQVKQIISKYGYTYHKVESAPPNKTKIVTGLALTANGAKVRNSHHEKIHELYVQYLDDTIATKDLARLIGMLSSASQVNQRMANKLRNLLESRASK

SEQ ID NO: 3015 - protein, 323 aa, Aeromonas hydrophila
  source 1..323: note = Related to NZ_NKXI01000009.1
MMKRVSKHKSYPLNQSALFKINSPTKLAKILLVSDMSVLFKLQNKGEENYYFGTTGSGRDIEVPLSQLRRIHNRINKLLSHISVPDYLNSGVKERSNIKNAAAHVNAKKLLKIDITKYYQSITEEQVRKCFRKTFQCSPDVSSLLASLCCVRGHLPTGSTISQSLSFAVNRPVFDSINIYSNSKGVKFTCYVDDLTFSGDDIPPSEFCDYIVGYIKKSRGYKCHKIRRYNSETDKPVTGVIISNGHLKVMNRHVKVINSLYKSMNKMTARFSSTDKELIHYFQVLQGHLFSAGQINPRYKRLGWHVVDIRKELSVPALNQNTM

SEQ ID NO: 3016 - protein, 321 aa, Aeromonas sp.
  source 1..321: note = Related to CP043321.1; note = Aeromonas jandaei
MMSRVNNKSYPLNQSPLFKINSPARLAKILLVSDASVLIKLKEKGEKNYYFGSTDKGREIEVPLSQLSRIHSRINKLLSNITPPDYLYSGVKKRSNVKNAAVHAGNKKLLKIDIAKYYQSISEEQVFRCFRKVFQCAPEVASLIASLCCVKGHLPTGSTISQSLSFAVNRPVFDNINIYSHSKGIKFTCYVDDLTFSGDEIPSGFCDYIVGYIKKNRGYKCHKIRRYNAETDKRVTGVIISDGKLKVMNRHVREINYLYKNVNSMLKKHAATDKELIHFFQRLQGHLFSAGQVNLRYRRLGASVVQIRKSSAVPALNQNTM

SEQ ID NO: 3017 - protein, 328 aa, unidentified
  source 1..328: note = Related to DMHG01000210.1; note = Alcanivorax sp.
MRYGWSLLANNNKGVKQYPVHQSPLFKLRSHSKLAAVLGTKPKTLKTVVRRADKNYKFGTTESGRAIEIPKSQILRYHNRINKLLCRISPPDYLMSGVKGRSYVDNAAKHRGERAVAKQDIQKFYQSTTRDIVYRGLRKRLHCSSDIAQTLADLCTVKGHIPTGSPISQSLAFFVNFGVFEHINQYASSRGLRFTLYVDDLTFSGQKIPKNFLRYISGYLEKNRGYKVHKNRTYHATTEKEVTGVILKQGGIDVKNRHRQKIDSMLRRLSYFSDESQESDAKTRDYFQRLIGHLYSAGQVSPGYRTRGKEMVEIRKAIGIEGQNQNNK

SEQ ID NO: 3018 - protein, 319 aa, Vibrio sp.
  source 1..319: note = Related to AAXMMD010000082.1; note = Vibrio cholerae
MKKNKSYKINQSPLYKLSSHKKLAACLGLDNEKTLSNILQHGDNNYYVSTLPSGRVIEVPKPQLNRIHRRLNKLLTRIEVPDYLNSGVKGRSNVKNAQDHIGELAVLKLDIQNFYQSVTQQQIARCFVKSFACPKDVAETLSKLCVIHGHIPTGSSISQSLAFIVNRPVFDHINIYSISKGIRFTCYVDDLTFSGQTIPKGFSSYITSYLKRNRSYKCHKMRVYKTLTPKLITGAVVVGKLLKVKNRHRNQIQKLLHSYDSMVKSYKPDDNKLINYFQTLQGHLYSAAQINPRYRQMGDIIVQRRCHLGVPALNQNTKK

SEQ ID NO: 3019 - protein, 319 aa, unidentified
  source 1..319: note = Related to NZ_CP074587.1; note = Pseudoalteromonas piscicida
MKKNKSYKIHQSPLYKLRSHKKLASCLGLEKEQTLRRLIKQGDKNYYVSKLPDGRVIEVPKPQLNRVHRRINKLLTRIEVPEYLNSGVKGRSNVKNAREHTGELSVLKLDIKKFYPSVTEQQIARCFVKSFGCTKDVAETLSKLCVVDGHLPTGSSISQSLSFTVNRPVFDHLNTYAKARKIKFTCYVDDLTFSGQAIPKEFCKYVTAYLKRSRGFKCHKIRVYKAITPKSITGAVVVGNVLKVKNCHRKRIQKLLHLYNYMVKRYKPDDENLINYFQRLQGHLYSAAQVNPRYRQMGDIIVQRRCNLGVPALNQNTKK

SEQ ID NO: 3020 - protein, 327 aa, unidentified
  source 1..327: note = Related to JAHKQO010000049.1; note = Paraglaciecola arctica
MEKQYHLNQSPLYKLRSFKRLAKILDCPQKSLEKLLLQPNNNYYTSHINQEKIIKGSKQIVQRKIQVPKPQLNRIHKKVQKFLSKIEKPGYLFSGVKRRSNVSNALYHVETDYMRKMDIQKYYEKTSAKYVYKCFVNTFRMAPDLAKVMTKLCTFNSHIPTGSSLSQNLAFFCNLHLFNQIESFCKKRKISFSLYVDDLTFSAKHKLTKDLTNRIVHIFNKNSDYVIHKFQVYNKETPKLVTGVILKNNIMLVPNKLRVKMLNHDKEKSIIIDNLSNDRDGAINFYQRFIGLVSCANQISPNYKLWTKELCEERKKYGIQAVTGKKD

SEQ ID NO: 3021 - protein, 323 aa, unidentified
  source 1..323: note = Related to NC_018632.1; note = Alteromonas macleodii
MELKKYDINQSPLYKLNNYKRLLKILDIKDKSLTKLLVAGDNNFYTSEIGGRKVQVPKPQLSRLHKRLQKLFSRIQTRPFLYSGVKGRSNVDNARVHEKSSHLLKVDIAKYYESTNFKRVLKCYINIFKVSPDLAEILARLSTYSGHVPTGSSISQSLTYFCNIKVFDQVMLYCKKRGVTFTLYVDDLTFSSRVPLGNGFLGGINLIFSKNTDYKLHKIRAYNPTTPKKVTGVILKGTSLDVPNDIRKRLNEFKMKHRRVVLNYVNNSTPSSYENAIAHFQKFIGLVSCASQISPYYKLWTDSLCNERRVNNIPAVNQNNPMP

SEQ ID NO: 3022 - protein, 313 aa, unidentified
  source 1..313: note = Related to NZ_CAJHOA010000005.1; note = Denitrificimonas caeni
MIKSYNLNQSPLYRINSHKKLSSVLGVKSSSVLTKIVSKSDNNYYLSKVDDRDIQVPLNQLRRIHKRIDSLLRRIEQPDYLYSGVKGRSNVLNARVHDNNYNVLKLDIKSYYQSVSKDQVARCFISVFKCSQDVAKTLSEICTYNNHIPTGSPVSLSLSMAVNRPVFDHIHKHSHSRNIRFSCYVDDLSFSGKVIPLSFRDYIVYYLKKSRGYECHKIRSYNPSTPKKITGVVLTKNGLKVMNRHRSTISSLLNDRKRILKNNKKDDELTINFYQKLIGHLFSAGQINGRYKQLGRILVNERKLYSIPACNKK

SEQ ID NO: 3023 - protein, 312 aa, unidentified
  source 1..312: note = Rhodospirillaceae bacterium; note = Related to VXNK01000080.1
MPYEIENSPLFKITSIHRLSEVLQLRVGRLRRLEYLTGQFKEGTTERNGKQRKTETPIRTMCRVHNRVQKLLSRIQMPNYLHSGKRKRSYLSNAVAHSGLIQSFQVDIAKFYPSCTWHHVYLCFIRQFQCSSDIAGIMATILTYRGHIPTGSPTSSLLAFLSHKEMFDALYELAQSHNLTMTVYQDDISFSGSSISESFRSEVRCIIKRCNLVPKRSKQRYCHGGRSPNITGVVLTSRGPKAPRSRHLALRQSIDEFDAAESEIDLRISYHRMMGRLSEIERVQGRLFDLKPKLKSRFRSRLKAMSQCPQVE

SEQ ID NO: 3024 - protein, 351 aa, Pseudomonas sp.
  source 1..351: note = Related to JAKMVT010000021.1; note = Pseudomonas syringae
MKQKRKKSVKRERKSYDICQSALYNTSTKSKLASLFSIGLHELRECIGDYRQFQLIPEPDPFKAGKLPKARQVQKPSARLLVIHEQILKLLRCVRVPEYMQFALKGTSYKINAESHLSKNTVATLDIRNFFGSTSKSKVFNFFKEDLKAPGDVANLYADLITFENCLPTGSPLSPLISFYANKNLYEDINNLAKAHNLKFTCYVDDLTFSGDKISSGFMWQIEEAIAKYGHVVARDKTKIYKNGRPAHITGVIVHDGVIRVPNARHRKMRLIKAAIARGKGTHGFSKKELEYKLGGLLGEAAYLDPSHLPAAIEFNKSVQRYSLVATEYKSNRPETGSEQPLDSPVNLPWD

SEQ ID NO: 3025 - protein, 351 aa, Pseudomonas sp.
  source 1..351: note = Related to NZ_CP056030.1
MRQKREKVVKRERKSYEICQSALYNTSTKSKLASLFSIGIQELKECIGDYRQFQLKSEPDPFKAGKPPKVRQVQKPSPRLLVIHERILKLLRCVRVPEYMQFALKGTSYKINAEAHLGKNSVATLDIRNFFGSTSKSKVFNFFKEALKAPGDVANLYADLITFDNCLPTGSPLSPLISFYANKSLFDDIDNIAKAHNLVFTCYVDDLTFSGDKISDGFMWQIEQTIAAHGHVVASDKTKVFKNGRPAHITGVIVHDGLIRVPNARHRKMRLIKAAITSGKGTHGLSKKELEYKLGGLLGEAAYLDPSLLPAAIEFNKSFQKSNTKTIEHKADHTNKNDKQSPDSPIDVPWE

SEQ ID NO: 3026 - protein, 350 aa, Pseudomonas sp.
  source 1..350: note = Related to FNSP01000003.1; note = Pseudomonas marginalis
MRQKREKAVRRERKSYDISQSALYNTSTKLKLASLFSVEIGALKDCIGDYRQFELIPEPDPFKAGKPPKSRLVQKPAPRLLAIHERILKLLRCVRVPEYMQFALKGTSYKRNAEEHLHKKCVATLDIRNFFGSTSKSKVFNLFNNDLKAPGDVANMYADLVTVDNCLPTGSPLSPLMSFYANKNLFDDLSKLAHAHNLTFTCYVDDLTFSGEKISESFLWQVERAIAAYGHIVASNKTKLFQNGKPAHITGVVVHSGAIRVPNARYRKIRLIKAAIATGKNNYGLTRKELEYKLGGLLGEAAYLDPSNLPAAIEFNKSFKRSSSPLPEHVPDNPAATEKTFDDASDLPWN

SEQ ID NO: 3027 - protein, 371 aa, Pseudomonas sp.
  source 1..371: note = Related to JAEKFB010000009.1
MKLRREKKPKKERKSYDISQSALYNTSSKAKLAAIFSTDIQEVIRCIGDYRRFELIPELDPFKLGKPPKVRQVQKPAPKLLAIHERILRLLRCVQVPKYMQFALKGTSYKNNAEMHLLGRCVATLDIRNFFGSTSKSKVFNFFNGPLKAPGDVASLYADLTTFDDCLPTGSPLSPLLSFYANKALFDDLNIIATEHGLTFTCYVDDLTFSGESISRRYLWQIENTIRQYGHVVASRKTRLFKDGIPKHITGVVVHEGSIRVPNVRYRKMRLIKEAIHGSGKNHGLTRKELEYKLGGLLGEAAYLDPSNLPAAIEFGKTSHKNFLKTITSVQEYLEPPKPNATDEKFHPPWHEQELITMLLPEHANDGNEAD

SEQ ID NO: 3028 - protein, 351 aa, Pseudomonas sp.
  source 1..351: note = Related to NZ_UWFM01000116.1; note = Pseudomonas viridiflava
MTLKRERKTKKERKSYDLSQSALYLTRNKSRMAAILATTTQNLTDCIGDYRRFETVPENDPFKLGNQPKPRQVQKPAAKLMAIHERILKLLRCVKVPEYMQFALKGTSYKKNAEAHISGKYVATLDIRNFFGSTSQSKVFNFFNGPLRSPGDIANIYAQLTTIDNCLPTGSPLSPLLSFYANKKLFDDLNDIAKEHELTFTCYVDDLTFSGECISNRFLWRVEERIRKSGHIIAANKTRIFSETMPKHITGVVIQDGGIRLPYVRQRKIRLIKDAISGKAKNHGFTKKELEYKLGGLLGEAAYLDPRNLPAAIEFSKSVRMNSFKFFKLFDYVELPKPAAPDENFIPPWQE

SEQ ID NO: 3029 - protein, 353 aa, Pseudomonas sp.
  source 1..353: note = Related to JAAQYG010000033.1; note = Pseudomonas lundensis
MRLKRVKKTKQEKKSYELSQSALYKTSSKCKLSAIFSLSAPDILNSIGDYKRFEMSPVLDPFKIGTPPKTRWVQKPKGKLLAIHERILKLLRCVEVPEYMQFALKGTSYKKNAEAHLAGSMVATLDISNFFGSTTKSQVFNFFRDRLKCAGDIAKIYAELVTCDDCIPTGSPLSPLLSYYSNKPLFDELSCLAKNANLHFTCYVDDLTFSGAYIGRGFLWQVEKTIKKYGHITASKKTRLFGLGVPKHITGTVIADGALKVPNVRFRKIRLIKLAIEGRISKFGFSDVQLKYKLGGLLGEAAYLDNDFKSLADEYNRKIRELNLASLEGGETYRSSTKPLELADDNFIPPWEI

SEQ ID NO: 3030 - protein, 359 aa, Pseudomonas sp.
  source 1..359: note = Related to NZ_JACVZE010000010.1; note = Pseudomonas pisciculturae
MKPKRVKKAKQEKKSYEISQSALYKTTSRSKLAAILSLSIHDLLCSIGDYKRFEMTPKPDPFKIGKPSKTRWVQKPKGKLLAIHERILKLLRCVKVPEYMQSALKGTSYKRNAEQHLSGCMVATLDISNFFRSTKKSHVFNFFRDRLECPGDIANFYAELVTCDDCIPTGSPLSPLLSFYSNKPLFDELSVLAKNSNLQFTCYVDDLTFSGSHITHDFLWEVQKIVKKHGHVTATKKTRLFGAEVPKHITGTVVAEGVLRVPNARFRKIRLIKLALEGKRDSFGLTKTQMEYKLSGLLGEAAYLDNDFKSLADRYNTTIREINLASLGDGKYRPSLKATDLIDDKFIPPWETEQSSSKS

SEQ ID NO: 3031 - protein, 359 aa, Pseudomonas sp.
  source 1..359: note = Related to NZ_LUUE01000002.1; note = Pseudomonas protegens
MKQKPVESHIKNYKSYALNQCAMFNTSSRTRLAAILLKPLHLIMESIGSYSKFKKDPKPDPFSHKKPRRPRSVQKPKGELLHIHNRMLRLLKRVVVPDYMQAALAGTSYRKNAAMHVGGPCVATLDIRNFFVATNKSKVFNFFETDLRCTGDIASIYSELVTCNDSLPTGSPLSPLMSFYANKRLFDELDVLARNNGFIFTCYIDDLTFSGNNISGSFLWDVERIVHCYGHEVTAGKTRLFKAGRPKHVTGVVLFDNEVSVPNSRYKKLRNINAALEGRASMHDFSEVELLNMKAGVLGEIAYLDPKKGFLARRAIDELKLRDLKILGDGKLKISTSPPAYLSPGEVPPWQPLPLATPD

SEQ ID NO: 3032 - protein, 333 aa, unidentified
  source 1..333: note = Related to CP008911.1; note = Burkholderia pseudomallei
MPGNASAKLLARRSRSKRYDIDQSHLFRVGSPARLSMVLGVSLDKLLALSRRTDNYKLFQKEDVDPFARHHRRRRDIQEPKAALKKIHERVAKLLKFVRVPTYLHSAIKGVSYRTNALEHAERGVSILTMDIADFYPSTGASRVFNFFRDVLECAPDVSKLMAKLLTWRGVLATGSPASPLLSFHCNRPMFDEMAAVAVKSEFTFTCYVDDVTFSGVNVRRGLVSEIACIARRHGHRIKEHKTRFYSAGQAGIVTGVVVEDGSVSVPHERRLKGRRIETAIDGATDPVERLALTEKLMGLAGEAAYLDKAFRPWVDSIRGKLKVLRRSYASRR

SEQ ID NO: 3033 - protein, 330 aa, unidentified
  source 1..330: note = Related to NZ_LOVC01000028.1; note = Burkholderia ubonensis
MPESTPKKVVRRRDGSDRYEIDQCALYKTGSLRRLAKILLIEKSDLIALSNRRDLYSVYDLEDDDEFSDKRGKVRKIQDPVEELKKIQRRVAKLLHYVRVPRYLHSAVKGVSYRSNVKAHAHAGSNILTMDVASFYSSTRESQVFRFFRETLLCAPDVARMLTRLLTWHGVLPTGGPASPLLSFHCNREMFDEIAREAERAGVVFTCYVDDITFSGTNVKRGFASLIDRIVRRSGYRIAAQKTRFYRPNQAALVTGAVIQDGKVSVPHARRRKARRIEIAARSTKDPARRLALTEKLMGLAGEAAYIDPAYRGWAYAVRGRLVALRKSAA

SEQ ID NO: 3034 - protein, 337 aa, unidentified
  source 1..337: note = Related to NQMK01000010.1; note = Pusillimonas sp.
MAKRGLYDINQCALYKLGSKARLAQILGVPKARLLILVRRSENYRVFTLPQEICEFTGKVRKERLVQEPKPELRRVHERIQRLLSRIRPPEYGHAAVKGRSYRTNAEAHLNGPRIATFDVRRFYPSTSRSAVRNFFSEQLCCAPDVADLLAQLCCWQNVKESNSSSGLPTGSPLSPILSLYANRPMFDVLNDYAGRHQLVFTCYVDDLTFSGEMLPAGISKFVEKIVTAGGHTLATEKTRLFRRNQVKHVTGVVLSNSQVKVPHARFLKARAIASAITAHETADARYRLLLQRKLAGLLGEAAFLDSRFAGWANRAYADLRAVQAEVHMAESLHVES

SEQ ID NO: 3035 - protein, 336 aa, Achromobacter sp.
  source 1..336: note = Related to CADIJU010000003.1; note = Achromobacter marplatensis
MAKRELYDINQCALYRLGSKTRLSILIGVPKSKLLALVNSLENYRVFPLPQEVCQFTGKVRKERLVQEPKPELRRVHERIHKLLSRVRPPEYGHAAVRGRSYRSNAEAHINGRRVATFDVRRFYPSTSLSAVRNFFADQLCCAPDVADILARLCCYRNVKEASSLLGLPTGSPLSPLLSLYANKPLFDALYHYAGRHKLVFTCYVDDLTFSGALLPRGLSQFVTKMVESCGHTLAQEKTRFFRSNQVKHVTGIVISDNEIKVPHARFLKARAIASAIAKHAPADVQQRLLLQRKLAGLLGEAAFLDGRYAGWANRSYVDLRAIQEEARAAELHSPE

SEQ ID NO: 3036 - protein, 347 aa, Achromobacter sp.
  source 1..347: note = Related to CADIKQ010000001.1; note = Achromobacter mucicolens
MATRGFYSIDQCALFKLGSKTRLAELLHVPKSHLTKLAAGSDNYRLFELPREVCEFTGKVTKARWVQEPKNDLRQVHERLQKLLARIRPPEYGHAAVKGRSYRTNAAAHVHAAVAATFDIRRFYPSTPRLAVRDFFLHTLRCASDVAELLTTLCCYQDRTEEGAQCGLPTGSPLSPILSLYANRAMFDRLHRFALQHELTFTCYVDDLTFSGPLLPRSLGRFVRKTVDAYGHSLAVEKTKVFRRGQAKHVTGVVIVNNKIKVPNARFKKARAIAAVIQRTASDDYMRLLALQRKLSGLLGEAAFLDPAFSDWARRSYRDLKKINEEAATSTSGVGAAKEGTGAVAFL

SEQ ID NO: 3037 - protein, 340 aa, Alcaligenes faecalis
  source 1..340: note = Related to MSZO01000007.1
MLFMKKQKSYSIDQCVLYKVGSKKRLADILNIPLSSLLKLAKSKNNYRVFELPFEQCEFTGKTKNARVVQEPKKLLKAVHARLQKLISRIEAPKYGHAAIKGRSYRSNASEHISSVYLATLDVRKFYPSTRQSLVRNFFADQLRCAPDVADILTKLCCFFGASKTGGSVGLPTGSPLSPILSLYANKPMFDKLQGYSNDNSLIFTCYVDDITFSGEALPKDIVRKVGEIVYSYGHTIAVEKTKIFREKDTKHVTGVAIKNNRISVPHSRFKKARAIERIISNTPQEELAKKRTLQRKLAGLLGEAGFLDSRYKPWASRSYVDLKKLEYDFNQQSRQVDFK

SEQ ID NO: 3038 - protein, 334 aa, unidentified
  source 1..334: note = Related to CP062062.1; note = Janthinobacterium sp.
MTNPPLRLVTKTPKKFYPINQSALYKIGSKKRLAKILATSLERILLLSTATDNYKIFCLPEEVCEFTKKTKKSRWVQEPKRPLRSIHERIQKLLKSIIYPDYSHAAVKGRSYRTNAETHKDATRVATFDLRKFYPSTSSSRVRDFWAEQMLCAPDVADLLAKLTCHEGCLPTGSPLSPLLSLYANRPMFDDLNELANSHNLKFTCYIDDLTFSGPIIPIGLPRLVSNIVHRSGHTLSVEKTKIFRSDQRKHVTGVVVYGNSLHVPYSRFFKARAIQNAFDLEKNSIAKLALARKLSGLLGEAAYLDTRYADLAKKSYVELKRINEEIMRDKLPF

SEQ ID NO: 3039 - protein, 319 aa, unidentified
  source 1..319: note = Related to nan
YTIDQCALYRLGSKARLSAVLGITLDWLLQLAESEKNYCLFNLPEEVCPFTRRVKKARAVQAPKNGLRTVHERILHLLRPIILPTYAHAGIKGKSYRSNAAAHKDSPRLAAFDIRKFYPSTTASRVYYFFADKMLCSPDVARLLTALTCYKNGLPTGSPLSPLLSLHANMPMFDSLEALALSNDLVFTCYVDDLTFSGEKLPIGLPRLVKGIVEKYGHKVSEEKTRLYRRRQGKHVTGTVLLDGRILVPNTRFHKARAISAALASERDPALRLELGRKLSGLLGEAAFIDDRYAKWASDSYISLRKLQADFACEEASLD

SEQ ID NO: 3040 - protein, 334 aa, unidentified
  source 1..334: note = Related to JACQDW010000206.1; note = Burkholderiales bacterium
MQKSLPNPPPTKKIKRTYSIDQSALYKIASMKRLASLIGLPRGKLLRIAGGAHKYKTFVLPEEKCPFTGKVRKSRKVEEPINELRYIHERIHALLCKVDHPEYAHGAVKGRSYRSNALAHVESQSLATFDMREFYPSTSESRVYTFWVEQMCCAPDLANVLAKLICYKGRLATGSPVSPLVSLYANKPMFDELSRIALSRNLKFTCYIDDITFSGQNLPRNFEQWIASIVGRYGHALSEKKTRFFRSEQAKHITGAIIKDGLVTAPHSRFQKMRLIGSALRQVKDFNLRKSLLRRQAGLIAEIAYLDKSFSAMAESANQQFRDLRVKAATDIVD

SEQ ID NO: 3041 - protein, 348 aa, unidentified
  source 1..348: note = Related to RDZZ01000077.1; note = Polaromonas sp.
MPRGLYEVTQCALYKINSKARLAGLLHVSVPVMLGMASSRKYQEFTLKEKVCPFGGKSRKARMVQTPTEALRPLHDRIHDLLRRCAPPNYAHAAVKGRSYRTNAEAHKGSCVAATFDLESFYSSTSETTVFRFFVDQMKCAPDIASLLARLICVERDDSYPCLPTGSPLSPLISVYANKPMFDKFAHLAETHALSFTCYVDDLTFSGLAMPKGLERMVTSVAKRYGHTLATHKTMTFGPSSAKHITGVVIFNGKITVPNARFRKARKIQAAINAENDPIKKISLMQKLSGLLGEAAYLDNRYSNLAKKAQHSMSEFRLNSPAITMSAIPVTQEDASKAGFVLTNDVPF

SEQ ID NO: 3042 - protein, 340 aa, unidentified
  source 1..340: note = Related to NZ_JQKD01000066.1; note = Xenophilus azovorans
MAGYALNQCALFKVGSKAKLASVLLLKQRDLVDLSEDGQYRQFRLEASVCEFTGKRTKARDVAEPKKALKRVHQRIGDLLSRVLLVEYAHAAVKGRSYRTNAAAHQHGDEIATFDIENFYPSTTHAHVYHFFFREMKCAADVAHLLARLLCFRATPEALGCLPTGSPASPIMSVYANKPLFDALHRLAQELGLVFTCYVDDLTFSGPQIPPSLGRRVDSIVAAHAQRLHASKSRVFRKGKPKHVTGVVIADGKLAVPDARFFKARRVEQRLVAETDPGERARLSRILCGLLGEAAYLDNKYANWAKDSYRKLAAETRLAVVTAAGTIAFAATRADPPTGA

SEQ ID NO: 3043 - protein, 370 aa, Achromobacter sp.
  source 1..370: note = Related to CADIJW010000048.1; note = Achromobacter dolens
MSENQKPPAPAKPRKTYALNQCALYKVGSKKRLEKILGVNVADLIRLSADEGNFQVFELEAEVCEFTGKTRKARWVQNPVPELKAILARITKLLSRVRVPDYCHGATPGRSYRSNAQAHVGAQSVATFDLKDFFPTTTSKQVFQFFSKDLECAPDVAGLLTDLCTHGHVLPTGAPTSPILAYWANRRLFETIDRRGKVLRLKLSVYVDDITLSGDAIPRSLADQIEGIVKSHGHKLSGHKTKIFGPSRPKHVTGVVITGQSLRVPHARFHKARAIRIALYAEKDSRKRVLLAAKLCGLLGEAAFLDPAYKRMASDSVKLLAAAKAQVAPRLSRSIGGPRRKRGRSNPRTVATMGGVQLREQLDLSDAPTN

SEQ ID NO: 3044 - protein, 327 aa, unidentified
  source 1..327: note = Burkholderiales bacterium; note = Related to JAECRL010000003.1
MAAKRLKSYPLDQCALYKVGSKKRLAKILDVDLPKLVRLSADQGNFQVFEIPEEVCEFTGAKKKARWVQNPVPDLKAILKRIAGLLSRVQVPDYCHGAMKGRSYRSNAAVHVEEESAATFDLKDFFPSTTSAQVFAFFRHTLQCAPDVAGLLTDLCTYGKILPTGAPSSPILAYWANRKLFDVLEGRGRDLSLKLSVYVDDVTFSGDAIPRSLPEQVDGIVSKHGQKLSAHKTRIFGPGKPKHITGVVVAGGRLGVPHARFRKARAIRAALAAAKDDEQRELLASKLCGLLGEAAFLDPRYRRWAEDSARQLAAIKAARLSAKRAVK

SEQ ID NO: 3045 - protein, 333 aa, unidentified
  source 1..333: note = Related to nan
MKNKRPPKSKDKKYEINQCALFKVTTKKRLASILGVDTGTLSRLSIDERNYNVFEIAEEKCEFTGKIVKARLVQNPVPELKDIHRRIHDLLSRVVAPDYCFGGAKGRSYRSNAAAHTDSVAAATFDLKSFFPSTKSAQIFGFFKDKLLCAPDVAGILTDLCTYKGALATGSPASPQLAFWANLPLFEVLETIAHRYNLILSVYVDDITMSGPRVPAQLQHQVNEVVQKYGHKLSPGKTKIFRRGNPKHITGVVVHNGFLRVPNSRMKKARAISEALTRTSATDLTQREHLASKLSGLLGEAAHIDSRYRPWAQRSYRDLRFLQRLANVPPIAF

SEQ ID NO: 3046 - protein, 368 aa, unidentified
  source 1..368: note = Related to NZ_JABBFW010000053.1; note = Azohydromonas caseinilytica
MKEEFKSKKKRKLYSLDQCALFKIGSKKRLAAILRVSQDRLEPLGVDKGNYFVFTLKEQICPFTGKVKGARRVQNPLPELKLVQRRILSLLARVEMPEFCHGAKQGSSYRSNAKAHVDAKNVATFDLKSFFPSTSASRVFSFFRNTLQCAPDVARILTKLCVCHGALATGSPVSPILAYWANCELFRVLNRLAEENHLLMTVYIDDFTISGDVLPRNIVWQVKSIVEKYGHSLSLSKTKIFRENEAKHVTGLVIYEGNLTVPHIRFKKARAIEKAIAVASNDEERLDLMRKMGGLLGEAAYVDKRYKSWAFKIYSKISQAQSVLRRKEASASEKRKFEEACVPDVMPDKASWSDISPKAQDNSSSMKS

SEQ ID NO: 3047 - protein, 329 aa, Pseudomonas sp.
  source 1..329: note = Related to NZ_MLEM01000008.1; note = Pseudomonas syringae
MQPKKNTRKKRKPDNQLPIHQCFLYKIGSPKRLADLLNVSAAELEDTLRSENNYKLFNKLLSPNPFTGKLRKKRAVQEPKSRLRKMHERILALLRRVQYPSYVQGGVKHRSYQTNAATHLGARQTATFDLKNFYGSTRYCLVHDFFHKSLCCPTDIAGRLASLTTWNGVMPTGSPLSPLLSFWAAKGFFDKCETLAAKYRLNFTCYIDDLTFSGDKISGKFQSELEIIASRFGYELAKEKTKVFRFGIPAHITGVISHKAKLSVPHSRLKGARKIQDAIEGRGEAYGFTTAQLKQKLAGTINEAATIDAVKYEKWATHTRKAAEDNEKE

SEQ ID NO: 3048 - protein, 329 aa, Pseudomonas fluorescens
  source 1..329: note = Related to JAEKIK010000020.1
MQPKKNIRKKRKPDNELPIHQCALYKVGSPKRLADLLNISTIELEVILQSESNYKLFNKVLAPNPFTGKSRKNRAVQEPKSRLRKLHERILSILRRVQYPGYVQGGVKHRSYQTNAAIHLGARQTATFDLKNFYGSTRYCLVHDFFHNTMCCPTDIAGRLASLTTWNGVMPTGSPLSPLLSLWAAKGLFDKCEVLAIKYGLNFTCYIDDLTFSGDQISGKFQSELKIIASRFGYELAKEKTKIFRFGVPAHITGVISHKAKLSVPHARLKGARKIQDAIDGKGKAYGFTEAQLKQKLAGTINEAATIDAVKYEKWAIYSRKDAGDELSQ

SEQ ID NO: 3049 - protein, 328 aa, Pseudomonas sp.
  source 1..328: note = Related to NZ_CP018420.1; note = Pseudomonas veronii
MQLKKSTRKKRKPDNELPIHQCGLYKVGSPRRLAELLKISEIELKKFLESQNNYKIFTKVLAPNPFTGKFRKKRAVQEPKYRLRKLHERILCMLRRVQYPDYVQGGVKHRSYQTNAAIHLGARQTATFDLKDFYGSTRYCLVHDFFLDVMCCPTDIAGRLVSLTTWNGVMPTGSPLSPLLSFWAAKGLFDKCEELAVKYGLNFTCYIDDLTFSGDQISGGFQAELKILASRFGYEIAKEKTKIFRFGVPAHITGVISHKATLSVPHSRLKGVRKIQDAIDGRGAAYGFTAVQLKQKLAGAISEAASIDAVKYEKWAFYSRKDIEGDLV

SEQ ID NO: 3050 - protein, 331 aa, Pseudomonas sp.
  source 1..331: note = Related to CP004061.1; note = Pseudomonas aeruginosa
MQPKKSEKPKRKPDNEIAINQCRLYKVGSFRKLSDILKTSPAEIMDLLVSDKNYKKFTVSQSANPFTGKPRKQREVQEPKSKLRRVHNRVLALLRRVGYPDYVQGAVRYRSYQTNAALHIGSRQTATFDISDFYGSTKRHLVHSFFHDVMKCPTDIAGKLARLTTCDGVIPTGSPLSPLLSFWVAKGLFDECAAVAKEYGMKFSCYIDDLTFSGDRIPRELKSRLKIICRRYRYRLKSEKTKVFRFGEPAHITGVIKMDAVLSVPFARLMAVRKLMDAIEGRGDSYGYTVEELKRKLAGTVSEAASIDGQFKKWALHAKQDAKSSSRPSAS

SEQ ID NO: 3051 - protein, 325 aa, Pseudomonas sp.
  source 1..325: note = Related to LN831024.1; note = Pseudomonas aeruginosa
MQPGKSKRVERKPDNSLELDQCRLYKIGSEKRLAEILGLSLQDLRLLLRSESNYKKFTISQSENPFTKKPRKKRAVQVPMNRLRRVHAKIFSFLRRVKYPDYVQGAVKGRSYQTNAAFHARSRQTATFDISKFYESTKYHLVHEFFLGALKCPTDIAGKLARLVTCDGVMPTGSLLSPLLSFWVAKGMFDECAALAETYDLKFTCYIDDLTFSGDRIPRELKSKLKIIVSRYGYKLAIEKTKVFRFGAPAHITGVVKLNGELVVPFARLMAARRISDALDGKSPDYGYTKNELKRKLAGTIAEAATIDGNRFSKWAAFAQKEARD

SEQ ID NO: 3052 - protein, 334 aa, Pseudomonas fluorescens
  source 1..334: note = Related to CP031450.1
MRIEMQPKKNEKTKRKPDNQIPINQCRLYKVTSPKRLAEILNLDMTGLLELLNCSTNYRFFDIPLSINPFTGKSRKKRSVQEPKQKLRRVHKRILLLLRRMSYPNYVQGAVKHRSYQTNAEVHKESRETATFDIRDFYGSTKYHLVHDFFLRVMGCPTDIAGKLANLTTCNGAMPTGSPLSPLLSFWIAKKMFDECHALAESHKLKFTCYVDDLTFSGNHIPRILKSKIKIIASRYGYSIANHKSRHFRFGQPAHITGVISLDKKLHVPFSRLMAVRKVTDAIDGNSDTFGFTKTELKKKLAGMVSEAATIDNRFGKWAIYTQNEVSDSSTPSD

SEQ ID NO: 3053 - protein, 323 aa, Pseudomonas sp.
  source 1..323: note = Related to JAIZEG010000001.1; note = Pseudomonas aeruginosa
MQQKKKEKNECKTAKSYPIDQCSLYKVGSAKRLAAVLGIELDKLKKLLLSDFNYKVFDIAGSVDPFSGKIFKTRHVQEPKDDLRAVHSRILRLLQNVSIPPYVHGAIKGRSYQTNAAAHVKGKQAATFDIHNFYGSTKSNLVHDLFHDVLACPSDVAGKLARLVTYKGMMPTGSPLSPLLSYWVAKPMFDEYACLARQYGLEFTCYIDDLTFSGDRIPRDLRYRVGIIARRYGYRISKKKTRLFVQGKVKHITGVAVAESGLMVPFSRLKAARKIMGAIEGSGESHGLSSEKLRQKLAGLIGEAATIEQRFGKWARKARTACS

SEQ ID NO: 3054 - protein, 333 aa, unidentified
  source 1..333: note = Related to NZ_BDMN01000231.1
MQRKPTKRKRKLFKRYPVNQCALYKVGSIKKICQLIGIKKSNLNSILKNPLQYREFVNKESFDHFSLKTSKTRQIQEPTGNLKKIHERILYLLEPVELPNYSHAAVKKRSYRSNAASHVLSKKIATFDLENFYGSTKNHLVYNFFLDKLKLPHDIAKKLTKITTFNNSMPTGSPLSPLLSLHAAKPMFDELESLAQKYNLIFTCYIDDLTFSGSTIPKSLNRQIVHIINRYGYNLSNHKTRIFNESEVKHVTGIIINKERLRAPYSRFMTARRIKKAIDGKAPMHNFSKIKLLEKRAGLLGETAYLDPTYKRAAKNAQIELKNARNQIKKSTL

SEQ ID NO: 3055 - protein, 326 aa, unidentified
  source 1..326: note = Related to NZ_BLYC01000085.1
MLRKPTKRKLKYLKHYPINQCALYKIGSIKKICDIIGIEKNELNLILKSPPKYRQFVNKESFNHFSLKKSKERQVQEPVGDLRKIHERILDLLKPVEPPDYSHAAVKKRSYRTNAAAHVLSKRIATFDLKNFYGSTKNHLVYNFFLDQLKLPHDIATKLTKLTTFHNSMPTGSPLSPLLSLHAAKPMFDELESLAQGYNLIFTCYIDDLTFSGSTIPKSLSKQIVHIIKRYGYNLSNHKTRIFNESEVKHVTGIIINEERLRAPYSRFMTARRIKLAIDGKASTHNYSKIKLLEKRAGLLGETAYLDPTYKGLAQKAQLDLKTARG

SEQ ID NO: 3056 - protein, 346 aa, unidentified
  source 1..346: note = Related to JADMKV010000009.1; note = Methylobacter sp.
MLKKPTKRKRKCLKRYSIDQCSLYKVRSAKRLSEILGVEKQRLDSILKSSAKYREFTIEETTNPFSSKFIKSRQVQAPSDELRRIHERILYLLEPIELPNYAHAAVKGRSYRSNAATHVNSARMATFDLKNFYGSTQRYLVYSFFLDNLKCSPDIAGKLTELTTFRNALPTGSPLSPLLSLHAAKPMLDELSKLAQLHDLIFTCYIDDLTFSGKKIPRSLERRVSRIVGKYNHQLSIHKTKIFDEDKPKHVTGVVINKGKLAVPHSRFLTARKLELAIAGKFPMHGNSMLKLCEKLAGLLGETACIDPTYKKWAEKAQEDLRKARTKDSSIVGPDSTDFGSCQQID

SEQ ID NO: 3057 - protein, 360 aa, Pseudomonas sp.
  source 1..360: note = Related to QUZU01000011.1; note = Pseudomonas kairouanensis
MWPKGLSQYLNGIKTEMRPQQSSAKKRRSFKLYTINQSALYKITSPKKLSNALNRSELEIDVLLGSDENYREFTLLEELNPFSHKRKKARLVQTPNKDLRSVHERILKLLQRIEYPEYAHAGVKKRSYRSNAQAHQKSKEVATFDLSNYYGSVKAHHVYDFYLKQLQCVRDVSGILTRLSTHRNCIPTGSPLSPLLALHSSRTMFDSLDCLAKRYGLVFTCYVDDLTFSGDAIPPSLEREVVSIVRRNGHSINKKKTRIFRAHQAKHVTGTVIINGNITVPHARLVTVRRLEDAINGKMDSFGFSETKLMEKLAGVLNEASYLDSKFRSKALAARSNLSSPSPSPSPSPSPAPQVADASI

SEQ ID NO: 3058 - protein, 333 aa, Pseudomonas sp.
  source 1..333: note = Related to JAJHPU010000021.1
MNGIKAEMRQPKTSAGSRRTSKLYPINQCALYKLTSPKKLCEALKIEKSLLSDVLESDENYREFTLLEEVDPFSRKIKKKRLVQTPNKKLRNIHERILQLLQRIEYPDYSHAGVKKRSYRSNALVHVNSKTIATFDLKGFYGAVKSYHVNTFFSEQLNCVGDVAGILTKLTTFRNCVPTGSPLSALLALFTSKPMFDDLDALAKKHKLKFTCYVDDLTFSGDSIPSSLERDVSSIVRKHGHSLSINKTKIYRENQPKHVTGTVILNNRIHVPHTRLLAARRLQSAINGEIESFGFTEEKLIQKLAGMLNEASYLDVRFKYKALTAKAMLKSAK

SEQ ID NO: 3059 - protein, 335 aa, unidentified
  source 1..335: note = Related to SCRP01000034.1; note = Paraburkholderia sp.
MCAQKTKVGAVRASHQRYPISQCCLYKIGSRSRLADLLYIEKVDLVTLPGERSYKVFTLPEKRDEFSGKIKKKRIVQDPKRPLRRVHDRILYLLNKIELPEYVHAAVKGRSYRSNAAAHTTAAHEVLTLDIKSFYPSVSYLLVREFFRYKMKCASDVATTLADLCTYKGALPTGSPLSPLLSYFACGDMFDELNRLAVECGLKFTCYVDDLTFSGEKIPGDLESRVKSVLRRYGHRLAVDKTIRYRPHSPKSVTGCILHNGAIHVPHSRFRKARMLAAAIATTDDPALTHKLYERLAGLLGEAAYLDGRFTSWKEDTARLLKLATQKLGAAKEAT

SEQ ID NO: 3060 - protein, 312 aa, Pseudomonas sp.
  source 1..312: note = Related to JACYWI010000012.1; note = Pseudomonas syringae
MKKRKNLQLKKDIPLDQCALYKIRSKRRLCQILNIPISSLKGFMNDDRNYHTVDIEEFFNELTGKRKKARTASVPNYWLKKLHSRVHRLLSSIAAPLYAHGSIKSRSYITNALVHVGSKEVLTMDLRDFFRSVKRHHVYFFFKDKLCCSPDVAGVLSNLLTYQGALPVGSPASAIIAMWACHTMFERLNQLASEYRLKFSVFVDDLTFSGEVVPSGYQSLVERICAQSGLSVREDKTVLYKHGTAASVTGVIIYAGAIKPPHSRYQNLRKLSAILSQQGAHAIVNGKHAKYSFQGGRNETMLLRNISIPHVD

SEQ ID NO: 3061 - protein, 315 aa, Pseudomonas sp.
  source 1..315: note = Related to NZ_BCBP01000051.1
MKKRKSSPPDKSIPLDQCALFKVRSKRRLCEILRVPLSSLKGLMDDDQNYHAVEIEEFVNELTGKRKKARIASVPNFWLKKLHLRVHDLLSAITTPIYAHGSIKKRSYITNALVHVEAKEFLTMDLRDFFRSVKRHHVYFFFKDKMACSSDVAGVLSYLLTYQGALPVGSPVSATLAMWVCHAMFEQLNKLASSYALKFSTFVDDLTFSGDVVPSKFQLLVERICQQSGLSIREDKTFLYKNGMAASVTGVIIHNGSIKPPHSRYQNLRKLSTVLSQQGRHAVINGKYARYSFQGGRNETRLLRRINNVQSNDSI

SEQ ID NO: 3062 - protein, 315 aa, Pseudomonas sp.
  source 1..315: note = Related to CP045551.1; note = Pseudomonas putida
MKKRKNLLPKKSIPLDQCALYKIRSKRRLCQILNIPSSSLKTLMDEDSNYHLVEIEEFVNELTGKRKKARTASVPNFWLKRIHSRVHCLLSAIVVPVYAHGSIKKRSYITNALVHVNGKEVLTMDLRDFFRSVKKHHVYFFFKDKLCCSPDVAGILSKLLTYQGALPVGSPVSALLAMWTCHSMFDGLNKLASEYKLKFSTFVDDLTFSGELVPSGFPLLVDRVCIKFGLSIREDKTVLYKNGVAASVTGVIVHEGNIKPPYSRYQNLRKLSVVLSQHGAHAVVNGKYAKYSFCGGLNEARLLRKFNEEKCSLVS

SEQ ID NO: 3063 - protein, 317 aa, Pseudomonas sp.
  source 1..317: note = Related to WIVT01000008.1; note = Pseudomonas helleri
MSQKRRKLLHKKRYPLNQCALYKLTSKKKLSAILGVSLANIKSLCDNDRNYHLVEIEEEFNELTGKRKKARQANVPNFFLKKVHSRVHNLLSRIQTPGYAHGSIVARSYVTNALAHVESWEFLTMDVQDFFRSVKREFVYYFFKDAMFCSPDVAGILSNLLTYKGALAVGSPVSSLLSMWTCKEMFDRLDSLAIKNNLTFSTFVDDLTFSGLKIPASFHEEIESTCRRYGLSIRKDKTKFYKNGMPALITGVIVVSGGIEATYSRFRSIRKLSTILSEEGAHAVVNGKYAKRSLRGGLLEARRIGHISDSRLQSSGG

SEQ ID NO: 3064 - protein, 350 aa, unidentified
  source 1..350: note = Related to JACXXJ020000005.1; note = Agrobacterium vitis
MRRKLVRSSIERYDLERSPFAQRPTQRDIGDLLGTTRNHLRYLVTHKEHFIVRRQEEIGKKKKLRELKFPVADLRGVHERLKYHLNKIRQPSYLFSPRRHRGQRDNAALHLGQNQYLTLDLKQFYPSTTATMVRRWFQDEMGIYPDVAGLLTHLATIDDHVSFGSPLTPVLCTLIHRPMFDKIADLCGSHGLRYSLWVDDLTISGRFVHGDIVCEIRKIIADAGLRSHKIRFRTGSRPVYITGIGVVGRELVAPNSLNLRIKELWEALHLAETLDERDDCIQALLAQLGTQRHICGASSAIGRKAADQMNALRQKRRKMHLEAAEKAAADRLPRSATIVQAPEDAPFDLG

SEQ ID NO: 3065 - protein, 350 aa, unidentified
  source 1..350: note = Related to CP081837.1; note = Agrobacterium vitis
MRRKLFRPPVERYDLVRSPFAQRPTQRDLGDLLGTTRDHLRYLATHKEHFVVRRQEVIGKKMKLRDLKYPVADLRGVHERLKFHLNKIKQPSYLFSPRRNRGQRDNAALHVGQHQYLTLDLKQFYPSTTADMVRRWFRDEMGMYSDVAGLLTHLCTIDDQVSFGSPLTPVLCTLIHRPMFDKIADLCERHGLRCSLWVDDLTISGQFVHGNVIREVRQIIASAGLRSHKIRIRTGSRPVYITGIGVVGRELVAPNTLNLRISDLWENYHLAETTEERDASIQALLAQLGTQRHICGPSSDLGRKAADQMNSLRQKRSKMYRETAARATAARLSRSLALPHAPEDAPFDVV

SEQ ID NO: 3066 - protein, 350 aa, unidentified
  source 1..350: note = Related to JAAMDS010000038.1; note = Agrobacterium rhizogenes
MRRKTARPPIEKYELPRSPFAQRPTQRDIGKLLGASRDHLRFLATHKEHFIVRRQEKIGKKQKLRDLKYPVSDLRGVHERLKFHLNKIRQPSYLFSPRRNRGQRDNAALHLGQHQYLTLDLKQFYPSTTADMVRRWFRDEMGMYPDVAGLLTHLCTIDDQVSFGSPLTPVLCTLIHRPMFDRIADLCERHGLRYTLWVDDLTISGEFVHGDVVREIRQIIAGAGLRSHKVRFRTGNRPVFITGIGVVGRELVAPNAMNLRIKELWEVYHLAETVDERDACIQALLAHLGTQRYISGPSSDLGRKASDQMNSLRQKRNKMHIEASAKALADSLMRSLTEQHSDQDAPFDLV

SEQ ID NO: 3067 - protein, 349 aa, unidentified
  source 1..349: note = Related to NZ_NNRJ01000027.1; note = Brucella thiophenivorans
MPRKRRPPIEIYELPSSPFSQRPTQRDIGSLVGCTRDHLRFLATHKESFIVRRQEIIGKKQKLRDLKYPVADLRRVHERLKFHLNKIVQPSYLFSPRQKRSQRDNAEIHLNQQQYLTLDLKQFYPSTSAGMVHRWLQEKMGMYEDVAGLLTHLCTVDGFVSFGSPLTPVLCTLVHRKMFDEIADLCANNGLNYSVWVDDLTISGKFVHGDIVSEIRDIISRAGLKSHKIAYRTGNRPVFLTGIGVVGRNLIAPNILHLRIKELWASYHTAESYEEKNACIQSLLAQLGTQRYICGAKSVLGRKASDQMNSLRQKRSKMRREAIEQSISNRALRITKEVGLKEDAPFDLA

SEQ ID NO: 3068 - protein, 302 aa, unidentified
  source 1..302: note = Related to NZ_PVWU01000025.1; note = Rhizobium pusense
MPRKARATFSERYPIERSPFAQRPTQREVAALLGETRDDLRFLATHKEHFIVRRQAILGKQKKARDLRYPVSRLRAIHERLKFHLNKIKQPSYLFSPRKNRGQRDNAALHLGQRQYLTLDIKQFYPSTTAQMVRRWFRDELGMYDDVAGLLTHLSTIDDVVSFGSPLTPVLCTLVHRRMFDEIADLCEQRNLRYSVWVDDLTISGDFVVRDFVRELRDIIRRYGLKSHKIQFRTGNKPVYITGIGVDGDQVIAPNSLNLRIKTLWHELSQAKTIPERDGLIQPLLAQLGTQLHVVGNSSKVG

SEQ ID NO: 3069 - protein, 350 aa, unidentified
  source 1..350: note = Related to JACDJD010000002.1; note = Rhizobium leguminosarum
MPRRPRRPVFEKYDISKSPFAQRPTQRDLGELLGENRNNLRLLVDYKEQFVVRRQEVIGKHQKVRDLKYPVSRLRAVHERLKFHLNKIKQPSYLFSPRKNRGQRDNALRHVNQDQYLTLDLKQFYPSTTATMVRRWFQDELGMYPDVAGLLTHLSTIDDRVSFGSPLTPVLCTLIHRAMFDEIAGVCERRGLRCTLWVDDLTISGKFIPGELVNEIREIIRAAGLRSHKVRYRTGNRPVFITGIGVVGTKLTAPNAVHLKIKSLWDDYHQAETLEEKESCSQLLLSQLGSLKHIVGAASLAGRKASDQMNTIRQQRRRMHVAATAAAAATRLSRALMPKESPEDVPFEIS

SEQ ID NO: 3070 - protein, 343 aa, unidentified
  source 1..343: note = Related to FZNM01000001.1; note = Paracoccus sediminis
MRHSRKPHPYEIYGLERSPFAQRPTQREVADLLGETKADLIRLANYKDQFIVRRRENIGGKDRDLAYPVSRLRGVHERLKFHLNKVQQPSYLFSPRKKRSQRDNAALHLDQDQYLTMDVKQFYPSTTEEMVYRWFVDELGLFEDVAGLLTRLSTIDGKASFGSPLTPVLCTLVHRPLFDRISDICGHRGLRHSLWVDDLTISGKFVPGQVVTSIREVIRQRGLRSHKIRYRTGNRPVMITGIGVVGRDLLAPNSLNLRIKQYWQDLHDAMTAEERASCAQRLLSQLGTVRHIVGTKSNVGQRASDQMNMLKQKRDKWISEASQEASKKSADEAAPMEHEDIPF

SEQ ID NO: 3071 - protein, 343 aa, unidentified
  source 1..343: note = Related to JASG01000004.1; note = Sulfitobacter guttiformis
MRRNSKPPQYERYDLERSPFAQQPTQRDVAALLGETKADLQRLINYKDEFIVRRQEKIGGKVRDLAYPVSRLRGAHERLKFHLNKVRQPNYLFSPRKKRSQRDNAELHLDQDQYLTLDLKQFYPSTTETMVYRWFVDELGMYEDVAGLLTRLSTVDGIVSFGSPLTPVLCTLVHRPMFDNISDICDARGLRHSLWVDDLTVSGKFIPGKVVTSIREAVRERGLRSHKINYRSGNRPVILTGIGVVGRNLLSPNSLNLRIKRYWKDLHEAETNEEKVACAQLLMSQLGTVRHIVGQKSDVGMRAADQMNMLRQKRNKWLQETSVSLPAPEETETASADTENIPF

SEQ ID NO: 3072 - protein, 340 aa, unidentified
  source 1..340: note = Related to NZ_SPUW01000001.1; note = Pseudooceanicola onchidii
MRRNKKPAYERYDLDRSPFAQRPTQRDVADLLGETKADLERLINYKDQFVVRRQERIAGKDRDLAYPTARLRGIHERLKFHLNKVRQPSYLFSPRKKRSQRDNAELHLDQDQYLTLDIKQFYPSTTDAMVFRWFKDELGMYDDVAGMLTHLCTIDGKASFGSPLTPVLCTLVHRPMFDSISDICSARGLRHSLWVDDLTISGRFVPGKVVTSIRTVIQDCGLRSHKIRYRSGNRPVVITGIGVVGRDLVAPNSLNLRIRRYWDDLHEAVTADEKAACAQLLMSQLGTVRHIVGAKSDVGQRAADQMNMLKQKRAKWLREANAVTPARQHDASVDAEDMPF

SEQ ID NO: 3073 - protein, 343 aa, unidentified
  source 1..343: note = Related to NZ_QRBG01000022.1; note = Cereibacter sphaeroides
MPRNRRSPVYERYDLSRSPFAQRPTQRDVAQLLGEAKADLHRLVNYKEQFIVRRREIIGGKVRDLAYPVSRLRGVHERLKFHLNKIRQPSYLFSPRKKRSQRDNAALHLDQEQYLTLDLKQFYPSTTEAMVFRWFKDELGMYEDVAGLLTHLCTIDGKASFGSPLTPVLCSLIHRPMFDEISEICTKRWLRHSVWVDDLTISGRFVPGQVVEEIRSVIRSAGLRSHKIRYRSGNRPVFITGIGVVGGCLLAPNSLNLRIQKYWQDLREAGTVDEKISCAELLLSQLGTVRHIVGARSDVGQRVADQMNMLKQKRGKWLHEALHLTQLKERTEPTFTGVCDIPF

SEQ ID NO: 3074 - protein, 346 aa, unidentified
  source 1..346: note = Related to NZ_APLP01000010.1; note = Agrobacterium tumefaciens
MRPRKARVRFERYEIERSPFSQKPTQREIAKLLGESRDGLRRLIEDKENYIIRREAFVGKKQKKRDLRYPIRRLRAVHERLKFHLNKVKLPSYLFSPRKNRSQRDNAALHLDQDEYLTLDLKQFYPSTTAQMVRGWFRDELGMYDDVAGMLTHLSTIDGAVAFGSPVTPVLCALIHRPMFDRISEICDDHGLRYSLWVDDLTISGKQITGEVVEKIRKVIRDAGLKSHKIRIFRGKKPVFITGVGVVGANLVAHSSLHLRLGAAWAEYDSAETLEERDHCTQTLLSLLGTIRHIVGAQSEAGQKAANQMNTLRQKLAKSRAEAAVANVKRRMLAVQTTEHARDAPW

SEQ ID NO: 3075 - protein, 347 aa, unidentified
  source 1..347: note = Related to NZ_AP023278.1; note = Agrobacterium vitis
MRRKKVRDRFERYELARSPFSQKPTQRDIAKLLGESRDDLRKLINYKEQFVVRRKAIIGKKQKERDLRYPVSRLRAVHERLKFHLNKVKLPSYLFSPRRNRGQRDNAVLHLDQDRYLTLDLKQFYPSTTAQMVWKWFRDDLGMYDDVAGMLTHLSTIDEKVSFGSPLTPVLCALIHRPMFDRIAEICDEHELRYSLWVDDLTISGRHISVEILKKIRAVVQEAGLKTHKIRFHSGRKPIFITGIGVVGAHLVAANSLNLRLKTAWAEYHGAQTINERDHCTQVLLAQLGTLRHIVGAKTDAGQKAANEMNSLRQKLKKHRVQDAKLQAAKRQIAASQTITEAADAPF

SEQ ID NO: 3076 - protein, 351 aa, unidentified
  source 1..351: note = Related to CP033022.1; note = Agrobacterium sp.
MSGKIARKNFERYGIERSPFSLRPTKRDLAALLGESVKDLKTLAIPSFKEQFVVRRQAETGTKKKKIRDLVYPESRLRGIHERLKFHLNKVRQPSYLFSPRKDRSQRDNAAMHLDQEMYLTLDLKQFYPSTTSAMVRKWFQNELGMFPDVARLLTDLSTIDEKVSFGSPLTPVLCTLVHREMFNEIADVCELHELRYTLWVDDLTISGRSIPAIVLERIREIIRKHGLKSHKIRFHKGRDPVFITGIGVVGRKLIAPFSLNLKIKKCWAEYHAATTTSERDQCIQTLLANLGTARFIVGANTLAGQKLSDEMNALRQKKAKMWRQDVKQSLARNMHLSGISDLAPAGDAPF

SEQ ID NO: 3077 - protein, 351 aa, unidentified
  source 1..351: note = Related to CCRK01000005.1; note = Neorhizobium galegae
MSGKVARKNIERYDIKRSPFSLHPTKRDLAVLLGETVNDLKTLSIPSFKEQFVVRRQAETGKKKKKLRDLVYPESRLRGIHERLKFHLNKVKQPSYLFSPRKNRSQRDNAETHLDQDVYLTLDLKQFYPSTTAAMVRKWFQDELGIYPDVARLLTDLSTIDEKVSFGSPLTPVLCTLVHRKMFDEIADVCDAYELRYTLWVDDLTISGRSIPAEILDKIRQIIRNHGLKSHKIRFSTGRRPVFITGIGVVGRKLIAPYTLNLKIQECWADYHAANTVAERDQCIQTLLANLGTARFIVGPKTAAGQKLSSEMNSLRQKKAKMYREDAAESLKRRTEARSLIGSSQIADVPF

SEQ ID NO: 3078 - protein, 345 aa, unidentified
  source 1..345: note = Related to NZ_AP025032.1; note = Aureimonas sp.
MLPRSQQRERYELERSPLAQKPTQRDVAQLLGETRDDLRRLRNYKEHFIVRRTAIIGKKGKIRELAYPEGRLRALHERLKYQLNKVKQPNYLFSPRLRRSQRDNAALHLEQNQYLTLDLKQFYPSTNESMVRSWMRDQLGMYEDVSGLLTDLCTVDGKVSFGSPLTPVLCSLIHKSMFDQIARICDNRGLTYSVWVDDLTISGRFIPGEVLNEIRWVVRDAGLKSHAVKYRNGNRPVFITGIGVVGRKLIAPSSLNLKIRVAWSEYHTALSDDERDEICQRLLSYLGTLRHISGSTSETGRKISDQMNSLRQKRSARRFASEATRNEVTKSPPAPKMADPLGLPW

SEQ ID NO: 3079 - protein, 349 aa, unidentified
  source 1..349: note = Related to MEEU01000016.1; note = Pelagibacterium sp.
MKSQTLRNRTPTHERYDLSRSPFFQKPTQREVAELLGETRDDLRRLINYKEEFVVRRTIVTGKNDKVRDLAYPVSRYRACHERLKFHLNKVRQPSYLFSPRKHRSQRDNAALHLGGLQYLTLDLKQFYPSTTDTMVRRWFRDELGLYEDVAGLLTHLCTIDGKVSFGSPVTPVLCSLIHREMFDEVARLCEVRGLHFSVWVDDLTISGLFVPGELVDQIRAIVRAAGLKSHAIRYRTGNRPVFITGIGIVGSKLVASNALNLKLKQGWADYHDAETDDEKDFLTQRMLSLLGTVRQISGAGSDRGRKAADEMNSLRQKRNERQRRARASKSALRHVSDPAELVPADAPF

SEQ ID NO: 3080 - protein, 352 aa, unidentified
  source 1..352: note = Related to JADCRT010000002.1; note = Methylobacterium mesophilicum
MPRSSQKDKKFERYELSRSPFAQKPTQRDVAKLLGEKRDDLRRLVNYKEQFIVRRQAKTGKKEKLRDLAYPENRLRAVHERLKFHLNKIKQPNYLFSPRRKRGQRDNAAHHLDQDQFLTLDLKQFYPSTTDKMVRRWFRDELGMMDDVAGLLMHLCTIDGRVSFGSPLTPVLCSLIHRPMFDRIAEVCDTYGLQYSVWVDDLTISGRFVPGDVLNKIRQIVHAAGLKMHDIKFRSGNRPVFITGIGVVGANLVAPNSLHIKIRDCWTEYHSAITADEKDAVSQQLLSHLGTLRHITGSSSEAGRKAADQMNSLRQERDARRKAEQKCRQAERNARASVEIFDLSDAPFEMTL

SEQ ID NO: 3081 - protein, 348 aa, unidentified
  source 1..348: note = Related to VFMG01000001.1; note = Bosea sp.
MPRKSTAASHYERYGVDRSPFAQRPTQRDLASLVGETRDDLRRLASYKEQFIVRRQVETGKKAKLRDLAYPEGRLRGVHERLKFHLNKVKQPSYLFSPRKGRGQRDNALHHLDQDQYLTLDLRQFYPSTSSQMVREWFRDHLGMYDDVAGLLTHLSTIDDKVSFGSPLTPVLCSLIHRPMFDRIADICEARGLRYSVWVDDLTISGRFVPGEVLRQIREVVQQFGLQSHKISYKTGNRPVFITGIGVVGSRLVAPNSLNLKVKEAWTGYHNAVTDDEKDAMCQRLLSYLGTLRQIVGGKTEAGRKAADQMNSLRQKRDARRKAAAEAYRIEREQRQAVPSAVAADAPF

SEQ ID NO: 3082 - protein, 354 aa, unidentified
  source 1..354: note = Related to JACEMU010000004.1; note = Paracoccus sp.
MQKRADKRNGERYPLNRSPLAQNPSQSDLAMLVRETKADLNTLATPEFKEQFLVRRTIETNGKTRNLVYPEGRLRAVHERLKFHLSKIVQPSYLMSPRKRRSQRDNAVAHLEATQYLTLDLKQFYPSTTRQMIRNSLVAQFGMQADVAGLIAHLATADDRACFGSPLTPVLASIVHRPMFDLIAGRCNVDGLSYTVWVDDLTISGPQITGQFRSDVRGIIAQNGLRSHKLRSQTGNHPVFITGIGIVGANLIVPKRIELRSKELWAEFKASQTFEELDSSATRLLSHLGGVKAVVGPSTIRGQKLSSEMNSVRQKREKARRFHQAFVAEQRTRSSQACCIQNGDGVGEQAEISF

SEQ ID NO: 3083 - protein, 351 aa, unidentified
  source 1..351: note = Related to NZ_WQCG01000003.1; note = Ruegeria atlantica
MRKRYRLKSGEKYPLERSPFAQKPSQRDIAELVRESKDDLNRLATPRYKEQFLVRRTIETNGKTRDLVYPEGRLRSVHERLKYHLSKIAQPSYLMSPRKGRAQRDNAVAHLEAAQFLTLDLKQFYPSTTRQMIRNSLMEQFKMEADVAGLIAHVATADDRACFGSPLTPVLASLVHRPMFDRIADRCVEDDLSYTVWVDDLTISGLRITGNFRADVRKLVAQSGLKSHKLRTQTGNRPVFVTGIGIVGANLIVPKRLELRSKELWTELKAAQTQEEMEACSVRLLSHLGGIRAVVGASSHRGQKLASEMNSIRQKLSKARRENKARLAEEKAAAQEISRVDPDNEKENIPF

SEQ ID NO: 3084 - protein, 355 aa, unidentified
  source 1..355: note = Related to CP002623.1; note = Roseobacter litoralis
MAVRKRRVRKAYERYEIDRSPLAQRPSQRDIASLISENKSDLNRLATPQFKEQFLVRRSIESGGKTRDLVYPEGRLRAAHERLKFHLNKIVQPSYLMSPRKNRSQRDNAAAHLDAAQYLTLDIKQFYPSTTRGMIRNSLVDLFGMEADVAGLIAHVATADDRACFGSPLTPVLASLVHRPMFDAIADLCASYDLGHTVWVDDLTISGNQIPGRFVSQVRAIVASHGLRSHKLKYRTGNKAVFITGIGVVGSNLVVPRSVERRSKDLWRDFQKADTVDEIDTAGSRLLSHLGGIRHVVGKSSKRGQKISSEMNSVRQKRTKALRIGSEKSASTSNLRYLTAEEQEERRDEIDAIPF

SEQ ID NO: 3085 - protein, 346 aa, unidentified
  source 1..346: note = Related to NZ_CP045393.1; note = Roseovarius sp.
MYERYELERSPFAQKPTQRDIAALVRENKEDLNKLGTDRFKEQFLVRRTIETSGKERRLVYPEARLRAVHERLKYHLNKIIQPSYLFSPRKNRSQRDNAEVHLSAFQYLTLDIKQFYPSTTRRMIRNSLAVQFGMAGDVAGLIAHVATADDRACFGSPLTPVLASLVHRPMFDEISDLCVSYGLSHSIWVDDLTISGPKIPGAFIAEIRRIIASYGLRSHKLKYYTGNKAVFVTGVGIVGSNLVAKKKVELRSKELWRALKNAETLDEIDTATTRLLAHLGGIKQIVGKSSKRGQKLSNEMHSIRQKREKAFRKNTERLINEASGLRRLSPEEQEARREEIDALPF

SEQ ID NO: 3086 - protein, 354 aa, unidentified
  source 1..354: note = Related to CP059262.1; note = Exiguobacterium profundum
MPRIRSSGLRERYPIERSPFSQNPTQRDIAELLHETKASLQTLATPHYKELFLVRRKVKTSGKERLLVYPVSRLRAVHERLKFHFSKITQPSYLMSPRIGKAQRDNAAAHLAAAEYLTLDLRQFYPSTTRAMIRNSLMSQFRMAADVAGMIAHLATADDRACFGSPLTPVLASIVHRPMFDEIADLCACYDLSYTVWVDDLTISGARVPGEFRRKVREIISNHGLRSHKLRFRTGNRVVFITGVGVVGSLLVVPRRMELRSKELWDDLHSSETFNEIDAASSRLLAHLGGIRYIVGHESLRGQKLADEMNSIRQKRKKAYLSDAARRSAESASLRYLTDEEXEARKLEIAAIPF

SEQ ID NO: 3087 - protein, 333 aa, unidentified
  source 1..333: note = Related to JACESO010000004.1; note = Sphingobium sp.
MPRIQRRLNQVERYELARSPLSQRPTQRDLAALVGETRDDLRRLVNYKEQFIVRRQTETGKKKKLRNLAYPSGRLRAVHERLKFHLNKVKQPDYLLSPRKGKSQRDNAAAHVGQDQYLTLDLKQFYPSTTGGMVKRWLHAQLRMEEDVAGLLAHLVTVDGKVSFGSPLTPVLCSLVHRPMFDKIASLCRHRGLNYTVWVDDLTISGRFVPSALLVQVRRIIQDHGLRSHDIRFRSGNRPVFITGIGVLGRNLVAPQALHLSIRSSFEEYHAAITDVERDSVEQKLLSQLGTLRHVVGVSSKAGQNAADQMHSIRQKRDKLRTAEQYSTTLAAG

SEQ ID NO: 3088 - protein, 348 aa, unidentified
  source 1..348: note = Related to FOFL01000001.1; note = Devosia sp.
MPRRAPAKSERYQLHRSPLAQRPTQRDIAKLLGETRDDLRRLVNYKEEFVQRRKIESVKSGKIRELAYPVGRLRGVHERLKFHLNKIKQPSYLFSPRRGFGQRDNAAYHIRQDQFLTLDLKQFYPSTSGAIIKRWLWEDLGMPEDVAGLLMHLVTVDEKASLGSPVTPVLCSLIHRKMFDRIAEICDARGLRYSVWVDDLTISGRFVPGDVLMQVRDIIRTSGLRSHKIKFRTGSRPVFITGIGVVGPHLVAPNTLHLRIQAGWADYHDAVTDDEKDAACQTLLSFLGTLRHISGRKSKAGQKVADQMNALRMEREVRQKFAIQLDKEKAELRVQTNYCAVEDLPFDL

SEQ ID NO: 3089 - protein, 342 aa, unidentified
  source 1..342: note = Related to NZ_FPKU01000001.1; note = Devosia enhydra
MPVTKKVQRAERYPIARSPFSMRPTQREVARLLGESRDNLRRLVNYKEQFVQRRDLEINGKLRHLAYPESRLRSAHERLKFHLNKIQQPAYLFSPRRGKSQRDNAALHLEQVQYLTLDLKQFYPSTTSAMVRRWFINDLGMYQDVAGLMTHLVTIDDKVSFGSPLTPVLCTMVHRRMFDQIADICRARGLNMSLWVDDLTISGQFVTREVLREVRTVVRAFGLKTHKIKYRTGNRPVFITGIGVVGSNLVAPAKMNLKIKAAWEAYHAAQTDAERDACAQHLLTLLGTVRHIARRGSPLARRVADQMNSLRQKRAVLTVTTTTRSAQAGAALIANDAVGDPF

SEQ ID NO: 3090 - protein, 319 aa, unidentified
  source 1..319: note = Caulobacteraceae bacterium; note = Related to WRPF01000034.1
MTKRTHERYALTRSPLAQRLTQKKLANLLRRPLPQLKGLIKYKKSFVVAEVREIDGKARPLCYPRGPLRSVNEALKYQLSKIRLPDYVASPRRGRGQRENAAVHVDAKQILTLDLRKFYPSVSRRYIARFFREEFSMHPDVAGLITELLTFEGRVLYGAPATPVLVMLAHRKMFDQIDNACLAFGTKMSLWVDNLTISGAEVPGALLVQVREIIASHGYKTHDIAFVTTNRDSTVTGVVVRCGELHPANSSNLAIRDLEAALRNSVDPSEYEAKANRLLSRLGGQLHILGTQREWGQKIARRMNVIRQKRDKRVRSNSK

SEQ ID NO: 3091 - protein, 328 aa, unidentified
  source 1..328: note = Related to NZ_LMNU01000047.1; note = Methylobacterium sp.
MTIKRKEPSHRSDRYELEASPLYQKPTQKQFAELVGLSKSKLRGLIDHKKQYIIRRDAEINGKKRRLVYPFGKFRSVHEKLKFHLNKIIQPAYLYSPRKGRNQRSNAVFHLGQTQYLKLDIKQFYPSTSSEHVFRWAKYDMRMSDDVAGLLVHIATIDDVVSFGSPLTPVLATLVHRRMFNAIAEECSARGLRISLWVDDIVISGKFIPGPLVSRIRDLTRSNGLKSHKLEYFTGYRRVTITGVVVKGDEIHSPRKLHTEISNAYGLAIQSNSRIEAEAAVDRLLSTLGRYRVMVGKGSPMGRRASSRMNAIRQKRVRFVSERCSTTD

SEQ ID NO: 3092 - protein, 346 aa, unidentified
  source 1..346: note = Related to nan
MTVKRHKQNKYERYPFENSPWTQDLTQRDLAELLGWKKQQLEALVRDKDRYIKRGPKLIGTKTRELAVPTGKLRTIHERIKIHLNKIKQPEYLFSPRKGRAQRDNAEHHVGQNQILSLDIKQFYPSTTDEHIFRWAYHVAGLRADVAGLFTKLVAVDGKMPFGSPVSPVLTTLVHRQMFDAISDICKEQDLKMSLWVDDLVISGSFVRGKVMEDVRAAIRRFGFQTHKIQFRSTARPVPITGVPVTKTSIGAPLSLHRRIQSGYAELRQRLTDAQRTQATDKLLAALGTYRYHLGASSEQGRLAANRMNALRMRRARLKPRYVTYPVGSTPDETSTEIDDGTPPWE

SEQ ID NO: 3093 - protein, 346 aa, unidentified
  source 1..346: note = Related to CP021181.1; note = Rhizorhabdus wittichii
MTRRKQPPYERYHFDQSPWVQDLTQRDLAALLGWKKQQLEALIRDKERFIKREAKLVGTKMRNLAVPTGKLRTIHERLKFHLNKIKQPGYLFSPRKGRAQRDNAEHHAGQTQFLSLDIKQFYPSTTDEHIFRWAHHMAGLRADVAGLFTKLVAIDGRMPFGSPVSPVLTTQVHRTMFDEIHAICEANRLHMSLWVDDLTISGVFVRGAIAEEIRAVIRRHGFQTHKVAFRNAHRPVVVTGVPIKNKRVVAPRSLHKRVQAGYQALRESRTDIERGIAIDRLLSALGTYRYHLGASTAEGRTTSNRMQMLRVRRARLKMSAITVPTVGPAQATSVLAGAEGLDLPWD

SEQ ID NO: 3094 - protein, 343 aa, unidentified
  source 1..343: note = Related to NZ_LDTE01000007.1; note = Sphingomonas sanguinis
MKQHKQRYERYLFKDSPWVQDLTQRDLAELLGWKKHQLEALIRDKERWVKREPKQIGLKLRNLAVPTGKLRTIHERLKFHLNKIRQPEYLFSPRKGRSQRDNAEHHAQQTQFLSLDIQQFYPSTTDEHIFRWAFHVAGLRSDVAGLFTKLVAIDRKMPFGSPVSPVLITHIHRAMFDEIFAICQANGLRMSLWVDDLTISGTFVRGELVEQIRGIIRQRGFQTHKIEFRSAARRVIVTGVPIERRRVMAPRALHQRIQNGYAALRGDLTDVERGKAIDKLLSALGTYRYHLGPSEPGGRKAADRMEALRVRRAKLDMTMVTLPAVENVITASSTLPGSELPWE

SEQ ID NO: 3095 - protein, 348 aa, unidentified
  source 1..348: note = Related to NZ_AP017898.1; note = Sphingopyxis sp.
MKRRKQQEYERYPFSDSPWTQDLTQRDLAELIGWKKHQLEALVRDKERYTRRKTELIGSKLRDLAVPTGKLRTVHERLKFHLNKIKQPTYLFSPRKGRSQRDNAEHHVEQVQFLSLDIKQFYPSTSDEHIFRWAYYVAGLRSDVAGLLVKLIAIDGKMPFGSPVSPVLTTHVHRSMFDEIYELCRSQGLKMSLWVDDLTVSGQFVRGELVEAIRVIIRRQGFKTHKIKFRSVGRAQGGRPVVVTGVPVRARRVDAPFSLQKRVQDGYAKLRPDLTDVERAQAIDSLLSALGTYRYHLGRSSPEGRKTADRMQALRQRRAKLDLTVITQPSGPIKPWGTTTRDSDVPWE

SEQ ID NO: 3096 - protein, 348 aa, unidentified
  source 1..348: note = Related to CP011344.1; note = Proposed Citromicrobium sp.
MKRRRQQKYERYSFRDSPWTQDLTQRDLAELIGWKKQQLEALVRDKERYTKRKREKIGSKMRDLAVPVGKLRTVHERLKFHFNKIKQPPYLFSPRKGRSQRDNAEHHAKQIQFLSLDIKQFYPSTTDEHIFRWAYYVAGLRSDVAGLLVKLIAIDGRMPFGSPVSPVLTTHVHRHMFDEIYDLCCRRGLKMSLWVDDLTISGQFVRGELVDAVRAVIRRQGFKTHKIKFRSVGRAQGGKPVVVTGVPLRAGRVDAPFSLQKRVRDGYALLRTDLTDVERAKAIDSLLSALGTYRYHLGRGSPEGRKAADRMQALRQRRAKLDAKGYVTGPKAEGSFEDRVTTSDVPWD

SEQ ID NO: 3097 - protein, 317 aa, unidentified
  source 1..317: note = Related to JAGHQS010000004.1; note = Qipengyuania flava
MKTTKGRLEWLIENKERFTKREDRQIGRKTRNLCYPVGKLRGVHELLKFHFNKIRQPPYLFSPRKGRSQRDNAEHHADKVQFLSLDIKQFYPSTTIEHVFRWAYHEAGLKADVAGMLAHLICIDGKLPFGSPVSPIAATHIHRSMFDAVYDICLENDLQMSLWVDDLTISGAFVRGELIEQIRSVLRRHGFQTHKIKFRQSDKPVIVTGVPVKNRRVIAPRSLHQRVEDGYAELRGAESDNATVSAINQLLSALGTMRYHYGAQSVEGRKAADRMHALRRRRDAIQQASSRQIPSDLSIRKQDEAVTGDGHLPWVAD

SEQ ID NO: 3098 - protein, 345 aa, unidentified
  source 1..345: note = Related to JADOUC010000001.1; note = Sphingobium sp.
MRQRKPKRYERYALEDSPWVQNLTQRDLAELLGYTKTQLEALIRDKDNWIGRRTEMIGSKLRNLAVPRGKLRAVHERLKFHLNKIKQPDYLFSPRKGRAQRDNAEHHVSQGQFLSLDIRQFYPSTTSEHIFRWAHHELGLRTDVAGMLVHLVSVDGRMPFGSPISPVLTTLVHRSMFDAIKLICDAHDLRMSLWVDDLTISGRAIPGTLIEDVRAEMRQRSFQTHKIQFRSGNRPVIVTGVPIDGDRVAAPRSVHERVRTGYAALRVPLADPDRAQQIDKLLSALGTLRYHVGRSSPEGRRAANRMDALRRRRSSLSKSVTTLPTLTDREASAELPVSTSSLPWE

SEQ ID NO: 3099 - protein, 345 aa, unidentified
  source 1..345: note = Related to NZ_JACBGA010000006.1; note = Sphingopyxis sp.
MKRRKVSRYERYAFEDSPWVQKLTQKELATLLGYTKDQLEALIRDKDKWIGRRAEVIAGKKRNLAVPYGRLRGLHERLKFHLNKIRQPDYLFSPRKGKAQRDNAAHHVGQTQFLTLDIRQFYPSTTGEHIFRWAHHEAGLRPDVAGMLVHLVAVDGKMPFGSPISPVLTALVHRPMFDAISGLCAERDLHMSLWVDDLTISGREVGGDLIDQVRAIMRKAGFQTHKIRFKMGNRPVVVTGVPIDGSRVTAPRSVNERVRIGYANLRVAANDNERRQAIDALLSALGTYRYHMGRGTAEGRKAANRMDALRRRRSALSNSYRSPAEVELDSASEAAAYDGEAPPWE

SEQ ID NO: 3100 - protein, 326 aa, unidentified
  source 1..326: note = Related to LMKH01000010.1; note = Sphingomonas sp.
MWAQNPGQRDIASLIGMTKGQLGAIVRDKERYIRRDTIDINGKLRNLTVPTGKLRMVHERLKFQLNKIKQPPYLCSPRKGVGQRDNAEMHVAGHQLLKLDIRQFYPKTMQEDIWRWAHYSLGIMDDVAGLFAKLAAIDGRMPFGSPISPVLTSLVHRGMFDKVYAICGSHGLKMSLWVDDLTISGAEVPGGAVTDIRQAIRAGGFQTHKIEYLMTARPTEITGVPIAKGRVLAPHAIHRRIKEGYEALKVAASDTERSNIIDKLLSALGSYRYHLGSSTPEGRLAADRMQSLRQRRAKMTIVAETPQTLSSIQAVTFGAPDTLPWD

SEQ ID NO: 3101 - protein, 341 aa, unidentified
  source 1..341: note = Alphaproteobacteria bacterium; note = Related to SDYE01000871.1
MKRPRDRRYERFGLDASLWAQDPTQQDVARLLGMTKDQLEAIVRDKERYTSRRTLEINGKLRNLAIPTGRLRRIHERLKFQLNKIKQPPYLCSPRKGIGQRDNAERHVDGAQLLKIDIRQFYPRTMQEDIWRWAHHTMGIRDDVAGLMAKLVAIDGRMPFGSPVSPVLTTLVHRPMFDRIYEVCGVRALAMSLWVDDLTLSGTEITANTIVAVRQIIRDGGFQTHKIEHLATARPVDITGVPIAAGRVLAPLALHRRIQEGFTALRAATTDADRASIIDKLLSALGTYRYHLGTSTLEGRRAADRMHALKQRRARMAITAVTVPATTTVHEAKSSAALPWE

SEQ ID NO: 3102 - protein, 383 aa, unidentified
  source 1..383: note = Related to WVTD01000004.1; note = Novosphingobium silvae
DRKRADLRPRRPSRSRSRRAADHHVCGAGLSAVPKNRLRQRAAKRPRYERYELADSPWTKKLTQRDLAVLLGTTKDRLEALVRDHENYVHRRDENIKGKLRKLAIPRGKLRAVHERLKGHLNKIKQPPYLYSPRKGRGQRDNAFLHASSAQVLKVDISQFYPQTTVEDIWRWAHYTVGMREDVAGLFAKLVAIDRKMPFGSPISPVLTSLIHRPMFDRVYQLVREAGFEMSLYVDDLTISGQGITGEFLAAVRSEIRSGGFNTHKIEFLEAARPVVITGVPIAGKRVLAPTALHQRLRRSYADLKSARSDKERAEVIDQILIALGTYRHFVGASSDEGRKAANRMHALKQRRRNLSIELVTMPTVDFVPTATLSPAAPGVPWA

SEQ ID NO: 3103 - protein, 354 aa, unidentified
  source 1..354: note = Related to JAFKJN010000009.1; note = Reyranella sp.
MAKPTDKTISERYAFSESPLVGLSTQRKLAQLLGSSKSRLHKLVAAVESDPSNCYKIEDRQVGEKLRTFSVPVGQMRKIHERMKILLGRISLPEYVMSPRRGKTIATNATAHRHAAELLKVDVKSYYPSTTDELVFRLFHHRFGIPGDIAGLLTKLLTVNGRVPIGSPASPILAFWASKPAFDKIASAVQSRGLKPTLWVDDLSISGRHVPREIADVVSYELGKLGYMGHKVKFQSRRRGFSITGVRIDSRGPGPTNAINLKIRDGLRRLERKSNTDEETSKLLAQLIGLNGHRLGTMAKDHPAAPRARKLQQHLHQRRRRHLMTMQETLSSSGQADSKGLSASAASRAFRSAS

SEQ ID NO: 3104 - protein, 305 aa, unidentified
  source 1..305: note = Bdellovibrionales bacterium RIFOXYD1_FULL_55_31; note = Related to MEQK01000113.1
MAETNTLPLSQSALYKVQSRARLAKTLLISPRHLKFLARGTQYKLTSILDKNVKPRMLQVPQGDLRKVHDRVRYLFAQLKAPEYLHSGVKGRSPVTNAKKHRSGAAGMRVDVRKFFPSCSRLSLAKFFHHDMGMAGDVAHQLSLLCTCDGALPTGSPLSMSLAFWMHRRVFDRIERMARERGYVFTLFVDDANFSADLSIPREFELAVRSELRRVRLRAHPRKTSRVAPGTARQITGVILPNSDEIRVPNAQRLKFLRGLETIKQNSALKAERVNSLRGLLAWMRQIEPTIFPRAGGELTRLNSK

SEQ ID NO: 3105 - protein, 342 aa, unidentified
  source 1..342: note = Related to JAIZSQ010000047.1; note = Burkholderia vietnamiensis
MPMKNPSHRREKAFGRARLRKNKSARYPIERSPFWRLSSIHQLAALLDVPVEDLEATCMAPSYNRFDDQPKPGKEARHIQEPTEATLKIHYRIARHLDSIQRPDFLHSATKCRSHVTNARAHLASGGAVVAMDIRKFFESTTYHHVKAFFYKDLGCSHDVARLLATVCTADGHLPTGSCISPLLSYFTHRQLFAEIEKLCVVTNVIMTLYVDDLTLSGIHATKSMLYRIKALIVRHGLQTKSTKDAVLRPGKSAIITGAIRAGDQLRLRNKHHGAIVEIQDQMSLGRTPPLDQLRGRIASARAVDPQAAARLEARLERIVRRGQLANGEGDLSGIVRKKPGI

SEQ ID NO: 3106 - protein, 333 aa, unidentified
  source 1..333: note = Related to JAGSTU010000036.1; note = Burkholderia vietnamiensis
MKNPLHKREKALGRARLRRNQSARYPIERSPFWRLSSIHQLAMLLDVPVQEIKATCMEPSYNRFDDHPKPGKEARHIQEPTDRTLKIHYRIARYLDSIERPEFLHSATKKRSHVTNARAHLPSGGAVVAMDIRKFFESTTYHHVKAFFHRDLGCSHDVARLLANVCTADGHLPTGSCISPLLSYFTHRLMFAQIERLCVGKGVVMTLYVDDLTLSGMHATKSMLYQIKNLIVRHGLQTKATKDAVVRPGKSAIITGVMRAGEQLRLRNKHHGAIVAIQDQIAAGETESFHQLRGRIAAARAVDPQAATRLEARMKRLAHATSGDVATGEDARS

SEQ ID NO: 3107 - protein, 329 aa, unidentified
  source 1..329: note = Related to NZ_JAFD01000236.1; note = Burkholderia sp.
MKNPSDRRDKAAGRARLRKNETGRYPVERSPLWRLSSIHRLAVLLGVPVQELEAACMAPSYHRFVDPPKKTGKEARHIQEPTGATLGIHYRILRHLDSIQRPDFLHSATKNRSHVTNARSHLASGGAVLGMDIRRFFESTTYHHVKTFFHKDLGCSHDVARLLATVCTADGHLPTGSCISPLLSYFTHRRLFAEIEGLCVEKRVIMTLYVDDLTLSGVHATKSMLHQIKALIARQGLRTKPSKDAVVRPGKPAIITGVVRDGDQLRLRNSHHDAIVQIQDLIAHGNAPSLHEQLRGRVASARAVEPTAAARLEARLIRLMSGERPADSK

SEQ ID NO: 3108 - protein, 328 aa, unidentified
  source 1..328: note = Related to CP009157.1; note = Burkholderia pseudomallei
MTRDAHKRDKSAGRARLRKNKSARYPIESSPLWSLSSIHQLAVLIGIPVDELEVTCTSPTYHRFDEAAKEGKEPRHIQEPTGATLRAHYRLVRHLDSIQRPDFLHSATKKRSHVTNARAHAESGGAVVAMDIRKFFESTTYQHVKRFFHKDLGCSHDIARLLANICTVDGHLPTGSCVSPLLSYFTHRHLFADIERRCVERGVTMTLYVDDLTLSGPHATKSLLFAIKAMIKRCGLRTKDAKDAVVRPGKAAIITGVVRSDGGVRLRNKHHGAIVAIQDSIATTGDNNDDVLRGRLAAARAVEPNAATRLEERLKRIIGNQQRNASAK

SEQ ID NO: 3109 - protein, 328 aa, unidentified
  source 1..328: note = Related to JACZKT010000108.1; note = Rubrivivax sp.
MKSLQHRVDKAAGRKRLRKNKSARYPIEQSPFWGLASIHTLASLLGVPVKDLEAVCLSPAYNRFDEPPKPGAKPGKEPRHIQEPVDATLRIHYRIVKHLDSIQRPDFLHSATKQRSHVTNARAHVDAGGAVVAMDIRKFYESTTYHHVKAFFHRDLGCALDVARLLATVCTADGHLPTGSCISPLLSYFAHRKMFAAVEALCVEKQVTMTLYVDDLTLSGAHATKTMLYQVKALIKQQGLRTQPTKDAVVRPGKAAIITGAVRDGQQIRLRNKHHNSIVTLQDRIASGDDVSFNQLRGRVAAAQSVEPVAAARLVARLDRILSNDKAA

SEQ ID NO: 3110 - protein, 331 aa, unidentified
  source 1..331: note = Related to SDXY01000242.1; note = Acidovorax sp.
MSNATNNKHRRQRLALKRENRRSPSEKYPLERSPVFELGGPRELATLMQLSIEQIRAIAANPEYHFFDEEPKREGKAARHIQDPRGDTQTLHYRFAKFLNRIERPAFLHSATRGRSHISNAAVHRGTYPVVCADIEKFYENTTRAHVKGFLFRELHWPMDLAALMADALTVNGHLPTGSAVSPILSYFTHRRMFAEIEAMCIATGCTLTLFVDDITVSGARASMSLLRQIKQILLGRGLRAKANKDKSAPTGSAVVITGAVRQGDRLRIRNEHRKGIVELLARYEAGEGAVEEQLVSKIAAARCVDSAGAVPLERRFTQLRSVARSSASGV

SEQ ID NO: 3111 - protein, 325 aa, unidentified
  source 1..325: note = Related to CP001505.1; note = Burkholderia glumae
MNKKRSALKRRLRANQSCRYELSRCALYGVRQLSVLTDLLQTTNKALRQSAQAPEFATWVDRSRPEKPRDIQDPRGTTERLHYRICELLDRVIRPEFLHSATRKRSSITNASQHVSHGPCVTTDMKSFYEATSTKQVEEFFSDSLNMAPNLARKLANLCTTDGHLPTGSPLSPLLSYWAHHQTFDKIHELVVERGVVMTVYVDDMAFSGAHASLALLRQVKHKLRLRGLETHKDKSFGRGQFKHITGAAVNGRGIHVPNRRLKQIVDDQGVLAKGEFDAETVASLRIKLSGRIASASAISRKTAAWLKRRDVYNPKGRRGAITAG

SEQ ID NO: 3112 - protein, 320 aa, unidentified
  source 1..320: note = Related to VCIZ01000019.1; note = Cupriavidus campinensis
MNKRRLALKKRLRANKQARYSLEGCALFGVTEMSVLSRLLQADNKSLRLTCKAPEFAVWVDTTKPLKPRNIQDPRGITERLHYRLCELLDRVVKPDFLHSATRKRSAITNAARHISKAPCVTTDMKSFYEVTTTQQVAAFFREDLHMAPDLALKLAQLCTVNGHLPTGSPLSPLLAYWAHRRTFGQLYEMSWSAGIVMTVYVDDLAFSGEHASLAFLHIVKQILRRRGLHTHKDKSFGAGQFKHITGAAVSSKGLHVPNGRLKRIVDGIDELTVVSDPAQQADLRRRLVGRIASASAISRQIGNALKRRHIQSAESAVTD

SEQ ID NO: 3113 - protein, 312 aa, unidentified
  source 1..312: note = Related to JADMJX010000176.1; note = Rhizobacter sp.
MNTPRDPYALESSPFFRLTSIHELAKLLRLTVGQLRQECLHPAFAPMRVVRKPGPRSKTRNVSPPLKTTLLLHQRLLRFFDRVRRPPYLHSATRRRSHVTNAAAHSGQRHLVKADIRKFYESTTYSHVVAFFHHELQMAGDLARLLARLCTREGRLAMGSPLSPLLSFWVHKKMFDRLDALSRQHRLRFTAYFDDLTISGNRITESFFQTIRRSVAIQGLELKEQRASVVRVRAGVEVTGAWLSRGALFVPQPAYLLARQAIAAVSSAEADELATAIRTAEGHVSASSAIRRGAGKALNRLMARAIHAKKPL

SEQ ID NO: 3114 - protein, 341 aa, unidentified
  source 1..341: note = Related to SOCA01000009.1; note = Prosthecobacter fusiformis
MIGHSQIMILSKTRADEDIKISKLYFVGTKKRLATVLKSNPSVLRRLAKTGDANYQHIFVTSRGKKRAVQNPNPELKEIQVRINQLLQRINYPEYMMAGLKGLSYEKNASAHLGLESTRVCTVDIEKFYPNCQRGAVIRSLEKWFNQKHDVAVQLADLVCLNGHLPTGGPASLLFSFWSNRDVFDEIKLAADAHGLKMTVYVDDMTFSGENAGLKFLHDCVLPVLKRAGLRGHKIKSYHKSCPQEITGIILNKGKLCLPYRRFKDIDKNILALNAARKPVARLKLINSLVSRLYSVSAFFPKCKTKAKAMGKKQKALLSKFPYLKLRHRFGKQAASLKTGR

SEQ ID NO: 3115 - protein, 313 aa, unidentified
  source 1..313: note = Related to NZ_MUAV01000008.1; note = Rhodovulum viride
MPKTQPEEGYQLKDSPFFRLRSRKQLAKLLRVSADTLDEISHRHDLYVRRWKHKKLKDDEKGAWLKHPPTPEQAENYRPIDIPDPQLKAMQGRIGDLLGRVKAPEFLFSPVKGRSYVENAAHHKEAKAFWLLDVADYFPSCSANNVARFFHRELECSRDVTAVLVHVATLGGCLPQGSPCSPILAYYSNSHIWLAVEKLVRAKGCKLSLYADDITISGDVVPKALIWEIKKLIFGNGLRLKTSKEVSLINAPADITGVIVKDGATHLPNRQLKRLAELKQERANTTNPKLQQRIDNQIAGRLSQRKQVENPKT

SEQ ID NO: 3116 - protein, 313 aa, unidentified
  source 1..313: note = Related to CP046620.1; note = Rhodobacteraceae bacterium 9Alg 56
MPKKQSDGGYHLKDSPFFRLRSRKQLAELLRVSANTLDEISHRSDLYVRRWKHKKLKDHERGAWLKQPPPPEKAESYRPIDIPDVQLKAMQKRIGDLLGRVKAPEFLFSPVKGRSYVENAAHHKESKAFWLLDVADYFPSCSANNVAHFFHRVLECSRDVTAVLVHLVTLNECLPQGSPCSPILAYYSNSHVWLAVEELVKARDCKLSLYADDITISGDVVPKALIWDIKKLIFGNGLRLKDSKEVSLINAPADITGVIVKEGGTHLPNRQLKMIAELKQLRARTTNPKLRGRLDEQISGRLSQRKQVENPKT

SEQ ID NO: 3117 - protein, 309 aa, unidentified
  source 1..309: note = Related to NZ_BMXE01000001.1; note = Pseudovibrio japonicus
MRKTQLKDGYQLRDSPFFRLANRKKLSTLLRVSEETLKALSTSQDLYTRRWKHKTKKDKEVDAWKNYIPENADEYRPIDIPIPKLKATQNRISDLLSRVQAPDFLFSPVKGRSYVENASHHVEGTAFWSLDVADYFPNCKANNVARFFRRDLECSRDVTAILVALTTLNKCLPQGSPSSPILAYYGNSHMWLKVADLVASYSCKFSLYADDITISGPIIKKELIWKIKKIIHANGFLLKPSKEISLIHAPADITGVIVKQGKTHLPNRQLKRLAELKKERAHTKNPASQAVLDNQISGRLGQRRQVERV

SEQ ID NO: 3118 - protein, 308 aa, unidentified
  source 1..308: note = Related to FZOV01000003.1; note = Luteovulum sphaeroides
MPLKLGYRLVDSPFYKLKSRSKLARLLRVSTETLDQLSSGRMLYARRWKHKKLEKWLCQPPSEDAADIYRPIDIPDPCLKAVQSRIASLLSRIHPPDFLFSPVKGRSYVENAARHVGSEAFWLLDIADYFPSCAANKVARFFRSDLDCSPDVSAVLVRLTTHNECLPQGSPCSPILAYYCNRPMWLAIEKIVTDAGCKLSLYADDITISGDVVRKSMIWEVKKIVHGNGLRLKASKEVSLIKSAADITGVIVKPDGTHLPNRQFKKLAELKALHSTTVNPKDKARIENQISGRIAQWRQVESFRIAPD

SEQ ID NO: 3119 - protein, 311 aa, unidentified
  source 1..311: note = Related to NZ_LJSC01000031.1; note = Gemmobacter sp.
MQKTPPRQAYQIKDSPFYKLSSRRKLASLLRTSSDTLAELASGKPMYVRRWKHKKLDQWLREAPSTTDADVYRPIDIPDPRLKAVQSRIAALLARIEPPDFLFSPVKGRSYVENAARHVGSKAFWLLDVADYFPSCTANNVARFFHRDLLCSEDVTAVLVKLVTLRECLPQGSPCSPILAYYCNRPMWLAIESCVKASGCKLSLYADDITISGDVVRKEMIWEIKKIVHGSGMRLKASKEVSLISAPADITGVIVKPTGTHLPNRQLKKLAELRKLHTLTTNAKDKARIENQISGRVAQRRQVESFQPSNE

SEQ ID NO: 3120 - protein, 311 aa, unidentified
  source 1..311: note = Related to NZ_SCMU01000003.1; note = Sphingopyxis sp.
MPLRHSATPYTLRDSPFFRLRTRKKLATLLRVSEAALADISARNDLYVRCWKHKKDKDIWLREQPAPDIAAHYRPIDIPDSGLKAVQSRIAGLLSRITPPDWLFSPVKGRSYVDNAASHKGARAYWLLDIADYFPSCSANNVAHFFNRKLECSPDVTAILVHLTTWQQCLPQGSPCSPILAYFSNLDLWQEIEQSVMQAGLKHSVYADDITISGQMIRKELIWEVKQSVHKHGMKIKADKELSLIDSPADITGVIVVGDRTKLPNRQLKRLFELRAERHRARDAIKKRLLDNQISGRVAQKRQVEQAYNAK

SEQ ID NO: 3121 - protein, 307 aa, unidentified
  source 1..307: note = Related to NZ_RWJI01000001.1; note = Sphingorhabdus wooponensis
MPTRHRAVPYTLRDSPFFRLRRRKDLAKLLHVSETTLATIASRNDLYERCWKHKKLKNNWLDDEPSADIAHLYRPIDIPDGGLKAIQSRIANLLGRITPPDWLFSPVKGRSYVGNAACHRGSKAFWLLDIADYFPSCTANNVAHFFQRKLECSPDVTAILVHLTTLQQCLPQGSPCSPVLAYFSNLDMWREIEQSVSKAALKHSIYADDITISGPIVPKKVIWEIKQAIHKHGMKIKADKELSLIDSPAEVTGVIVVGDRTKLPNRQFKRLFELRGERHRERSKTLMRLLDGQIAGRVAQRRQVEQF

SEQ ID NO: 3122 - protein, 300 aa, unidentified
  source 1..300: note = Related to CP060122.1; note = Sphingobium yanoikuyae
MSYELRDSPFFRLKTRKKLAATLKISEMALNTLTVRTDLYVRKWKHKKEKDKWLETPPPPGESHLYRSIDIPDSDLKAVQSRIAKLLSRVTPPDWLFSPVKGRSYVDNAARHRGSIAFWLLDIADYFPSCTANNVAHFFRTRMECSPDVTAILVHVATWHQCLPQGSPCSPILAYFSNLGLWEEIESAVIEAGLKHSIYADDITISGAIVRKKVIWEIKRSIHKHGFKIKAEKELSLIHRPADITGVIVAGDDTKLPNRQLKRLFDLRAERHKAKGKLLISQIDNKISGHLAQKRQVERT

SEQ ID NO: 3123 - protein, 313 aa, unidentified
  source 1..313: note = Related to NZ_JPDP02000039.1; note = Sphingomonas sp.
MLPLPNGSQYALRDTPFFRLRSRKKLAEILLVSDAALQRVLNEENLYERRWKHKKEKDSWLNFEPKPEVSHFYRPIDIPDKGLKSIQSRIAKLFAKVTPPDWLFSPVKGRSYVNNAARHVGARAFWLLDIADYFPSCTDNNVAHLFHTRLECSPDVTAIIVKLITLCGCLPQGSPCSPIMAYYSNHTMWLKISEIVTDSGLTHSVYADDITISGNLIKKEVIWNIKATVHKHGLRIKAEKELSIIDSPADITGVIVKGGRTMLPNRQLKRLFELRGERQRAKGSLAKAALDSQIAGRLAQQRQVEHQYRHPPS

SEQ ID NO: 3124 - protein, 312 aa, unidentified
  source 1..312: note = Related to NZ_CP032125.1; note = Profundibacter amoris
MLKETTINTYSLRDSPFFRLRSRKKLAQLLRVSPKTLSEISQREDLYSRYWKSKKGDVWLKSPPDEVDADKYRPIDIPVHRLKSLQARIAKLLSRITPPEWLFSPVKGRSYVDNAAYHKGAKAYWLLDIENFFPSCSGNNVVHFFSSKLECSPDVTAILVHITTILDTDTDRVGLPQGAPCSPILAYFSNLDMWAEIESIVKRASLKHGVYADDITISGGMVPKAAIWEIKKAIHKHGHKIKAAKEVSLIHAPADITGVIVAEGKTKLPNRQWKKLNELRAARSVAKGSKLKQRLDNQISGRIAQKNQVEQS

SEQ ID NO: 3125 - protein, 310 aa, unidentified
  source 1..310: note = Related to NZ_JAGGJV010000004.1; note = Rhizobium herbae
MPRKAFPFHKLEASALFNVRTRKKLADILMCSPAHLKSVDAIEIRYKKRWKPKDSDTAPWLKQPPPAEKAGNYRPIDIPVDPLKKLQTRIANLLSRIEPPSYLCSPVKGVSYVDNARRHVNSNAFWLLDIADYFPSCTADRVAWFFSTVMKCAPDVTAVLVSLVTDSGRLPQGSPCSPILAYFSNKKMWDDVAEAVASAGCILSVYADDITLSGTTVPGALVWEVKQIIVKNGFKLKREKEVSLVGSPADITGVIVRNGTLKLPNRQLKKLAETKKLHKLATDKVTLIKLEHQVKGRLAQRRQIEEALKP

SEQ ID NO: 3126 - protein, 307 aa, unidentified
  source 1..307: note = Related to JAGIPO010000002.1; note = Agrobacterium tumefaciens
MRRKAFEFHNLEASALFNVRTRKRLAEVLLCSPAHLKAVCEIAIRYKKRWKPKDSDTAPWLKQPPPAEQTANYRPIDIPIDPLKKLQARIANLLSRIEPPEFLCSPVKGVSYVDNAKRHINNNAFWLLDIADYFPSCSSNRVAWFFNTVMKCAPDVTAVLVSLVSENDSLPQGSPSSPILAYFSNKKMWDDVALAVANSGCTLSVYADDVTLSGTTVPGALVWRVKQIIVKNGFKLKREKEVSLIGSPADITGVIVRDGTLKLPNRQLKKIAEIKKLHTNATNSRLAIKLENQLKGRLAQRRQIEEA

SEQ ID NO: 3127 - protein, 309 aa, unidentified
  source 1..309: note = Related to NZ_LMPE01000005.1; note = Rhizobium sp.
MSHRAVKSHDLRDSALFNIGTRKKLASVLLCSPDHLNLVQKLEVKYKKRWKPKDSDTAPWLTQPPAPHEADCFRPIDIPVDPLKKLQGRIADLLSRVKAPPYLCSPVRGVSYVDNARAHIEGSAFWLLDIADYFPSCTANRVAWFFRTVMKCAPDVTAILVAIVTDSGRLPQGSPSSPILAYFSNLKMWGEVAALVHRAGCILSVYADDITISGKTVPGALVWNVKQTIVKNGFRLKREKEVSLVCCPADITGVIVRNGSLKLPNRQLKKIVETKKLLRASTDKMTADKLKTQIAGRLAQRRQIECASC

SEQ ID NO: 3128 - protein, 308 aa, unidentified
  source 1..308: note = Related to JAILYH010000012.1; note = Rhizobium sp.
MPRKSFRFHKIEDSALFNVSTRKKLANVLMCSLPLLKAVEGLDVRYKKRWKRKDSDTAPWLTQPPPPDQATQYRPIDIPVDQLKKLQARIADLLSRIETPPFLCSPVKGVSYVDNAGRHVNNRAFWLLDIADYFPSCSADRVAWFFGTIMKCAPDVTAVLVSLTTDMNRLPQGSPCSPILAYYSNMKMWHDVATLVAGAGCILSVYADDITISGKTVPGSLIWQVKQVIFRNGFKLKHEKELSLMASPADITGVIVRDGKLKLPNRQHKKIVDLSKQQKIATDTKLLAKIESQIRGRLAQRRQIEEAI

SEQ ID NO: 3129 - protein, 308 aa, unidentified
  source 1..308: note = Related to JABDWX010000001.1; note = Rhizobium bangladeshense
MPPKPRQFHKLNDSALYQVSTRKKLAEVLMCSPQDLKDVLALSVRYKNRWKRKDSDTAPWLTHPPAPDEASNYRPIDIPVPPLKKLQGRIADLLSRVEPPEFLCSPVKGVSYVDNARRHINSHAFWLLDIADYFPNCRADRVAWFFRTKMKCAPDVTTILVALTTDKDRLPQGSPCSPILAYFSNMRMWRDISTLVTNAGCVLSVYADDITISGSKVPGGLVWQIKQTIHKNGFKLKRDKELSLIASPADITGVIVQNGQLKLPNRQRKKLVELVSQQKATSDKKLLAKLDNQIQGRIAQRRQIESVD

SEQ ID NO: 3130 - protein, 309 aa, unidentified
  source 1..309: note = Related to VIUA01000006.1; note = Rhizobium sp.
MPPKQQRHFYKLQDSALYNVTTKKRLAEVLLCSPDDLKNVLATKVRYKNRWKPKDSDTAPWLTQPPPPEEAANYRPIDIPIPSLKRLQARIAYLLSRIEPPSFLFSPVKGLSYVDNARRHVGSRAFWLLDVADYFPSCRADRVAWFFRTEMKCAPDVAAILVALTTDKERLPQGSPCSPILAYFCNMVMWNDIATTVENAGCVLSVYADDITISGANVPGQLIWQVKKTIHKNGFRLKREKELSLLDRPADITGVIVRNGQLKLPNRQLKKLVELVEKHKSETKKKELAKLFNQIQGRLAQRKQVENAN

SEQ ID NO: 3131 - protein, 308 aa, unidentified
  source 1..308: note = Hyphomicrobiales bacterium; note = Related to NZQL01000081.1
MRPGHRIVDSALYKVRTRRRLAELLFTEVGFLESLEKNQPKYVVKYKPKYDDKAPWLAMPPPPELADNYRPISLPPTALKRLQARLAKLLGMITVPPYVFSSVKGVSYVDNAAVHVGARAFWLLDIEAFLPSCTAERLTWFFRDKLQCSPDVAAILVEIVTFDGCLPQGSPCSPILSYFCNARMWSDIYQLAGEYGCTLSIYADDITLSGAVVPKKLVWRIKEVLKNNGFRTSRSKEVSLVNAPADITGVIVRDNKLFLPNRQFKKLRVELAKRRDAKTSIEKRKIDNRIAGRKAQARQIEKHSKSGR

SEQ ID NO: 3132 - protein, 305 aa, unidentified
  source 1..305: note = Proposed Citromicrobium bathyomarinum; note = Related to NZ_JAINWL010000001.1
MKVASLRGNALFRISNRRLLAERLLLKPEALAAALNLDLPYVRRWKSKKGDEWRSEEPDADEARAFRPIDIPHPHLKQVQRRIGRLLSSARPPDWLFSPVKGRSYVDNAARHLGSTAFCMLDIADYFPSCTTSAVAGMFLNELHCPPDVASILTSLVTKDGSLPQGSPCSPVVAFYSKVGMWNEIARLVDERGLIHSVYADDLTISGPVIPGEAVWGVKKIVHKHGMRLRRDKEVGLFCRPADITGVIVTNGGLRLPNRQFKRLAELRAQRQASREKEREMIDRKIAGRIAQRRQVEGHDGQSAP

SEQ ID NO: 3133 - protein, 316 aa, unidentified
  source 1..316: note = Related to NZ_QBFD01000015.1; note = Sulfitobacter sp.
MASSSNATENASSLFGCQRKRDFAKILGITRGRLRWLANQKNEYPEGKTANSLYTRLWKPKRGEGKWLRVEPLPEVASNYRPIDELKVLQRHLHDDLSNIEVPAWLFAPALGKSYVDNAAAHSGSSHFHLLDLEAYFPSCRSHRVYDFFRRKLHCSSDVAELLTHVSTLGGSLPQGSPSSPILAYLSNVDVWNNIADLCRSEGVTLSVYADDITLSSHKSISGELVWNIKSALYSKGLGTKKSKEASMVHKAADITGVIVGKQGVRPPNRQVKRLKELEEVASQRPNNEVLVRKIRGRRAQLNQIASASSNPAAKK

SEQ ID NO: 3134 - protein, 324 aa, unidentified
  source 1..324: note = Related to NZ_SJFN01000052.1; note = Siculibacillus lacustris
MNPNMGYTERESPFFRLNSKNKLAKLLFIGLPKLKELAAGADLYYSFQKVKKSGGMRMISAPRDDLKKVQKRISDLLQRIAPPDFLFAPVKGRSYVDNAAVHIGATAVHLLDIEDFFPSCTANKVIWFFKTRFECSPDIAVILKNIATRNGSLPQGSPCSPALAYFCYVDMWKEIEAHVKQRGCKLSVYADDLTISGDVVPGELVFDIKATMLRHGHQYSAKKERSKIMKPVEITGVIVANNQLLIPNRQHRSIVIAQRKLGKEKKLRERLKITNELKGRNAQKNQIKNHPGQPTTDAIPTPTGYYQSTTRSTSSSVTSSDRRS

SEQ ID NO: 3135 - protein, 308 aa, unidentified
  source 1..308: note = Hyphomicrobiales bacterium; note = Related to RXIY01000013.1
MRNPRRRKTTDMAVKGGYQERDSPFFRLKSKTKLATFLFIGSQKLKDLSDGRDLYRSFQKLKGNGKTREINAPRDDLKKVQRRIADLLQRIQPPDYLFAPVNGRSYVDNAAVHVGANAVHLLDIEDFFPSCTANKVIWFFKTRMECSADVSVILKNIVTRKGCLPQGSPCSPILAYLCYADMWNEIEEAVRRHHCQISVYADDLTISGKVVPQQLVWEIKATLRKHGHVISAHKERSRFKRPVEITGVVVTNGRMSVPNRQLKRIVETRDKLANEKKPKAVEKLQNELKGRISQVTQIKNHPRQPAHY

SEQ ID NO: 3136 - protein, 304 aa, unidentified
  source 1..304: note = Related to WBUK01000026.1; note = Ignavibacteriaceae bacterium
MLRKKPVLKSKSKKYHNERDSAFFRLRSKNNLARLLFSSEKKLSDIAREDGLYKDFEKLKKNGKDTRTVSAPRADLKAVQSRISDLLMRIRPPDWLFSPVKGRSYVDNARPHANAASVRLLDIEDFFPSCTGNKVVWFFKERMECSPDVVAILKGIVTKDDALPQGSPCSPILAYLCYIDMWEEIESLVNKAECDLSVYADDLTISGEKVPEKMIWGIKQILKRHGHSYHAGKERKKWHKPAEVTGVIVRGDGLLFVPNRQHQATAKIRKKLASKCSIKERAALQAQLLGRESQMKQITTLNDF

SEQ ID NO: 3137 - protein, 302 aa, unidentified
  source 1..302: note = Related to CP055265.1; note = Agrobacterium vitis
MTDRRKYSLRDSPFFRLRSKAKLASLLYVSREKLQTLSEGEQRYFEFTKPKKSGGVRKISAPNAPLKAVQSRIADLLRRVTPPDYLFAPVPGRSYADNAAFHVGARSVRLLDIEDFFPSCTVKKAIWFFRTRMECSEDVAAILANIVTFKGALPQGSPCSPILAYLCYLDMWGEIAKLVEDGGCKLSVYADDLTISGVSVPEAQIWEIKKTLYRHGHRYARSKERSVRDKSVEVTGVVLLRGSVVAPNRQHAKIAKVRDELTRTASADHRKALESQLRGRLAQVGQIKAADQRRRASEAAKI

SEQ ID NO: 3138 - protein, 303 aa, unidentified
  source 1..303: note = Related to WGNU01000009.1; note = Alphaproteobacteria bacterium
MKKVESQGYALRDCGLYNIQTKAVLAKRLLVSPSRLTRLTNKQDRYRCWTEPKKSGGTREIEAPLDDLKDVQKRISELLGRVRAPSYLMAPVKGRSYVDNAAIHVGSQCFRLLDIEDFFPSCTEKRVFWFFRTVMRCSVDVAAVLARLSTRNGRLPQGSPCSPILAFYAYFDMWETINATVESRKCYLTVYADDITISGESIREFDVWRIKQTLFKFGHRYNRSKERAIINRPADITGVIVRGDILLLPNRQHKALTEVIRKRSSAGTSLERNAIDRQIRGRIAQAGQITRHLEKIGAKIASA

SEQ ID NO: 3139 - protein, 300 aa, unidentified
  source 1..300: note = Related to WTYX01000002.1; note = Pontixanthobacter aquaemixtae
MSKTKKPWRRKAKKFYPLEASPFYKLQSKKRLASLLFTSLTALRGMADKSVPHYEYWEEQKADGSMRPLCRPHEGLDKTQSRIAYLLACVQTPDYVHAPVPAKTYVTNAASHQGARAFSLLDIESFYPSCKEEKVLAFFRHRMKCSIDVSTLLARLCCDNGSLPQGSSSSPILSYWAYAEMWDAIYTITSNAGNNFTLYLDDLTISGDRVLGNTLWRIRQQIHKHGLQIKESKSRRIIDKPADVTGVIVTNQGLRLPNRQHQKLAHAKSDFSKPGGNRKRKGNVLRGRNAQAVQILNHNS

SEQ ID NO: 3140 - protein, 312 aa, unidentified
  source 1..312: note = Related to NC_016587.1; note = Azospirillum lipoferum
MTKKIKSYPLDQSPFYKLTTKRKLAELLRLPLGRLKRIALLSPNMYNEWIQENAKGKKRQIEDPARPLKLAQGRIANILSSISAPNYLHCPVKGRSYISNAAEHIGAKHIRNIDISNYFPSTKSTRVYWFFNTILKCTPDVSGILTALTTYKGHLPCGSPASSILAYFAHYDMWQSIDQIVSENGCKLSVYMDDITVSGEMVTERVIFQVRRCIFRAGLQPKKEKERWYRHGIGIVTGIVVRPSGLSAPNSAHLKRFTLRRQIASSCNESEKSSLRRSLKGIEGQQSQIDRWNRRLHNSKSNAKEHVNLKPN

SEQ ID NO: 3141 - protein, 309 aa, unidentified
  source 1..309: note = Related to NZ_FXAK01000010.1; note = Azospirillum oryzae
MKTKKIKNYPLDQSPLYKLTTKRKLAELLCLPLARLKRIATLSPNMYNEWTQEKKNGDLRTIEDPARPLKMVQSRIAKILSSISAPEYLHCPVKGKSYISNAAQHIGSKHIRNVDISNYFPSTKSRRVYWFFHNILKCSPDVAGLLTTLTTYKGHLPCGSPSSSILAYYAHYDMWQNIYQIVSESGCKLSVYMDDVTVSGGVVTERVMFQVRRCIYRSGLQPKKEKERWYRRGIGIVTGIVVRSGGLSAPNAAHLKRFKLRNKLATSSNDEERITLQKSLRGIDGQQSQIDKWNRRLNTSTKSVRADLQ

SEQ ID NO: 3142 - protein, 303 aa, unidentified
  source 1..303: note = Related to NZ_CP029353.1; note = Azospirillum thermophilum
MTTKTKSYPLNQSPFYKLTTKRKLAELLRLTPAKLRKLSALSQDLYREWPQTNLKGKTRLIEDPAPALKEVQRRIYRLLSCITPPYFLHCPVRGRLYISNAAYHVGSRHFRNIDISDYFPSTKSRRVNWFFRRILKCAPDVSGILTELTTYKGHLPCGSPASSILAYFAHCDMWEQIARIASENGCKLSVYMDDLTVSGDVVPDRVMFQIRQRIYRAGLQPKKEKEKWYRRGVGVVTGVVVRPSGLSAPNSAHLKRFKLRCQLATASSADERATLQNSLRGVEGQQSQIDRWNSHFTSYNAEE

SEQ ID NO: 3143 - protein, 313 aa, unidentified
  source 1..313: note = Related to QDKQ01000014.1; note = Caulobacter sp.
MLSLGRKLMATLPRTHPIKQSPLHKLGHHKRLASLLKIEVAQLRGLAKAGSAAYSEWDEDKPNGGTRRIENPKPRLKRLQSRLATILSLIDPPAFLSCPVKGRSYISNARAHLGSKEFVTLDVKSYFPSTTWNRVYWYFNKRLLMPRDTAWTLASVATIDGRLPTGSPLSPIMAYLAHEDMWLKVAKLAEDVGCRLTVYMDDITISGARVPEATVWKIKQEVHKVGLRLNDKKERRFSDVGVITGVVVTPDGVRLPKRSHLNLSIARKAALVVDGEAKLRAMRRVRGLEAQHRQVLAPTDFTDNLSGSHRGSS

SEQ ID NO: 3144 - protein, 302 aa, Nodularia sphaerocarpa
  source 1..302: note = Related to NZ_CP060140.1
MQKSKYARYELDQSPFYCLKSKAKLAELLHISQSKLKCLTCTEDLYVERDTFNPGRRKSRRIEQPKLPLKLVQKRIEELLKRIKLPNYIHSPGKGRSYISNAKAHVNAKELRILDIEKYFTSTPARRIYWFFHKQMKCSPDIAGILTKLSTFKDHLPTGSPSSPILSYFSHIDMWEEINRIVEPNNCILTVYMDDVTISGEHVPGELIWQVKKQFKRYGLRSNKKKEKHYIGKKSYEVTGVITTQSGELRVPNRQHLQMRNIRRLISLESEPEKLAKLRRSLKGLEAQSEQIRRANSLLTET

SEQ ID NO: 3145 - protein, 302 aa, Nostoc sp.
  source 1..302: note = Related to JABXKF010000035.1
MRKSKYARYELDQSPFYCLKSKAKLAKLLRVSQIKLKLLTNTEHLYVESDIFDPERGKSRRFEKPRQDLKCVQTRIEELLKRIKVPNYIHAPAKGRSYISNAKAHVNSTEVRSLDIEKYFPSTPARRIDWFFRKQMKCSSDVANILAKLSTFKDHLPTGSPSSPILSYFAHIDMWKAINEIVDLANCTLTVYIDDVTISGDRVPGELIWQVKKQFNRYGLRSNKKKEKHYIGKKSYEVTGIIATKEGELKIPNRQHLKMYRCRKLLKLGIRYEKGKDMLKRLRGLKAQMQQIRKVNNSSIET

SEQ ID NO: 3146 - protein, 301 aa, unidentified
  source 1..301: note = Related to JACJOI010000059.1; note = Coleofasciculus sp.
MPRIKQAGYELNQSPFYCLKSKKNLASLLQISQSKLNNLTRSEELYIEENRFDKKRGKIRHIEEPKPDLKRVQKRIKNLLTRIQLPNYVHAPAQGHSHIGNAKAHVGAVVVRSLDIEKYFPSTPAKSIFWFFYKQMKCSSDVAGILTKLSTFKGYLPTGSPLSPILSYFSHIDMWETIGEIVRNASCTLTLYMDDVTISGNSVSGELIWEVKKQFHHCGLRSNKKKEKYYFRKNSYEITGIIVTKEGELKVPNRQHLKTHQIRQELHCETEPKKCKKLRQRLQGLEAQIQQVKRVNYPLPE

SEQ ID NO: 3147 - protein, 306 aa, Nostoc sp.
  source 1..306: note = Related to BA000019.2
MPVLRIKKIGYKLDQSPFYCLQSKAKLATLLGVSRSRLIQLARSESLYIEKEIIHPRRKKSRLVEKPKYELKLIQKRIEGLLKRIEIPKYIHAPTKGRSYVSNAKAHLNSYVISSLDIVKYFPSTKSKRVYWFFHTRMKCSPDVAAILTKLSTYKEHLPTGSPLSPILSYFAHIDMWEEINNIVEDAGCILTVYMDDVTISGDYVSRNLIWQIKKKFHRYGLSSNTKKEKYYIGKNSRKITGVILDFEKGVLKIPNRQHKKMYSIRKQISKETHPDTYAHLMSKLKGLKSQVQQIHKANNTQTNEN

SEQ ID NO: 3148 - protein, 306 aa, Nostoc sp.
  source 1..306: note = Related to JABXKI010000057.1
MQRSRCKQYTLDQSPFYCLKSKEKLAKLLYITQRKLEVLAHTEELYIERDKFNPKKGKTFRVEEPTPPLKRVQKRIDEILKRVKMPNYIHAPGKGRSYISNARAHINVAVVRSLDIKQYFPSSQSWRVYSFFDKRMRCSSDVAGILTKLSTFKKHLPTGSPSSPVLSYFAHIDMWEAINELVEGAGCTLTVYMDDVTISGSSVSDELIRKIKREFDRCGLRDSRDKEKHYVGNKPREITGVIVKDGELKLPNSQHKKMHDCRQAIQLETDPAKLAHLMQSLKGLESQAQQIRKANEIRVDNGCNDL

SEQ ID NO: 3149 - protein, 303 aa, Calothrix sp.
  source 1..303: note = Related to NZ_KB217482.1
MKKDKCKQYPLHQSPFYYLKSKDKLAKLLHISQKTLEILTSTEQLYIEQDRFNLKKKKFFRVEEPKPLLKQVQKRIGELLKRIEVPNYIHAPAKGRSYISNAKAHINGFVVRSLDIEKYFPSTQSQRVYWFFHKQMECSSDVAGILTKLSTFKNHLPTGSPSSPMLSYFAHLDMWKAINELVESAGCVLTVYMDDVTISGSFVSGKLIWLIKKEFYRCGLHDSRKKEKHYVGNKPRETTGIIIDNGQLMLPNSQYKKMHECRQAIRQETDADKRYILMRTLKGLESQAQQIRKANETYIDTEC

SEQ ID NO: 3150 - protein, 307 aa, unidentified
  source 1..307: note = Related to NZ_QAYE01000001.1; note = Sphingomonas faeni
MPTKRLYQLNQSPLFKLGSRSKLAKLLGMTPGALRALAAGDGLYKEFEVEKKSGGKRGVENPCRPLKLAQATLARLLGRIQPPDFLFCPVKRRCYVTNAAAHRHSRMVQCLDIKKFFPSVSQRRVFWFFATVMKCPRDVAGLLAQLACYKGHLPTGSPLSPIMAYFAYYDLWAAIDALCKARGYTFTVYIDDVTISGTHVPKSAIWEVQQMIHGAGLRYHKQKTFVDKPAEITGIILKDGQLLAPFRQHRKLKDTRAALRAADPVDRKALKSRLTGVTAQIGQIERQNLCAPQRKGGSTKIYRLSEV

SEQ ID NO: 3151 - protein, 300 aa, unidentified
  source 1..300: note = Related to JABMLM010000386.1; note = Microvirga sp.
MRTNAKLYKLDQSPLYKLRSRAKLARLLGVSVADLRRLTKNADSLYKEFEIRKKNGEMRPVQNPERYLKVVQGRLAKVLARIAPPDYLYCPVKGRCYVSNAGQHRGNRDVRCLDIRRYFPSTPSRRVYWFFRSVMGCEKDIAATLARLATYKGCLPTGSRLSPIMAYYSHIDTWDAIACICKEKGYRLTVYIDDVTISGQSVDPDDIWRIKQVIHRSGLRYHKEKAYTDRPPEITGVIVDGERLIVPNRQIAKLAKTRKSLSSTTDPEELKKLHDKISGLRGQMAQVAIKALELPQLSTT

SEQ ID NO: 3152 - protein, 334 aa, unidentified
  source 1..334: note = Related to CP026002.1; note = Stenotrophomonas sp.
MTLPRKSANRYDVSSSALYRLPTLKALARFLEWKGSPSALRALCKRPDNFSEFYQAHPRTGKMRLIQAPSKVIKPLQKRLNVLLKQVRVPDYLHSGIPKRSHLSNSEQHMLAAGATVTVDVSDFYPSITRQRVFRLFKNVFQCRGDVADAMADLVCYQGKLATGSPASVLVSFWACRDMFDSMAQRVATQGGTFTLYVDDVAITGDTIGHGDIQWLDRLLRRFGFSSKVEKAKLFRKTRAKVVTGRAFRHGISRAPNRKHKEMHEARAEIESGRATIKAKRGLVGQLENIGNLDQERGTSLKAEAKKLRSTLPRPRRRRRATARPVKTRSEIAT

SEQ ID NO: 3153 - protein, 334 aa, unidentified
  source 1..334: note = Related to JAJGQF010000003.1; note = Xanthomonas campestris
MSLPRKSANRYEVTSSAFFRLPTLKALARLLQWEGSPSALRALCKRPDNFTEFPRIHPRTKKERVIQAPSDVVKPLQKRLNVLLKQVRVPDYLHSGIPKRSHLSNSESHMWAEGATVTVDVSDFYPSITRQRVFRLFRNVFECPGDVADAMADLVCYKGKLATGSPASVLISFWACRDMFDMIADRVATLGGTFTLYVDDVAITGNTVGHGDIQWLDRLLRKFGFSSKLEKAKLFRKDSAKVVTGRAFRHGISRAPNKKHKEMHEARTEAKSIGASVKVRRGLVGQLENIGNLDHERGTSLKAEAKKLRSTLPPPRRRRRAITRPNHISPEAAT

SEQ ID NO: 3154 - protein, 334 aa, unidentified
  source 1..334: note = Related to NZ_AP021867.1; note = Stenotrophomonas maltophilia
MTLPRKSANRYDITSSAFFRLPTLKALARVLQWDGTPSALRALCKRPDNFSEFYQTHRRTGKKRLIQAPNAVVKPLQKRLNVLLKQICVPDYLHSGIPKRSHLTNSECHMLAEGATVTVDVSDFYPSITRQRVFKLFRNVFQCPGDIADAMADLVCYNGKLATGSPASVLLSFWACRDMFDLIAKRVADQGGTFSLYVDDVAITGNTIGHGDVRWLDRVLRRFGFASKVEKAKVFRKASAKVVTGRAFRDGISRAPNRKHKEMHESRNLVKGTSASTKVKRGLVGQLENIGNLDQKRGKALKAEAQKLRSTLPPARRRRRSAALPTAISAAEEA

SEQ ID NO: 3155 - protein, 336 aa, unidentified
  source 1..336: note = Related to CP049368.1; note = Stenotrophomonas maltophilia
MTLPRSSANRYDVPSSALFRLPSLKALAKVLQWGGNPSALRALCKRPDNFEEFYRTHPRTKKKRLIQAPSDQVKPLQRRLNVLLKQLRVPDYLQSGIPKRSHLSNSELHMRAEGATVTVDVSDFYPSIKRKRLFRLFRNVFECRPDVADALADLVCFNGNLATGSPASVLLSFWACRDMFDMVAERALSQGGTFTLYVDDIAITGNAIGHGDIRSLDRLLNKFGFNSKKEKAKLFRKADAKLVTGRAFRDGVSRAPNKKHQELHETRKQLRDTTASIRLKRGAVGQLENIGNLDARRGSSLKAEAKKLRTTLPPPRRRRRSSSALPLEAGILDPKA

SEQ ID NO: 3156 - protein, 322 aa, unidentified
  source 1..322: note = Related to MIGU01000085.1; note = Xanthomonas arboricola
MTLTRKSANRYDVSSSALFRLPSLKALASALLWPGTPSALRALSKRPNNFQEFNRVHRRTGKARKIQAPCEEVKPLQKRLNLLLKQLRVPDYLQSGIPGRSHLSNSGKHMTAEGATVTVDVSDFYPSITRKRVFRLFRNVFQCEPDVADALADLVCFNGHLATGSPASVLLSFWACRDMFDVIAERTSLSGATFTLYVDDIAITGDKIGHSEILFLGRLLKDFGFSSKEQKAKLFRKREAKVVTGRAFRDGVSRAPNKKHKELHESMRQLREHKATVKERRAAVGQLENVGLLDEKRGALLKAEAKKLRSTLPPSRRPKRLP

SEQ ID NO: 3157 - protein, 311 aa, unidentified
  source 1..311: note = Related to RRYK01000010.1; note = Pseudoxanthomonas sp.
MAKKERLPRSLENSGLYRLRTMGALARLLHWKKSPSALRALCSRQDNWDEFDQARPGKKPRRIQAPKPAIKALQRRLNDLLQRIDAPEYLHSGTVGRSYLTNSALHRDAEGATVTVDISDFYPSVTRKRLFVLFRTVFQCSSDVADALAGLLSCGGSLATGSPASALVAFWAAKDMFDGIAERAKRLGGRFSLYVDDITLTARTAGRGDVSFIERHVGRYGFRLARKKSRVYRAGQPREITGRVLRNGQSRAPNKQHRYMHEALSAMGPETPPAEVRSAIGRIQHVGILDDVRSQELMASARRLREKLASS

SEQ ID NO: 3158 - protein, 318 aa, unidentified
  source 1..318: note = Related to NZ_LASZ01000005.1; note = Luteimonas sp.
MIALDQSSRYELELSPLYRLGRTKDLAALLRWRGNPSQLKAFSKRDDHFDEYDQVDPKTLKKRHIEAPKAGLKRLQRRLNALLQRIHAPPYLHSGIRGRSYLTHAGTHTQAEGATLTADISDYYPSVSTERLQQLFRKDFRCSIDVAWILARLLSCRGHLATGSPASAIVAFMANRSIFDELAKRATKRGIAFSLYMDDLAFTGRGVNRSDAAAAGELLIRHGLRIKAKKTRLFHADQPKLVTGVAWRNGIKRAPNAQHKLMREALLVLQRAPREPGHYRTAIGRVQHIAMLDDVRGPQLRKKARELRVGLKALESPR

SEQ ID NO: 3159 - protein, 318 aa, unidentified
  source 1..318: note = Related to CP011800.1; note = Xylella taiwanensis
MNQQTTKPVSTKRRTERYRIASSHLYGIRRHTKLAEILWWAGTAGQLQTFTRQPDNYTRYIDTSKPGKDRLIEAPARRLKGFQRRLLDLLIRIELPDYLHSARPGYSYLSNSAAHCKADGSTVTMDIDSFYQSVTLHRVAQFFEQKLNCAPDVSETLAHLLCCDGHLATGSPASPLLSFWAYHNLFDSINDRVRSRGGVFTLYIDDMAITGNGFGHTDARWVGRLIRRSGLRLKDSKTRVFRADAAKLITGRACRNGVSRAPNKQHRKMREAQAQLEQNPHDLTLRASVAGLKRHLALLDDVKRDQHRADASRISKRH

SEQ ID NO: 3160 - protein, 318 aa, unidentified
  source 1..318: note = Related to NZ_WUSX01000002.1; note = Luteimonas sp.
MSQQTTKPASTKKRTERYGITLSHLYGIRSHTRLAEVIWWAGTAGQLRTFSRRAGNYSRYIDKSKPGKDRLIEAPAASLKGFQARLLCLLSRIELPDYLHSARPGYSYLSNSAAHCNAHGSTVTMDIDSFYQSVKLHRVAKFFESKLNCASDVSETLAHLLCCDGHLATGSPASPLVSFWAYRDLFDSVDERVRSRGGIFTLYIDDMGMTGNGFGHTDARWVGRLMHRSGLRLKDSKTRVFRADAPKLITGRACRNGVSRAPNKQHRKMREAKARLEQNPNDPTLRASVAGLKRHLALLDVKKRDQHRADASRISKGR

SEQ ID NO: 3161 - protein, 320 aa, unidentified
  source 1..320: note = Related to SEHC01000018.1; note = Xanthomonadaceae bacterium
MTLQTKKKAIPLKRRTERYGISSSHLHGIRSHSRLAEILRWGGTAGQLRTYARREENYNRYIEKGKPGKKDRQIEAPEPRLKEFQKRLLDLLNRIELPEYLHSARPGYSYLSNSAAHCNATGCTLTMDIDSFYQSVKVQHVARFFEKALGCSGDVSETMAQLCCCDGHLATGSPLSPLLSFWAFKEVFDAINHRVKSRGGVFTLYIDDIGITGKGFGHTDIIWTTRLLRKSGLTVKESKTRVFHADAPKLITGRACRNNVSRAPNKQHRKMRDAQLKLESNPNDPSLRASVAGLKRHLGLLDDKNRDQHRSEARQILKAR

SEQ ID NO: 3162 - protein, 319 aa, unidentified
  source 1..319: note = Related to CP036255.1; note = Xanthomonas oryzae
MNTPRTKKTTPTQKRTERYAIDSSPLYGMTSHTRLAAILRWAGTTGQLREFCRRPTNFSRYIDRSKPGKERLIEAPAKSAKTFQTRFLELLRRIELPDYLHSARSGRSYLSNSATHCEADGCTITMDIDSFYQSATRERVIHFFEVHLKQPRDVAETLASLLCCDGHLATGSPASPLVSFWAYREVFDAIDERVRSRGGVFTLYIDDMGITGKGFGHTDVGWISRLLRKAGLTVKETKTRVFHADAPKLVTGRACRNGVSRAPNKQHRKMRAAQTQLELNPNDPGLRASVAGQKRHLALLDDANRDRHRAEAERLTKGR

SEQ ID NO: 3163 - protein, 322 aa, unidentified
  source 1..322: note = Related to NZ_KQ061217.1; note = Lysobacter capsici
MSTPNPKKHPRPKRRTECYDVADSHLHGLESHSRLASILYWAGTPSQLKTFSRREDNYSRYTDKSKAGKERLIEAPAERLKVFQARILDLLSRIKLPDYVHSGRIGRSYLSNSAAHCSADGCTITMDIEGFYQSVTLQRVARFFEVWLKCSPDVSLTLAHLLCCDWHLATGSPASPLMSFWAYREVFDAIDSRVRARGGVFTLYIDDMGITGKGFGHTDVQWVSRLLRRYGLKIKEAKTRVFHADRPKLVTGRGMRHGVSRAPNKQHMKMRQAQALLEANPNDPTLRASVAGHRRHLALLDDEKRAHHRAEAARVSRLKLKV

SEQ ID NO: 3164 - protein, 312 aa, unidentified
  source 1..312: note = Related to JACHCO010000001.1; note = Rhodanobacter sp.
MASKQTNSAQRYGVGTSPLYGIQSKRRLAEVLFWAGPTSALASFARDPDNYARYIDRRRSEKPRLIEAPQARLKGFQKRVEDLLKRTVMPDYLHSGIPGRSYLTCSAAHRDAAGCTVTMDISDFYLSISQDRVTRMFIVLFACTRDVAEVLAQLLCCDGHLATGSPASPLLSFLANKETFDQIAAHAGRRSGAFTLYIDDVALTGKGIGTAEVKWITRLLKRSDFTVKRSKTKIFRASRARLITGRVLYGGQSRAPSRQHQKMKAAIEASNALPKDKALKASAIGRVRHVALLDDVRRDGMRATAKRLAPPK

SEQ ID NO: 3165 - protein, 326 aa, unidentified
  source 1..326: note = Related to NZ_LGRQ01000750.1; note = Luteibacter rhizovicinus
MNPKVRTKKERLEKPLKQYAPDQCALYGIKGVGQLMRVLRWRGTRAELEAFDRAPGSYRFWANEQGREIQAAGAEMRKLHARVAVLLRRIMPPEYRQSGVRKRSFLTNAQFHTLDEPSVKLDIKSFYPSTTFAHVRRFFQNDMKCAGDVAFLLAKMCCVNQRHLPTGGVHSEVLAFYCHRNAFEQLYQRAKARGGVMTVYVDDIMMTMPRASLTDLEWARRLFANHGIKIHPGKSKVLAKAKRKTITGVDIHRGKISAPKAQHQLILQRHVELNAAVNPTLAVTAARSLLGHLDHVAQIEPRFRSRAEGTRAWLAAVLAETDAPGE

SEQ ID NO: 3166 - protein, 320 aa, unidentified
  source 1..320: note = Related to NZ_JQNL01000001.1; note = Luteibacter sp.
MKMPVRKKKQRLEKPRKQYRIDQCALYGLKGVGQLMRALRWTGTRAALEGFDQAKGSYKAWANETGREIQAAGADMRKLQARIAVLLRRVMPPDYRQSGVRDRSFLTNAKLHRADEPSIKLDIKSFYPSTTFAHVRRFFHQEMKCAGDVAFLLAKLCCYHRRHLPTGGVHSEVLAFYCHRRAFEQLYRRAKGRGGEMTVYVDDIMMTMPGASLTDLEWARRLFAKQGVKIHPGKSTVLTKDRPKTITGVTIHRGKLQAPKAQHHLIRQKFEDLAKAEDPAAATAAARSLIGHLDHVAQIEPHLRDRANGTRALLRRTLAP

SEQ ID NO: 3167 - protein, 328 aa, unidentified
  source 1..328: note = Related to JACYXL010000002.1; note = Rhodanobacter sp.
MTTVQKRKKPPRLETPKKQYALTDCALSGIRGIGQLLHVLRWEGSRQELEDLPAAQGSYKVWRTDQGRAIQAVNLKEANGSKLRQIQARIAVLLRRVLPPEYRHSGVRGRSFITNAQQHLQDDPSIKLDIKSFYPSTTFQHVRRFFVEAMRCSGDVAFLLAKLCCYQQRHLPTGGVHSEVVAFYCHKRSFDQLWERVKARSGKMSVYVDDIMLTMPNASLTDLEWARRLFAKQRVKIHPGKSKVLSKRSIKVITGVEIRGGKTGAPKEQHRLIKQRFDEIRAAASADELAGAVKSLLGHLDHVAQIDPRFVNRARGTRARLKAVIDHN

SEQ ID NO: 3168 - protein, 323 aa, unidentified
  source 1..323: note = Related to LR990730.1; note = Xanthomonas hydrangeae
MTKTIRKSKRRRQPRLEKPKKQYALHDCGLYGLKGLGQLAKALQITQDELDELANLRGGYTVWNQNGRAVQQARPALRKIHARIATLLRRVASPDYRHSGVRDRSFISNAAQHIAPHASLKLDISKFYPSTSVHHVWKFFFRKMHCARDIAAILAGLCCFERRHLPTGGVHSEVLAFYCHKDMLDSLNERVVSRGGVMTVYVDDIVVTMPGACESDLHWAQRLIARARLAMNLRKSRVINADKEKLITGVLIRRGKISAPAGQHKKVKLLHEAIGSATAGDDVTPQIRSLQGHLDHIAQIDPKFLSRAKGHRAKNRLALLPPI

SEQ ID NO: 3169 - protein, 319 aa, unidentified
  source 1..319: note = Proteobacteria bacterium; note = Related to JADJBZ010000003.1
MARLEQLDRPKYAMTTSPLYGIRSRKRLVEVLDWQGSVKALDGFVEQPDNYNCFLHEEDGKKPRPVQQPTPKLEALHRRVARLLLRILPPDYLHSGLRKRSFVTNAAQHVNGHPAVKLDVHKFYPSTLHSHVCGFFKNQMACAPDVAGLLASLCCVTVNGVRHLPTGSPLSQILAFYSHRQMFDELSAYVAARGGVITVYVDDITASMEFASVGDIRAMGRIITRHGLMWHKERFFPRGHSKAITGAIAKVDHLEAPKKQHLKYATARDRVDHPSLLVADQKQAARSAIGLLQCIAQIDERQIRVARGMAQKLTAVAGL

SEQ ID NO: 3170 - protein, 310 aa, unidentified
  source 1..310: note = Related to NC_013851.1; note = Allochromatium vinosum
MKKIKSPYAINQSPLYKIYSLKKLCEVLKFDRKVIAKLLKSQDNYKKFHQHDGAKSRLIEYPKPRLEAVHKRVFSLLSRITTPEYLHSGVSGRSYITNAQQHSSALAGFKLDIKSFFLSTTTDHIYKLFRFSFGCSFKVSQTLASLLCVSGHLPTGSCASQVLAFFAHKKMFDKLAKTVNQFGGKMTLYVDDLYVSIQYVKRWHIRRLDRIIRGNGLFAHKGRVYQRVKPKLITGVILIDGKMKLPHAKHRKIRDTRNAARICSSRSQKSLLMRSLVGQLTTGSLLDPSLKSRVKPARSYLQRLEKQHQV

SEQ ID NO: 3171 - protein, 316 aa, unidentified
  source 1..316: note = Related to NZ_CP061930.1; note = Klebsiella michiganensis
MKKRKKLKISTKNKSYGVMDSPFYKLKSKKKLAGLLCISVNDLSILKNDEGNYSVFDQLSKKGKSRKIQKPLDKLDIVHTRIASLLSRIALPEYLHSGKKRCSNVTNAKAHLNHEKMMTTDIKAFFPSTTRIMIFSFFFSVMKTSSDVADILSHICTCHDRLPTGSRISMPLAYFANSRMFGEMYELCQKLKVKMTVYVDDLTFSGANVNRLFCAVIRKVISKHGHIMHPTKTKLYAKDKPKLVTGIIVLGDALKVRNEQHRLMARDIEYWKIIKDAENAKETSIAKTLFGRLHSMGVIEQRYKSKVLTLKVNTAS

SEQ ID NO: 3172 - protein, 316 aa, Escherichia coli
  source 1..316: note = Related to CP056584.1
MKKRKKLKVNTKNKSYDIMDSPFYKLKSKRKLANLLCVSLEELYSLRKDEGNYSVFEQLSKKGKARKIQKPLEKLELVHTRIASLLSRIALPEYLHSGKKKCSNVTNAKAHLNNEKMMTTDIKAFFPSTTRGMIFSFFFSVMKMSSDVADVLSHICTCHDRLPTGSRISMPLAYFANSRMFGEIYQLCQKLRVNMTVYVDDLTFSGGNVNRLFCAVIRKIVNKHGHVIHPTKTKLYARDKPKLVTGVIVFGNALKVRNEQHFLMAREIDYWKIIKDAENARETIIAKKLFGRLHSMGVIEQRYKSKVLTLKANTAN

SEQ ID NO: 3173 - protein, 316 aa, Enterobacter sp.
  source 1..316: note = Related to NZ_JAIFPH010000003.1; note = Enterobacter hormaechei
MKKRKKLKIFTNNKSYGVMDSPFYKLKSKKKLACLLCVDTNDLYALKKDEGNYSVFEQLSKKGKPRKIQKPVDKLDVVHTRIASLLSRIALPEYLHSGKKKCSNVTNAKAHLNHEKMMTSDIKAFFPSTTRSMIFSFFFSVMKMSSDVADILSHICTCHERLPTGSRISMPLAYFANSRMFCEIDELCRKLRIKMTVYVDDLTFSGANVNRLFCAVVRKVISKHGHNMHPTKTKLYAKDKPKLVTGVIVFGDCLKVRNEQHRLMARDIEYWKIIKDAENARDTPIAKTLFGRLHSMGVIEQRYKSKVLTLKVNTAI

SEQ ID NO: 3174 - protein, 316 aa, Escherichia coli
  source 1..316: note = Related to UGAA01000001.1
MKKRIKLKVSTKNKSYPITDSPLYKLKSKKKLANLLCVSINDLSALKRDEGNYSIFEQLSKKNKIRKIQKPLEKLDVVHTRIASLLLRIAMPEYLHSGKKSCSNITNAKAHLNHQKLMTTDIKSFFPSTTREMIFSFFFSIMKMSPDVADILSHICTCHERLPTGSRISMPLAYFANSRMFDEMNQLCEKFRVKMTVYVDDLTFSGDNVNRLFCSVIRKIINKHGHVMHPTKTKLYAGDKPKLVTGVIVFGDSLKVRNEQHYLMAREIELWKIIKDVEQAKDTRTAKKLFGRLYSMGVIEKRYRSKVLTLKANTSV

SEQ ID NO: 3175 - protein, 316 aa, Enterobacter sp.
  source 1..316: note = Related to CP074170.1
MQKPKKLKISTKNKSYGMMDSPFYKLKSKRKLAELLCVSLSDLSALKKDEGNYCIFEQLSKKGKLRKIQKPLDKLDIVHTRIASLLSRIALPSYLHSGKKGCSNVTNAKAHLNNDKMMTTDIKSFFPSTTRVMVFSFFYSVMKTSSDVADFLSHICTCHGQLPTGSRISMPLAYFANSRMFDEIYQLCQKLTVKMTVYVDDLTFSGANVNRLFCAVIGKIINKHGHAVHPTKTKMYGKEKPKLVTGVIVLGDSLKVRNEQHRLMARDIECWKMIKDMEKAKETSFAKTLFGRLHSMGVIDQRYKSKVLTLKVNTAN

SEQ ID NO: 3176 - protein, 316 aa, Escherichia coli
  source 1..316: note = Related to CP023960.1
MKRRIKLKISTKNKSYDIIDSPFYKMRSKRKLASLLGVDVGDLSTLKKDEGNYSIFEQLSKNGKPRKIQKPLEKLDVVHTRIASLLSRITLPDYLHSGKKGCSNVTNAKIHLNNERLMTTDIRAFFPSTTREMIFSFFFSVMKMSSDVADVLSYICTCYGRLPTGSRISMPLAYFANSRMFGEIHQLCNKLHVNMSVYVDDLTFSGQNVNRLFCSVIRKIINKHGHVMHADKTKIYSREKPKLVTGVIVLGGSLKVRNKQHLLMSQEIEYWKMIKDAACARETHTAKKLFGRLHSMGVIEQRYRSKVLTLKASTAL

SEQ ID NO: 3177 - protein, 316 aa, unidentified
  source 1..316: note = Related to NZ_WUBS01000011.1; note = Acerihabitans arboris
MKKRKKLKISTKNKSYSLNDSPFFMLKSKKKLATLLGITISDLSLLKKDDENYSIFEQLSKKGKPRKIQKPLDALDIVHTRIASLLSRIALPEYLHSGKKGRSNITNAHAHLNTSKTMTSDIKAFFPSTTRHMIFSFYFSVMKMSSDVADVLSHICTCYGQLPTGSRISMPLAFFANSRMFDELNALCNTLKVKMTVYVDDLTFSGDNVNRLFCSVVRRIIYKHGHIMHPTKTKLYSEYMPKLVTGVIVTAGCMKVRNEQHRLMARDIEYWMLIKDADRARETSVVKTLFGRLHSMGVIEPRYKSKVLTLKMNTAI

SEQ ID NO: 3178 - protein, 316 aa, unidentified
  source 1..316: note = Related to NZ_CP006929.1; note = Dickeya zeae
MRIKPKLKIITRSKEYNLTDSPLYKINSKRKLAKIINVDFNTLKSLKDDKMNYSIFDQVSKKGKVRKIQKPVQRLDIVHTRIASLLCRIATPSYLHSGKKHHSNITNADVHKNEFNLLTTDIKSFFPSTKRSMVFSFFLTVMKTSPDVADILSHLCTCHNHIPTGSRISMPLAFWANVRMFEELKRLCSNLDITMTVYVDDITFSGENVNRLFVSCVKKIIVKHGHQMHPTKTKFYNSTAPKLVTGVIVVSNCLKVRNEQHQLFANEFEQWRIIKEEPHAINANITNKLIGRLYSMGVIEKRFKEKVRTVKNSTAL

SEQ ID NO: 3179 - protein, 316 aa, Escherichia coli
  source 1..316: note = Related to CP010122.1
MKSKPKLKISTRDKSYNLIDSPLYKLKNKKRLAQLLNINLCDFRTLTSDDENYSVFEQLSKKGKVRKIQKPVHKLDVVHTRIASLICRIQTPLYLHSGKKTCSNISNASAHINELNLLTTDIKSFFPSTTRNMVFSFFYSVMKTSSDIADILSHICTCHGHIPTGSRISMPLAFWSNIRMFTELENLSLSLNVTMTVYVDDITFSGEKVNRLFMSCMRKIVAKHGHQVHPTKTKLYGAKLPKLVTGVIVHSNVLKIRNEQHLLLSRELEQWRIIKDEPYAINANITSKLVGRLYSMGVIEQRYKEKVRTIKSNTAF

SEQ ID NO: 3180 - protein, 317 aa, Vibrio sp.
  source 1..317: note = Related to MCYV02000002.1; note = Vibrio splendidus
MNRKSKLRINTKCKSYQLQDSSFYKLTSKKRLASILNLSLQNINSLRCDLGNYTEFEELGKSGKPRKIQKPCHRLDVAHTRIASLLCRIQTPTYLHSGKKSHSNVTNAASHVNFHQLLATDVKSFFPSTSRKMVFSFFLTVLKCSPDIADILADICTCHNHIPTGSRISMPLAYWANCRMFEELERVSDKHHVTMTVYVDDLTFSGEKVNRQFRSLVKKIISKHGHTMHPKKTKLYQGSQPKLVTGVIVSDGVLKVRNEQHLMYSSELAQWDSIKNLPLASETNLVAKLIGRLHSMGVIDTKYKAKVKSIKNATCSD

SEQ ID NO: 3181 - protein, 317 aa, Vibrio sp.
  source 1..317: note = Related to PIFL01000078.1; note = Vibrio splendidus
MNLKSKLKINTKQKCYPLNDSPLYKLKSKKKLASILKVQLPEILALRCDDGNYAEFTELGKSGKPRSIQKPCYKLDVIHTRIASLLCRIENPPFLHSGKKFHSNVTNAATHANSHQLLATDVKSFFPSTSRPMVFSFFLTVLKCSPDVADILADICTCHKHLPTGSRISMPLAYWANCRMFEELQRISLKHGVTMTVYVDDLTFSGQAVNRRFKSLVKKVVSKHGHIIHPTKTKLYKGTQPKLITGVVVVDGVLKVRNEQHLKYSSELAQWDSIKDLPAASETKLVAQLIGRLHSMGVIDMKYKAKVKSIKNATCSD

SEQ ID NO: 3182 - protein, 316 aa, Vibrio sp.
  source 1..316: note = Related to VTLM01000009.1; note = Vibrio cholerae
MTRNSKLKLETKNKSYPLQDSPFHKLTSKKQLRKLLDIDSEKLKKLRQDKGNYSEFEDVSVSGKARKIQKPTRELDVVHTRIASLLCRISTPDYLHSGKKQHSNVTNARQHKNEYALLATDVKSFFPSTTWNMVFSFFYGVMKCSSDVSEILSDLCTCHKHIPTGSRISMPLAFWANIRMFSELDCLSNKHGVTMTVYVDDLTFSGREVNNLFRSSVKKIINKHGHIMHPTKTKLYKPNQPKLVTGVVVNGGHLKVRNEQHFKMHQELQIWCKIKDTPYALSSSITSQLLGRLHAMGTIDDRFKQKARTIKLSTAP

SEQ ID NO: 3183 - protein, 316 aa, Vibrio sp.
  source 1..316: note = Related to LMYA01000001.1; note = Vibrio vulnificus
MTRKSKLKLETKNKSYPLQDSPFHKLTSKKVLRKLLDVDADKLKKLRQDKGNYSEFDDIGESGKARKIQKPARDLDIVHTRIASLLCRISTPQYLHSGKKQHSNITNARQHQNKYPLLATDVKSFFPSTTWDMVFSFFYGVMKCSSDVSEILADLCTCHKHIPTGSRISMPLAFWANIRMFSELEALSTKHNVTMTVYVDDLTFSGMQVNKLFRSSAKKIITKHGHIMHPTKTKLYKSNQAKLVTGVVVEGESIKVRNEQHRKMHEELGVWFEIKDMPYAMSSSITSKLLGRLHAMGTIDDKFKQKAKTVKKSTTS

SEQ ID NO: 3184 - protein, 316 aa, unidentified
  source 1..316: note = Related to NZ_CP035690.1; note = Grimontia hollisae
MSRKSKLKIDTKNKSYSIIDSPFYKLFSKKKLATLLKCDLSELKKLRDDEGNYSEFEDIGKSGKPRKIQKPSRNLDIVHTRIASLLSRISTPTYLHSGKKEHSNVTNAKAHLETSALMTTDIRSFFPSTSHRMIFSFFYGVMQCSSDVAELLADLCTCHKHLPTGSRISMPLAYWANCRMFEELNSLSSKHGVTMTVYVDDLTFSGSKVNKLFTSTVNKIISKHGHTMHPAKTKLYSSHEPKLVTGVVVDKGVLRVRNEQHLKLFEDISLWSFIKDEKYALGSSITSKLIGRLHAMGTIEPRFKSKAKSVRNSTAM

SEQ ID NO: 3185 - protein, 314 aa, unidentified
  source 1..314: note = Related to NZ_CP058958.1; note = Providencia rettgeri
MSQKLTLNNKNKAYQLTDSPFHKLSSKKKLAILLRTPLSQIRSLRADSGNYSEFESIGKSGKIRKIQKPSRNLDVVHTRIASLLIRIITPEYLHSGKKGYSNVTNANIHLNTNALMTSDIKSFYPSTSWNMIFSFFYSVMSCSADIAEILADLCTCHKHLPTGSRISMPLAYWANVRMFNELENICQKHDVIMTVYVDDLTFSGKNVNRLFKSTVKKIISRYGHEMHPTKTKLYPPNGTKLVTGVVIDRNNLLVRNEQHFKLFEELSMWNSIKNNQYAISMSITSKLIGRLHSMGTIEPKYKTKAKSVRKSTAI

SEQ ID NO: 3186 - protein, 316 aa, Vibrio sp.
  source 1..316: note = Related to NZ_CP054700.1; note = Vibrio alginolyticus
MPKTKTKLKIDTRGKFYALKDSPLYKLRTKRRLAEVLNHSLQTLRALRTDQGNYKEFEDNSGGKARKIQQPARSLDMVHTRIASLLCRIDTPDYLHSGKKGVSNVTNAEAHIDSHNVLTTDIRSFFPSTTRRMVFSFFYGVMKCAPDVADLLADLCTIHSHIPTGSRLSMPLAFWANHTMFNELNELSIKHNVKMTVYVDDLTFSGKEVNRLFSSCARRIISKYDHCMHPNKTKLYSATSPKLITGVVVQGSLLKVRNQQHQYLLSEMTQWLSIKDSPRALHLNITNRMLGRLYSMSVIDKRYRAKARMVRNSTAL

SEQ ID NO: 3187 - protein, 317 aa, unidentified
  source 1..317: note = Related to NZ_LASA01000054.1; note = Endozoicomonas arenosclerae
MKQRKSKLKIQTKGKSYSLHDSPLYKLKTKRKLASILQHSLPDLKLLCSDEGNYAVFEETKKGSKPREIQKPNPKLEVVHTRIASLLCRIDTPNYLHSGKKGHSNVSNAYAHVNSDNLLTTDVKSFFPATSRRQVFSYFYSIMQCSPDVADMLADLCTYNAHIPTGSRISMPLAYWANVSMFNELQALSLKHSVKMTIYVDDLTFSGKKVNKLFRLCVKRILENYDHAMHPAKTILYRAAQPKLVTGVIVTEGQMKVRNEQHQQLASELDIWKAIKDHPYAAGMKPTSKLLGRLYSMAVIDSRYKSKAVTVRKSTHT

SEQ ID NO: 3188 - protein, 316 aa, unidentified
  source 1..316: note = Related to NZ_LTYZ01000001.1; note = Aliivibrio fischeri
MTKKSKLKIELKGKSYDIRDSPFFRLRSKKKLSSLFNLTLPQLQELKSDIGNYAEFEDVGKTGKARKIQKPNLELDKVHTKIASYLSRIKTPDFLHSGKKYHSNITNAKAHLDSTNLMVTDIKSFFPSTKKNMIFSFFYSVMECSSDVADLLAQLCSIHGFLPTGSRISMPLAYWANCRMFNELDTLSRSHGITMTVYVDDLTFSGENINRLFKAVVNKVISKHGHTMHPSKTKIYSAKQPKLVTGVIVKDNELKVRNEQHQKLYADLEFWKLIKDSPLTKNAKISSQLLGRLYSMGFIEQKFKQKALTIKSALNS

SEQ ID NO: 3189 - protein, 317 aa, Vibrio sp.
  source 1..317: note = Related to NMSO01000008.1; note = Vibrio metoecus
MTKKSKLKIVTRKKSYELSDSPFYKLKSKKKLAHLLKVNVTKLQQMTKDSNNYNEFEHNKDDGGKVRKIQHPIGELDVVHTRIASLLCRIKTPDFLHSGKKHHSNVTNAKAHCNKHPLMTTDVCSFFPSTSREMVFSFFYTVMNCAPDVADVLSRICTIHGHLPTGSRISMPLAYWANCRMFKELEELTKKHQVKMTLYVDDLTFSGKSVNTLFKSITCQIIERHGHKMHPRKTKLYEAKSPKLVTGVVIKDNQIEVRNEQRKKLVSDIACWKSIKDFPNAISMQVTNTLLGRLHALGSIDSKFKDRARTIKAATQK

SEQ ID NO: 3190 - protein, 301 aa, unidentified
  source 1..301: note = Related to NZ_FPBJ01000003.1; note = Xenorhabdus koppenhoeferi
MLYRILLSINLSQKKKLASLLKVDMQTLFRMMNDTENYNEFEKKGKKGKVRKIQHPVGELDVVHTRIASLICRIATPNFLHSGKKQHSNVSNAHVHCNNFPLMTTDVCSFFPSTKKSMVFSFFYTVMECSSDVADILSCICTIHSHLPTGSRISMPLAYWANCRMFSELEQLAIKHDVTMTLYVDDLTFSGAQVNSLFKSIIRQVIERHGHQMHSTKTKLYSGNKPKLVTGIVIKGEMVSVRNEQRMKLVSDITCWKSIKDMPNAINMPVTHTLLGRLYALSSIDPMFKDRAKTIKANTQK

SEQ ID NO: 3191 - protein, 316 aa, Vibrio sp.
  source 1..316: note = Related to VTYH01000022.1; note = Vibrio europaeus
MRKKSKLKLQTKGKSYPLCDSPFYKLRTKKKLAELIGFPLIELQKLRSHIGHYIEFEEEGKKGKKRKIQQPINEMDRVHTRIASLICRIDVPNYLHSGRKGFSNVSNAKAHLDSSKLMATDVKSFFPSTTRRMIFSFFYSVMQCSPDVSDILADICTIHGHLPTGSRISMPIAFWASCRLFEELDSLSKHHDVKMTLYVDDLTFSGANVNRLFKTTVRKIIERHGHTMHPTKTKLYDEHQPKLITGVVVDNGVLRVRNQQRKQLITDFACWDLVKDVENASLLPCTNSLIGRLQSMGMIDGAFKERAKTVRGQTHK

SEQ ID NO: 3192 - protein, 323 aa, Vibrio sp.
  source 1..323: note = Related to PIFP01000042.1; note = Vibrio splendidus
MKKSKLKIKTKGKEYGIKDSPLYNLRTKRHLANLLNCSNSDLKKYAKDDGNYHEFEEKGANQKARKIQQPMRGLDKVHTRIASLLCRITTPDYLHSGKKKHSNVSNALAHTAKENSRTPLMTTDVKSFFPSTSRKMIFSFFYSVMKCSADVSDILADICTVHHFLPTGSRISMPLAFWANCRMFSELEQLSKKHDNLMTVYVDDLTFSGVNVNPLFKTTVKKILNRYGHIMHPDKTKVYDCDDAKLVTGVIIKGGTIMVRNEQRKQLVNDLSCWSVIKNQPDAINNTFTQRLIGRLHSMGVVDETFKKRAMTIRNQTNRTPIS

SEQ ID NO: 3193 - protein, 319 aa, Vibrio sp.
  source 1..319: note = Related to CP073273.1; note = Vibrio fluvialis
MKKSKLKIKTNGKEYSLKDSPFYNIKTKKRLSILIGCTLSELKAFSKDQGNYHEFLEKSTGGKSRKIQQPVRGLDRIHTRIASLLCRIETPDYLHSGKKNHSNVSNAKTHAEKHFDNVPTMTTDIKSFFPSTTRKMIFSFFYSVMKCSADVADVLADICTIHKFLPTGSRISMPLAFWANSRMFEELEALSIKHDIVMTVYVDDLTFSGCNVNKLFKTTVKRVIERHHHTMHPDKTKIYRKAEPKLVTGVVVHNGEIRVRNEQHKQLVTDLACWNSIKAIPEAIRMPYTNRLIGRLHSMGVIESVFKDKATAIRNQTAK

SEQ ID NO: 3194 - protein, 319 aa, unidentified
  source 1..319: note = Related to JADZHF010000006.1; note = Shewanella algae
MRKPKFKIKTKGKSYSIKDSPLYNLRTKKHLANLLNCNTQDFSTLSKDDGNYNVFETTGKNGKKRKIHKPQPQLDKIHTRIASLLCRIDAPDYLHSGRKNRSNITNAQAHITNHSSETAILATDIRDFFTSTHRKNVFNFFYTIMKCSTDVADILAKLSTIHEHVPTGSRISMPIAFWANYHMFEELHALSSKYNVCMTVYVDDLTFSGNNVNPLFRTVVEKIVSRYGHKIHPTKTKLYAKAAPKLVTGVIVKNQSLQVRNEQFKQLVTDFTCWKAIRNTPQAIFDPHTYRLLGRLHSMGSIEPVFREKARTVKGATNR

SEQ ID NO: 3195 - protein, 317 aa, unidentified
  source 1..317: note = Related to AXZL01000070.1; note = Shewanella decolorationis
MQKLKIKTKGKSYALKDSPFYNLRTKKRLSILLGCDTKDLPLLAKDDGNYNVFSIIGKAGKPRQIHKPINKLDKIHTRIASLICRINLPSYVHSGRKKHSNLTNAKAHLSADGFDTKVLTTDIKDFFTSTRKKQVFGFFYSDLKCTADVANLLADMCTIHGHVPTGSRLSMVLAYWANYHLFEELSSLSKQHSVTMTVYVDDLTFSGTGVNELFKTVVRKVLSRYGHTMHPTKTKLYGKESPKLVTGIVVKEGQLQIRNQQFKELVTDFACWHAIRQTPHAIFDPHTYRLLGRLNSMSSIDPVFKEKAQTVKGNTCR

SEQ ID NO: 3196 - protein, 318 aa, unidentified
  source 1..318: note = Related to NC_006371.1; note = Photobacterium profundum
MNRKRSKKLKIQTNGKSYTIKDSPLYRLRSKKKLANILKSDLNNLKKLRLDADNYHEFEDKGKGGKPRKIQCPCNGLEKIHSRIASLLCRIKTPDYLQSGKKGHSNVSNANVHLGSSCLLATDIKSFFPSTKRYMLFSFFFHSMECSADVADILSDLCTINGHIPTGSQISMPLAFWANSHMFDELYLLSVKHAVKMTVYVDDLTFSGDAVNKLFMSVTQRIITKHNQVMHPDKTKLYRGYESKLITGVVVKGDNLLVRNEQHKMLFSDVECWKAIKDIPSAINSNIAKKVIGRMHSMSVIDSKFKDKVRTLRISTAT

SEQ ID NO: 3197 - protein, 301 aa, Aeromonas salmonicida
  source 1..301: note = Related to NZ_CP060032.1
MDSPLYKVKTKRKLASLLNSTIPDLNRLKIDDGNYNEFDDLKKPEKPRKIQQPVKSLDVVHSRLASLLCRISVPEYLHSGRKGRSHVTNANAHVGNHSILTTDIKAFFQSTKRDMIFTFFYKKMQCSADVADLLSDLCTCHGHIPTGSRISMPLAYWANSDMFDELYALALKHDNNMSVYVDDLTFSGGNINELFCSIVKKIIIRYGQTPHPNKTRIYGKNSVKIVTGVAVHGDELLVTNYQHYQHYQLYSDVEVWKAIKDTENAMELNTSKRLIGRLNSLAVINRKYRDKARTIKAATSK

SEQ ID NO: 3198 - protein, 315 aa, Aeromonas sp.
  source 1..315: note = Related to JAEHHN010000014.1; note = Aeromonas caviae
MKPKINTLGKSHPIENSAFYKLTSKNVLYKLLGVPKEEVIRLLGDPDRYNEFQDLTNIDKPRAIQKPKKALDVVQSRIASLICRIEVPEYLESGRKGHSHVTNAIAHVSPNNTSVAFLTTDIRSFFPSTTVVMVYDFFRSTLRCSHAVSEILSNLCTCRGFVPTGSRISMPIAFWANYPMFLELEKLCIKHNIRMSVYVDDLTFSGNNINTLFLACVRKIIIRHGHEPHPDKTKLYARNDVKIVTGVAVVDNSITATNKQHLKLYQEIEAWKAIKDIPDALETNTVKRLIGRLNSLTLIDYRFKDKARSIKSATS

SEQ ID NO: 3199 - protein, 309 aa, unidentified
  source 1..309: note = Related to UFGU01000001.1; note = Klebsiella pneumoniae
MKVKKQKIKTKGKSYPLQGCIFYKLSSKKRLEKILFTSIKELQFLSNDINYVLFYEKSDINKKRLIEKPNEKLDIIHTRIASLISRITQPQYMHSGLIDKSYISNAKQHLGKKPTLTTDIKSFFPSTTRQKVFNFFYKKLCCSSDIADLLSLLCTINNHIPTGSRISMPLAYWANANMFNNLYAISCANNIIMTVYVDDITFSGEKVNKQFLSRVKKIITSESHIMHPTKTILYSGTEIKKITGVIISNDKLKVPNSLHNKIYLDIEEWKSLDNNENTAVKNRLLGRVYAAANIDNRFKDKARTIKKYV

SEQ ID NO: 3200 - protein, 308 aa, unidentified
  source 1..308: note = Related to NZ_CP087584.1; note = Providencia rettgeri
MKAKKRKIKTKGKSYSLQECVFYKLTSKKKLEKILFSSIQELKLLSDDRNYILFYEKSDINKKRLIEKPNEKLDIIHTRIASLISRIIQPQYMHSGLKDKSYISNARAHLGKKPVLTTDIKSFFPSTTRLKVFNFFYKKLRCSSDIADLLSHLCTVNNHIPTGSRISMPLAYWANADMFNNLYAISRANGNKMTVYVDDVTFSGEKVNSKFLSSAKRIIASESHIMHPTKTILYGSIQIKKITGVIISSDELKVPNSLHNKIYIDMEAWKRSNNKNYTGIIDRLLGRVHAAANIDNRFKDKARTIKNK

SEQ ID NO: 3201 - protein, 311 aa, unidentified
  source 1..311: note = Related to LXEX01000068.1; note = Obesumbacterium proteus
MRRKKPKINTKNKSYSLQDCALYKCITKKRLVKILKSDLGKLKNLSRDIDNYTTFYEKTDIQKKRLIERPNEELDVIHTRIASLLCRVTQPDFMHSGLKLHSHVSNAKKHIGVHPLLTTDLKSFFSSTSKAIVFDFFFKKLLCSPDVSELLSNLCTYNNHIPTGSRISMPLAYWANSKMFLELNALSKALGICMTVYVDDITFSGRSVNKLFKSKVNKIIESHSHIMHPVKTILYKPYQNKLVTGVIVSGDNLRVRNKQLKDIHVQMKEWENSNLIISRNIVKERLLGRLNSASTIDIRFKDKARTLKKTT

SEQ ID NO: 3202 - protein, 310 aa, unidentified
  source 1..310: note = Related to CP042173.1; note = Yersinia sp.
MAKKKGRINTKGKSYSINDSALFNIQSKNKLAEVLLTNLDNIKSLLSNDNYIVFDNTNEDGKKRTIQTPSDKLNVVHTRIASLLCRITQPEYVHSGIKNKSNVSNARKHVGTHPVLTSDIRSFFPSTSKHQVFNFFNRKLKCAADVSDLMAELCTYANHIPTGSRISMPLAFWANYDMFNEMNTISNKLNITMTVYVDDITFSGNAVNRLFLHKCKRIVEKNGHVLHPKKTALYSAKEPKTITGVIVHENEIKVRNLHYKKIYFDLDAWKKTDDAIEKENLKNKVLGRMHSLSTINEKFKDKARSFRSID

SEQ ID NO: 3203 - protein, 316 aa, Nitrosomonas sp.
  source 1..316: note = Related to JAGRFN010000264.1
MSQKKRRLKIDVRNKKYPIVDSCLFRLQSKRKLSEFLNTELFALKNLTDDRNYNCYIDTSGHKPREIEHPCFELDKIQTRIASLICRIAQPDYIHSGVKGRSHITNAKQHVGRHNVLTSDIQSFFPSTTQRMVFNFFYKRLQCSSDVADLLANLCTCKGHIPTGSRISMPLAFWANEPMFNLLHKVSLSQGITFTVFVDDIVFSGSSIDERFVYNIKKLISNHGHTAHPRKTKLYKAGNTKLVTGVAVDTNGLHVANRHRKNIYQDMSQWKVSKQAGLQFDDLNKRIIGRMNAQSLVDYRFKDKARTLRLSIKKKN

SEQ ID NO: 3204 - protein, 315 aa, unidentified
  source 1..315: note = Related to NZ_CP031727.1; note = Cellvibrio sp.
MKIKHSKLKIIRKGKSYALKDSSLYKITSKKKLLSILSQASVTISDLTKAIGDYSIFIDNKNPLKPRTIEKPNKNLDIYQSRIASLLCRIESPDFIHSGTKRRSHVTNAKIHLANENTFTTDIKSFFPSTPIEKVFSFFYGVMKCEPDVADLLAKLCTCNGHIPTGSRISMPMSFWANEKMFRELQNLSIQHNVTMTLYVDDITFTGSNVNKIFVNTVKKIITRHGHIMHPKKSILYPKGSVKVITGVVIRNGTALAKNEQHKNLYQDIELLKGFSGKLSPPEKLIDRTLGRINSLSVIESRYKDKARSLWSLIK

SEQ ID NO: 3205 - protein, 316 aa, unidentified
  source 1..316: note = Related to NZ_CP047970.1; note = Cobetia pacifica
MNNPLKINTKSKSYSLQDSALYKIKSKRRLLSLLNLSHQELKSLLSDGNYNIYQDNTQEKPRLIEHPQRQLERIHTRIASLLCRIKQPEYIHSGIKGKSHLTNARTHIGPAPTLTTDIKSFYQATHIHSVFDFFKNSLDCSPDVAKLLSELCTCNGHIPTGSRISMPLAYWANAHMFNELYRYSSERDIIMTVFVDDITFSGNKVTRTFKQNVKKIIEKHNHVMHPTKTVLHKENSLKVITGAVVGSKKLQIRNLHHESIYSELSQWMLIRDENSKNSSIFTEQIKNRLLGKINSQGQIDNRFKDKARSIKNYRKV

SEQ ID NO: 3206 - protein, 312 aa, unidentified
  source 1..312: note = Related to JWLZ01000077.1; note = Photobacterium gaetbulicola
MKRKKNNKINTNGKSYPLHDSPFYKLRSKKVLFSLLKTDKEKIAHLKSDQGYNTFTQKSNKKTREIEHPVDALDIAHTKIASLLCRVTTPTYVHSGVKGRTHVTNAKEHLGKKRVLTTDIKSFYPSTTRQHVFKLFFNTFKCSPDVADILADICTFQGHVPTGSRLSMPIALWANINMFDELNVVSRKHDITMTVYVDDITFSGNLLNGRFKSLVKKIISRYDHVMHPKKTVLYKDDEIKVITGVVLDQDGIKIKNSQHKLIYQDIEQWKLFKGLAALPPESLNSRLMGRLHALSVINPRLKDKARSIKNCM

SEQ ID NO: 3207 - protein, 313 aa, unidentified
  source 1..313: note = Related to NZ_JAHNZV010000205.1; note = Psychromonas antarctica
MPRKKYKINTNDKAYSFESSSFYKLSSPNILANLLHIPLADLKKLKNSKDSYKPFVIKKEGKKDRTIECPKRLLEKVHTRIASLLCRIITPDFLHSGIKGRTYITNAKSHLGKHKVLTSDLRSFYPSTSKKMIFKLFRYNFHCSVEVADLIASVATYEEHLPTGSRLSMPLALWANIEMFLEIESLAKKHSINMTIYVDDLVFSGKNLNELFSSTVNKIVLKHGHEIHSGKTVLYKSDEIKLITGVIVHNDEIFIRNCHHQNMHNDLEEWKTYKNGFMVPDDLKSRLLGRINAFAQIDPRLKDKARSILAIEH

SEQ ID NO: 3208 - protein, 330 aa, unidentified
  source 1..330: note = Related to NZ_LS483452.1; note = Shewanella benthica
MSQQRRKYKINTNGKSYQIHDSPFYKLSSKKKLLSVLCITKEQLQSVLSNELNYNVFSQVGKTGKPRKIEHPINSVDKIHTRIASLLCRISQPEFMHSGVKGFSHVTNAKAHLGSHKTLTTDIKSFFPSTKKSMVFHFFYKRMKCSPDVADIMARITTFESHIPTGSRISMPLAFWANMDMFFELEKLAKLHNAIMTVYVDDLTFSGKAVNNLFKSIVKKIISKHGHIMHPKKTILYQHDDVKVITGVVLKNDSIAIKNQQHANIHADMIFWKIVRDDLFVPQGLKNRLLGRLNSLSVIAPSLKDKARSINNYKRKSKKSRVENKKQMVS

SEQ ID NO: 3209 - protein, 318 aa, unidentified
  source 1..318: note = Related to MZ568827.1; note = Shewanella phage vB_SspS_MuM16-1
MTRKKLRLKINTAGKSYRLHDSPFYKLIKQSRLLSILCITSEELSYLRYSPERYNVFIQKGNNEKERVIEHPREKLEKVHTRIASLMCRIEPPPFLHSGMKGLSHITNAQSHSTNSKVLTTDIKSFFPSTTREMIFRFFYKTLKCSSNVADILADICSVNGHLPTGSRISMPLAFWVNAEMFFELEKLSNMHDVCMTVYVDDVTFSGVTINKLFTKTVKSIISRHGHLMHPRKTVLYKGDDTKVITGVVLSGSKIAIKNQQHKKIHEDILLWKVVRDKYVPASLKNRLLGRLNSLSVVEPRLKDKARSIKNYKPNPQV

SEQ ID NO: 3210 - protein, 320 aa, unidentified
  source 1..320: note = Related to NZ_KB905161.1; note = Colwellia piezophila
MKKQKRPKFKIKTLNKAYEISDSPLYKLTTKRKLAALLLLEPVTLNALIKNTDNYNVFEQVNSNGKKRIIEHPNLELDKVHTRIASLLCRIKIPDFVHSGRAKHSHITNARIHIGHHKVLTTDIRSFFPSTSRTHLFNFFNRKMKCSSDVSDILSKICTYNEHLPTGSRISMPLALWANIGMFLELEKIAVKHDIKMSVYVDDITFSGDKLNKLFISTIKRIVERHGHIIHPVKTVLYAKDDAKVITGVILKDGKQFVKNEQHRNVYQDIEQWKILKDTPYMPETLKNRLLGRLNSLSAIEPKFKDKARSIRNHKTPTPY

SEQ ID NO: 3211 - protein, 327 aa, unidentified
  source 1..327: note = Related to NZ_KB889976.1; note = Teredinibacter turnerae
MAEKKLPNNKQRRLRLQTRGKQYSVCDSPFYKLCSKTKLAEMLGCTLPELKNLSSDEDYIVFNEEKSGKRREVQQPKPKLDKIHTRIGSLLARIKTPDYLHSGVKGRTHITNAKCHNSNSRILVTDVKSFYQSTTFKMIYGFFNHRMRCSPDVSWLLTKVSTYNNSIPTGSRLSMPLAFWSSIGMFEKLNQLSISESVVMTLYVDDLTFSGEKINKLFCHKVKKIVSSYGHLCHPKKTKIYNQNQAKVVTGVALLENGPAISNKQHKSIYEDMLQWEIIKNEALFESLNNRLLGKLNSQGQIDFRYKDKARSLMNEIRRRKPYSQVV

SEQ ID NO: 3212 - protein, 319 aa, unidentified
  source 1..319: note = Related to JABEPJ010000003.1; note = Pseudoalteromonas sp.
MRNSRSKLKINSNSKKHSINQSPFFKLKTKKKLIELLGLASSELSIAKKDIGNYVVFEQMGNNGKSRTIQHPKDKQNEIHNRIANLLTRIELPAYLHSGRKKHSHITNATQHLGSKKVLTTDIKSFFQSTTKKMVFNFFNRKLLCSPDVSHILSCICTFNGHIPTGSQLSMPLAFWANIDMFERLENLSSSLNVDMTVYVDDLTFSGEQVNRRFLSLIKKIIISSGQVPHPLKTKLFKKNDLKIITGVALKEDKTLITNKQHMLIYQSFESWKGCRDEPVIANYVMPKLLGRLNALSGIDPKLKDKAKSLINYKPTSLL

SEQ ID NO: 3213 - protein, 320 aa, unidentified
  source 1..320: note = Related to NZ_JACGUS010000120.1; note = Colwellia sp.
MRNRSKLKINSNSKKYSLNQSPFYKLKTKRKLIELLSLSMPELSIAKKDIDNYQVFDQMGNNGKPRTIQHPKNKQNEIHNRIANLLTRIELPDYLHSGRKKHSHITNATQHLGSKKVLTTDIKKFFQSTTREMVFRFFNKTLHCSSDVSDILSYICTFNSHIPTGSQLSMPLAFWSNIDMFEQLDNLSASLDVKMTVYVDDLTFSGEQVNKHFQSIVKKIIISNGQTPHPLKTKLFNKNDLKIITGVVIKDDKTLITNKQHKLIYQSFESWKGCRDEPLLESYIKIKPKLLGRLNALSGIDPKLKDKAKSLMNYKSAAEI

SEQ ID NO: 3214 - protein, 322 aa, unidentified
  source 1..322: note = Related to BDMN01000366.1
MRNKSKHKLKTYEICDSPLYKLRSKKKLLSLLYMSKEEIGIAVQDTDNYVVFETIRKKGKSRTIQHPKDRHKEIHCRLANLLIKIKVPNYLHSGRKEHSYVTNANQHLGEKRVLTTDISAFFQSTARDNVFCFFLNIMKCSSDVADTLSHICTYNGHIPTGSKLSMPLAFWSNLRMFDQLEKLSIKHNVCMSVYVDDITFSGNSINRLFLSTVRKIITSNGHTPHPEKTKIFGKKDIKVITGVVINGDDTLITNKQNKLIFQSFVEWKASRDEPLTERLITQKLLGRLNALSMIDPKLKDKAKSVTSYKKIVIKYVTTQRVF

SEQ ID NO: 3215 - protein, 324 aa, unidentified
  source 1..324: note = Related to NC_018692.1; note = Alteromonas macleodii
MPKKSKLKIDHSRRKHKLFESSLYKLKTKRKLAELLQVTIPELKLASADVGNYVVFEQEGKSGKARTIQHPKDSQKKIHCRIANLLCRIEFPEYLHSGRKEHSHITNAKAHTGNKKVLTTDIKSFFPSTTRKMVFNFFYNTMKCSSDVADLLASICTYNGHIPTGSQLSMPLAFWANIRMFEQLNNLANKHDVKMTVYVDDLTFSGDSINRQFLSVIKKIIVSNGHISHPDKTKLFEKSDVKVITGVAIKCNDVGITNKQHKLIYESLEQWKGCRDEPLISSFVIPKLLGRLHAHSNIEPKLKHKVNSILNYKPVKNPHSKSTD

SEQ ID NO: 3216 - protein, 310 aa, unidentified
  source 1..310: note = Related to NZ_FOHV01000014.1; note = Thorsellia anophelis
MKKTKKLKLISNQKCYHLDQSPFYKLQSKKKLLALLCINEAELKDCITSPLNYNVFLNGTRVIETPIGVLKKVHWRIASLLIRVNVPEYLQSGKKKHSNISNAKVHIGDTNLLSTDIKSFYPSTLRYKVFNFFLNIMKCSVYVADILSKLSTYNDHIPTGSQLSMPLVFWSNFRMFSQLNGLAEKHNAKMTVYVDDITFSGNSVNNLFLSVVKKIIISNNHTPHPNKTKLYASKENKIVTGVVIKGSKILIMNKHHKAIYQDLTVINACKLSGGAPSCYEITKKRLLGRVNALKLIDTRLQHKIEYFSNL

SEQ ID NO: 3217 - protein, 318 aa, unidentified
  source 1..318: note = Related to PNDR01000076.1; note = Pseudoalteromonas sp.
MTRKLKLDIDHRRRKYTLIESPLYKLKTKRKLAELLLVQTNELKNLTQDQGNYRVFQQIGKSGKPRAIQHPKDSLKIVHCRIASLLGRVELPDYLHSGRKEHSHISNAKKHLGQHNVLTTDIKSFFPSTTRKMVFDFYFNLLKCSADVADLLASISTYNCHIPTGSQISMPLAFWSNIRMFEQLYSLAKKHDSEMTVYVDDLTFSGHAVNKRFASVVKKIIHTNGHIAHPDKTRLYAKDEVKVITGVAIKGNETRITNDQHMKIYETLEFWKGCRDEPIIAELIKPKLLGRLNAHLQIDTRIRDKVKSITSYKPKFSI

SEQ ID NO: 3218 - protein, 317 aa, unidentified
  source 1..317: note = Related to NZ_JAGJED010000003.1; note = Pseudoalteromonas luteoviolacea
MNVKKNQKSKLKIQLKNKSYQVKDSPFYKLATKRKLANLLNISVSELLTLTKDAVNYKVFSQSKGYGKQRVIQKPIGRLEYVHTRIASLLCRVSVPSFVHSGRKGHSHVTNAKQHLGNNRVLTTDIKNFFPSTTEEMVFKLFFHTFKMNGDVAKLLANLCCFSGHVPTGSRVSMPISFWSNSKMFDELSSLSTKHDVVMSLYVDDLTFSGDGINRLFLSTVRKIVQKHGHIMHPDKTKVHTKNSRKVITGVVVQGDTLNITNKQNLMIYRELAQWKVIKNLPFIPKSLESRLLGRLYAMGQIDKKYKDKAMSVRNSS

SEQ ID NO: 3219 - protein, 312 aa, unidentified
  source 1..312: note = Related to PPSX01000023.1; note = Pseudoalteromonas phenolica
MRKNHSKLKITTKQKAYSISDSPFYKLSNKKKLAELLFVKASEFKNLTSDENYKVFKQLNSKGKSRQIEQPLLNLDRVHTRIASLLCRIDLPNYLHSGRKGRSHVSNARAHVGNKKVLTTDITNFFPSTTEKQIFSLFYNIFKMTPDVARVFAKICCYKQHVPTGSRLSMVLAFWANYKMFEELNSFSLFRNVRMTVYVDDLTFSGENINREFSSLIRKIIKKHGHLAHKGKTHQKQSHEVKVITGVVVKGNDIKPKLSQFKELHNDIQAWKLVRDTGLPLSSLRDRISGRLYSMGQINKRFKDKAKSVRNY

SEQ ID NO: 3220 - protein, 312 aa, unidentified
  source 1..312: note = Related to NVVS02000010.1; note = Halomonas sp.
MKQKRLKPRIITKNKSYPIEDSVFYKLSSKKRLANLLFSTSQELKSLGESDNYRCFTQTKNGKPRLIQEPLPRLDKIHSRVASLLCRIDTVDGLHSGKKGRSNISNAHAHLGQGKKVITADIKSFFPATTRQNVFDFFYTTMQCAADVADLLSKILTYNDHIPTGSRISMPLAYFANKRMFDEIESAASEFSAKMTIYVDDLTFSGAMLQKSFIGRLEATAKKYGHKIHPSKTRFYEASEVKLITGAAIKGDEITPRNKHLKQLRGELSVWLDNPGNDEKLTNRILGRMTFIGSIDPRYKDKAKTFRKSVFK

SEQ ID NO: 3221 - protein, 312 aa, unidentified
  source 1..312: note = Related to NZ_AMRJ01000028.1; note = Alcanivorax hongdengensis
MKQKRRKPKIITKQKSYPLQDSVFYKLSNKKRLANLLSSTPQELKMLAGNDNYRCFTQTKNGKKRLIQEPLPRLDIIHTRVASLLCRIETIDGLHSGKKGKSNISNARAHVGLGKKVITADIKSFFPTTTRLNVFDFFYNTMRCSPDIADLLSKMLTYDEHVPTGSRISMPLAYFANKKMFDEIESAANDCGATMTIFVDDLTFSGTTLKRSFIGRLETIAKKYGHKIHPSKSRFYGANEVKLITGAAVKGNDISPRNKHLKLLRSELSEWLKCAQKDEKLTNRVLGRMTFIGSIDARYKDKARAFRKTAFK

SEQ ID NO: 3222 - protein, 312 aa, unidentified
  source 1..312: note = Related to JAFMPS010000045.1; note = Alcanivorax sp.
MKRRLPKNRIITKKKSYPLQDSPFYKLSSKTRLASLLGSTPKELKSLVGNDNYHCFTQTKKGKPRLIQEPLPHLDKIHSRVASLLCRIETVDGLHSGKKGRSNISNARAHLGPGRKVITADIKSFFPSTTRLMVFDFFYNTMQCSSDVADLLSRILTYDEHIPTGSRISMPLAYIANKRMFDEIEDAAMRVGAKMTIYVDDLTFSGVMLHKDFVKTLEMIAKKHGHRIHPSKTRFYSENAIKLITGAAIGEDRIFPRNRHLKALKEDLQIWINSPQKDRKLINKILGRLTFIGSIDPRYKDKARTFRNVAIK

SEQ ID NO: 3223 - protein, 308 aa, unidentified
  source 1..308: note = Related to RZGU01000003.1; note = Legionella sp.
MNTQKQKIITKNKYYPAKDSLFYKLSSKGRLAKLVSSTVQELKSLTKNDQYHCFTQSKRGKTRPIQEPLPKLDKIHSRIASLLCRIETADGLHSGRKGRSNISNASAHIGVGKKVITLDIKNFFPSTKRSSVFDFFYNTMCCSPDIADLLSHICTYDDHIPTGSRLSMPLAYFANKRMFDEMEQTANECNAKMTIYVDDLTFSGEELSKNFITRIELIAKKYGHKINSSKTRFYAEDAVKLVTGVAVIDNQLKPRNKHLEALFKKTNDWQVNKSMQSRNCILGYMTYLGSIDSRYKDRARTFRQKAIF

SEQ ID NO: 3224 - protein, 307 aa, unidentified
  source 1..307: note = Related to CP000675.2; note = Legionella pneumophila
MKQKKNKIITKNKCYPIKDSVFYKLSSKGRLANLLSSTVQELKSLTKNDQYHCFTQLKRGKTRLIQEPLPKLDKIHSRIASLLCRIETVDGLHSGCKGRSNISNAKAHVGVGKKVITLDIKSFFPSTKRSSVFYFFNNTMSCSPDIADLLSQLCTYEGYIPTGSRLSMQLAYFSNKRMFDEMEQAASECGAIMTIYVDDLTFSGAELSRNFIKRLEFIAKKYGHKIQSSKTRFYSENEVKLITGVAVIGEQLKPRNKHLAALTQEIEYWRVNKSQQSANRILGYMTYLGSIDSRYKDKAKTFRHQMA

SEQ ID NO: 3225 - protein, 310 aa, unidentified
  source 1..310: note = Related to NZ_KB889904.1; note = Marinobacter sp.
MTQNRRKPRIQTKNKSYPLQDSPLFKLTTKRKLAKIIFSELAELKQLCNDNNYSCFTEITKGKTRFIQAPLRRLDMVHTRIASLLCRIDVPNELHSGTKGRSIFSNAKAHLGVGRRTVTVDIKSFFKSTSRSQVFDFFSDTMKCAPDVADLLSRLLTFNDHIPTGSRVSMPMAYFANQKMFCDMQAVADARGATMTIYVDDLTFSGTKLNHQFVDKISNITEKYKHTLHPDKTRFYGPKAAKCITGTVIVGNELRPRNCQYKAVHEDMQNWLSINKPDDALAARLLGRISFIGNFDARFKDKAVRFRRAL

SEQ ID NO: 3226 - protein, 320 aa, unidentified
  source 1..320: note = Related to NZ_QUNG01000011.1; note = Marinomonas pollencensis
MIKKKKSKLKIRTNGKIYRLQDSPFYKLTSKKRFASLLNLEYDQLKQLLSNSDSKFEKFTQVKEGKKPRAIQKPITSFAPLHCRIASLLCRIGTPEYLHSGKKGRSNLSNAQSHSGKHKLLAVDIESFFESTSHEKVYSFFRGHLKCSSDIADALCKLCLCDSHIPTGSQLSMPLAYWANSNMFNELDMLATKHRVKMSVYVDDVVFSGEQLNKLFLSTVKKICARYGMTVHPDKIRLYNKEQPKVVTGVAIIGGELKVDHKQHKLLENDLKLWNACKEDPIASDLSLPRKISGRLSAMGSVEKEYLDRARSFRKKNSIR

SEQ ID NO: 3227 - protein, 316 aa, Acinetobacter sp.
  source 1..316: note = Related to JZRF01000008.1; note = Acinetobacter indicus
MNQINLKPKLITKNKSYKIQNSALYMIKTKNHLARVLLVDIEEIKNIENICTQYNVFQIEGKSSKLREIQTPINFLEIVHNRIASLLCRIETPNFLHSGKKSHSNITNAKAHLGYNLQVLTIDIENFYPSTTAQKIYKFFLHGMKCSETISKILTKICTYNEHLPTGSRISMPLAYFANMLMFQEIEKLSIKHEIKLTVYVDDITFSGFKVSTLFYKLIRNIIFRHQHLVNIKKTRFYLKNQPKLVTGVILKENSIFIRNKHHKELYELKELYEITKTNNPEQLFSIRNKLVGKLYSCGVINSKYKSEAKIYLNTP

SEQ ID NO: 3228 - protein, 316 aa, Acinetobacter sp.
  source 1..316: note = Related to NZ_RCHC01000004.1; note = Acinetobacter chengduensis
MIQKNSKPKLVTKNKSYSIQDSALYMIKTKKHLARVLLIDVEKLKNIKDICTQYNVFSTNGKSNKLREIQTPINVLETIHNRIASLLCRIKTPDFLHSGKKNHSNISNAKVHLGENLKILTIDIEKFFPSTASKKIYEFFLYGMKCNKTVSKILTQLCTYNECLPTGSRISMPLAYFSNMLMFQEMALLASKHQINMTVYVDDITFSGSNISTLFYKLVKKITIRHQHSINDDKTRFYTEYQPKLITGAILKGNSLLIRNKHHKELYEFKELYSFTKDNNPTQLSEVRNKLIGKLYSCGVINVKYKSEAKVYQNYL

SEQ ID NO: 3229 - protein, 316 aa, Acinetobacter sp.
  source 1..316: note = Related to JAIWSZ010000041.1; note = Acinetobacter baumannii
MNSKLKIVTLKKSYNIQDSALFKVRSLKHLAKVLLIDIEKLNDLSFTKDQYRIFTITGKSGKEREIQNPTGLLAQIHSRIASLLCRIKTPDYLHSGKKGRSNVTNAKYHTGHNLEILTVDLVDFYPSTTSNKILNFFLCTMKCSYKVACILTTLCSYNEKLPTGSQISMPLAYFANCMMFKEIEALSNKHNIKMSIYVDDITFSGEKITRLFYSLIKKIVVRHGHSLKHTKTRYYKKSSAKLITGVVVKDANLLIRNKHHQEIYQTKELLTIAIHSDSKEQIGSLRLKLIGKLHACGSIDPKAKSEAYYYQRQSIN

SEQ ID NO: 3230 - protein, 315 aa, unidentified
  source 1..315: note = Related to JABMOK010000124.1; note = Pseudohongiella sp.
MKLPAKHSPKLHIKSNKKSYLPSDSALYNLTTKKRLEAIIGKTIAEIEAAGIDENYRVFGLKKGGKTREIQAPKYSLDVIHTRIASLLVRVAVPDYLHSGIKGRSNITNAKAHIGNHPLLTMDIQKFYPSISKKSIFNFFHIRMNASRDVAGILAEVCSYKDCLPTGSRISMPLSFWVNYEMYSKLESLCLNKGIIMTVFVDDFTFSGDQVDEKFKKHAKKIIKESGLEVHPRKTRLFGKGFPRVVTGALVDGSGIKVRNKHHKSIYTLFGEIEKCSDDKKLEKMQMQLLGKLSAAGQIDKSFKNKAAQFRKAIC

SEQ ID NO: 3231 - protein, 329 aa, unidentified
  source 1..329: note = Related to NZ_SLYB01000032.1; note = Cricetibacter osteomyelitidis
MKKKKKLITHNKEYTLDKSPLFNIEYIKRLVSVLNADEEIITSLIKYKAENYNCFSQGKKKREIQTPINELYLIHNRIASLLARIKLPKYLYSGVKNRSYIDNAKEHLNSKAILTTDVTAFFPSTTRTMIFWFFKDKMQCSSRMANILADLCSINDHLPTGSQISMPLAYWVNSSMFKELHRLAEDHKLKMTVYVDDLTFSGEKVPKGFKYQVEQIIKKHKHQIKSEKTTLYNNQSVKEVTGLILKEGKLLPPNRQLKKLHQHLNLWEKLIESPRNGIKIEWLYPKVIGVLNNITYFRPEYKNVIFAIQKEYHQYKNTPSNYKNQIDAN

SEQ ID NO: 3232 - protein, 325 aa, unidentified
  source 1..325: note = Related to NZ_MNAL01000052.1; note = Glaesserella parasuis
MKKKKLITHNKSYAIDKSPLYNIQYIKRLSDILQINEKTIFSLIENKTKNYNCFLQGKKKREIQSPINELYLIHNRIASLLARVKLPEYLYSGVKNRSYIDNAKAHLTSKEIITTDITAFFPSTTRTMIFWFFKNKLKCSHKIANILADLCSINEHLPTGSQISMPLAYLVNASMFDELNNLAEKNKLIMTVYVDDVTFSGEKVPKGFKYQVERIIKKHKHNIKAEKTTLYKNQSVKEVTGLILKDNTLLPPNRQFKKLHQHLTLWKTLIAKPRNGIKIEWLYHKIVGILNNISYFKSGYKNVVFAIQKEYHQYKNTPTNYKKAD

SEQ ID NO: 3233 - protein, 322 aa, Pasteurella sp.
  source 1..322: note = Related to NZ_CP076113.1; note = Pasteurella multocida
MKKKLITHDKSYQLENSPLFKIQYTKRLSQVILQSEETISSVFESKAQYYNIFQQGNRLIEVPLRTLYAIHNRIASLLARITPPDYLYSGIKNKSYITNAQQHLDSDVILTTDITAFFPSTTKEKIFWFFKDKMQCSTKIANHLAELCTIDGHLPTGSQISMPLAYWVNANMFDELNRLAKENELKMTVYVDDVTFSGARIPKEFKFLVERTIKKYRHSIKLEKTKLYKSQSAKEVTGLILKDGKLLPSNRQIKKLHQYLNLWGELLSQPRQGRKIEWLYPKLVGVVNNIAYFKPEYRNVVFAIHREYNQYKNTPSNYKKEV

SEQ ID NO: 3234 - protein, 316 aa, unidentified
  source 1..316: note = Alcaligenaceae bacterium; note = Related to JAGYHV010000039.1
MKYPVKYSKPSYPLSKSPFYRLCSISYLKRILEVCVWYEEELLNEIEQFYSCYDSSGHQKRFPYPIDELYGIHNKIASYLARMEMPEYIHSSKKGASYLTNAQVHQGTKETFKTDIRSFFQSTTKAMVFKFFRKKMLCSRAVSEYLAHLCTLDNALPLGSQVSMRLAYFANMDMFEQLFLLAQSHNLRMSVYVDDITFSGDKIPKGFKGQVAQIVHRHGHKIKRNKTKCYSQNKKEITGIMIDGETLKLPDRKLLQIHNEFNKFKALLKTTERDKEKILYKTRYLFGLLNHAAQFDPKYQLIRKELKAKINEKCGL

SEQ ID NO: 3235 - protein, 390 aa, unidentified
  source 1..390: note = Related to NZ_KB893940.1; note = Actinobacillus capsulatus
MAIHKRHTLQTSPLYGLKHLHQLQHLLYHSRYFRNTNIDLDKQYKLSETAHREVFYPDDTLYNFHSELNKFLSKIEKPEFIKSGKKGESYLTHVSSHINKNQYFSLDIRSYYSNINRLDVFKFFRNNLGCSHKIANYLAYFCTYKDQLPLGSPMSMNLAYFINEPMFYCLNEIAVKNNLSMTVYVDDIAFSGRVITSKVKYDIIGVINKHGYSINEDKLRFYKSKKTYRETSGLLIYKGKLLPNKEKLDKLHKMLSEWDALLRLDKPLETKNHFIRLISFISYLCQIDTKYMQLKYKVIKEYNNKKEGDLLAIYQDRITEWNTLLSNHETSFHALNEKHAELNELIKNLSKLNKKHLILYKQIKYEHEKFKKHKRSSIGRFFSAFSKYLA

SEQ ID NO: 3236 - protein, 310 aa, unidentified
  source 1..310: note = Related to PKJP01000009.1; note = Neisseria perflava
MILCTTDEIFSIINNKIFYYNMFEIGGRVCHTPCYELKGLHSRLAQFLVRIKKPRYLYSGVKGLSYVDNARVHSVYYETFKTDISEFYSATTQAIVFKFFRNKMQCSHKVANILAELCTLEGKLPTGSQLSMILAFWANSDMFEQLNQLAQEHHLVMTVYVDDITFSGAKIPAGFCQQVAQIMSEHGHAMNKKKTRLYQANSHKEITGLIINRVGDSPIPPNRFYLKLHNKLAEFNQIYAEIKNGKSKMEEDTLRQLTNHLIGLLNHASQFDKKYKMVKKHIQKQHDDLIQYLQTTHKVGSGKLGKLCIR

SEQ ID NO: 3237 - protein, 328 aa, unidentified
  source 1..328: note = Related to NZ_KB893930.1; note = Actinobacillus capsulatus
MNKIRRKSLKIPIRQTKEYDLNQSPFFKLVSIKKLLSILRVSQEELKDILDNPTSHYSIRIENKRDIQSPKKYRILYRIHNRIAHHLRAIITPDYLFSDKKGCSIYDNAIVHFGCKMLLNVDISKFFPSTNRNKIYSFFKYSMQCSSEISDIMSYLCSINNHIPTGSQISMRLAYLVNKKLFDDLYKFAKDKNLKMSVWVDDVSFSGDKIDSSVIYVVEKIIKKHGFNVSKNKTQIRHSTENKSVTGIFISGDIMEASKELYKKRRIKLREWKNFIKNKEISLEELEKVKDSLLGLLNYLNLFEPSSSKYIALIENDFLSYSNKRISI

SEQ ID NO: 3238 - protein, 326 aa, unidentified
  source 1..326: note = Related to NZ_CP015030.1; note = Mannheimia granulomatis
MNKIRKKSLKIPIKQNKEYELNQSPFFKLVSLKRLLSILRVSEDELKDILDNPASYYSIRVENNREIQSPKKTKSLYRIHNRIAHHLRAIITPCYLFSDKVGCSIYDNASVHIGCKMLLNVDISKFFPSTNRNKIYSFFKKDMECSPQISEILSYVCSINGHIPTGSQLSMRLAYLVNKKLFDHLFHFAESKSLKMSVWVDDISFSGEKINSNFLNSVEKIIERHGFNISKHKTKLKHSTESKSITGIFISGEKMEASNESYQKRRVLLEKWKESIKNKEIPIKELEKLKDSLLGLLNYLNHFENSSKKYIFQIEKDFIEYLKRVS

SEQ ID NO: 3239 - protein, 329 aa, unidentified
  source 1..329: note = Related to NC_015964.1; note = Haemophilus parainfluenzae
MKKKFKKLHITQTKEYELTQSPFFKLYSVDKLLNILKVEREILEDILNFPGNYYTFKTSNGRNIQTPSKDLSLYLIHNCIANHLRAIITPDYLFSDKKNCTVYDNASVHLGCDILLNIDISKFFPSTTYIKVFKFFRYRLLCSTEIADILAHLCTINDHIPTGSQISMRLAFLVNQGLFNDLYNLAISKNIKMSLWVDDISFSGAEVTPTFKYKVYKIIEEYGFKVSEHKTKLSYKGQPKSVTGIFIDGDKSIGANEHYKKRRVLFKKWKDACKKKTFNKKQFQRIKALRIQILGLLNYLNHFEPSSKNYINIIENDFKKIKNKFLYKI

SEQ ID NO: 3240 - protein, 319 aa, unidentified
  source 1..319: note = Related to NZ_LR134510.1; note = Actinobacillus delphinicola
MTKLNTRNKSYNLEESPLYNIQYEQKLLKILNISQNDLIFVRENLKDFYHSFSKKHRIIQTPKNLLKQIHYRIGDLLARIAMPDYLMSGKKGASHIENAKLHLQEDLHVFTADIEKFFPSTKRQAIFKFFKNKLQCSHNIATILSELCTTHEGRLPTGSQLSMHLAFWTNFNMFEKIAKLSNQYDLRFSIFVDDLTFSGKTIPHNFKYQLKKIITSYGYQINTQKILLFKPFKIRRVTGIYIKNGDTHLPNTFLRELHTALQSWKDILKTSPDKLDKKKLETTYNKLLGSINYAALLDKKYKQIRKKVIAEKQKITQYQ

SEQ ID NO: 3241 - protein, 319 aa, unidentified
  source 1..319: note = Related to JADGFW010000011.1; note = Psychrobacter sp.
MSKKKLKIKSSKKYSINQCRLYKVTSLKKLCEILGINNRELKLIIDKSKNREFYNCYINQKGRLIQEPINLMYRVHNRIANLLARVETPSYIHYSKRGYSHISNAKAHLDSKQLITFDIKSYYQSIDYETLRRFFREKLKCEQDVAYILSMICSFEGSLPTGSQISVYLCNLTNLDMFDEMYLQSNRVDQKFTVYADDITISGRTVNNSHYNVMKKIIERYGYIIKEQKTKRYTSNQIPIVTGVALRNTVDVKNEYYKGLRKLCEGVNFNIDNEPYAQLKDRYLSLKGKTQYIKQLNKEVPYFILQTQMLLEKKLEGQL

SEQ ID NO: 3242 - protein, 319 aa, unidentified
  source 1..319: note = Related to VOBE01000007.1; note = Psychrobacter sp.
MSRKKLKVKADKRYSIDQCRLYKITSLKKLCEILSINNEELKLLIDKSRNSKFYNCYTNQKGRLIQEPINLMYRVHNRIANLLARVETPSYINYSKKGCSHISNAKAHLYSKQLITFDIKSYYQSICNEALRRFFRDKLKCEQDVAYVLSIICSFEGSLPTGSQISVYLCNLANIDMFHEMYLQSNRFQQEFTVYADDITISGDIVNDSHYNVMKKIIERYGYIIKEEKTKRYTSNQTPIVTGVALKDTVDVKNVYYKGLRELCESINLNVDNESYAQLKDEYLSLKGKIQYIKQLNREVPCFILQTQSLLEKKLEGQL

SEQ ID NO: 3243 - protein, 319 aa, unidentified
  source 1..319: note = Related to AUSW01000014.1; note = Psychrobacter aquaticus
MSGKKLKVKTDKKYSIDQCRLYRVTSLKKLCEILGINNQDLKVLIDKSKNSEFYHCYVNQKGRLIQEPINLMYRVHNRIANLLSRVETPSYIHYSKKGCSHISNAKAHLHSKQLITFDIKSYYQNIGNETIRKFFRDKLKCEQDVAYILSIICSFEGSLPTGSQISVYLCNLVNLDMFQEMYLQSHKAQQQFTVYADDITISGQIVNDSHYNVMKKIIERYGYTVKEEKTKRYNSNQIPIVTGIALKNTVDVKNVFYKESRKLCENININIDNEPYAQLKDKYLSLKGKAQYIKQLNKEVPYFILQTQMLLEKKLEGQI

SEQ ID NO: 3244 - protein, 319 aa, unidentified
  source 1..319: note = Related to NWFK02000001.1; note = Psychrobacter sp.
MSKKKLKVKANKTYPLNQCLLYKVPSLKKLCVILKITKEELLTLMADSESNGLYNCYENKEGRLIQEPRDLMYVVHNRIANLLSRVKTPDYIHYSKKGHSHISNAEVHLDSNQLMTFDIKSYYPSISSELIRKFFRHKLKCEQDIAYLLSKLCTIDGSLPTGSQISVYLCNLVNLDMFNEMKLQCDRFNHKFTVYADDITISGESVNESHYNVMRKILERYGYEIKESKTKRYTSNQTPIVTGIALTKNLDAKNDFYKQLRQLCDDINFIIDNASYAQLKDEYYSLKGKAQYLKQLQQKVPEFVFTTQARLEKKLEGQI

SEQ ID NO: 3245 - protein, 317 aa, unidentified
  source 1..317: note = Related to NZ_CAJHBG010000001.1; note = Psychrobacter sp.
MSKKKVKANKIYSLNQCRLYKVTSLKKLCSILKITEEELSLLVESYENSDFYNCYINKDGRPIQEPKKLMYRVHNRIANLLSRIETPEYVHYSKKGHSHISNAEVHLHSKQLMTFDIKSYYSNISSESIRVFFRHKLQCEQDIAYLLSKLCTLNGSLPTGSQISVYLCNLVNLDMFDEMKLQCEMFEQKFTVYADDITISGKSVNKSHYNVMSKILERHGYEIKESKTKRFTSNEIPVVTGIALKKTSDVKNSFYMELRQLCEGIDIHIDDASYAQLKDEYYSLKGKAQYVKQLNQKIPKFVFQTQAKLEKKLEGQL

SEQ ID NO: 3246 - protein, 321 aa, unidentified
  source 1..321: note = Related to NZ_JABUZJ010000058.1; note = Psychrobacter namhaensis
MKVKSNKLKVKTDKYYPLNQSALYRVNSKKKLAEVLLISGTELATLIRDDDKIKFYNCYLNEKDRLIQQPQGLMYKLHNRVANLLSRIETPEYIQYSKKGLSHITNASIHANSKQVITFDIKSYYLSIKRESVQNFFREELECEIDIAFILSKLCTLDEALPTGSQISNYLCNLVNLVMFDEMNSLASRFGMSFSVYADDITISGDNLDSSHLNTMRKIIERYGYCIKDEKTKIFKGNETAVVTGIALKESLDIKNEFYSDLRKLCELVNSYIDKESYAQLKGDYFKLKGKIQYIKQLNQTIPRLALNTKALLERKLDGQI

SEQ ID NO: 3247 - protein, 318 aa, unidentified
  source 1..318: note = Related to NZ_CAJHAZ010000027.1; note = Psychrobacter sp.
MKKKRKLKVRHFNKQYPIHQSPLYRLSSLKKLSVLLAMPLKDIRKLNGNNDSRYNVFTNKDDREIQEPFNEIYVIHNKLASLLSRIDTPTYLHSFKKQYSHITNSKTHLGSEQVITFDIKAFYQNITQDKIRMFFKNDLKCSPDIAFLLSKICSYDNHLPTGSQVSIYLNFLVNRTMFDEMHSLAETLKICLTVYADDVTISGEKVDMGMLNTMSKIVERHGHTINKQKTRKYSNNQVPVITGIALCNGKTQPTNEKFKELRQKSNFLLRVSNDLDLDFLKKESMSLDGTLNYFSQLSSEVPKSTLEARDRLAKLLGI

SEQ ID NO: 3248 - protein, 318 aa, unidentified
  source 1..318: note = Related to NZ_CP047226.1; note = Moraxella osloensis
MSNKKRLKIKNHNQYPFHQSPLYKLKSKKRLADIFNVELSELKSWFNTIPSEYNVFLNEKDREIQTPLNNLYIIHNRLANLLSRIETPSWLHSFKKNFSYLTNAKSHIDSRQVLTFDLKSFYQSTTQNAVRKFFKDTMLCSEDVSFFLSKICCYNNHLPTGSQVSIYLCYLVNIKMFDEMRRLAVSRNALLTVYADDITVSGDKIDYSLLNTMRKIIVRHGYKLSEDKTLRFKYNEIPVITGIALVQGELRPTNKFMSELRSKVYFLNRNAEELDIELLKKEKQRINGKINYIESLNRPIPSQAIDINKKLDKLVPIK

SEQ ID NO: 3249 - protein, 319 aa, Citrobacter sp.
  source 1..319: note = Related to VHJG01000001.1; note = Citrobacter freundii
MKSTKRTPSLQRFPKLYPLNQSPFFKLKTRTKLLEIIGLSRSQADKLMLDSAYKEFINDAGRSIQEPIAQLKAVHKRIGILFSRIELPQYLHSGRKKHSTLTNAESHRHATELLKLDIHKFFPSTSAAKVYKAFVEKFEMSPDVAYVMTNLATFAGKVPTGSPISMAIAFWANKDMFDELSNLATLSNLVFTAYVDDVAFSGAKIPKGFASQAKKCIHSHGLTSKDKKERFYPASEGKLLTGIVIQNGKLKVRWAHNDSIGKEFATLAEAKDNAAKISHLEKLAGKLHAAGQIDFRQKDKARFFTQQLKVAKKQSEQDS

SEQ ID NO: 3250 - protein, 325 aa, Enterobacter sp.
  source 1..325: note = Related to CP084692.1; note = Enterobacter mori
MKSTKRTPSLQSPPKIYPLNQSPLFKLKNKRKSLEIIGLSKKQADKLMLDSAYKEFVNDAGRTIQEPIAQLKAVHRKIGVLLSRIELPPYLHSGRKKHSTLTNVESHKLATELLKLDIHKFFPSTRAAKVYKAFVEKFEMSPDVAYIMTNLSTFAGKVPTGSPISMAMAFWANKDMFDELSNLAASNSLVFTAYVDDVAFSGSKIPKGFAAQAKKCIRSHGLTSKDKKERFYPSSEGKLLTGIVIQDGELKVRWAHNDSIGKEFATLAEAKDNATKIIHLEKLAGKLHAAGQVDFRQKDRARFFYTAAQSHKKALRTRYLKQQVD

SEQ ID NO: 3251 - protein, 319 aa, unidentified
  source 1..319: note = Related to NZ_FMBC01000051.1; note = Kosakonia oryziphila
MISTKRSSSLHSSPKLYPLNQSPLFKLKSKKKLLEIIGLSKKQADKLMLDSAYKEFENDAGRAIQEPIAQLKAVHKRIGALLSRIELPPYLHSGRKKHSTLTNAKCHRHATELLKLDIHKFFPSTKAAKVYKAFAEKFEMSPDVAYLMTNLVTFAGKVPTGSPISMAMAFWANRDMFDTLSELASSNNLVFTAYVDDVAFSGSKIPKGFAAQAKKCIKSYGLTSKDKKERFYQSSEGKLLTGIVIQDGELKVRWAHNNSIRKEFADLAKVKDNSAKIIHLEKLAGKLHAAGQVDFRQKDKARFFTQQLKAAKKQSTESS

SEQ ID NO: 3252 - protein, 321 aa, unidentified
  source 1..321: note = Related to JAFJZU010000002.1; note = Pectobacterium brasiliense
MISTKRSSSLHISPKLYPLNQSPLFKLRSKKKLLEIIGLSKKQADKLMLDSSYKEFENNAGRTIQEPIAQLKAVHKRIGALLSRVELPPYLHSGRKKHSTLTNAECHRQATELLKLDIHKFFPSTKAAKVYKAFVEKFEMSPDVAYVMTNLATFAGKVPTGSPISMAMAFWANKDMFDELSELATSHNLIFTAYVDDITFSGLKIPKGFSSQIKRCIHSHGLVSKQKKEKFYSSSQGKLLTGVVIRDGKLKVRWAHNSSIKKEFNELAKAKDDTEKIIHLEKLAGRLHAAGQIDERMKNKARFFSKKLKEAKQSLLIRSTK

SEQ ID NO: 3253 - protein, 305 aa, unidentified
  source 1..305: note = Related to NZ_JAESHX010000078.1; note = Pectobacterium polaris
MNQSPFFKLKTKKKLLEIIGLSKAQSDKLMQKSAYKEFVNDAGRTIQEPIAQLKAAHRRIGVLLGRIELPTYLHSGRKKHSTLTNAESHIQANELLKLDIHKFFPSTTAAKVHKAFVEKFQMSPDVAFLMTNLVTFSGKVPTGSPVSMAMAYWANKDMFDELSDLAISNSLIFTAYVDDVAFSGVKIPKGFSSRVKKCIHSHGLVSKQKKETFYDSTQGKLLTGVVIQDGKLKVRWAHNSSIKKEFDELAKAESDTDKIIHLEKLAGRLHAAGQIDERMKNKARFFSQKLKEAKQHLAAQSSEKS

SEQ ID NO: 3254 - protein, 319 aa, unidentified
  source 1..319: note = Related to JADOXZ010000029.1; note = Pectobacterium brasiliense
MKSTKRTPSLHRAPKLYPLNQSPFFKLKNKNKFFEIIGLSKHQVEKLSFETAYKVFINESGRTIQEPIPQLKAVHKRIGILLGRIELPIYLHSGRKKHSTLTNAESHRYATELLKLDIHKFFPSTSAAKVYRTFIDIFKMSPDVAYLMTNLVTYSGKVPTGSPISMAVAFWANKDMFDELSRLAFSNGLIFTVYVDDVAFSGEKIPKGFAAQAKKCIHAHGLVSKKEKETFYPSSKGKLLTGIVIQNGKLKVRWAHNASIKNELDTLAKAENTPEKITHLEKLAGKLHAAGQIDYRLKDKARFFTRQLKKAKTQSEQEN

SEQ ID NO: 3255 - protein, 325 aa, unidentified
  source 1..325: note = Related to JACYNZ010000001.1; note = Pantoea agglomerans
MKNTKRTPSLHSKPKLYPLHQSPLYKLKVKSKLFQLLGITKSQLAKLSQDKSYNVFTNENGRTIQEPIPQLKLAHKRIGKILSRIEMPSYLHSGRKKHSTLTNARAHIKANELLKLDIHHFFPSTTAARVYNLFHRKFDMSPDVAYLITNFVTYSGRIPTGSPISMALAFWANWEMFDEINKLAISHDLVFTVYVDDLAFSGEKIPKGFASQVKSIISSNGLISKRKKEIFYPSSKGKLLTGVVIQNGELKVRWAHNASIKNEFDNLSLASQDVQLRIKLLERLTGKLHAAGQVDYKLKDKARFFTKQLKIARCTLIQQPHLSHQ

SEQ ID NO: 3256 - protein, 318 aa, unidentified
  source 1..318: note = Related to JACETZ010000001.1; note = Pantoea stewartii
MKNTKRPPSLHCAPKTYPLNQSPFYRLKVKKKLYQLLGLTKAQVERLSQDNSYNVFTNEKGRVIQEPISQLKLAHKRIGKMLARIELPDFLHSGRKTYSTLSNAEAHINADELLKLDIHKFFPSTTAAKVYKVFNEKFEMSPDVAYVITNFVTFSGKIPTGSPISMAIAYWANWELFDEINKVSIANRLVFTVYVDDLAFSGRKIPKGFASQIKSLIASKGLIAKKNKEVFYPKSKGKLLTGVVIQNGTLKVRWAHSASIKDEFKNLAIMSRNKESTVKLLEKLAGKLHAAGRIDYKLRDKARFFTKQLKIAKCVLID

SEQ ID NO: 3257 - protein, 328 aa, unidentified
  source 1..328: note = Related to JACYMO010000013.1; note = Erwinia persicina
MKNATRSSSSFSSLKNYPINQSPLFKLTTKKKLLALLGFSLPQIEKLSKDSSYRVFLTPSDRCVQEPILQLKKIHKKIGSLLNRIEQPDYIHSGRKKRSIITNAKVHQNSYQLLKLDIHKFFPSTSGSKIYRLFVNDFQMQPDVAHLLTNLVTYNYSVPTGSPLSMVLAYWANKSMFDELYQLANENDLDFSVYVDDVAFSGEKIPKGFSHCAKSCISKHGMKSKSKKEMFYQENQAKLLTGVIISDGVLKTRWKHSQMIKKGFETLALQTSDGDRVIALEKLTGRLHAAGQIDPRIKSKAIHFSKILRAAKLDIIAAKNENDKPDVS

SEQ ID NO: 3258 - protein, 316 aa, Vibrio sp.
  source 1..316: note = Related to NZ_MPHM01000037.1; note = Vibrio ostreicida
MSKNRSPSFKYYELNQSPLYKLQSKNKLNALLGINKNQIPSLLSDELFNQFLNKDNRLIQHPIGKLELVHKKIYCLLNKIIKPSYLHSGTKKRSTSTNAEIHKNNKEMLKIDISKFFPSNSERKIRNLFLYQFEMSIDAASYLSKLICINGILPTGSQVSMQIAYFANKVMFDRLNTLAKENNLSMTAYVDDVAFSGEKIPTGFLKKVKTIVNESGLTIKNKKIKIYREKQPKMITGIIIKNNMLTVRNKNLRKIKQTFLEIFTPNAHLSLEEKEVIYTRLKGQLHAAGQINKRFKQKAKHINKNQKKYLKQNQTL

SEQ ID NO: 3259 - protein, 300 aa, Acinetobacter sp.
  source 1..300: note = Related to CP012952.1; note = Acinetobacter baumannii
MESSPPCDYAKYVYELELLSSPLFHITSKKRLAILLHSSVKELNNIVRSKDQMYQYFNETQTDNSGNIIKVRPIQNPHDRLKQIHSRIGKFLGNLKAPEYLHSKRSKSAISNAKAHVGIKGHTLNIDITDFYPSTSRAKVQAFFGYTLQYPTDIAKYLSEICTVKNCLPTGSPLSSALAFWANKSMFDEIYRVAKSRAITMTVYVDDISFTGRAVNQNFLKKIIQIVGKYQHKIKQEKIKFFPEYSVKFVTGVAILNGRLQPAHRHYRDIRVLQKIDNDLQATLRLMGKNNYIKQITNQV

SEQ ID NO: 3260 - protein, 300 aa, Acinetobacter sp.
  source 1..300: note = Related to NZ_VPDH01000112.1
MGNSQPSDHARYVYDLELLNSPLFHITSKKRLAMLLCSSVKELNHISRSKNQMYQCFNKKQTDNNGNVIKVRPIQDPHERLKQIHSRIGKFLGNLKAPDYLHSKRSKSAISNAKAHVGLKGLTLNIDITDFYPSTSKAKIQSFFGYTLQYPTDIAKYISEICTVNNCLPTGSPLSSALAFWANKAMFDEIYRIAKSRSINMTVYVDDISFTGKAINQKFLKKIVQIIEKYQHKIKEEKIKFFPENGVKFVTGVAIVNGHLQPAHRHFRDMRHLQKFDNDIQVALRLAGKNNYIKQITNHS

SEQ ID NO: 3261 - protein, 304 aa, Acinetobacter sp.
  source 1..304: note = Related to DADBFC010000020.1; note = Acinetobacter baumannii
MKKLSYVSFDYVEHIKDLAIFNIQSKRYLAFVLKTQLPLLKDISRNPNNFYRFKVKEIVKNEKLKIRRIEEPNSILKPIHKQIHNLISQLPAPDYLFSKKKSSCVLNAKVHSLAKGKTLNIDIENFFPSTAKWKVQNFFGYYLQYNRDVAAFFADICTVDGHIPTGSPLSLMLAFWANQPMFNELNKLSKSRQITMTIYVDDISFTGEAVSEKFKNKVIEIVNKHHHTVNADKVRFFGKDLKFINGIAIVNNQLEPSNELSGKVRNLKKSKEIQYIKNLNGKIGYIKYIKKVDSLNRDITTECK

SEQ ID NO: 3262 - protein, 303 aa, Acinetobacter sp.
  source 1..303: note = Related to NZ_CP060811.1; note = Acinetobacter variabilis
MSSQLKGNYELNQCVIYKLKSKRKLKKLLNLSENSNLKIYFNDDYFSCFDLMQEDGSARNIQTPINELQQIHIRLANFFKYVKTPDYLHSGKKKHSIVTNAKAHIDSSKPTLTIDIAKFFPSTKREKIFNFFYKKMHQSADVADILSRLVCYNNHVPTGSSISMLIAFWANKEMFDELYKLCEANNIIMTVYVDDISFTGNGVGKLFLKKVTEIIERYGLNIKKEKVKFFKANSPKTITGVIVKNNRIYARNEHYKKLRVMESAYKITKVEDVIEKGIMQKAYNGQLAFLVQIHPQLRNKMVF

SEQ ID NO: 3263 - protein, 300 aa, Acinetobacter sp.
  source 1..300: note = Related to NZ_VPER01000044.1
MTKMTPRCSANYDISQSILYKLHSKKKLSEILGLPLSVLKICKNDSYYSCFDLEQKNKIRSIQQPIDQLFIIHQRIASLLTRIYHPDYLHSGRKKHSIITNASQHLISDKKTLTIDIEKFFPSTTQNKVFHFFRTIFKQSVDVADLLSHLLTFNNHVPTGSPVSMSLAFWANKNLFDELSRFSKNRNTIMTVYVDDLTFTGSGVNSNFLKNASKIIEKHNLKVKKSKVFLYKENQAKFITGTVVLNNKLEAEFKQFKALRVSEFLFLNDPKNEVYRNAYNGRLAFLSQIKPNLKIKMNFK

SEQ ID NO: 3264 - protein, 311 aa, unidentified
  source 1..311: note = Related to DABN01000043.1; note = Candidatus Gastranaerophilales bacterium HUM_16
MNVHNGIKIEDSSLYRINRECLFLLLGIKNNDELKTLLSNNNYKVYTVGPKNRIIEEPDKKLKNIQTKFNKLLQQIETPPYVFAGRKKMNHISNAKAHIDCNDMICADIKKFFPHTKIKYLQEFLETNLKFSPDLALDVANLLTINGHLPTGAPSSPLLTFWSYKIVFDKIYDFATNLGITMTIYIDDMTFSSKSKVSKKLIPFVGAELTRVGLELHPEKLKNFKCSKYKHVTGVCIDRKHRLVVKNEHRDNLLKILNSKDDITQLSTEQIETCIGMIKSMQLIEPKIFEPTLKKLKEIYKLRPKRIVKKR

SEQ ID NO: 3265 - protein, 307 aa, unidentified
  source 1..307: note = Related to nan
MTIKDNFKSFESLDKTLKLLDVSLEEMQQAINKGYRRYKTFKNGKFRWIEEPNDELKIIQQKILLYLQNNLECPTYCTAGFKGQNNIKNAEKHRNKREVLTMDISHYFPNTQEKYVRKIFSEFIGVDDNVLNLLVKITTFNGYLPTGAATSTILSCFVHKEIFDNIFKKMKSLDIDMTVYVDDITLSTHKHISNWVISHINNSLQSHGLFLKKSKIKRYGYKHAVVTGVHIAQSGKMSAPFKIGHSAICALCDKDLKQMSLTELRKIIVKISYIQQFNPLKMIKVKKQAIKQLKKLQKISANKNERI

SEQ ID NO: 3266 - protein, 317 aa, unidentified
  source 1..317: note = Related to CP013653.1; note = Paenibacillus sp.
MNTLMKKRYDITQCSFYKCRSKRRLMNLLMLNEEEFKNIKKKICYHSFTQAKKDGDKRVITAPNEELKRIQKRILKLFSYVKRPEWLISGERGKSYIDNGRYHINSNYFLTMDIRKFYDNCKREYVYRFFNDNLEMSKDTAAILTDLVTYEGKVPTGCPTSQIIAYYAYQKMFHSIHKVAEMHGCKFSLYVDDMTFSSSSPFNPDSLRNDIDKILRKYGHRPKYSKVKYYSKNKFKLITGVTISSDHKLLVSNTLRKKIYDGAMSQIEMDRQKKVTIPKELRRLKGRIQAARVVNPHIFPEVNRFVEEKLYSSGSYK

SEQ ID NO: 3267 - protein, 321 aa, unidentified
  source 1..321: note = Related to NZ_CP040396.1; note = Paenibacillus algicola
MTQIRKKHELDQCALYKCKSKRKLAYYLKIDYEKLKTISNITLYHSFSLQKNDGDPRLITAPKAELKKLQKRILRLLEKVKRPDYLISGEKGKSYLNNALTHQHSDYFLTIDIRKFYDNCKREYVYNFFIKMLQTSKDVACILTDIITFDNKIPTGCPTSQMLAYYAYFDMFTELKEISQRFNSIFTLYVDDMTFSSKTSFNPKALANEVDIVLRKYGHRPKYKKVKYFSKEDFKLVTGVVITKEHALTVPNRLREKIYTGSMAEKERLYTYNPREISKRIKKLRSIKGQVQAAKNIQKTIFPEIDRLIDDKLLDISSHTR

SEQ ID NO: 3268 - protein, 319 aa, unidentified
  source 1..319: note = Related to CP026363.1; note = Brevibacillus agri
MSLKKKRYDLNQCALYKCRGKGRLAYLLHMNKEEFDNLEKLIEYYSFTTDKNDGDKRLITAPRNNLKKIQKRILKLITFVKRPEWLISGERGKNYIDNGKFHQQSHYLLTMDIKKFYENCKREFVYRFFRYTMCMSGDIAEILTNIVTLEQKIPTGCPTSQLIAYYAYQEMFENIKKIANKYNCVFTLYVDDMTFSSKRPFNPDKLRNEIDIELRKYGHRPKYSKVQYYSRNSNKLVTGVVISKDHNLLVANKLQKKIYDNAMKLKKVNGNKKEAKIAYQLESDLRSLKGQLQAARNVKKGIFPEINRLVENSMINLSK

SEQ ID NO: 3269 - protein, 315 aa, unidentified
  source 1..315: note = Related to NZ_JABMCC010000107.1; note = Paenibacillus taichungensis
MARIVKRYRLDQCALYKLKSKKKLAHYLNVDYETFKETGELIHYSAFSLKAEGKKDRSITAPNSKLKSLQKRVHKLLLKIERPEWLISGERGKSYIDNGKMHQKCNYALCMDIRSFYTNTKREYVFRFFIEEMLMSKDTAKIVTDILTFKDSIPTGSPASQLIAYYGYHRMFQEIESISTNKYGCVFSLYVDDMTFSSEKPFQMKGLRNEIDIILRKYGHKPSYKKTKYYSRNKAKPITGTTVSSKHELLIPNSLQLKIIRGAELILEKPQELSRAQLASFRGQVQAARIIQKRAFPELNKLAEEMLSNPLKIPT

SEQ ID NO: 3270 - protein, 308 aa, unidentified
  source 1..308: note = Related to QGTZ01000022.1; note = Paenibacillus pabuli
MARIVQRYKLNQCVFYKLKSKKQLAYFLKVDYETLREINELIHYKSFSLRTEGKKDRDITAPNKKLKDLQKRIHNLLLRIERPDWLISGERGKSYIDNGKMHQNCNYALCMDIKSFYRNTKREYVFRFFTEEMLMSKDTAKVVTDILTFQNSIPTGSPASQLIAYYAYHRMFHEIKSIATNKHSCIFSLYVDDMTFSSDTPFEVNVLRKEIDILLRKYDHKPSYSKTNYYSRNKAKPVTGTTISKNHELLIPNTLQMKIKRDSEMVLQKGRELSTKQRASFNGRVKAARIIEKLAFPELNKLAERMLN

SEQ ID NO: 3271 - protein, 322 aa, unidentified
  source 1..322: note = Clostridia bacterium; note = Related to JAFYLK010000105.1
MKAPIKRYPLHQCALYKCSSKKKLELRLKLNAGDASLLENMIQYHKFSIPKKDSTKLRDITAPADDLKKVQRRILRLLQRIERPQWLISGERGKSYVDNGRAHINSMYLLAADIKSFYDNCRRDYVYRFFTERLKTAPDIAKLLTDIITYKGGIPTGCPTSQIIAYYAYERMFSEIAQVAERHGCIFTLYVDDMTFSSQTPFDPKRLKREIEMILLRYGHRLKDSKVKYYARDDAKPVTGTIITKEHRLATPNQLQKRIVTEFQALKEQMNGQALTPEEKSRYATLQGRIYAARNIEPCIFPEIHRQVTAVKHSPENGKGVE

SEQ ID NO: 3272 - protein, 309 aa, unidentified
  source 1..309: note = Related to NZ_JADCKB010000021.1; note = Ructibacterium gallinarum
MNSAMHKYEINQCALYKCSSKKRLEHLLLLKENELKQIKQYTRYYNFSTPKKDGSPRKITAPCDKLKKIQRRILRLLSPIKRPDWLISGERGKSYIDNGKSHINSKYFLTMDIKNFYPNCQREYVFRFFTDVLLTAPDIAKILTDIITYNNGIPTGCPTSQLIAYYAYENMFKSIYEISLNYGCKFTLYVDDMTFSSNFPFDPKKLEQEIDIQLRRYNHKPKYSKVKYYPANTYKLVTGTTVSPDNKLLVTNNLRQKIVENFKILKNYQKLSNDERKKKIDSLKGQIQAARNVNKTIFPEINRLTNDLK

SEQ ID NO: 3273 - protein, 311 aa, unidentified
  source 1..311: note = Related to QTZF01000005.1; note = Coprococcus sp.
MREKSHKYDITQCALYKIKGSKQLKKVLCITEEEYKDILSIVHYHSFQIDKKDSTEKRNITAPDKRIKEIQTRILKLLQNVERPIWLISGEKGKCYIDNGKSHLNSNYFLTMDIKKFYDNCSREYVFLFFKNRLMMAGDLAGLCTDIVTYDGGIPTGCPTSQIIAYYAYESMFNEIYSVACKYGCEYTVYVDDMTFSAKEPFDINRMKNEVDCILRKYGHKPKYKKVKYYSKGKSVPITGTIVTGQHELKVPNRLQKRVYDDFQELKYLGGKELSDIEIRKLNSLKGRILASRNIEEGKFPEINRLTNFIS

SEQ ID NO: 3274 - protein, 311 aa, unidentified
  source 1..311: note = Related to JAFBIY010000001.1; note = Faecalicatena contorta
MAKQYKRYDITQCALYKCISPYNLKRVLKITDEEYKDIVKIVRYHTFQIDKKDGVEKRNITAPDRRIKEIQTRILQLLQKVERPEWLISGEKGKCYIDNGKKHIHSNYFLTMDIKKFYDNCEREYVFRFFRDRLLMAGDLAGLCTDIVTYEGGIPTGCPTSQLLAFYAYENMFNEISEVAYKYGCIYSVYVDDMTFSSEVAFDVKKMRSEIDQKLRKYGHKPKYRKVKYYSHGQYVPITGTIVTGNHELKVPNRLQKRVYDDFQEIKSFEGRKVTSEEQKKINSLKGRIQASENIEPGKFPEIKRLTKLIG

SEQ ID NO: 3275 - protein, 311 aa, unidentified
  source 1..311: note = Related to NZ_QOHO01000034.1; note = Clostridium indicum
MENKWKKYDITQCAFYKCNSPKNLKRILQIKDEEYNDIFSIVKYHGFSIDKKDGIEKRNITAPDKRIKAIQGRILRLFQKVERPEWLISGEKGKCYIDNGKQHVFSNYFLTIDIKKFYDNCKREYVFRFFKDRMLMTGDLAGLCTDIVTYEGGIPTGCPTSQLIAYYAYENMFKEIYEVATEYSCIFTVYVDDMTFSSEKAFDVNKMVNKVDCTLRKYGHKPKYKKVKYYSQGQYVPITGTIVTGKHEIKVPNQLQKKVYDEFQEIKTLNTENLTDKEQKKINSLKGRIQASRNIEDGKFPEIRRLVNKIG

SEQ ID NO: 3276 - protein, 311 aa, unidentified
  source 1..311: note = Related to FCNR01000043.1; note = Eubacteriaceae bacterium CHKCI004
MSKVIKKYDITQCALYKCRSPRILKKRLVIKDEEYKDITAIVKYHGFQIDKKDSTEKRNITAPNKRIKEIQTRMLQLLQKVMRPEWLISGEKGKCYIDNGLKHIHSNYFLTMDIKKFYDNCKREYVFLFFKNRLCMAGDIAGICTDIVTYKKGIPTGCPTSQLLAFYAYENMFTEIYEVAQSHGCMFTLYVDDMTFSSPKAFNVKEMIREIDCILRKYGHKPKYKKVKYYSHGRFVPITGTIVTANHDIKVPNRLQKKVYDDFQELKDLSGKKLSVEQQKKINSLKGRIQAARNIEKNKFPEINRLTQAIG

SEQ ID NO: 3277 - protein, 310 aa, unidentified
  source 1..310: note = Related to NZ_GL870812.1; note = Clostridium sp.
MRKETKRYNITQSALYKCRSPKKIKTLLRLEDTEYKKITEIVGYHEFQIDKKDGIEKRDITAPNRRIKQIQSRVLELIQKVERPQWLISGEKGKCYIDNGKAHISSNYFLTIDIKKFYDNCKREYVYQFFKNKLQMSGDIAGICTDIVTFNQGIPTGCPTSQLIAYYAYEQMFDEIYRLAVEHGCIFTLYVDDMTFSSIKAFDVNRLVKEIDFKLRKYGHKPKYKKVKYYSHGKPVPITGAIINAKHEIKVPNSLQQKVFEGFQEVKKLQGQELSGNDQKKLDRLKGQIQASRNIETNKFPEIKRLVNQI

SEQ ID NO: 3278 - protein, 314 aa, unidentified
  source 1..314: note = Related to JAGNZR010000001.1; note = Fusobacteriaceae bacterium
MKNPKYRYEINQCALYKCQSKKKICSLLDISDSEFNTLRDSVKYHCFEIYKKDNSDKRKITAPNQRLKIVQKRLLQLIQYVKRPDWLISGEKGKCYIDNGKAHIMSHYVLTMDIKNFYDNCNREYVFRFFKDKMLMAGDIAGFCTDLVCLEGGIPTGCPTSQLIAFYAYEAMFFELYEVACENKCIFTVYVDDLTFSAENPFNVNLLKREADIRLRKYGHRPKYKKVKYYGKDIPAPITGTILMPDNKLKVPNNLQKKIYDNFQDIKNLCDVEAIDKVDLKKIYTLQGQIQAARSIEPEKYKEIGRISSAKVQR

SEQ ID NO: 3279 - protein, 309 aa, unidentified
  source 1..309: note = Related to NZ_SNXO01000023.1; note = Aminicella lysinilytica
MVKKYSIEQSALYKCRSLRRLNTLLFLDTDSKQIADIKKYYSFEINKKDGIAKRKITAPTKKLKTVQKRVLYLLQRIERPNWLISGEKGKSYIDNGKAHIYSNYFLAMDIKSFYDNCNREYVFRFFKDYLQVSGDIAGILTDIVTYDNGIPTGCPTSQLIAYYAYGKMFREISEIAQKYECIFTLYVDDMTFSSQEHFDDNSMKKEIDCTLRKYGHKPKYSKMKYYSHGKDVLITGTVVNRNHELKIPNKLQKKIYDGFQNVKDVDIKEMDCNKKKEIASLRGKLQAAKSIECNKFSDINKIVGNIEKQ

SEQ ID NO: 3280 - protein, 344 aa, unidentified
  source 1..344: note = Clostridia bacterium; note = Related to JAFTWE010000007.1
MRGLMKNKSYPINQCALFKCNSKKRLEHLLTIEQGDLKLVQSIIKYSNFEIDKKNSTEKRKITAPQKTLKQIQRRILYLLQSIEHPEWLISGTKGKSYIDNGKYHCKSSYVLTMDIEKFYDNCTRENVYSFFKNKMCTSSDVAEILTNIVTFNNGIPTGCPTSQIIAFYAYEEMFSNIKKIADKYGCIFSVYVDDLTFSSDKAFDAEKLKRDVDIELRRYKHKPKNKKIKYYSKYEAKPITGTIVTKEHELATPNSLQHKIYTDFQDIKNDCLSSDEELYKKIQVLEGRIQASKNIEIGANKFPEISRLTNRIKENTPIPTQPTVTRKNTNKKAKIRIKNSTQA

SEQ ID NO: 3281 - protein, 336 aa, unidentified
  source 1..336: note = Clostridia bacterium; note = Related to JAFQBX010000034.1
MKAKKYPLNQCALYKCNSKRRLEKTLTIEQGQLKLIDSVIKYSHFEIDKKDSTEKRQITAPKYTLKQIQRRILRLIQFIERPEWVIAGTKEKSYIDNGEFHLKSNYALMVDIKKFYDNCKREYVYRFFRDKMLNSPDVAEILTDIVTYEGGVPTGCPTSQLIAYYAYEDMFANIKRIADNYGCLFSLYVDDMTFSSEKPFNKDVLKREIDIELRRYQHKPKYKKVKYYSKNDPKPITGTIVTKDNTLVAPNKLQEKVYKGFQDIKNLDIDDNSEETIKKIAALQGRIQASRNIEKNKKFPEIERITKQISTEHSGSVPANPPKKSRKRPRKIRIIK

SEQ ID NO: 3282 - protein, 342 aa, unidentified
  source 1..342: note = Related to JAFRQP010000036.1; note = Oscillospiraceae bacterium
MKANKQKYPLDQCALYKCRSRKKLESILAIEQGDLRNIQSAIKYSSFEIDKKDSSEKRTITAPKRTIKAVQARILTLIQRIERPEWLISGEKGKCYIDNGKAHIGSAYVLTMDIKKFYDNCRREYVYRFFLDKMQTAPDVAKILTDIVTYKGGIPTGCPTSQLIAYYAYEDMFKQIQACAESYGCIFTLYVDDMTFSSKDPFPQEKLSREIDIILRRYGHKPKYKKVVFFAKEKPKPITGTIVTSDHELEVPNRLQEKIYNGFQGIKQLSEQNDFKQIDHAAQILLGQVQAAKSIDNKKFPEIERLTKEIRNIQEPQRDFKPKPPHRRKAKGKIHIPKPRTN

SEQ ID NO: 3283 - protein, 344 aa, unidentified
  source 1..344: note = Related to CP095094.1; note = Flavonifractor plautii
MKNKVPIKKYDITQCALYKCRTRKRLEYLLRLDPGGLKIIDGIIGYHKFEIDKKHSDEKREITAPDKTLKAIQRRILYLLQRVIRPEWLISGEKQKCYIDNGKAHLNGKYVLTIDIKKFYDNCTREPVYQFFVQKLETSPDVAEILTNIITYNGGIPTGCPTSQIMAFYAYSDMFSEIFDLAKQHGCKFTLYVDDMTFSSKEPFSPHQLSQMIDRVLRKYGHKPKYPKVKYYGPSDYKPITGTVVTPEHSLAVPNGLQKTIYDAFQTVKPLIGVETCSEEDARQILSLKGQIQAACNIEDGKFPEIRRLTNQIKVPDSQSVSTRKRQHHRRSKKIHIKQQAPIK

SEQ ID NO: 3284 - protein, 336 aa, unidentified
  source 1..336: note = Related to JAFHCI010000085.1; note = Ruthenibacterium lactatiformans
MKNKTPLKKYDITQCALYKCRTKKRLEYLLRLESGSLKMIDSIIEYHKFETDKKHSTEKRKITAPNKALKTVQKRILYLLQQVLRPDWLISGEKRKCYIDNGKAHLDGRYVLTIDIKKFYDHCTREPVYHFFVQKLKTSPDVAEILTNIITYDGSIPTGCPTSQIMAFYAYFDMFSEVYDIAQKCGCKFTLYVDDMTFSSKEPFSPHQLRQMVDRVLRKYGHRPKYPKVKYYGPSDYKPITGTIVTPRQSLAVPNGLQKTIYNAFQSVKPFIDAESHSEEDVKQILSLKGQIQAARNIEEGKFPEIRRLINQIRIPDNQTASKQKSYARLHSKKSE

SEQ ID NO: 3285 - protein, 327 aa, unidentified
  source 1..327: note = Clostridia bacterium; note = Related to JAFWRN010000131.1
MENPSLKKYDITQCAFYKCRTKKRLAFLLCLSLKELEHISGIIEYHSFEIDKKNSEEKRKITAPSKELKTIQRRILALLQRVIRPDWLISGEKGKCYIDNGKAHINGRYILTMDIRKFYDHCVREAVYQFFIQKMKTTPDVAKLLTDISTYNLGIPTGCPTSQLIAFYAYIDMFSEIAAIAREYGCVFTLYVDDMTFSSSKPIQVNNLIRKIDCILRKFKHKPKYSKIKYHHPSDYKPVTGTVISPNQTLLTPNSLQHKIYIGFIKLKPKLFENNEALSNEEGKELQSLNGRIQAARNIEEGKYPELKRIIHNSQAAIRYNGKRKKI

SEQ ID NO: 3286 - protein, 307 aa, unidentified
  source 1..307: note = Related to DVNI01000021.1; note = Candidatus Avacidaminococcus intestinavium
MQDKFRRYDINQCALYKCKSKKKLEKLLNLQIGELKYINVITTYYHFEIAKSSSHEKRAVSAPSSKLKSIQSRILSLIQYINRPGWLISGEKGKSYINNSQCHISANYLLAMDIKNFYNNCKRNPVYLFFLNELKTSPDVANVLTNIVTYENLIPTGAPTSQLIAFHAYTNMFTEINQMALNFGCIFTLYVDDMTFSSSVPFNHMSLSCNIDKILRKHGHRPKYKKLKYYSKNESKPITGAILTPTHTIKVPNKLRYKIHNTFQKIKNNSNFSDEAKSELLTLKGRLQAAKSIEKNIFPEISRIINS

SEQ ID NO: 3287 - protein, 322 aa, unidentified
  source 1..322: note = Related to QSVE01000001.1; note = Megamonas rupellensis
MINKNKLYRYDISQSALYKCRSKNKLSEFLKISIKDVDKIIKYYTFNIPKKDTSKTRQISAPQKKLKTLQKRLLYLIKRIKRPPWLFSGEMGKCYLDNGKYHLNNPYVLTIDIKSFYEHCTRNAVYLFFLEKMQTSPDVAKILTDITTLDKKLPTGTPTSQLIAFHAYEDMFNEINNLAKSYNCIFSLYVDDMTFSSSYPFSPKNLTYKIKTILHKYKHHLSSEKVKYYSKDMAKDITGLILTKDNQIAIPNRLQKKIYDNFSKIKDYEKMTVYDKEIIKSINTLKGQLQAAKNINYNVFPEITRIVYSINCKTNKKPLGNS

SEQ ID NO: 3288 - protein, 303 aa, unidentified
  source 1..303: note = Related to CP010994.1; note = Clostridium perfringens
MMMIKKYDICQSPLYKLKNKRRLEKILGLEKYELNKLKFWNKYKSGKIPKDDGDFREINIPNFKLKKVQKKLQILLSKIQRPEWLISGEKNKCYINNAQYHIKSKYVITADIKKFYDNCSRERVYLSLVNKFKVSSDVAGAITDIVTYNKRIPTGASTSQLIAYYSYEDMFNEINTISHKYGCKFSLYVDDMTFSSINPINVQSLKRQIDIILRKYGHRLKSNKFKYYSKDEDKLITGVTLKSNNSLAVSNRLRYNIIKDFKGIKYRKDSNIKLQSLKGRITAAKMIEKSIFPQINNYVSNLN

SEQ ID NO: 3289 - protein, 312 aa, unidentified
  source 1..312: note = Related to JACEGF010000016.1; note = Macrococcus bohemicus
MRKQPPKFYNINQSALYKCRSKRKLAELLKCDLKTIQQMAKDIKLYYDSFSMSKKDSEKVRKVDAPNEQLKRTQKNILKLLQRIEKPDYVMSGTLGKSHIDNAQYHIKGSYFLKTDIKQFYNNCSRDRVYRFYVDKMKTSPDVANILTDLTTYNNIIPTGSPSSQIIAYFAYEDMFNNMYIKAKENGFLMSLYVDDLVFSRTDYIDYKSFLREIEVEALKFNHSLKKSKTMYYSPNRSALVTGVIIKNKKMKIPNRLRNNTILQYKNIKKDKNKDEKTELSLIGSINSARMIEPNHFNGVFSFYKQIKKTPK

SEQ ID NO: 3290 - protein, 308 aa, Staphylococcus sp.
  source 1..308: note = Related to JALCVX010000013.1; note = Staphylococcus hominis
MKKKKLKFYNINQSLLYKCRSKKKLAQYLHYDLKSLKKIISEIDSHYNFFSKDKKNSDKKREIEAPSDELKKIQKNILKYLKKIQKPNYVMSGTLGKSYIDNAKYHINEKYFLKTDIKQFYKNCSRDRVYRFFLDKMYTSPDVAEILTNLTTYRNTIPTGAPSSQLIAYFAYEDMFNNMYRKAKNNGFKMSLYVDDLVFSRNDYIDFKSFLREIEIEALKYNHSLKKSKTMYYSPKKAALVTGVIINKGELKIPNRLRNNAVHQYRDIKNNFIDDKVLLSFIGNINSARLIEPNHFNGLLSFYKKTPK

SEQ ID NO: 3291 - protein, 310 aa, unidentified
  source 1..310: note = Related to NZ_CACSLH010000030.1; note = Enterococcus sp.
MPRKKTNVNLYELNQCVFYKCYSKKKLAEILKITLRELKNTSWNANTSYYQFSQKKKGTDELRKITAPDKELKKVQSTIYSFLRRIKKPEWVISSTLKKSYLSNALYHKKSNYFYKTDIKKFYDNCHRDRVYRFFKDKMKTSSDVAKILTDLTTNENIPTGCPSSQLIAYFAYEDMFNNIKIIADKYKCIMTLYVDDIVFSNADKFNYRALIREVENEVRHFDHSLKKSKTKYYTGEKGAPITGVIVKNNLLYVPNSNRKSILDSFSLAKGINKISEKEFKSLRGKVNAARLIEKNHFNGINSYLKKNNP

SEQ ID NO: 3292 - protein, 307 aa, Staphylococcus sp.
  source 1..307: note = Related to PZAM01000037.1; note = Staphylococcus chromogenes
MNTLTNWRKNDLKQFKKYPIHQCAFYKCKSKKKLASLLKTDLKNLNRLSKSIEQEYYTFNKKRQITAPKKELKAIQKRVLNLLNKIEKPDWVISSTKEKSYLDNAHYHIGAQYVCTTDIRSFYNNCSRDRVYQFFAKKLMTSPDVAKLLSDITTLKYIPTGSPSSQILAYFAYEEMFINMFNISQKFNCKMTLYVDDLTFSKDSSFNYQNLINHIDIEARKFNHSLKYKKTNYKSVKKGAKITGVILKNYELKIPNSLRISILKDFENIKNNQELKHQVMSLKGKINAARLIEPNHFNGTNSYVKSL

SEQ ID NO: 3293 - protein, 306 aa, Leptospira sp.
  source 1..306: note = Related to AHMP02000001.1; note = Leptospira kmetyi
MKHQKYHSIKNSPFFRLKSIDKLAEYLNTKSKRLIYLENMPLTERYRCFPQGTRDIQQPIGFNRFIHNRLHTLLSRILSPDFVFSGKKGFSHVDNALAHLNSKYAALMDIEGFYRNSKREYVFRFFLKKLEMASDIANILTNIVCFNDFIPTGSPLSQLIAYWAYSDMFEEIETVASSNNFIFSLFVDDLTFSSQDRIRHDFHLEINAILKSYRLNIKRKKLQYRSKNQTKIITGCAITPDNKIKVRNKHRVKYINNLQLLLGSHQNRKDEKLIDSALGLISSLQAIEPQIFMESKRILKQKISFS

SEQ ID NO: 3294 - protein, 304 aa, unidentified
  source 1..304: note = Related to NZ_CP067089.2; note = Breznakiella homolactica
MRKVNKIYDITFSPLYGIKNKRKLRELLDIGTNEELIHLPLTNSYRIFSINGREIQEPIGLLRKIHDRLFRYLSRIDTPTYLYSGKRGLSYVDNAKRHINSSYFLKMDIKGFYKNANREYVFRFYRYRLNQSDDIAHILANISCYGKIIPTGSPISQLIAYWSYKQMFDEIAILNKDKIFTLYVDDLTISSVELSLAKNLHLQVQAIVKKYRLDLKRKKIRYYNKRENKHITGCVITSDHKFRVPNKHRKKLISIMRKYPSLNTIPEGELMKLTGLISSSQQIEPDIFINTKKRLSQIIKKQLA

SEQ ID NO: 3295 - protein, 309 aa, Leptospira sp.
  source 1..309: note = Related to CP030147.1; note = Leptospira mayottensis
MHTVHGNFFYTLSNKKRLAKYLRVSLKELLTLQDDSNYKVWFEEGENGKLREIQEPSYKLKSVHSIIQKSLASIVAPEFLFSGVKGKSNISNASYHKDSNYIVTADIRSFYINCNKEYIFRFFKYTLHTSDDIARILTELCCYKTFLPTGSPVSQILAYHSYARIFNRIDAFSKANGITFSLYVDDITLSSEKSIHPYILKKISKLLESVNLSLKREKTKFYSKNSYKIVTGCAISPDHILLRPNKIMRKINNKLCKHEKDLSKLTSKEIESVLGQVIYLRSITPNSYSQLFKSLSLMKAEEKIKQRPL

SEQ ID NO: 3296 - protein, 308 aa, unidentified
  source 1..308: note = Elusimicrobiaceae bacterium; note = Related to JAFZUQ010000009.1
MKTLKYPINKSSLYNLQNKKKLKQLLYIDNSEFNYFAKQVNIDNEYHPFVNKKGRGIDNPSKRLKKLHSRIQKLLSRITYPKYLYSAAKRSNIKNVLKHKNHKYMFKTDINKFFPSSKKEYIFRAFKYNFQMSEDIAWYLANLVCYNDHLATGSPVSTILSFWGYKGVFDSIYALAKRRGITMSLFVDDMAFSSNKYIPISFKSKIEKYLKNVDLILSLKPSKNIFYKSNEEKKLTGAIITTDKKLKILPETELTIKDLLNNIENLNHQKLKSLLGMLQYQKQVEKNNPNITEHISLVKAKIKNLISK

SEQ ID NO: 3297 - protein, 300 aa, unidentified
  source 1..300: note = Related to PKTM01000012.1; note = Denitrovibrio sp.
MSNKQYNIHQSPLYKLNSKSKLSSILHIDNLANLLRDGHYNRFEMNGRQIESPCKELKRVHKRVLKLLSRINTPDYLISGKKGLSYVDNAKVHTRRCNLVKMDIKKFYPSSKKEYVFRLFHYKFRMAEDVAWILTELLTCDGHIPTGSPVSQILAFMIFADTFEEINNLAITHGCCFTLYVDDITISSTGNIPRKLIYAIRNELKKVNLNLSGKKTRFYSLNKTKCVTGCVITPDGELRIPNKLHQKIHEKSTMLNKEGLSPHDHQVLFGLLNAAQQIQKSTFPSLYREAKRNFKISVAQ

SEQ ID NO: 3298 - protein, 303 aa, unidentified
  source 1..303: note = Rhodobiaceae bacterium; note = Related to NVWR01000002.1
MKNYSLEKSPLFGIPSKAKLADLLNVGRSDLLAMSRNPTYSFFKIRKGEKFRDIEDPNPDLKKLQKRLNRLLSRIQVPEYVKSSRKGISYVDNAKFHLGFNCTAKFDIDKFFRSTKREYVFRCFHYTFGMPGDLAWLLTDLVTLDGHLPTGAPTSPLLAYWAYADVFSRMHSLAESRGAVMSLYVDDVAVSGNQPLKSEFRDKLSSIAGDYELKLKKDKTHYYLEGETRLITGCALNTVGQAIVPNKLRRKISIMIQQRDISDMTEKEIRRLYGLLNSARQIEPDFSPGLFGRAKSRIETLPV

SEQ ID NO: 3299 - protein, 329 aa, unidentified
  source 1..329: note = Candidatus Scatocola faecipullorum; note = Related to DVNC01000014.1
MSQMKIYPLENSPLYQLCNKSKLEELLGLPKGYINNFTYSRENYHCWHQLKKNKIDTRPVEDPCGILKKAQSKLNKLLSRIYTTDYLMSGKKHSNYIKNAKYHQNNPYVFCFDLSAFFQTATRHYVFSAFKNEFLMSEDVAWMLTDLVTIPNIENTDGYIPTGSPSSQNVIYWAYKKAFDTLFRVAESKKLKFSLYVDDMTFSSSRPISNKFPQLIQKLCSKVGLKINSKKTRYFSKNDFKDITGNVISPKKELKVPNRRRKEILDILAFKNIKDMNVKEIRSFYGKLCSMRQIEPNIFPALYNEARSQYYKLGAQYNQSKQFMKGRRK

SEQ ID NO: 3300 - protein, 329 aa, unidentified
  source 1..329: note = Related to BK021518.1; note = Myoviridae sp.
MKQIKTYPINNSPLYRLSNKSKLAELLGVSKKYLEHFNYSRDNYKCWKQKKKNKKGARPVEDPTLILKKAQSKLNKLLSRVITTDYLMSGKKHSCYINNAQYHLNNPYVFCFDLHTFFQTASRKYIFKAFKNEFQMPAHIAWLITDLVTIPKLDNSDGYIPTGSPSSQNVIYWAYKKTFDKLLEIAEAKALTFSLYVDDMTFSSQRPISATFPKLIQKMCARVGLEINETKTQYFSAKDYKDVTGCIISPKNELKVPNRRRNELINIVKNKPIEEMDIPEIRSLYGKLNSMRQVEPNIFPQLYNQARKRYYELGAQYNTKSKQKIRKKK

SEQ ID NO: 3301 - protein, 328 aa, unidentified
  source 1..328: note = Related to JACFNN010000015.1; note = Alphaproteobacteria bacterium
MLTIEQSWFYRLGRKRDLAALLNLSLSELKALTNDKNFEPWEKTFPDGKKRLIEEPQPQLKKALTEVQKILSHIQTPPWLMSGKKKIQPRDNAIAHIKNAYMISVDIAKFYQNSKREFVYTLFRDDFKQTTDIASLLADLVTYNGHIPTGAPSSQLLAFWTYRKTLEKIHAEASRQHITMTVWVDDITFSSRKPLPKNWLTFVKRSLDKTDLHLKKEKIKFHGQKDHKITTGSAISPKGVLKVKNQKRLEILSLIKSKKIEQLTLKEARSLLGKLTAQRQNEPDFFSSTYIRCKKHLRNLEKMKQKESYHKKPKRIKSLKQKPAAQSR

SEQ ID NO: 3302 - protein, 343 aa, unidentified
  source 1..343: note = Related to SVDP01000050.1; note = Enterocloster citroniae
MSKCYPIESSPLYRLRNRRRLAKLLYLPKNYFQEEHTYCYNEFSRPKPNGDGKRHFTVPPDDLKDIQKHICILLKRIITPEWVMSGKKSCSYITNAEIHLKHRFVRTMDISKFYDSAQRSRIYNMFSQTFKMASDIAWIMTELVTYNGMLPTGSPSSQLVVYWTYFNMFQRINELSEKYDCRFSLYVDDMTFSSDFPIKRQLRDEVSVVLRKNGLLAKSKKDHYYQANDFKVITGVGIRQGKKIVPNNKRKQIIELYVQCKKSGNIYDIEKLNGILCSLRQIEPNIFPEIYGYVHCYEKELKKLSRDRFYRTKRKKKPYRTKQMYNVVNNMNLVEQRKEGKQC

SEQ ID NO: 3303 - protein, 336 aa, unidentified
  source 1..336: note = Related to BLMC01000012.1; note = Lachnospiraceae bacterium
MNKCYPIENSPLYRLRNRRRLAEFLNLPKNYFKEEHTYCYNEFSRPKPNGDGERHFTVPPEDLKDIQKHICKLFKRIITPEWVISGKKSCSYITNAEVHLKHRFVKTMDISKFYDSAQRSRIYQMFSQTFNMASDIAWIMTELVTYNGKLPTGSPSSQLIIYWTYCGMFQRINELAEEYNCYFSLYVDDMTFSSDFPIKAILRDGVSDVLRKNGLLAKSKKDHYYQVNDFKVVTGVGIKQGKKLVLNSKRKQIIELYAKCKKSSNIYQIEKLNGTLCSLRQIEPDIFPEIYRYVHSYEQELKKLSRDRFYRSKREKGRYLSKHIHNVGINTEQGFD

SEQ ID NO: 3304 - protein, 337 aa, unidentified
  source 1..337: note = Related to RZYS01000049.1; note = Clostridia bacterium
MMSSKCYLLEQSPLFRLRNRRKLATLLKLDEKYFSNERAYTYRSFSRPKPNGIGIRKFTVPSDELKIIQKQICKLLSRIETPEWVMSGKKSCSYITNAKVHLEYPFVKTMDISEFYDSAQRSKIYNMFFNLFQMEHDIAWLMTELVTYNGGLPTGSPSSQLIVYWAYSDMFNEIQLLSTKYNCTFSLYVDDMTFSSDESISGKLREDVSALLRKNNLNAKVKKDHYYQMKDFKMITGVGIYKGNMVVPNSRRKAAISLYSECRKHGNIKDIEKLNGILCSMRQIEPNIFPEIAMYVKHYEKELKEYSRKRFYMARRKAYQKKRNSCSVAVSNEVKIC

SEQ ID NO: 3305 - protein, 331 aa, unidentified
  source 1..331: note = Related to JAFQOE010000034.1; note = Lachnospiraceae bacterium
MSKMYALEQSPLYRMRNKKKLATLLRISTNYLMQEHGQDYYKFSRPKPNGDGTRNFTVPSDELKYAQKKLCRLLSRIQTPDWVISGKKNHSYITNAEKHIENTFVKTMDISKFYDSAERKYVYRMFKETFKMAEDIAWLMTELVMYENMLPTGSPSSQLIVYWAYCDMFNEINQIANERACIFTLYVDDMTFSSKTPITKELRQEVCNQLKKYGLIAKSKKDHYYQGNTVKVITGVGINDGQKVVLNNKRKRILEQFEKCKTSNKIYDIEKLNGMLCALRQIEPEIFPEIYNYIKHYDSELKLMARNRFFKHRRKRRKIEKQRQYINQNNI

SEQ ID NO: 3306 - protein, 325 aa, unidentified
  source 1..325: note = Related to NZ_MIEH01000001.1; note = Merdimonas faecis
MSKLYPIERSPLYKMCNRRTLANLLCLPTKYFSYEHEYQYNEFSKPKPNGNGRRDFTVPSDELKAIQKRICRLLSRIVTPEWVMSGKKHCSYITNAEHHVDKKFVRTMDVSKFYDSVQRNYIFKMFKNTFQMAEDIAWLMTDIVTYKGVLPTGSPSSQLIVYWTYAEMFDAIKRKADENDCDFTLYVDDMTFSADHPISTEFRNEIAIQLKKNGLLAKAQKDHYYQPGSFKVVTGVGIENGEKKVLNNKRQKILFQYEKCKKTCNLYDIEKLNGMLCSMRQIEPDIFPELGNYIKHYEAELKEMARKRFYANKRKKAKVKEKNYA

SEQ ID NO: 3307 - protein, 328 aa, unidentified
  source 1..328: note = Related to JADCKL010000006.1; note = Sellimonas monacensis
MSKTYSIEFSPLYRMRNRRKLARVLKLDEKYFKQNHTYKYNHFSEPKPNGTGTRNFTVPEKELKSIQKRICKLMSRIETPEWVISGKKKHSYISNARNHCRNYNVKTMDISQFYDSAKRKYVYSMFKEKFLMADDIAWIMTDLVMCGGTLPTGSPTSQLVVYWSYSDMFENIYEIARKYKCEFTLYVDDMTFSSNIGISKQLRKDVEELLNSYCLHAKAKKDHYYQNNAFKKVTGVGIKKGKLLVPNQKRYEIIGMYKTCLKNKDIIEIEKLRGLLISARQIEPDIFPEIYRFVEKYKDDLNLLARNRYYRNMRKRKKVQRREDVAFV

SEQ ID NO: 3308 - protein, 323 aa, unidentified
  source 1..323: note = Lachnospiraceae bacterium; note = Related to JAFNXD010000190.1
MRKSKTYPLEKSPLFRLRNRRKLALLLGLDVDYFKTAHEYSYKEFEKPKASGDGVRKFAEPKGEICEIQKHILKYLKRIETPEWLKSGKKSESYITNCKMHKDALYIRTMDICHFYDAVSYAQIEKSFCQVFKMAPDIARLMAKLVTNRKTIPTGSPSSQLVVYWVYRDMFDEINSIAATFGCKFSLYVDDMTFSSEKQISHQLRDAVVKKLNEYGLHAKRSKDHYYEAQDYKVVTGCGIKDGKTDVPNKLRYKIVQQYRLCQLTDTIAEIEKLNGMMCSARQMDENIFDSVSNYLCKNRERLKGYVRSRKSKRQYEDNDFEF

SEQ ID NO: 3309 - protein, 309 aa, unidentified
  source 1..309: note = Related to CP016090.1; note = Clostridium beijerinckii
MNKDINQYELEDSLLYRLRNRGKLAEMFNLPHNYFRTQYKLDIEYKSKHIQTGRNKKDRLVENPSKKLKNIQREILKYLSRIQTPDWIISGKKGKSYIDNSKFHKDNSYVITSDIMNFYPSCKKDYVYRMFRYTFRMSSDLATILTTLVTYNGGIPTGAPTSQMIAYWAYKDAFIRINEIALKYNAKFSLYVDDMVFSSKSTISKRMILEIKKELQKYNLSLKDNKTRKYGSKDYKLITGVVYDKNGELKIPNRLRKDIIDGYNEIKKKKDNCNETDKKSLLGKIYSARQIEPDAFSQLLHNVKKIECK

SEQ ID NO: 3310 - protein, 307 aa, unidentified
  source 1..307: note = Related to NZ_FOTS01000082.1; note = Pelosinus propionicus
MKKIVERHHKKQSFFYCLANKSLLATQFGLPQNFFRSKYKEQLIYSFFEISKKDGSSREINNPKYDLKVLQRKILNYMNRIYKPDWLMSGRKTISYIDNGRKHLGSNYVITIDIKKIYSNCKRNNVYNMFKDVFKMTPDIASIMADLTTFEGAVPTGAPTSQVIAFWTYQDAFEKINEIAQQYDCIFSLYVDDMTFSSLGEIPTQLLLEVDKELKLVGLSIKWKKVKRFGINHCKLITGVVLDEAKQMRIPNALRLSIIQGVKKLSNKELSQEERLRLIKSLKGKINSARNIEPEIFPEIHRKISSI

SEQ ID NO: 3311 - protein, 308 aa, unidentified
  source 1..308: note = Related to NZ_CAPF01000040.1; note = Enorma timonensis
MRPSIPLNQCMFYKCRSKKALARCLLLDLHQLQRRSEWIQYRVHAEQKASGGLRVIYAPADELKSVQKVIKSRLHRIEVPSWVYSGVKGRCHIDNAKHHAGSRYFVLSDISSFYENCTRDAVYRFFRDDLLCSPDVASLLADLTTVRNAEGKTVNPTGSPCSQLIAYFSYRSMFHEIASIADRYGCKFSLYVDDLTISSESPISNPRNLMKQVAKSLRAYGHRVKWEKTGYFGKNQFKLVTGVAIDQQGELNIPNHLGEAVITGLKETLSGDRSEIAPTLGRINAARQIDGRVFSEARRLVENAQRCF

SEQ ID NO: 3312 - protein, 306 aa, unidentified
  source 1..306: note = Atopobiaceae bacterium; note = Related to JAFVBW010000499.1
MRPEITIDQCQLYKCRSKKRLAEILYIERADFNDIPTWATYRISHLEKGDGGTRTIYSPSKRLKKVQKRIKRLLERIHKPSWVFSGTKGKCHVDNAMHHAGNTYFVLSDIAEFYESCTRDTVYKFFLNEMKTSPDVAELLADITTLETNGKTIIPTGSPSGQLLAFFSYREMFDELEELTTRHGCRLSLYVDDLTISSNTPIANPKSLQKQLARIMASYGHSIKWSKTRYVKPSEFKVVTGVAIGPDGTPHIPNNLGRAIIGGLQDALGGDCLSQASTLGRINAARQIVEGSFPEVERVLCDYRHL

SEQ ID NO: 3313 - protein, 306 aa, unidentified
  source 1..306: note = Related to NZ_QSNG01000001.1; note = Paratractidigestivibacter faecalis
MTHPIDQSRFYKLRSKRKLAEVLCTNPQELKRTLRNASYRISQTPKADGTFRTIYNPNPSLKRVQHRIGNLLSRIEMPPWAFFARKGVCYVDNARYHEGARYLVKSDLSSFYDHCDREHVYRFFKNTMKCSPDIAEALCDLTTYTLQDGSTIIPTGSPSAQIVAFLAYREMFDEIKAVADLYKCKFSLYVDDLTFSSRSGISNPSNLERSISHIARQYGHCIKAEKTVYLDASTSKIITGVALTPSGEPKAPNALREATVSDLTQISSGDLSKIVSCLGRINAAQMIERNLFADSKRQVEQILASA

SEQ ID NO: 3314 - protein, 308 aa, unidentified
  source 1..308: note = Related to NZ_AP022829.1; note = Adlercreutzia hattorii
MKKTVRQYPLQRSPIYRLGRRRDLEELLYMQKGDSRRVKCFSEYNIFDKEKSSGGSRTIEAPCSKMKKWQRRVWDLMARIEKPDWVISATKGKSYKDNASKHRSNGYVMTMDISSFYPSCVREYVYRLFRERLECSPDVAQCLTDICTYQGGIPTGSPASQAVAYFAYAKMFEEIEDLARTYGCTFTLYVDDMTFSSQDNFSWKKLAYEVDGVLHKYGHRAKGSKTKYRLPGDFKIVTGVCLAPDGALVAPNKLRSKIVGNTRSLKASGDLSLLSRIQGQIQAADYVEGRRTFPGIRSELERIAEAAL

SEQ ID NO: 3315 - protein, 307 aa, unidentified
  source 1..307: note = Related to FP929047.1; note = Gordonibacter pamelaeae
MGANRKKYAIEQCALYNLTTKRRLEEKLLLQSGELKGVMRGVTYRDFQIPKKSGSFRQVSEPNKRLKLVQKRVLWLLSAVEKPDWVMSATPGKCHKDNAVFHRSNAYMVTMDIESFYDKCERERVYQFFKRKLRQPGDVAKALTDLSTYRQSIPTGAPTSQIVAYFAYESMFAEINQVAKSHGCIFTLYVDDMTFSSGEPFSPDKLASEVDAVLRKYGHKSKMSKTRYYPKGTCKLTTGAAISRQLLLVAPNDLRKRVLENYDKLRKTGDKSLVAVILGQIGAAEFIEGRDMFPGIKQAVRAFGNAS

SEQ ID NO: 3316 - protein, 300 aa, unidentified
  source 1..300: note = Related to JAGBOE010000222.1; note = Pseudobutyrivibrio sp.
MKRASKKYDLDQCALYKCKSKKKLAELLLIDLRYIKNSKNFIDYHSFELTGKNNKTRLINAPQPILKKIQKRLLALLRPINRPAWVMFGEKGKSYIQNAIVHQYNPYCITMDIKGFYDHCRRDAVYRFCKDKLQVSPDAATIITDFTTWEQRIPTGSPVSQILAYHAYEDMFCKINEYAKSIGAKFTLYVDDITISSKNAIDPKKLASKVRKILHVYGHTISKNKTKYYSKNDFKLITGVIISPNHQLLVPNKLSHKINNELEHLYSIMQESTDVQGAILRLNGLLQAARLIQPNYRSDI

SEQ ID NO: 3317 - protein, 309 aa, unidentified
  source 1..309: note = Related to VDFO01000068.1; note = Companilactobacillus halodurans
MKKKYPLSQSYLFKCHSKKKLADSLGMSLKKLKYISNNPRYYSFTKRTGTKNREIDVPSDAELKKAQKNIYNYLKYTNRPNYLMAGEIGKNILSNATFHKDSDYWLKFDISNFFPNCKREYIYRFFQSSMQCSPDVASILTNITVYRGGLVQGISTSMLLSFFAFTPMFDELSLLATKNNLKFSTYVDDFTFSSSSPINTNFIKLRVNKIVRAYGHTIKNRKVKYYSTNDSKRVSGVIVTKTHHLKVPNKNRKKIISLAKSMRENINTGNYQEAEKIRLSLRGCINSARQIEPEIFPEISKFTKTKFKS

SEQ ID NO: 3318 - protein, 310 aa, unidentified
  source 1..310: note = Related to QUAW01000007.1; note = Apilactobacillus micheneri
MTYPINQCYLYKIHSKKRLSKIFGLDLKKMMDISNTPIYKNFYILKKNKKDYRKIEYASDTLNGIQRKIHKYLANINKPKFLTGGVKSKSILTNGKIHKNNNYWIKFDISNFYVNCNRDYIYKFFLNDLKCSPDISEILTNLTTFEGHLIQGSSSSVDLSYFAYSKMFKQLNDLALLNDLTFSTYIDDFTFSSNIPINIDYISKNVLKILRLYGHKAKRNKVKYYNINSNKLITGIVVNKNNEIRVPNYNREMIINLRRKIEDNDSCDLRDILSLIGMINSARQIENGVFSNSYNYAQNILKRLRKNKSY

SEQ ID NO: 3319 - protein, 310 aa, unidentified
  source 1..310: note = Related to NZ_AP014808.1; note = Lactobacillus acetotolerans
MRKGKYALNQSALYKCGSKKRLAEILGIPLGTLKENAENPQYHIVYKPKKNSTEKRKINAPRKTLKRIQGKIYKKLQYVKRPKWVMAGEKGKNWPDNAEFHKDSCYVLKFDIANFFPNCGREYVYRFFLNRLKCAPDIAEILTNLTTYHGCIVQGSPVSMVLAFYAYEKMFDELANLADENSLLFSTYVDDLTFSSKKQIQKDKLIKIVNKKLHAYDHKSKSKKEMYYGKTKYKKITGVILYPDHVSKVPNRIRLKIKRSLVAAKEAEKEGNVKQANDFKKELVGTIYSARQIEKNIFPEALNYAKQQVS

SEQ ID NO: 3320 - protein, 317 aa, unidentified
  source 1..317: note = Related to NZ_RHOJ01000001.1; note = Lacticaseibacillus jixianensis
MKPSESRKRYNLNQCALYCCRSKSKLFKLLGTNAREIRDLTKNMNEQYSIFDLEKKGGGTRTVHGPSPLLKRIQKTLYKYLRKVERPSWLISGELGKSVIDNVRPHQFAGDMIKLDISGFFDNCKREPVFQFFHTILRQPGDVASICTELCMLNGAIVQGSPTSMVIAFYANRKMLEELQQLASDFGLVFTVYVDDIAFSCAASFNEDALLSRACQIVRAYGFRVKTKKVREYPLEKPKLLTGIVISKKNTLSVPNRVRRTILDSMTSYRKMDDSNEKEKLRQSMLGMIASAQQIEPGIFNSIRGQLLSDRRKQLVS

SEQ ID NO: 3321 - protein, 315 aa, unidentified
  source 1..315: note = Related to CP045180.1; note = Schleiferilactobacillus harbinensis
MTTKVTKRYLLNQSALYHCTSKRKLARVLQIDLKRLVGIVGDIPNQYSTITRPKKDSGERIVHNAHFELKRVQRRLFTLLRRVKRPNWLISGEIGKSITDNVRPHLGGTQLLKIDISGFFDNCSRESVYQFFHVQMAQPSDVAKICTDLCTLENAVVQGASTSMLIAFYANQSMLQELHELAEDNSLIFTVYVDDIAFSSSHSFQASDILDQATRIVSAYGFRVKNKKVRAYNDSRPKLLTGVIITTTSKMAVPNCKRRKILDDMTQYRRSTNPAERRSMRSKILGQISAAQQIEPDFFTGVKNQLKYEMRMDED

SEQ ID NO: 3322 - protein, 311 aa, unidentified
  source 1..311: note = Related to CP017713.1; note = Loigolactobacillus coryniformis
MKKNIRRYPLNQSQLYKCHSRRRLARMLDTDLKTLEEIAKNPRYYSFTRPKKNSNERRIIDAPNQRLKKIQTSVYAYLRKVKRPDWVMAGEVGKNWTENAETHADDSYFVKADISKFFDNCEREYVYQFFLTKLEQSPDVADICTSLVMFEGKIVQGAPTSMVIAFYAYQKMFEELACVAKQFHCIFTIYVDDVTYSSLDPIDSAALEARISQIMAAYGHKVKRQKVRTYGSQRAKRVTGVILSTDHQMLTPNSLRQEIYADFQQYLAQKKADKDDPNLDHQRASLLGKINSARQINPGIFPEMHRILKNG

SEQ ID NO: 3323 - protein, 316 aa, unidentified
  source 1..316: note = Related to JAGZJL010000011.1; note = Coprobacillus cateniformis
MKNITLSNNPLYNLKSKNKLKKLLYVDNFDNIINQYDVFIAKPARLVEKPSNQLKIIHTRIFKFLKKIEIPDYLFSSKKGKCYIDNARLHQNNSFVVTLDLSKFFPKSNASHIYNLFEKKFNMSKDVAYIMTQICSIDTSKITLKDSVKRWYQNANNKLKYPIPISHVPTGSCTSQIIAFLSFIDMFEEMNSIACCNNITFSVFVDDIIISSNQPIKRHIINKFKYIATKYGHEINKSKIKYYGINYNKRITGVIITKDHRLKSPSKNHFQSFKDAQQYKINPSIKSKQRTIGRIQAVRNIEKQKFIQLIKDIKQV

SEQ ID NO: 3324 - protein, 313 aa, unidentified
  source 1..313: note = Related to CP051151.1; note = Tenericutes bacterium zrk29
MENALFNLKSKKKLAKLLFYDKIGYLDKDLSFINNYSVFIVETSNGGTIKSRIVETPRGMLKVIHDRVFKFLNQVDLPDYLISKRGSSYVQNHISHKNNSNVVSIDIQKFYPMCSFGNVYKFFHNTMNMSPDVAYIISEILTINYENIKINDKVDEYLEQQEVKNKVKFPTKHIPTGSSVSNILSFLSYREMFEEIAQLSKRYNIEMTVYVDDITFSSNEQFPKTFIGKVKKILIKNGHKYNKRKSKKLDKNHNKNITGVIVNKYKQTKIPNKLHLKYKYAKRDLLKDPSQLNNQKLNGIKEAMKQIDTVSKK

SEQ ID NO: 3325 - protein, 306 aa, unidentified
  source 1..306: note = Related to JAFSUG010000001.1; note = Oscillospiraceae bacterium
MLKRLLHIEDNKFLKQDYIASMVTPYIDKKGKARLIEPPREELKTIQKRIKMMLGQIVVPSNVFSGIRGRSYAENAVMHSSEKLRNLFKIDLTAFFPSISRETVYRFFYEDLCCSPDVAETLTNLTTIDLEKSQAHCLDEIYSFLNYKGVTCKNHLISGAPTSQIMSYLVNHRMFEEMQKVADDNNAVMTVYVDDVTFSTEDHISRHFKNRVIDIVRKYGYQISKAKVKNYTKLYPKLVTGVIIDSHGKPIIKNSMREKIIKEYELLRDHPESAESKQRLKGLLTAARQVDHRAFPTIYRFAFDKE

SEQ ID NO: 3326 - protein, 306 aa, unidentified
  source 1..306: note = Related to JAFYVE010000007.1; note = Clostridia bacterium
MLKRLLRIEDSKFLKQDYVASMVSPYIDKKGKPRLIEPPREELKIIQKRIKQMLGQIIVPSNVFSGIKGRSYADNAVMHTGESRRNLFKIDLTAFFPSISRETVYHFFYEDLCCSPDIAEILTNFTTIDLDKSQANCLDDIYSFLDSKGVLCKNHLISGAPTSQIMSYLVNHQMFDEMQKVADENGAVMTVYVDDVTFSAENRISKNFRDRIIAIVRKYGYQISKSKVKKYTKLYPKLVTGVVIDSEGKPVIKNSMREKIIKEHDYLREHPDDAKSRQRLRGLLTAARQVNNHAFPTIYKFAHNKT

SEQ ID NO: 3327 - protein, 308 aa, unidentified
  source 1..308: note = Related to nan
MLLLHIKDSRYIKQDYIADMVSPYIDKKGKPRLIEPPCEELKTIQKKIKNMLGQIVVPNNVFSGVKGKSYADNAIMHVDNKRRNLFKIDMTAFFPSISRETVYRFFCKDLCCSPDVAEILTNFTTIDLKKSHARYLDEIYAFLDSKHVKCKNHLISGAPTSQIMSYLVNHRMFDEMQKLSDENNAVMTVYVDDVTFSSENWLSGSFRNKIVDIVGKYGYQISKNKVKKYTKLYPKLVTGVVIALNGKPTIKNSIRMKIVLEHAHLRDHPEDADSRQRLRGLLTAARQVDAHAFPTIYKYAYELDTKNN

SEQ ID NO: 3328 - protein, 312 aa, unidentified
  source 1..312: note = Oscillospiraceae bacterium; note = Related to JAFSCK010000132.1
MLKRLLHIEDSKLTKQDYIASLISPYIDKTGKPRLIEPPREELKTVQKRLKKLLGEIVVPDNVFSGIKGRSYADNAKMHIGSGRRNLFKIDLTAFFPSIDRDTVYHFFSKDLNCSSDVAQILTNLTTVDLEKAHITNRNDVYLFLSSKKVSCRNHLISGAPTSQIMSYLVNHHMFDEMQTIADRNNISMTVYVDDVTFSSEGRISHDFTEQIYAIIKKYRYQVSRSKVRKYTKLYPKLVTGVVIDADGKAVIKNAMRLKIINEYNHLLQNPNDPICRQRLRGLLTAARQVDQHAFPTIYKYAFEGSLKCQQN

SEQ ID NO: 3329 - protein, 309 aa, unidentified
  source 1..309: note = Related to JAFQCV010000001.1; note = Oscillospiraceae bacterium
MLKRLLHIEDSKFTKQDYIAALVSPYIDKTGKPRLIEPPHKDLKTIQKRLKNLLGTIVVPNNVFSGIKGRSYADNAKMHAGSHSRNLFKIDLTAFFPSISRETVYNFFYHDMTCSSDVAEILTNLTTIDLEKARIHERNEVLLFLESKKVSCHNHLISGAPTSQIMSYLVNHHMFDEMQIVADNNHAIMTVYVDDVTFSSEYRLSHKFKEQILSIVRKYGYQISRPKVKYYTKLYPKLVTGVVIDSSGSPIIKNAMREKIINEHRHLREFPDDKSSRQRLCGLLTAARQVDPHTFPTIYKFAFSSPDHE

SEQ ID NO: 3330 - protein, 326 aa, unidentified
  source 1..326: note = Related to FR898238.1; note = Eubacterium sp.
MPLIYTDCPLYGLKSKKLLKRLLRINNNQMMRQTHIASLVSPYIDKSGKPRLIEPPHEELKIIQKRIKNCLGRITVPDNVFSGIKGRSYADNARFHVGNNRRNLYKIDLTAFFPSITRDTVYRFFAEDLLCSPDVAQLLTDLTTIDLETSNTKNIDEIRLFLKEKGVSTYNHLISGAPTSQILSYLVNHQMFDEMQKIADDNNITMTVYVDDVTFSSENRISKDFRDKIIAIIRKYNYQISKKKVKRYTKLYPKLVTGVIIDATGKIVLKNSMRQKIIIAYNELKNDPDNADIRMRLKGLLIAARQVNKDAFPTIYKFAFQTEENK

SEQ ID NO: 3331 - protein, 309 aa, unidentified
  source 1..309: note = Related to PRLC01000002.1; note = Faecalibacterium hattorii
MLKYVLHIKNGDLLKQDYVVSMIGPYIDKTKKPRLIEPPQAELKTVQKRMKTLLGKIQVPDNVFSGIKGRSYSDNACLHLGKSKRNLYKIDLTAFFPSISRETVYCFFFEDLCCSPDVAEILTNLTTVDLKKLNQSSLLEVYDFLANKGVKCYNHLISGAPTSQILSYLVNHKMFDELQSLSDKSNVTMTIYVDDVVFSSEHKISSEFRQSVLSLIKKYNYQVSRKKVKGYSKTYPKLVTGVIINSEGRATIKNALRKKIMVEYEHLRNNPDDIKSRQRLRGLVTAARQVDKSAYPNIRKFAFDNPAKS

SEQ ID NO: 3332 - protein, 308 aa, unidentified
  source 1..308: note = Related to FP929045.1; note = Faecalibacterium prausnitzii
MLKYVLQIKNDDMLKQSNITSKIHPYIDKTKKPRLIEAPQAELKIVQRRIKTLLGKIQTPDNVFSGIKGKSYPENARMHIGGRKRNLYKTDLTAFFPSISREDVYQFFNNELCCSPDVSEVLTNLTTVSLERFPKEELTEVYDFLGQKGVHCYNHLISGAPTSQILSYLVNHKMFDELHTLSAKNDMVMTVYVDDMVFSSEHKISSHFRNSVKSIIKKYRYKLSHNKVKGYSKGYPKLVTGVVIDCNENMIVKNSLQHKIILEFEHLRKNPMDQESRQRLRGLVTSAQQIDKSIFPNIKRFAFENPSK

SEQ ID NO: 3333 - protein, 307 aa, unidentified
  source 1..307: note = Related to JAGBJU010000241.1; note = Oscillospiraceae bacterium
MLCHMLNIRDTNLLKQDYVSKLVEPYIDKTGKPRLIEPPRAELKLIQKRIKNMLGMIEVPENVFSGIKGRSYADNASFHIGDSPRYLFKIDLTAFFPSISRDKVYAFFLSDMHCSPDVAAILTNYTTIDLSRAAIQDRQSIYTFLSEKNVSCYNHLISGAPTSQILSYLVNYHMFDEIQMLADKHSVSMTIYVDDLTFSCEHRIPRHFKENVLSVITKYGYVISAGKTKSYTKRYPKLVTGVIIDSNGQLALKNSLQLKISLEHAHLRDHPEDTKSRQRLRGLITAARQVKKDAFPTIHQFAFQANP

SEQ ID NO: 3334 - protein, 324 aa, unidentified
  source 1..324: note = Related to NZ_JADMUB010000001.1; note = Clostridium jeddahense
MKYDNCPLYELKSKKILKYLLGIKNSNLLNQQYVASLVTPYIDTTRKPRLIEPPHSELKAIQKKIKTLLGKIEVPNNVFSGIKGRSYIDNALIHKGNGLRHLFKIDLTTFFPSISRETVYGFFYKDLRCAPDVAQILANLTTIDLIKSNSRDIETIYQFLEMKKVRCRNHLISGAPTSQILSYLVNHRMFDEMQALADKNRVTMSIYVDDVTFSSDYRIPQRFKNLVFTIVRKYNYQISGIKVKSYSKLYPKLVTGVIIDTTGDLTIKNSLRKKIIDEHRNLRNDPGNRESRQRLRGLITAARQIDKSAYPNIHRFAFEKFTIR

SEQ ID NO: 3335 - protein, 321 aa, unidentified
  source 1..321: note = Firmicutes bacterium ADurb.Bin300; note = Related to MWBL01000033.1
MNYNYCPLYGLKSKKRLKYLLKIKNSKMLSQAHIAKHVEPYIDIQGRPRLIEPPSVELKAIQKRIKNLLSKIIVPDNVFSGIKGRSYVDNARMHSNGLRYLFKVDLTAFFPSITRETVYTFFREDLHCSSDVAEALTNLTTIDIQKSKAKNINEIYCFLDAKQVNVINHLISGAPTSQILSYLVNHKMFDELQLLSDKNKITMSVYVDDITFSSEFRISHMFREKVYQIIKKYNYKISKKKVKGYSKLYPKLITGVIIDANGNLVIKNTLRRKIILEFRKLMEDPADDESRQRLRGLATAARQINKAAYPFIYKFAFDNKQ

SEQ ID NO: 3336 - protein, 323 aa, unidentified
  source 1..323: note = Related to NZ_CP020991.1; note = Monoglobus pectinilyticus
MIYTNCKLYKLNSKKVLKYLLAVSDNNFFEQKYVASQIEPYIDTLKKPRLIEKPSEQLKAIQSKIKGLLYAIQVPDNVFSGIKGRSYSQNAQWHKGTKHVYKIDLTAFFPSITREKVYSFFKDDLETSSDVAEIITNITTVDIDLTNLQNVEQVNEFLISKNVKTRNHLISGAPTSQILSYMANHKMFDEIQSLANHNGIVMTIYVDDITFSSENYISNKFKNKVQSIIKKYGYQISARKVKSYSKCYPKLVTGAIIDKNGCLTVKNSLRYKIMSTLNELKENPNNKTARRKLRGLVIAARQIEPNAYPSVHKLAFDKKYKVN

SEQ ID NO: 3337 - protein, 316 aa, unidentified
  source 1..316: note = Related to JAGFNZ010000002.1; note = Caproiciproducens sp.
MYQLKCKKVLKYLLKISDNSVFNQWYVASLIEPYIDISRGKPRLIEPPSLMLKSMQTRLKNMLGTIDVPINVFSGIKGRSYAQNAQWHKGNKFVYKIDLTAFFPSISRERVYSFFKEKLRTSPDIAEFLTNITTVNLDLSNIKSMEEINIFLESKNITTRNHLISGAPTSQILSYLANQDMFNEIQKLSDHNNITMTIYVDDLTFSSTDHISNNFKQEIFSVIRKYGYHISNKKVKGYSKFYPKLITGVIISKDGNIAVKNSLRLKTINELNTLKQAPQNTTSRKRLRGLVTATRQVEPNAYPSIHQFAFDKKYKV

SEQ ID NO: 3338 - protein, 324 aa, unidentified
  source 1..324: note = Related to JAGZEF010000053.1; note = Clostridium sp.
MINPIHSNLYKLTSKKYLLSLLHIHNRQFLKQSYVSKQISPYIQTDPKPRLIEVPSEELKTIQRHIKNELNKIIVPANIFSGIKGKSYIGNAKLHSGNKYVFKIDLCAFFPCITRNTVYNFFIESLKTSPDIANILTNLLTVDLSKCSIENVESVNAFLISKKIKTPNHLISGSPASQILSYLVNHKMFDSLQNFCDKNNITMSVYVDDVTFSSQHIISHTQKQVIYKIISKNLYRLSRNKVKYYTKKYPKLITGVVISSNGNLKIKNSLSLNVISEWKYFSQNPKNLQSKARLQGLLIAARQSEPAKFQNIYNLIREASIPFS

SEQ ID NO: 3339 - protein, 324 aa, unidentified
  source 1..324: note = Related to JAFQRZ010000015.1; note = Agathobacter sp.
MINPINSNLYKQTSKKYLLNLLHIHDKRFLQQRYVSKHISPYIQTNPKPRLIEVPSEELKIIQRHIKNELNKIIVPENIFSGVKGKSYIENAKLHSGNKYVFKIDLSSFFPCISRNTVYNFFTESLKTSPDIACILTNLLTVDLSKCNIEDADSVNEFLISKKIKTSNHLISGSPASQILSYLVNHKMFDTLQEFCDKNSLIMSVYVDDITFSSQHVISHSQKEVIYKVISKNLYRLSRNKVKYYTKNYPKLITGAIISSNGNLKIRNSLSLNIIKEWKHFKYNQQDAQSKARLQGLIIAAHQSEPNKFQSIYKIVRDASFDVS

SEQ ID NO: 3340 - protein, 323 aa, unidentified
  source 1..323: note = Related to KE159538.1; note = Lachnospiraceae bacterium A4
MIDPVKSNLFKLSSKKYLMTLLNVPTKEYLNQNFTAKQIKPYIQANPKPRLIEVPSDSLKKIQKNIKCELNKIEVPSNVFSGIKGKSYVDNAVIHQNCNFLFKIDLTAFFPCITRETVYKFFKVDLKTSSDIANILTNFVTIDLTLCDIQEPEPIEQFLLSKGIKTTNHLISGSPASQILSYLANHNMFDELQNFCDKNDIIMSIYVDDITFSSQHEISHKHKEIIYNIIFKYLYRLSRSKVKYYTSIYPKSVTGAIISPNGNLSIPNSLSYKVINELRNYKNNPNDEHSQKRLQGLIVVAQQTEPTKFSNIYNHVRNATIKA

SEQ ID NO: 3341 - protein, 320 aa, unidentified
  source 1..320: note = Clostridiales bacterium; note = Related to JAJQEB010000010.1
MINATNSKLYNLQSKKNLIYLLKIHDKDFFNQDYVAAHIHPYIDKRGKPRLIESPSLQLKKIQRNLKNELAKIEVPYNVFSGIKGKSYVENAEMHRKSNYIFKIDLTAFFPCIPRESVYTFFRKQLKTSPDIAQILTNLTTVDLTRCNIKKLESIEKFILDKHIVTTNHLISGSPTSQALSYLVNTKMFDELQYLCDKNKVIMSIYVDDITFSSNHKISHKFKEIVYTIISKYMFKLSHNKIKYYTKDYPKLVTGPVISNGKLIIRNSLRFKIISEFKSLKKNPNKASYDRLKGLIVAAKQIDLNQYPNISKYIKENPIH

SEQ ID NO: 3342 - protein, 302 aa, unidentified
  source 1..302: note = Related to JAGXSA010000175.1; note = Dethiobacter sp.
MLRHFLQVQSNQLFNQTFILDKIHPYIDTVGKSRLIEVPDKALRTIQKKIKNMLGKLVLPDYVFSGVKGKSYVDNATHHSGTKFTYKVDVTAFFPSISREKVYLFFREKLKTSPDVAEALTNLTTVDLHLIENIQEVHEFLKRKNIKTWNHLISGAPTSPILSYLVNSDMFDALYSLSKENEIVMTVYIDDIVFSSSYRISYKIRTKILSIIKQYGLQVNKKKLKLYTRKYPKKITGVIIDKNGNSEVPNSLRKKIITELHTLKSNPNNLSSRQRLQGLVTSARQINKETFQNICSYAYKKD

SEQ ID NO: 3343 - protein, 319 aa, unidentified
  source 1..319: note = Related to NZ_DS560015.1; note = Anaerofustis stercorihominis
MEIQKSPLYKLSNKNYLKYLLKIPDKKFFKQSYITQLITPYIDNKNGKKRLIEVPDLELKKIQSRLKNILSLLQMPNYVFSGVKGRSYYDNAYLHKGNKYVCKIDLESFFPNISREKVYLFFLTYFKCSSDIAYILTNLTTVDLTRTKIKNNKKLEKFLEYKNIFCKNHLISGSPASQLLSYLVNKDMFDEIYNLANKNSINVSIYVDDIIFSSFNKISYDFIKQIKRIINKYNYNISNSKFKRYLNGYPKRITGVIIDKNGQLSIPNSLRLKIIKEFEYLKSHPNDSKSKIRLRGLILSSRQIEPNAFVGIYKYLKKF

SEQ ID NO: 3344 - protein, 317 aa, unidentified
  source 1..317: note = Related to JAFUZY010000121.1; note = Eubacterium sp.
MNKKCPLHGLKSKAQLYSMLGVNDKKLFRNGIQDKVKIYIAKDPKERLIEAPDYITKKAQKQVKNYLMKCDFPPYVFSGIKGKSYFNNAEMHLSSKYMYKTDISKFFPNISRDKVYLFFLNDLNTSPDVANILTNICTINISDSIETNPQVAEFVSKNKIRMFNHLCTGSPASPLLSYLVNRKMFDELNNIAENNGMSFSVYIDDVFFGSKKPIPYGVRQQILKTLTKHGYNISFKKVIYYKDKENKKVTGVIISPNNKLEIPNKLKLKIVSGFSKGNLKDSRAKINGMLIASSIIDKNSFNGIREYMKQLEKDSEE

SEQ ID NO: 3345 - protein, 315 aa, unidentified
  source 1..315: note = Clostridia bacterium; note = Related to JAFVVO010000024.1
MHKHCLLHGLKSKKQLISMLDITDNKVMKGKAQDKIKIYIATEPKKRLIEAPEYKIKKVQNKIKNYLLKCDLPSYVFSGIKGKSYFCNAALHRDCKFLYKTDISAFFPSISRNTAYKFFKNDLETSSDVAKILTDICTVDIRDTLEKDSSVAGFVKDKKIKMYNHLCTGSPASPILSYLVNKAMFDEMYAIAENNNLKFSIYMDDVFFSSSKSISNNVREHILRILTKYGYNVSFKKVIYYTSQQNKKVTGVIITPQNKLSIPNKLRRKIIASFSKGNLKTGEQNLRGMLVASNIIEKNSFSGIKRYLNELSKIQ

SEQ ID NO: 3346 - protein, 317 aa, unidentified
  source 1..317: note = Clostridiales bacterium; note = Related to QAKR01000043.1
MYKSCPLYALQSKKMLMKVLGIQDKKWTKNIYVQQNISPFIDCMVKPRLVEAPKQELKVIQKRIKNGLMKCRFPNYIFSGVKGKSYIDNAKMHAGIKYLYKIDISAFFPNTSREKVYMFFKNELKTSSDVAEIVTNLCTYDISIDLVEKKEIDTFIRMKKIKHINHLCTGASPSPLLSYLVNKSMFDEMYSLCLKYNVNMSVYVDDVVFSCDKPIQPEFRGRILKIVLKNGYNISKNKVKYYGSSDVKKVTGVIIKPDGTLDVPNKLKFKVTKRFKDTQKGSELNKLYGCVIAAKQIKKNIYPSISEYIMNQKKKEK

SEQ ID NO: 3347 - protein, 340 aa, unidentified
  source 1..340: note = Related to DPGI01000004.1; note = Clostridiales bacterium
MQSWDKHNQFKYNEVYPLEYRKCYLYGLKSKKKLLELLHIDRKIYCKSSFLNCKIKPYIEINKNKKKRLIEAPDEDVKNIQSIILRALQLIDVPNYAFSGIKGKCYIDNAKAHSDKKYLFKIDISKFFPNIGRNKIYNFYLNKLKTSPDVANILTNLSTINLDLKNQNNKTMLKINEFINDAHIKERNHLITGSPLSSIMSYFANVDMFEKINEIALKYNITMTVYVDDVVFSSDNKIPYFFRKNVLNIINQNSYDVSVKKCKWYNKPENKKVTGVILDKKGKMQIPNKLMLKTHNYINEINKGDKTNIDKLQGCLVVANSINGKFKEYRGQLKKMKRKF

SEQ ID NO: 3348 - protein, 328 aa, unidentified
  source 1..328: note = Related to JAFQEA010000008.1; note = Clostridia bacterium
MTYKLCRLYGLKSKKTLREWLEIDDSSFFHSKNIAKNYHPYIDNKANKKRLIEVSSPKLKFVQTKILGMLKNLDYPEYLFSSVKGVSFIDNAKQHSGKYYTFKIDISKFFPNTSRNKVYNFFKKDLNTSSDVATILTDCTTVDLRNYNSDKHHNEIVNFLEEYKIKQIAHLSTGAPTSMLLSFLANRPMFEELNSFCEQRGYIFTVYADDVTMSSINPISYSDRSAIIRIAEKYGHFVSKRKVKYYNANQSKKITGVVINKNGEICTPNKLLNKTHNKILKYKSKNIDEHEINSLKGCINVAYQIDKRYPHLRKVLNKNSNYSKEKNG

SEQ ID NO: 3349 - protein, 323 aa, unidentified
  source 1..323: note = Related to DVLO01000021.1; note = Candidatus Limihabitans stercoravium
MTYKLCRLYGLKSKKTLREWLGINDSGFFCSQNIAKNYHPYIGSKDNKIRLIEDSSFKLKHVQKKILKMLKKLDYPKYLFSGVKGLSYIDNAKQHLGKFYTYKIDVSKFFPNTSRNKVYSFFKDFLNTSPDVAKILTDCTTVDLRNYSNSKHYNKIMRFVAIAGIRQIAHLSTGASTSMLLSFCVNQSMFEELNEFCKQRDYIFTVYVDDVTISSTKPITYKDRLKIIRIVEKYGHSISRNKIKYYTLSKTKKITGVVINKNGEARTPNKLLSKTHCKILKFKRGNIGDAEINSLKGCINVAYQIDGKFIHLKKLLNLKDNLK

SEQ ID NO: 3350 - protein, 304 aa, unidentified
  source 1..304: note = Clostridia bacterium; note = Related to JAFWLJ010000001.1
MDLTTCKLYGVQRKRDLSNILKINCKEINKIVNSYKPYIANKSKKRLIEPVSSVELKKVQKRIQNLLKEIKYDSNVFSGISGRSYIDNGRLHLGCEYVVALDISKFFPNTSREKVYKFFKHDMKNSSDIAEILTNLCTIDLSNIADIDEEVIKYISENRIRYKKHIPTGSSISCILSYLVNYKMFDEIVKLGVEYRCKTSIYVDDVVISSTEKINKQLIDRIMGIIKSRGYSIQKTKLKFYDKNEFKRVTGNIISKDGTKLVIPNKIRYKMIKLKKNKEIQKDKKEAKLNGYNQVINQINMEAF

SEQ ID NO: 3351 - protein, 320 aa, unidentified
  source 1..320: note = Related to FR893092.1; note = Clostridium sp.
MNFKNCELYKIKRKRDLFILLHIDENKLNEELYKYKVCIKDKKRLLEKPSEELKKIQRNILYKLYQLDFPQYVFSGIKGRSAFGNAIYHINCKYMLKLDMSKFFPNTHRNNIYEFFKDKLKMSSDVSSICTDIVTVNYEKEDVEIDYEVYDFLKRKKIKNTNHLPSGTPTSQILSYLANIDMFDKIIEYTKKHKLQCSIYVDDITISSSNRYITKKEESEIKRIIKKHKHNLSKEKTIRYSVNEFKKVTGFVIDPNNRLVIPNKIKSKIKNQTKFIRKKELDEQRKNSIIGLTNFANISVEGSYKGLRATLKNISTSNTV

SEQ ID NO: 3352 - protein, 305 aa, unidentified
  source 1..305: note = Related to JAADIZ010000149.1; note = Epsilonproteobacteria bacterium
MNKYKCTLFNCKSIKKLQKYLFIQNKNNFKKISNELKNNPLNFYVSFKNNTGRELFSCNEQIKKIHKRLQKLFNVEKSDYLKSGVKKESHITNVKFHKNSNFFLLLDIKNFYPSITKQKIKKQLITTYNQSSDVAEIISNMVTVPQEKALGKRALVTGSVLSQFFAYMINKKMFDELDKISKEENIRFSLYVDDLTFSSNVPVSYLFYTKVYNIIRKNGYIIHSGKIYRGKIGNKSKITGVHITKYGFRLLDRHKIKIREIIKNKDYLENNKPLLGLLNYALQVNPKYSKYMYLIKKKLISDSNI

SEQ ID NO: 3353 - protein, 325 aa, unidentified
  source 1..325: note = Related to CACVAZ010000125.1; note = Sulfurovum sp.
MNAYQCTLYGVKSLNKLQQFLQIKAKQEFKALSSSVKSTPLKYYSPFKDENKRELFNCSSHITFLHKKVMRLFNLEQSTYLKSGVKKESHITNAKEHQNSNFFLLIDIKGFYPSITKSKIKTQLIQTYKQSKDVAEFLSNLLTVPQEKSLGKRALVTGSPLSQWFAYVINKKMFDELYNVSKEENIIFSVYVDDITFSSKSIISYKFYTKIYNIINKYEYRIHQGKMYRGKLCNKTKVTGIQFTKYGFRLLDKHKEKIRKIVKSKDCSNQIKSLLGLVNFAIQVNPRYSKYKYLIEKSLLLKHSNTKNKNQYHKSPTNSKALKYS

SEQ ID NO: 3354 - protein, 300 aa, unidentified
  source 1..300: note = Related to NZ_PDKB01000003.1; note = Aliarcobacter vitoriensis
MNPYSCTLYNCKSLNKLKSYLNIEDDKYFKSLNANLSANPFKFFRKFEKNERELFRCNKRITQIHQRFIKLFKIEESEYLKSGIKKESHITNALAHKDSNFFLLVDIKGFYPSTTKAKIKKQLIMTYQQSSNVAEFISNAVTVPQEKANNKRALVTGSVLSQYFAYVINKKMFDELYKLSKHNDVIFTVYVDDISFSSKKVLTYKFHQQVYNIIKKYGYTVHNGKVYRGKINNKSKITGVQITKYGFRLLTKHKDKIKELKNKIDIKSKRSLLGMLNYAIQVNPKYRRYKNLFKNYEELN

SEQ ID NO: 3355 - protein, 301 aa, unidentified
  source 1..301: note = Related to NVUO01000016.1; note = Sulfurimonas sp.
MFTCTLYNCKSLNSLQKYLLIKTKEFKSLSIELKEIPHKFFKSFTDDKGRELFRCNGQVTKLHKRLMKLFNVEIPIYLKSGVKKQSHITNVKYHESSNFFLLIDVKRFYPSITKSKIKKQLITTYKQSSNVAEFISNLVTVPQKKSNNKRALVTGSPLSQYFAFIINKKMFDELNKISIEEDVKFSVYVDDMTFSSKQVISYKFHQKVFSILTKYGFVTHLIGNKKTYRGKVGAKSKITGVHITKYGLRLLQKHKDSIQHIIKQNLHEEKGKTLLGLVYYAIQVNPKYDKYKRLLEKYNKL

SEQ ID NO: 3356 - protein, 318 aa, unidentified
  source 1..318: note = Related to CP015910.2; note = Brachyspira hyodysenteriae
MIKYNLDIFKNFTSIEKTCEFLCVNKVLKYNIINNNIKECYITEINDNGREIHKPIFFLKKTQKKLLKCLLPKVLPKYLFAPSIKNTNKNNIENARYHLGKKYFLTMDISSFYNSIKGNTIYDLFFNKFKLNSDIALFITKLTVYDNGKETFLSTGSPSSQILAYLCYSDVFDNIYNLCLKKGIRFSLYVDDMTFSSDIKFTNKLPNKIIDIFEKNNLKIKPEKTKRYNKGYAKITGVILKNNKLYIKNSKRKDIIENLKLLNKSNDIIKKEIENNNIEIIKTISKLNGLLNYTKQIEEDHFLANRNRIRKLYKLIPK

SEQ ID NO: 3357 - protein, 317 aa, unidentified
  source 1..317: note = Related to NZ_CADDIL010000010.1; note = Spiroplasma sp.
MQYNNCILYSLNSKKKLVKILIVNKNINKKKLVKIFSKEEQLKILIEKSKKVQLTDKKTRNKILNSTNITFNENIHRQFTYAQKKSDYKMILKKLSKILSIWVEKNNLNYLYSIIKNVDYVKNAYFHKENNYFLKIDFKNYFNNISSLQIFNFFKYKLNTSIDIARILTVLSVADINNTNLKQGLETSPILSFLVNIEIFEEIYQYCIEKKFKMSLYVDDLVISSKNPINKKEIQFVFNILIKNKLKINRRKIKYQNLYNNIVIITGIQILKNHNLKPINKTCKKLRIEKKISKNQNVINGLISNLKYIQQINDKNK

SEQ ID NO: 3358 - protein, 333 aa, unidentified
  source 1..333: note = Vallitaleaceae bacterium; note = Related to JAIPEU010000010.1
MNYKECSIYKITKKSDVNYLLDNADKATNINKYHQYITTYVVLDPNGKPKRLIECIEEKYRHTNKVLFNLLKSIETPEWHFSKKAVSYLDNAFYHLDNRYMLTLDIKKFFPNTSQDSVYRFFLNKFELTPDIASYLAKLCTVNIDLCKYDSVEMKNNVNTYMEIKKIRQRNHLITGASTSCLLSFLVHQEMFEEIRGLLKKHEKMSVYVDDITISSNCPIDKKLVKQISAILYRYGHRLSKNKTKYYTKDSYKRTTGVILTPSKQARIPNSKRNEIFSLFGIYKETGYTCEKTKDRLRGLLNYARSIEPNAFPRIYEAVVSQSKSYSKQNPTR

SEQ ID NO: 3359 - protein, 416 aa, unidentified
  source 1..416: note = Related to FR881490.1; note = Clostridium sp.
MNLNELIEQQIQKCRLYGLTKPLIIKEILNIPDYVDIKHLDKSIDSFYDTFYIKKNWAKESQTKEERYKEILNIEKNISERFTSIPDGEDKTKYRKIVTINTDWLKKSQKKFNKILMSILLDKKVRGIKQKSIIPYLHSAVKQRSYHTNAQAHVGDKYVFAIDLKDFYPSVTKYKLYLFFKNEFNLSSDIAMFYAVLSTCISDDGTYRLGQGLSQSSTLAYLVNYSLFNYLYELSKVEDIDMSIYVDDVVFSSKNKISQDFIDKLFGIIKSNNMQIKRQKVHYYKKESVKKITGVYVNGNKTRVANHKHYEFHTQYKYLKNHILNVKTIEDYYKIYNLYLKFYGNFQHIKMVESRVHDRYEKFIKDFDEFFPKGINKKQKSINYQKDNIKNVTDREKLNKCYQKLLNKNKIIESVL

SEQ ID NO: 3360 - protein, 416 aa, unidentified
  source 1..416: note = Related to FR890375.1; note = Clostridium sp.
MNLDNLLEEKIRESRLYGVTKPMIIKEMLNIPEDIDIKNLDKNIDSFYDTFYIKKTWVQGSKTKEEKIKEILNIEKTTSERYKSIPDGEEKTKYRKIVTINSDWLKKSQKKFNKILMNILLDKKIRGVKQNSIIPYLHSAVKQRSYHTNAQVHVGDKYVFAIDLKDFYPSVTKYKLFLFFKDKFNLSSDIAMFYSVLSTCLADDGSYRLGQGLSQSSTLAYLVNYSLFNYLYNLAKNDDIEMSIYVDDVIFSSKNEISQVFIDKLFGIIKGNDMRIKRQKVHSYKKESVKKVTGVFINGNKTRVANHKHYEFHMQYKYLKKHIIDIKSIEQYFKIYNLYLKFYGNFQHIKMVEGRVHDRYIKFIKEYDDFFPKGINKKQKNVNYRKGNIKNISDSEKLKSSYKRLLKINKVSKSVL

SEQ ID NO: 3361 - protein, 421 aa, unidentified
  source 1..421: note = Candidatus Caccenecus avistercoris; note = Related to DVJF01000026.1
MDLNKLIEENISKNRITGLTKPKIIKEMLSIPENINLKKLDQIINSCYSTFYIKKNWSKHQETEEEKYIRYLNIHQELSERIQQLPENADKTKYRKILVINEPWLKVSQKKLNKLLTSILLTKKEKAKKRESIVPYLHSSVKQRSYTTNAQAHIGDKYVFAIDLKDFYPSVTKVKIFNFFKKHFKLPSDIAMIYAVLSTYKSDNGEYCLGQGLSQSSTLAFLVNYRLFNYLYLEAQKLGIEMTIYVDDVIFSSSSPIPQKFINRLFGIIKENKMSIKRRKVYYYGKKQTKKITGIYIKKNKTSVAYEKHKEIRIQYNYLKEKIKEIKTFSDYLCIYNLYLKFYGNYHHILNVEKKINNKILNFVDKYDEFFPKGIHKKQKQPYSVQNIKTINDVQRLNKCYQKLKNKNLNEVILDYPNVNL

SEQ ID NO: 3362 - protein, 408 aa, unidentified
  source 1..408: note = Related to NZ_WTSZ01000005.1; note = Erysipelothrix sp.
MKKNFDGLKRLNKKKTIYSLFEFPKAASNKDYDFSNNYEFRYLAKKKDDINRKERKLERLTGYIQLQDSDKDALMRSRPKDYDKNSYRTIVNYSNSSDWLKKAQKKIHKYIVKELGEVEYLHSTIKSKSYATNAFQHRGENYTLAIDLKNFFTYVSREKLQYTLKDFLQIDSDVAFLYSSMLTSPVDEPPHHGGKYNLGQGLPSSPILAYLCHASLFEYIYNNSLKEEITMTVYVDDVVFSSVKPIPQHFIDRLFGLFKRNGLEINKDKIRLYMNGSTKKITGTYVSPQKLSIPNRKHEELHNLYQTLKEKKEKIETMDDYLFLYNIYLKFSGNYQYLIQVECRGEDGKISVNPRYKKFEKLNNELNILFPRGLKKKKKKTPYSKENMYFEEYKQLEEKYKLSVSRLK

SEQ ID NO: 3363 - protein, 325 aa, Staphylococcus sp.
  source 1..325: note = Related to JAHAKK010000031.1
MKILENCKLFKLNKIKTIYKKLNIPIEAQQKNFDFDSLYDFKYLKKDSKDNNKISKEERFEKYVNIEKSIPQLIDERPGDFNKSKYRVIININQEWLKKSQKKFHKIIAKELNNIPYLHSTIKHKSFATNAHKHIGEKFTLTIDLKNFFTCISRETLANKLKTLLEIDSDIAIYYSRLFTSPSDKPPYNNGQYNLGQGLPSSPILAFLCNYTLFEYINDLAKLYNTSMTIYVDDITFSSDLPISQEFIDKLFGLFKQNGMRINPSKIHLSKNNSFKKITGVNIIDGKPKIPSRKHEEIMIQFKTIKTLMTIKSFSDYFDDNQVIF

SEQ ID NO: 3364 - protein, 419 aa, unidentified
  source 1..419: note = Bacilli bacterium; note = Related to JAGBET010000010.1
MDRVKECLKNCRLYKFNNRKGIKQLLKIPDNLNLNDIRGELSSYYNFFYLKKPDKIKSKMSKEEIRNKYLSIEENLEIYDERPADYTKDKYRMLINIREKWLKQTLKRINKLLSQSLIKKNKKNVEYPIPYLHSSLKKRSYNTNVKAHKNHKYILAIDLKAFYPSVSYEKIINFFRHDLKLEKDIAEIYTALCTCPLDDPQQGNIQYGIGQGLATSPVLAFLTNYRMFEYIYSIAQKSGIEMTVYVDDIVFSSSKPIEQTFINSLFGIVKKNNLKINKNKVKLYGPKQVKKITGLCIIKGGSIKVPNSKHFETKIQFEYLVNKILVISNIDDYLSFYNLFLKFKGNVQFIELVEDKIPKKYSDFIKEYKDYFLYGVPKIKKSKIYTQSNVSNDDYKNFVIMYERLKKKIDKVKNNKIIM

SEQ ID NO: 3365 - protein, 413 aa, unidentified
  source 1..413: note = Related to DUUN01000201.1; note = Gallicola sp.
MDNVKECLKKCRLYCFNSRNGIKNLLNIPKDFDLENVRDGLLPYYNFFYLKKPDKSKTKETPEERKMKYLSIEESSDIYDTRPDDYSKDKYRMLININEKWLKKTLKKINKLLSLSLIKKNKKEVNYPIPYLHSSLKKRSYKTNVEAHNSNKYLLAIDIQNFYPSISCEKIFNFFKYDLNLDDDIAGIYTSLCTCPLDDPVVGKFEYGIGQGLATSPVLAFLSNYRMFEYINDFATKNNIEMTVYVDDVVFSSNKPIKQEFINSLFGIIKRNGLRIKKSKVKIYGPNQDKKITGLCITKGGKVRVPRSKHEELKIQYDYLSKEVLNIKNINNYFNFYNLFLKFKGNVQFVLLVEERATTKHFKFIEEYKDFFLYGIRKNKKGNKYTKDNISEEDYKKFILKYENLRKKIDSLK

SEQ ID NO: 3366 - protein, 338 aa, unidentified
  source 1..338: note = Related to FOGY01000005.1; note = Psychrobacillus sp.
MQFNNSKLYGLSNKKLLADILSVDKKSLKNVSLEFLPYKLPQHLSTINGKQRDIYNPNDEHKKALRKLVRLLMQVELPSYVFGGIKEKSHIQNASIHKANNYLMLIDIQNFFPSTLDSYVYDLFKGKFQMADDIAKILTDFVTIPCEKKDGRYLPQGYPTSPILSYLAYVGMYNELATVAVENEMIFSCYYDDLTFSSNKFINKSLKRKCYQIIEKHQLKVHPIKSKLIVKKGVEVTGVFLDDLGEAKAPKKLLKKLQESYEKVKNMDRNPSEFTKMNFVDELNKLQGLISAVKSIEKNRKIDLFLNELKFIRKKYNVPYRKNDVKKYFNTEYASIIR

SEQ ID NO: 3367 - protein, 338 aa, unidentified
  source 1..338: note = Related to NZ_CP070490.1; note = Lysinibacillus fusiformis
MQFNNSKLFGLSNKKLLADTLNVEKKSLKNVAIEFVPYKLPPQLSNINGKQRDLYNPNEEHKKALRKLVKLLMQVELPSYVFGGIKEKSHIQNAFVHKQNKYLMLIDIQNFFPSTMDSYVYDLFKRKFQMEEDLAKILTDFVTIQCERKEGRYLPQGYPTSPILSYLAYVDMYNELEALAVENGMSFSCYYDDLTFSSNKFINKSLKRKCSQIIEKYQFKIHPTKSKLIVKEGVEVTGVFLDDLGNLKAPKKLLKKLQKSYDKVKEMNENPSGFTKKNFVDELNRLQGLVAAVRSIENNRKVNLFLNELKYIRRKYNVPYRKKDIKKYFKTEHALLIQ

SEQ ID NO: 3368 - protein, 338 aa, unidentified
  source 1..338: note = Related to NZ_VCBM01000001.1; note = Rummeliibacillus sp.
MNFNNSKLYGLSNKKILADLLKVDKKRLKNVIEEFVPYKLPTELSTINGKKRDLYNPKNEHKKALKKLVGLLMQVGIPSYVYGGIKERSHIQNASIHRTKKYLMLIDIQNFFPSTSDSYIYNLFKDRFGMANDLAKILTDFVTVQCENREGRYLPQGYPTSPVLSYLSYAAMYQELLHLAVENGMQFSCYYDDLTFSSDKFISKSLKRKCSQIIERYHFKIHPTKSKLMVKKGVEVTGVFLGDSGEVKAPKKLLKKVQNSYEKVKEMDKNPNAFTKIDFVDELNSFQGLIAAVKSIENDRKVDLYLNELKHIRKKYDVPYRKGSAKEHFRSENAKFIL

SEQ ID NO: 3369 - protein, 338 aa, unidentified
  source 1..338: note = Related to NZ_CP090431.1; note = Priestia flexa
MNFNNSRLYALSNKKVLADILGIDKKRLKNVIQEFVPYRLPPELSTVNGKQRNLYNPNDEHKRALRKLVRLLMQLEIPPYVYGGIKEKSHIQNASIHKKGKYLMLIDIQNFFPSTSDSYVYDLFKNKFGMANDIAKILTNFVTVPCENSDGRYLPQGYPTSPILSYLSYLDMYEELLYLAVENGMKFSCYYDDLTFSSDIFISKSLKRKCSQIIGKYHFKIHPTKSKLIMKKGVEVTGIFLNDLGEIKVPKKLLKKLQSSYEKVKEMGENPSTYIKSDFVDELNRLQGLIAAVKSIEVNRKVDLYLNELKYIRKKYDVPYRKSSIHKHFKTESAKFIM

SEQ ID NO: 3370 - protein, 337 aa, Bacillus sp.
  source 1..337: note = Related to NZ_CP036356.1
MDFSASKLFGISNKKYVAELLNVEKAKLKNVSSEFVPYKFEQSVKGKKRILYNPNDIHKAILKKITKMISQLDIPDYTFGGIKGRNYIDNANVHRDNSYLLLVDIKNFFPSTRDSYIYGLFKNKFEMPSDIAKIFTDLVTVPCENGEGRYLPQGYPTSPILSFFAYLDMYEEIFEVVRANNMGFSCYYDDLTLSSNKFIAKSVKRRVTRIIRKYGFEVHPTKSRLVIKKYTKVTGVILKEDEIVAPKALLRKLHDTHNLMRLMDKDCVKHTKEDFIDVCNKVQGLISAIKSINDQKKLDIYINTLTHIRKKYNVPYRKANIATSFNTDYGRLIGVSI

SEQ ID NO: 3371 - protein, 341 aa, unidentified
  source 1..341: note = Related to NZ_VNKI01000001.1; note = Peribacillus simplex
MDFSTSKLFGISNKKYVAELLNVEKVKLKNVSSEFVPYRFEQSVKGKKRVLYNPNDAHKAILKKIVRMISQLYLPGYTFGGIKGRNYIDNANVHRNNSYLLLVDIKNFFPSTRDSYIYDLFKNKFEMPPDIAKIFTDLVTVPCESGEGRYLPQGYPTSPILSFFSYLDMYEEILKVTLENNMLFSCYYDDLTLSSNKFIAKSVKRRVTRIIQKYGFEVHPTKSRLVIKRHTKVTGVILKENDIAAPKALLKKLHDTYNLLLSLDKNCTKYTKEEFVDVCNKLQGLISAIKSINDKKKLEMYHNTLSHIRKKYNVPYKRANISTSFETDYGKLIGTLPRHIS

SEQ ID NO: 3372 - protein, 402 aa, unidentified
  source 1..402: note = Related to NZ_JABEQQ010000001.1; note = Lentilactobacillus kribbianus
MKHAKHRKKQCLNDYYQALKEITIVKNLVYVVKAIQYLTILKIIIAIIFFTLQVIVKIISWVIPYLEIIYNFLSQVTSLFCCFQRGNVKMYWKSCRLYGVKSKRELSYLLKVPLESLKNIDENYISENFVYDGRELTNPSDKLKKVLERILGYLFMLRIPPYEYGGIKGRNAIQNVQRHVGHGFILRTDIRHFFPNTKYDNVFDLFRNKLNMSIDCATILTLLTTNVAVNASYRSLAQGYPTSPVLSLLSYLDLFNEISDYADEHKFTFTAYYDDLTLSSETFINKSHLRMIEHIIKKYGFDAHPQKTKLVKVSKVHSKIKITGVLLQKDGLYVPKKLYKGLYEYVQRLRSVLSGDVSISNEEKKTLIQQVRGCIAAIQVISDDESFQGYEDMARSLEKTII

SEQ ID NO: 3373 - protein, 332 aa, unidentified
  source 1..332: note = Related to CP024635.1; note = Levilactobacillus brevis
MIFFLKLHLFFVAFKEVRKVYWKSCPLYRVKSKRKLSYLLKVPVESFKNVDENYISENFEKDGRNLTNPSDKLKVVLERILDYLFMLKIPPYEYGGIKGRNAIQNVQRHVGHGFILRTDIRHFFPNTKYNNVFDFFRNKLDMSIDCATILSLLTTNIARNSDHRSLAQGYPTSPVLSLLAYLNLFNEISSYANEKGFTFTAYYDDLTLSSNDIISHSHLRMVKHIIEKYGFEAHPRKTKLVNVSKFQSKIKITGVLLQKDGLYVPKKLYKGLHESVNQLNLALNSRQGISNKEKKKLVEQVRGCIAAIHSINDDTVFQGYEDMARHLEKSIV

SEQ ID NO: 3374 - protein, 321 aa, unidentified
  source 1..321: note = Related to NZ_BOLL01000005.1; note = Levilactobacillus wangkuiensis
MYWKSCPLYGVESKRKLSYLLKVSLNSLRDVDLNYPSENFEEKGRNLTNPSPKLKTVLETILNYLFKLRIPQYEFGGIKGRNAVQNVQCHVGHGYILRTDIRHFFPNTNYNNVYDFFRNKMKMSIDCATIISLLTTNIAAGAQHRSLAQGYPTSPVLSLLVYLNLFDEIDYYARAHDFTFTAYYDDLTLSSTSIINKQHLRKVKHIIRKYGFEAHPKKTKLVIVTEIHSKIKITGVLLQKNGLYIPKKLYKKLHEAVSLIDPVLNGNLKYSDDDKKKLVEQVRGCIAAIEAISLENDFQGYRDQARHLEKTIDYEQLSENK

SEQ ID NO: 3375 - protein, 314 aa, unidentified
  source 1..314: note = Related to NZ_AP018405.1; note = Lactiplantibacillus plantarum
MQFTTCKLYGIQSKRKLSYILKTSLASLKNVDLSFQSKNFYQQNRLLTNPSEELKVILQRITKYLFTIGIPEYEFGGIKDRSFVTNVEMHVGHGFVLRTDIRHFFPNTHYGDVYVFFHEIMNMSVDCATIMAKLTTYRCNQNYRSLPQGYPTSPILSLFSYLNMFEEINTYAVKNGFTFTAYYDDITISSKRFIGRSHLRVIIHILKKYGFQAHPQKTKLVKISKNSSRIKITGLLLQKDETLVPKKLYKKLHVAMKNIDSALKQSNSRLNKADAKKIVQQARGCIAAINTIGSNDEFQGYSDQIRQLEKRCYY

SEQ ID NO: 3376 - protein, 420 aa, unidentified
  source 1..420: note = Related to NZ_NIBN01000001.1; note = Enterococcus sp.
MIKKHKIVQVKQWLKEKTCKDGKINFTKTCTFLAAIQVCLWLIEIICMLCGFIISTFVEIAPFLEAFFKILENLASTLSYNLRRSFFVDFYNSKLYGVSNKKYLSELLHLEKSTLKKIDKFYEVKPFLKKVNKKERLLYNPSMQHKIALKRIVKMLSFIGFPDYLCGGVPEVSYVTNASRHLEKNNLLLLDITNFFPSTKDSYVYDFFLNTLNQSTDIAKIMVNLTTAKSEDGDYRFLPQGYSTSPMLSFFAYHKMYERLNAFAEKNDLTFSAYYDDFTFSSKDFIPKYLMKEAIKIISDYGLSVNEKKTKLVKVNHTKITGVVVHKDKMSVPKGLFKKTYEHYLTLLDMDENTENYTQDNFIDTCNRMQGCLAAIQSVEPERNLEHYKNMIRYIRNKYDVPVERKKKDKYFKKKEVRQT

SEQ ID NO: 3377 - protein, 408 aa, unidentified
  source 1..408: note = Related to NZ_UARO01000001.1; note = Enterococcus faecium
MINKHKIVQVKQWLKEKTCKDGKLDFTKTIAFLAAIQVCVWLFKIICRICGFSISIFIEIAPFLEAFFKFLENLASTLSYIKEGVFFYGFYNTKLYGVSNKKYLSELLHLEKSTLKKVDTFYEVKPFLKNINGKERLLYNPSSQHKIALKRTVKMLSFIGFPDYLCGGIPEVSYVTNASRHLEKKNLLLLDITNFFPSTKDSYVYDFFKNTLNQSTDVAKIMVNLTTATNNSGNSRFLPQGYSTSPMLSFFAYHKMYDRLNTFAEKNNLTFSAYYDDFTFSSNEFIPKYCMKEAIKIINDYGLSVNENKTKLVKLNHTKITGIIVHEDKMSVPKGLFKKTFEHYLTLLDMDKYPEKYSQYNFIDTCNRMQGCLAAIQSVEPERNLDHYKNTIRYVRSKYNVPVNKKNK

SEQ ID NO: 3378 - protein, 323 aa, unidentified
  source 1..323: note = Related to NZ_MJEA01000001.1; note = Enterococcus villorum
MDFSNTKLHGVSNKKYLSELIHLELHTLKKVDQFYTVTPFVKNINDKERILYNPSLPHKIALKRIVKMLGYIGFPDYLCGGIPNVSYVSNASRHLMQKNLLLLDITNFFPSTSDSYVYDFFKNTLNQSTDIAKIMVNLTTAKNESNNVRFLPQGYSTSPILSFLSYFRMYEQLNDFALNNNLVFSAYYDDFTFSSNKFIPKYYLKETTKIINKYGLNVNERKSKIVKINHTKVTGVIIHDEKIKAAKGLFRKMYECYLTLLDVDVNNNFYSKDDLINTCNKMQGCLAAIQSIERDRNLEHYQNMIRYIRRKYDVPVSKKSINR

SEQ ID NO: 3379 - protein, 330 aa, unidentified
  source 1..330: note = Related to CP042216.2; note = Enterococcus faecalis
MDFAKSRLYGVSNKKYLSELLQLELKTLKDVDSNYEVEPFFKEVNGKIRELYNPSDAHKRALKNIVKRLSYIGFPHYIYGGIPLVGYVDNASRHLEKEYLLLLDITNFFPSTKDSYVYDFFHNTMSQPADIAKILTNLTTIKKDEERFLPQGFSTSPMLSFLSYHQMYEELDVFSKRNNFTFSAYYDDFTFSSDKFIHTSKRREAIAIIEKYGLQVNKKKTRLTICNHTRVTGVIIHGDTKKAPKKLHKKMYDYYRLLLDMDKDPTKYTQDEFIDTCNRLQGCIAAIQSIEKERNLEHYKNTLRYIRTKFDVPVEKKKKHLYFKNVQINN

SEQ ID NO: 3380 - protein, 332 aa, unidentified
  source 1..332: note = Related to JAAVMB010000016.1; note = Vagococcus fluvialis
MEFTKSKLFGISNKKYLSELLNVELKTIKDVDSNYKVEPFFKEVNGKNRELYNPSEVHKKVLKKIVKLLSCIEYPEYVYGGIPNVGYVDNASRHLEKEYLLLLDITNFFPSTKDSYVYNFFYNTMCQSSDIAKILTNLTTVKIENGDERFLPQGFSTSPILSFLAYHEMYEKLEGFAKNNKFTFSAYYDDFTFSSNKFIHANKRREAIAIIEKYGLQVNNKKTRLTICNYTRITGVIINGNIKKAPKKLHKKMYDCYRLLLNMDKCPEKFTQNEFIDTCNRFQGCIAAIQSIETERNLEHYKNTLRYIRTKFDVPIEKKKKHLYFNNILIAD

SEQ ID NO: 3381 - protein, 322 aa, unidentified
  source 1..322: note = Related to NZ_FQUF01000018.1; note = Atopostipes suicloacalis
MEFKEKFKQKIVQIKQWLDSLEAKADNYIWLQFILIIVRLCDFIKVISIIALVIKCFLRLSYILLPYLIEFIEFIETLASTFSYKRRSFFMDFTQSVLYGVSNKKYLSELLHLELKTLKNVDKYYTVYPFEKKTNGKTRELYNPSNEHKRALKRMTGMLNKIKFPSYLCGGIQNVSYVDNASRHLNKDYMLLLDIANFFPSTRDSYIYDFFYNSMSQPSDIAKILVNLVTAKVNNHRHLPQGYSTSPVLSFLSYHRMYQELYEYSLHNCFTFSAYYDDFTFSSNNFIHPNRRRDIIKIIEKYDFKVNSKKTKLVIGNHVSSP

SEQ ID NO: 3382 - protein, 315 aa, Streptococcus sp.
  source 1..315: note = Related to AZYV01000015.1
MDFKRSILFGVSNKKWLADLLKIEKYKLTNISSNFIGKSFFREVNGKTRELYNAGLIHKRVLRLIVKYLQKIDVPAYLHGGIPGRSYVTNVEMHCENNFAIIVDISDFFPSTSAQKVFDFFRYDMNQSPDIAKILTDLTTVTKYEKSFLPQGYPTSPILSYFAYYNMYETLMRYAQANDFIFSAYYDDLTFSSKKPIPKRCMNRIIKIIESHKLKINKSKSKIRRINNVKVTGCIIVNGELKAPRKLQKETYDLYMIIKNDVLSTNDLSRMLKKFIGKISAIQMIEKNRKFPNYMKLIKDKQAELEELRVEKAKA

SEQ ID NO: 3383 - protein, 316 aa, Streptococcus sp.
  source 1..316: note = Related to NCUA01000007.1; note = Streptococcus oralis
MDFSKSILYEISNKKWLAELLKIEKNMLSNVGDNFVGKSFMKDVNGKTRELYNAGTIHKRSLKLIVKYLQKINFPTYLHGGIPGRSYVTNVESHSKNKFAVIVDISNFFPSTNAQKVFNFFRYDMNQAPDIAKILTDLTTVSKDEHSFLPQGYPTSPILSFLAYYHMYENLMKYAQNNGLTFSAYYDDLTFSSKKPIPKICLKEIVNIIESFNLKVNKEKSKVSKLDYTKITGCVIVKGELKAPRKLQKETYDLYRYLKNSNLSDEELLSLLKKFAGKISAIQSIEKERQFPNYFKLIENMKSELEERRISELDWL

SEQ ID NO: 3384 - protein, 311 aa, Streptococcus sp.
  source 1..311: note = Related to RBKM01001915.1
MDFTRTILYGVSNKKWLSELLKIEKSKLKNIRNNFNTVPFVKKVNGKNRELYNAGKMHKLVLKRIVKYLQSIDIPNYIHGGITGKSYVTNVESHKKNRYGVIIDISNFFPSTDAQNVYNFFRFDMNQSTDIAKIMTDLTTVSKGNKSFLPQGFPTSPILSFLAYHKMYELLNNYAKVRDLTFSAYYDDLTFSSRKRISKRCLREIVSIIESNSLEINLIKSKVSKLNYTKITGCVIVGNELKAPNKLQKETHDLFLKIKNGNLSETELSILLKRFLGKISAIQMIEKNRKFPNYLKLIEDKKRELMSRRND

SEQ ID NO: 3385 - protein, 324 aa, unidentified
  source 1..324: note = Related to CP038012.1; note = Sporosarcina pasteurii
MYIQGGIFLFRESFLYELSNKKFLSEIIQVDLSVLKNLEDLLETEKWKPYKLENKKRDLYNPTVQHKRALKRLVRSLYSITYPTYLYGGIKNKSYIDNAAIHKNNKYFLIADIEKFFPSTHESYVYDFFRNKMQMSIDISRILTLLVTYQHEEDSYRYLPQGFPTSPLLSFLAYSDMFKELEQFAETNNLVFSAYYDDLTFSSASFISKHLKRELALILRRYGFNLSTEKTRFQKRKANNITGVIVTKDGLKSPYKLTKKLMRLSSDLDNNLKNSSLTKEEIIVQLRRIRGCIIAIQSVDPSRNLQVYEKQINEVKRVHDVTFS

SEQ ID NO: 3386 - protein, 385 aa, unidentified
  source 1..385: note = Related to JADMDV010000024.1; note = Enterococcus asini
MKTRNEVKKTRGKHRKQLAQFTLCNIVVNFLMDFKDVLESLRAVFRLVSFVVDSLQYWIDLLYSLLFYFCEVYKMNYSTSPLFEVSSKKRLSYLLKTDISKLKQADISFSAPYFSKMKGRKTRQFFNPTDTQRITINAIKNCLEQIEIPNYIYGGIKNRSYIANARVHENAKSLILIDLKNFFPSTSDSYVYDFFKNKLNQPADVARILTIITTESGDHGRFIPQGYSTSPLMSFLAYESMYQQLNNLANQQQLHFSAYFDDITFSSSKYINKAVERSAKKIVRSFGLQINQEKSRTLFNNASKLTGVVITPTQIQASGKLHKQMIDNFDLLLNSLYSNSKPSKKDLLNLCNKTQGCINSIKAIEENRDLSYYTNKVKEVRRLIK

SEQ ID NO: 3387 - protein, 315 aa, unidentified
  source 1..315: note = Related to NRPS01000012.1; note = Carnobacterium maltaromaticum
MILLKYTNSSLYGITTKKHLSYILKMNLGSLSNIEPLFCANSFSKKKNNKSREFYNPTLEQRAVLNRINVALCQIGAPNYAYGGIKGRSYIDNAKVHSGQKALFLIDISNFFPSTRDKYVYKFFKNKLAMSTDVATILTLVVTEKLFDSDKRFLPQGYPTSPLLSLFAYIEMFESINKIAINNDLKYTCYYDDLTLSSSSYIDKKILRQVKKEISSYDLKVNDFKTRALFNKASKLTGVVVSPEKIVAPGKLQLQMIDNFSKLMDAIYSGKMTTKIEINELCNKVQGCLASIKSIEPDRDLTYYVNKLKIIRQML

SEQ ID NO: 3388 - protein, 318 aa, unidentified
  source 1..318: note = Related to nan
MNYKNSNLYSVQSKAKLARLLNIDANKLRAVRENFSVDAFVVEINGKKRLLHNPSYCYKQILKRMLLLLYPIGAGDYVFGGIKNRDYIMNAKVHKNNTYFCLIDIKDFFPSTNSDFVYRFFRYKMNMSIDVAKICTLLTTVSNSETSRPDNLPQGFPTSPYLSYLSYLELFEQLNNISISKNMNFSCYYDDLTFSSPRFISKGTKRDIIKLINSYQLQVNSSKTRLLKNSNGVKVTGAVIRDNQLLTPNSLFLKLYKEYDNLLSEFYLNSFDQKKILNMCEVVDGILASVTRIELTENAEYIKNKVQIIRETSNATIS

SEQ ID NO: 3389 - protein, 318 aa, unidentified
  source 1..318: note = Related to NZ_MKXO01000001.1; note = Exiguobacterium aurantiacum
MNFEKSILYNVQSKKHLANLLRIDARKLKAVREYFSVEPFVAEINGKKRLLYNPSYFHKQLLKRMLLLLYPIGAANYVFGGIKNRDYIMNAEFHKNNKCFCLIDIKDFFPSTSSDFVYRFFRYKMNMSIDVAKICTLLTTASSRETNKLDYLPQGYPTSPYLSYLCYLEFFEQLNNISVSKNITFSCYYDDLTFSSQHFISKGTKRDIIKLIESYQFQVNKDKSRLLKNSNGVKVTGAVIRDHKLLIPNSMHLKLYKTYDKLLNDFYLSSFDQTNIVNMCDAVDGILASISRVESIENIKHIKNKVRIIREISNAITS

SEQ ID NO: 3390 - protein, 346 aa, unidentified
  source 1..346: note = Related to NZ_LFQN01000028.1; note = Exiguobacterium acetylicum
MSLQISLALAFIILLLEKEIENYMNFQNSILYGIKTKKELAKLLDINKKLLNDVNYHFSTKPFEANINGKKRMLYNPNDIHKEILKKLIELLSPIKAKEYVFGGIKNRSYIMNATLHKDSTFFCLIDIKDFFPSTKEKFVYNFFYNNLKMSSDVAKVCTLLTTEYDIQQRNRHLPQGYPSSPYLSYLCYFKLFEELNAISISKNLIFSCYYDDFTFSSKQSISIKTKREIMKCIKKYNLTVNTDKTKLVKNKNGIKITGVVIRNNDVIPPNKNLHKLYIGFKELKIKFENDFFEKDEVLKLCEKVKGLYEAVQKIKFNNDLTYMVSYIKDIKIFYEKNKSIKNKSD

SEQ ID NO: 3391 - protein, 317 aa, Bacillus sp.
  source 1..317: note = Related to NZ_WEIO01000005.1
MVDFKLSKLYGINNKKYLSELLKVELSKLKDIETHFSTTPFYQKNQKGKRRRLYNPHPDYKKVLQRLNIHLSRIVAPDYVLGGIKKRSYVMNANLHKENDYFLLLDLKDFFPSTRDNHVYYFFRNKLKMSQDIAKICTLLTTEPSEDRTFRHLPQGYSTSPYLSFLSYFDMYNGIKNISDNQNIIFSCYYDDLTFSSKKRISFKFKETISNIVADYHLTINKDKTRFYTKKRKVIKITGAIINKGQLLKAPNSLQKKMYIYFKELTQKTQQRPVEKEHIIKLCNKVIGCLTAIQHIEPKREFPHIRKKVKEIRKALR

SEQ ID NO: 3392 - protein, 315 aa, Bacillus sp.
  source 1..315: note = Related to NZ_CP021500.1; note = Bacillus atrophaeus
MNYSTSKLFGVTNKKYLSELLSIDINELKNIEEFYNTSPFTKIIKGKERTLYNPPFKYKKVLNKINIYLQQITPPSFVFGGIKGRSYVMNATLHKDHSNFLLLDLKDFFPSTRDFYVYNFFKNKLRMATDIAKICTLLTTVKLGLNTQERNLPQGFATSPYLSFLCYYDMYNSIYKISNHKQIVFSCYYDDLTFSSSSYISKGFKRNIVKVIKEYGLVVNDKKTRLLFNKHGIKITGAIVKDNSLLSPNNTQLKMYSHFEKLMVLYSTDPTKQQEILELCNKVNGLLIALKIVETNRDLGYIKNKVKEIRKTING

SEQ ID NO: 3393 - protein, 316 aa, unidentified
  source 1..316: note = Related to NZ_BMHE01000064.1; note = Paenibacillus marchantiophytorum
MLNIQLCKLKNLKSKKMLSLYLRIELYKLKDITKHYSTAPFEKEFDNGKKRMLYNPNKDYKQVLKRINLILQQIPIPNYVFGGIRERDYVQNATVHKDNNFYLLMDLKNFFPSTSDSYVYDFFKNKLGMSMDNAKIVTLLVTVPNEGNSGIRSLPQGFSTSPVLSYLSYSDMFEKIHDLAVSQGIKFSCYYDDLTFSSSNMIGKSFKNRVIEIVEQFNLKVNNKKTHLTRNINGTRITGTIVKNNTLFAPNKLQRKLTEKFNELEKMEQVDILNKREVIQLLCNTVQGCCSAIMSVERTRKFPHILRRVREIRRSV

SEQ ID NO: 3394 - protein, 314 aa, unidentified
  source 1..314: note = Related to NZ_CP010976.1; note = Paenibacillus sp.
MIDYTVCTLYGVKNKKYLSELLKIELFKLKEIEKYYITLPFSKKMGNNKIRLLYNPSKEYKDILKRLNYFLQKIVLPDYVFGGIKKRDYIQNASKHKDNKFFLIIDLKDFFPSTSDTYVYNFFKNKLNMSIDVAKICTLLVTEQSEINTRYLPQGYSTSPILSYLCYFEMFNSINSLSINNNITYSCYYDDNTFSSKNIIIKDFKNKIVEIIKSYNLQVNPKKTILLKNTKGVRITGTIVNNNILSAPNPLQGKMYINFNKLVNSDLTDMNEAKNIIKLCNIVQGCSSAIKSIERQRKFPHILKKVKEIRSLIK

SEQ ID NO: 3395 - protein, 317 aa, unidentified
  source 1..317: note = Related to JAHHWV010000004.1; note = Cytobacillus oceanisediminis
MEYQKCKLYGISNKKYLSELLHIDAFKLKDIDRHFSTDFYISKSRNKERHIYPPKPYYKKVLKRLNWYLSRIAVPDFVNGGIKNKSYIMNGLYHINSNHFLLLDIKNFYPSTSDYFVYRFFKNRLNMSTDIAKICTLLVTEPHPMHDNYRHLPQGYPTSSLLSFLAYSDMYIHLYNYAMLNNITFTCFVDDLTFSSDDYISKSFKRNINKIVRQYNLEINSGKTMHRRINKGINITGTYIKENKLFAPNRLQKDMSIAFSELCAAYEANPKDINQLKLLCNQLQGYIVNVKLIEEARSLDYMQNMITKVRRYIKNKA

SEQ ID NO: 3396 - protein, 319 aa, unidentified
  source 1..319: note = Related to NZ_LT985747.1; note = Paenibacillus sp.
MDINNCKLQNISNKKYFSELIRIPLSHLKNVRKYYTTVPFTQMTQKNKPRTLYNPSTEHKRILKSINRHLQKIIIPEYVIGGVKGKSYINNGEIHNGQSFFCLIDFTDFFPSTNEKYVYNFFRYKLNNSVDIAKILTLLVTETSPSTGVDILPQGYPTSPILSYLSYHGMFSKLKILADANNYKFSCYYDDVTFSSNTFINKNFKKQVIRVTSDYGLKVHPQKSGIYILKNGIRITGTIVRKEGLYAPNKLQLKMINQFKELEQKAKVSADHDEIISLINRVQGTVSAIKSIEKDRSFPHITRRLKEIRHSSKINNIAK

SEQ ID NO: 3397 - protein, 309 aa, unidentified
  source 1..309: note = Related to VWVR01000006.1; note = Exiguobacterium sp.
MDYSSCKLYKIETKKSLSYILQTPKSSLKNVNLCYYPKVNIFNKNTSSGKVRTFYNPTGEHKKALRNINRSLSVLPIPPYVIGGIKKQSIISNASKHMSSRFFLSMDIKDFFNHVPQKYIYSFFKNDLKMSIDSAKICTTLVTYEIDNHSILPQGYPTSPILSYLTNKKMFDKISQLSSQNNIIFSLYVDDLTFSSPNPISKKFENEVRKILNFYSYKVNSSKTKRQYITKPVLITGVIINNGELLPQIKHTKQMIDYIHNIKSRDLHEVNIDSWGKKIRGYYYYHQAFESYSGIKFPQIKNFLGNYKK

SEQ ID NO: 3398 - protein, 342 aa, unidentified
  source 1..342: note = Related to NZ_RAPK01000002.1; note = Sinobaca qinghaiensis
MFIDEKNSLANLQKKTKLAKILNCDVEYLKNFSDYSEVKSFDKRVGPKTRRLFNADPNHKKILRKINKLLLSMNIPDYVYGGRPNRDYLSNAFLHKKNPYIQTADIRSFFPSTHESYVYGFFKNKLLMSEDVSKILTDLTTYSSSESPHYPEKSLPQGFPTSTIMSYLAYFDMFNGIYKQCRDRNIHFSLFVDDMTFSSDVKIPKSFIRHINNIVTQYDLSLHPNKIRRFSVDQPKLVTGVIIDPKTNNFHIPNKLHKKIYTNIQNFHSLNVNTYTDYVNLKRIILSLKGQLASCSRIDQEKTFNHIIKVIQDVEIHFIVPSVKGATHRQLYEEYISFVSFR

SEQ ID NO: 3399 - protein, 338 aa, unidentified
  source 1..338: note = Related to NZ_FOHJ01000001.1; note = Salinibacillus kushneri
MLISQPHSLFELHNKRRLASLLKTDVENFNRIEERYTVYPFKKKVGKKVRTLFNTDQHYKSLLRRLNKMLCKTNIPDYVYAGIPKRDFLDNALIHRQKPYIQTADIQNFFPSTRDSYVYGLLLHKFHTSPDVAKIITQLTTYPLDSKTALRHIPQGFPTSTILSFLSYFDLFNGIYNLCKQNDIHFTLFVDDMTFSSHKRIPKSFLRHINSIVKKYDLQLHPSKIHRMNPYNYKTVTGVVIDPCTGLLKAPNKLQRKMFNNFKAIHNYSINTFNDYIQFKQLVLKLEGQLKSINRIEPNRQMPYITTVVKDIKRNFITHSVKGSSRDVLKSEYEFFVK

SEQ ID NO: 3400 - protein, 421 aa, unidentified
  source 1..421: note = Related to NZ_JAEUZA010000002.1; note = Alkalihalobacillus gibsonii
MDDKSIGRDRNHYLETRPSRKEKHGRKKTKLRSVLIDVFIRTLLSRLFTEVFNIVSRFVLRIIDMISNLLYQKNKVIFMRIPENHAFYQLKSKKRLAAILGIDSPAFFKHLDLHFTCTEFSLTKNNKTRTLLNPSKQYKRILRKINQLLQGINFPTYLHSGVKQKNALSNACYHNSHSHICTMDIKNFFPSTSEAFVYKFFKDKFKMSEDVAKIMTLLVTYKNENEVARLPQGFPTSSILSYLVYFDFFNGVNALAHSRNMKFSIYVDDLTFSSNRAFTPSFLNRIVTIAQQYELTIHPDKTQFYNRHAHKKITGVILKQETVRAPLFIHKQINQHYLDILDCDLLTFSNFIKFKQKVIKTLGQIQYVRSIEGTHKYISIERNLNDFKEHFSVLSVKDKYRIQLKQEYKHFQGMFTHSIIF

SEQ ID NO: 3401 - protein, 350 aa, unidentified
  source 1..350: note = Related to JAFWLO010000012.1; note = Candidatus Saccharibacteria bacterium
MLNQGYPKLNLYTKKQLADAIRGKDLSFDSAMKLIDDCLINKDKYWSDNSEESKSNENKWVRNASGTPLGKLQKRIDQKVLALHDSELPIFIYGGVGKKGIKNAVIALQGKRNKRTLLKLDMSHFFEHISYGDVIKILVCHCGCGKDVAHIIAEIACIQSGKKSSNNTNEKVLARGFSTSSRLAVWRNLSLFRSLFYCMAKRLNKHDPRIAVYMDDIGITASRIDPVSLSSLYKDITKLIENSSKLVVNKNKTKIIDYLQHEYDVTDGHLLEDKIAQFEFLGIGIGRNRLYPGVKIRSKMAKLIKKSHLSDEELRTLKGQKRYVKFITGKKLGLPPNDASLNRKGLLWQN

SEQ ID NO: 3402 - protein, 331 aa, unidentified
  source 1..331: note = Related to JAFUEB010000001.1; note = Candidatus Saccharibacteria bacterium
MINQGYPKLNLYTRKQLANAIRDKDLSFDAAMKLIDDCLINKDKYWSDNPKESKQDDDKWVRNASGTPLGKLQKRINQKVLAPHDSELPIFIYGGVGKKGIKNAAIALQGKNNKRTLLKVDMRRFFEHITYEDIVRTLVCHCNCGKDVAQIIAEIACVRMGKKSLDNTNEKVLARGFSTSSRLAVWCNLILFRKLFYCISKRLKGHDPRIAVYMDDIGITASRVDPAMLSSLYKDIVNLIENTSKLEVNKNKTRIIDYLQREYDIIDGHLLEDKTAQFEFLGIGIGRSRLYPGVKTRSKMAKLIKKPNSSDEERRTLKGQKQYVKYITSKN

SEQ ID NO: 3403 - protein, 333 aa, unidentified
  source 1..333: note = Candidatus Saccharibacteria bacterium; note = Related to JAFWIP010000002.1
MNMINYPNFNIRSKNEIAKRISSRKLPQSEALALINDCLVDFDSLWVDNLKMSEPGKKKWVRDASRTKLGNLLSLIDKRIFAPYDTKLPSFIHGGVAGKGVKSAASSLLGKRRKRMLLKVDMSRFFEHVSSERLKYALIHKLGFSREAALIICKLCCVDAGPKNGLEKGKTIARGFATSNRLAIWCNLELFYRIKWLTEKRLGRYDARLAIYVDDIGITASRIPPKTMANFYSGLIVLVNKYGNGLEINHGKTRIINYLGNQFSVNGEPAVDNGGSPVKGSYEVLGIRMERNRVTAGRRTIGKIQSLKSRKSLTIPQKKSLKGLEKYKRYIGS

SEQ ID NO: 3404 - protein, 334 aa, unidentified
  source 1..334: note = Related to JABZTB010000283.1; note = Prevotella nanceiensis
MKKKDNPLIPINIRSKNELAKRISNKYLSVKDALTLINEVKNNFDDLWKDNLKDSKPEENKWVRNAKGTKLGTLLSLINKRLFAPYDNYLPCNIFGGVSGKNTKSATLHLLGNKRKRTLLKMDLHRFFEQNDYEKVLDFFHKKAGCSLRMSHFFATICCVPLGQKGTLGTKRVIARGFSTSPRLAIWCNLQIFKQIDRKSRSMLKGFDPRVSFYVDDIGITASRVNLKKMTDVFHCVKSLLDGSGNYRLELNTKKCFIVDYLNNTYDTNGEYIGKGHFEHLGNELMRNYVTPGIKTMSKLRSDEAKLKALSGQKYKRCLNSIRARKRYVHYTKS

SEQ ID NO: 3405 - protein, 334 aa, unidentified
  source 1..334: note = Related to SHNI01000007.1; note = Candidatus Saccharibacteria bacterium
MALKPNNYPAIRIRSKNELAKQISSIKRNPSSSLKLINDVVGNYDNYWKDHPKLSQPEKGKWVRDSSRTNLGKLLRDIDKHVLRPHDNLVPKFIFGGLTGLNHKAAVLHLLGRRRNRTILKLDITKFFEQISQERVYHLFYSKCECSKVASNLLASLCCVPYGPKEKPEDYNTIARGYPTSPRLAVWCNLDTFIKIERVVTRELKGKDPRIAIYVDDIAITASNVSIEDMMKLYPKIKDILENGDKNQKLPLNHAKTKIVKHSGETYDIEGEYQGKWAFEHLGLQMNRNSVTLGTKTRRKLRNTNQDFKKSGRKDRIIRRKRKSLLLYKSYIEK

SEQ ID NO: 3406 - protein, 333 aa, unidentified
  source 1..333: note = Related to CP040000.1; note = Candidatus Saccharibacteria bacterium oral taxon 488
MKNNQRNYPKIAIRSKRELAKRLSDKRDSVEDMARLISDVKTNYDNYWTDHPTQSQPEKGKWVRDASRTDLGKLLKLINVKVLAPHDSLIPTFVFGGVSGRNHKVAVTHLLGVKRKRIILKLDVSRFFEQIKYERVYSFFLAKGRCGQRGARLLADLCCVPIGAKDNPGTYKTIARGFSTSSRLAVWCNLDTFLRLERLVKKELQGKDPRIAIYVDDIAITASGITKEDMMKLYPKIKTILESDKNQKLPLNDAKTKIIYHSGDEYDIDGIYQGKRGFEHLGLQMNRNSLTLGTKTRWKLANLTHRYKESRRRNTTIRKKRKSTLRYKEYVER

SEQ ID NO: 3407 - protein, 325 aa, unidentified
  source 1..325: note = Candidatus Yonathbacteria bacterium; note = Related to JAAXVH010000004.1
MTVRRYPKLNIRSKNELAKHLSTKKISKESRLALINDVLTNFDTYWKDNLHESKPQERKYVRNAKHTHLDKLLRAINEQVLSPHDNLLPEFIFGGIKGKNHIKAAGHLLGEKRNRTLIKLDIQTFFEKIDDKRVYYFFKNKCGCSSKASRILANLCCIPEGPKDKPGTKKVLARGFATSSRLAIWCNLDTFLKLDWMIKKELKGYDSRIAIYVDDIGITASRVGKQKILNLEQKIEMILCSDKNAELPLNKEKTRVIPHQEGMEHLGIILRRNKLSLGKKTRSKLEETKKRISRAKDKDKVKKIKTQKRSLMSYKRSVETYKPAK

SEQ ID NO: 3408 - protein, 323 aa, unidentified
  source 1..323: note = Chitinophagaceae bacterium; note = Related to JADLDS010000026.1
MKHEDGYPKLCIRSKNELAKHISHKGFLPDEALALINNVKSNFNDYWKDSKKASKPQNDKYVRNAKGSPLGKLLRKIDRLVLTPHDSLLPNFIFGGVKGKNHAMAAYNLLGNKRRRRLLKIDISRFYERVELHRVINFFQYKCGCQYRAAKLLAEFCSVPFGAKDSKNPRITIARGFATSSRLAIWCNLGVFKKMERLVMRRLKGHDPRISVYVDDIGITSSGVTKEQMENLRDEVIQLLQTHDKNQPLPVNKKKTAIQSHEEGLYILGIKLNRNNLTIGRKTHSRIHNFKHKLKVSKAKKERDKLKQLIRGISRYKNYVENM

SEQ ID NO: 3409 - protein, 328 aa, unidentified
  source 1..328: note = Related to PFPL01000018.1; note = Candidatus Magasanikbacteria bacterium CG_4_10_14_0_2_um_filter_33_14
MLNKTYPKINIRSKCELSKRISHKKLPRQDALTLINDVKNNFEKYWKDNISKSKPEKNKYVRNAKRTPLGKLLKIINSKILAPHDNIVPNFIFGGPKGRDHVKAAYSLLGTYKKRTLLKADLQGFFEQIDEKNVIDFFLKCDCDYKTAKFLGYICCVFDGQKGSNSKKRVLARGFSTSSRLAVWCNLDVFIELDRLVKKRLKGYDPRLAIFVDDIGITASRVPIDLMDNLYKEIKELFEGKKQKQPLILNDKKKDIKQHFEGMEILGSFLYRNKLKLGKKSFSNKQKIKSLLKEKNVTNMKKIKNKYRSIKQYEKYVEMQGKQKNKIL

SEQ ID NO: 3410 - protein, 320 aa, unidentified
  source 1..320: note = Related to LCFU01000010.1; note = Parcubacteria group bacterium GW2011_GWA2_43_17
MQNRRYPKIFIRSKSEFAKHISHKNFTKEDALKLINDVKINFEKYWKDSKRSDPKKEKYVRNAKGTPLGMLLKKINSLILAPHDKILPNFIFGGLKDLNHAKAAKHLLGNKRKRTLLKLDIKHFFEQIGLGRVFIFFQNKCGCSKKASKLLSSLCCVSLGPKGSNNPIKTIARGFATSSRLAVWCNLDIFIALNKLIQKRLKGHDPRIAIYVDDIGITASRINKETMEKLYIEIKKLFYSFDKNQLLPLHDIKDKGGIITHNENMQILGLQLNRNTLSIGSKTRSKKNKLMNKLKISTDKKILKNKYMSLIRYKNYIESL

SEQ ID NO: 3411 - protein, 308 aa, unidentified
  source 1..308: note = Candidatus Jorgensenbacteria bacterium RIFCSPLOWO2_12_FULL_42_11; note = Related to MFKM01000024.1
MQTSRYPKLYIRSKNELVKHLSHSKFPKKEVLALINDVLNNFTRYWRDNEYRSEPEKEKYVRSAKRTPLGRLLDNINKAVLAPHDKMIPDFIFGGVKNMNHAKAAKYLLGKKRKRTSLKLDITRFFEQISEERVYHFFRDKCACSKKAAALLASFCCVPEGPKGNASERKTIARGFATSSRLAVWCNLDTFIKLDRLIKKRLKGNDPRVAIYVDDIGITASRVSKEEMGKLSLEVESLLLNTDRNQKLPINKRKTKISSHEEGIEHLGLRLYRNRLSIGAKTKSKIDRIRNRSERKPLIRYKHYIEKI

SEQ ID NO: 3412 - protein, 321 aa, unidentified
  source 1..321: note = Candidatus Moranbacteria bacterium; note = Related to DMVZ01000029.1
MQSRRYPKLFIRSKNELAKHISHENFPKEKALVLINDVIANFDFYWKDSVHSDPLKEKFIRNAKHTKLGLLLRKLNTLVLAPHDKLLPKFIYGGVKEMSHAKAAKNLLGSKRKRILLKMDLKKFFEQVSSERVAYFFQNKCECSKKTSEMLSCLCCVPIGPKNNGASKKAIARGFSTSPRLAAWCNLDIFIKLERLIQKRLSGHDPKISVYVDDIGITASRLPREVMEKLRDEVSSFLLTADSKQQLEINQDKTIITSHEEGMEYVGARLYRNKLGLGKKAKSKRDQTKNKLKKNSDPKVRESLRRKLNGMNHHKKYIETT

SEQ ID NO: 3413 - protein, 322 aa, unidentified
  source 1..322: note = Candidatus Micrarchaeota archaeon; note = Related to JAHKLX010000106.1
MSNRYPQLGLRSKNEIAKRICSKKLSQNEALELINDVIKNFDDYWKDSKESEPRKQKYIRSAAGNPLNKLLKAIDAKILQPHDHLVPNFIFGGLKGTSHIDAAYSLIGRQNARTILKMDIKRFYKQITRERVFFLFYRKCGCSVKAANLLADLSCVPVGKKGSGSTKKTIARGFPTSSRLAIWTNLDTFLRLQWEVSRLLRKHDPKVVVFVDDIGVSASRVSGKLFKHVKHVAQTILAAYDENQPLPVNKRKTQVIPFSDGAEHLGLLLGRNKISIGRKTKSKMARVKNKIASAVGLERKSLLKKRSSYYSYKKQIKKAYDN

SEQ ID NO: 3414 - protein, 321 aa, unidentified
  source 1..321: note = Related to JAACWQ010000004.1; note = Candidatus Pacebacteria bacterium
MANIYPQISIRSKNELAKQISSVKLPFEGALSLINNVIENYDTYWKDSKKSEPQKRKYVRTAVGTPLDTLLKAIDKKLLQTHDKLIPGFIFGGVKGKSHIAAAYHLVGNRNKRILLKMDISRFFEKITRERVFYFFNKKCNCSVKASNLLADLCCVPKGKKGSTDPTKTIARGFPTSSRLAIWTNLETFLKLRHTVTKKLKNHDPQTVIFVDDIGISASRTSKESLDEIRKSVQKILLSHDRNQPLPANKGKTKIIPFSEGAEHLGLLLGRNKISIGRKTKSRMATIRSLVGKSRGETKKSLIKREASYYRYKKQIEETII

SEQ ID NO: 3415 - protein, 326 aa, unidentified
  source 1..326: note = Candidatus Pacebacteria bacterium; note = Related to DOZC01000042.1
MQTNSRYPIINIGSKNELAKRLSSKNFSKDKSLELINNVLANFDKYWYDSKKSDPEKQKFFRSSVGTPLHKLLKLINAKILKVYDKSLPEFIFGGVSDRNHILAARELIGNKNDRTLLKIDVSRFFEQITMQRIVRFFHQKCNCSLRASYLLASLCCVPGGQKDSSANMQKYLARGFPTSSRLAVWTNLDTFLRLKWETNKRLKNHDPKIVIFVDDIGVSASRVDIKTINCLKESLIGLLESYDINQPLPVNHKKTEIIAFKNGAEHLGMRLGKNKISIGRKTISNKSKLNNSIKTSDGLGKSLLLKKKAAYYQYLKQIEQVNDMA

SEQ ID NO: 3416 - protein, 323 aa, unidentified
  source 1..323: note = Related to PFOQ01000006.1; note = Candidatus Pacebacteria bacterium CG_4_10_14_0_2_um_filter_40_20
MKKNNYPQFGIRSKNELAKRISSKSLPANEALILINDVLENHEGYWKDSKMSEPEKGKYVRSCVGTPLHRLLNLIDKRILRPYDKLAPHFIFGGLSKKNHIQAAHYLIGSKKRRSLIKLDIKRFYEQITQERIFYFFYKKAGCSVRASRLLAYICCVTQGAKGNPGVQRVLARGFSTSSRLAVWANLDTFLKLRWKLQAELGKNDPKIAVYVDDIGISVADVSQTKLEEIALMMAEILESSDANQPLPINNEKLDIMSFEKNAEHLGLRLGRKAIFMGNKIMSKIRKIKNDYQRAENNTKFKLMSKRIAYRLYQKQIDKQNEQ

SEQ ID NO: 3417 - protein, 323 aa, unidentified
  source 1..323: note = Related to JAHIUG010000089.1; note = Patescibacteria group bacterium
MFEQLRYPKIGIRSTCELAKRISDSYLPYDKALLLINNVILHFDEYWHDSKSSQPKKEKYVRSAVGNQLGELLRRIDRKILAPHDGKLPEFIFGGLSGRDHIQAGKRLLGKKRKRVLLGLDITRFFEQIKESRISYFFHKKCGCSLEASTLLARICCVPLGPKGGSSTNRVLARGFATSTRLAVWCNLDTFLRMSWKAKRLLRHHDPKVMTFVDDIGITASRVSHEEMKEIEKKVISILSHFDKNQPLPINPTKTKICSFSNGAQILGLGMGKRLSVGARSRSRISKTRLALKLATSPLEKRYLLQKKRGQDSYRRQVAQASD

SEQ ID NO: 3418 - protein, 325 aa, unidentified
  source 1..325: note = Parcubacteria group bacterium Gr01-1014_31; note = Related to VMFR01000001.1
MFSRPRYPRLRIGSKNELAKTISDSALPYPQALTLINDVIRNFDYYWRDNSENSQPNRGKFVRSAARTPLGVLLERIDKKVLAPHDRLVPNYIFGGMTGRSHIQAARSLLGQERGRILASLDITHFFEQIREQRVFFFFYRKCGCSPRASRLLASLCCVPVGQKGSMSTEKTLARGFATSTRLAVWCNLDTFIHLDREVKKLLKKYDPRVAIFIDDIGISASRVSQEKISAVVKIVEKILSDFDNNQRLPVNPAKTKIRTYASGAEHLGLKLGRNKLAMGSKSRSRRDSVINLLKKRGAYSPTRARRLLLKKQAYQRYQGQIRSA

SEQ ID NO: 3419 - protein, 328 aa, unidentified
  source 1..328: note = Related to PFMK01000011.1; note = Candidatus Gottesmanbacteria bacterium CG_4_10_14_0_8_um_filter_37_24
MQNNGRYPRINLRSKNELAKRISDKSFSFQSSLKLINDVLKNYNDYWYDSRQSQPEKGKFVRSSVGKPLGKLLKRINRKVLIPYDKLVPNFIFGGISKKDHIQAAYSLLGKQKNRMLLGLDISTFFEQIRKERVFYFFHAKCGCSARVSRILASVCCVPAGKKGSGSKVEVLARGFSTSSRLSVWTNLDTFLRLKWVTDRNLRNHDSKIVIFVDDIGISASRVTKNNLEILSRKIQAILSDFDRNQKLPINNKKTKIRSFTEGVEHLGLRLGRNKITAGYKTKKKLDKIKTEIKSSSGLNKKDLINKVKAYYVYKKQIKNVYSNSSNV

SEQ ID NO: 3420 - protein, 329 aa, unidentified
  source 1..329: note = Candidatus Magasanikbacteria bacterium CG_4_10_14_0_2_um_filter_37_12; note = Related to PFPK01000038.1
MPLEKRYPTINLRSKNEIAKRITDNKLPFKESIKLLNRVINNHSELWHDVISFSEPSKGKYVRSAKNTPLGKLLSLFDKKILRPHDKLIPKFIFGGVSGGSHVQASYHLLGICKKRTKLGLDITKFFEHNSEQRVFYFFHKKCNCSVQASKILSKLCCVPLGAKGSNNSKTLARGFATSTRLAVWCNLDLFLRIYWEAKKTLKYKDVKIAVFIDDIGISASRVDKRTMEDLSLKIRDILENYDKNQCLPLNNKKTEVKSYLDGEIEHLGLILGNKKLSFGRKTRKKLSDLKKDLDNKQIKGKQRKSLYTAKKSYYSYKKYIKNPIDDKK

SEQ ID NO: 3421 - protein, 326 aa, unidentified
  source 1..326: note = Candidatus Harrisonbacteria bacterium; note = Related to JACROC010000008.1
MRKEARYPKINILSKNELAKHISGSKLRFSDALKLINNAADNFNNQWYDSEHSEPEKEKFVRSAVGTCLGKLLELIDKKVLAPHDNLVPDFIFGGVSSKNHIQAAHHLLGNKRERVLLRLDIKRFFEQIHEDRVFNFFYAKCRCSARASRLIARLCCVPLGPKGQGSATKSLARGFATSPRLSLWCNLDLFLRLSWMVKKELRGHDPKIAIYVDDIGVTASRVSLERMEEISRIAENILENFDSNQKLPINPSKKEILSNVDGMEHLGLRFGRNKLSFGGKTRFNLNKIYSKLKSPLSKSEKLRLLNQLRSYQRYKQQIVKTSNAI

SEQ ID NO: 3422 - protein, 323 aa, unidentified
  source 1..323: note = Related to JACQFD010000021.1; note = Planctomycetes bacterium
MLKDRRYPVIALRSKNELAKRISGKDLPYPDALALINDVLQNFDAYWYDSDRSEPKKEKYVRSAIGKPLGKLLKLIDRKILAPHDSKVPGFIFGGLSGKNHIQAAYHLLGEKRKRTLLRLDIKGFFEQIHEERVFHLFNKKFGCSVEAAQLIARLCCVAVGPKNSGSTKKTLARGFATSPRLALWCNLDLFLRLQWKMKRVLRHHDPRITIFVDDIGVTASRIEEDQMRKFSTELENILAHHDPNQSLRINPQKKEILTAGMHKEHLGLQLGRNRLSIGKKTRFKRNEIAKALKQPQSEADKKALLKKRHSYFAYQEQIKNIS

SEQ ID NO: 3423 - protein, 325 aa, unidentified
  source 1..325: note = Candidatus Collierbacteria bacterium RIFOXYD1_FULL_40_9; note = Related to MFAQ01000041.1
MSDLRYPQINLESKNELAKRISDRYLPYSESLKLINDCLENLDHYWYDSRASEPEKEKFVRSARGKPLAELLKRINLAVLAPYDRLVPDFIFGGLSYRNHVQAAANLLGFQKKRTLLKLDISRFFERIGDGRIFHFFNKKCGCSVRASRLLSKICCVPKGPKGSGEVSKTLARGFATSPRLAVWANLDIFLKIDLTVHKMLRGHDPRLVVFVDDIGISASRVEMSKMQEVKEKVIDILQNYDPNQTLPVNQDKTKVIPFQKIPEHLGIKLGRNKLSPGKKTQLRMKNVSLLLGEAKSKKERDRLMIKKQAYRQYKRQLSSVNIPK

SEQ ID NO: 3424 - protein, 334 aa, unidentified
  source 1..334: note = Related to JAGOON010000014.1; note = Candidatus Pacebacteria bacterium
MGKQYTHKHPKLNLRTEKDLLRFLNAAKTVKTKNKTLKKQVTSKDLHFLSENAHLEWSDHPTESNPIKKKYVRFVKPGSSLNITNRRLNAALKLTLDKKVPGIFYGSVSKKSHIQAAEVLCNGKNTTIISLDITRFFESISPSRVARFFGKAGCSPEIIKVLVDITCVPLGSKNEPLSDYSLARGFPTSPRLALWATYEIFVKLNRVLLKNFPHLSPKMVIFVDDVGISIKNATIIDVEAIKETAFSIIENDKNGINLEVHKKPPKLKVRHISQTAEHLGLVIGKKSLAPGFKTRVKIGDVKTKLSDKSLSKTERETALQHKRGLMNYKRSVRP

SEQ ID NO: 3425 - protein, 335 aa, unidentified
  source 1..335: note = Candidatus Kaiserbacteria bacterium; note = Related to JAGQLY010000031.1
MRKQFAHKHPKLNLRTEKDLLRFLNASKEIKTKRGTLKRPVLFKDLTYLYEEPRLDWSDHPTESDSTKEKYVRSIKPGSILNTANRRLNEALRRTLDEQASQIFYGSVSKKSHIQAAGSLCNGKNTTIVSLDITRFFESISSDRVARFFCKAGCSPEIAKKLVAVTCVPVGPKEKPEEKYSLARGFPTSPRLALWSTFEIFVKLNRVLQKKFAHLSPKIVVFVDDIGISLKNATGEDIQAVKEIAFSVIESDTKDLSLKVHKNPPKLKIQHISENPEHLGLVIGKKNLSLGFKTRSKIGDVKVRLSDRTLSQEDRYKALQNKRGLMNYKRSITRP

SEQ ID NO: 3426 - protein, 335 aa, unidentified
  source 1..335: note = Related to nan
MRKHYTHKHPKLNLRTEKDLLHFLNARKTVKLKGKTVRRQVATKDLSYLDKNSRSDWNDHPSESKPENGKYVRYIKQGSTLDISNRRLNAALKQTLDKKVPSIFYGSVSKKSHIQASRALCNGKSTVIISLDVTRFFESVSLARIFRFFRKAGCSTEIADILVELTCVPLGAKEHPQSGFSIARGFPTSPRLALWATFEIFVKLNRILQKRYGHLSPKLVVFVDDVGISLKNSTPEEIEEIKALSFETIESDKNGIHLVVHKEAPKLKVQSIDQNAEHLGLVIGKNSLSPSFETRHKIGYVKAQLSKQTLSTENRDRARKNKRGLMNYKRSVSNG

SEQ ID NO: 3427 - protein, 343 aa, unidentified
  source 1..343: note = Related to MFLF01000011.1; note = Candidatus Kaiserbacteria bacterium RIFCSPHIGHO2_02_FULL_50_50
MKKNYTHTHPKINLRTEKDLLLFLNAKATKDRRYKIPRKLVSQKDVAYIRQNVHLDWKDYAYGGDSLKFESAAEKGKMTRSIKQNSCLDVVNRRLNASFRRVLDKHVPDVFYGSVSGRTHILAAKELTNGKKTVFLSFDIQKFFESISSNRVQRFFVKAGCTKEIADFLVSITCVPLGVKGLQKDKLSLARGFPTSPRLALWCTFEIFSKLNRILQKSFSHLFPKIVLYVDDIGISLKNPSEDEIVQIRDLVFELIESDKNGLSLTVHRDPPKFRVQKVEGRAEHLGVAIGKSKIAVGSKTVRNIAIVKNQLLSTNDKDERGRVLQKKRGLMNYRKTVTKNNL

SEQ ID NO: 3428 - protein, 319 aa, unidentified
  source 1..319: note = bacterium (gcode 4); note = Related to AMFJ01028863.1
MCKLNIYSLKTLSERSWISRDFLLSCSDGSGRFRKKFFSDHKNSKITDDITTCKYIRVVKYGSQMQKFHKWINWELKRFDSKLPLTIYGWVEEKSTIDAISIHIRGVPFVFIKSDLSRFFESIPKEQIFSLFCGKFNCDKIVAEVISNSITFPQWPLGSKGELFLARWLHVSSRIAVWSALNFFKDLCYFFQKKYKKYKPKISYYVDDIGISLVTTDQIIIDEFMADLVWFVWQIHKNSDFLNLHPDKTNCTIIKDNNDFVEYLWGKIYMNRKDISNKTTEKTKQLYFLYKKAKTIEEKNFYAKRLTPLRSYKKRMRSS

SEQ ID NO: 3429 - protein, 302 aa, unidentified
  source 1..302: note = Related to NC_016816.1; note = Pantoea ananatis
MTKQHKIGLVKVLEIVTTILAFINESWTFVEKVLSLFNIVPNYMNSSMKPASDWLHKFEIKENRWVFIPNEDTLTLGRKIHKYIKSKWKFPLYMFHLRDGGHVAAANYHIENTYFCLIDISDFFGATSQSRITRELNKFIPYDRAREIAKLSTVKNLNSNGLKKVLPYGYPQSPILASFCFRQSYCGKVIHTLSKSGNISISVYMDDILLSSDDIEQLVYAFNSIKTALKKSGYTVNEAKTQSPSTSVNVFNLVLSKNLLKVSSIRIVEFLQAYISSQNPAEKKGIASYVGSVNKTQAKLFQ

SEQ ID NO: 3430 - protein, 302 aa, unidentified
  source 1..302: note = Related to CABFWX010000001.1; note = Klebsiella pneumoniae
MTKQHKIGLVKVLETTTVVLAFINESWTFVEKVLSLFNIVPNYMTLSMSTPSDWLHKFEIKTERWVFVPSKKTLERGRQIHAYIKQKWKYPRYMFHLRNGGHVAAANFHLKSNYFSLIDVSDFYGATSQSRVTRELGRLVPYVKARQIARLSTVANPNRNGFKHVIPYGYPQSPILASLCFHHSFCGGVISSISKSERVFVSVYMDDILLSSDDMNLLVEAFDTVRQALRKSGYKVNENKTQSPSPKIQVFNLELGHNHLRVTPKRIVEFLKVFISSANEHERKGIASYVGSINKSQAKLFR

SEQ ID NO: 3431 - protein, 309 aa, unidentified
  source 1..309: note = Related to CP028949.1; note = Serratia marcescens
MKKFKLGLVKVLWGVYALYHFLKDFVPFLNESISLFEKLLSYFNIALNYLFLRRFFLMVKWESKFEIKKDRWVYVPTDEVRLYGEKLHNYLRKRWVPPLYFYHLRDGGHVACAKKHLANEYFALIDIKNFFESTGQSRVTREIKNYFKYNDAREIAKLSTVRNPLPVGPKYIIPYGFPQSPILSTLCLHKSYCGGLFKKIDSSFGIDISIYMDDIIISGNDLELCNLNYKLLCDGLIRSGYEVNENKSQAPSKSIRAFNLELKKDSLRVLSSRVIEFLVAYIKSDNPHVRKGIASYVGSINAEQAKLFR

SEQ ID NO: 3432 - protein, 312 aa, unidentified
  source 1..312: note = Related to NZ_LT629693.1; note = Bradyrhizobium ottawaense
MRKGALRRIPRGFTAIPAKWRWGRFHLAPIVIFLENMRNVARSFLKDGTRYFVLTKSYAGWRTFSEGGRAAYDGEEEWRLLKERVFSHWQPNAAFTAFAKRAHVAALRPHLVNKCFAVIDLKGFFDHVTRTKVCRALEAIGLARSSAFKIAGESTIRQGDKCTLPRGFRQSSLLATLVLEKSLFGSALTGNRFESKVTVYSDDIIFSSNDFETLADEHSQAIALLRRSHFAINPTKTQTARAEVDIFNLRMSHRTLRFTDERMWKFLEQAASFVKGEDAEHKLHLYEKLFGDYIRSINPEQEKRLRTSLGLP

SEQ ID NO: 3433 - protein, 310 aa, unidentified
  source 1..310: note = Candidatus Peregrinibacteria bacterium CG10_big_fil_rev_8_21_14_0_10_54_7; note = Related to PFDU01000094.1
MPKGLNFQRKSDIVKRLGIEPKVLEEILYDKEKLFYVEEEIIKGKTRDFHKCRGSLYGFLPQLNKAIMSLDALPPELCGGVRGKSIFKSASQHQKKKFVLKLDLKDFFHSVKPYQVQAVFERLGCTPSMSKLLTYTCTANNHLPQGFSTSPILAAHVLAPFVEDMRALLRPHHLSFTIWVDDITISGYTNPVRLLPTIRSICKKHKVHLNEKKRKLLRAGKQTQEVTGVRISYDKLSTGATFFRDTERMVYVLKKFGWHEVKKKFAFNVTDKRKVIQKIKGRINHIRQANAHQAGKLDTALRDTLEVQAH

SEQ ID NO: 3434 - protein, 319 aa, unidentified
  source 1..319: note = Related to MFXY01000035.1; note = Candidatus Peribacteria bacterium RIFCSPHIGHO2_12_FULL_54_10
MNDTRLNLRSENDVVNRLHLRDKKFLQTLCENRDRYFQKRMLNTGTKEREICIPHDPLGHFLRKFNAVLRTLPVPPECYGGVPGRSVKDNASKHTNKRFVMNLDIQNFFPSVTANQVFEVLRRHGCYRETSELLTKLVMIDNRLPQGFNTSPLLSIQVLTPIIEELRPLLSEQDATFTVWIDDIAISSDKSPEPLVKRIAEKCRRHGFRLNTDKYHCGERGVSVQEVTGVVINGDELRPAGGFIKQTEKMIHVLVKYGLEDLNAAFDREFLDTAKAQAHIEGRIVWIDEFDSAKADKLKQQLHKLVVPASFRSVLVTAQ

SEQ ID NO: 3435 - protein, 301 aa, unidentified
  source 1..301: note = Related to PFDR01000059.1; note = Candidatus Peregrinibacteria bacterium CG10_big_fil_rev_8_21_14_0_10_49_10
MRNALNFQFPNQIARRLKIKSSMLQNALHNMTDLYCHQERDIDGKVRDIYMPYPPLKTVQRKLHLTLRKIPFPAEFIGGMPKHSIFDNARRHVGRNFVLNLDLKNFYPSIKPSQVESVFLRLGCNKGMSRLLTYLTTADGHLPQGFPTSTMLSALVLVPLADDLRALLQPKFVFSFWVDDLTISGDSDPTPLIPAVRKLCRKHGFRLKEEKKHLGVRGKVPQEVTGIIISGKDFSPANGFLPHTKNMLRALNKEGWEYLNTIERWGCTSKREVTSRLKGRIRFIGQFDKSRAEKLYDSLNM

SEQ ID NO: 3436 - protein, 320 aa, unidentified
  source 1..320: note = Related to SABB01000002.1; note = Candidatus Saccharibacteria bacterium
MPRCKIMVTKSANKTIISTRRLCVEILQIHKDELLSLVADTDSYYRPYVQKKKRADGTAKERRIEPSYGYLKTAQRLVNKRILKPAMADLPIEIMGGRPGVSVVNNANHHAQSKSLMKYDVKNFFPSIKYGHVYHIFRYRLGFCEEAANILTKLTTYPSTGDVHVPQGAPTSTSLAMFALEPMCDRLKVYCDDNDLRSSIWIDDITISGDPKALRQHRPRINHIVNGTPFQIHPDKDTGVLVKGGKAGHEKGRKITGVVIDNNNRLTIGRQKLRSLRSKVRRSKVVSDKLEGSLQFLRHVNPTQGNKLLREYRSKHKRSA

SEQ ID NO: 3437 - protein, 305 aa, unidentified
  source 1..305: note = Related to NZ_CP040004.1; note = Candidatus Nanosynbacter featherlites
MVNQKCITTTKLCRDILKIPKEELLALLADRQSYYVPFEKKKITAGGRVKIRTIEPPHGYLKRVLKKINITVLQPQMERLPYGVMGGRKGYSVVDNAKYHASAPALMKYDIKDFFPSIKYADVFHIFRYQLNYCEEAANILAHLTTFENSQHGVHVPQGSPTSMSIAIFAVEKMSCAVDDYCRENGLKFSIWVDDITISGPYDKLCRHRSTINHILNSTHYRINPDKDSGIVKKGQKGRSVTGVIISNDGRLTVGHSKLSRLRRQVKRSTRPSDKLRGRLQFLLQVNKHQARRLIHEYAEKHRKN

SEQ ID NO: 3438 - protein, 305 aa, unidentified
  source 1..305: note = Related to JAHJMQ010000120.1; note = candidate division Zixibacteria bacterium
MNTSSKKVCLWGSVEALAKTLKVPVDDLFAWCGRKKRFVTEEERLIGAKYRQLKVPHGEFKELLRKIDQQLKRCPIPNYFYGSRKGVSAIDCALVHLHSPYILKLDLKDFFPSTDYRRVSNSLSQVCDKEAVLKLLTELCTFQHHLPQGFPTSTTIAELTLIPLAQRLFGMCNQYGLQLSIYVDDICISGSPVLLRLEARILRMFQEMHFRLNLKKKELRSKQEGIAVTGVFMQNGFCTTKPKFDEKLLKKIWAYELAQMICDSTLAEDLLGSIRGQLLWTRQLDESKYLCFLSELRQGQMMSGT

SEQ ID NO: 3439 - protein, 308 aa, unidentified
  source 1..308: note = Related to QZJA01000016.1; note = Candidatus Parcubacteria bacterium
MKKRQLLNINTLNELALQLEIPYDFLIKMADRMDNNYYTFDKKLIKKNGKIKIRKFFEGNNNLKIIHRKINQLLDHINYPDSIQGGIVGKSIVTNASIHASRKYVANFDISNFFPSIDYRVVYRVYRFLKCSPDVARILTKFTTADAHLPQGFGTSPKVSGLVLFEVDMRLNKLLSRYGLKHSFWIDDLTISGDHSIKKFKNIICKIFQQSGFKLNHDKTEFTNSKQKQVCTGLTINYQPNADKAIRDKVRKELFLCKKFGVENFLNEHGYSIDKDKYLRSMAGKISFLYSINPKYLTYKKTFQEITT

SEQ ID NO: 3440 - protein, 305 aa, unidentified
  source 1..305: note = Related to DOZJ01000002.1; note = Candidatus Falkowbacteria bacterium
MKKRQFLKINTVKELSYQLGLPEAFLISSANKIDNCYRKFTDKDKKGKERTFYVANENLKKVHQKINKLLDTLDYPINIQGGIAGRSIVTNASVHVGKKYVANYDIKNFFPSVNYKIVYRSFEKQKCMPEVCRMLTRFTTADGCLPQGFATSPKVSGLVLYSSNFRIETLLKPYDLIHTFWIDDLTVSGNRPIKKFQKLFYKIFKQEGFSLHDDPKKARITDSQHRQTCTGLIINQELNPEKGLKDKVRKELFLCKKFGVNNFLKEHNSPFDKDRYLRKLAGNISFLCSVNKKNFIYKEQLKLIK

SEQ ID NO: 3441 - protein, 316 aa, unidentified
  source 1..316: note = Related to MFGH01000021.1; note = Candidatus Falkowbacteria bacterium RIFOXYC12_FULL_34_55
MKRKKYFKFYSIKSLAKHLGVSEGFLIDLANKQDGNYKFCQGVMIKNKSRDLYKANTSLKIVLNLIDKKILNYYDFPKTFQGGIRGRALRDNAQFHTGKKYILKIDIADFFPSISPEKIFKTLKQLQIADKPASLLTTLVTVKNPHPHLPQGFCTSPKIASLVLLNLEKRFHNLFKEKKCDYSFWVDDITFSSDMPIGKFKNLILKILKDEGFSVNQKKIELLTNKERMVVTGVVVNSFPTLSNDRKKEIEKPLYCLVKFGIVDYFKKNKIEISEASITKIRSSLLGKINFAKSINPELGIKYKKDFLKITWELKK

SEQ ID NO: 3442 - protein, 383 aa, unidentified
  source 1..383: note = Related to STFG01000036.1; note = Lampropedia sp.
MNALCKALDLTLDEISEALSLTAADRYKERSVPKPNGSIRIVHNPHHLIRKIQRRINRRIFSNPDIILWPDHVFGSIPNEEFSDSPAAEKDYVNCARQHCRAKSVLSVDIKDFFDNIHRDRVHQIFSDFLKCEEEVSDVLANICCRGDNLVQGALTSSYIATLCLYSNEGLVVERLRNKGVAYTRLVDDITISSKIADYDFSFAMRQIERMLDEFGLPLNTNKTKLQNAGMQPLIVHGLRVDFDQPRLPPDEPRRIRAAVKNLELLASTPGYRASRAYRKDFNRCLGRVNKLDRVGHKQHKVLLARLRSVIPLPSHMDIERAEQQVTRLQNDSAKAGYKETYWFYRRWYVASQRIGILKRSFPGKASELRERLNQLRPIKNYE

SEQ ID NO: 3443 - protein, 402 aa, unidentified
  source 1..402: note = Related to NSLA01000001.1; note = Rubrivivax gelatinosus
MHSPIRLQPIKVARGSVPTLAALCSALDIQRAELDAALALTAAERYQVRTVPKADGSERIVHNPHHLIRKIQRRLNRRFFANPDVIKWPDHVFGSIPNDDLSTSPAADKDYVNCARQHCGAKSILSVDIKNFFDNIHRDKVRDVFTLFFKYPTDVAEALADVCCKEDHVVQGALTSSYIATLCLYDVEGLVVSKLRHKGLVYTRLVDDITVSSRVTGYDFSYALRLIESMVDSAGLPLNTRKTRIQSVGMRPLLVHGLRVDFAEPRLPPEEPRKIRASVKQVELLAASPGYRASRAYRRDFNRCLGRVNKLARVKHTQHLPLLKRLQKIVPLPSHKDIERAEKQITRLERDSLKPGYKDTYWFYKRWHVASERLTILKRSFPKTASDMRDRLRKLHPKKAYE

SEQ ID NO: 3444 - protein, 402 aa, unidentified
  source 1..402: note = Related to JAHUXB010000001.1; note = Comamonas sp.
MTYTAKLHPEKVALSSISNIDNLCDALDISVAELTAAMKLSPEQRYTSGVVPKKDGSDRIINNPHHLIRKIQRRINKRIFSDQDVISWPDHVFGSIPNDDLSISPASDKDYVNCARQHCCAKSVLSVDIKDFFDNIHYEAVVSIFESFLKYPADVADALANVCCKGEHVVQGALTSSYIATLCLHAVEGDLVKRLRHKGLVYTRLVDDITISSKLANYDFGFSLKQVEKMLHGADLPLNDGKTRIQHASMQPLIVHGLRVDFSQPRLPPSEPRNIRAAVKNLELMANSPGYRASRAYRRDFNRCMGRVNKLGRVKHNQHSELLARVRRVLPLPSHKDIERAERQVDRLEVDFLKPNYRSTYWFYKRYYVAMERLGILKRSFPKKAAELRARLIVMRPSGKYE

SEQ ID NO: 3445 - protein, 402 aa, unidentified
  source 1..402: note = Related to NZ_LOXM01000118.1; note = Burkholderia ubonensis
MAHTPRFHPVKESAGSIADVASLCVALDVALSELSSARNLPADQRYFRREVRKKDGSIRVVYNPHYLIRKIQRRINRRIFSNSSVVSWPDHIFGSIPNDDFSESDASEKDYVNCARQHCGAKSVLSLDIRDFFDNIHREIVRGIFSRFFNYPDDVSDALADVCCMGDHVVQGALTSSYIATLCLWDVEGQVVRKLGYKGLVYTRFVDDINISSKVARYDFSYALRLVEEMVSEAGLPLNGKKTKIQYASIKPLIVHGLRVDFDQPRLPPEEPRNIRAAVKNLELLAASPGYRASRSYRKDFNRCLGRVNKLARVGHQLHEFLMQRLRKILPLPSNMDIERAEKMISRLERDAVKSGYTETYWFKKRYFAASERIGILKRSFPNKAKELREKLKNIGPSTYRE

SEQ ID NO: 3446 - protein, 401 aa, unidentified
  source 1..401: note = Related to NZ_PKPC01000024.1; note = Ralstonia insidiosa
METPKFNPVKEAPGSISSIAGLCSALDISQSELDEALALPVEERYKKGEVPKKDGSMRIVNNPHYLVRKIQRRINKRIFSDSNVISWPDHIFGSIPNDDLSDSVAADKDYVNCARQHCGAKSVLTLDIRDFFDNIHRDRVFGIFFKFLKYSEDVSNVLADICCKGGAIAQGALTSSYIATLCLHETEGDLVRRLRYKNLTYTRFVDDITISSRVANYDFKYALGLTESMLSEAGLPINGQKTKIQYTSMKPLIVHGLRVDFDQPRLPPEEPRKIRAAVKNLELLAAGPGYRASHAYRKDFNRCMGRVNKLGRVGHSQHSILLNRLRKILPLPSHMDIERVERLIARLEKDVAKPNYSETYWFRKRYYAASERIGILKRSFPKKAEEFRGKLREIRPSSQYE

SEQ ID NO: 3447 - protein, 402 aa, unidentified
  source 1..402: note = Related to VIVL01000004.1; note = Variovorax sp.
MTQPQRFDPIKVSAESIATIDSLCGALGIGAAELAQARGLAPSERYIQKELPKKDGSTRIVHNPHYLVRRIQRRINRRIFSNPSVISWPDHIFGSIPNDDTYESLVYEKDYVNCARQHCGAKSILSIDIKDFFDNIHRDQVSRIFKNFLHYSDVVAEALTDICCKDASIVQGALTSSYLATLCLFREEGALVKRLGYKGLVYTRLVDDITISSKISNYDFSYALGQAVQMLSEADLPLNAKKTRIQYASMKPLMVHGLRVDFQQPRLPPEEAKRIRAAVKNLELLAASPGYRASRAYRKDFNRCMGRVNKLRRVEHNQHPVLIARLRKILPLPSHSDIVRAEQIIQRLKKDMSRPNYQGSFWFHKRCHVAAERLGILGRSFPKKAKELREQLKLIRPSTGYE

SEQ ID NO: 3448 - protein, 401 aa, unidentified
  source 1..401: note = Related to NZ_MRCN01000006.1; note = Variovorax boronicumulans
MPQFQKLHPIKESSGSIANIDALCRALDISSTELAQVRALSSSQRYEKKEVPKKDGSTRTVHNPHYALRKIQRRINRRIFANPDVVSWPDYIFGSIPNDESAEDPIDRDYVNCARQHCGAKSILSVDIKDFFNNIHRHQVIGIFKNFLKYSEEVSVILADICCDDEHVVQGALTSSYIASLCLFETEGDLAKKLGYKGLVYTRFVDDITISSKIAKYEFSYALTLTEQMLNDAGLPLNSGKTKVQNASMKPLIVHGLRVDFEQPRLPPDEARRIRASVKNLELLAASPGYRASRSYRKDFNRSMGRVNKLARVGHSQHSILLSRLRRILPLPSHADIGKAEELIQRLQKDFWRPNYQTSYWFHKRYHVAIERLGILKRSFPKKAEELNRILKLIRPASRND

SEQ ID NO: 3449 - protein, 401 aa, unidentified
  source 1..401: note = Related to NZ_CP059488.1; note = Acidithiobacillus ferrivorans
MEARQIDIYNPKKISLESIGSLAKLASCLDVTLEEIQEAQELSASERYKIKETPKRDGSLRKVYSPHFLIRKIQRRINARILSNSDVIAWPDHIFGSVPNQHCGESLVVERDYISCARRHCGAKSVLTLDIRNFFDNIHQSYVENIFTEFLKYDVEVSKVLSDLCCLDGHVVQGALTSSYIASLCLWDVEGELVVKLGHKNLVYTRYVDDMNVSSVISDYDFTYAVRAIEVMLDKKGLPLNPNKTKIQHISTEPLTVHGLRIGFKEPRLPSSEVRNIRAAVKNIEILASEHRYRTSHAFRKDFNRCMGRVNKLGRIGHNQHQKLVLRLKKVIPLPSKKDIVRAKKIVERLEKDYSANKSTFWYMKRFYLAHERLNILQRTYFKTSAELRGRLKSISPTYGF

SEQ ID NO: 3450 - protein, 395 aa, unidentified
  source 1..395: note = Related to PDHS01000438.1; note = Candidatus Accumulibacter phosphatis
MTQYNPEKKASGSIAGLDNLCSALDIHRSELDEALALSSSARYTARSIHKKDGSLRVVHNPHYLIRKIQRRINRRIFSNASLIRWPDHIFGSIPNQSSDDGVPIAKDYMSCASRHCEAKSVLTLDIKNFFDNIHATLVRSVFLDFFKYCPEVSDALSDICCLDSHLVQGALTSSYIACLCMHDIEGSVVEKLNRKGLVYTRLVDDINISSRISQYDFYYAISMVDNMLLEKGLQLNLDKKRVQYISTEPLTVHGLRIAFKEPRLPADEVRRIRAAVRNIETIASERDYRTTHAYRKDFNRCMGRVNKLSRVGHNQHKLLVGRLKRVFPLPSKKDIDRVTTIVTKLEADSGQKKGTYWYWRRFYLAHERLTILNRSFPHAAQDLRQRLKLLKPLYE

SEQ ID NO: 3451 - protein, 400 aa, unidentified
  source 1..400: note = Related to SORD01000001.1; note = Janthinobacterium sp.
MIPVSSTTRLYPVKTATHAITTIQGLCEALDIVVEELDDVLLIPPKDKYSSQERRKKDGSVRVVHNPHHRLRVIQRRINKRLFSNQNFVSWPDHIFGSIPNQKFEGSKHPKDYVACAKVHCGAKSILTLDIENFFGNIHVSQVIKVFTQLLKFSPEVAEVVSKICCHEDYLIQGALTSSYIAGLILFDVEGMVVERLLRKNLRYTRLVDDINVSSVVSDYNFSYAKTIIEDMLIGKDLPVNHSKTKIQYSSTVPLTVHGLRVGFKEPRLPSDEVRKIRAAVHSIELMAKEPNYKTTHSYRRDFNRCMGRVNKLCRVGHNQYDKLLLRLQKNYPLPSKKDIERAIKIVTKLEVDYPTKQGNFWFAKRFYLAHERLNILQRSFPNVAYDLRFRLKAIKTVYE

SEQ ID NO: 3452 - protein, 397 aa, unidentified
  source 1..397: note = Related to JACYUQ010000003.1; note = Oxalobacteraceae bacterium
MVRVPQLFPKKTAVGSIATIDQLCNALSITEDELREVILLPDILRYSSRPIPKKDGSLRFVHNPHFRLRRIQRRINNRLLSNQSFLSWPDHIFGSIPNQQFDDGIHAKDYIACARVHCESKSILTIDIANFFDNVHISHVLQIFRDLLKCSEIVSEVLADICCHNDALIQGALTSSYIAGLALYDVEGRVVERLARKGLRYTRLVDDINVSSKNSEYNFDYAKKIVEDMLFSKDLPVNTSKTKVQFSSTLPLAVHGLRVGFKEPRLPGEEVSRIRAAVHSIEMMAREPNYRTSHAYRRDFNRCMGRVNKLSRVGHKQHGGLVHRLHQIMPLPSQKDVQRAIKIVEKLEADFSLKRHTYWYAKRFYLAHERLNILKRSFPGITDMLRLRLKPIKARYE

SEQ ID NO: 3453 - protein, 398 aa, unidentified
  source 1..398: note = Related to WKJJ01000006.1; note = Massilia rivuli
MPTVPQLNPVKVSTESIITVENLCSALSITLEELNEVRSIPNGERYIASQIPKKDGTMRVVHNPHFRLRRIQRRINKRILSRQSVVSWPDHIFGSIPNQLDSERIEHEKDYVACARVHCEAKSILSIDIANFFDNIHITKISKIFCEFFKYSTEVSNILAEICCHNDNLIQGALTSSYLATLSLYEVEGKVVERLLKKNLRYTRLVDDITVSSRLAGYNFDYAKALIEEMLIDMDLPMNSSKTRIQYNSTVPLTVHGLRVAFKEPRLPGDEVRKIRAAVHSIELMASEPNYRTTHPYRRDFNRCMGRVNKLSRVGHQQHSVLVNRLRKVMPLPSPKDIERTIKIITRLERDYPTKRGTFWFSKRYYLAHERLNILKRSFPGISKELRKRLKPLRSKYE

SEQ ID NO: 3454 - protein, 396 aa, Chromobacterium sp.
  source 1..396: note = Related to NZ_CP029495.1; note = Chromobacterium phragmitis
MIILRPYKKIPSSIANIDNLCSALDISTTELDEAISLAETDRYQVREIAKKDGSPRRIYNPHYLIRKIQRRINHRIFTDQNFLGWPDYIFGTIPNQKKSDGRIVQRDYISCAKIHCKSKSIASIDIQDFFDNIHIDHVENIFSKFFKYPDEVSEVLANICCLNSHVIQGALTSSYIASLCLFDVEGDAVERLIRKNLRYTRLVDDITISSTVSNYNFDYALSIIRKMLESKDLPINENKTKIQYASTVPLTVHGLRVAFSEPRFPSDEVRRLRAAVKNIETLSQEKNYRTSHAYRHDFNRCMGRVNKLSRIGHKQHAALVKRLQKVMPLPSQKDIERAFMIIERLEKDYSTHNSSYWYSRRYYLAHERLNVLQRTYTRIASDLRSKLRYLRPSYEK

SEQ ID NO: 3455 - protein, 398 aa, unidentified
  source 1..398: note = Related to NZ_CAJNBE010000044.1; note = Paraburkholderia aspalathi
MEKQPQLNPVKTAVDSIASVANLCHTLNVTQEELDAALTLDPEEKYERRAIPKKDGSDRLVFSPDRRLRKIQRRINKRIFAAQSVVSWPDHLFGSIPNQNGPENIKIEKDYVACARRHCQSKSILKIDIKNFFDNISEFHVKDIFVNFFKYSDDVANVLANLCCLNGHVIQGALTSSYIAGLCLYDVEGDVVRRLARKGLVYTRLVDDITVSSKSADFDFGFAKSIIEQMLVGKDLPINESKTAVHYVSTTPLTVHGLRVGFKEPRLPSDEVRRIRSAVKNIETLAKEDSYRITHGYRHDFNRAMGRVNKLGRVKHKQHEPLVRRMRKVLPLPSKKDIERATRIIDRLQADHAGKHDTYWYWKRFYLAHERLNVLQRSFPEVSKKLRTKLRLLRSSYE

SEQ ID NO: 3456 - protein, 398 aa, unidentified
  source 1..398: note = Related to NZ_CP012746.1; note = Paraburkholderia caribensis
MAHIPLLNPLKTALGSISSIDSLCEALNITREDLEEALQLDPSEKYVRLTTPKKDGSDRVIFKPDYRLRKIQRRINKRIFSNQNVVTWPSHLFGSIPNQFDADKTKIEKDYVACARSHCESKSILKIDIKNFFDNIHQHYVEDIFLNFFKYPEDVSSTLAEICCHESHVVQGALTSSYIASLCLYDVEGETVRRLTRKGLTYTRLVDDITVSSKIADYNFDYTKNVIETMLVGKELPINSSKTITQYISTTALTVHGLRVGFKEPRLPSDEVRRIRSAVKNVETLAKEDSYRTSHGYRRDFNRVMGRVNKLSRVKHKQHASLVKRMRIVLPLPSKKDIDRTTRIVERLLTDYASRHDTYWYWRRFFLAHERLNVLQRSFPEVSKHLRKKLKLIKPTYE

SEQ ID NO: 3457 - protein, 396 aa, unidentified
  source 1..396: note = Related to NZ_LPNA01000081.1; note = Burkholderia stagnalis
MAAILNPIKVATGSISSIDNLCAALDITRAELDAALELDILTRYQRDETPKKDGSMRVVYKPDYRIRRIQRRINRRIFSRADVILWPDHLFGSIPNQESDDGDEIQKDYVACARLHCEAKSIVSIDIQNFFDNIHSDLVLDIFEKFLQYPSDVARTLTDICCRGDHIVQGALTSSYIASLCLYDIEGKTVERLSKKGLTYTRLVDDITVSSKIANYKFDYAMSVIEDMLTSKDLPINTSKTKIQYVSTTGLLVHGLRVSFQQPRLPSDEVRRIRAAVQNIETLAAEKGYRQTHAYRQDFNRCMGRVNKLSRVEHNQHANFLRRLQKILPLPSKKDINRATKIIENLERDFEKKSGTYWYAKRFYLAHERLNVLNRSFPAITKRLRARLKPLKQNYE

SEQ ID NO: 3458 - protein, 396 aa, Pseudomonas sp.
  source 1..396: note = Related to NZ_AUED01000023.1; note = Pseudomonas vranovensis
MALLNPRKVSTGSISSIENLCSALSVSLEEIYAALSLPDEEKYAVSQVFKSDGSVRLVHNPHFLLRKIQRRINKRIFSRLSIIEWPDHLFGSVPNQREQDTKRLINKDYVSCAAKHCGAKSLLKVDVKDFFDNIHKDLVLDIFSNFMKFDREVSELLAEICCFRSHVIQGALTSSYLASLCLHDIEGAVVHRLSRKGLVYTRLVDDITVSSKISNYDFSFALDIIRAMLTSKDLPLNIVKTRSIYVSSEPLTVHGLRVAFPQPRLPSGEIARIRAAVRNIENLASERGYRTTHAYRHDFNRCMGRVNKLVRVGHDRYDSLLARLKQIFPLPSKKDIERARAMLDRLARDCATKRSTYWYAKRYYKLQERLIILKRSFPAVTKEIRKSLKGLKPDYE

SEQ ID NO: 3459 - protein, 396 aa, unidentified
  source 1..396: note = Sphingobacteriales bacterium; note = Related to SEFL01000928.1
MVLLNPKKISAGSISSIENLCSALDITLEEIYGALSLSEEDKYAVTEISKSDGGIRLVHNPNYLLRKIQRRVNKRIFSRPSVIQWPDHLYGSVPNQRNRQNSEMLNKDYVSCAAKHCGAKSLLKIDVKDFFDNIHQNLVLDIFNNFMKFDGEVSGLLAEICCFKSHVIQGALTSSYLASLCLYDVEGSVVERLMRKGLIYTRLVDDITVSSKVSNYDFGYALDIIRTMLTSKDLPVNLAKTRAIYVSSEPLTVHGLRVGFSQPRLPSGEVARIRSAVRNIESLASERGYRTTHAYRHDFNRCMGRVNKLVRVGHDRYESLLKRLRKVFPLPSKKDIERAHAMLARLNRDYSDKRGTYWYAKRYYKLQERLIVLKRSFPAVTKEIRKAIKGLQPDYE

SEQ ID NO: 3460 - protein, 397 aa, Pseudomonas sp.
  source 1..397: note = Related to NZ_BPLZ01000021.1
MATQLAPKKVSKRSIASIENLCSALDISLSEIYSALSLSDEEKYKVSTRAKSDGTDRIVHNPHFLLRKIQRRINKRIFSKPSVIKWPDHLFGSVPNQLDQSMTHIINKDYVSCAAKHCGAKSILKVDIKDFFDNIHEDLVLDIFRNFLKFDQEVSETLTNICCFHSRPVQGALTSSYLASLCLYDVEGSVVEKLSRKGLTYTRLVDDITVSSKSNNYDFSYALDIIKGMLTAKELPLNVAKTKSIYISSEPLSVHGLRVSFPQPRLPSGEVSRIRAAVKNIESLASERGYRTTHAYRHDFNRCMGRVNKLVRVGHNRHQPLLDRLRKVFPLPSKKDIDRARAMLKRLMRDKDSKRDTYWYAKRYYKLQERLIVLERSFPASAKEIRASLKGLKPSYD

SEQ ID NO: 3461 - protein, 395 aa, Pseudomonas sp.
  source 1..395: note = Related to NKIG01000020.1
MAAVNPKKVTSESIANIDRLCAALDITAEELCQVQNLHEDAKYQASTVEKSDGSFRKIYNPDFRLRKIQRRINKRIFSNSKVIAWPDHLYGSVPNQINDDFDLINKDYVSCAAKHCGAKSILKLDIKDFFDNIHKIIVHDIFLNFLKYPQDVSSALASICCLNDHVVQGALTSSYLASLSLYDVEGYVVEKLHRKNLVYTRLVDDITVSSKTSNYDFSYAINLIEGMLTEKELPLNKKKTKVQYTSSEPLTVHGLRVAFKQPRLPSDEVARIRTAVKNIETLAKEVGYRTTLSYRQDFNRCMGRVNKLSRVNHEKHLGLVKRLVKVYPLPSKKDISRAEAIVARLEKDYASKHSTYWYSKRFHTAHERLNILKRSFPCAEKALRKRLKSLRPIYD

SEQ ID NO: 3462 - protein, 399 aa, Pseudomonas sp.
  source 1..399: note = Related to JACASD010000120.1
MTRNVTARSFKISTRSISNLENLSSTLSIPLKTLQKTLVLPKPDRYRRDELPKSDGGIRIIYNPSQMIRLVQRRINSRILSNNQILAWPPFLFGSIPKSKDALGNEITRDYITCAAQHCGAKSLLKLDVKDFFDNVHADLVYGVFSQLLKFPHLVSASLTNICTFESHLIQGALTSSFLANLCLHDVEAFVVDRLAKKNLTYTRFVDDITISSKTSKYDFSYALSIVEEMLTSKDLPLNRQKTKVYFSSSTPLTVHGLRICFAEPRLPSDEVRRIRASVKNLETIANERSYRMTHAYRHDYNRCMGKVNKLARLKHNQHIPLLDRLRKIPPLPSKKDISRAIQIVSRLERDFFLKKNTYWYYRRFYIAYERLNVLKISYPRMTKLLKIRLKKLKPIYEK

SEQ ID NO: 3463 - protein, 398 aa, Pseudomonas sp.
  source 1..398: note = Related to LS483433.1; note = Pseudomonas mucidolens
MTRTVAARSFKVSNSSIADLQNLATALSVPLLTLQKTLTLPKSERYRRDELPKSDGGLRIIYNPSHEIRLVQRRVNTRIFSNSHILAWPPFLFGSIPKSRDALGNEVTRDYITCAAQHCGAKSILKLDVKDFFDNVHSDLVYGVFNKLLKFPHLVAASLTNICTLDSHLIQGALTSSFLANLCLHDVEAFVVDRLAKKNLVYTRFVDDITISSKVAKYDFSYAQAIIEEMLISKDLPLNSQKTKVSHASSTPLTVHGLRVSFSKPRLPSDEVGRIRAAVRNIEKIADERSYRMTHAYRHDFNRCMGRVNKLARVEHNQHRPLLKRLLKLPPLPSKKDISRAIQIVSRLERDFYLKKNTYWYSRRFYIAYERLNVLKISYPRMTKLLKLRLKKLKPVYE

SEQ ID NO: 3464 - protein, 398 aa, Pseudomonas sp.
  source 1..398: note = Related to NZ_BCBR01000170.1
MAGIAEVQRYKASVHSISSIENLASALGVSLSFLQEVLQIPDEHRYKKSELPKSDGGIRTVYSPDYRIRLIQRRINKRIFSNSRVITWPDFLFGSIPNHKDKCGQEVTKDHIACAASHCGAKSLLKLDVKNFFDNVHSDIVYGVFRDLLKYPDEVSRALTNICTFKSHLVQGALTSSYLASLCLHDVEAYVVDRLSRKGIVYTRFVDDITLSSKISSFDFGFARGVVEQMLTAKDLPLNSGKSRTQYLSSEPLMVHGLRICFNEPRLPADEVRRIRASVKNIEVIANERGYRLTHAYRHDFNRCMGKVNKLARLGHTQHTALVARLVKVYPLPSKRDISRAIQIIMRLERDVSAKASTYWYAKRFYMAHERLNILKRSYPRITLLLRNRLRKLRPNYE

SEQ ID NO: 3465 - protein, 399 aa, Pseudomonas sp.
  source 1..399: note = Related to NZ_RXHX01000002.1
MAMDASAAGGFKVSKNSIGSVDNLIQILAVSLKDFESVLMMPSELRYIKTEIPKSDGGVRRIHNPHFLIRLLQRRINTRILSNPRVIGWPSHLFGSIPNQRDEKNNIDSRDYIACAKAHCGAKSLLKLDVKDFFDNVSEDLVYGVFHDLLKYSEDVSSVLTDICTYNSHLVQGALTSSYLASLCLHDVEAHVVDRLRKKNLVYTRFVDDITISSRTSNYDFAFARSVVEQMLISKDLPLNSGKSRVFYTSSEPLTVHGLRVSFSEPRLPSDEVRRIRAAVRNVETISSERAYRLTHAYRHDFNRCMGRVNKLARVGHNQHKPLKNRLLAVYPLPSKRDISRSIQIVSRLERDVAEKRATYWYSRRFYIAHERLNILKRTYPRMTKILRARLKKLTPTYF

SEQ ID NO: 3466 - protein, 398 aa, unidentified
  source 1..398: note = Related to nan
MIKDKAHRIFKASTSSISSLESLASALDLQVDDFERVWAKEESSRYTRKEIPKSGGGVRVVFNPCVEVRKIQRRVNTRIFSNPHVVKWPGYLYGSIPKSLNSEDELASRDYISCAKQHCEAKSLLKMDIKNFFDNVHDDLVYGVFKDVLKYPEVVSNVLTRICTYRSSLVQGALTSSYLAMLSLYKEENDVVSKLKRKGLVYTRFVDDISISSKVSGYDFSYARSLVEKMLLNAGLPLNSNKTKVLYATATPLTLHGLRICFKDPRLPPEEVRRIRAAVKEIEIVAGESNYRNTYAYRRNFNRCLGRVNKLSRVKHKQHSNLVRRLSKVLPLPSQKEVNYVQHALVKLEGLFQSRGDTYWYRKHFYQLGDRLNLVARSYPRLAEEIRRRLREVKPTYE

SEQ ID NO: 3467 - protein, 398 aa, Pseudomonas sp.
  source 1..398: note = Related to NZ_JAGQFP010000002.1; note = Pseudomonas stutzeri
MRRSSAHRAFKVASGSISNVENLAAALGLTTLHFEKLWEIPEELRYSSKTIPKLSGELREVHNPCRELRIIQRRINTRIFSNPDVVKWPSYLYGSIPKGDNPEDEFNSRDYVACAKLHCRAKSILKLDIKDFFSNVHDDLVMGVFSEVLKYPDVVSQVLTRVCTYKSSLVQGALTSSYLAMLSLYGAEDDLVHRLRKKNLIYTRFVDDITISSKVANYDFSYAARLVEQMLVEKGLPLNTKKTITQYASLAPLTVHGLRVCFAEPRLPADEVRRIRAAVQSIEIVAKEKNYRQTYPYRKDFNRCMGRVNKLARVGHNQHSKFISRLHKILPLPSAREVEYVKAATLKLESLYATKRESFWYKKLYYRVGDRLNLVGRSFPNLAKSLRERLREVKPAYE

SEQ ID NO: 3468 - protein, 398 aa, Pseudomonas sp.
  source 1..398: note = Related to JAAMQS010000014.1; note = Pseudomonas kunmingensis
MKKDFAHRAFKASSGSIASVENLASALSLEVSDFERLWEIPEEKRYKLKELPKSSGGFRTVYNPCVALRVIQRRINTRIFSNPYIFQWPVHLYGSIPKSPNADDEYRSRDYVACAKQHCGARSLLKLDIKDFFDNIHEDVVLSIFRKVLKYPEDVSLVLTRICTHNSKVVQGALTSSYIAMLSLHQEEQGVVDRLRRKGLVYTRFVDDITVSSKCTNYDFSYAQSIIEQMLNNADLPVNTKKTEVQYATAAPLMVHGLRISFNEPRLPSNEVKKIRAAVQGLEIVAKENNYRQTYPYRKDFNRCMGRVNKLGRVKHNQHQKLVRRLVKILPLPSAKEVAYVKTAVERLEATYETKKSSFWYKKHYYRVNDRLNLVKRSYKTLAVTLRKRLQCIPPLYE

SEQ ID NO: 3469 - protein, 398 aa, Pseudomonas sp.
  source 1..398: note = Related to NZ_LR134290.1; note = Pseudomonas mendocina
MKRTLAHREFKAASGSISSISNLAKALNLQVSDFERLWEIPEESRYKSLEKPKTSGGMRVVYNPCPQLRLIQRRINTRIFSNPYVIRWPSYLYGSIPSSPNKSDINHSRDYVACARLHCEAKSILKLDIQNFFDNIHEKLVIEIFSDILRYPEDVSEILARICTYKSRLVQGALTSSYLAMLSLYKEEPEIVAKLKRKDLVYTRFVDDITVSSKIANYDFSYAQKIIEDMLSNAEFPVNSKKTQTQYASASPLTVHGLRVCYKEPRLPSREISNIRAAIRSLEIASKHGNYRQTYAYRKDHNRCLGRANKLARVKHPQHSKFVARLSRILPLPSQKEVNYVKSSVEILERDYLHKKDSFRYKRHYYRTNDRLNVVQRSYPSLVRDLRKRLRPIKPTYE

SEQ ID NO: 3470 - protein, 387 aa, Pseudomonas sp.
  source 1..387: note = Related to CP080287.1; note = Pseudomonas aeruginosa
MTTRHTFKVATGSIATLDNLSLALGVSHCELENALSMPQDERYTRLERHKADGSVRSVYKPHYLIRLLQRRINHRILANPDVIAWPSYLFGSIPSFKNEDGEWVAKDYVASARLHCGAKSLLKMDIKDFFDNIHSSVVEDIFLGLLNYPGEVAKALTNICTYNSHLAQGALTSSYIANMCLHGLEDEVFTKLSRKNLRYSRFVDDITVSSVVNRYDFSYVKSIIEGMLLERGLPVNSRKTKVQYSTTEALTVHGLRVCFPEPRLPSDEVRRIRAAVKNVEMLAQENGYRMTHAYRRDFNKCMGRVNKLSRVSHKQHGNLVRRLVKVYPLPSKKDISRARSMVARLERDYLEKRDTYWYSRRFYIAHERLNILKRSYKASAIELRGAS

SEQ ID NO: 3471 - protein, 396 aa, unidentified
  source 1..396: note = Related to NZ_CP033831.1; note = Serratia sp.
MKKNNYLKISKSSISSVENLCLALDLTLDDFLNLKMMSGCDRYVLNEKPKPGGGIRKTYNPNNLVRVFQRRINNRIFSNPHIIKWPDHIYGSIPNDMNSDGGIRRRDFVACASVHCGAKSILKVDVKDFFDNISKDIVYDIFNGFLKFNSEVSEALTDICTYDRSHLVQGALTSSYLATLALFNIEGRIVQRLALKKLKYTRFVDDITISSVNSRYDFDFAKSIVINMLHEKDLPVNLSKTKVYYSGSEPLTVHGLRVSFNQVRLPSDEVRKIRAAVKNIEIIANDTSYRKTGSYRKDFNKCMGRVNKLSRVGHKQHESLVARLNKVYPLPSFTDIKKTKDLIEKIRSKYDDGKNYFYYHKMYYAAMEKLNLVKRSFPNTAKNLRLRLRGLRPEYD

SEQ ID NO: 3472 - protein, 407 aa, Citrobacter sp.
  source 1..407: note = Related to CP055089.1; note = Citrobacter portucalensis
MSLPIRHTKKKTVSSINSISSLCSTLSITRAELETALSTPDKERYTPSEVEKSDGTIRNIYNPKSLIRKIQRRINRRIFNIYTPKGREKKNPPIIWASYLFGSIPNQFLDEDIEQKDYIACARVHCQSKSLLKVDIKNFFDNVQAIHVESIFSKFFFFSDDVSQALTNICCYEGHLVQGALTSSYLSCLCLHDVEWKIVDRLSRKNLRYTRLVDDITVSSTVSNYDFSYAKDIIINMLHEKDLPVNFKKTQQYYTSTTPLTVHGLRVSFSEPRLPSDEAKRIRASVRNIESLAAERNYRTTHAYRKDFNRCMGRVNKLKRVNHSQYESLVNRLFKLFPLPSKKDLDRVFISIANLEDDFHKGKHDTYWYWKRYHRVHERINILQRTFVREATIFRNKTKNIKPSYIQ

SEQ ID NO: 3473 - protein, 407 aa, unidentified
  source 1..407: note = Related to JTBU02000001.1; note = Serratia marcescens
MSFQIRHTKKNTVSAINSIQGLCNALDISLHDFNIALSTPDSERYTPSEIEKSDGSFRKIYNPKSFLRKIQRRINRRIFNLYTKKGREIKNPPITWASYLFGSIPNQFLDENIEQKDYIACARVHCQSKSLLKVDIKNFFDNVQDVHIEDVFRNFFLFDEEVSRALTNICCFEGHLVQGALTSSYLSCLCLYDIEGKIVDRLARKNLRYTRLVDDITVSSVVSNYDFSYAKDIIINMLHEKDLPVNSKKTQCYYTSTSPLTVHGLRVSFSEPRLPSDEAKRIRASVRNIESLSSETNYRTTHAYRKDFNRCMGRVNKLKRVNHSQYESLFNRLFILLPLPSKKDIERVSVSLLRLENDYKLGKHDTYWYWKRYHRIHERLNILQRTFTREASVFRIRLRLVKTTYIQ

SEQ ID NO: 3474 - protein, 407 aa, unidentified
  source 1..407: note = Related to MUJJ01000002.1; note = Pantoea vagans
MSYHIRHTSKRNITAINSIEALCKALSISKEELENALATPDHFRYTPSTAIKSDGSPRKVYNPKPMIRMIQRRINRRIFNSYNNKGREKKNPPIIWASYIFGSIPNQYYDLDLENKDYISCAAIHCGAKSLLKVDVKNFFDNIHDIYVKNVFENFFHFSNEVSEALTNICCYQGHLVQGALTSSYLACLCLYDVEGDIVQRLARKNLKYTRLIDDITISSEISNYDFSYAKSIVIDMLHKKDLPINNEKTKASYISSEPLMVHGLRVAFKEPRLPSDEVRRIRASVRNIECLASETNYRTTHPYRKDFNRCIGRVNKLKRVNHTQYDNLVARLLRILPLPSKKDIERISEQIDRLENEYSNNLHGSYWYWRRLNKVHERITILNRTFKSEAKTYRDRLKKINHCYIQ

SEQ ID NO: 3475 - protein, 393 aa, unidentified
  source 1..393: note = Related to NZ_CP091194.1; note = Lysobacter gummosus
MAVLKRVAKKSISSLTNLCDALSITIHELNGALALSDDQKYLRSTTPKPDGSLRIVHNPHRLLRKVQRRLNSRIFSNSAVVTWPDYVYGSIPNQIDVGGAIVEKDYIACARVHCGAKSMLKMDIKDFFNNVHEEAVRDIFLRFFKYSKEVSDALTSICTFEGGLVQGALTSSYIANLCLFDVEDSAVERLRRKKLRYTRLVDDITVTSTIANYDFSFAKDVITTTLVDKDLPVNERKTRVLYISSEPLTVHGLRVNYKEPRLPAKEVARIRSAVRNVELLASEGSYRTSHSYRHDFNRCMGRVNKLKRIGHRQHMVLIKRLLKILPLPAKRDIERAEKLLIRIKKDWLSNPDSYGYAKRFYILHERLNVLARSFPAVSAVMRKEMRGLRPVYD

SEQ ID NO: 3476 - protein, 400 aa, unidentified
  source 1..400: note = Related to NZ_VLXO01000050.1; note = Stenotrophomonas maltophilia
MARDSMSFRGTSGPIASVEKLASALRLPESLLLEVSERPIWRNYKPASAPNRRGGRPRLVFSPSRDVRLIQNRIVRTFFKNPKVINWLPFIYGGIHKDALKSGDSRDHVACARRHCGAKSILKLDIEDFFGNVSFDLVEDVFVGLLGWSKDAGSLAAKLCTRDGVLPQGGITSSYLALLCLHDIEPKLVRQLSYKKLTYTRYVDDITISSGSFTQEFSGPMRMVEQQLASKGLGINSAKVESLTVGLEAMSVHGLNVAYRDPVLPKSEVKRIRSVCRQTILDAREVGRRSINYRRRYNRAMGLVNKLSRVNSSSHKKLVQSLRLVSPLPSQADFEYATKIAYDMRDDYDKKKLGYWYWRRFNRLMARLTLIGVDNPGWAGNLRKYMKSHFLPGFKDDKDK

SEQ ID NO: 3477 - protein, 397 aa, unidentified
  source 1..397: note = Related to WELC01000020.1; note = Stenotrophomonas rhizophila
MGKDSMSFRGTSGPIASVEKLADSLRLPISLLKDVAARPEWKKYKPAKAPDKRGGRPRLVFSPSKDVRLIQHRLVRTFFKNPKVVNWLPFLYGGIHKDALAAGDSRDHVACARRHCEAKSILKLDIEDFFGNVSFDHVEGIFVRLLGWSREAGHLAALLCTRDGVLPQGGITSSYLALLCLYDMEPALVRQLAYKKLVYTRYVDDITISSSSFNQDFNGIKRLVEQQLGAKGFTINSSKVEDLTVGLEALKVHGLNVAYANPVLPKSEVRRIRSVCKQTIMDAREVGRRSINYRRRYNRAMGLVNKLARVKSSSHAALVSKLRAVSPLPSHADFSYATEISYNMREGYDKKKYSFWYRRRFNRLMARLSLIKSDNPVWAANLRNYMTSHFLPEYKEE

SEQ ID NO: 3478 - protein, 393 aa, unidentified
  source 1..393: note = Related to NZ_CP052863.1; note = Stenotrophomonas maltophilia
MTLRGSAGPIRSNCALARALGCTEKFLSDVIARDTSSKYRLVEAPAKLDGTRREVYSPSRDVRLIQRRIVNRFFKNPRVIKWPPFIYGGIHRDALAPGESRDHVACAQKHCGARSMVKLDIRSFFDNVTHDMVVETMVMQLGWSRGPAILLADLCTRDGSLPQGGITSSYLALLSIYDVESKIFNIVGYKKLVYTRYVDDITISSRNSGYDFSPIVKMVDQFLLSKGLSINDAKTSVSVSGLEPLVVHGLNVANKHPVLPKAEVKRIKSVSRQTINDASEEGRRTHGFRRRYYRSMGLINKLSRVRSSSHKSSLSKLKSVSPLPNFADYDIATVVAYRLRDLYGAKKGGRWYWRKFNVLMARLDLIAVENPGWAKTLRRYMRRHYRPDYRRPE

SEQ ID NO: 3479 - protein, 367 aa, unidentified
  source 1..367: note = Related to NZ_JABDRS010000003.1; note = Stenotrophomonas maltophilia
MRDVASRASTTNYRSVDAPIKSDGLPRRVYNPARDVRLVQSRIANRFFKNPAVIKWPAHIFGGIHKKALPAGDSRDHVACAAKHCGAHSLLKLDIRNFFDNVTHEIIVETMTRQLAWSRSPAVLLADLCTREGVLPQGGITSSYLALISIYDIESKLVRNLEYKGLAYTRYVDDITISSKVASFDYAPIVRMVDNLLLSKGLSINEAKTSARISGLEPLVVHGLNVANRSPVLPKAEVARIKRVGRQTILDAQEEGRRSHGFRRRYYRSMGLINKLSRVGSASHASSLEKLKAVSPLPSFDDYKISTNVAHKLRADYDIKKSGVWYWRKFNVLMARLDLIGAENPRWAKTLRRYMRQHYRPEFKRPK

SEQ ID NO: 3480 - protein, 369 aa, unidentified
  source 1..369: note = Related to NZ_CP063658.1; note = Lysobacter sp.
MNLLLDVAERSAEENYRPVSAHSKLDGTERRVFSPSRDVRLIQRRLVNRFFRKPQVVSWPPFLFGGIPNDALPQRDAPRDYVACAAQHSIARSALKLDVRSFFDNVHSDVVEPIFSGLLRWDEEPAVLATRVCTRLDSLPQGGITSSYLALLCLFREEGNVARTLRRKGLTYTRYVDDITISSTSVLQEFDFAHALVERMLMNHGLFINSSKVNLQKAGSSPLEVHNLRVGCGPPRLPQREVKRIKQVCRQTELDASEGRRSYSYRRRYFRAVGLVNKLARVGNNQHRHLITRLSTIRPLPSQKDYELATNVAHDLRERYVLGHDRYWYRRRFHILMERLNLIGVEDPAWAANLRIYMKAHYAPTSVDA

SEQ ID NO: 3481 - protein, 400 aa, unidentified
  source 1..400: note = Related to NZ_LR733312.1; note = Luteimonas sp.
MKSKPYSSMRGSNGPIRNLDHLCTILDVERRVLDRVLAMPGSQRYALARSRAAKSDGSAREVFNPCREVRRIQLKIVKRILKVPGAVRWHDFLYGSMPNQIDAHGNELKKDYVTCAAQHCDARSVLKIDIKDFFGNIHSDTIMRIWTELFGYPGDVAFVLTNLCLKDDNLPQGGITSSYLAMLCLFDLEAKTVATLRLKGLRYTRYVDDITISSPLSNYDFELALALVRAMLISRALPINESKVKRVSLSTEAITVHGLRVNFETPRLPAAEVGRIRASVKTIELLAADTSFSSTPGFRKSFNKCMGRVNKLKRVGHSQHSKLLKRLQAVRPLPSRRDIKKAVASIRTLSAEFHSRGNTFGYRKRYYILMERLNLIARSHKELAAMLRAHVKRIKPSYVD

SEQ ID NO: 3482 - protein, 373 aa, unidentified
  source 1..373: note = Related to JAFRGP010000385.1; note = Rudaea sp.
MAITQDELFQALRLTDDVRFQPIPEKRKPDGTIREIYNPHPLIRKIQRRLVTRLLSGSAAFQWPDHLYGSIPNVSSPDGEVQSKDYVACARRHCGAKSLLKLDIKNFFGNVHHDTVYRIFRELLGYGSRVSKVLACLCTHKGSLPQGGLTSSYLAMLSLHDLEGYVVERLRLKSLVYTRYVDDITISSKVLNYDFGYALKIVDNMLVERGLPLNLKKNRIERISTSPLIVHGLRIAFDKPRLPADEVGRIRASVRYTELIYLEANFRFTSSYRKAFNRCLGRVNKLKRVGHSQHGVLLRRLLRVRPLASKKDLIRAHVTASRLANEYGRYKETYGYHRRFYLLQERLNLIQRTYPKIAKSLRLKLNIIRPEFN

SEQ ID NO: 3483 - protein, 372 aa, unidentified
  source 1..372: note = Related to NZ_MDDY01000002.1; note = Xanthomonas arboricola
MDVPISDFRAALLLSEEERFRLLPDKKKADGTDRIVYNPDPLIRKIQRRFLTRILSRPSAVKWPEFLFGSIPNHSFNGIDVSRDYVACAARHCGSKSLLKLDIKSFFENVHSDLVLEIFRGVFSYGDLVSRVLTRICTHKGGLPQGGIVSSYLAMLCLHDVEARVVERLRQKRLTYTRYVDDITVSSKSSNQDFDFSKRIIEEMLLSKNLPLNYKKVLVSRVSTTALTVHGLRVGFKEPRLPADEVKRIRASVKYLEILYVDGDYKYTSSYRKNFNKCMGRVNKLKRVGHSQHGQLKSRIIRLMPKASRSDLARVFKISKRLQSDYLEKKDTFGFYKRFHILAERLNLVARTHPGIARLIRRRLREIKPTFE

SEQ ID NO: 3484 - protein, 351 aa, unidentified
  source 1..351: note = Related to NC_013889.1; note = Thioalkalivibrio sp.
MRQPKLNGSDRIVNNPHYLIRKIQRRLNKRFFANPDFIRWPRHIFGCIPNYVDDDGELVTTDYVSCASKHCQSKSILKMDISDFFGNVHQDHVYKVFLNLLSFPEDVSKILTDLCTLRGSLPQGGLTSSYLASLCLHDKEGSVVRRLENKGLVYTRLVDDITVSSHVANYNFSYAKKIITDMLIEKDLPINEDKTIVQRLSTEPLTVHGLRVGFKEPRLPAGEVKRIRASVQSMEQLAREPNYRVSHAYRRDYNRCMGRVNKLSRVGHKQHSILVRRLKSIRPLPSRADLDRLEVMVSRLEKDHAEKRATFWYWKRYHRAHERLNVLQLIYIAKAKKFRERLKKVKPLYDS

SEQ ID NO: 3485 - protein, 399 aa, unidentified
  source 1..399: note = Related to JAGPVE010000007.1; note = Marinobacter sp.
MDDFLFHKVSTASISNVKNLCTALDITETDLEKALSLEPSARYEEVQVNKSDGSLRTAFKPHYLIRRIQRRINKRIFAPQKNEPNTIQWPNYIFGSIPNQIIDGEEIQKDYISCARRHCKAKSLLKIDIKSFFDNIHSDLVYDVFNEFFKYPKSVCEVLTDICCHENRVPQGGLTSSYLASLVLHDIEPTVVKRLLRKGLHYTRLVDDITVSSKIHDYDFSFAKKIITDMLYEKDFPINEQKTRIEREASTPLCVHGLRICFNEPRLASHEVKNIRAAVKNIEIVAMERHYRTTHPYRKDYNRCLGRVNKLARVGHNQHAKLVSRLKKVEPLPSERDIKRCTTMVTNLEMDHSTKGSRYWYWRRYHKAHQRLNILQRTFVHTANDLRARLKVIRPSYES

SEQ ID NO: 3486 - protein, 397 aa, Pseudomonas sp.
  source 1..397: note = Related to CP071730.1; note = Pseudomonas aeruginosa
MGQFQPTKNPKGSIATIDALCAALSISIDELNQALAMPIDERYTLPKKELFKSDGSPRVAYKPHHLIRKIQRRINKRILGQEGYIDWPNHIFGSVPNKKVPDGEDIVKDYINCARQHCLAKSMLKMDVKDFFDNIHVDLVFSIFNSFLSFSDVVSNTLANICCRGEFVVQGGLTSSYLACLCLFDVEADVVVRLKNKGLIYTRLIDDITVSSKRSGYDFSFARQIIEDMLFSRNLPVNSKKTAIHYHFSAPLMVHGLRVSFNEPRLPASEVKKIRAAVKDIEVLAKDHLYRITHAYRHDFNRVMGRVNKLSRIGHTQHENLKNRLLKCYPLPSFKDITRARLAVERVERDYEEKCATYWYKKRFYRAHERLNLLKRSFPDTASELRDRLRDLRPEYD

SEQ ID NO: 3487 - protein, 399 aa, unidentified
  source 1..399: note = Related to NZ_PZJP01000003.1; note = Salinicola aestuarinus
MSTNNNLYFQKNASNSIGSISNLANALNLTVNEIVRAVNLPNEVKYTANPQQKADGSQRMAYNPHRYLRKVQRRINKRIFADPSVVSWPDYIFGSVPNTTLSLSEVIKKDYVSCAARHCLAKSLLRLDIKDFFPNIGEHLVRAVFEDFYHFPPDVSEILVSLCTKDGGVPQGALTSGYLACLCLFDVEPEVVRRIEMKGLTYTRYVDDIVVSSKVHDHNFSLQEKLISSMLEDKDLPVNDTKTLIQRSSTAPLIVHGLRVSFKEPRLPSDEVRRIRSAVRNLEKQASEPNFRTTRVFRSAHNRCVGKVNKLKRVGHKQHSEYLRRLNLIKPLARRSDVERVVSMIRRLENDHGSISDTYAYHKRYFRAHERLNIIQRNYENIAFKLRQRLKSIPSNYVK

SEQ ID NO: 3488 - protein, 395 aa, unidentified
  source 1..395: note = Related to CP059843.1; note = Cobetia sp.
MIIMNNYKIKGSVIASPQNLAKALNLTLEEINAANALSTEKRYKEKNLPKADGNFRKIYKPNHRIRTIQRRLNKRIFSSSNVIEWPSYLYGSIPNTIGDDEIEMKKDYVTCASIHCQAKSVLKIDVKDFFDNIHSDLIFNIFIKLFKYPQEVAELLTDLCTYKNKLPQGGLTSSYLACLSLFDVEPDVVKRLENKDVKYTRFVDDITISSQHPNYDFSFAKKLVFDMLHSKDLPINEAKTTVQRLSSAPILVHGLRISFKEPRLPPEEARQIRAAVRNIEKLSKHPDYRTSNAYKKDYNKCIGRVNKLARVKHIQHKKLISRLRKVKPLPNRQAVIRARSMIRQLEHIYPTHLHDYWYKKKYFQAHERLNIIQRSFPNIAKTLRFKLKTIRPQYE

SEQ ID NO: 3489 - protein, 411 aa, Pseudomonas sp.
  source 1..411: note = Related to JABEMH010000004.1; note = Pseudomonas fragi
MSWVGRATFISNGLVILLTNPIKHSKNSISNRENLCKALRVSDDFLGSVLALSQSERYTKKDHVKKAGGGSRPIYNPHRFLRKIQNRINIAFFSNYYVIRWPHFIYGSVPNQKNGDGYDSKDYVSCAGRHCGAKSLLKVDVSSFFDNIHQDVVFAIFNDFLKYDAEVSSILTDLCCHHSHLVQGGLTSSYIASLCLYDVEGAVVDRLNRKGLTYTRLVDDITVSSKSLNTDFTYALKIISDMLTGKDLPINESKTRVFRTSTEPLTVHGLRVSFDTPRLPADEVGRIRAAVRNVESLAAQPGYRISHDYRHDYNRCMGRVNKLLRVKHTQHKVLLRRLNAVKPLPSRRDVNRAKDMVARLEMDFDSKKHTHWYKSRYHRVMERLIVLNRIYDKTSVQLRSKLRRLRPVVEN

SEQ ID NO: 3490 - protein, 397 aa, Pseudomonas sp.
  source 1..397: note = Related to NZ_UUEU01000227.1; note = Pseudomonas viridiflava
MLLNPIKVSKNSVSSRENLCKLLRVSDEFLTSVLALSQEERYTKKDHVKKAGGLSRPIFNPHRFLRRIQKRINIAIFSNNYVIRWPHYIYGSIPNQKNGDGYDSKDYVSCAGRHCQAKSLLKIDVSSFFDNIHADIVFSIFNDFLKYDREVSVILTDLCCHNSHLVQGGLTSSYIASLCLYDVEGDIVERLNRKGFTYTRLVDDITISSKSLGTDFTYPLKIVGDMLVAKDLPINEGKTRIYRTSTEPLTVHGLRVSFDSPRLPADEVGRIRAAVRNIESLAAEPGYRTTHNYRHDYNRCMGRVNKLHRVGHNQHGPLLDRLDAVRPLPSRRDVNRAKDMVARLEKDHKGKGHTHWYKARYYRLMERLVVLDRVYDKTCYQIRLKLKTLRPEREVEK

SEQ ID NO: 3491 - protein, 401 aa, Pseudomonas sp.
  source 1..401: note = Related to NZ_CP027762.1
MLANPLKISKNSVSSRENLCKLLRVTDEFLASVMTLSQEDRYTKKEHVKKAGGISRPIYNPHRFLRKLQKRINIAIFSNHYVIRWPHFIYGSVPNQKNNDAYDSKDYVSCAGRHCGAKSLLKVDVSSFFDNIHQDIVFSIFSNFLKYDEEVSRILTNLCCHNSHLVQGGLTSSYIASLCLYDVEGDVVERLNRKGFIYTRLVDDITVSSKSLNTDFTYALKIISDMLTAKDLPINESKTRVFRTSTEPLTVHGLRVSFNTPRLPADEVGRIRAAVRNLESLADQPGYRTTHGYRHDYNRCMGRVNKLLRVGHNQHKPLLARLNSIKPLPSRRDVNRAKDMVARLEKDFDAKRHTHWYKSRFHRVMERLIVLNRVYDITSKQLRSKLKRLRPESEDIIDKHV

SEQ ID NO: 3492 - protein, 394 aa, Pseudomonas sp.
  source 1..394: note = Related to JAGYWD010000006.1
MLTNPLKFTKNSISSRENLCKALRIPDDFLATVLALPPDDRYTKKDHVKKAGGISRPIYNPHRFLRRIQKKINIAIFSNNYVIRWPHFIYGSVPNQTNNDGYDRKDYVSCAGRHCGAKSLLKVDVSSFFDNIHQDIVFSIFKDFLNYEKEVSEILTNLCCHNSHLVQGGLTSSYIASLCLWDIEGKVVERLNRKGLTYTRLVDDITVSSKSLETDFTYALKIISDMLTTKDLPINESKTRIYRTSTEPLTVHGLRVSFSTPRLPSDEVGRIRASVRNLESLAAEPSYRTSHGYRHDYNRCMGRVNKLHRVEHNQHKPLLMRLRAIRPLPSRRDVNRAKDMVARLEKDYDTQSHTHWYKSRFHRVTERLIVLDRIYTKTSTLLRSKLKKLRPVGE

SEQ ID NO: 3493 - protein, 402 aa, Pseudomonas sp.
  source 1..402: note = Related to PCQD01000007.1
MVRLFPQKVSTASIANVDSLCQALSIPRSVLDQVLALGLDERYKEVMHIKKADGTNRPIYNPHHLLRRIQKKINERIFSDTKIIKWPGFLYGSIPNQTGSSGQDVSKDYVACAAVHCGAKSLLKIDVESFFDNIQRDIVLNIFSKFLKYPEDVADVLTNICCYKGRLVQGALTSSYIASLCLWDVEGNVVRRLNLKGLRYTRLVDDITVSSVGLATDFSYAKKLVEDMLSDRDLPIKASKTKVYRMSSEPLTVHSLRVNFSSPRLPADEVGRIRAAVKHVERLASEPNYITTHSYRKVYNRCVGRVNKLSRVGHNQHKILLARLNKIKPLPSFSDIRRAKAMLARLKSDFGSKGHTHWYRSRYYRLDQRLRILSRRYERTSDQIREEIRGIKPFKKHSSETH

SEQ ID NO: 3494 - protein, 364 aa, Pseudomonas sp.
  source 1..364: note = Related to NZ_RWLL01000003.1; note = Pseudomonas aeruginosa
MLSLPDNILYTEKEIPKAGGKVRVVYNPHRLLRRVQRKINTQIFSSSNIIEWPTYLYGSIPNQEYEAELKHLNNKDYVSCAARHCGGRSVLKLDVESFFDNVHEDVVRSIFADFLKCSPEVSDVLTSLCCKGEHIVQGALTSSYLASLCLYDVEGTVAERLRRKGFVYTRLVDDITVSSKKLGVDFSYAKSLIVDMLKEKDLPVNEGKTKVYRASTAPLTVHGLRIGFSTPRLPSDEVRRIRAAVRNVELLAKENNYRTSHAYRHDFNRCMGRVNKLERVKHNQHQSLVRRLKDIKPLPSIRDIGRAKKMLERLRKDYKLRSHTYWYRARYFKVLERLNVLQRTYEHVAFDFRVELKGLKPTQN

SEQ ID NO: 3495 - protein, 400 aa, unidentified
  source 1..400: note = Related to nan
MNLVGNNLDIPRKISTGAIASLNSLYNTLGCTESEITSVLNIPPDQLYTEIRISKAGGKQRVVYNPHRLLRRLQKKINEQIFSNSDVISWPCYLYGSIPNQNYEDGLEIYSRKDYVSCAARHCGARSLLKLDVENFFDNIHYDVVYAVFSDFLKCSSDVSDILSRLCCKGEHLVQGALTSSYLASLCLYDLEGAVAERLRRKGFVYTRLVDDVTVSSKKLNVDFTFARNTVVSMLEGKDLPVNESKTKVHRVSTVPLSVHGLRIGFSTPRLPADEVRRIRAAVRNIESLATESNYRTTHAYRHEFNRCMGRVNKLLRVEHSQHPSLASRLERIRPLPSFRDIARAKGMIDRLRSDHTSRAHTHWYKTRYHKVLERLIVLQRTYKHVSYEFRVELKGLKPI

SEQ ID NO: 3496 - protein, 404 aa, Pseudomonas sp.
  source 1..404: note = Related to NZ_JAETZZ010000009.1; note = Pseudomonas putida
MIDARFVNPIKLSADSISSVSSLCDVLDISQKELGEVLALSGEERYSSKEISKAGGKSRIVHNPHKLVRKIQRRINNRIFTAENYIQWPSYLYGSVSNQEYDVEDDQTYLNGKDYVSCAARHCQASSILKLDVQDFFDNIHIGLVEQVFKDFLCFPEPVAKVLANLCSRNEHLLQGALTSSYLASLCLWDVEGKVAERLGRKGLVYTRLVDDITVSSKSIKTDFTYAKNIIIGMLESKDLPVNEAKTQVHRASTKPLTVHGLRVGFSTPRLPADEVRRIRAAVRNVESLAEEPNYRVKHAYRKDFNVCMGRVNKLQRVGHSQYDALVSRLEKVQPLPSKRDIGRVRSMIERLRSDYPKRAHTYWYRVRFYKVHERLNILKRTYRHEALDFRIELKALKPPKSGQ

SEQ ID NO: 3497 - protein, 396 aa, unidentified
  source 1..396: note = Related to NZ_JAAAFX010000009.1; note = Variovorax boronicumulans
MAVLVPYKKTNTSIGSIESLCGTLGITQEELARAIAMPLVMRYTTVEAQPKADGSVRSVSNPHFLIRKIQRRLNKRIFSNGALIGWPDYIFGSIPNQFDALGVEADKDYIACAARHCGAKSILHLDVQSFFDNIHRTQVLAIFEDFLKYSEAVSDQLADICCNGENLVQGALTSSYLATLCLWDVEGEMVNRLNRKSLTYTRFVDDITISSKVASYDFSYAQGIVQDMLASKDLPINSGKTRVRRISSEALTVHGLRVNFSQPRLPSDEVRRIRSSVQNVEKLAVESNYRQSHSYRKDFNRCMGRVNKLKRVGHKQHADLLKRLREILPLPSFKDIERAHLMVARLKDSYQAKGDSFWYRRRFYATHERLTILDRSFHAIAVKLRGELRLIRPSYD

SEQ ID NO: 3498 - protein, 408 aa, unidentified
  source 1..408: note = Related to NZ_JAHNZV010000018.1; note = Psychromonas antarctica
MSYKYDFGKRSKRSIGSIAKLIAVLDITQKELDIVNLLTETQKYKKKETVKSDGTVRVVYNPDKTLRKIQRRINKRIFNQRGNKGGLISWPNYIYGSIPNTPQYNSNQKNLDFSKDYVACAANHCGSKSLLKMDISDFFDNIHSVHVKSVFTDLLKIPDDVSDLLTALCCLKGNVVQGALTSSYIASAVLFDVEGDVVRRLHFKGLTYTRLVDDITVSSQKLNYEFTFAQNLIADMLSKKDLPINLNKTIISNCSTEELIVHGLRVNFKEPRLPSSEVSRIRASVKHLELLSQDSIYRVSRDYRKSYDRCLGRVNKLGRLGHKQHATLLTRVLRIWPLPNKKDINLASNLIKKLEGWHLTTKADEYWYYRLCNKAHSELNILQRSYSKTALSLRKRLKNITPNREDYL

SEQ ID NO: 3499 - protein, 337 aa, unidentified
  source 1..337: note = Related to DNQQ01000166.1; note = Shewanella frigidimarina
MSYKYDFGKRSKRSIGSIAKLLDVLDIKQEELDLVNSLTEDQKYKKNEIPKSDGTVRVVYNPHKTLRKVQRRINKRIFNQRHNKGGLISWPSYLYGSIPNTPQQNSTTKTFDLSKDYVACAANHCGSKSLLKMDISNFFDNIHETHVKNIFSNLLKFPEDVSNTLTSLCCLKGNVVQGALTSSYIASAVLFDVEAQVVRRLHFKSLTYTRLVDDITVSSQKLNYDFTFAQRLIADMLQSKDLPINLSKTIIFTCSTEELIVHGLRVNYSEPRLPSSEVARIRASVKHLELLAQDSVYRVSRDYRKSYDRCLGRVNKLGRLGHKQHSILLERTVKIKP

SEQ ID NO: 3500 - protein, 400 aa, unidentified
  source 1..400: note = Related to QFOM01000049.1; note = Shewanella oneidensis
MAFRYDFIKRNRNSISSIPNLLDALGIEQVQFEQFQNLRDLDKYKASSVPKSDGKIRTVYNPAQLIRLFQRRINTRIFHPKHSQGGLITWPSYLFGSIPNNPQSPESSSRNYITCAGMHCGAKSILKMDISDFFDNIHHREVINIFEKLLKFPNDVSRTLADICCHKGNVVQGALTSSYIASAVLFDVEPNVVRRMHEKHLVYTRLVDDITISSKIYDYDFSYAKNIVIDMLRKKGLPTNENKTIVINSSTKEGLVHGLRVCFKEPRLPADEVGKIRASVQHVERFARDAEYRTSREYRRIYNRCLGRVNRLKQLGHNQYQNLKDRLIKIEPKPCKADIKKARNLVRKVKTLHKDYGSGYRYRRLYYKAQYELNILQRTFSVTADSLRKQLRRVKPTYEQ

SEQ ID NO: 3501 - protein, 408 aa, Aeromonas sp.
  source 1..408: note = Related to NQMB01000054.1; note = Aeromonas veronii
MENTLNYRKRYTSSIGSVSNLLSCLDITQQEYDAFCALASEEKYKSFKLPKPDGTSREVHAPHKLVRKIQRRIVRRIFGSPNRNQWDKKRPKGGAIIWPEYIYGSVPNDYYNNTPISKDYVACASNHCGCKSILKMDLKDFFDNITPDLVFNVFNNLLKYPRPVSNALVKICCHNGKLIQGALTSSYIASAVLFDAEPKLVKRLKSKNLIYTRLVDDITVSSLNQDYDFSYATELIRQVLYEKNLPLNESKTIVLRVSTSDILIHGLRVSFSKPRLPADEVSRIRASVKNLESLAKIADYRVSRDYRRSFNRCLGRVNKLKRLGHNQYKALQRRVIKILPMPSRMDITRLDSFVYKLEGWYQNHSDSYWYKRLYHRAYYDLNILNRTFKASAEKLKARLRLIKPNCDD

SEQ ID NO: 3502 - protein, 408 aa, Aeromonas sp.
  source 1..408: note = Related to NZ_PGGC01000010.1
MENTLNYRRRYKNSISTVSNLLSCLDVSSSEYEDFKALAHSDRYKEFYVPKADGTSRHVHAPHKLVRKIQRRIVRRIFGSPKRNPWDKHRKKGGAIIWPEYIYGSVPNDCYNNTMISKDYVACASKHCGSQSVLKIDIKDFFDNITPELVFNVFNKLLKYPRAVANALVDICCHNNMLIQGALTSSYIASAVLFDVEPAIVQRLKSKGLSYTRLVDDITISSRNPEYDFSFSLELVRQMLYGKNLPLNETKTNIIRSSTIDILIHGLRVSFKEPRLPSDEVSRIRASVKNLESLAKIADYRVSRDYRRSFNRCLGRVNKLKRLGHKQYISLQTRVLNILPLPSKMDITRLDSFIHKLEGWYANHKEEYWYRRLYHQAHYDLNILNRTFEHSSRRFRSRLNDIKPMCDD

SEQ ID NO: 3503 - protein, 407 aa, unidentified
  source 1..407: note = Related to JAKRFW010000006.1; note = Pseudoalteromonas sp.
MTSKYEYHVRKRTNRSIPSIKSLKRALSISDTEIDSFYELIKEGKAYKRVLGHLKSSGDERLVYDPHPLVRKIQRLINSRVFNPRKPKEGLIVWPPYLYGSVPNTVKVIKGKVEVTSRDYISCAKNHCLTKSILKIDIKDFYENIHKSDVFDIFSKVLKYPDDVSTLLADFCTYKDKIPQGGLTSSFIASAVLHDVEPKLVQRLHKKKLIYTRLADDITVSSFTNNYDFNLCISLIKEMLISKDLPINEDKLVISNHSNSATLVHGLRVNFKEPRLPEDEISKIRASVRSLEKLAQDSKYRTSRDYRRSHSICMGRVNRMQSIGHNKARQLMVRVLKILPLPSYQDIITSHKLVYKLEKSFKKDKCEYFYKRLYNLAQYELNILQRSFSREAHELRNRLKRVKPNEV

SEQ ID NO: 3504 - protein, 407 aa, unidentified
  source 1..407: note = Related to LKDX01000018.1; note = Pseudoalteromonas sp.
MKTHFQYHIKKRTNRSIPSIGVLKRTLSITDEEFDSFYTLIANDDAYKKVSGHFKSSGDERLVYNPHPLVRKIQRMINSRIFNPKKPKEGVVIWPKYLYGSVPNTLKWVDGKLEVFHRDYISCAKNHCLTKSILKVDISDFYENIHWQDVYEIFNKVFKYADDVSKALADFCTYDNKVPQGGLTSSFIASAVLHDVEPKLVQRLHKKKLIYTRLVDDITVSSYTKNYDFTLAVGLIKEMLLSKDLPINEEKLVISNHSNSSTLVHGLRVNFKQPRLPEDEVSKIRASVRSLENLAKDSKYRTSRDYRKSHAMCMGRVNRMQSIGHNQAKQLLNRVLKILPLPSYQDIITAHKLVYRLEKNFENDKGTYSYKRIYNLAHYELNLLQRSFSSHAKGLRLRLKEVRPNEV

SEQ ID NO: 3505 - protein, 386 aa, unidentified
  source 1..386: note = Related to NVWL01000003.1; note = Oceanobacter sp.
MKHLEKVPSAKSIGSLNKLSHALGIEKSILIDVAESIGGYRKSERTKDNGKIRVVYSPSRIVRKIQSAINERIFTDPRIISWGEYLYGSIPNDEYVTRDYISCAARHGMCKSILKMDISDYFDNIHEDAVFDVFNGFLKYPNDVSTILAGICTHEGRVPQGGLTSSYLANLVLYDVEEIVINKLEKKKLTYTRYVDDITVSSLSYGYDFTYAQDLIKNMLHGKGFPVNEEKCVIERSGTIGLSVHGLRVGYDRPRLPREEMRRIRANVQKVEIISKEPGYRTTHSYRRDFNRCMGRVNKLVRLKHDQGAKFIKRLNAIKPLPSIKDINRCRKMVWFLAKDYENKKRRLSYERRFYICHERLNILKRSFYQEEQYLRSNLRTIRPVS

SEQ ID NO: 3506 - protein, 422 aa, unidentified
  source 1..422: note = Related to CP011924.1; note = Pseudoalteromonas piscicida
MDKVFLDSSYSMGRPSLLVRSENMELIDYYDKDSGNSISSIKNLCLALDINESELDEISQLGDDRYVKSEVPKSSGGVRIVYNPHRTLRKVQRRINNRIFNPKSGAIIRWPSFIYGSIPNQHLLHGELEHKDYVACVKNHCLRSSILKVDVQDFFNNIHIDHVVEIFTSFFKYPDDVSNCLAELCCYKDFVVQGALTSSYIASLCLFDVEPDVVRRVKRKGLVYTRLVDDITISSMDRDYDFSYVKSLVIDMLHEKDLPVNVEKTNVFRVSEGPLLVHGLRISFQEPRLPADEISRIRASVKNVERLASEPKFRTTHAYRQDYNRCMGRVNKLKRVGHNQHKKLTERLLKVHPKPSKKDLKRIKVMISTLERDYEKKGDNYWFYKRFYRAQERLNLIAKSYPNYVNKLRPRLKKVFPNYDKS

SEQ ID NO: 3507 - protein, 399 aa, unidentified
  source 1..399: note = Related to PNDP01000055.1; note = Pseudoalteromonas sp.
MEVIDYFAKDSDNSISSIKNLCRALDLTESEINEVRALGSDSYIQSEIPKSSGGLRRVYNPHYKLRKVQRRINNRIFNPKSGAIVHWPSFIYGSIPNQNLLDGDIDHKDYVACVSNHCLSRSLLKIDVQDFFNNIHIDHVTDIFKNFFKYSDDVSECLAEICCYNGFVVQGALTSSYIASLCLFDIEPEVVKRVRRKGLRYTRLVDDITVSSLERDYNYSYVKNLIIDMLHQKDLPINEEKTNVFRVSEGPLLVHGLRVSFREPRLPSDEVSRIRASVRNLEKLASEPKFRTTHAYRKDFNRCMGRVNKLKRVGHNQHRKLITRLLKVSPKPSKKDLKRIEVMLERLERDYDKKAGNYWFYKRFYRAQERLNLIAKSYPNLAKNLRLRLKCVFPIYDKH

SEQ ID NO: 3508 - protein, 399 aa, unidentified
  source 1..399: note = Related to LAHP01000027.1; note = Arsukibacterium sp.
MATDVLFKKVSAPIVSIEKLCLALDISKEELNDALKLTSSERYTKSEVPKPNGKVRIVHNPHKLIRKIQRRINTRLFNPKPTGRGVVEWPYYIFGSVPNVKDPIKPIERDYIACARQHCLSQSILKIDITDFFDNIHIDHVYYIFRHLLDYSDEVCNVISDICSLNGALLQGALTSSYLACLCLFDVEPNVVIRLQRKGLRYTRLVDDITVSSIKDGYDFTLAKNIIVEMLESKDLPVNDAKTQIIHKSSVPLVVHGLRVNFKEPRLPSSEVSKIRASVKNIEQLAKERHYITTHAYRKDFNRCMGRVNKLKRIGHNQHQSLVERLRKILPLPSKKDIERCKEMVSGLESDFPNKKGHFWYHRRFYRANERITILDRTFKSIAKELRLKMKDIRPLYKD

SEQ ID NO: 3509 - protein, 399 aa, unidentified
  source 1..399: note = Alteromonadaceae bacterium; note = Related to PBYW01000011.1
MFDRFTFSAAKAPITSIDKLCETLSVSREELYDTLDLPDELKYTETQIPKSFGKVRKVHNPHKKLRKLQRRINRRLFNPKGKSDSVINWPVYIYGSVPNQEIEGVTYNRDYVACARQHCGSRSILKLDISDFFDNVHEDHVKNVFANLLKYEEEVAEVLTQLCCFNGSLVQGALTSSFLACLCLYDIEPKLVKKLSRKNLRYTRLVDDITISSTQPHFDFSMVKDIVLRQLYEKDLPVNKDKIVELYSGTSPMLVHGLRVNYSEPRLPSEEVSRIRAAVKRIELQAIEPNYRTSHTFRKDFNRTLGRVNKLARMGHNQHKKLSARLSNVRPLPSKKDIERCWSMLARLQRDYNSQKNSYWYKRRYHRLSERLIILKRTFHKTEARIREALKKIKPGFVD

SEQ ID NO: 3510 - protein, 425 aa, unidentified
  source 1..425: note = Related to NZ_LJSO01000004.1; note = Pseudoalteromonas sp.
MANVYTDEMELCQLPLNNKYNFKYIINSGPIKSIQDLCEKVLDIPISELYKALSIAEEERYQRASVPKKDGTIRVVYNPHYLIRKIQRKINSRIFNPKVKLGKNPGVIKWPPYIFGCIPTQYQEVDEGELITDSRDYIACAKKHCLSKSILKIDISNFFDNVHKSIVEDIFKELLKYPDDVAEVLADICCKGEHLVQGGLTSSYLASLALWDVEPEVVKRLNNKGLKYTRLIDDITVSSKKQNFQFDLVKDVIVNMLHNKDLPVNNSKTEVSYASTKPLIVHGLRVNFKEPRLPSDEVSRIRANVHNVEKLAKERHYRTIHPYRKDFNRCMGRVNKLKRLGHNAHKPLLKRLQAILPLPSKLDISRCEKMITRLEADFDKGKGNTIWYWRRYNRASQRLIVLKRTFIHQALDFRERLKNVKPTVV

SEQ ID NO: 3511 - protein, 328 aa, unidentified
  source 1..328: note = Related to NZ_JACAVQ010000006.1; note = Aliidiomarina indica
MTYRMYFERKVSGPIDSRAKLCQALSIGDEELTQALALTEAERYTESSVPKADGTTRTIYNPHHKIRKLQRRINTRFFNPSKKIHGNDSGIIRWPSYIFGCVPNDIGDDGETEVQKDYVACARVHCPSKSILKMDISDFYNNVHRDLVLEVFKDMLGFTDDEVASLLTDICCKGDSLVQGGLTSSYLACLALYDEEPEVVRRLKRKGFRYTRLIDDITISSPNENVNFDYVKDLVVNMLHAKELPVNRDKTKVQYVSTEPLLVHGLRVNFKEPRLPKGEAARIRANVHNVERLAKERHYRTIHPYRRDFNKCMGRVNKLARVNPPLAG

SEQ ID NO: 3512 - protein, 402 aa, Alcaligenes faecalis
  source 1..402: note = Related to NZ_UFSQ01000006.1
MTTALINDKIKKSNSALIGNFKNLLHALEISDDDVSKLRAFLPHDRYKEKTIKKKDGSDRKVYAPIPVLKKIQNRIKNRILANQDVISWPSYIFGSIKNQKIEGGGIDSRDYVSCAAKHSGAKSLLTVDIKDFFDNVHEDIVAAVFERYVSTDKEVINWLLDVCCYEQHLVQGAPTSSYLANMSLYDIEPQLVHKLARKGLIYTRLVDDISVSSKIYDYNFSYALKLIEDALSEKGLYLNPEKISQRSVGSAPLTMHGLRIDYQTARLPAAEVGQIRAHVKNLEDAAKSYKSRTSYAYRQDYARCMGRVNKLARVKHNQHSKYLARLRAIQPLPSGNESTYCLKKLEVLEKTYLEAKETFSYRKNFYRLQEKINILSRSFPRSAEDMKKRMKLIAPPPKDGK

SEQ ID NO: 3513 - protein, 405 aa, unidentified
  source 1..405: note = Related to JAKCOW010000055.1; note = Shewanella algae
MSRPTIRNSAPINTLETLLKTLSISSDQLEEILALSAGERYTKPLNDVHKKDGSIRKIRCPHHSLRVIQRRISKRLIYDKVIWPEYLFGSIRTRDYEDLSERDYISCAAKHCGAKSLIKIDVENFFDNVSRETVVGIFKDLIRCSDKNSELLSEICCYEDNLVQGAITSSALAMLALWDIEGKVVDRLARKGLVYTRLVDDITISSKSHNFNFDHALNIVKQMLYEKDLPFNQAKTKIERLSSEALTVHGLRVAFKEPRLPSSEPRVIRSYVQRLEKLASDGFHRRTADYRKDYNRCVGKVVKLHRVKHNKYRPLKDRLDRIPPLPSKRDLKVVEKLICRLERDYNSETKGIGGGKYQDTYWYKKRYSRIMYRLSIVKRSYKNKYDEYIERLDKVKPDTKGLYND

SEQ ID NO: 3514 - protein, 400 aa, unidentified
  source 1..400: note = Related to NZ_BMXV01000003.1; note = Marinobacter zhanjiangensis
MIDPRFPLFPEKTTEKSISTLQSLADAFSIPLADLEKARQLSPIERYRAKEIPKAGGGIRQVYNPSYLIRLIQSRVNKRIFLDLVRWPGYLYGSLPNTYIDDEPVYRDYIACAKNHCLSKSLLKIDISNFFDNIHRDHVYRIFNGLLKFPPPVSEYLTDICCYEDFLVQGALTSSYLATLCFWNCEGDVVKRLSRKGLVYTRLVDDITVSSRRHGFNFDYAEHHIKMMLIDLDLPANDRKKQILRDGIEPLHVHGLRVNYQTPRLPADEVRRIRSAVHNVVKMAKINNYRTSSSYRSLHDRCVGRVNKLARVGHNKHKIFKDQLLGVLPLPSRRDVEKAEGAISFLESLDRSRIKERRYTRKYHLVRYRVSIIARTYEKEARSFESRLYALSDCVGSYDW

SEQ ID NO: 3515 - protein, 400 aa, unidentified
  source 1..400: note = Related to NZ_NIHC01000001.1; note = Marinobacter salexigens
MIDPRFPLFPEKTSKQAISSLESLAEALSVTVKDLEEVRSLESDKCYRLKEIPKNGGGLRKVYDPHPLIRRLQSRINKRIFLDLIQWPGYLFGSLPNINIDGQLVSRDYIACAQKHCKAKSLLKVDVNNFFDNIHRDHVFDIFRMFLKFSDEVSNCLADICCYNGFLVQGALTSSYIATLCFWQNEGYVVKRLSRKGLIYTRLVDDITVSSKRHDFNFEYAEHHIKMMLVDLDLPANKRKREILRDGIEPLQVHGLRVNYASPRLPADEVRRIRAAVKNVVRMSKINNYRTSLSYRAMHDRCMGRVNKLARVGHNKHGDFKRELVDVIPLPSVRDLEKAESSISFLEKLDPERLKLRKYTRRYHLAKYRVSIVARTYCQEADDLSFRLQKLSVFVGDYEL

SEQ ID NO: 3516 - protein, 398 aa, unidentified
  source 1..398: note = Related to CP034246.1; note = Shewanella algae
MNTMISSLYPQKSSTSSISNLENLAESLSLDKNLLEYSQKLTQEERYKKIKIPKSNNSYRTVHDPIDIIRKIQNRINTRIFTQLVDWPDYLFGSIPNDIIDSRDYISCARKHCLAKSIFKLDISNFYDNIHRDFVYDIFNNFFKFPTEVSDFLTDICCYDDYLPQGALTSSYIATLCFWNVEGDLVKRFQRKNLVYTRLVDDITVSSKKHDYDFEYVEKHIKNMLLHFDFPVNNSKTKIMRDGLEPLNVHGLRVNYPEPRLPSAEVNKIRAAVHNVVKMSKINNYRTSKSYRNLYDRALGRVNKLARVGHNKHSELINKLKKVTPLPSKRDLNYIKNNIRTLKNLNELDCKKLRQLKYKRKYHLINYRISILNRTFPNKASTLRNELKLLKDKILDKQ

SEQ ID NO: 3517 - protein, 368 aa, unidentified
  source 1..368: note = Related to JAGPVP010000081.1; note = Zhongshania sp.
VAELEAIRGIPLSERYREKPLQKGHGKIRLVYNPSFKIRLIQNLINTRLFKDLIWWPEFLFGSLPNSLHEERLIERDYIACASVHCGAKSIYKIDISDFFDSIHKDFVYEIFSKLFSYPHEVAEYLTDVCCYENKIPQGGLTSSYIATACFWDLEGEVVKKLSRKGLKYTRLVDDITVSTTVSNYDFSYVDRHVRDMLIAKDLPVNESKTLALYSGMAPLFVHGLRVDFKQPRLPAKEIANVRASVHNVCSWAKVDSYRTSVTYRAAFDRCLGRVNKLARVGHEKHAVYVAKLRKVAPLPSQFDIDSAEASISRLEKISTAKLVSVKYKRHFALVRYRITIIKRRFPSIAEKFKLRLRALEVRRNAAL

SEQ ID NO: 3518 - protein, 425 aa, unidentified
  source 1..425: note = Related to nan
MTVTPCYSALDYGGVGHDIKLPRMAVEMTDLRPEKITKSSIGSISKLSVVLSIPESDLSAILKILPENRYKKITIPKGVGGERIVYSATPLLRKIQHRINTRIFKKLIKWPPYLYGSLPNDKELVGGQTKTTVQRDYIACAQNHCGAKSILKLDIANFFENIHRDTVKKIFRKFFHYPENVSDYLTEVCCYGDTLVQGALTSSYLASLCMWDTEYKVIQKLSRRNLVYTRLVDDITISSKHRGYDFRNAESHVRAMMLKKDFPLNLSKTKIMRAGSSPLLVHGLIVNFRTPRLPSSEISRIKASVNNLVKASATDNYRTTYSFRAQYFRCLGRVNRLARVNHNKHEYLINKLKKIRPKPCKTDIERVENAIDRLKSLKDKTTDSYRRIYNIARYRIGIVSRSFDRKSMILLSELKKLEKPVSKID

SEQ ID NO: 3519 - protein, 409 aa, unidentified
  source 1..409: note = Related to NZ_PDWP01000037.1; note = Pseudoxanthomonas suwonensis
MIHTYFSGAAMLPGKGVQKIARHSIGSVRSLCRTLSIEESELDELLTWPADARFKKKKIEKSSGGHRTVFVPNWKFRRIQRKINKRILGNTKIIRWPKYIFGSVPSSSADAEEVVGRDYIACAAVHAGSKSILKVDISDFFDNVEHDVVSDVFEKFLKYPPEVVEALCNVCCLKGRLPQGAPTSSYLANLAFWDVEHRLVRRLHQKGLRYTRYVDDITISSRKHAQDFSLALRLVDGMLIDKNLSRNEKKTLTLRSGINPLVVHGLAVEHSVPRMPAQEYKRIRASVRALENFVTDPGFRTYNAYRRMFNTCQGRVNKLSRLKRVAHASYVNRLRRIRPLPSHRDLAWCKKVAERLLARFKVPGATDGYFFKRDLFRLRERLNLLRRTYLHEAAELKNRISHIRIFSHE

SEQ ID NO: 3520 - protein, 399 aa, unidentified
  source 1..399: note = Related to NZ_VSSP01000009.1; note = Luteimonas sp.
MSLKSHVTKVSRHSIGSVRSLCRTLSIDEPELQALLSWVPESRFKKKAVTKSSGGSRTVYVPHWRYRKILRKINKRILGNTKIIRWPDYVFGSVPSSDADDARLIGRDYIACAAVHSSSKSILKVDICDFFDNVEQPLVRNIYTDFLKYPPAVAETLCNLCCIHGKIPQGAPTSSYLANLVFWDLEANLVARLKQKGLTYTRYVDDITISSRKYSQDFSLALKLVDQMLMDKDLTRSEVKTQVLRSGTKPLLVHSLRVEHATPRIPSPEYRRIRSAVRTLENFAADAGFRTYDAYRRMFNVCLGRVNKLSRLRKKSHTAYITRLNRVGPLPSHRDLRWCQRTAREVLKRFAIPGESERFFFRRKLFRLRERLNLLQRTYVHEASAIRDSLAQIKIYSHE

SEQ ID NO: 3521 - protein, 388 aa, unidentified
  source 1..388: note = Related to VWWQ01000001.1; note = Comamonas sp.
MTKLIEDFTKRVAGSISSIPTLANALDINLSEIENLLNTPADQRYKEKFIEKKHGGVRKVYNPSALVRKIQQRIINRIFKPLVDWPFFVYGSIPKSNGQPAKDYVAAANVHAGAGSLLKMDIKDFFDNIQREVVFDVFFDFFKYPYPVSEILTDICCRDDRLCQGALTSSYLAALCIFDVEAKMVKRIEKKGVTYTRYVDDITISSKNRSYDFSYVEKVVEEVLMSKDLPVNKGKTSVINLTSKPLLVHGLRVNTSNARLPIAEVKRIRAAVQHLEVASREPNYITLPTYREEFNKCMGRVNKLARVGHIQHSALVNRLKRIRPKSTRSDLYVAIQMLKIIRRTSQQRRQHYFFKKQCAQAKTLLTLIKKNNKYSRRAAILLNYLRKI

SEQ ID NO: 3522 - protein, 395 aa, Proteus sp.
  source 1..395: note = Related to DPFJ01000041.1
MLTDLPINRSSSGISTLISLSKTLGFSLEELEDIRNIPLDKRYFKLEKPKIDGTKRVVYRVHHKLKRLQRRINSRIFRELVIWPEFLFGSIPNDNDEVSLKRDYISCASRHCSAKSILKIDIKNFFDNIHRDLVSDIFSDFFRIKSEANEYIVDICCLENFIVQGALTSSYIASLCLHDLETNVYRRAKRKGLIYTRLVDDITVSTKVNDFDFTQIKKHIETMLAEKDLPINYEKSGVFQISTKPLLVHGLRVDYSKPRLPSDEVKKIRASLHNLIGNAVKNNNKTTIAYRTEYNRCMGRISKLGRLGHEKHKVFMGKIKCIRPMPSYLDVKNCKKKLKGLESLYSRGFNRSNKYSREFNVVSHYITLIKRSNSFMKIANEFRERLNKIKPNVEK

SEQ ID NO: 3523 - protein, 396 aa, unidentified
  source 1..396: note = Related to NZ_CP035382.1; note = Leclercia adecarboxylata
MSNDLPSNKSNSGISTLTSLSKALGFSIDELVEIRSIPLDRRYHKLEKPKSDGSMRIVYRPHHKLKRLQRRINNRIFRELVIWPNFLFGSVPNDNDGEDSLNRDYITCANQHCGAKTLLKVDIKNFFDNIHKELVSDIFSDFFYINAEANDYITDICCAGEFIVQGALTSSYIASLCLHDVETTVYRRAKRKGLVYTRLVDDITVSSKVYDYDFSQIKKHIEDMLAEKDLPINIVKSGVFQVSTKPLLVHGLRVDHNKPRLPSYEVRKIRASLNNLIGNSIKNNNKTSLAYRVEYNRCMGRINKLGRLGHEKHAVFMGRIKKVRPMPSFQDVRECKKKIKWLEIQYSKGFNKSDKYFRVFQITGHVISLINRSDAFSTIAKELRTRLNKVKPDVEK

SEQ ID NO: 3524 - protein, 396 aa, unidentified
  source 1..396: note = Related to CP008955.1; note = Yersinia kristensenii
MPSDIPINKSNSGISTLNALSKTLGFSLLELDEIRNIPLDKRYVKLEKPKADGSVRVVYRPHHKLKRLQRRINSRIFRELVVWPDFLFGSVPNDNDEEQSLKRDYITCAGQHCSAKSILKIDIRNFFDNIHRDLVSNIFNDFLCIKSEANEYIVDICCAGDFIVQGALTSSYIASLCLHDVETKVCRRARRKGLTYTRLVDDITVSSKVYDFDFSQIRKHIEDMLAEKDLPINSDKSGVHQISTKPLLVHGLRIDHSKPRLPSDEVKRIRASLHNLINNSSKNNNKTSLAYRVEYNRCMGRINKLGRLGHEKHTVFMGKIRKVRPMPSYRDVRECKKKLKRVEYLYSKGLNKSEKYFRNFQLVGHNISLINRSSSFSVLAKEFRVRLNKVKPDVEK

SEQ ID NO: 3525 - protein, 396 aa, Enterobacter sp.
  source 1..396: note = Related to NZ_JAHEVU010000002.1; note = Enterobacter quasimori
MSSELPIKKSNSGISTLDSLSKTLGFSLEELEEIRSIPLEKRYFKLEKPKTDGTMRTVYRPHHKLKRLQRRINKRIFRELVIWPDFLFGSVPNDNDDEDSIKRDYITCASLHCSAKSILKIDIKNFFDNIHKDLVGDIFEGFLCIKSEAKEYMIDVCCAGEFIVQGALTSSYIASLCLYDVETQVYRRAKRKGLTYTRLVDDITVSSKIYDFDFTQIRKHIEDMLAEKDLPINFDKSGVFQISTKPLLVHGLRIDHNKPRLPSNEVRRIRASLHNLINNATKNNSKTSLPYRIEYNRCMGRINKLGRLGHEKHAVFMEKIKRVRPMPSFSDVKECKKKLKKLEELHAKGFNKSERYLRNFQLVGHSISLIKRSDSFSILAKELRMRLNRIKPNVEK

SEQ ID NO: 3526 - protein, 396 aa, unidentified
  source 1..396: note = Related to LR134235.1; note = Klebsiella variicola
MSPDLPTKKSSSGFSTLTSLSKTLGFSLEELNEIRDISIDKRYVKLEKPKTDGSMRIVYRPHHKLKRLQRRINKRIFRELIVWPSFLFGSVPNDNDEEDALKRDYITCASQHCSAKSILKIDIKNFFDNIHRDLVGDIFENFLCIKSEAKEYMVDVCCAGDFIVQGALTSSYIASLCLYDVETTVYRRAKRKGLTYTRLVDDITVSSKVYDFDFTQIRKHIEDMLAGKDLPLNHDKSGVFKISTKPLLVHGLRIDHDKPRIPSDEVKRIRASLYNLTSNSKKNNNKTSAAYRVEYNRCMGRINKLGRLKHEKHVIFMEKIKRIRPMPSFRDVKECKKRILWLEKLYSKGLNKTERYFRVYQVTGHNISLINRSASFSDIAKEHRFRLNKVKPNVER

SEQ ID NO: 3527 - protein, 397 aa, unidentified
  source 1..397: note = Related to nan
MLSDLPRNKSISGISTLLSLARALGLPREYLEEIKNMPLETRYSKLEKPKIDGSMRVVYRPHHKLKKLQRRINNRIFRELIIWPEFLFGSIPNDNDSDDDALKRDYITCAGQHCSAKSILKMDIKNFFDNIHRDLVDDIFENFLHISLEAKEYLVDFCCSGDFIVQGALTSSYIASLCLYDIETKVYRRAKRKGLVYTRFVDDITVSSEIYNFDFSQIRKHIEDMLADKDLPINLEKTGVYQVSTKPLLVHGLRIDHSTPRLPSYEVRNIRASLHNLMKNSTKNNNKTSLAYRVEYNRCMGKINKLGRLGHEKHDVFMKKIKKIRPMPSYKDVKHCKEMLKKLEDLYEKGFNKSNKYYREYQIVGHNISLIKRSNSFLVVSEDLRKRHNKIKPNFEK

SEQ ID NO: 3528 - protein, 395 aa, Escherichia coli
  source 1..395: note = Related to NZ_LR778152.1
MSSDRPIKTTASAIPSLKKLSQTLGFSIEELEEIRAIPLEKRYVKLEKPKIDGTMRTVYRPHFKLKRLQRRINSRIFRPLVIWPVYLYGSVPCDNDDESIKRDYITCASQHCAAKTILKIDIKNFFDNIHQDIVRDVFDKVLNIKDDALDYIVDVCCAGDFIVQGALTSSYIASLCLHDVEADIYARAKRKKLVYTRLVDDITVSSKIHDFDFSQIRKHIEDMLAKKDLPINVEKSGVFITSTKPLVVHGLRIDHSKPRLPSDEVKKIRASLHNLIANASKNNNKTSLAYRIEFNRCMGRINKLGRVGHEKHLVFMSKIKLIRPMPSYKDIVDCKGKLVKLEKLHAKGYNTSDIYFRRYQLVSHLLSLINRSSSFHEVVKDLRKRLNRIKPNVQR

SEQ ID NO: 3529 - protein, 395 aa, unidentified
  source 1..395: note = Related to JACFXZ010000002.1; note = Pectobacterium aroidearum
MPSDIAINKSDSGISTLQSLAKTLGFSLQELQEIQSIPLDKRYQKLEKPKVDGTKRIVYKPHHKLKRLQRRINSRIFRELVVWPDFLYGSIPGDNDEDDLIKRDYVNCASQHCAAKSILKVDIKNFFDNIHKDLVRSIFENFLHINSDALDYLVDVCCMGDFIVQGALTSSYIASLCLYDVETKVVRRARRKKLVYTRLVDDITVSSKIYDFDFSQIKKHIEDMLADKDLPLNQEKTGVFQTSTKPLTVHGLRVDHSKPRLPSDEVKKIRSSLHNLVINSKKNNNKTTAAYRVEYNRCMGKINKLGRVGHEKHEQFMLKIKSIRPMPSKRDIIECNKKITTLEKLFKAGLSSHESYKRKFYLVSHQISIVKRSNAYKNIADELRERLSKVKINEN

SEQ ID NO: 3530 - protein, 396 aa, unidentified
  source 1..396: note = Related to NZ_HG738868.1; note = Serratia marcescens
MTTDVPIKKSSSGISSLESLSKTLGISLLELSEIRGIPTNKRYEKILVPKADGSQRIVYKPHYKIKKIQRRINSRIFRELVIWPDFLFGSIPNDNDTEESIKRDYVSCSSLHCGAKSILKIDIKNFFDNIHKDLVSDIFCNFFCIKGDALNFLVDICVKDDFIVQGALTSSYIASLCLHDVESKIVRRARRKNLVYTRLVDDIVISSKVFDFDFSQIRKHVEDMLADKDLPLNHEKSGIFYNSTKPLTVHGLRVDHHKPRLPSDEVKRIRASVHNLVTLSRKNNARTSLAFRKEYNRCMGRINKLTRVKHEKDKVFKKMVEFIYPMPSYGDIISCKKDISSLETSFKNGFNKTEWYYRKYNLVSYKISIIKRSSAFINLADELRDRIKKVKPNEDR

SEQ ID NO: 3531 - protein, 395 aa, unidentified
  source 1..395: note = Related to NZ_CP027225.1; note = Phytobacter sp.
MSSDLPKNTSSKGISSLSLLSKTLGIAVEELREIRAIPLDKRYEKILVPKSDGTNRIVYKPHYKIKKVQRKINSRIFRKLVVWPDFLFGSVPNDNDDEDSIKRDYVTCASLHCGAKSILKIDIRNFFDNIHRELVSDIFSTFFKCKSTALDYLVDFCTKGDFIVQGALTSSYIASLCLYDKETHVVRRARRKGLTYTRLVDDITISSTVFDFDFNQIRKHVEDMLADKDLPLNYEKSGVFHNSTTPLMVHGLRIDHLTPRLPSDEVKRIRASLNNLINLSEKNNSRTSLAFRKEYNRCLGRVNKLGRVGHEKHPIFLKKIKVIYPMPSYKDVISCKKAIASLETSYVNGFSDKDWYSRKFNLASHKISIINRSLAFQLIAKQLRVRLNKVKPDEE

SEQ ID NO: 3532 - protein, 406 aa, unidentified
  source 1..406: note = Related to CP015613.1; note = Serratia inhibens
MGRPYVTLFGEIMDKFKPYSKSKAPISTLQKLAQTLSISIDELNEISALPEDEKYERKELPKADGSKRVVYSLHPKMRLLQSRINKRIFKELVIFPPFLFGSVPGKNDGANSNIKRDYVSCAKAHCGAKTVLKVDISNFFDNIHKDLVRDVFNNVLNIRDEALEYVTNLCCKGDFVVQGALTSSYIATLCLYEQEGNVYQRAIRKNLVYTRLVDDITVSSKINGYDFTQILSHIENMLSTHDLPVNKRKTKIFHCSSEPIKIHGLRVDYNSPRLPSDEVKRIRASLHNLKKLAVKNNTKTSMAYRKEFNRCMGRINKLGRVGHDKYELFKEQLLAIKPMPSPRDITIVESAVTSLEISCSKGNGNKHWYKRKYNLTLYKLIILTRSKAFDGIVDTFKERLKKVKPA

SEQ ID NO: 3533 - protein, 394 aa, Citrobacter sp.
  source 1..394: note = Related to CP040698.1; note = Citrobacter freundii
MDKFKPFSKSNAPISTLLKLSQTLSISVDELREIEALPDDEKYTRKDLPKADGSNRVVYSLHPKMRLVQSRINKRIFKELLVFPPFLFGSVPSKNDGVDSNVKRDYVSCAKAHCGAKTVLKVDISNFFDNIHKDLVRDVFSNVINIQDEALDYVTKICCKGDFVVQGALTSSYIATLCLYEQEGVIYQRALRKNLVYTRLVDDITVSSKINNYDFTQILGHIEDMLAEHDLPINKRKTKILHCSSEPIKIHGLRVDYKSPRLPSDEVKRIRASLHNLKKLAVKNNTKTSVAYRKEFNRCMGRINKLGRVGHEKYKVFKEQLLEIKPMPSLRDSKIIDAAINSLELSYSKGNSNKHWYKRKHDLTLYKLIILTRSQSFDKTVSLFRARLKKVSPT

SEQ ID NO: 3534 - protein, 394 aa, Escherichia coli
  source 1..394: note = Related to CP088348.1
MDKFKPYSKSNAPITTLEKLSKALSISVEELKAIAELSLDEKYTLKEIPKIDGSKRIVYSLHPKMRLLQSRINKRIFKELVVFPSFLFGSVPSKNDVLNSNVKRDYVSCAKAHCGAKTVLKVDISNFFDNIHRDLVRSVFEEILHIKDEALEYLVDICTKDDFVVQGALTSSYIATLCLFAVEGDVVRRAQRKGLVYTRLVDDITVSSKISNYDFSQMQSHIERMLSEHDLPINKHKTKIFHCSSEPIKVHGLRVDYDSPRLPSDEVKRIRASIHNLKLLAAKNNTKTSVAYRKEFNRCMGRVNKLGRVGHEKYESFKKQLQAIKPMPSKRDVAVIDAAIKSLELSYSKGNQNKHWYKRKYDLTRYKMIILTRSESFKEKLECFKSRLASLKPL

SEQ ID NO: 3535 - protein, 397 aa, unidentified
  source 1..397: note = Related to NZ_CAKLIV010000013.1; note = Pectobacterium versatile
MFKPSLKNTNQGYISSLESLSRTLSIPIDKLIEISNIPVDDKYLLKEIPKADGSTRHVYKLHPDLRLLQSRINSRIFRELIVWPDFLFGSIPNDNDPSSEDVKRDYISCAGLHCQAKTILKVDIKDFFDNIHEDLVKDIFSNVLNIKDKSLEYLTQACCRNGFIVQGALTSSYIASLCLFDMEGKIVSRARKKNLVYTRLVDDITVSSKISNYDFSQIRQHIESMLAEKDLPINNKKTKVFYSSTQPLYVHGLIVDYSKPRLPSDEVRKIRASLNNISKLAVKNNSRTSVAYRKEYNRCFGKIGKLKRVGHNKYEVFLGKIKKIKPMPSLRDVKMAKATVKSLEVSHAKGNNNKYWFKRKYDLARYKIVILNRTKEFELLVAELRERMKNVKPNFER

SEQ ID NO: 3536 - protein, 404 aa, Proteus hauseri
  source 1..404: note = Related to AWXP01000008.1
MLNNENYCPHTPYSIAKKRITSLKILSDTLSISESELIRINSLSDHEKYTELKVPKIDGTDRIVYSLNSDLRKVQYRINKRIFRELIKWPNHLFGSVPSNNDSNKDQIKRDYVACASLHCGAKSILKIDINNFFDNIHKDIVTDIFSNVLKIEGYALEIITDLCCKGNFIVQGALTSSYIASLCLHDLEADIIKRAERKNLVYTRLVDDITVSSKLSNFDFSQIKSHIENMLANKDLPVNKNKSKILKESIQPLVVHGLRVDFEQPRIPSDEVKKIRASLHNLCNLAKKNNMRTSSTYRKEYNRCLGRINRLGRLNHNKHSSFIKIIEKIKPLPSWRDVQKTKAALNSLKASYSKGNNNKSWYIRKYHLTYYRTSILNRSTEFHDMVIYLREKLKKIKPKDKRG

SEQ ID NO: 3537 - protein, 395 aa, unidentified
  source 1..395: note = Related to NZ_OU659150.1; note = Providencia alcalifaciens
MTSNKPISKSKKPILNLDVLSATLSIDKVELLRVDSLPSDEKYKQITLAKIDGSKRIVYSLSADLRKIQSRINKRIFRELIIWPDYLFGSVPNENDNDDSIRRDYVACAELHCGAKSILKVDIKDFFDHIHRDLVKQIFENVLNIHNDALELITNLCCKDDFIVQGALTSSYIATLCLFDQEHEIVTRTRRNGLVYTRLVDDITVSSKLSNFDFSHIQMHIDNMLASKDLPINKSKSKVTKVSMEPLTVHGLRVDFISPRVPSDEVKRIRASLHNLNMLVKKSNSRTSAAYRKEYNRCLGRINRLGRLGHNKYPIFLESIKKIIPLPSWRDVLKTKAALKSLESSYSKGNKNKSWYIRKYDLTYHRTAILNRSPVFNKLVIYIRNKLNGIKPDER

SEQ ID NO: 3538 - protein, 394 aa, unidentified
  source 1..394: note = Related to JACYNA010000001.1; note = Pantoea agglomerans
MSIDIPTRKQNIKSLRSMHSLSSCLDISLGDLNEARALTSELRYKKKEVKKINGDTRDVYDPHQLIRRIQKRINNRIFKPLIIWPNYIYGSVPSNKEEKKLGIERHYIACAKQHCKAKTILKVDIKSFFDNIHKDIVRDIFNRVFKFKGDALEYLTDICCYEHRIVQGALTSSYIASLCLFDLEADVVNRTRRKQLTYTRLVDDITVSSPLVNFDMSQILEHIKNMLAQKDLPVNESKTQVYNISTESLKVHGLRISFNEPRLPSDEVGRIRASVHNLEGLAKKNNSLTSVAYRVEFNRCVGRVNKLGRVKHKKYKTLSDKLRLIQPKAAKRDLSKIERAICFLENSYLGGNSKKHYYKKKYDLALFNLIILRRTAAYISFADGFKARLSKIKY

SEQ ID NO: 3539 - protein, 394 aa, unidentified
  source 1..394: note = Related to NZ_JAENMQ010000001.1; note = Lelliottia aquatilis
MITDIPIKKPNTNSLRSLHSLSSCLNISLSDLNEAREMPSHLRYKKKQVKKINGDSRDVYDPHPLIRRIQKRINNRIFKELIIWPGFIYGSVPTNKEEKKAGIERHYIACAKQHCNAKTILKVDIKNFFDNIHRDVVYSIFQRVFKFKGEVLNYLTDICCFDHKIVQGALTSSYIASLCLFDLEHNVVNRARRKQLVYTRLVDDITVSSKLVGYNMNQILEHIKSMLDEKDLPLNEDKTQVHNISTESLKVHGLRISFNEPRLPSDEVGRIRASVHNLEQLAKKNNSITSIAYRLEYNRCVGRVNKLGRVKHGKYKILSAKLKLIQPKAAKRDIDKIERAVQFLENSYKGGNSQKDYYKKKYDLAFFNLIILRRTAGFVSIADGFKKRLEKVKY

SEQ ID NO: 3540 - protein, 394 aa, unidentified
  source 1..394: note = Related to CP043932.1; note = Klebsiella pneumoniae
MVARNPIKKPGAQSLRSLQSLSSCLDITLADLKTAIAMPSHQRYKKKQVKKINGELRDVYDPHQLIRRIQKRINNRIFKELILWPDYIYGSVPTNKDEKKKGIERHYIACARKHCNAKTILKVDIKNFFDNIHRDIVYSIFSKVLKFKGEALEYLTDICCYDDTIVQGALTSSYIASLCLFDVESDIVNRAERKKLVYTRLVDDITVSSKLVNYNMNQILDHIKDMLAGKDLPINEDKTQVHNISTESLKVHGLRISFNEPRLPSDEVGRIRASVHNLEKLAKKNNSITSVAYRIEYNRCVGRVNKLGRLNHNKYKVLSLRLKDIQPKAAKRDIVKIDRAIKFLENSYKGGNSKKDYYKKKYDLTLYNLIILRRTPGFLLIEKGFRDRLQKVKY

SEQ ID NO: 3541 - protein, 380 aa, unidentified
  source 1..380: note = Related to NZ_JAFMOV010000254.1; note = Rahnella perminowiae
MRSLQSLSSALDISLQELEMAKNMPCNIRYKKIELKKVNGDIRDVYNPHSLIRKIQKRINNRIFKTLIIWPDYLFGSVPSNKEEKKQGIERHYIACAKKHCQAKTILKVDIKSFFDNIHRDVVYSIFKKVFKYKGDALEYLVDICCYESNVVQGALTSSYIASLCLFDVEYEVFRRAERKELVYTRLVDDITVSSKTVGYNMSQILDHIRNMLMEKDLPLNEEKTQVHNISTESLKVHGLRVSFDTPRLPADEVGRIRASVHNLEQLSKKNNSLTSAAYRLEYNRCIGRVNKLKRLGNNKHPMLRDKLKAILPKAAKRDIDKLKRAVSYLESSFASVNSGKFYYKKKYDLTIHGLIILRRTPAFSSIEASLRQRLSLVKY

SEQ ID NO: 3542 - protein, 357 aa, unidentified
  source 1..357: note = Related to NZ_JAGKOO010000001.1; note = Providencia huaxiensis
MPYHERYKEIELKKSSGDVRIVYNPAHLIRKIQKRINNRIFKPLILWPNYLFGSIPKNELDKKEGIDRHYIACARKHCEAKTILKVDIKNFFDNIHRDIVYDVFKKVLKYKGEALEYLVDICCFGDKIVQGALTSSYIASLCLFDLEFDIVKRAARKQLVYTRLVDDITVSSKIVNFDMSQMLNHIKNMLLNKDLPINEKKTQVHNISTESLTVHGLRISFATPRLPAHEVGRIRASIHNLEQLSKKNNSLTSVAYRLEYNRCVGRVNKLVRLNHNKKDEFKRRLKAILPKASKKDIKEITRSINFLESSYALGNSNKAYYKKKYDLTIYRLIILKRTPSYHEMEAEFRNRLLNIKY

SEQ ID NO: 3543 - protein, 381 aa, unidentified
  source 1..381: note = Related to HF933424.1; note = Yersinia enterocolitica
LRSLQSLSNALDISISDLNAAINIPVEKRYHRLELSKVNGEKRIVFDPDHRVRKIQRRINKRIFKELILWPEYLFGSIPTNQSDKENKIERHYIACAAKHCKAKTILKLDIKNFFENIHRDIVVSIFSDVFQYKGEALKYLVDICCYNEYIVQGALTSSYIASLCLFDVEYDVFRRAERKGLVYTRLVDDITISSRVVDYDMAQIKSHVENMLNEKDLPINQKKTEVHNISTEALTVHGLRVSFNEPRLASNEVKRIKASVHNIVNLSQKNNSKTSEAYRIEYNRCMGRVNKLGRVGHNKYKLLLDTLKKIKPKASLLDLQSVHKLVGELEKLHVKGSYNEFEFKRKYNLAVFKLIVINRTDSYKPFSDWIKSRLEKIKPC

SEQ ID NO: 3544 - protein, 325 aa, unidentified
  source 1..325: note = Related to NZ_CABHWQ010000046.1; note = Yersinia alsatica
MSVNFPVKKPGAKSLRSLQSLSDALDISISDLQAAKKLTKEERYKRIEIPKVNGDVRVVYRPDHRIRRIQRRINKRIFKELILWPSYLFGSIPSTKPEKREGIERHYIACAQKHCNAKIILKLDIRNFFENIHKDIVEDIFSKVLKYKGDALNYLVDLCCFDDNIVQGALTSSYIASLCLHDLEYDVYRRAERKKLAYTRLVDDITVSSKTVNYDMGQIRGHIEEMLNKKDLPININKSEVHDVSTEPLTVHGLRVSFDKPRLASDEVRRIKASVYNITQLAMKNNSKTTVAYRIEYNRCMGRVNKLGRVKHNKHLVLLNILKAI

SEQ ID NO: 3545 - protein, 398 aa, unidentified
  source 1..398: note = Related to CPZT01000016.1; note = Yersinia enterocolitica
MSIIRPEKLKDSGSLKKLESLSRALGLSVNELKEVKSLPLSKRYTEVKVPKIDGTFRIVYKPDYRLRKVQRRINNRIFKELVSWPYYLFGSVPSSPDDKKNGIKRDYVNCAKKHCNAKTILKVDIKNFFDNIHRDLVEDIFKNFFKYKGEALEYLVDLCCNGGYIVQGALTSSYIATLCLYDIEFDIVKRAERKNLVYTRLVDDITISSKVSNFDFSQIKMHVEKMMLEKDLPLNLEKTKIHHISTEPLSVHGLRVSFDTPRLASDEVKRIRASLSNLIALSKKNNSITSATYRKEYDRCMGKVNKLGRVEHNKHPIFLNKLKNIRPLPSEKDACRALANIHRLEVMYKNGNSAKYSYIRSFHLASYRLIILSRTACFSRLVNSLRVRLKKIEPKLQN

SEQ ID NO: 3546 - protein, 399 aa, unidentified
  source 1..399: note = Related to NZ_MDKE01000022.1; note = Oceanisphaera psychrotolerans
MYIKKPQITTLNAIANVSNLCSVLDISEEELNQALALSDYDRYVQAKTEKNDGSFRTIHKPHYLLRKVQRRINTRIFQKIVRWPSYIFGSVPNTKDEGNNVVENKDYVSCAAQHCGAKSLLKLDIKDFFDNIDIFHVKKIFTGLFKYNCDVSNVLSDICCYRGVVVQGALTSSYIASLCLWDEEYKIIERLQRKGLVYTRLVDDITVSSRISNFQFDHAQSIISKMLQDKDLPINNNKTKVFHASIEPLMVHGMRVNFKEPRYPSDEVRRLRAAVQNIEKLSSEVGYRTTFAYRKDFNRCMGRVNKLKRVKHEKHQVLINKLNKILPLPSKTDLRRCKLAVKRLENDFNNKKESYWYKKRYYMAQDRLNVLQRTYYKTALKLRSRLNVIKPEYDNVENA

SEQ ID NO: 3547 - protein, 398 aa, unidentified
  source 1..398: note = Related to NZ_SODO01000004.1; note = Oceanimonas baumannii
MQKDKPYITTTNVISSIPNLCKSLNITEDELSQALSLGSDMYVRDRVEKSDGSYRVIHKPHYLLRKIQRRINKRIFQKLVGWPSYIFGSVPNTVNYKGEVVEPKDYVSCAAQHCGAKSLLKLDIKDFFDNIHIYHVERIFSGFFHYNEEVSKTLSQICTYNNVVVQGALTSSYIASLCLWDKELEVVERLKRKNLVYTRLVDDITVSSKVSNYQFDNASALIVEMLRSKDLPVNNNKTKVFHATIEPLMVHGMRVNFKEPRYPSDEVRRLRAAVRNVEMLASEPGYRTTFAYRKDFNRCMGRVSKLKRVKHEKHKHLVERLNKVLPLPSRTDLRRCKLSVRRLENDYNKKRESYWYKKRFYMVHDRLNVLQRTYFKTAYQLRERLKKIRPWYDHVENE

SEQ ID NO: 3548 - protein, 395 aa, unidentified
  source 1..395: note = Related to BADY01000010.1; note = Pseudoalteromonas sp.
MDRLIPEKSTFQSISNIKNLCAALDISEKDLSSALSLRDNEKYVIDHVEKSDGTLRKIHKPHYEIRKIQRRINKRIFKKIVLWPDYIYGCIPNEISSDGKLIKARDYVSCASQHCSTKSLLKIDIKDFFDNISAHLVFEMFSRFFKYNDEISQTLTKLCCFKGTLIQGALTSSYIAALCLWDLEHKVVSRLKRKQLTYTRLVDDITISSKTSNFQFDYALTLVSNMLLEKELPINLHKTKSSSSSILPLVVHGMRVNFEEPRYPSNEVKKLRAAVHNIEKLASEPGYRITHAYRRDFNRCMGRVNKLKRVGHNSHSKLVEKLLRVLPLPAKVDLKRSHTIVARLEKDFKEKHTSYWYHKRFYKAHDRLNILQRTYSKTAQELRLKLKAIKPKYEN

SEQ ID NO: 3549 - protein, 397 aa, unidentified
  source 1..397: note = Related to JAHKPR010000090.1; note = Colwellia sp.
MERLSPIKSSSKSISNKLNLCKTLDITIDELDSALTLPNNQKYITAYIDKPNGEQRKIHKPHYKIRKIQRRINNRIFKRLVLWPSYIYGCIPNEKDETTNITIQARDYVSCAAEHCTSTSLLKIDIKDFFDNISFYLVNDMFLNFFKYPTEVSKILSEICCYKGNLIQGALTSSYIAALCLWDCEEKLVARLKRKGLRYTRLVDDITISSTISNYQFDYAISCVTNTLNEKELPINPEKTSISYESITPLMVHGMRINFPEPRYPANEVKKLRAAVHNIERLASEPGYRITFAYRKDFSRCMGRINKLKRVKHSSHGKLVSRLQKILPLPAKVDIKRAKIMVDRLVKDFDEKKDTYWYHRRFYRAHDRLNVLQRTYNKTSKILREKLKGKSPTYDNK

SEQ ID NO: 3550 - protein, 399 aa, Vibrio sp.
  source 1..399: note = Related to REBK01000001.1
MCNLSPKKTTEHSISSIANLCDALDITPNDLDELSLLSDQDRYTRDTVEKSNGTLRTIYKPHFLLRKIQRRINRRIFTRIVEWPDYIFGSVPNTKGPDKKVIQRKDYVSCAAQHCESKSLLKIDIKDFFDNIHIYHVKKIFLDFFKYPEDVSELLADICCFEQRVVQGALTSSYIASLCLWDTEPQLVKRLQRNNLTYTRLVDDITVSSKVSNFQFEMAMSQITRILEDKDLPINYSKTKVSYVSISPLMVHGMRVNFSEPRYPSDELRKLRASVHNIEKLASQTGYRTTFAYRKDFNRCMGRVNKLKRVKHNKHAVLLKKLKKILPLPSKTDLKRISLSVKRLESDYLDKKETYWYRKRFYMAQDRLNILNRTFNQSAAQYRERLNRIKPLYDRVENG

SEQ ID NO: 3551 - protein, 366 aa, unidentified
  source 1..366: note = Related to UGTC01000001.1; note = Plesiomonas shigelloides
MNSLSPQKNTTESIASITNLCTALSISIDELNTVLQMEPSEWYVKDYVPKSDGSERVIYKPHHLLRRIQRRINKRILSRIIKWPEFIYGSVPNEKVDANTIIRKDYVSCAAKHCGAKSILKVDIKDFFDNIQQYHVLNIFRGFFNYSDEVSKTLANLCCYNERVVQGALTSSYIASLCLWDVETEVVKRLMRHRLVYTRLVDDITVSSTVSNFQFDSALSYIRSMLEGKDLPLNMAKTKSLYVSVEPLLVHGMRVNFPEPRYPSDEIRKLRASVHNLERLASQVGYRTTYAYRTDFNRCMGRVNKLKRVGHNKHAVLLKKLKKILPLPSKTDLKRINVTISRLESDFDRKRTRTGIRKDILRRMIG

SEQ ID NO: 3552 - protein, 395 aa, unidentified
  source 1..395: note = Related to CP000020.2; note = Aliivibrio fischeri
MYQLEPIKKTKQVIASIPNLCSALDITIDELNKALSLSSEERYVQGKVSKSDGSYRDVYNPHNLIRKIQRRINRRIFIKLVGWPSYIFGSIPNNIDKNGKVLEAKDYVNCAAQHCLAKSLLKMDLKDFFNNIHIDHVKEMFEKFFNYPKDVSEALSNICCRGDSLVQGALTSSYIASLCLWDLEPHLVKRLKRKQLIYTRLVDDITVSSKISNFQFDMTIEHITSMLHEMDLPINNSKTKVAYTSIEPLTVHGMRVNFKEPRYPSDEVRRLRAAVHNIESLASEPGYRVTFAYRKDFNRCMGRVNKLKRVEHEKHQTLVNKLLKILPLPSEKDLKRCKASILRLETDFPLKGDTYWYRKRFYIVHDRLNVLQRTYKRTALKLRNRMKPIRPEYDD

SEQ ID NO: 3553 - protein, 395 aa, Vibrio sp.
  source 1..395: note = Related to BODJ01000024.1; note = Vibrio cholerae
MYQLEPIKKTDESIASIENLCNTLDISLKEINEALSLSPDERYVYRKIPKSDGSYREVYNPHNLIRKIQRRINRRIFIKLVKWPSYIFGSIPNNVDSVGQVLEAKDYVSCAFQHCQSKSLLKMDLKDFFNNVHIDHVHDIFEGFFNYPSEVSRVLSDLCCREDSLVQGALTSSYIASLCLWRFEPLLVKRLKRKNLVYTRLVDDITVSSKISNFQFDMTIEHIKNMLYEMDLPLNNEKTKVIYTSIEPLTVHGMRVNFKEPRYSSDEVRKLRSAVHNIECLASEPGYRVTFAYRRDFNRCMGRINKLKRVGHEKHKTLVSKLLKILPLPSEKDLKRCKASILRLEADYPLKGDSYWYRKRFYILHDRLNVLQRTYNKTADSIRDRMKEITPKYDD

SEQ ID NO: 3554 - protein, 400 aa, Vibrio sp.
  source 1..400: note = Related to MCYK01000079.1; note = Vibrio lentus
MYAFQFHPIKKSTSVIANFKKLCEALNISEVEMKKALSLPPEERYVASSVKKADGSTRAIFKPHNLIRKIQRRINRRIFKTLVIWPSYLYGSIPNTIDPTTKKVIEHKDYVNCAAQHCSSKSLLKMDIKDFFDNIHRDYVSDIFTVFFKFPPDVSEALTSICCRENTLVQGALTSSYLANLVLWDIEGDLVKKLNRKNLTYTRLVDDITVSSKVSNFQFDLAISLISSALISKELPINTSKTQVSYVSSNPLTVHGMRVNFPEPRYPSDEVRKLRASVHNLQCLASQPGYRQSHSYRKDYACCMGRVNKLKRVKHEKHAVLIKKLNKIKPLPSEVDQRRCKQMLRRLQNDYKNKHLDYWYCKRFYRLHDRLNVLQRKSCFRDLAEKIREEMRLIKPTYDQ

SEQ ID NO: 3555 - protein, 400 aa, Vibrio parahaemolyticus
  source 1..400: note = Related to ABGCYW010000004.1
MRNIRPALTTSKPIKSLASLESTLGLSSKQLSEILDIPECQKYVEKAVPKPDGSLRTVYRPHPLIRKAQRRINNNIFKEIVIWPSYVFGSLPNSVINQDEIERKDYISCAAQHCGAKSLLKMDIKSFFDNIHIDYVNHMFCNFFDYSSDVADILSRLCCRGDFIVQGGLTSSYVASLILWEFEPKLVKRLTRKKLIYTRLVDDISISSKISNFDFSMTKSLVTNTLHELDLPVNERKTKVSYVSTEPLSVHGIRVNFKEPRLPSNEVRCIRAAVHNLTVLASQPGYRTTHDYRSDFSRCMGRVNKLKRVEHEKHKDFLEILQNIKPLPSPKDLKRAREMLGRLERDYTTQSGSRGYRTRFFRLQERLNVLSRKKEYLNDAKKIRHKLKSLKPDETARSNF

SEQ ID NO: 3556 - protein, 397 aa, Vibrio sp.
  source 1..397: note = Related to NZ_POSL01000026.1; note = Vibrio diazotrophicus
MRNLNPTLTTVKPITTLERTLGLDSNEISTILAIPENQKYVEKTVPKADGSLRTVYRPHPLIRKAQRKINNNIFKEIVIWPSYVFGSLPNSVIDKNEIERKDYISCAAKHCGAKSLLKMDIKNFFDNIHIDHVVSMFINFFGCKAEIANTLSRLCCKGEFIVQGGLTSSYVASLILWQLEPELVRRLSRKKLTYTRLVDDISISSKTSHFDFSMVISLVTNMLHELDLPVNETKTKVSHLSTEPLSVHGIRINFKQPRLPSNEVRRIRASVHNLTVLASQPGYRTTHDYRGDFARCMGRVNKLKRVEHEKHSEFLSILQKIKPLPSPKDLTRAREMLSRLERDYSDKNETRGYRTRYFRLQERLNVLYRKKDYICEAKSIRKKLKSIKPNENARNNF

SEQ ID NO: 3557 - protein, 400 aa, Vibrio sp.
  source 1..400: note = Related to NZ_CP051101.1; note = Vibrio navarrensis
MYLSQPSLNTKNAINSMAALEKTLGLTAKEIQSIISLPESQKYFEKKVPKSDGSIRLVYCPHPQVRRAQRKINNNIFKKLVKWPSYIFGSIPNTKISKEQIEKKDYISCAGQHCGAKSLLKMDIKSFFDNIHFDHVLDMFVNFFHYDKDVSFTLAKLCCKSNYIVQGGLTSSYVASLILWRHEPELVKRLQRKNLTYTRLVDDISISSHVSNFDFSMVQQLVTNMLYEIDLPVNNDKTKVYHLSTEPLTIHGIRVNFNEPRLPANEVRKIRAAVHNLTILASQPGYRTLHSYREDYARCMGRVNKLKRVQHEKHSEFLKTLQNIRPLPSEKDLKRARVVYHRLMRNYSEKKDTRGYRTSFFKLQERLNVLCRKKCFREEAQKIRRKLKEIAPSKQAKENF

SEQ ID NO: 3558 - protein, 400 aa, unidentified
  source 1..400: note = Related to NZ_CP068230.1; note = Shewanella algae
MTIIEPSLNTPNVIASIRALEKTLGLTQQDITTALEIPESKKYHVKQVPKQNGELRSVYRPHPLIRRAQRRINNNIFKKIVLWPSYIFGSLPNTINKNNEVERKDYISCAAQHCGAKSLLKMDIKDFFDNIHIDHVRSMFIHFFKCGDDVADILAKLCCKENHVVQGGLTSSYIACLILWNIEHKLVNRLARKNLTYTRLMDDITVSSKISNFDFSMTTNLIANMLQELDLPINTSKTKVCHLSTEPLTVHGVRVNFKEPRFPSNEVKRIRASVHNLTILASQPGYRLTHDYRSDYARCMGRVNKLKRVNHEKHKEFLVILQKILPLPSVRDKKRAKQMFIRLIKDYRIKYKTKGYRTRYFRLQERLNVLSRKKDYLNFTKYIRKKLKNIKPDEHSKTDF

SEQ ID NO: 3559 - protein, 401 aa, Vibrio sp.
  source 1..401: note = Related to JAHUCR010000005.1; note = Vibrio fluvialis
MTIIKPQKIHPTTIASKSALCVTLGFTLLELNEVLSVPSSERYKRKEIDKPDGSKRVVYNPHPLIRRAQRRINTNIFKKLVSWPYYLYGSIPNTVIKESGLPKIIIRKDYVTCASKHCGAKSLLKMDIKNFFDNIHENHVRNLFLRFFHFSPEVAHILTNICCHESNVVQGSPTSSYIASLILWDVEHLAVKKISRKNLVYTRLVDDISVSSKSSKYDFSMIEDIITQMLTSRDLPVNKKKTKHCYLSTEPLTVHGIRINYKEPRFPSDEIRRLRSYVHNLQTLAKQPGYRTTHSYRTDYAICMGKVNKLKRVNHNKHFIFLEQLRAIRPLPSEDDLDRCRYVIARLDAYNTIHGNESFSYRKRFYRLQERLNVLQRLSKYKTAAKEMRARLKSLRPPNEV

SEQ ID NO: 3560 - protein, 408 aa, unidentified
  source 1..408: note = Related to NZ_PJPV01000060.1; note = Endozoicomonas acroporae
MAKPLLFNLKTMYQILKPEKINSKSISSLDNLCEALNISVDELNEALNLPESEKYTEKTVPKSNGAIRHVFKPHHLLRKIQRRINKRIFTKLVKWPSYLYGTLPNDLDGNGDIILNRDYINCARQHCQSKSLLKVDIKDFFDNIHEDYVFEIFHVFLKYPDDVSKALTKICCHNKNVVQGALTSSYISCLSLWNMEHKIVKRLQRKNLIYTRLVDDITVSSKVSNYNFDAALSHIKNMLYERDLPLNIEKTRPYYISMEPLTVHGLRVNFDTPRLPSDEVRKIRAAVHNISKLSSEPGYRTTFAYRKDYNRCIGRVNKLKRIGHEKHEALLKKLIEIPPLPSRKDIERTRASIERLERDFQSKGSSYWYYKRFYRAHDRLNVLQRRFDVIASELRDRLKEIKPLYDKN

SEQ ID NO: 3561 - protein, 421 aa, Aeromonas sp.
  source 1..421: note = Related to NZ_KQ087566.1; note = Aeromonas caviae
MSILQYMNENQPIQAPIKPTLKTSKKISSPENLLVALGLSASELNCALYMTSAERYTAKKVPKSSGGERIVHIPHPLIKKIQRRINNRVLSKIVVWPYYLFGSVPSEIDVLYEDAILKRDYISCAQQHCKAKSILKYDIENFFDNIHYDLVNDIFINFFKFDCDTARILSDLCCIDSEDGSHIVQGAPTSSYLACLCLWDIEHDIVQRLKRKNLIYTRLVDDITVSSKIYDYNFENAKKSIEDMIHEKDFPINKAKSRALSTSSEPLLVHGLRVNFHTPRLPSDEVGRIRASVKNVELRAATNNFRTSKAYRKAFERCLGRVHKLARVGHNAHTKLRDRLLKIQPLPSQRDIDRVKHNVTRLEILAANGCDDLRYSRSYYISMYILNIINRTERYKPLVSELRARLHAIAPSKEVGGTYFD

SEQ ID NO: 3562 - protein, 408 aa, Aeromonas hydrophila
  source 1..408: note = Related to VHIX01000003.1
MAPLQPTLKTTKKIASSANLLTALGLDESELSSALAMTPAERYTAKKVPKSSGGERTVHIPHPLIKKIQRRINNRILSKIVIWPYYLFGSVPSEIDVLYEDEILKRDYISCAQQHCRAKSILKYDIENFFDHIHYDLVYEIFTNFFNYNDETSKTLSNLCCMESDDGHHIVQGAPTSSYLACLCLWDIEHKVVTRLERNNLVYTRLVDDITISSKIHDYNFENAKKSIEDMIHGKDFPINKAKSRTFSISNEPLLVHGLRVNFNTPRLPSDEVGRIRAAVKNIELRAAKNNFRTSKAYRKAFEKCLGRVHKLARVGHNSHIKLRDRLLKIKPLPSMRDINMVKRYIDRLEVQAKSGVDDIKYSRSYHITMYYLNIINRTERYQSLVSELRARLHLITPSKEDRGTYFD

SEQ ID NO: 3563 - protein, 408 aa, Aeromonas sp.
  source 1..408: note = Related to CP023817.1
MAPQKPTLKTDKKIASLANLLTALGLDESELLSALSMTYLERYTPKKVPKSSGGERTVHIPHPLIKKIQRRINNRIFSKIVIWPYYLFGSVPSEIDVLYENELLKRDYISCAQQHCKAKSILKYDIENFFDHIHYDLVYEIFTKFFKYDHEVSRILSDLCCIDGEEGNHIVQGAPTSSYLACLCLWDVECNIIKRLERKNLVYTRLVDDITVSSKIHDYNFENAKKTIEDMIHGKDFPINKEKSRTFNISNEPLSVHGLRVNFNTPRLPSDEVGRIRASVKNIELRAATNNFRTSKAYRKAFERCLGRVHKLARVGHEAHIKLKERLRKIKPLPSPKDVNKVKHYVDRLEVIAKTGCDNIKYSRSYHITMYYLNIVYRTEKYRPLVSELRSRLHAIAPSKEEKGTYFD

SEQ ID NO: 3564 - protein, 422 aa, Aeromonas sp.
  source 1..422: note = Related to JAIEYG010000002.1; note = Aeromonas veronii
MSILKNVTNSSVSVAPNKPTLKTTKTIASLANLCTALGIDSSELDAARSMTSSQRYVEKKVPKSSGGERTVFIPHPLIKKIQRRINNRVFSRIVVWPYYLFGSVPSEIEVTHHNDILKRDYISCANQHCKSKSILKYDIENFFDNIHYDLVYELFTDFFHYSDDVAEVLSDLCCINGVNGYVVQGAPTSSYLASLCLWDVEYKVVKRLERKNLVYTRLVDDITVSSKIHDYNFENARQAIEEMILNKDLPINKSKSKSFSISSEPLSVHGLRVNFNTPRLPSDEVGRIRASVKNIELRASTNNFRTSKAYRKAFERSLGRVHKLARVGHEAHRKLKDRLLKIQPLPSKRDVQRVKRAVDLLEQKSKGCVDEIRYARSYHIAMYYLNIVNRTDRYKPLVESLRTRLHLIAPDKEKHGDYFEEV

SEQ ID NO: 3565 - protein, 390 aa, Vibrio sp.
  source 1..390: note = Related to NZ_CP019291.1; note = Vibrio vulnificus
MPKLISKNKISSVDNLCRALDISRCELDAIYALNDDEKYSEPSKLAFKKDGKKRVIKCPIPIIRKVQNRINSRIFKTLVKWPEFLFGSIPNDEFEDIELKKDYVTCASLHCEAKSLLKIDISDFFSNIHEDFVRELFLDFFNYDEDLVDYLIKICCYKGTLVQGALTSSYIASLILWNEERYVVRKLERWGLVYTRLVDDITVSSKRSKYNFSIAEHHIYEMLFKKDLPVNKEKSKTFFSSSSPLTVHGLRVSFKTPRLPSDEVRRIRAAVQCLENLYSEPNYNTSYSYRKDFQRCVGRVNKLARVHHEKHKPLMNRLRKIRPKPSEIDLKISKKILSKLKMEYDDKKDKYWYKKQYWQLVDRVNLISSTYHKEACYFRNELKNIKPEFD

SEQ ID NO: 3566 - protein, 390 aa, Vibrio sp.
  source 1..390: note = Related to DS179564.1; note = Vibrio campbellii
MPRLISKNKISSVDNFCHALDIPRQELDLIYSLTDEDKYTEPAKLAFKKDGKKRVIKCPTPSIRKVQSRINSRIFKKLIKWPEFIFGSIPNDDFEEHELKKDYVTCASLHCEAKSLLKIDISDFFSNIHQDFVEELFKNFFKYDEELVKYLVHICCYKGTLVQGALTSSYIASLILWDEERKVVKKLDRWGLVYTRLVDDITVSSKTSRYNFSVVEHHIYEMLFKKDLPVNKEKSKIFFSSSSPLTVHGLRVSFKTPRLPSDEVRKIRAAVQSLEVLYSEPNYNTSFSYRKDFQRCVGRVNKLARVSHEKHKPLMNRLRKIKPKPSEVDIKIAYKVLAKLKKDYTNKKDKFWYKKQYWQLVDRVNLISTTFYFEAASIRKDLINIKPEFE

SEQ ID NO: 3567 - protein, 389 aa, Vibrio parahaemolyticus
  source 1..389: note = Related to JABCGZ010000001.1
MPKIIPKNKISKVDNFCQVLDISREELEAIIQLNDEDKYLEPKTLAFKKNGKKRLVKCPIQPLRKIQKRINNRIFKEIIQWPEFVFGSVPNDDELEIQKDYVTCASLHCEAKSLLKVDISDFFLNIHEDFVRDLFKRFFNYDEELCDYLVALCCYNGTLVQGALTSSYLASLILWDLERSVVNKLKRWKLTYTRLVDDITVSSKISKFNFEIAEHHIKNMLMLKDLPVNSNKSKVIYSSSSPLMVHGLRVSFKTPRLPSDEVRRIRAAVQSLERLYNEPNYNTSFSYRKDHQRCTGRVNKLARVKHEKHKALMRRLKKIRPNPSIVDVKIAEKILVKLKKDYPTKHSKYWYARQYWKLIDRINIINQSFIIDAKRLRAEASKIKPENTI

SEQ ID NO: 3568 - protein, 391 aa, unidentified
  source 1..391: note = Related to JADQAO010000002.1; note = Photobacterium damselae
MPKITTTKKISNIDNFAKAIGVSKEYIDSVISLSDDDKYTDPKKKAFKKDGKIRIVKCPSSKLRKIQSRINTRIFKDLIKWPDFLYGSIPNDDDGEIEIKKDYISCASRHCEARSLLKIDISDFFLNIHESFVYDLFNKFFKYDDELCRCLVSLCCYKGTLVQGALTSSYIASLILWDVESNLVRRLERWQLVYTRLVDDITVSSKVEKYNFDIAKYHIKEMLFSKDLPINEKKTSVSYNSSTPLMVHGLRVSFKTPRLPSYEVKRIRSSVQSLELLFKEPGYNTSFGYRKDYQKCMGRVNKLARVQHNKFPILMNRLKKIRPKCSKLDVKISRRILRKLQEDYPQKKDMFWYKKQYYKLIDRINFISNTFKSEAHEIRLDAKKISPPEDD

SEQ ID NO: 3569 - protein, 395 aa, unidentified
  source 1..395: note = Related to NZ_CP019628.1; note = Pseudoalteromonas aliena
MIQPKYKFGPIKDLNQLAASLSYTLKELNTLLSTPDDKKYSDPSQPAYKKDGSIRKIKNPSDDFRRVQGRINHRIFKQGIEWPSYLFGSIPKESAGRETDYIECARRHVEAKSICKIDITNFFDNIHEIFVYEMFLELFRFPEPVAKALTNLCCYNKSLVQGARTSSYIATLILWKEEGRIFERLSRKNLVYTRLIDDITVSSKIANYNFDVPKKHIENMLLEIDLPVNEDKFKIQYTSMTPLEVHGVRVTYSKPSFSKSEMMNIKAAVHHLEVLVKTPNTRTEMWYRKDYNRCMGRVNKLARVKSPRHKKLVKKLKVIRPLPSLKDLNYSKIRLKNLKEDSKNSKKIASYSYYKRYFLLMNRTNLIKLTYPDKAKALRNELYKIKPKYNPKDFK

SEQ ID NO: 3570 - protein, 390 aa, unidentified
  source 1..390: note = Related to JAHKPW010000058.1; note = Colwellia sp.
MDIPKYNHPPFVELDKLCKMLRISRTELENILSSPSDVRYKDPKTTAYKKDGSIRKIKCPLKELRSIQEKINNNIFKTGFYWPKYLFGSIPKKAALSNRDYVSCVSLHCRAKSICKIDISNFFDNVHISLVKSVFKNLCHFSDEVTDVLADLCCYNDFLVQGALTSSYLATLILWDKEPELVENLKKKGLVYTRLVDDITISSRISNYNFDIATKRVEVMLLEKDLPINKSKYEYNYLSIEPLTVHGLRVSFDKPKLPKHESSNIRASVKNLENLAQLDSARTKMWFRTDYNRCMGRVNKLARVKNQKHQALVERLKVIEPLPSINDIKYARLRLKNLEADYSTKKKTFNYKKRYYKLNQRIHLISKTYPDVAKKIRESLKEVPPDEKPI

SEQ ID NO: 3571 - protein, 391 aa, unidentified
  source 1..391: note = Related to JAGJEH010000004.1; note = Pseudoalteromonas luteoviolacea
MDSNLYRDNPINSIRNLLAALDISESEYEKFLITKEEDRYHRPHAEAFKKDGSVRKVYCPCKLTRKFQRRLNNRIFKKSIVWPPYVFGSIPIDVKTHESKDYIKCAAMHCKSKSLLKLDISDFFDNIDQYHVVKIFTEAFSYHQEVADFISKICCFKGHLVQGALTSSYVANLIFYDLEPELVKSLSRKNLTYTRFIDDITVSSKVSHYNFSSTKRLIEDMLLKKNLPLNEQKVEVLYSSTKPLMVHGLRVDFSEPRLPSKEVANIRAELNNLKRKAKEKKYRKSRSYRKSYDKCLGRVNKLARVKHSAHAKFKPQLKEIQPLPSAVDIKLCHVILKKLASFPDDKRESYWYKKRFNQLVYLNGIIKRLYPKSYSIIKEKSKELEPKSRVY

SEQ ID NO: 3572 - protein, 394 aa, unidentified
  source 1..394: note = Related to NZ_CP011034.1; note = Pseudoalteromonas translucida
MEIKYYRGDPIKKLENFISFLDLEDDYEAFISSNSSSRYREPVKSAYKSDGSKRRVLCPNKLTRKFQRRINNRFFKPKIIWPEFVYGSIPKLINGIEDSRDHIKCAEKHCGAKSLLKMDISDFFDNIHKEHIKDILVNTLDLSNEVADFICDVCCFENTLVQGALTSSYVANLIFFDLEHLLVKRLERKGLTYTRFIDDISVSSTASNFNFNTAKKLIEDMLLQKDLPINEQKEEVSYSSIKPLMVHGLRVEFDQPRLPAKEIAKIRAEVHALTKKAQENNFRKSRSYRRSFDRCLGRIHKLARVKHPKHGYFKNALSDIQPLPSAVDIKHCFFIIKKLETYPDSYREKYWYKKRFNLVVYMNGIIKRLYKDKYTEISERLKEIEPKDRKYDIG

SEQ ID NO: 3573 - protein, 387 aa, unidentified
  source 1..387: note = Related to BCAI01000026.1; note = Pseudoalteromonas sp.
MDYCKYPKAPILSIKKLCLHLGVAESNLKKALLIPHNLRYKDPSSPAYKKDGSRRLIKSPKDPIRTIQRKLNSRLFSHVKWASYLYGSIPKGKNGDIKDYIGAAKVHCQAKSICKLDISDFFNNIAEPHVIEMFRLFFRFSETVSKDLANVVTYKGNLVQGALTSSYLAMLLFWDLEPQLVSRLKSKGVKYTRLVDDITLSSEVHNFDFKLSIRLVEEMLAKKDLHLNEVKVKSSYISTELLLVHGLNINNDTPCLPKGELRKVRAAVHNLCSEADEEIRKEYWYRKEFEKCLGRVHKLKSFGKTRSFNNLMNKLNRVKPLASKQDLKYAMKRVASLKRDYKNRRKRSSFTYRKRYFIAQYKVGFLKDDYSLEHNLLRSELKRVKPK

SEQ ID NO: 3574 - protein, 370 aa, unidentified
  source 1..370: note = Related to JACJDY010000006.1; note = Pseudoalteromonas sp.
MSLHLGVQTSDINKALLIPADSRYKDPSSPAYKKDGTKRLIKSPRDPIRTLQRKINTTLFCHLKWANYLYGSIPKGKEGDVKDYINAAAIHCQRKSICKLDIADYFNNITEHHVNNLFNDFFRFSEDVSKVLTDIVSYKSNLVQGALTSSYLAMLLFWDLEPQLVTRLKYKGIKYTRLVDDITLSSNVHDFDFSLAIKLVEDMLKEKDLHLNQVKIQSSSISTQLLLVHGLNINNKLPCLPKGELKRIRAAVHSISCVTDEKMRRENWFRKDYEKCLGRVYKLKSFGKNKSFNNLINKLNKVRPLASSKDLKYAKKRVQSLKSDYKRGKKKESFAYRKRYFFAQYKIGFLKVEFPQAYFILRSELKKVKP

SEQ ID NO: 3575 - protein, 393 aa, unidentified
  source 1..393: note = Related to NZ_CP064795.1; note = Salinimonas sp.
MDRCSYINSPISSLSSLSKTLGEDISQIVAVADAPASEKYNKPKTPVFKKDKTERIVRSPVRALRSLQYRINKQIMVKGVSWPSYLFGSIPKGHNGEVSQDYIAAAKVHCGAKSLCCLDISDFFDNIHACDVFAVFNELFHFSTEVSTILTKLVTFDERLVQGALTSSYLAMLVLWKTEPGLVEALGRKNINYSRLVDDITLSTKKYNYNFSYEVSLIEKTLHEKGLFFNEEKAKVYSVSSELMLVHGLNVMGKNPAMPRYEARRIRAAVRQLEKLAEQEGARCEMWYRREYNRCQGRVYKLERFGKSNSFRNLLNRLQKITPLPSKKDITYAKLRVKKLESDFNNVKKRETYNYMRRFSIASHRVAFLKGYYDEEWKKLRTRLKAIFPDYRK

SEQ ID NO: 3576 - protein, 401 aa, unidentified
  source 1..401: note = Related to NZ_LRRU01000020.1; note = Pseudoalteromonas gelatinilytica
MTTPDIPLFKAGPIKSKAHLAKVLNIDISDIDDVLNMPLDKRYRPPKNPILKSDGTIRKIFNPHRKVRFLQRRINNRINKQCIRWPSYIYGSIPKSIENGNRDYVECAHKHCGAKSILKVDISNFFDNIQEFHVKNMFKNLFRYSDEVSEIITNICCYGDRVVQGALTSSYIASLILWDVELYLVRKLKRLNLTYTRLVDDITVSSTSHNFDFNGTSKLIEEMLNEKGLPQNIDKTRVYRLSSEPLKVHGLVVSFPNPIYSKDEVKNIRAAVHQLKHRAEKQEDQKSKSYRNDYQRILGRVNKLSRVKNDKHAKLIKILRSDGLRPKPSQSDKISAEKRFDKIVIDYSRKKSQYNFYKRYHYLKHLLFFIKGEGGSDYKKFAQDKLDKLSRYEPEFKIKDY

SEQ ID NO: 3577 - protein, 341 aa, unidentified
  source 1..341: note = Related to CP069213.1; note = Shewanella litorisediminis
MDNIKPIFQAGPIKSISRLVTALGITLSELEHVLHLSPNERYSDLKNPIYKKDGSVRVIKNPNRDIRKIQFRLNQRISKACVRWPDYLFGSIPKTDQSGNRDYVACAQVHCGAKSILKLDVSSFFDSIHKDHVYSLFHGLFRYSEEVSLCLANICCYEDHLVQGALTSSYIATLILWDVEQELVRKLRRAGLKYTRLVDDITISSTCHGYDFSMAEKLVFDMLAAKSLSLNVKKSVVYRTGTESLKVHGLEVSFSKPNLPKSEVKKIRAAVHQISLLAKNKSVRRTYKYRANYHRTLGRVNKLARLENDKRDRFLKVLLSTSVRPLPSGRDTGRDSTLCII

SEQ ID NO: 3578 - protein, 391 aa, Acinetobacter sp.
  source 1..391: note = Related to NZ_VOXY01000007.1
MNTKFEFLGSPIKDIDHLAKILDVDIEDILYAVQIEDEDKYSSRTIAKKDGRERTVYNPKPIFRKIQRRIKNRIFSQISWPDFVFGSIPADDNSHDFIECAQQHCLAQSILKLDIEDFFDNISQELVESIFKKFFRYPDPVSEILATLCCVDLKVPQGGITSSYLASIALHSLEENLFLRMKSKKLTYTRYVDDITISSKNRDFNFEAIINIVESLLNNLNLPLNKKKIEINRFSSIPLTVHNIRVDFKSPRYDKTEVKNIRAAIHRLSELAKKPNHRTHYYYRIDFNRCQGLISKLQRVNHQSYTKLQNKLNKIYPLPNDSDIKYIEKSIKELKVFFPKQIGEGNYIYNKKFFKIQHRIGFLKSHPKKIYDSKAFDLNAELQLYRIRNKV

SEQ ID NO: 3579 - protein, 390 aa, Acinetobacter sp.
  source 1..390: note = Related to NZ_CP088955.1; note = Acinetobacter calcoaceticus
MNTKFEFLGSPIKDIDHLAEILDLDINDILFAAQLDDADRYTSRSIAKPDGRERIVYNPKPIFRKIQRRIKNRLFTQISWPDFVFGSIPADEKSHDFIECAQQHCLAQSVLKLDIEDFFDNITMRLVQDIFEIFFHYPEDVSEILAQLCCVDLKVPQGGITSSYLASIALFSLEEKLFLRLKSKKLTYTRYVDDITISSKNRDFNYDSIINIVENLLNSINLPLNKKKIEVNRFSSTPLKVHNIRIDFKEPKYDKSEVKNIRAAIHRLSELAKKPNHRTHYFYRIDFNRCQGLVSKLRRVNHPSYLKLQDRLNKIAPIPNNADVKYIKNSIIELIKYFPQQKGEGSYVYNKRFFKTQSRIGFLKSHPKKIYNNLAVQLNTELQLYRMRGK

SEQ ID NO: 3580 - protein, 399 aa, Acinetobacter sp.
  source 1..399: note = Related to NZ_VPEJ01000008.1
MNELTKIIYKGGPISRSELSTVLGVDEIELDFILMLEDEAKYKSSQLVKNDGRFRNINNPSPIVRKIQRKIKNRIFSLISWPVYLYGSIPAENENSHDFIACASRHCRAKSLVKLDVEDFFDNISQELVQKIFENVMFFDKDAADTLAKICCLDGRVPQGGITSSYLATLALYSIEERLYFRLKNKKLVYTRYVDDITISSKDRDFSFDMIIKIIEKELNSLDLPLNKDKVEICRFGLEPLKVHNVRVDSKLPRYDQADVKRIKAMVHRLELLVKKPNYRTHYFYRQDYNSCMGFINKLGRVEHPSYFKLKNKLKKIFPLPNNADVTYVRNSIDNLKELKLNSKNAFVYQKKFYKIQYRIALLKKHPKGIYNAKAVELNRELQLLRLNDELERKTESGN

SEQ ID NO: 3581 - protein, 392 aa, Acinetobacter sp.
  source 1..392: note = Related to AP022302.1
MIKSKYIYKGSKIDSLDKLSEVLSIDIDELTNVLLLEDEAKYKAGFIKKSNGKLRNIYNPNTSLRKIQRRIKNRIFTQQIEWPDYIFGSIPADEISSNDYVASAEKHCGARALLKLDIEDFFDNITQELVEKIFKNFFKYNDELSKILAQLCCVDGKVPQGGITSSYIASLALFSIEERLFFRLKNKKLIYTRYIDDITISSKNSEYNFDSIIKIVEGQLNSIDLPLNIDKIKVERFSSKALKVHNIRVDLKTPKFDKIEVKNIRAAIHRLEQLVKKPNYRTHYFYRIDFNRCQGLVSKLSRVNHVSVEKLQRKLNAIKPLPNKADIKFIEDSIKSLKKHFPLQKENGSFIYNRKFFKIQHRIGFLKSHPKGIYTEKAISLNTELQKYRLIR

SEQ ID NO: 3582 - protein, 394 aa, Acinetobacter sp.
  source 1..394: note = Related to NZ_CP045101.1; note = Acinetobacter johnsonii
MNNVNFVYRSKKFQKFLDLAKRLDLSAAEILKISKIPDSEKYETDEIEKSDGRIRKIHKPCADIRKIQRRINKRIFNAVIWPNYIYGSIPANKLNNENKDYVECASMHCQARTILKLDIEDFFDNVSEDLVYRIFNKLFGFSEKVSLVLARICTVDGALPQGGLTSSYLASLALFEIESNIYSRLKNKKLTYTRYVDDITISSKKDNFNFQSTINILEVALNSIDLPLNQAKINVSNFSSELLRVHNIRVDQSKPRLDKAEVVKIKDNVSRLKEIAFDKKQPNIRTYYFYREDFNRCLGLINKLGRVNHPSYEKLNKALMKIYPIPNLSDIQYVRDSINKLKNLYPAYMNSYIYRKLFFRIQHRIGFIKKHKIYEKTARNLNLELQKYRAMYEK

SEQ ID NO: 3583 - protein, 398 aa, Acinetobacter sp.
  source 1..398: note = Related to NZ_CP067019.1
MTIPDKYLFKLNTTNKISSLNNLASALGVTLSDLKYAANLPDNKKYEHFFIKKSDGRERLIHKPCKEIRNIQRRINHRIFKPLVIWPVYLFGSVPSEKHEPAHDYINCAKRHCLSKSVLKLDIKDFFDNIDESLVKKIFREFFKYSESVVNILTKICCVNGHVPQGALTSSYIASLCLFSIEPLLAQRLNNKNLRYTRYVDDITISTTKHKFDFNATINIVENLLNSVDLPLNIEKIKTEYFSTEPLKVHNLRIDFNKPRYDKSETKNLRAAINRLSIQKKIPNYRSHYFYRSDYNRCVGLINKISRVNNPCSNRFFKKIKKIKPLPNPNDLEYVRKSIFELIRDSLTHKNTYRYRKKFFRTQQRLIFIRSHPQYIYEGSANALNILLQKYRLNYEEK

SEQ ID NO: 3584 - protein, 398 aa, Acinetobacter sp.
  source 1..398: note = Related to ABDHTD010000004.1; note = Acinetobacter baumannii
MSLPENYLFRLNTANKISSLNNLAKALGVQVSYLRKIADLPDEKKYEVFSIKKNDGRERLIHKPCKEIRNIQRRINHRIFKPLIIWPTFLYGSIPAEKEEPVNDYINCAKKHCLSKSVLKLDIKDFFDNIDEALVKNIFRDFFKYSEAVSNLLTKICCVNGHVPQGALTSSYIASLCLYSIEPILAQRLNNKKLKYTRYVDDITISTKKNNYDFNATINIVEGALNSIDLPLNIEKIKVEYFSTKPIKVHNLRIDFKTPRYDKDEARKIRSAIDRLVKQKEIPNYRSHYFYRADYNRCIGLINKINRLKHPSSKNFLKKILRIKPLPNPNDLDYVRRSIFELSRDYAIMKNSYQYRKKFFRIQQRLIFIRSHPQMIYENSAQVLNSILQKYRPLYEEK

SEQ ID NO: 3585 - protein, 391 aa, Pseudomonas sp.
  source 1..391: note = Related to CP061850.1; note = Pseudomonas aeruginosa
MDELKVRLKDGVDPIQSVDNLCSALDIPRSELDEVLALSDDERYIEISLPKSNGSRRLVYDPHPRLRRIQRRIKSRLLVSQILYPRYLYGSLSDSEYPRDYIRCASIHCGAKVLLKADIKNFFDNISRRLVLEIFERVFHYPEEVSDVLSDLCTRAGVVPQGASTSSFLANLCLLNEWCFVRDIQYEKLRYTRLVDDITISSTTTGKDLSRCMRTLTAMIESAGFELNENKTGIEHVTTKAFSVHGLRINKPSPCLPREEVRRIRADVHNLKRKASVPNARVSFEYRKLYESISGRVNKLKRLNHGRYNELRRQMNAILPLPSTKDIKRCQIMLATLERDYDLHRDSYLYKLRYSRLIHRLGILKRIYLHEAAAIRDALQDLKPEFVNEAD

SEQ ID NO: 3586 - protein, 390 aa, Pseudomonas sp.
  source 1..390: note = Related to NZ_LR130779.1; note = Pseudomonas oleovorans
MEELKARTKDGIDPIQNLDNLCDALGISREELDTALSLTDEDRYVEIKLRKKNGSTRIVYNPHPKLRRIQRRIKNRILSSQIIYPHYLYGSLSDKENPRDYIRCAAVHCGAKTVLKVDIRNFFDNISRDLVFEVFKTILHYPPEVSDTLANLCTRCGVVPQGASTSSFIANLCLLDEHDLVRKLSYDSLRYTRLIDDITISSKTPNKDLEKWMRVLKRMIEDSDFELNEEKSGIEHVALKAFSVHGLRINRSTPGLTREEVRKIRSDVHNLKNKASEPNARVSFEYRRLFESVSGKVNKLKRVNHPRYNILRKQMRDILPLPSKKDIKRCQIMLATLVRDHANHNSSYLYKVRHARLRHRLGILRRIYHHEAAAMRQTLRGLEPNFSDDT

SEQ ID NO: 3587 - protein, 390 aa, Pseudomonas sp.
  source 1..390: note = Related to NZ_WIFO01000002.1; note = Pseudomonas stutzeri
MDEFSPHAKPNIAPIQSIANLCNALSLTREEFDYASSLATPNGYIPIELTKKDGSKRTVFDPHPALRRVQRRIKNRILATNVVYPKFLYGSLSDPDHPRDYVRCAAIHCGAKTIAKIDISNFFDNIDYDLTFRIFADILHYPREVSLALANICTREGTIPQGAATSSFIANLCLFEEGGLVEGFTRENLRYTRLVDDITLSSTSTQKNLTRHFSKLEKMLQDAGFTLNVDKSGIEHISTKAFSLHGLRISQASPQLPREEIRKIRADVHNLKQEAAKANARVSFNYRRLFESVSGKVNKLKRLEHPRYQTLRAQLTDIRPLPSKRDIRRCQVMLATLKRDFPDHSESYLYKKRYFRLRHRVGILRRIYEREAQKITQELKDLKPRHVDEH

SEQ ID NO: 3588 - protein, 392 aa, Pseudomonas sp.
  source 1..392: note = Related to NZ_CP035088.1; note = Pseudomonas viciae
MDEYAPQKTTSESIFSIDNLLAALGLSEAEYKSIQDLEEKNRYTPLHLKKKNGDDRVVFDPHPLVRKFQRRIKNRLFNQIRYPTYLYGSISDPEHPRDYISCAQRHCKAKTILKIDITSFFDFIDYDLVYKIFNELFFYSDEISEALANICTREGVVPQGAPTSSFIANLCFFDTEGRIVKGLERQQLSYTRLTDDITVSSAIQDKDLNKAKSTIVSMIEHAGFKVNEAKTSIESISTTAFKVHGLRVNKETPQLPRDEIRAIRAAVNNLKILSREPNARTSFDYRKRYESISGRVNKLARTGHPRYKKHRLELKSILPLPSQKDIRRCLTMLSTLMRDYDVFCSTPLYMKRYHRLRHRLILLQRVYKHEAKKIWTELKVLTPTKSKAEHEL

SEQ ID NO: 3589 - protein, 392 aa, Pseudomonas sp.
  source 1..392: note = Related to UETT01000008.1
MDEYVPKKLTDESIFSVDNLISALGICEADFKIIQSLETKDRYTAINLKKKNGDDRIVYDPHPLIRKIQRRIKNRIFTQIRYPKYLYGSISDPDCPRDYISCASRHCKAKTILKIDITSFFDNIDYDLVYKIFRELFFYSDEVSETLAGICTREGVVPQGAPTSSFIANLCFFDIEGGIVKGLERQNLNYTRLTDDITVSSTTQDKDLNKAKDKIISMIQNAGFRINEDKTCIESISTTAFKIHGLRINKNTPQLPRDEIKRIRAAVNNLKILSKEPNARTSFHYRKLYESVSGRVNKLARTGHPRYHKHRQDLRDILPLPSQKDIKRCLVMLSTLMRDHETLCSSPLYMKRYHRLRHRLILLQRTYKHEANKIWKTIKDLTPTKSAAEHAL

SEQ ID NO: 3590 - protein, 389 aa, Pseudomonas sp.
  source 1..389: note = Related to NZ_RFFM01000002.1; note = Pseudomonas zhaodongensis
MDEFSFSKTTNQSISNIANLAYALDVSEELIDEALALPSDQRYTPHRPGNGNRLVYRPHPLIRKIQRKIKNRILVDLVRYPRYLYGSLRDVGFPRDYISCAQVHCLSKSVLKIDITKFFDNISANVVEDIYSDFFSFPFPVADVLANLCTHEGWVPQGAPTSSHLANLCFFREEPSLVRQLHRQGLRYTRLIDDITISCDSYGYDFTKDEERVRRLITEKGFSVNEAKTGLHYQGNSNIKIHGLRINFPKPQMTQEESRNIRVAVHQVEQWAAEPNCRTSIAYRKLFESTSGRVNKLKRLSHSKYDRYRKRLQKLLPLPSNKDYDRCIGLYNGVVADAAKGVHSFRYYRRYCLLQNRLNLIQRTRSYRAEAVRMRAVLKGLKPTYKNDI

SEQ ID NO: 3591 - protein, 382 aa, unidentified
  source 1..382: note = Related to NYWB01000030.1; note = Pseudomonadales bacterium
MDQLTFTKKTDQSIGPSAENLANALGISPEELDEALQIPSAQRYIPFTVSGGTRVVYRTHSRIKFIQQKIKNRILADCINYPKYVFGSIKDPDFKRDYVNCAAQHCGARSLLKVDIEKFFDNISIGNVRRIFRDLLHYPDPVCSMLCDLTTHNGYLPQGAPTSSHLATLCFFKEEPDIVEQAQAQGLVYTRLMDDITVSSKSYDYDFHRLERLIRNMIETKDLTVNEGKSETFPTVSSTTLVHGLKINTETLRVSDKTLSNIRAAINQLEKDAKQPNKRTLSNYRKRYERTSGSLSVLHRLGHPKYEKYRRKLRRLRPLPSPYFLNKTWELMESIENIQDMRESAIYRKRFYMLHHKLNLAQRTFKAEAKTMRERLKEIKPK

SEQ ID NO: 3592 - protein, 360 aa, unidentified
  source 1..360: note = Related to JAGPVE010000050.1; note = Marinobacter sp.
MAHLQDLALPFDGRYFELSKPKRNGGTRIVYDPHPDLKAIQKKINSRIFRAVFYPRYLYGGIRDTLDSRDYIKCATVHCPSGVVAQLDIDGFFDNILFHQIYEVFTGFFHYSPDVSNLLARICAKDEFNLPQGAPTSVALSNLVFFNDEPNLVRHILDSGARYTRFIDDITISHPDSKFPIEKYAKATIRIIERNGFRINESKSGTLRDTGLIDVFGIRVNGAIPRTPQNYSKNLRRKIYQLEELAKIPNERKQEGYRTSWNSTSGRLAKLKRTSSGKYRTYRKRLNKIKPLTHEREARRVKAKTRRMLVDSQKIQNPEAFKKRYQKLMHEIGSLKSTYPALNTSLKSLMAQVRENMAEE

SEQ ID NO: 3593 - protein, 360 aa, unidentified
  source 1..360: note = Related to JAINWM010000001.1; note = Marinobacter adhaerens
MEHLEALAQPFEGRYFEIQKPKKNGGIRVVYDPHPHLKAVQKKINSRIFRTVTYPRYLYGGIRDTADSRDYIKCATVHCPSSVVVKLDIDSFFDSVLSHQVLDIFSDFFNYSPAVAELLTRLCTKDDFNLPQGAPTSVALSNLVFFREEPGLARGIEGSGARYTRFIDDITISHSDSKFPVEKYLKAARRVITEKGFDINEDKTQTVRDTGLIDVFGIRVNGATPKTPKKYSKELRQKIYRLEELARIPNERKQEGYRASWHSTSGRLAKLKRTNSGKYRTYRRRLDKIKPLTHEREASRIKAKTRRLLNDSQQIHNKDAFRKRYQKIMHEIGLLKSTYPALNTSLKSLMKQVRENMDAQ

SEQ ID NO: 3594 - protein, 382 aa, unidentified
  source 1..382: note = Alteromonadaceae bacterium; note = Related to NZOQ01000019.1
MPLNISYSAPHRIASKRNLAKALNIGDEELEYLIAQKNHHYRQKRLPKKSGGTRTVYAPERNLKALQRKIVARIFHLVRFPPYLQGSISDPENQRDYIKCATQHCGAVAVSHIDIKNFFDGIEFDRVVDIFEGVFLFRSEVSLLLAELCTLDGYVPQGAPTSSYIANMIFFKDEPKIVNLANKSGITYTRLVDDITISTDVKNTCLRTLTKKVIRMIESYDLEINADKTKSMIRGSVPLTVHGIRVVEKKPKISRDEYRNIRDAVHRVVLASSTPNYRTKFEYFKLYHRVSGRLSKLKRLEHPGYTRLRNKLKPLLPLPSKGFKAKVTEKIEKLERNYSLSSSHEWYKKEWNVTSYKLGIVGRTYKKESSELRARIKAIRPS

SEQ ID NO: 3595 - protein, 382 aa, unidentified
  source 1..382: note = Related to SNZY01000014.1; note = Idiomarina sp.
MKISTYKPINVIGNPANLAAALDSSLEELGSLIENKAKLYQKKIIPKKNGKSRTVYSVDRELKKIQNKINNRIFSEVEFASYLFGSISDPDLPRDYLLCAESHCPSAIIATIDIKDFFDHITDEKVEKIFSGFFNFPDDVAELLTELCTFQGRVPQGAPTSSYLANLMFGTQEKRIAKAANECGARYSRLLDDIIISSPQKNFSIDTLYQRVEQMIVNSGFQINETKSKVDILGPKPLEVHGIVVTGNSPKVSKLKYQEIRRLVHQVSDLSKTDNRRTTHRYYKKYHRAYGLLSILKRVNHPAHKKLKSKLTSAPPLPSNRFRNSIFRRLSKLESKHQIHQQRKWFAKDWNRISHELGILRRSYPEDATNARNRLNLITPYV

SEQ ID NO: 3596 - protein, 393 aa, Enterobacter sp.
  source 1..393: note = Related to NZ_KI973178.1
MAKDFSFKNTFTPIQKKESLLALLGISDIDKFEKLISDGVEKAYYIKPPIEKKNGGHRIVYAPNRMLKSILRKINNKIFSQINFPDYLYGSIPDKENPRDYILCAQQHCKSKILVKMDIENFFPTMKSKFVYQIFKELFRFSDEVSNILTTLTTYEGFVPQGAPTSTYLANLYFYDCEPSKVSYLRKLGFRYTRLIDDITISRLNKEEDWKFVESVISNFIKQKELTVNNEKTKLLSAKSPQSFKVHGLCIEDEAPRFSKTERTNIKTQVHQVVRTAYGRDQIRMQPSFHKKYFSVKGKITKLKRVDCPDYPVLKNLLKKHCDPLPEHKEIKRINRVISNLSKDHVSIGHTERYKSRYFQVVFRLDILKKLYPVEANEFRARLRQIGPTKNEN

SEQ ID NO: 3597 - protein, 328 aa, unidentified
  source 1..328: note = Related to JSXC01000034.1; note = Pectobacterium fontis
MLKSILRKINNKIFSQVNFPDYLYGSIPDKESPRDYILCAQQHCKSKILIKLDIENFFPTMKDRFVYKIFKELFRFSDEVSSILTKLTTYEGFVPQGAPTSTYLANLYFYDCEPSKVRYLRGLGFRYTRLIDDITISRIKKEGDWKFVESIISEFINKKELTVNEEKTKLLSADSPQSFKVHGLCIEDTTPRFTKIERSNIRTQVYQVVKTGYGHDKIRMQLSYHKKYFSVKGKITKLKRVNCPDYPLLKKLLKKHCDPLPEHKEIKRINRVISNLSKDHTNFGHTERYKSRYFQVVFRLDILKKLYPIEASEFRSRLRQIGPIKNEN

SEQ ID NO: 3598 - protein, 393 aa, unidentified
  source 1..393: note = Related to BX571875.1; note = Photorhabdus laumondii
MPKGFSFKDTFTPIQRKESLIGLLGIKDIEKFESLLRDGVENAYYIKPPIKKKNGGERIVYAPNRMLKSILRKINNRIFNQINFPDYLYGSIPDKENPRDYILCAHQHCKAKILIKLDIENFFPTMKTKFVFNIFKDLFKFSDEVSNILTKLTTYDGFVPQGAPTSTYLANLYFYDCEPNKVNYLRSLGFRYTRLIDDITVSRLKKEGDWKFVETIISEFITQKELSVNKDKTQLLSANSPQSFKVHGLCIEETTPRFTKNERINIKTQVKRVVKTGYNRDNIRMQKNYHDVYFSVKGKITKLKRVNCPDYPLLKKLLAKHCDPLPEHKEIKRINRVISNLSKDHATFGSTERYRSRYFQVIFRLEILKKLYPVEANEFKARLKLISPIKNEN

SEQ ID NO: 3599 - protein, 393 aa, unidentified
  source 1..393: note = Related to NZ_CAKAKG010000001.1; note = Leclercia sp.
MPKDFSFKDTFTPIQKKESLIALLGIKDVEKFNNLVRDGVERSYYVKPPIKKKNGGERIVYAPNRMLKTILRKINNKIFNQINYPNYLYGSIPDKENPRDYILCAQQHCKAKILIKIDIENFFPTMKAKFVFKLFKEVFKFSDEVSDILTKLTTYDGFVPQGAPTSTYLANLYFHDCEPNKVSYLRSLGFRYTRLIDDITISRLEKEGDWKFVEGIISDFIKQKELTINDKKTKLLSTHSTQSFKVHGLCIEESSPRFTKNERLVIKTQVNRIVKTGYGNDKIRMDKNYHNSYFSVKGKTTKLKRVNCPDYPVLKKLLSRHCDPLPEHKEIKRINRVISNLSKDYAVCGNTERYLRRYFQVIFRIEILKKLYPVEANEFKLRLKLISPIKNEN

SEQ ID NO: 3600 - protein, 390 aa, unidentified
  source 1..390: note = Related to NZ_LVHW01000001.1; note = Pantoea agglomerans
MASSFSFKETFTPIQSVQSLINLLGVKDTEKFEDLIRNGAETSYYIKPPIKKKNGGERIVYAPNKMLKSLLRKVNQKIFTQINYPDYLFGSIPDKENPRDYILCAEQHCKAKVLIKIDIENFFPTMREEYVYKIFNKLLKCSEEVAQILTKLTTFDGYVPQGAPTSTYLANLYFFDSEPKKVQHLRNNGFRYTRLIDDITVSRATKEGSWKYVESFIGEFITQKHLSINKDKTISRSSSSPQQFKVHSLSIEGEKPKFPRIERLKIKDHVHRVVKTGYGKDNERMKKSFHYLYFSVRGKITKLKRVDCSDYPIFKKMLKRHCDPLPDHKEIIRLNRVISNLSRDFNSLGESERYKNRYFKVMFRLSILKKLYPKETNEFKKRLKLISPKK

SEQ ID NO: 3601 - protein, 396 aa, unidentified
  source 1..396: note = Related to CP042493.1; note = Leclercia adecarboxylata
MQSNNFVINKKNLPPIKNVDSLIKLLGVDAGYLDFLIEHGVEKNYYRKDPIPKKNGGERIVYAPNKKLKSLLKRINNKIFSQISFPHYLYGSISDSEHPRDYIRCASVHCKAKILIKIDIQDFFPSMDSVGVNSIFSKFFNFSDEISQILTKLTTYHGIVPQGSPTSTFLANLYFYDVEPSIVSHLESEGFRYTRLIDDITISKSERGESYKYIKPRIIKMITNKGLVINEKKCSEQSLKSSQSFKVHGLCIEEETPKFSKPEILKIRGQVFNILRVGYCNDKMRMSRDFHKFYFSVKGKTTKLKRVNSPEYTELKKLLKRNCDPLPDHLEIKRLNRVISNLSKDYVLLHNSKRYKSRFFHVYFRLVILSKLYKEEADEFKTRLKRIRPSSDMSSL

SEQ ID NO: 3602 - protein, 354 aa, unidentified
  source 1..354: note = Related to NZ_CP042173.1; note = Yersinia sp.
MLTRGVASFYTEKEINKKSGGKRLLHAPNRKIKFILRKVNNKIFNKVLFPHYLFGSISDKENPRDYIRCAEVHCKAKILIKVDISNFFPSINTYSVRDIYKVFFNFSDEVSDVLTELTTVNGTVPQGAPTSTFLSNLYFYNIEPQLVKYLESLGFRYTRLIDDITISKLDKNNFRFADDRVKAMITQKGLTINEGKSSIQSTVAAKGYKVHGVCIDEDKPRFTKSECMKITDEVYQIARVGYNRSDVRMRQSYHKAYYSVKGKITKLKRVGYVKYNDLRKVLNKHCEPLPDHDEIKRLNRVISNIQRDYTGKPATDNYKRRYYQAHFRLSVLRRIYKEEAKQFRARLISVRPNR

SEQ ID NO: 3603 - protein, 389 aa, Aeromonas sp.
  source 1..389: note = Related to JAHUWU010000005.1
MNNRPTYHGGVISNPLTLARVLGIELADLLAMSVDTVSHYKAKEINKKTVGAGKRVIHMPDESIKRLLRRVNSRIFNGVTFPGYLYGSISDQENPRDYIKCAELHCRASVLIKVDISNFFSQITTEHVYKIFLKFFNFSHEVSEILSKITTVTGFVPQGAPTSTFIANLCFFETEASLVTYLHGAGFRYSRLIDDITVSTLNNKLPWQYVEDRIVRFLDKEGFSINADKTESISTPSAQSFKVHGLCIGDEKPRFSKKHIDEIKKSVNCVLKKALFSDKNRKEKSYHKLFYSTQGKTTKLKRVKHNSYPSLKKALGRYALPLPDERESYRLNIAVKNLERDYPTLSSKLAYRNRYYKAKFRVGILSRIYRRDATLLNNRLKDILPTYED

SEQ ID NO: 3604 - protein, 395 aa, Vibrio sp.
  source 1..395: note = Related to PIFQ01000031.1; note = Vibrio splendidus
MDKPHYPCRPIGSVDVLANTLGVHIRRLRNIASKVDSSYTSYELKPHPVTNKVRTVVEPKHELKKIQKKINSRIFLHVNFPEYLQGGIRATSQSKRDYIENASRHGRSQTLINLDVKNFYPNIKADVVRDIFKYFFKFSDDVVDILTTLTTYRGSIPQGGCTSSYLANLVFFNDEYRIVSSLRGRNLRYTRLLDDITISSVTTIDNKTSEKIIKDIAGMLRKRNLSLKSPKTKVTDRSEMHKDFEVTGLCVRASEPKVRKKDRRLIRLSVFQCESQAKTDRTSDDYHKNWNKTSGLVAKLKRLNHSQAKDYRKRLAEILPLYDEYRESKIVKRAYAALKVPVSSHEKIGTIRSYNNLIYQLGILSRTNKKVAKGLSKSLKDHYSSVPTIENFWEN

SEQ ID NO: 3605 - protein, 395 aa, Vibrio sp.
  source 1..395: note = Related to NZ_AFWF01000003.1; note = Vibrio ichthyoenteri
MDKPHYPCQPIGSIDVLANTLGVHKRKLISIASKVNTSYSSYELPAHPITKKVRTVVEAKHELKKIQKRINSRIFLHVKFPEYLQGGIRATDKVKRDYIENATKHGRSQTLINLDVKNFYPNIKSEVVRDIFKYFFKFSDEVVDILTTLTTYRGCVPQGGCTSSYLANLVFFNDEYRLVSSLRGRQLRYTRLLDDITISSVKKIDQKLSEKIIKEVAGMLRKRSLSLKSPKTKVSDRSEMHKDFEVTGLCVRDSEPKVRKKDRRHIRQLVFNCELKAVNDRTSDEYHALWNKTSGLVAKLKRLKHSQASDYRKRLAVILPLYDQYQEGKIVKRANAALKVPVDLHSKFGVMRRFNSLIYQLGILSRTNKSVAKGLSCLLKKHYSSVPSINDFWET

SEQ ID NO: 3606 - protein, 395 aa, unidentified
  source 1..395: note = Related to NZ_CP035780.1; note = Photobacterium damselae
MDKPLYPCKSIGSIQVLAQTLGVHPKKLVSLARKANASYTSYELPPHPTTQKIRVVVEPKHELKKLQKRINSRIFINVKFPNYLQGGLKATSTVKRDYIANAFLHGKSKTLINLDVKNFYPNIKQKNIVDIFKYFFKFSDEVVDILTALTTYNGSLPQGGCTSSYLANLVFFNEEYKLVSSFRGQKLRYTRLLDDITISSEKTIIDKDKEKIIKRVAAMLKKHGLSLKSSKTKVTDRSEMHKDFEVTGLCVRATTPKASKKDRRYVRQLVHNCELMAVKEKTSNEYHALWNKTSGLVARLTQLKHNEAKGFRERLSEILPEYDQYQKDKVIKRARAALKVPSTAHSEWGTIRRYNRIIYHLGILARTDKKQAHRIKLTLKKHYSSRPTINEYWES

SEQ ID NO: 3607 - protein, 395 aa, unidentified
  source 1..395: note = Related to MCUF01000038.1; note = Shewanella sp.
MDKPLYPCSSIGTLDVLSKTLGVHPKKLKSIASKVNDSYSKYELPAHPTTGKVREVFEPKHELKKIQKRINSRIFEHIIFPEYLQGGIKATPEIARDYIANATIHGRSKTLINLDVRNFYPNIKENVVSDIFKYFFKFSDEVVEILTKITTYNGSLPQGGCTSSYLANLVFYNDEYRLFSSLKGRGLRYTRLLDDITISSPQLIDKELSVQLIKDVAALLRKRNLNLKSNKTKITNRSEIHKDFEVTGLCVRAAKPRTRKKDRMYVRQLVFNCEKMAVESKSSEEFHKLWNKTSGLIAKLDRLKKSHAKDYRKRLSVILPIYDQYQENKIIKRSKRALKVPITSHSQWGTIQQYNNLIYQLGILGRTKKGLAKNLRKSLKLHYSSVPTINKFWEQ

SEQ ID NO: 3608 - protein, 395 aa, unidentified
  source 1..395: note = Related to JACJDR010000003.1; note = Pseudoalteromonas sp.
MDKPLYPCKPIGSIEVLAKTLGIHTSKLQSISKKIEESYTPHTLKPNSSTGKVRSVFDPKFELKKLQKRINSRIFENIKFPEYLQGGLKATASCKRDYVENAEIHGRSKTLINLDVKDFYPNIKVDTVRDIFKNFFRFSDDVVDILTVITTYRGCLPQGGCTSSYLANLVFYNNEYRLFSSLRGRGLRYTRLLDDITISSKTAIDNKVREKAIKDVAAMLKKKNLRLKSSKTKITDRTEMHKDFEVTGLCVRSRLPNIPKKERKYIRQLVFNCEKIGRNDKTSKEYHSLWNKTSGLVTRLGRLGNTQASDYRSRLSEVLPEYDEYEEAKLVKRSNAALKVPQSEHLKWGVIKRYNIIIYHLGILTRTKTLLARNLRNKLKEHYSLVPSVKDFWEK

SEQ ID NO: 3609 - protein, 395 aa, unidentified
  source 1..395: note = Related to NZ_AP023033.1; note = Agarivorans aestuarii
MDKPLYPCKPIGSIHVLANTLGVHPLKLKSIANKAESSYTSYNLKQHPTTGKVRTVCDPKHELKKIQKRLNSRIFAKVEFPPYVQGGIKATIDSKRDYIENATIHGRSQTLINLDVKNFYPNVKADAVKNIFKYFFRFSDDVVDLLTKLTTYRGSLPQGGCASSYLANLVFFNDEYRLVSSLRGKQIRYTRLLDDVTISSQKPLDGNTSEKIIKQVAAMLRKHNLSLKSPKTKVSDRKELHKEFEVTGLCVRASFPKVRKQDRRYVRQLVFNCEQLAAQTRTSEDYHSLWNKTSGLVAKLVRLQHSEGKSYRKRLTKILPLYDQYQENKICKRYYAALKVPREQHVQWGTINKYNKLMYSLGILSRTNKKRAQHFRKKLATHYSSVPVIEDFWES

SEQ ID NO: 3610 - protein, 394 aa, unidentified
  source 1..394: note = Related to JAACRB010000019.1; note = Shewanella frigidimarina
MDKPRYPCKPIGSIDVLATTLGVHKKKLIDIASKVNSSYTSHELPKHPITGKIRKVVDPKHELKKIQKRINSRIFELVIFPPYLHGGIKATSSIKRDYVENASQHGHSQTLINLDVKNFYPNIKTNAVSGIFKYFFRFSDDVVEILTTLTTYNGSLPQGGCTSSYLANLVFFNTEYKLVSSFRGKAIRYTRLLDDITISSKNKIDSKSTTKIIQKVSAMLRKNELSLKSNKTKISDRSEIHKEFEVTGLWVQPVNPQMRKKDVRHVRQLVFECEKLASKSKTSEDFHILWNKTSGLVAKLSRLNHSQAISHRERLSNMLPEYDQEAQDKLVRSTNAALKVPVSSHSKWGVLKKYNLIIYNLGILARTNKILSKKLRVSLKKHYSSVTTISEYWG

SEQ ID NO: 3611 - protein, 395 aa, unidentified
  source 1..395: note = Related to LR721750.1; note = Aliivibrio wodanis
MDKPLYPCKPIGSIDVLAKTLGVHPTKLIDIASQVNNSYTSYQLPAHPVTGKERTVLEPKYELKKIQKRINSRIFEQVQFPSYLQGGLKASHSIKRDYVQNATIHSHSQTLINLDVKNFYPNIKTEAVSNIFKYFFNFSDDVVSILIKLTTYHGSIPQGGCTSSYLANLVLFNSEYKLVSSLRGKNVRYSRLLDDITISSKTKLDPKFIEKTIKDVAALLKKQKLSLRSQKTKITDRAEIHKEFEVTGLWVRPSQPQVRKKDRRYIRQLVFNCEQKSKTDKTSDEFHKLWNQTSGQVTILERLKHSQASDYRQRLAKIYPEYDQYQENKLIRKIKAALKVPISEHHQLGTIKRYNGLIYQLGILSRTKKTLSKNFRRTLKAHYSTVPTLNNFWNK

SEQ ID NO: 3612 - protein, 397 aa, unidentified
  source 1..397: note = Related to PYLU01000035.1; note = Photobacterium iliopiscarium
MDKPQYPCKSIASVEVLAKTLGVHLKLLNNIASKVEESYSSYVLPAHKVSGKIRTVFEPKHELKKIQKRINSRIFERVIFPEYLIGGIKATPTIPRDYVQNARIHSKSKTLINLDVRNFYPTIKAQEVKKIYKYFFKFSDEVVELLTLLTTYKGAVPQGGCTSSYLANLIFFNSEYQIVSSLRGQNIRYSRLLDDITISSTSEISSKKITVIIKSVSAMLKKHNLSLKGKKTKISDRDECHKDFEVTGLWVKEAEPKLRKEEVRRIRQLVYHCQLESINGMDSDEYHKIWNNVSGLVTKLTRLKHSQGKKYRDILTLILPIYNDYEINKLKKKINFALKIPKEDHYRIGVIKKYNQLNYKLGILGRTHKGMAKDARKRLKCHYSTIPKMDNYWEMDS

SEQ ID NO: 3613 - protein, 395 aa, unidentified
  source 1..395: note = Related to WEJX01000068.1; note = Plesiomonas shigelloides
MDKPYYGCASIGSVDVLAKTLGVNVKILESIVSKVDDSYTSYDLAPHPVTGKVRTVVEPKHDLKKLQKRINSRIFCGVKFPSYLQGGIASTEDVDRSYIKNAEIHCSSRTLINLDIKNFYTNIKYDVVFDIYKNFFRFSIPVCDVLTKLTTYKKQVPQGACTSSYLANLVFYNNEYLLVSFLRGKGFSYSRLLDDITISAKSECSEILTSDIIKRVASMLRKKDLKINNKKTKITDKREEHKEYKVTGLWVKHATPKLRKDERRYIRMLVYVCECKAQESRSTDEYHAFWNKTSGLVAKLKQLSHSQADSYRKRLSSILPICSEEKVYSINRRVKNALKIPVADHGSVSVIRRYNKLMYQLGILSRTEPELAKSLRKKMLHHYPSIKTINEYWHG

SEQ ID NO: 3614 - protein, 395 aa, Vibrio sp.
  source 1..395: note = Related to LIZL01000063.1; note = Vibrio splendidus
MDKPLYPCEPIGSLDVLAKTLGMHPAHIQSIASKVDESYTTFLLPPHPKTNKIREVRDAKFELKRIQKRINSRIFSHIRFPNYLQGGLKATXEQSRDYVENAGIHSRCLTLINLDVRNFYPNIKTKSVEQVFKHFFNFNDEVIEPLVKLTTFKGSVPQGGCTSSYLANLVFFNNEYHLVSKLRGQGIKYSRLLDDITISSEKKLSDDKCTELIKLVASMLKKHDLRLNNGKTSISFRNDINAKFEVTGLWIKHKTPRIRKNERRFIRQLVYNCELKARIDKTTTEYHELWNKTSGLVAKLERLNHCQSKDYRKRLANLLPEYSQSNAAQVLRAVSLALKVPKSEHQKLGRIKRINQLKHQLGILSRTHKSDAKKARQALNKHYSSSISKQKFWER

SEQ ID NO: 3615 - protein, 395 aa, unidentified
  source 1..395: note = Related to BPET01000001.1; note = Shewanella sp.
MDKPYYPCDSIGSVEVLAKTLGLHPLHLQNIADKAEESYTTFLLSPNPKTGKEREVREAKFELKRIQKRINSRIFEHVIFPAYLQGGLKATEDQGRDYVENASIHSRCRTLINLDVRNFYPNIKARSVKDVFKQFFRFSDEVVDLLVKLTTFQGAIPQGGCTSSYLANLVFFNNEYHLVSKLRGQGFAYSRLLDDITISSDKELSQAKASEVIRMVAAMLTKQKLRLNGDKTSISYRNELSAKFEVTGLWIKHKQPKVRKQERRYIRQLVYNCELKSKQDKTTDSYHTLWNKTSGLVTKLERLNHSQAGSYRKRLAVILPEYSPMQTDQLLKKVSAAMKVPASEHRKLGVIKRYNQIKYQLGILSRTQKGVARKARKALVAHYSSASTKLEVWES

SEQ ID NO: 3616 - protein, 395 aa, Vibrio sp.
  source 1..395: note = Related to NZ_JSTD01000043.1; note = Vibrio cholerae
MDKPLYTCKPIASIGLLAKTLGVHPDHLVDVANKIDTSYTSFELAPHPKTGKVRTVLEAKKNLKRIQKRINSRIFSNVKFPAYLQGGLKSDESTQRDYIENARLHSHCRTLIQLDVRNFYPNIKPIYVEPVFKQLFRFNDEVSQILTQLTTYKNSVPQGGCTSSYIANLLFFNSEYHLVSKLRGQGLQYSRLLDDITISSQEELSKQKCEEVIKLVAGMLTKYGLKLKGSKTQTEYRSNRNANLEVTGVWVKHRAPKVRKEERRYVRQLVYVCEQKAKVSKTTQEYHEHWNRTSGLVAKLERLEHGQAKKYRERLRAILPIYSESTANQVLKSVNTALKVPKTSHKELGRVNRLNKIYYQLSILSRTKRYEAKKARRQLKQYYSSSPTKQEIWEI

SEQ ID NO: 3617 - protein, 388 aa, unidentified
  source 1..388: note = Related to NZ_CP084222.1; note = Arsenophonus sp.
MDKPYYPFNAIASIEALARTLGIHPKLLCSIADKVESSYSTYDLANKNRTVFEPKYELKKIQKRINSRIFEKVEYPLYLQGGIKSEVKRDYVENAKIHSHAETLISLDIKKFYTNIKADKVFSVFKYFFKFPDDVSTILTTLTTYRGRVPQGGCTSSYLANLVFFNSEYSLVSAFRGKDVKYSRLLDDVTLSSEKNLDSIKCTNLIKNVVAMFRSYELRLNTKKTKIEYRGKANKGFEVTGLWVEHKKPKVRRKEQRYIRQLVYNCELQYNDRKTNSEYHELWNKTSGKVAKLVRLDHSQAKNLRERLRLVLPQYDNNTAYKLKKLTNKSLQVPKEHHQKIGRIRDYNRLIFKLGILKRSHPALAKVLIKKMKSHYLNVPTNKEYWLE

SEQ ID NO: 3618 - protein, 388 aa, Vibrio sp.
  source 1..388: note = Related to CP063377.1; note = Vibrio diabolicus
MDKPYYPHDAIASVEKLALTLGIHPNRLLSIADRADESYTEYELVDKDRTVFEPKYELKKIQKRINSRIFELVEFPLYLQGGIRANVKRDYVENAKIHANATTLISLDIKKFYTNIKADKVSAIYKYFFKFPDEVVDILTKLTTYKGKVPQGGCTSSYLANLVFFNSEYRLVSAFRGKGISYSRLLDDVTLSSASNLDSSGCTEAIRKVVGMFTAHDLKLNSKKTKIEYRGKAAKGFEVTGLWVEHKKPKLRRKERRYVRQLVYNCELKYESDKTTPEYHELWNKTSGKVAKLTRLEHSQAKALRKRLRNVLPEYDDYTANKLKHLAYRALQVPKEHHQKIGRVNDFNRLIFKLGVLRRSHPSLAKVLIKKLKVHYKNVPTKKEYWLE

SEQ ID NO: 3619 - protein, 395 aa, unidentified
  source 1..395: note = Related to NZ_KB907054.1; note = Psychromonas ossibalaenae
MDKPHYPFEPIGSIDKLARTLGVSPAVMEAISNRIDESYSEYELPPHPKTGKVRTVFEAKHELKRIQKRINSRIFELIEYPTYLQGGIKATPKRDYVENANMHVGANSLISLDIKNFYPNIKASQVFNIFKQLFNFPDALAKILTKLTTYKGTVPQGGCTSTYLANLVFFNSEYHLVSAFRGQGIVYSRLLDDVVLSSPKVLSNSECTDAIQKVAGMFKKYEFRLNSSKTKVEFRGNSNSEFNVTGLWIEHSKPKIRKKERRYIRQLVFNCELKYIQSKHSDDYHIFWNKTSGLVAKLERLKHPQAKKYRDRLKQVLPIYDDVNIRKIIKLTNKALKVPKEEHSRYGRIQNCNRILYRLGILGRSEAKLAKNLRRKLKSHYSTIPTKKEYWFGTA

SEQ ID NO: 3620 - protein, 392 aa, unidentified
  source 1..392: note = Related to JAHKPW010000044.1; note = Colwellia sp.
MDKPYYPYQAIGSIELLARTLGISSKRLISIASRVDNSYAEFELHPHPKTNKIRTVFDPKYELKKLQKRINSRIFEKVQYPKYLQGGIKAPDSRDYVENAKIHSKSNTLISLDIKNFYPNIKEKYVYDIFKQFLNFPDEVSKILTTLTTYKGFVPQGAVTSSYIANLIFFNSEYSIVSALRTKGVIYSRLLDDVSISSEKRLNETEITKNIKFVVSMFTKYDLKLNTKKTKKEYKNKKNPYEVTGLWVGHAKPKARKLERRYIRQLVYNCELKYPSMKDSSDYHELWNKSSGLVAKLERLGHSQAKRLRARMSSVLPCYDDIEIIKTKKLIRKALKVPREYHQKHGHIKIFNKLIYRCGILSRTHKKLSKHLRQQLQAHYQNVPTIREYWHG

SEQ ID NO: 3621 - protein, 396 aa, unidentified
  source 1..396: note = Related to NYUN01000050.1; note = Haliea sp.
MDKPEYPHKAIGSVDALAQSLGTNPSALKNLVSKVDNSYTPILISTNNGTKERQVYEPKYYLKKIQKRINREIFEKVKFPTYLQGSIRDVKNTRDFVKNAGVHSGANDLISLDITGFYDHIKEEYVSDIFTKLFSFPPDVSEILTKLVTYKGIVPQGACTSSYVANLVFFNSEYRVYSRLKNRHNVKYTRLLDDVTLSSERRLTDKELTICIDEVKSLFRKYDLKSNDSKKKVQTRKFHGHLDFQVTGLWVGHKTPRLRKKERRYIRQLVYSCEREYERDSTKTEYHELWNRTSGKVAKMARLNHSQSRALRERLKKVLPTYNQDQAETLIYNIKRFVDKVKKNKIKSDPAKTKNFNTLVYQVNILTRTNKSLANSLRLQLMSIRKSVNLKSALWD

SEQ ID NO: 3622 - protein, 388 aa, unidentified
  source 1..388: note = Related to NZ_CP047240.1; note = Pseudoalteromonas sp.
MDKPYYPHKPIGSVAILANTLGITELKLRAIASDSDNSYTEFLISDGKRTVCEPKFELKKLQKRINRRIFEKVQYPEYLQGGIKSTSKRDYVQNALIHSKATTLISLDIRRFFDNVKESYVYDVYKYLFKFPDEVAELLARVTTYRGTLPQGACTSTYLANLIFFNSEYRVVSILRGRGISYSRLLDDVTLSSGENLKKEEVTNSIKEVIDLFKKYDLRQNNKKLKVEYRDTPNGDFCVTGLWVEHSTPKLKKKERKYIRQLVYETEKLYRTDRTSEKYHELWGKASGKVAKLNRLGHKQSDSLRQRLSNILPEFDKYTTKKIVTIHYRLLSIPKIKHKRIDVAKQYNKQLHKLGILSRTNKTLAKKLRMALKQHFNQVTTIERYWHD

SEQ ID NO: 3623 - protein, 392 aa, Citrobacter sp.
  source 1..392: note = Related to CP077405.1; note = Citrobacter braakii
MDKPYYPFRPISSIAILAKTLGIHEKMLLNLANKVDDSYTEFLINVKGKDRTVYEPKHDLKKLQKRINHRIFEKVQYPVYLQGGIKDPSNKRDYVENAKIHCERDPNIIISIDIKSFYDNIKSDYVFNVYKNFFIFPDEVSEILTKLTTFKNKVPQGACTSSYLANLIFFNTEYSLVSKFRSTGICYTRLLDDVTLSSNKFLSEEKISSSIKDVVAMFRKYKLKHNNKKTKVECQKNAKNSFKITGLWVGHSKPKTTRHDRRYIRLLVKICENKFKDDKYSLEYHTFWNKTSGLVAKLSRLEQSNHVSLRERMSMILPLYDDKEKDKIIRECKAILKFNNKVAFTIGQVETINKVIGKLGILARNNKSLSKIWRSRIRKHCQSLPSKRSMWL

SEQ ID NO: 3624 - protein, 392 aa, Enterobacter sp.
  source 1..392: note = Related to JAHEVB010000007.1; note = Enterobacter hormaechei
MDKPYYPFRPISSTSILAKTLGIHEKMLLNLANKVDDSYTEFLINVKGKDRTVYEPKHDLKRLQKRINHRIFEKVQYPSYLQGGIKDNSNKRDYVENAKIHCDNNPNLIISLDIKSFYDSIKSDYILNVYKNFFHFPDEVSLILTKLTTYRNKVPQGACTSSYLANLVFFNSEYSLVSKFRSKGICYTRLLDDVTLSTNKKISEEYISASIRDVVAMFRKYNLKHNNKKTKVEFQKSAKDSFKITGLWVGHATPKTTRHDRRYIRLLVKICENKFKDSKYDLEYHAFWNKTSGMVAKLARLDQSNHVKLRERMSQILPHYDVREKEKIIRECKMVLKFNNKISFTIGQIDAINKLIGKLGILSRNNKALSRVWRNRIHKHCKSKPSKRSMWL

SEQ ID NO: 3625 - protein, 392 aa, unidentified
  source 1..392: note = Related to NZ_CP055904.1; note = Klebsiella aerogenes
MDKPYYPFRPISSIPTLAKTLGIHEVLLVNLSNKIDDSYTEFLINVKGKDRTVYEPKHELKRLQKRINHRIFEKVQYPGYLQGGIKDNNNKRDYVENANIHCEHKPNIIISIDIRSFYDNIKSNFVFLIYKNFFHFPDEVANILTKLTTFRNKVPQGACTSSYLANLIFFNSEYSLVSSFRNNSITYTRLLDDVTLSSSKALSESQITASIKEVIGMFNKYNLKHNNKKTKVETQKNSKDSFKITGLWVGHSKPKATRKERRYIRLLVKICENKANTDIYSEEYHAFWNKTSGLVAKLTRLDQSNHKDLRERLNAILPLYDDKSKNKVIRECKIILRYNNKVSLSIGQVDTVNKLIGKLGILSRNNRALSKIWRTKIRKHFKCMPTKKEIWQ

SEQ ID NO: 3626 - protein, 413 aa, unidentified
  source 1..413: note = Related to CP018628.1; note = Lelliottia jeotgali
MVDFDANYLLTSFTPLKHWCAMDKPYYPHNPISSVAILAKTLGIRKDLLVNLVNKVDSSYTEFLITVKNKDRTVYEPKFELKKLQKRINSRIFEKVQYPTYLQGGIKDDSNKRDYVENAALHCKNKPETIISIDIKSFYDNIRSSYINDIYKNFFNFPDEVADTLTKLTTYRNKVPQGACTSSYLANLIFYNSEYTLVSKFRNKNITYTRLLDDVTLTSRDNISEEKISEHIKSVVGMFRKYNLKHNNKKTKVETQKNAKNSFKITGLWVGHAKPKITRHDRRYIRLLVKICENKFKDDKYSEEYHAFWNRTSGMVAKLTRLDQSNHIELRKRMATILPLYDDNEKDKIIRECRRVLRFNNKIDLSIGQLDIINKLIGKLGILARNNNALSKIWRNKIKNHFPLLPTKREIWE

SEQ ID NO: 3627 - protein, 395 aa, unidentified
  source 1..395: note = Related to JACYNC010000004.1; note = Pantoea agglomerans
MLMDKPYYPHKAISSVNVLAKTLGIRESLLIELSIKSDTSYHEFTVCTKKGKDRTVYEPKPLLKRLQKKINSRIFEKVKYPIYLQGGIKDEISKRDYVENARLHSKSKPSHLIGLDIKSFYDNIKTPKVHDIYKYFFKFPDPVCDVLTKLTTHKGKLPQGACTSSYLANLVFFNSEYSLVSYFRKMGVTYTRLLDDVTLSSPVQLSEHQVGEAIKKVVGLFKKYNLKHNNKKTSIENNKNIKNGFQVTGLWVGHSEPKTTRDERRYIRILVKTCEQKHKSDPYSQEFHELWNKSSGLVAKLKRLGQPSHDSLRARLSVVLPLYDQKMASKLIMECKSLLTIKNKIQYSAGEVSNINKTLYKLGILSRNNPISSSIWRKRIRANFKNLPSKKELWE

SEQ ID NO: 3628 - protein, 393 aa, unidentified
  source 1..393: note = Related to CP026378.1; note = Mixta calida
MDKPYYPYKAISSIETLAKTLGIRVNLLSLLVEKSDSSYHEFIVCTKKGKDRTVYEPKPLLKRLQKKINSRIFEKVKYPVYLQGGIKDEINKRDYVENALLHSKNKPKQLIGLDIKSFYDNIKSDKVFDIYKYFFKFPDPVSDALTKLTTFKGKLPQGACTSSYLANLVFFNSEYNLVSYFRNMNITYTRLLDDVTLSSPVKLSEKQIGESIKKVVAMFRKYNLKHNNKKTSIECNRNLKNGFQVTGLWVGHATPKTTRDERRYVRLLVKTCEQKYKNNPYTEEYHELWNKTSGLVAKLKRLNQPSHDTLRNRLSLVLPLYDAVMVSKLMMECKSLLRVKNKIEYSVSEVNHINKTLYKLGILSRNNPGRASIWRKKIIANFKNLPTKRELWE

SEQ ID NO: 3629 - protein, 392 aa, unidentified
  source 1..392: note = Related to CGBL01000001.1; note = Yersinia aleksiciae
MDKPNYPHKPISEVSVLAKTLGISEVMLKSIASKVDTSYTEFDIESNGKDRHVYEPKFNLKKLQKRINSRIFEHVNFPSYLHGGIRDVNIRRDYVENARLHSKTKVNSLINLDIRSFYDNIKIDKVYKIYKYFFKFTDPVCEILTTLTTYKNKVPQGACTSSYLANLVFYNSEYQVVSALRCKGITYTRLLDDVTLSSKKTLSETTISNSIKSVIGMFTKHGLKQNKKKMKIESIQNKKDGFQVTGLWVGHAEPKTRRDERRYIRLMVYVCEKEYPNSMSTESYHELWNKTSGLVAKLNRLNQSNYKSLRERLGAVLPLYNDSERDKIIRECKSLLKLDSSKPVSYGQLDSINKIYSRLGILARNNTNLSRSWRKKLRSHFRKLPTKKEIWL

SEQ ID NO: 3630 - protein, 392 aa, unidentified
  source 1..392: note = Related to NZ_MJIB01000008.1; note = Rahnella sp.
MDKPYYPHKPISSVEVLAKTLGVSEPALRSIANKAGNSYTEFLIESKGKDRTVYDPKFELKKIQKRINSRLFENVIFPSYLQGGIHDKENRRDYVENAKIHSTEKIKSLINLDIKSFYDNIKKAKVNDIFKYFFKFPDPVCDILTSLTTYKNKVPQGACTSSYLANLVFFNSEYLEVSKLRGKGVTYTRLLDDVTLSSSKQLNDEEIEIYIKSIHGMFKKHGLKFNNKKTKIEHIKSKKEGFRITGLWVGHQLPKTTRNERRYIRLLVRICENEYSKSMYSEGYHELWNKTSGLVAKLNRLNQSNHESLRTRLGLILPLYDDAERDKILRECRNLLKIKATIELKYGHVDSINKAYGKLGILSRNNKLVSRMWRKKLKSHFRKLPTKRDIWL

SEQ ID NO: 3631 - protein, 390 aa, unidentified
  source 1..390: note = Related to JAFJAP010000008.1; note = Serratia marcescens
MDKPYYPHQPISTIESLARCLGVTTITLNSISSAIDSSYTEFVISSKNKERTVYEPKFELKRIQKRINNRIFEKVEFPRYLHGGIKSLEHKRDYVENAKMHSNTSVETIIGLDVKNFYDNIKKERVYIIYSQFFNFPHEVSELLTQLTTYKNKVPQGACTSSYLANLIFFNSEYGLVSKLRGKKITYTRLLDDVTISAAKKISDEEITKVIRDVSALFTKHGLKLNSGKTRVHHDKYAADSFEVTGLWVGNIAPKTRRQERRYIRSLVHACENEYLVDKYSSDYHALWNKTSGLVAKLYRLEQSNHKALRERLGKILPLFDDVAKRKIIIDCKSMLKIAPCSLNYGKLKRLNLIYSKLGILSRNYKCEAKLWRKKLKAHFVKHPKKSEVW

SEQ ID NO: 3632 - protein, 390 aa, unidentified
  source 1..390: note = Related to KI929259.1; note = Serratia marcescens
MDKPNYPHCPIASIDALARCLGVASTKLLSISRDIDNSYSEFIIESKGKDRTVYEPKFELKRVQKRINQRIFEKVKYPIYLHGGIRDPDNKRDYVENARIHSANSCKTIIGLDVRNFYDNIRADKVTPIFKLLFKFPNDVSELLTKLTTYRGKVPQGACTSSYIANLVFFNSEYTVVSRLRSLGISYTRLLDDVTLSSPKELSPERISECIRSVVALFKKHGLEHNKKKTRIENKNNNAQSFIVTGLWVGHKTPKVTRHERRYIRTMVHACERLYLDDNSTDAYHNIWNKTSGLVAKLNRLEQSNHKGLRERLNKVLPVYDEAARRKIILDCKSLLKLNATSLTYGQLTRLNLVYSKLGILSRSFLFESRLWRRRLNAHFKNKPKKSEVW

SEQ ID NO: 3633 - protein, 392 aa, unidentified
  source 1..392: note = Related to QDKH01000022.1; note = Brenneria sp.
MDKPYYPHNPISDVSTLAKTLGINEVMLNVIVSNVDTSYTKFDIPSKNKTRTVYEPKLNLKKIQKRINSRIFEAIQFPIYLQGGIKDSVDKRDYVENARTHSVNSPSTLINLDIKSFYDNIKYDKVFDIFKYFFKFPDDVSKVLTDLTTFKNKVPQGACTSSYLANLVFFNTEYSIVSSLRGKEIYYTRLLDDVTMSACCVLPEEIISESIKKVVGMFKQYGFKSNNKKKKIEYNKNMKGGFQVTGLWIGHTNPKTTKKERRFIRLLVHTCFKKYNESMTNESYHELWNKASGLVAKLKRLDQSNHKALREKLASILPLYDDSERKKIVHECNRLLKIPSSKTLTYGEIDRINRVFYKLGILSRSEKNLSRMWRRKLKQHFKNIPKKRASWL

SEQ ID NO: 3634 - protein, 391 aa, unidentified
  source 1..391: note = Related to NZ_WUBF01000012.1; note = Pectobacterium polaris
MDKPYYPHSPISDLPTLAKTLGVNLVMLNVIVNKVDDSYTEFQIPSKNRFRTVYEPKLNLKRIQKRINSRIFEFIQFPFYLQGGVKDSIDKRDYVENAKMHSSNNPETLISLDIKSFYDNIKSDKVFDIFKYFFKFPDDVSNTLTKLTTFKNKVPQGACTSSYLANLVFFNSEYTIVSNLRGKGICYSRLLDDVTMSANYSLSEEVVSESIKKVVGMFKQYGLKSNNKKKRIENNKNLKGGFQVTGLWVGHKNPKTTKLERRFIRLLVHTCFKKYNESMTSDSYHELWNKTSGLVAKLKRLDQSNHKALREKLARILPLYDENEKKKIIQECNRVLRIAPSKTLTYGEIDRINKLFYKLGVLSRNEKQLSRMWRKKLKFHFKNIPRKREVW

SEQ ID NO: 3635 - protein, 398 aa, Aeromonas salmonicida
  source 1..398: note = Related to CP022426.1
MTRLQVFMDKPYYPYSPIASIDSLSLTLGVVPKVLLDIAKNSSNSYTEFIVPSKNKDRLVYEPKYELKKIQKRINARLFEKVQYPLYLQGGIKDNLVKRDYVENAKLHVKSKHLINLDIKAFYDNIKPHHVFSVYKYLFKFPDDVCDVLTQLTTYKNRVPQGACTSSYIANLIFFNDEYTLVSSFRQQGISYSRLLDDVTLSSNKELSSEDVTNAIKKVAALFKKYDLRLKNSKTKIEVKSNKEAEYKVTGLWIGNGEPKVRKDERRYIRQLVYICGLKYAKSSSCQEYHEFWNKISGMVAKLTRLNHPEAAKLRVKLSNILPTFSVEVKRKVIHDIKKLMRKPATQGSYTLGEIARVNNSMYLLGILGRTDFNLARNLRRDLKRKYKNLPTYNQIWS

SEQ ID NO: 3636 - protein, 391 aa, Aeromonas sp.
  source 1..391: note = Related to NZ_UETL01000014.1; note = Aeromonas media
MDKPYYPHSSIASIDSLSSTLGVVPQRLLDIAKNSCNSYTEFVVPSKNKDRLVYEPKYELKIIQKRINARIFEKVEYPEYLQGGIKDLAKKRDYVENSKIHVNSKHLINLDIKSFYDNIKPLHVHNVYKNLFKFSDEVCDVLTLLTVYKNRVPQGACTSSYIANLIFFNSEYTLVSSFRQQSIIYSRLLDDVTLSSNKELPQDTVTKAIKSVAAVFKKYDLRLKNSKTKVEVKSDKKSEYKVTGLWIGNGEPRARKSERRYIRQLVYICGLKHHTSSSSQEYHDFWNKVSGMVAKLTRLNHPESASLRLKMSDILPTFSKEMKAKIILDIKKLLRKPSAQCSYTQGEIARVNKAFYLLGILGRTDKILAKNLRCDLKRKYKNLPTYNEVWR

SEQ ID NO: 3637 - protein, 391 aa, Aeromonas sp.
  source 1..391: note = Related to AP024466.1; note = Aeromonas jandaei
MDKPYYPYSPIASIDALSLTLGVIPEALVDIARKSSSSYTEFVVPSKNKDRLVYEPKHDLKRIQKRINTRIFEKVEYPRYLQGGIKDALIKRDYVENASLHTTSKHLINLDIKSFYDNIKACHVFAVYKYFFKFPDDVCEILTLLTTYKNKVPQGACTSSYIANLIFFNSEYSLVSSFRQRGVTYTRLLDDVTLSSNKELAEEEITKAIKDVSALFKKYDLRLKNNKTKIELKANKDADYKVTGLWIGNGAPRVRKHERRYIRQLVYVCSLKYKESSSSKEYHDLWNKVSGMVAKLTRLKHSDASGLRSKLTEMLPTFGDDVKRKIIHDIKKLMRKPDPQCSYTHGEIARVNKAIYLLGILSRTDRNLANNLRRDLKRKYKNLPTYNDIWS

SEQ ID NO: 3638 - protein, 391 aa, unidentified
  source 1..391: note = Related to RBJB01000003.1; note = Marinobacter nauticus
MDKPYYPHKPIGSLDALAKTLGVHPKLLLDFAEKANSSYTSFNIVSKSGKIRTVYEPKYELKKIQKRINDRIFEAVRFPLYLQGGISDDQSKRDYVENAKIHANSQCLIVLDIKNFYGNIKSDYVFDVFKYLFKFPDEVSMLLTKLVCLRGRVPQGACTSSYVANLVFHNSEYHVVSYFRQRGVVYSRLLDDVTLSTNDRPSAESTQEYIERVIALFKKYDLKPRSDKIKVYIKGSHAYTYDVTGLWVGHAKPKLRKSERRYIRQLVFECEKKYQASSCDPSYHKFWNYVSGQVAKMTRLGHHQSKELRRRLGLILPTIDALEEQKIAADVQKIAKLRRNHTYKSGDISRINKLYYKLGLLSRTNKGRSKALRSMLKSAHPNVPNKREYWL

SEQ ID NO: 3639 - protein, 391 aa, unidentified
  source 1..391: note = Related to NZ_VZZZ01000001.1; note = Marinobacter changyiensis
MDKPYYPHLPISTNETLAKTLGVHPKLLQDFCARSNSSYTSFSVTSKSGKQRIVFEPKYELKKLQKRINHRIFEKVRFPIYLQGGIKDYEKKRDYVENAKIHANSKTLISLDIKNFYDNIGEAYVYRVFKYFFNFPDEVSKTLTALVTLNGRVPQGACTSSYIANLIFFNSEYRIVANLRGQGVKYTRLLDDITLSIESEISEEHTSQLIKDVIALFKKHDLKVQNKKTKISVKHSHAQPYDVTGLWIGHSKPKLRKSERRYIRQLVFECEKKHSQGSAEIDYHKFWNHVSGQVAKMHRLGHSQSADLRSRLAMILPTLDDLSERKLEIDLNKLINSKKQTSLKYGDITRINKVFYTLGILSRTKRNKSRKLRRKLKNAYPKIPTKVEYWL

SEQ ID NO: 3640 - protein, 391 aa, unidentified
  source 1..391: note = Related to NZ_LAPT01000169.1; note = Pokkaliibacter plantistimulans
MDKPYYPFKPIGSLDALATTLGVHPKLLTDFSNKANDSYVKFEIVSKSNKRRTVYEPKFELKRLQKRINSRIFEKVEYPVYLHGGISDEINKRDYVENAKLHAKSNTLICLDIKDFYGSILLDHVFDVFKNFFHFPPDVSSLLTKLVTLNGNVPQGACTSSYLANLVFFNSEYNLVSRFRGRGVTYSRLLDDVTLSSNDKLSDTLVQKYIEEVSKLFAKYSLHIKNKKTRVHIKSDHSKPYDVTGLWVGHSSPRLRKSDRRNIRHEVFLCEKEFEFDSTSEKYHKQWNRVSGLVAKMQRLQHSQAKILRQRLSKVLPTYSDADAAAVIRDANKILNAKKKENMKIGELNRINRVLYSLGILGRTNSGKAKSLGKNIRAKYNNLPGKRAFWV

SEQ ID NO: 3641 - protein, 393 aa, Pseudomonas sp.
  source 1..393: note = Related to CP033104.1
MAKDKPYYPHGPIGSLAILAKTLGVPPKLLSDLAKKASSSYTPFVIETKGGKQRDVYEPKYELKRLQKRINSRLFEKIEYPTYLQGGVKDEAQPRDYIENSKIHAGSKFLISLDIRNFYDNIHIDSVLSIFKHLFKFPEDVSTLLTSLVTREGKVPQGACTSSYIANLIFHNSEYSYVKKLRDNGFYYSRLLDDVTISADRLVPQEEVTKTIKYVAGLFSEHGLRLRGSKTKIERADDLKSAYAVTGVWVGHGIPKIRRTERDMIRHSVYICEQEYAKNCFSDEYHALWNKVSGQVAKLTRLNHAQAPKLRHRMRSILPLYDSKATASIWRETDKMLKRPKKSHTKIGVINAYRRLIYQLGILARTDKGLSRALRRQLQSRFSGVPSKALMWE

SEQ ID NO: 3642 - protein, 393 aa, Pseudomonas sp.
  source 1..393: note = Related to JAEHTA010000001.1; note = Pseudomonas monteilii
MAKDKPYYPHQPIGSLATLAKTLGLPPKLLSDLSRKADVSYTPFNIITKGGKSRDVFEPKYELKRLQKRINSRLFECVEYPFYLQGGIKDDAKPRDYIENSRIHSGSQFLISLDIRDFYGNIQLESVRSVFKHLFKFPDDVSETLVKLVTREGRVPQGACTSSYVANLIFHNSEYSYVKKLRDKGFSYSRLLDDVTISCNRLIPQEEATEIIKYVSGLFREHGLRLRTNKTKLERSDDLKASYSVTGVWVGHGVPKIRRAERDMIRHSVYICERECVKDRYSDAYHDLWNKVSGQVAKLTRLNHVQAPALRDRMRDILPLYDSKAVASVRREVDKMLKRPVAHHSKVPVIDAYRQLVNKLGILGRTNKTLAKALRRQLKARFAGVPTKAMMWE

SEQ ID NO: 3643 - protein, 348 aa, Pseudomonas sp.
  source 1..348: note = Related to NZ_CP077075.1; note = Pseudomonas xanthosomae
METKGGKIRNVYEPKYELKRLQKRINSRLFEAVEYPKYLQGGIKDEENPRDYIENSRIHAGSRFLISLDIRDFYDNIPFASVVSVFKYFFKFPDDVSEVLAKLVTREGRVPQGACTSSYIANLIFHNSEFSYVKRLRDKGFSYSRLLDDVTISSDRLVAQEEATASIRYIAGLFREHGLRLRQSKTKMERSDDLKAPYAVTGVWVGHGVPKIRRAERDTIRHSVHICECEYEKDRFSDEYHALWNKVSGQVAKLTRLEHAQAPKLRKRMRKILPLYDSKAIASILRETDKMLRRPKSHHSKIGVIDAYRRLINKLGILSRTDRTLSRAMRKQLKAKFSDVPSKAMMWE

SEQ ID NO: 3644 - protein, 392 aa, Pseudomonas sp.
  source 1..392: note = Related to NZ_UWAB01000407.1; note = Pseudomonas viridiflava
MAKDKPYYPHASIGSLAMLAKTLGVHPKVLTDLASKASNSYTHFLVSTKGKDRDVYEPKFELKKLQKRINSRLFEKVQFPNYLQGGIKDESNPRDYIENSRIHAGSKFLISLDIRNFYDSIPLESVISVFKHFFKFPDDVSDVLARIVTRDGRVPQGGCTSSYVANLIFHNSEYSYVKKLRDEGFSYSRLLDDVTISSPRLISQDEATQRIRYLTGLFKEHGLRLRQSKTKLERSDDLNAAYKVTGVWVGHGIPKLRRSERDMIRHSVYICEKEYAKNPFSDEYHVMWNRVSGQVAKLTRLDHSQAPKLRDRMGEILPLYDSKAVASIWREADRMLRRPLSSHKRIAVIQSYRRLVNKLGIMTRTNRPLAKNLRRQLKARFSGVPSKVMMWE

SEQ ID NO: 3645 - protein, 393 aa, Pseudomonas sp.
  source 1..393: note = Related to AE016853.1; note = Pseudomonas syringae
MAKDKPYYPHASIGSVAMLAKTLGVHPKLLNDLAGRATDSYTHFVIRTKGDKERNVYEPKYELKKLQKRINSRLFEKVHYPFYLQGGVRDEDHPRDYIENSRIHAGSKSLISLDIRNFYDNIPYESVVSIFKYFFNFPDEVSDLLSKIVTRDGKVPQGACTSSYVANLIFHNSEYNFVSRLRNQGVTYSRLLDDVTLSSSRLLSQDEVSGYIKYVAGLFSEHKLRIKKSKTKIERSDDLSAEYTVTGVWVGHGVPKIRRAERDLIRHSVYICEREYQKDRFRDEYHELWNKVSGQVAKLTRLEHSQALKLRARMRDILPLYDGKATAAIIREADLLLKRPRTSHVKVSVVNAYRRLINRLGILTRTNKTLARGLRRQLKTKFSDVPSKVLMWE

SEQ ID NO: 3646 - protein, 393 aa, Pseudomonas sp.
  source 1..393: note = Related to CP054472.1; note = Pseudomonas aeruginosa
MAKDKPYYPNAPIASIEVLAKCLGVSPRVMLDLAGKVGSSYTEFLVSSKSKDRTVYEPKFELKKLQKRINSRIFSAVQFPTYLQGGIKDAKSPRDYVRNGEFHAGSCMLVSLDIRNFYDNIKRERVEDVFKNFFRFPPDVCQVLTDLVTLKGKVPQGACTSSYIANLVFHNSEYSIVSYLRSKGITYTRLLDDVTLSSKKPLSDESLSDVIGRISGMFKKHGLRIHPGKKKIELASDSRSDYKVTGVWVGHGVPKLRRKERDYIRHLVYICECEYKKDPTQDSYHELWSRTSAHVATMTRLEHSQSVELRKRMSKILPLFSEARKKQVIVEAGKLLRRDFSKAMRLGVIKTYNKTMHSLGILSRTDRAKSKRLRKELRLKFSGIQSMQQYWEG

SEQ ID NO: 3647 - protein, 393 aa, Pseudomonas sp.
  source 1..393: note = Related to JAHUVZ010000002.1
MAKDKPYYPNASIASIDILAKCLGVSPKVMLDLASKTESSYTEFLVSSKSKDRTVYEPKFELKKLQKRINARIFAAVQFPGYLQGGIKDSDSPRDYVRNGKCHAGSNMLVSLDIRNFYDNIKRESVEDIFRNFFRFSPEVCSVLTDIVTLKGKVPQGACTSSYIANLVFHNTEYSVVSYLRSRGITYTRLLDDVTLSSKSELSDEVLSEIIFKVSGMFKKHKLRIHPGKKKIEIAKDSRSEYKVTGVWVGHGVPKLRRKERDYIRHLVYICEQEYKKDPSVDSYHELWNRTSAHVATMTRMEHSQAVDLRERMSKILPVFGVDRKTQVIVEANKLLRRDISNNVRIGVIKTYNKTMHSLGILSRTDRAASRYYKRALRRKFSGVKTIQQFWEE

SEQ ID NO: 3648 - protein, 392 aa, Pseudomonas sp.
  source 1..392: note = Related to NC_018028.1; note = Pseudomonas stutzeri
MAKDRPYYPNASISSIDVLAKCLGVSPKVMLSLAKNSSNSYTQFTVPSKGKDRVVYEPKLNLKKIQKRINSRIFEHVQFPPYLQGGIKDNLSPRDYVENSKFHAGSSVLVSLDIRNFYDNIKYDSVYDVFLYFFKFEPSVCTVLTDLVTLNGKVPQGACTSSYIANLVFHNHEYSLVSYFRSKGITYSRLLDDVTLSSSKEIPPQEIEEAISKVAEMFKRHKLRIHPKKKKIEVSSDTRSEYKVTGVWVGHGVPKLRRKERDYIRQLVYICELEYKKDPTAEDYHDLWNRASAQVAKMTRLDHSQASALRSRMSKLLPLYSPAKRKQVIIKAKTLLSRNKSDAKELGFIKMYNKTYHSLGILSRTDKPTSRYYKAALERKFSVEPIKQFWEN

SEQ ID NO: 3649 - protein, 393 aa, Pseudomonas sp.
  source 1..393: note = Related to QJRF01000029.1; note = Pseudomonas taiwanensis
MAKDKPYYPHSSISSIDTLAKCLGVAPKVMLDLARDTENSYTEFVVPSKGKDRTVYDPKHNLKKIQKRINSRIFEHVLFPEYLQGGIRDVDSPRDHVNNGRAHTGSSVLVSLDIRNFYDNIKYPSVFDVFKNFFKFPDEVSKVLADLVTFRGKVPQGACTSSYVANLVFHNTEYSVVSYLKSRGIQYTRLLDDVALSSNRVISKADLEGAIEKVAGMFKRHKLRIHPRKKKIEYSSDSRSEYKVTGVWVAHGVPKLRRKDRDYIRHLVHICELEFLKDPTADSYHELWNRSSAQVAQMTRLGHSQAASLRSRMSEILPLYGPSRKTQLNIEVKKLLGRKQSESNSLGFIRTYHKLINALGILSRTDRGLARSYRGLLTAKFPHVRSKVKYWEQ

SEQ ID NO: 3650 - protein, 393 aa, Pseudomonas sp.
  source 1..393: note = Related to NZ_FRBQ01000013.1; note = Pseudomonas punonensis
MAKDKPFYPHAPISTLDVLAKSLGVSPQVMSKLSSSADDSYTAFSVSSKNKDRTVYDPKYNLKKLQKRINSRIFEHVVFPQYLHGGIRDVSHSRDYINNSRIHAGSRVLVSLDIKNFYDNIKRDSVFDIFKSFFRFPDEVSTLLTNVVTMRGKVPQGGCTSSYVANLIFHNTEYSVVSYLRSFGIEYSRLLDDVTLSSSHPIPPEKLEQAISKVAGMFKRHGLRVHPHKKKIESSSDSRSPYEVTGVWVGHGVPKIRRKDRDYARQLVYICTKEYLKDYTSDAYHALWNKSSAHVARMTRLDHAQARQLRDRLSKILPQYSAARIKQLSFEYKKLINRPVADVATLGFSKSFHKLIHSIGILSRTDAHLARHYRKSLRAKFPRVLSKADHWGI

SEQ ID NO: 3651 - protein, 393 aa, Pseudomonas sp.
  source 1..393: note = Related to QTSW01000011.1; note = Pseudomonas lactis
MAKDKPYYPLSPIASINALAKTLGVVPKLLVDIAANVSTSYTSFDIESKKGKLRTVYDPKYELKRLQKRINSRIFEKVIFPLYLQGGIKDQENPRDYVENCKLHAGSSFLISLDIKNFYDNIRMSSVFDIFKYFFKFPDPVCEILTSLVTLDGHVPQGACTSSYIANLVFHNSEYKLVSCFRDQGLNYSRLLDDVTVSSKNLISQEKTTDIIRSVAAVFKKYDLRLNSKKTKVERSDDLGADFKVTGLWVGHGQPKLKKDERRYIRQLVYVCEKDYQNNPCSEKYHELWNRVSGKVAILTRLKHVEAQNLRARLGCVLPLYDEDAKAKICFESKKLLRRHPSTHSKVGVMTAYHKIIHSLGILTRTDRALARSLRKQLRARYSALPLKRDIWE

SEQ ID NO: 3652 - protein, 393 aa, Pseudomonas sp.
  source 1..393: note = Related to NZ_CP043571.1; note = Pseudomonas migulae
MAKDKPYYPLSPIASIETLAKALGVVPGLLKDLGEDASNSYTKFDIVTKNGKERTVYDPKYELKRLQKRINSRLFEKVIYPGYLQGGIKDPNNTRDYVENCKLHAGSKFLISLDIKNFYDNIRETSVLSIFKHFFKFPDDVSVLLTKLVTLNGRVPQGACTSSYVANLVFHNSEYSLVSKLKSRGLVYTRLLDDVTISSSTLLTQDVATDLIKDVAAVFRKHNLRLNNSKTKVERSDDLAAEYKVTGLWVSHGQPKLKKEERRYIRQLVYICEQEHQKSPFEESYHDLWNRVSGKVAIVTRLKHVEAADLRGRLSKILPLYDSTKRSQILFEAQKLLRKHPSTHTRMGVINSYHKIIHAIGILTRTDRVLARALRRQLKAKFSDLPLKSQVWE

SEQ ID NO: 3653 - protein, 393 aa, Pseudomonas sp.
  source 1..393: note = Related to CP073082.1; note = Pseudomonas aeruginosa
MAMDKPYYPYRPISSIDALARTLGVVPKLLCDLADDPATSYVKFTIFSKNGKQRDVYEPKYELKRLQKRINSRIFELVIFPSYLQGGIKDVEFPRDYIENSKIHAGSGALVSVDIKDFYNSIREPSVLSIFKNFFSFPDDVSCLLTRLVMLEGRVPQGACTSSYVANLIFHNSEYSLVSKFRAKGLAYSRLLDDVTVSATKPISQEESTLAIKSIAAMARKHDLRLNSKKTKIERSDDINADYAVTGVWVGHGVPKLRKDERRHIRHLVYICEKEYAKDCFSVEYHSLWNRVSGQVSKLTRLKHAQAKSLRERMGNILPKYDFQAKAKIIYECSRLLRRPVSSHKKIGVINNYRRLIYSIGILSRTDRSTAKALRRQLVERFAGVPSKAEMWS

SEQ ID NO: 3654 - protein, 393 aa, Pseudomonas sp.
  source 1..393: note = Related to NZ_CP027733.1
MAKDKPYYPHHPIGSVESLAKCLGLPPRLLKDLSEDTSNSYTEFSITSKSGKERIVYDPKFELKRLQKRINSRLFEGVFYPSYLQGGIRDQKNPRDYIVNGTIHAGSKNLIGIDIKDFYNNIKEESVKPIFTRLFNFPDAVASILTKLVTRDGRVPQGACTSSYVANLVFFNSEYSLVSRMRARGFSYTRLLDDVTLSSKRPITKEESTELIKEVAAIFKKHNLRLNNKKTKQESAGDVKAEYKVTGVWVGHGIPKLRKAERRHIRHLVYICEKEYLKCRFSEEYHALWNRISGQVAKLTRLEHSQAEDLRLRMSGILPEYDNQMKASIIFEADKLLKKPVAHHVRPGVISSLNKTLYSLGILTRTDKPLARHYKKMLRLRFINAPTKSEMWG

SEQ ID NO: 3655 - protein, 390 aa, unidentified
  source 1..390: note = Related to NZ_OBMO01000006.1; note = Alcanivorax xenomutans
MDKPYYPHNGISSIQSLAKTLGIHPSLLVDIASKTTDSYTEFQITSKNGKIRTVYDPKYELKRIQKNINQKILEKVEYPTYLQGGIRDLENRRSYVDNAGIHAGSNHILSLDIKNFYDNIRPEKVKEIFLYFFKFSDETSELLTKLVTLGNKVPQGACTSSYIANLVFFNSEYRIFSELKSKGISYSRLLDDVTLSSRKHLSRDEASEHIRLVCSIFKKNGLRLNNKKTKNELKGSNPNFKVTGLWVEHKNPKIPKKERHHTRHLVYICEKEYAKSPSSEHYHQLWNKTSGQVAKLKQLGHSQHKQLRTRLKKILPILDESSKKKLILDCKKLLHLERNAKERFGVLKRINKCIYMLGILSRSDKGLSSNLRRQLLKHFGDLPTHKDYWI

SEQ ID NO: 3656 - protein, 396 aa, unidentified
  source 1..396: note = Related to NZ_FUKJ01000432.1; note = Crenothrix polyspora
MKLKPHYPHNPIASIEALAITLGIHPKLLQDLANKANDSYINFTVSSTNRKGEDKDRHVCEPKHELKKLQKRINSRIFEKVEYPNYLQGGIKDEENPRDYVANATRHANANQIICIDVKQFYPSIKSQYVVKVFQYFLNFPPDVSEILTKLVTYHGRVPQGGCTSSYIANLIFYDTEYLLVSELQKHGIQYSRLLDDITLSTQKNFTKEQENFYIKKIADIFKKYELKINNKKTRNEHSSNPAVSFEVTGLWIGHKKPKARKEERRFIRQLVFMCEREYTQSPYSEKYHERWNEASGKVAKLQRLEHLQATKLRERLGIILPLYDENMQSQINQETKKLVKLSAPQNQRLGNIKRVNILIHKLGILARNNKSLANSLRSQINEVYANKPTIKEIWE

SEQ ID NO: 3657 - protein, 396 aa, unidentified
  source 1..396: note = Related to PERX01000093.1; note = Methylobacter sp.
MKLKPHYPYNPIASIEALATTLGIHPKLLQDLANKVDDSYTNFIVKSKNKKGEQKDRDVCEPKYELKKLQKRINSRIFEKVEYPLYLQGGIRDEESPRDYFANATCHANATQIICIDIKKFYPNIKSKYVTKVFQYFFKFPPDVSELLTKLVTYHDRVPQGGCSSSYIANLIFYDTEYLLVSELQRHSIQYSRLLDDITLSSQQNFTKDQETQYIQKIAKIFKKYELKINSKKTKIEHRANPEVGFEVTGLWIGHKKPKARKEERRFIRQLVFMCEREYKLNPCSEKYHERWNEVSGKVAKLQRLEHLQARKLRERLRLILPLYDENVQNQITQEAKKLIKLPSPQNQRLNNIKRVNQLIYKLGILARNNKTLANSLRLQINKAYANKPTIKEIWE

SEQ ID NO: 3658 - protein, 392 aa, unidentified
  source 1..392: note = Related to NZ_JACXSS010000001.1; note = Methylomonas albis
MKLAPHYPNNPIASVEALAITLGIHPKLLLDLSNKIDNSYTSFLTPQKNGKERLVHEPKYELKKLQKRINSRIFEKVEYPEYLQGGIKDENNPRDYVANALRHSHANQIICIDIKQFYPNIKSEYVSKIFQHFFKFPAHIAELLTKIVTLHNRVPQGACTSSYIANLLFYDTEYLLVSELQKHNIQYSRLLDDITLSTQTTLTKEQETFYIKKIAALFKKYELKINGRKTRIEHRANPEASFEVTGLWIGHKKPKSRKEERRFIRQLVFMCEREYKVNRCSEKYHERWNEVSGKVAKLQRLQHVQAKKLRERLSLVLPVYDEPMQKQLIQETKKLVKVTAPQNQRIGNIKRVNSLYYRLGILGRNNKSLANSLRLQLNKVYGNKQTKKEIWE

SEQ ID NO: 3659 - protein, 396 aa, unidentified
  source 1..396: note = Related to NZ_CP014360.1; note = Methylomonas sp.
MKLKPHYPHNPIASIEALATTLGIHPKLLQDLANKADDSYTDFLITSKNRKGEVKDRTVCEPKFELKKLQKRINSRIFEKVEYPLYLQGGIRDEESPRDYVANAQIHAHANQIICIDIKQFYPSIKIPHVKNIFKYFFKFPEEVSEMLAKLVTYRGAVPQGGCTSSYIANLIFYDTEYLLVSELRKHSVKYSRLLDDITLSAEKDFTKEQEEFFIRKISAMFTKYGLSMHSGKKRIEHRSNSDVSFEVTGLWIGHKKPKARKEERRFVRQLVFMCEREYKVSPYTKEYHERWNEVSGKVAKLQRLEHQQAKNLRKRLGLILPLYDENMEKQLTHETKKLITLSLPQSKRPGNIKRVNSLINKLGILSRNNKALARSLRLQLSTVYADKPSNKEIWE

SEQ ID NO: 3660 - protein, 302 aa, unidentified
  source 1..302: note = Oxalobacteraceae bacterium; note = Related to JACYUQ010000012.1
MDKPFYPFPGIGSVEALAKALDVHHDLLLDIAKKVDQSYTSFDIPKKNNSGYRTVCEPKHELKRLQKKINSRILELVKYPSYLQGGIKDKSLSRDYVKNAAIHVKPTVLISLDIKNFYPNIHRSHVLNVFKNFLGFHPDVAEVLTCLTTLNDRVPQGGCCSSYLANLIFFGDEFKLVQKLRKLGWRYSRLLDDISISSTDDIKDNISPIKEISSLCKRYGLKLNNSKTDVSHRSNGVASLAVTGVWIGHSEAKLRKDERRYIRQLVYVCEKKYADDPCDSKYHDFWNRVSGKVAKLSRMEHV

SEQ ID NO: 3661 - protein, 398 aa, unidentified
  source 1..398: note = Related to NZ_AQXY01000025.1; note = Thioalkalivibrio sp.
MPQKSAKKPHYPYKPIGSVETLARMLGVHPKILTDIANRTDDSYTDFTITTPSGKERNVSEPKFTLKKIQKRINRTILEKVEYPLYLMGGIRDLEEPRDYVSNASAHAGASTIIKLDIKNFYPNIRRQNVYDIFRYLLRFPEPVSDLLTTLCVRHHRLPQGACTSSYLANLIFFNAEYQLAASFERQAIAYTRLLDDITISSPKQLTPAKTTEIIRSVAAMCKKHGLKLNNKKTRVDRVHQRDSDYIVTGLWAKHSVPKVPRHERRAIRKMVHDCENRFTTDPASPEYHSMWNQASGKIAKLKRLGHSQAQPLRARMRKILPQIGDQEKDNLILECKKLANKSRRNTDRIGHILRVNRAIHKVGLLSRTDKRLARSLRRQVVAAYPNKPTIKDYWEIK

SEQ ID NO: 3662 - protein, 343 aa, Escherichia coli
  source 1..343: note = Related to NZ_CP050193.1
MSYKQFKVETGKNKKERQIFEPKRSLKGIQKKINKEIFEKIDYPHYLHGALSGRDYISNAAVHTRKRTVICLDITNFYPSISKKDVCSIFKNLMRFSPEVSLCLTELVTLNDKVPQGGCCSSYIANLLFFNSEYNLYNRLKSMGLSYSRLLDDITISSDKDLSSEEKTKVIKLVHGMVNQYRLSINESKTTIEHSKDSSSKLSVTGLWVKHGVPKLTKENRRYIRYLVYICKKQGAYERHTKEYHDLWNRCSGKVAQMSRLGHVQAVELRAILSEIMPVYDDYKISKLKLMAKHYLNKFTPPLTDDQIRKIDRMLYDFDIVGRTNKNLAKLYRRKLVALLPDR

SEQ ID NO: 3663 - protein, 379 aa, unidentified
  source 1..379: note = Related to CP068315.1; note = Klebsiella pneumoniae
MNKPRFNGTPIASLDSLAAMLGIDRKRLDWMVLSVSRSYKQFTVETGKNKKERKIFEPKRSLKGIQKKINKEIFENIDYPHYLHGAITGRDYISNASVHTKKKTIICLDITNFYPSISKRDVTLIFKNLMRFSPDVSIALTELVTLNNQVPQGGCCSSYIANLLFFNSEYNLYNRLQSIGYSYTRLLDDITISSDEDISLEEKTKVIQLVYRMVSQHRLSINEDKTTIEHTKDSSSKLSVTGLWVKHGVPKLTKENRRYIRYLVYICQKQAAYERHTKEYHDLWNRCSGKVAQMSRLGHVQANELRCVLSDILPIYDDYKIGKLKYVAKHYLSKFTHPLSEEQIRKVDRMIYDFDIVGRTNEKLAKDYRSKLRALLPER

SEQ ID NO: 3664 - protein, 331 aa, Escherichia coli
  source 1..331: note = Related to DADHSI010000124.1
KKRTIFEPKKALKALQKKINREIFENVTYPSYLHGGLKEKDYISNSASHTKKKTIICMDIQDFYPSISKRDVHQIFQYLMRFSPDVSSALTELVTLNGKVPQGACCSSYIANLVFFNKEFNIVNKLSRKGLSYTRLLDDITVSSDNDLSDAEKTEIIQLVTGMARSYRLNINKDKTSIEHSKDSNAKLQVTGLWVKHGIPKLTKADRRYIRYLVYICKKDYDAKKDSVEYHDLWNKCSGKVAQMERLGHSQAKDLRQTLSEILPIYDEFRIKKCTMFAKRYIKTFSPPLSEEQISKVNKLIYKFGIVARTQKNLAKTYRRELRALLPIEKQ

SEQ ID NO: 3665 - protein, 380 aa, unidentified
  source 1..380: note = Related to NZ_CP083739.1; note = Hafnia paralvei
MMKPLFNGTQLASQDSLAAMLGVTTERLNKIVLSIPKSYKSFNIETGKNKKVRTLFEPKKGLKHIQKKINKEIFENVNYPNYLHGGLKERDYVSNAGTHAGKKTIISLDIENFYPSISKRDILNIFKNMMRFSPSISETLTELVTLDGKLPQGACCSSYIANLIFFNDEHNIVRKINNMGMNYTRLLDDVTISSDKKLSKEEETKAITTVVGMINRHRLSLNDAKTVIEKSDHPNSKLHVTGLWVKHKTPKINKENRRYIRYLVFICEKESAVDRTSTEYHTLWNKASGKVAQMSRVGHEQSVELREKLGKILPLYDEFKIRKIVFLANNYIKNFSLPLSEEQVSKVNKIIYDVGIVGRSNKKLSNELRKKLRSILPKDA

SEQ ID NO: 3666 - protein, 379 aa, unidentified
  source 1..379: note = Related to MECU01000027.1; note = Shigella sp.
MKPLFNGTQLSSHSSLAAMLGVTPEILDKIVLSIPKSYKDFCIKTGKNKKERAIFEPKKGLKYIQKKINEEIFCKVKYPVYLHGGLKNRDYVSNAGFHSGKKTIISLDITNFYPSISKKDILNIFKNMMRFSPSISETLTKLVTLNDKLPQGACTSSYIANLIFFNDEHNIVSKLNRMGMTYTRLLDDITISSDKKLSKEEETKAITTVIGMINRHRLSINNDKTVIEKSDHHNSKLHVTGLWVKHKKPKVSKENRRYIRYLVFICQKESVVDRTSSEYHKLWNKASGKVAQMHRLGHPQSIELREKLSEILPLYDEYKIRKIVFLSNNYIKNFSLPLSDEQIKKVNKIIYEIGIVGRTNKKLANELRGKMKSMLPKVK

SEQ ID NO: 3667 - protein, 384 aa, unidentified
  source 1..384: note = Related to NZ_WVWD01000013.1; note = Leclercia adecarboxylata
MNKPYYKKSPIASVEKLSLTLNVTPERLAVIVDNIHNSYKTFTKVTGRNKKERSLSEPKKGLKKLQKRINQEIFENVSFPDYLHGGLKGKDYLSNAKVHTNKKHLISLDIENFYPSISKKNVLEIFKYMMRFPEDVSKVLTELVTLDGHVPQGSCCSSYIANLVFFNTEYNYVNQLKNKGYHYTRLLDDITISSDKELDKKEKTFIINQMRAMVEKHRLKINDEKTKVESHTDLRSSFEVTGLWTKHKNPKLRKPQRRHIRYLVFICSKQAEYERTSNEYHALWNKVSGKVAQMQRIGHTQANQLREQLTKILPIYDDFKIKKVIYLADILSKTKKEEITFAKVERYRKIIHKLDIVSRSNKKLADKHRSVLHTIFKDCKVESE

SEQ ID NO: 3668 - protein, 384 aa, unidentified
  source 1..384: note = Related to JAGNRY010000075.1; note = Paludibacteraceae bacterium
MKKPIYKKSPIGSLESLSAMLGINQSQLDHIINSIPNSYKSFKIETGKKLKLRQLHEPKKGLKSLQKKLNKEIFENIEYPYYLHGGIKNRDYLSNARIHSGSKSLISLDIKDFYPNIRKTDVINIFKNLMRFPADISEALTKLVTLNGEVPQGSCCSSYIANLIFFNNEYNIVTKIENKGFRYTRLLDDITISSDRELTNNEKTFIINSVRSMIKSHRLNINEDKTKIESSSNLNDGFEVTGLWAKHKAPKVRKNHRDHIRHLVFICKKQAEYDKESPEYHALWNKASGKVAQLTRLNHAESNPLRIILNSILPEYNEHKIKKITKIADNLIKEKNKVTSNDLINKINKLLYELSIVSRTRKSLAYRYRKKINSCFSSVLKVSI

SEQ ID NO: 3669 - protein, 367 aa, unidentified
  source 1..367: note = Related to CP066129.1; note = Morganella morganii
MLGISKSQLDNIINHVSDSYKSFIKETGKNKKSRELFEPKKTLKQIQKKLNKEIFEGITYPNYLHGGIKNKDYITNAKVHSGAKSIISLDIENFYPSIRKNDVLNIFKNLMKFPQDVSESLTKLVTLNGVVPQGSCCSSYIANLVFFNSEYHLVTKVKNKRFEYSRLLDDITISSKTEFTNEEKTFVINNVRAMANRYRLSLNENKTKIENSSDLKSDFEVTGLWAKHSVPKLKKCHRRYIRYIVFICEKQALFDRTSMDYHALWNKASGKVAQLKRLNHSESNMLRDRLSLVLPEYDDDKIQKIIKIADNLLVNGHKLNAIDLKDKINHLFYEFGIVSRTKKSLAYRYRKKIRANFSSITDKVTIS

SEQ ID NO: 3670 - protein, 394 aa, Pseudomonas sp.
  source 1..394: note = Related to NZ_UUIA01000028.1; note = Pseudomonas viridiflava
MANDKPYYSKKPIASVEALAQCLGVTPERLLLIAKNSEKSYIEFTVYTGKDKTNLKKRVLHEPKPFLKSIQKKINREIFEHVIYPEYLHGGLKERDYITNVSLHAGAKTIIAMDIQDFYPSIQRTHVQDIFTLLCKFPPAISSLITDLITINGRVAQGACCSSYIANLIFFNSEYGRISKFRSQGLTYTRLLDDITISSRVVLEEKKISNAIESVASLFTKFGLKLHPRKTKVEQSSDTKAKFEVTGLWAKHGNPKIRKKDRHYVRHLVFICQKEFEKDSNCSKYHELWNMTSGKVAVLTRLKHAQSKDLRKKLGSVLPTYDSEASAKLQRIAYKLCRIPETETSSPGKLKIYHKLKYHFGIVARTDRQLAKKWKEVLDTKFKASAIAARSTNE

SEQ ID NO: 3671 - protein, 385 aa, unidentified
  source 1..385: note = Related to nan
MKKPIYNGKPISTLDALSKALGTNLSRLRIFIDTAENSYTTFTLEKKVNGIVVKERTLNEPKKNLKDLQKRINQAIFNNVSYPEYLQGGIKGKDFITNSKNHLSAKSLINLDIKDFYPSISIHHVYAIYNKLFKFPHTVSDALVKLTTKNGVVTQGGCCSSYIANLIFFNSEHDLVQKLESRSLTYTRLIDDITISSAKPMSKDEITNTINLTNNHLTKFNLNLNRDKTNIDHHHNKSDNFEVTGLWVRHGKPKVKSAVRRQIRQLVFKCKIQYELCPTDKSYHDLWNKTSGKVAILTRLGHANSKIYRKKLSEILPLYDIKKEEKIERIINYLIDTESKEINSPRRIKLYHKMIYHCGILGRSNKSKAKLLKNKLKAKFIAVQV

SEQ ID NO: 3672 - protein, 394 aa, unidentified
  source 1..394: note = Related to NZ_SOBR01000014.1; note = Chromohalobacter marismortui
MADKPYYPGSSVAHISTLAAMLEINRDLIEKHSKNTSSSYTTFLISPPSKKSREVSEPKESLKKIQKRINSRIMSEVDYPKYLMGGIRDTASRRDYVNNSKLHLKPETLINLDIENFFPNIHKEHVKNVFKYLFRFSEDVSETLSCLTTLEGVVPQGGCTSTYLGNLVFFNYEYGVVSKLRSKGISYSRLLDDITLSSKKRLTEEEKTWAISLVAGMINHYGMNMHDGKTRIEHRESRDAKYEVTGAWVRHGEPKIRKDDRKKIRSAVRKCEIMYEESPYSSEYHKQWNKTSGRVAQLGRFNHKAEEKKLRERLKTILPLYDDVYSKTLSVKVNQVVRRRRKNQINIDSVGTRNYILKLYHELGIMARTKKTQARRLKQSLRENFGNIISNPHY

SEQ ID NO: 3673 - protein, 393 aa, unidentified
  source 1..393: note = Related to NZ_NSKA01000004.1; note = Halomonas sp.
MADKPYYPLPPIGSVSVLAAMLKINEKQLIHIANNASNSYTSFEITPEGKKPRDVVEPKEQLKYVQKKINAMIFSEVKYPIYLMGGISDKVQSRDYINNGKLHLNKNTLINLDIENFFPNIKHVYVKKIFTHLFKFPESVSEILTKLTTLNGRLPQGGCSSTYIANLLFFNYEYHIVSQLRNKGITYSRLLDDITLSSNKKLNKEDKTHAISAVDGLIKRFELSINTSKTRIEHKDDLSAQYEVTGSWVRFGELKFPGKARKKIRSAVKKCELMYQENCYSAEYHSQWNRTSGRVAQLKRFGHHKQEREFRTRLGKILPLYDEQQAITLRTKVYQLVKKRKLNKLRLDNPGLRKQILTLYHQLGILARNNTSSKILKNELRENFSFLINNPYY

SEQ ID NO: 3674 - protein, 393 aa, unidentified
  source 1..393: note = Related to CP040452.1; note = Halomonas sp.
MGDKPHYPFEPIASSKTLAKTLGVNLPLLLKTASNTSNSYTSFIVPTKSKDRTVYEPKTTLKYIQKKINKEILSRVEFPSYLMGGIKDTQSPRDYLANSRMHLRKESLINLDIENFYHSIKKPYATQIFKQLFKFNDEVSNLLTELVTLDGQVPQGACTSSYIANLVFFNSEYTVVNNLRAKKIAYTRLLDDITLSADRKLTNIEKEWLISQVTGMIVSHELKIKDAKTRIENRDHPRSRYEVTGAWVKYGEPKLRKKERNKIRHDVYICELFHEKDPTTEEYHRLWNRTSGLVSKLGRFNHKNEADKLRKRLSFILPKYSDIQAKTLQTKIYQIVNRKKKNNIDINNPGLSKQILRFYHNLGILSRTHPHLSKPLKNQLRSEFGTMIRNEYY

SEQ ID NO: 3675 - protein, 391 aa, unidentified
  source 1..391: note = Related to JABFTW010000016.1; note = Halomonas sp.
MADKPYYPHAPISNIDTLAKMLGVRSSLLILIANKANSSYVSFEVETKNKQRMVNEPKTILKYIQKKINSQIFNSVEFPAYLMGGIRDPKTPRDYISNAAIHAKAKTLISLDVKDFFPTTQEVHIKSVFKNLFNFPEDVSNTLTKLVSLNGRLPQGGCTSSYVANLIFHNSEYKVVSQLRQKGIRYTRLLDDITLSANRPLSKNECEKYIRLVAGMITKHDLTINSGKTKVEYSKNIASPYEVTGAWVRHGKPKLRKKERNEIRHIVHIVEKKYAENPYDKEYHDLWNKASGLVAKLKRFEHINESKGLRKKLKATLPLYDDQKAETLRVQANKLLRRQARNTLNYNSGTKKSIDKLVYDLGILSRTRPEISKPLKKKIKDSFTGIDFDGI

SEQ ID NO: 3676 - protein, 395 aa, Vibrio sp.
  source 1..395: note = Related to JAERHH010000003.1; note = Vibrio vulnificus
MNSVRRDKPYYPSSPISSVSRLSDVLEVRENVLRDLIQNKSTHYHSFSIETTSSDGKKKNRSIHEPKFLLKKLQKRINSRILSKVEYPHYLQGGIYDEDNPRDYYSNAAIHSKANCVMSVDIKNFYPSIKTEQVTRIFKFFFKFPQDVSELLAELVTYEGFVPQGAVTSSYIANLLFFEDEYKVVAHLAGKKLLYSRLLDDITISGKSISNQDFGKIKTQIVGMFKKRGVRINRKKTALVYSGIRSVTGLRVEHSTPRCDRKEKRRIRAAVKHCEIQYQIDRTSDEYHSLWNSTSGKVAKLERVGHSQAKKLRTRLQQIYPTLSTGQVHALKIAIKKLEKVPSSKRMKIGYLKQVNKLIHRTSLVFRTDKPLAHSLTERLITIKPVKTYSDFWEK

SEQ ID NO: 3677 - protein, 410 aa, unidentified
  source 1..410: note = Related to JAGOQM010000006.1; note = Neisseriaceae bacterium
MNKFNFDKPYYTQRPISSIKALANALGADQQALIQLANNKTNYHYYTKHVKSGSKTKQRSIFDAKHSLKKIQKRIISRIFCHIEFPQYLHGGIKDLNQPRDYFSNATVHCNSKNIISLDIKNFYDSVRDDKVLIIFLNFFKFPKDVAQILTQLVTVQWSDYDKDISQSARHLPQGAPTSSYLANLIFFDNEYKLFNHFKRQKISYTRLLDDITISSLSEFTKAQKTKIITRVAGMVRESDLKLNNKKTICTSFREPGKKMIVTGLWVNHSIPKLQKHSLKKILEGVKSCEYIHSRCPFSFEYHKEWNTYSGKVANMARSYPNLAKRLRVRLSTILPIFSPKQTLVLERQIDTLLNSKTTQTNKLTNIKRFNKAYYAIGIISRTDKRLARKLRSRLLTRMPNITYKDYWEN

SEQ ID NO: 3678 - protein, 389 aa, unidentified
  source 1..389: note = Related to NZ_CADFBN010000021.1; note = Burkholderia gladioli
MRPQYLKKPIGTVATLSAALRVSEPVLRHAESNLDAHYTPYEIPKRDGRVRSIVIPSLHLKTIQKRINREIFAHVEYPSYLYGGVNGQDYVRNASAHRGAQVLIALDVKDFYPSISRKRVANIFQHFLHFGAEVSDLLAGLTTYQNKVPQGACTSSHLANLVLHDVEYSIAQYCHNAGLVYTRLLDDITISSRKHVSGEKITKIIAMVSRMLKSKGLKIKRQKTKITSKSNPEDLMEVTGLWLNRGAPRANSFARRAIRVEVYKCSQSAKKDKASSNYHKDHASASGKVAMLNYLGHGEAGRLRKMLADILPIYDERELTKTEKMVRMLRRSSEKDREKYAYNVRFHKVMQRLNIVARTDKVLADRLRQELCASRPVKSSNAALYDEPI

SEQ ID NO: 3679 - protein, 336 aa, unidentified
  source 1..336: note = Related to NZ_CADFFT010000005.1; note = Caballeronia sp.
MIPSLHLKTIQKRINREIFSHVTYPEYLYGGVPGKDYVRNAKRHELAHVVIALDVKNFYPSISKLRVSNIYQHLFKFGADVSDFLAALTTYENKVPQGACTSSHLANLVLHDVESSVVKYCNDSGLVYTRLLDDITISSTRRLPEKKVEKIVGMVATMLKGKGLKLKHNKTRVSTKANPEELMEVTGLWLNRGAPRVHSVSRRLVRVEVYKCKEAAKVERVSESYHKAFARASGRVAMLCYLGHAESGRLRKSLSEMLPLYDVREVTKTKKIVKMLGRTSEKDRSKYSYNVSYFKTMQRINIVSRTDPLLARTLRHQLLMCKPKNKSDAALYDEPI

SEQ ID NO: 3680 - protein, 389 aa, unidentified
  source 1..389: note = Related to NZ_CADESX010000025.1; note = Burkholderia anthina
MRPYYTKNRIGSVAALSAALRVSEPILKHTADNLERHYTPYEIPKSNGKPRLIVIPSLHLKTIQKRINREIFSHVAYPHYLYGGVSGKDYVRNAEAHQNAHVVIALDVKDFYPSISFARVVGIYQHFLKFNPEVAELLASLTTFKNKVPQGACTSSHLANLVLHDVEYSIAQYCENFGLIYTRLLDDITVSSTKALSPQKIKKIIDMISKMLRDKGLRVKHQKTRVSSKANPENLMEVTGLWLNRGAPRANSFDRRLVRVEVYKCKQAAAVDRTRPEYHKAHASVSGKVAMLNYLGHAEAGRFRTTLAEILPLYSVGEITKTEKIVAMLCKSSLKDRGKYTYNLNYYKTMQRLNIVARSDFALAKRLRVKLLGYKPTKLSSDALYDEPI

SEQ ID NO: 3681 - protein, 396 aa, unidentified
  source 1..396: note = Related to CP090714.1; note = Burkholderia multivorans
MSTFFSVMRPYYTKKPIGTTAALASALRVSEPVLKHAANNLDRHYTPYLIPKGDGKQRAIVIPSLHLKTIQKRINREIFSHIEYPHYLYGGIDGKDYVRNAGAHKDRHTIIALDVKDFYPSITFERVLGVYQHFLKFSPEVAELLAKLTTFNKRVPQGACTSSHLANLVLHDVEYHVVQYCENAGLTYTRLLDDITVSSPKPLPVQRVSKIIEMISKMLKGKGLRLKKPKTRVSSKSNPESLMEVTGLWLNRGAPRVNSATRRAIRVEVYQCKQAAATSRTSLDYHKKHASASGKVAMLNYLMHAEAGRLRKALADILPLYDVSEMTKTRKIVEMLSRASVADRGKYSFSLSYFKTMQRLNIVARSDAALAHSLRRKLLVCKPTKPSSATLYDEPI

SEQ ID NO: 3682 - protein, 362 aa, unidentified
  source 1..362: note = Related to FOWV01000008.1; note = Ralstonia sp.
MHTARNIEKHYTPYEIPKADGKVRAIVIPSLHLKTLQKRINREIFSNIVYPPYLYGGIEGKDYVRNASAHRSAHVVIALDVKDFYPSISFHRVLNIFQYFFKFSPEVSELLAKLTTFQNKLPQGAATSSHLANLVLHDTEYHLAQYCENAGLIYTRLLDDITISSTKPLSEQRISKLIDMVARMLREKGLKLKNKKTRISSRSNPKILMEVTGLWLNRGSPRVSTDNRRKIRTEVHQCAVAAMTSRTSQSYHKAHASVSGKVAMLNHVGHAEAERFRKTLADILPLYDANELTKTINIVNVLSRSSESDREEYAFNLNYFKTMQRINIVARSDPRLARRLREKLATCKPINQSDEALYDEPI

SEQ ID NO: 3683 - protein, 395 aa, unidentified
  source 1..395: note = Related to NZ_QBUB01000002.1; note = Paraburkholderia sp.
MLTLLPMRPFYKKKKIGSVASLGAALRVSDVVLKHTAATLEQHYTPYEIPKKSGKPRSILIPSLHLKTLQKRINREIFAHVQYPDYLFGGVEGKDYVRNARVHAGSHVLISLDVKDFYPSITFDRVKRIYQHFLQFDPAVSELLAKLTTYNNSVPQGACTSSHLANLILHDVEYHLAQYCATAKLTYTRLLDDICISSKTALSKEKIAKLIDKVSSMLRDKGMKLKHQKTRVCSKSNPKELMEVTGLWINRGAPRVKPTERRKIRVDVHRCQVLANQSLTNREYDRAHASVSGRVAMLSYLGHSEAERLRKSVAAILPQFDIHEISKTKKIVALLSRASAKDRNKYSFILNFNKTMQRLNIVARTDPKLAVQLRKSMATCRPTKRADATLYDEPI

SEQ ID NO: 3684 - protein, 357 aa, unidentified
  source 1..357: note = Related to LFMX01000035.1; note = Candidatus Burkholderia humilis
MLRKTLHFLSNSQERREASFDSYSSLHLKTLQKRINREIFAHVEYPNYLSGDIEGKDYVRNAKAHAGSYVLISLDVKDFYPSINFNQVKRIFQYFLKFEPGTSELLAKLTTFNNSLPQGACTSSHLANLVLHNVEYHLAQYCKTARLTYTRLLDDICISSNSPISKEKISRLIEKVSKMLRDEGLKLKHRKTRVSSRSNPKELMEVTGLWINRGAPRVKSAERRAIRVEVYCCKDAAQTSLTDREYHKAYARVSRKVAMLNHLNHREASRLRRGLSEILLRFDIHEITKTEKVVAMLMRASIKDREKHSFILNFNKTMNRLNIVARTDPKLAIRLRKEMAKCRPTKRTSATLYDQPI

SEQ ID NO: 3685 - protein, 356 aa, unidentified
  source 1..356: note = Related to NZ_QREJ01000001.1; note = Paraburkholderia sp.
MDKHYTPYQIPKKNGKPRTIMIPSLHLKTLQKRINREIFSHVKYPDYLYGGVEGKDYVRNAEMHAKAHVLVSLDVKDFYPSISADRVTGIYQYLLKFNPGVAELLARLTTYKGAVPQGACTSSHLANLILHDVEYHVAQYCKNAGLVYTRLLDDICVSSEAALSEKKISRIIEMISRMLRDKGLKLKHQKTRISSKSNPKELMEVTGLWVNRGMPRVNSTERRSIRVEVHRCRQLAAGRRTDLAYHKAHGSVSGKVAMLNYLRHSEAGRLRRSLGAILPEYDQAEMTKTVKIVEMLSRTSPKDREKYSFNVSFFKTLQRLNVVARTDPKLAVRLRKKLASCRPTKHSSATLYDEPI

SEQ ID NO: 3686 - protein, 377 aa, unidentified
  source 1..377: note = Related to NZ_QPER01000002.1; note = Paraburkholderia agricolaris
MNALCAALRISESALKHLAANLDRHYTPFEIPKDNGKRRALLIPSLHLKTLQKRINREIFSHVAYPAYLYGGVENRDYVKNASVHQRAEVLIALDVKDFYPSIEMKQVVSIFQHLFKFPKEVADILARLTTYEGKVPQGACTSSHIANLVLHDVEYHIAQDFHNRNYVYTRLLDDICVSSLKPLSPEKVEDVIKKVSSMVKKKGLKLRAAKTRITSRSNPESLMEVTGLWLNRGTPRVNPKQRRSIRSAVYQCQKTAMSDNSSLTYHVEHASASGKVAMLKYLKYGDATRMRTILQGIVPVYDKAELTKTKKIVDMLCRTSHRDREKYAYSLGYHKAKHRINIVSRTEPMLAHALRAKLKKCPPTKTRSEMIYDESI

SEQ ID NO: 3687 - protein, 404 aa, Chromobacterium sp.
  source 1..404: note = Related to NZ_MUKT01000065.1; note = Chromobacterium haemolyticum
MTTLSSHACFMLSGFMRPQYNKNPIRSIDSLCDALRVSEVVLRHTAENIQHHYTPYSIPKANGKTRVVHIPSLHLKTIQKRINKEIFSHITYPDYLYGGIEGKDYVKNANAHAGANVLIALDVKDFYPSIKREHVTDVYQHLCNFSKDVAELLTDLTTLRERVPQGACTSSHLANLVLHKVEYPVVQNLRNQDFRYTRLLDDICISASKFLSPAKIETIISDVARMLKSKELRLHPKKKSITSKNNPESLMEVTGLWLNRGHARAKREERRAIRTEVYRCEKEAARSRYSPEYHKMHGSVSGRVAKLNYLHHPEAKNFRLRLQEILPLYDEHEIIKTSKIASVLSKVAKADRAKHWFAIQHHKAQYRVNIVGRTNVKMASKLSRQLSLCRPPKTLSELIYDEPI

SEQ ID NO: 3688 - protein, 389 aa, unidentified
  source 1..389: note = Related to NZ_CP043568.1; note = Comamonas testosteroni
MRPIFNKKSIGSIEALSDALQVNKHILQNTADNIFQHYHPYEIKKKDGGTRLIHIPTLHLKIIQKRINKNIFDNVTYPDYLHGGIEDKDYVKNALSHANAEAIICLDIKNFYPSITQTRVSKIFQYFFKFPEDVSNLLAKLCCHEERVPQGACTSSHLANLAFFDSEYHFASFCKSKKYTYTRLLDDITISKSSAFSDTEISKAIASVKSIISPHGIKLNNKKQKIVSRSNPKDLMEVTGLWLNRGRPRAHRSYRKVVRLEMHICEKMAKTDRFSEEYHKLHNRVSGKVSKLSYLGHHEATNYRDTLQKILPLYDIHKATNLHKNALILSKVNANIRKKFAYFKRYSKINYELNILARNNKPLSKTIRNILSNCKPSGLRDDLLYNEPI

SEQ ID NO: 3689 - protein, 389 aa, unidentified
  source 1..389: note = Related to NZ_STFG01000005.1; note = Lampropedia sp.
MRPFYDARPIGSLAALSKTLQVELSILQRTASNIEEHYHAHEIVKKSGGTREINIPSNHLKIIQKRINKHIFENVVYPSYLHGGLPEKDYVKNANCHSSAEVVIALDIKNFYPSISIDKVEEIFQFFCHFPKDVSKLLAELCCLNNSVPQGGCSSSHIANLILNNTEYSLVSWLSSKKYTYTRLLDDINISSKHLISKEEITKIIKKTKETISKSDLKLNNKKQKITSRSNPEILMEVTGLWLNRGTPKAHTYDRKLIRAEMHKCQTMAKKDRFSAEYHEIHNSISGKVAKLSYLKHKESERYRYILRGILPLFDKSKEVSIRKQANYLLKSKPNYRKKYVYFKKYHKLLYKLNILTRNNKSLANQIKGNLKSCKPLGMKDELLYNEPI

SEQ ID NO: 3690 - protein, 384 aa, Achromobacter sp.
  source 1..384: note = Related to CADIJU010000023.1; note = Achromobacter marplatensis
MRAQYTKKPIGSLEVLSRALEIDLGVLINTANAIDQHYHAHQIPKKKGGFRTINIPTLHLKSIQKKINSRIFSNVVYPEYLFGGIKERDYVKNAAQHAGCKALIALDVKDFYPSISLNAVKDIFQYFFRFPRDVAELLGKLCCLNERVPQGACTSSHLANLSLQENEYHFAQYCKNKGWTYTRLLDDISVSSKEVFQQKDVDAIISKAKAVLAGARLKLNNKKTRILSKANPVDLMEVTGLWLNRGRPRAHRSDRNAIRSEVYQCEILAKEGRERKKYHDFHSHVSGRVSKLAYLEHANSKLYRERLRKILPIYDVNQATNLLRQAEYISKTTLSNRKSVAYYKKYHILKHRLNILMRTDRGLARRIQSMLSLCKPTLQSSDML

SEQ ID NO: 3691 - protein, 365 aa, unidentified
  source 1..365: note = Related to NZ_CP012334.1; note = Bordetella sp.
MDLGILRNTIRTIDKHYHPHSIPKKNGGSRIIHIPTTHLKTIQKRINRQIFDNVIYPSYLFGGVREKDYVRNTSEHGGCNALVALDVKDFYPSITVAAVKKIFQYFCKFPAEVAETLAGLCCLNGRVPQGACTSSHLANLVLHDEEYHLAQYCKNKGWTYTRLLDDISVSSKAEFDVKEIDAIIRKVKYMLGKSALKLNNRKTRVLTKANPVNLMEVTGLWLNRGVPRAHRADRNTIRGEVHQCEVAARDSRTEKQYHELHNRVSGRVAKLSYLKHANSREYRERLRSVLPLYDEHQATNLLKQARYMAKTKTNIRKTPAYCKKYFILQHRLNILMRTDRGAAGKIRAILTTCRPAIASASAYIE

SEQ ID NO: 3692 - protein, 389 aa, unidentified
  source 1..389: note = Related to NZ_JABUXU010000004.1; note = Advenella sp.
MRPQYLAKPIASLNVLSVALGVDIDVLRNAASNIERHYHPHSVPKKDGSLRSIYIPSIHLKKIQKRINRNIFENISYPGYLFGGIKERDYVKNANAHASAELLIALDVRGFYPSITRDKTLNIFKFFFKFSHDVASLLADLTCLRGQVPQGACTSSHLANLVLHDTEYHLVQHLNNKGLTYTRLLDDISISSKTQLEEKQVQTLIGKVRTMLNEQGLKLQNKKTKITSRKNPENLMEVTGLWLNRGRARVHRNERRIIRAELHKCESMSRLSKSSPEYHDFYNRLSGRVAKLTYLEHKEALSYRSRLREILPIYEKNEIHRTIQLVTSLQKSSIKDRGKYAYYAKFHQVRYRLNILGRTDGGLAKKLATTLQTCKPTSDKERLFYHDII

SEQ ID NO: 3693 - protein, 389 aa, unidentified
  source 1..389: note = Related to NZ_CP003915.1; note = Advenella mimigardefordensis
MRPLYLAKPIASLQALSSALRIDVHVLKSTAANIDRHYHPHSVPKKDGSSRSIYIPSIHLKKIQKRINRNIFDKIKYPDYLFGGIKERDYVKNANAHASAETLIALDIRGFYPSITYEKTLKIFKFFFKFPEDVAALLTDLVCLRGRVPQGACTSSHIANLSLHEAEYHLVQHIRNKEFTYTRLLDDISISSKKQINEIQIQTLIGKVRKMLNEQGFKLQNKKTRITSRKNPEKLMEVTGLWLNRGQARLHRQERRLIRAELHNCEKLSKLSRTSIDYHELHNSLSGRVAKLTYLGHKEAACYRSRLREILPVYDDNEIHRTIKLVSFLEKSSVNDRKKYAYYAKFHQVGYRLNILRRTQSGLANKLAEILRTCKPPLNKEELFYHEII

SEQ ID NO: 3694 - protein, 387 aa, unidentified
  source 1..387: note = Related to SMLK01000007.1; note = Ramlibacter humi
MRPIYSAQPIGSTAALALALGMSESALLALAASASIRYSAFEIPKKNSDKVRTVCEPHHELKVAQKRINRAVFEHVVYPEYLQGGIADRDYVRNARIHAHSKSLIALDVQNFYDNIQAPDVLKIFKFFCKFPEDVARVLTQLTTRGGRVPQGACTSSHIANLVFFATEHRVVREFFQQGLRYSRLLDDITVSSAKQLSQERTSKIIHKVKLLLAEKHLRLKTSKTRVSSNSNPEVLMEVTGLWLNRGAPRAFRAERHDIRARMFKLERMHELSSHDLDYHAEHNRISGRVAKITYLGHFEAENYRSRLQKILPTYDGTEVARTLKLVRLLCATPAHQRDNLAYIDKYHHVLYRLGILSRTHRRLASKQRALVMKCAPSTSREELLYG

SEQ ID NO: 3695 - protein, 386 aa, unidentified
  source 1..386: note = Related to FOWG01000001.1; note = Variovorax sp.
MRPIFHGKPIASIASLAAALGLNATTLQDFSARAQSQYTRFEIPKKNGGTRTICSPTHDLKVIQKRINRAIFSNVEFPPFLFGGIEGKDYVKNAQAHAGAKTIITLDVTDFYPSISKKRVAEIFKYFCHFPDPVSHLLAELVTLDEVVPQGACTSSYIANLVLFETEHRLVEEFRQRKLTYSRLLDDICISSQRNIAPKEVQEIISRTASLLKSKGFRIKNRKTRVSSASNPETLMEVTGLWLNRGHPRVFRAEREKIRTQLHRCEENFKISRTAPEYHQEHDRLSGLVAKPTYLNHFEATNFRNRLSAKLPHYNRADTYKTEKIVESLERVNMGDRGKISYIEKFNQVTHRINILARSNAKLATNLRDRLRKHAPTKTKEDLIYG

SEQ ID NO: 3696 - protein, 401 aa, unidentified
  source 1..401: note = Related to CP022423.1; note = Vitreoscilla filiformis
MDHRSVQLSRCLFLSMRPIFNGTPIASVDALARSLSLSAQQLRTLAGAVSGHYRDFDIPKRDGSFRTVSGPTEELKIIQRRINRHIFERVQYPSYLFGSIKERNYVQNARSHSRAHVIVAMDVENFFPSIKREAVLNIFKNLFRFPQEVASLLADLCTKDGHVPQGACTSSYIANLALHDIEHRLVSNLRHEGLIYSRLTDDISISSPHPLAKKRIESLVVQVAEMLKCKGFKPKRRKTKVTSKNNSAELMEVTGLWLNLGEPRVKRDERASIRTEVRRCIRESKVERTSPEFHKLHDRTSGRVAMLSQLKHREANRFRVALRLCAPLYSPIEIKRTQKIVAAVCKTPLRSRETAVYIQRFYQARYRVNIVSRTDPKLAKELHARLSSHVPKMKKEEAIYG

SEQ ID NO: 3697 - protein, 394 aa, unidentified
  source 1..394: note = Related to NZ_FOGD01000002.1; note = Giesbergeria anulus
MSVIFNSCMKAKFLGTPIARVESLARTLGVSIHDLRTIAGAASSRYNDFQIDKKDGGKRDVSSPRIELKLIQKRINREIFEKVYFPSYLNGGIKGRDYVKNAYEHGNSETIISLDIENFYPKVSRISILNIFKNFLKQPEEIAEILTNLCTKDNKLPQGGCASSYLANLVFFDIEPRLVSRLQEEGFTYTRLIDDITIYSKNLISKKKISDLIESITKMLKSRGFKLKQKKTRCTSASNPEKLMEVTGLWLNRGAPRVRRNERAEIRKEVRECLISAELNKTDKEYHDLHQKVSGRVAKLSQLNHCQAERFRKELREILPIYSDADIRKTRRLVAKIIKTPRTTRSSLGYIKKYHQIVYRINILARSNKSIARSLREKMKICAPTITKENSIHG

SEQ ID NO: 3698 - protein, 392 aa, unidentified
  source 1..392: note = Related to NZ_JQNP01000001.1; note = Janthinobacterium sp.
MNISYSHPPIGSISKLAKMLDVSEAYLYQVAKNPENFYAFSEIPKKNGDFRTISDPVKELKIVQRRIIRRIFCNCIFPTYLFGSIKDIENPRDFVRNAQFHSNANEVMAFDIDSFFPSIQAKYVKLVFKYLLNFPNDVSDLLVKLTTLNGSIPQGAPTSPYIANLVFYDQEPKLVKLFTDKKLRYSRLVDDITISSEKPITSGNKTFIYEQVKKLLDSKSLKINKKKYQVTNTSNSGKKTIVTGLIIENNIVKLPKETIKSISRQVYTLNRMADVATTDVKYHKAHGSTSGLVALYSRLSKEKSDVHRLSLRGIKPTYSPSRLKKIASLCRRFIKYGESHTKKHGDEDYAKKYYKYKHKISIIRRTDKKTAYRLDLALKPIKPLHLLSSYHE

SEQ ID NO: 3699 - protein, 392 aa, unidentified
  source 1..392: note = Related to NC_015856.1; note = Collimonas fungivorans
MKIAYSNSSIGSVAALAKMLDVTENFLTLVASKPDDFYSISKIPKKTDGFRTISDPVKELKIVQRRIVRRIFSKCSFPSYLFGSIRDEINPRDFVRNAQYHSQAREVMAFDVESFFPSVRPQFVKKVLKFLFNLPNEVAEMLVSLMTLQDGLPQGAPTSSYVANLIFYDCEHKIVKTLNAMGFTYSRLVDDITVSSKTIIKNEERRFIYEQISKMLGEKKLKISQRKYGVTNTTVIGKKTVVTGLVVEDKMIKLPKEKVKLIGQMVYELKSKAEVSTTDHEYHKSFNKASGLVALYSRLNTKKAEIHRQHLRQILPTYDNKKAKKIGWLCRKFIGYSKLHPSKFSEEGYTRKYYKFKHKISILSRTNRTLAISLEKDLKPLKPTCLLASFHE

SEQ ID NO: 3700 - protein, 392 aa, unidentified
  source 1..392: note = Related to NJIE01000028.1; note = Xenophilus sp.
MRIEYQGKPIRSIKALSTCLGVSEDSLSQISLDIENQYSISEIPKKKGGFRTISDPLPPLKIIQRRIVRRIFSNIKFPDYLFGSIKDDNNPRDFYKNALYHQKAKEVLSFDIESFFPSCRPKFIYKIYKYLFNFSDEVSHLLVNLTTLNNGLPQGAPTSSYLANLFFYDNEHKIFKTLKSKGFLYSRLIDDIVVSKQSKINSNEKQFIYRNILSLLREKEVNLNKDKYSYSNTKTHGKKTIITGLQVRNGNTILPKEKTTEIHKKIHEIEHLGEVDRTSNKFHEAYGTASGLLALYKRVDITKAEKLHKKIITIKPIYHPNRIKKIKWICNKFVRISKSNPRRIGEYNHAKKYHRLMHKISIIRRTHTALAKQLKARMQSIKPTRLLSEYEP

SEQ ID NO: 3701 - protein, 393 aa, unidentified
  source 1..393: note = Related to NZ_SSSP01000010.1; note = Rhodocyclus tenuis
MPLQVTYRGSPIRSLEALSSALSCDEPILKHISNHVADYYTFFEIEKKSGGARQIKPPKPILKAIQKRINSRIFSLCEFPEYLQGSIKDATNPRDFVSNARAHSNGKTVVAADIKNFYPSVTESNVKEIFKYLFRFSDDVTAVLVALTTLDNSLPQGAPTSSYLANLVFYNNEHKLVTELRRKGLIYTRLIDDITVSSPVVLDKNEQEWIIRKIKGFTASKGLELHRGKLKVCTTSTPGANVIVTGLWIDRGHPRISREARNKIRAAVHRCKKEHEAGHKTLGEFHDRHNSVSGSVALISRLGHTQGKQYRLILNENLPEYSKEYAGKLTKICYRFSAKKGLRKETLSYTKRYYQLMYHLSILGRSDKKKANFLRSLLKQNPPKHCLRELSEE

SEQ ID NO: 3702 - protein, 419 aa, Alcaligenes faecalis
  source 1..419: note = Related to NZ_CP021641.1
MCFTLRYFPEWLPQVFLELIDSLPFLSLGYMNRITFASRPIASRAALAKALSIDERVLAEFEQNANAYYYFFERPKKHGEGIRSITAPKPLLMQLQRRVNNRIFSGCNFPRYLHGSIKDSEIPRDFLTNAREHITADHVITLDIRNFYPSIGREEVFKIFKYLLRFTDEVASSLTSLVTLNGTVPQGAPTSSFIANMVFYDREPRLVEELIRSGVRYTRLLDDITLSFSNRISSEKLKGEIIGKVRTMCSAKGFKLHDGKQKIHSLISSPNPAIVTGLSIRNNKLGLPVAYRNKTRAKVHNCVQQYRAGHQTAAEYHSLHNSTLGDITLLKRLKYKCADTYEEKLRSCLPTYHPKKAQQLRRACEDLAIKIRPSSVASLTRRFHVLMHCLTVLQRTKPDLAAALRTLLRTSYAKAISNE

SEQ ID NO: 3703 - protein, 389 aa, Achromobacter sp.
  source 1..389: note = Related to JAHUWQ010000001.1
MNRITFASRPIASRAALAKTLSLDERVLRQLEQNVNALYLSFERPKKHGEGMRSITAPKPALMQVQRRINTRIFSGCKFPRYLHGSIKDLEAPRDFLTNASEHKAAEHVITLDIKNFYPSIEREVVFKIFKYLLRFPDEVATSLTSLVTLDGVVPQGAPTSSFIANMVFYDREPKLVEEFIRSGVRYTRLLDDITLSFSNRISSEKLKGEVIGKVRAMCSEKGFKLHDGKQRIHALISSPNPAIVTGVSIRNGRVGLPPVYRDKTRAKVHTCVKQFDAGHQTAAEYHRLHNSALGDVTLLKRLNYSCAEAYAEKLRSCLPTYSPKKARQLRRMCEDLAMKMRPTSVAALTRRFHVLMHCLTVLGRTKPNQARTLRTLLRTSHAKAISNG

SEQ ID NO: 3704 - protein, 339 aa, unidentified
  source 1..339: note = Related to FTMV01000007.1; note = Janthinobacterium sp.
MRSLSEPILLLKILQKRILNRIFCHIKFPHYLHGGIKATNPRDFHSNASAHLGAEVAITLDIKSFFPNVTSMVVENSFLRLFQFPDEVATVLAKLTMLNNQLPQGAPTSSCISNIILFDREYKIAANLEAQGFQYTRLIDDITISSKKKISSERVSKVIDIIAKMLGHYGLKIHPDKTHVRSKGNPLDLMTITGLWINRGSPKLDRKKCFEISCEVIQLKREALKNGVNEVKYHTRYSSVAGKVALLERLNHSRATRLKLILDTILPTYNNYDVAKVANLVSKFCKNQRDSNSIGYLKKFYQLQHAVSIVKRTHVPTAKSLQALLNIRRPKRTMSEFYG

SEQ ID NO: 3705 - protein, 392 aa, unidentified
  source 1..392: note = Related to NZ_JAAOLX010000002.1; note = Iodobacter sp.
MASKHKIYYDGLPIGSIKTLAKTLSCTEARLIKISTDPSFFYTTFLKTVKNKNRELSEPNPELKLIQKRIVSRIFNHIKFPHYLHGGIKALDPRDFHSNAKAHSGAETAITLDIKNFFPSIKADQVENLFLHLFKFPPNVSSVMSKLTTLNNCIPQGAPTSSYISNLILTEKEYRIAAKLESQGFIYTRLIDDITISSKKELPEKKITQIITNIAGMLTHYNFELHPEKVHIYSRSNPEKLMVITGLWLNRGMPRIEKSRRLQISNDVIAIAKLATSSTGTSDASYHEKFNAASGKVALLQRFKHTEARRLRAILNEIQPTYNDYDKCKINKLAFRFLNKKTSKETIGYLKKFYQFQYRASIIKRTDPALAKRIQEKLNLNRPTSTKKAFYE

SEQ ID NO: 3706 - protein, 391 aa, unidentified
  source 1..391: note = Related to NZ_KB467824.1; note = Janthinobacterium sp.
MTTHKIFYSAKPIGSIAKLATALGFTESFLRSVSNRTTDYYTEFVKSVKGKDRELSEPKPHLKTLQKRINTRIFSHVKFPSYLHGGIKTIDPRDFVTNASQHCKSETAITLDIKGFFPSITTAQVENIFRNLLNFPNEVSALLASIVTLNGLLPQGAPTSSYISNLVMWEKECRLVSRFEGRGLIYTRLIDDMTISSKTRIPEKLVTKIIEDVAGMLQHYNYTLHPKKKNIFSKRDPEHLMLITGLWLNRGAPKLLKEKRAEISHGVIAATHMASEPDMIFNPKYHAIHATCSGKVALLQRLGHTRAIRLRNILNSIEPQFSPQYCHRISVVVRKFYAKGRVKNDLGSLKIFYEFQHKVSIVKRTDPILAKKLQIYLNAIRPQATMRELNG

SEQ ID NO: 3707 - protein, 394 aa, unidentified
  source 1..394: note = Related to CP074381.1; note = Cupriavidus necator
MATYDKIYYESNPIGSVAALAKSLDVAESRLLQVAADIQSFYHIFEKTVGKKTRQLCNPNDELKRLQKKVVSRIFAHLVFPPYLHGGIKAEDPRDFLSNAGVHVGAHVAIAIDVKDFFPSISEQSIAQAFKLLFRFPKEVAEILAKLTTLNGFVPQGAPTSTYLSNVVMFDKEYRLVARLRAKGLRYSRLIDDITISSEKSMMPSEIDRVTTDVIKMLRAYNFYHHEAKYRILTRSNPKDLMMVTGLWLNRGAPRVARKKREDIAAHVVQLSKRALENHAREDESYHQEFHALSGKVALLQRVGHREASRLRSILREIKPIYGEQELRRLRKIIPAFCEKVIDRSKLGYIKKFYRFQYCVGIVRNSHPKLAATLQASLNSVRPTKTLRELDEHE

SEQ ID NO: 3708 - protein, 390 aa, unidentified
  source 1..390: note = Related to NZ_AP018441.1; note = Undibacterium sp.
MRQNHKIVYDASSIGSLQVLAKTLDISVHRIQKIASVQTDFYTIFEKQVKNKIRELAEPKAELKIIHKRIISRIFSHFRFPHYLHGGIKADTPRDFISNASAHAACKTAIAMDIKSFYPSITYEHVYQMFLRLCKFPPQVSEALAGLTTLNGSVPQGAPTSSYIANLVIWDREYKLASLFEQKGFVYTRLIDDITVSTEKSMSKEAIENVIKLVSSMLVNYGFKIHPDKTQIYSKSNPEKLMLITGLWLNRGMPRLDADKRVKISASVTRLTKNGVKDCVSDEYHQQHSKLAGQVALLKRLKHVEAGQLRKLLDATPPIFEHSKIAKIQKVVKMFVRKEIDSSKLGYLQRFFHLQHQVSIVKRTNPRIARQLQIMLNKRRPTSTKESHYA

SEQ ID NO: 3709 - protein, 341 aa, unidentified
  source 1..341: note = Related to JACFQL010000003.1; note = Snodgrassella sp.
MIKPQLFYYPLAGIQSIESLAKHLDIDLDKLTYLLENINSQYIGPIFIKKSNGGSRPIYRCRPQLKYFLKRLNSKVFKLVHYPNFLYGALPNKSIYTNASQHLNAKVMCNFDIKSYFTTITFDHVFDIFKNFFHFSTEVSNILATLTTINNQVPQGSPCSTYIANLVFYRSEVNVANKLKDKNYVYTRFIDDITVSSQYKKTKKDIEEVHTIVIGMIRAYKFSLQTEKRSIAPSHKCQILTVNQINIVKSNLSISKENRKKIRAAVHELKCNLNDNNIEFVVKNFESVYGRVQYLKNIHIKEAQGMLKQLEQIRSKILKPLQIYKYRKLKEAIRKKQGYKL

SEQ ID NO: 3710 - protein, 351 aa, unidentified
  source 1..351: note = Related to NZ_MEIP01000014.1; note = Snodgrassella alvi
MLNLQFKYPLAAVQSIESLAKHLNIDCNTIIYLLENIDFLYEGPIPILKSNGKTRPIYLCKPRLKYFIKRLNSKIFKVVSYPDFLYGALPNRDTYTNVSQHLNAKVICNFDIESFFTAITYEHVFDIFKNFFHFSAEVSQVLAKLTTVNNQVPQGSPCSSYIANLVFYRSEVNVVQKLRNKNFVYTRFIDDISVSSLSKKKKKDIEEVHRIVIGMIRAYQFSLQTEKISIAPSHKTQSLTVNKINIVKSRLSIPKKKRANIRAALYQLEQHFQEKDMKFVVKNFESVQGKVQYLSKFHPKIADKMMKRLEKIHIKIAQPLNHYKRNRLKSDIRKYRNINFIRNKSALTEKI

SEQ ID NO: 3711 - protein, 339 aa, unidentified
  source 1..339: note = Related to NZ_CP051298.1; note = Alicycliphilus denitrificans
MSPSATSAPSYSQRRIGTLQALHVPLGLPASDLLALAERADGLYRVAKRITKPDGSIRIAYDTLDPLKGVHRRVKSQILDHVSYPAYLTGSIKGCDAKVNASLHARARIVINEDISGFFPSTSADRVFSIWHNFFGFSEEVARCLTRLTTRHGELPQGAITSSFLANLVFWRDEPALHDKFAAQGLVYSRYVDDIAVSSKTFLTNKEKTDVIRQVYGMLLKHGYRAKRAKHEIATSARRMAVTKLAVNSKPGLDGATRDKTRAVVQAVEQRSAQGEVLSFDRGPYAQAMGKVLHLERFHPGDAAPLKRRLLALKEAAASITSSHPSTWRPNEKKLGSHS

SEQ ID NO: 3712 - protein, 323 aa, unidentified
  source 1..323: note = Related to CP000352.1; note = Cupriavidus metallidurans
MSQSATNAPSYSQRRIGTLQALHVALGMPVGDLPTLAERANDLYRVAKSITKPDGSIRNTYDAREPLKEVHRRIKSQILDHVNYPAYLTGSIKGCDYKVNASLHARARIVINEDISGFFPSTSADRVFSIWRGFFGFSEDVARCLTQLTTRHGELPQGAITSSFLANLVFWWDEPELFGKFAAQGLVYSRYVDDIAVSSKTFLTNEAKTNVVRQVYGMLLKHGYKAKRAKHEIATSGSRMAVTKLAVNNKPGLDKATRNKIRAVVHAVERRIAQGEALSFERGPYAQAMGQVLHLERFHPGDAAPLKRRLLALKEAGAALPHS

SEQ ID NO: 3713 - protein, 331 aa, unidentified
  source 1..331: note = Related to NZ_JGXC01000015.1; note = Bordetella bronchiseptica
MSPSATSAPFYSQRRIGTLHALQVPLGRSVSELLVLATRADSLYRVAKSMTKADGTIRNTYDALEPLKEVHRRIKGQILDHVNYPAYLTGSIKGTDYKVNASLHVRAKIVINEDISGFFPSTSADRVFSIWRGFFGFSEDVAQCLTQLTTKHGELPQGAITSSFLANLVFWRDEPALRARFAAQGLVYSRYVDDIAVSSKAFLTDEEKSDVVRHVYGMLREHGYQPKRAKHEIATAGTRMAVTKLAVNAKPGLDKSARSRIRAVVHAVEQRVASGEALSLERGPYAQAMGQVRHLERFHPGEAAPLKQRLLALKKATKPQSPNSDDHAETA

SEQ ID NO: 3714 - protein, 327 aa, unidentified
  source 1..327: note = Related to JACCEN010000001.1; note = Alcaligenaceae bacterium
MNPSATNAPSYRQRRIGSLEALHNSLGLPASNLLALAERANILYRVAKSITKADGSIRNTYDALEPLKETHRRIKSQILDHVSFPAYLTGSIKGCDYKTNATLHVGARILINEDISGFFPSTSADRVFNVWHCFFGFSKAVAQCLTLLTTRHGELPQGAITSSFLANLVFWQDEPTLHAKLASQGLIYSRYVDDIAVSSKSFLTDEEKSKAVRHVYGMLLKHGYQPKRAKHEISTSATRMAVTKLAINSKPGLDRATRSRIRAIVHAVERRFELGEVLSFDQGPYAKAMGQVRHLERFHPGEAAPLKNRLLALKSISRTRSRHRKVE

SEQ ID NO: 3715 - protein, 319 aa, unidentified
  source 1..319: note = Related to NZ_CP048030.1; note = Sinimarinibacterium sp.
MSPPATSAPSYSQRRIGTLNALRLPLGLSVDELLSLAQRADGLYRVAKSITKPDGSIRNTYDALAPLKAVHRRIKSQILDHVVYPAYLTGSIKGSDYKVNASLHTSARIVINEDISGFFPSTSAEHVFNIWHGLFGFSQEVSQCLTQLTTRQGELPQGAITSSFLANLVFWQDEPTLHARFAAEGLVYSRYVDDIAVSSKTFLSNQEKSEVMRKIYGMLLKHGYQPKRAKHEISTSGTRMEVTKLSVNAKPGLGKAVYSKTRAAVRDIEERIALGEVLSFERGPYAQAMGRVLHLERFHPGKAAPLKRRLLALKEGAKT

SEQ ID NO: 3716 - protein, 319 aa, Alcaligenes faecalis
  source 1..319: note = Related to MSZR01000033.1
MNLQATSAPSYSQHRIGTLNSLRLPLGLSVDKLLSLAQRADSLYRVAKSITKPDGSIRNTYDAVASLKAVHRRIKSQILDHVIYPAYLTGSIKGSDYKVNAALHTNARIVINEDISGFFPATSTEHVFNIWYGLFGFSQEVSQCLTQLTTRQGELPQGAITSSFLANLVFWQDEPTLHAEFAAQGLVYSRYVDDIAVSSKTFLSNKEKSEVVRQIYGMLLKHGYQPKRTKHEISTSGTRMEVTKLSVNAKPGLGKAVYSKTRAAVHDIERRIANGEVLSFERGPYAQVMGRVLHLERFHPGKAAPLKKRLLALQEGTKT

SEQ ID NO: 3717 - protein, 319 aa, unidentified
  source 1..319: note = Related to NZ_ATUS01000004.1; note = Spongiibacter tropicus
MSLSAISAPLYRQRRIGTLHALHVPLGLSVDELLSLAKRADGLYRVAKSIAKPDGSIRNTYDALAPLKEVHRRIKSQILDHVDYPAYLTGSIKGSDYKVNAALHSNARIVINEDISGFFPSTSAELVFKVWNGLFGFSQDVSQCLTQLTTRQGELPQGAITSSFLANLVFWQDEPILHTKLASQGLIYSRYVDDIAVSSKAFLTNQEKSEVMRQIYGMLLKLGYQPKRAKHEISTSGARMEVTKLSVNAKPGLGKAVYSRTRAAVRDIELRISNGEILSFERGPYAQAMGRVLHLERFHPGKAAPLKKRLIALKESAKT

SEQ ID NO: 3718 - protein, 323 aa, unidentified
  source 1..323: note = Proposed Superficieibacter electus; note = Related to PQGD01000025.1
MIHTPSDSPFYSKRRISSMTALSKALNISPIELLNLANRADHMYRLASTITKPDGSTRQTWDAYAPLKKVQRNIRRNILDYVVYPAYLTGSLKGCDYKVNASLHVGATIVINEDITRFFPSTSTAIVQSIWRYFFGFSHEVAECLTKLTTRQGELPQGAITSSFLANLAFWKDEPALQASFRARGIIYSRYVDDIAVSSVNFLDKPAKTNVIASIYGMLSRHGYQPKRAKHEIRTSGQRMEVTKLSVNSKPGISSAKQSQIRSAVHHLEQAILRGEIIEFDKGPYAQTLGLVHLLARFHPGKAKKLKQRLLALKSSGCTNMYT

SEQ ID NO: 3719 - protein, 323 aa, unidentified
  source 1..323: note = Related to NZ_LS483470.1; note = Leminorella richardii
MIHTPSDSPFYSKRRISSMTALSKALNISPIELLNLANRADHMYRLANSITKPDGSTRQTWDAYAPLKKVQRNIRHNILDYVVYPAYLTGSLKGCDYKTNATLHAGSSIVINEDITLFFPSTSDTIVHNIWQHFFGFGNEVAECLTKLTTRQGELPQGAITSSFLANLVFWKDEPILQASFRARGIIYSRYVDDIAVSSVNFLDKPTKTNVIASIYGMLSRHGYQPKRAKHEIRTSGQRMEVTKLSVNSKPGLSSAKKSQIRSAVYHLEQAILRGEIIEFDKGPYAQTLGLVHLLARFHSGKAKKLKQRLLALKSAGHANMYP

SEQ ID NO: 3720 - protein, 323 aa, unidentified
  source 1..323: note = Related to CP007044.2; note = Chania multitudinisentens
MNHIPSDSPFYCRRRISNMAALSKALNTSLDELNSLARRADQMYRLASSLTKPDGSVRQTWDAYEPLKKVQRSIRCNILDNVVYPAYLTGSLKGCDYKVNASLHIGAKIVINEDITCFFPSTSATIVQNIWRNFFGFGKEVAECLTRLTTRQEELPQGAITSSFLANLAFWKDEPVLQASLRARGLIYSRYVDDIAVSSVNFLDNSAKSAVIACVYGMLFRHGYRPKRTKHEIKTSGERMEVTRLSVNSKPGLSASRQSQIRSAVNHLEQAFLRGEIIEFGKGPYAQTLGQVHLLARFHPGKAEKLKQRLRALKKMERMNKCP

SEQ ID NO: 3721 - protein, 323 aa, unidentified
  source 1..323: note = Related to NZ_NJCX01000054.1; note = Xenorhabdus kozodoii
MKHTLPDGPFYSRRRIHSMASLAKALNIPASELISLACRADRMYRLANNIPKADGSVRQTWDAHEPLKKIHRSIRRNILDHVTYPYYLTGSLKGCDYKVNASLHAGATIVINEDITGFFPGTSAAVVHCIWRNFFCFGQDVADCLTRLTTRHGELPQGAITSSFLANLAFWDAESALHSSFKARGLIYSRYVDDIAVSSETFLDNSTKTEVIASLYGMLFRHGYRPKRTKHEIRTSGERMDVTKLSVNSKPGLSTSRQSQIRSAVNHIEQAFLRGEITVFDSGPYAQTLGQVHLLARFHPGKAEKLKQRLLALKKLAQSNKCS

SEQ ID NO: 3722 - protein, 320 aa, unidentified
  source 1..320: note = Related to NMZX01000011.1; note = Pantoea ananatis
MNPVLSDAPFYRRRRIGSVASLAKALSVKEDELFSLAARADQMYRLASSVLKPDGSVRQTWDAREPLKSLHRSIRRNILDLVAWPSYLTGSLKGCDYKVNASLHAGARIVISEDISGFFPATTEAIVRHIWRGFFGFSQDVADCLTRLTTRHGALPQGAITSSFLANLAFWDVEPELQAGFRARGLIYSRYVDDIDVSSYTFLDNHAKAAIIADIYGMLFRRGYQPKRAKHEITTSGQRMEVTKLSVNSRPGLTASKQSQIRSAVYHAEQAFLRGEITCFDSGIYAITLGQVNLLARFHPGKAEKLLQRMRALRNKSEES

SEQ ID NO: 3723 - protein, 322 aa, unidentified
  source 1..322: note = Related to NZ_LR134306.1; note = Yersinia pseudotuberculosis
MNPSTILPRYKRQRIASLDALQAALGVSIEQLQSLAEHADNSYRVAKSVIKPDGSTRHTYDAFKPLKDIHRKIKNHILDHVAYPSYLTGSIKGCDYKVNAEIHTQAKIVISEDITAFFPSTTAKKVFKIWRDFFGFNSDVARCLTRLTTRKNELPQGAITSSFLANLVFWQSEPFLYEQFSMRHLKYSRYVDDIVVSSKSFLDDVEKTEVIRQIYGMLLTNGYHPKRAKHEISTSASRMEVTKLAVNIKPGLKKAKKSMIRAAVHRLETLISEGKEISFESGDFVEVMGQVQHMKRFHPGKAEALIKRLNTLKLSYIVLHNK

SEQ ID NO: 3724 - protein, 328 aa, unidentified
  source 1..328: note = Related to NZ_JPQP01000023.1; note = Bordetella trematum
MHLSTINAPSYKRKRIGTLEALAYPLGLNAAALEDLARRADAMYRLAKEIVKPDGSVRHTYDAFKPLKVVHGRIKREILDQVAFPLYLTGSIKGRDYKVNATLHSRAKIVINEDISGFFPATTSQHVFDIWHRFFGFSEAVARCLTDLTTYHGELPQGAITSPALANLVFWRREPQLQAEFAAKGWTYSRYVDDIAVSSTIGMAPHQKTEAIRKVYGLLSGYGYKPKRNKHEITTAAQRMVVTKLSINAKPGLAQSERDRIRAAVHEVERLVSSGNSISTDSGVYAKAMGRVTTLARFHPGEAAPLRQRLLRAKQTLQPLLSPSTRAP

SEQ ID NO: 3725 - protein, 332 aa, unidentified
  source 1..332: note = Related to NZ_SNVV01000001.1; note = Azoarcus indigens
MSLSTSSNSPFYKGTPIRQRTSLAAALGSTLHRIEYVAPRANKLYRLAHAELKSDGTIRQTFDAKPLLKDLHRRIKTEILDRVTFPDYLTGSLKGRDYKSNAELHEGAAIVIAEDIENFFPNTTSDKVFDIWRHFFRFSEPVAQLLTSLTTKDGALPQGAITSPQLANLVFWRDEPLLQAKLAADDITYSRFVDDVTVSSVVPIPAENKTELVGAIYGLLRRNGLQPKRVKHELKTRRERMAVTKLTVNDKAGLSAKERSRIRAAVHRLELKGAQQLLEAGELASVLGKVHHMARFHPGEARPLKARLLKISAHGCAATPSEQSPLPPCSEP

SEQ ID NO: 3726 - protein, 316 aa, unidentified
  source 1..316: note = Related to JFAX01000020.1; note = Candidatus Accumulibacter sp. SK-12
MNPSPSDSPSYNGRPIRSIQSLAKAVYCKPQRLAFVSERASDLYRVAKEVPKADGTVRRTYDAKKLLKDIHRLIKTEILDRVDFPPYLTGSLKGQDYKSNAEIHVGAAIVIAEDIGNFFPSTTAERVLDIWRNFFRFSAEVAQCLTNLTTRNNELPQGAITSPQLANLVFWRNEPQLHARFKADGVDYSRFVDDVVASSKTPITPKKKTEIIAAIYGLMKRSGYQPKRRKHELKTARERMTVTTLNVNDTVGIPKEERSRIRAAVHRLEGLVTSGRGEVDLKHEYAVVAGKVNNLGRFHPGEARTLRERLAALDLC

SEQ ID NO: 3727 - protein, 315 aa, unidentified
  source 1..315: note = Related to NZ_SSSP01000011.1; note = Rhodocyclus tenuis
MNRLPTSSPLYSGQAIRRIESLGKALRFSPQRLGYLGNNADRLYRIAHEIEKSDGSKRVTFDAKPALKEVHRRIKSEILDRVTFPLYLTGSIKGRDYKTNAELHVGAALVITEDIGSFFPSTTTAHVFDVWRNFFRFSDEVARLLTALTTRNGELPQGAITSPHLANLVFWRDEPALHDRFAADGIVYSRFVDDIAASSKTPIPPEHKNEIVRLIFGLMLRRGYKPKREKHDLKTAGQQMTVTKLTVNQLPGLPKAERGRIRAAVDHLERLASRGPLSAEQWREHASVSGRVTHLARFHPGEAAGLKARLKMLHP

SEQ ID NO: 3728 - protein, 320 aa, unidentified
  source 1..320: note = Related to NZ_UZVX01000004.1; note = Burkholderia ambifaria
MNQSTTNCPSYDAKPIRLITSLAKALETDENQLLLLADEANELYRIAKKIRKPDGSLRRTYDALPRLKDIQRRIKFRILDRVTFPSYLTGSLKGRDYKVNAALHSGAKILIAEDIGSFFPSTSASRVFDIWKNFFGFGHEVACCLTKLTTLRNELPQGAITSAHLANLVFWREEPQLRTRLDQSGIVYSRFVDDVAVSSRSVIEPAQKTEVVTSIYGMMIRHGYRPKRTKHELHTARNRMVVTKLTVNAKPGLEKTERSKIRAMVHELERLSESLDNTQAILDRLNSVAGKINMLGRFHPGKAQSLKKRLLEVKQIIAAR

SEQ ID NO: 3729 - protein, 303 aa, unidentified
  source 1..303: note = Related to JAGOBW010000017.1; note = Shewanella sp.
MLSLAHKANTMYRIAKEVEKGDGTVRRTFDAHRPLKDIHRRIKLEILDKVVFPDYLTGSIKGRDYKVNAALHAGAKIVISEDIGAFFPSTTDAIVFDIWHGFFGFSHDVATCLTRLTTYNGELPQGAITSPQLANLVFWRSEPVMYQRMADMGLKYSRFVDDIAVSSRLVIAPEAKTVIISLIYGMMFRQGYRPKRSKHDISTSKDRMTVTKLTVNHKPGLASSQRSQIRAAVHALECNLAVKQTADVAAKLPSVIGKVIMLRRFHPGEGLRLKQRLAAIQASQSPQRECKAELQFGPLAGSL

SEQ ID NO: 3730 - protein, 346 aa, unidentified
  source 1..346: note = Related to QLTK01000002.1; note = Paraburkholderia bryophila
MIHVNRLEVPRYTATPIESMAALSRALGVTNQHLAAVAAKASSLYRVADKIEKADGTLRETFDAKPVLKDIHRRIKLAILDRVSFPNYLTGSVKGQDYRTNALLHRNSKILISEDIQGFFPSTTQHLVQEIWSQFFGFSADVAQCLTALCTKDGALPQGAITSPHIANLVFWRVEPAIRAEMAFRGLRYSRYVDDVCVSSSTGIAHADKQSVISVIYAMLARHGYSAKRSKHKIQTASGRITATKLGVNGDPSLSGQQRGQIRAAVHKLELTFAAGAFSDARALLPSVTGRVSMLARFHSTEGQALKQRIASVREQLLLVPMVTRADDATHKAIRDSVDDISTVPW

SEQ ID NO: 3731 - protein, 344 aa, unidentified
  source 1..344: note = Related to CP008726.1; note = Burkholderia oklahomensis
MILMNQIEVPRYTAAPIESMAALSRALGVTSAHLLAVAARASSLYRVAEKVEKADGTFRETFDAKPVLKDIHRRIKSSILDRVAFPRYLTGSIKGQDYRTNALLHRNSKILISEDIQGFFPSTGQCLVYEVWSQFFGFSDDVSRCLTSLCVKDGVLPQGGITSAHLANLVFWRVEPAVRAELARFGIRYSRYVDDICLSSPDAIGHEDKKKVIALVYAMLARHGYSAKRSKHNVQTSRGRIVATKLGVNREPSLSRQQRGQIRAAVHKLESLFADGDLDGVRERLPSAGGRVSMLGRFHAAEGAALAKRLASIRRALDLLPVISKTSAVMSQVSHSDLDGTVPW

SEQ ID NO: 3732 - protein, 341 aa, unidentified
  source 1..341: note = Related to NZ_JADZ01000026.1; note = Curvibacter gracilis
MDLFLIKPRYRASPIRSIAALARSLRWDALALVDMAERANGMWRTVKPKPGSIRQTFDAMGPLKEIHQSLKLNIFSKVDFPEYLQGSLKGRDYVSNASLHKDKQILICEDVKGFFPSVGAAYVEDVWCGFFGFAPDVAKLLTKLTTKDGCLPQGCIASSFLANLVLWRHEPLLHAKLAQRGITYSRYVDDMVMSAATHLDKATQTWVIAQVYGMLARHNLKASRKKHEVFSATQPMIATKLIVNRKPSLSLKKRSQVRAQVRQLEIAVGTGLDAEELRDLANKAAQQVGQLGRFHKTQAEHLRNRIAIVRGTLPIEHPSIITAPSNAPLSQELSTGSLSSK

SEQ ID NO: 3733 - protein, 342 aa, unidentified
  source 1..342: note = Related to NZ_JAELTO010000123.1; note = Xylophilus sp.
MDLFLIKPRYRASPIRSIAALARGLRWDAKALVELAERANGMWRTVKPKPGSTRQTFDAMGPLKEIHKRLKLNIFPKVDFPEYLQGSLKGRDYVTNASLHKDKQILICEDVKGFFPSVSAAYVEDVWCSFFGFAPEVAKLLTQLTTKDGSFPQGSIASSFLANLVMWRYEPLLHAKLAQRGITYSRYVDDMVMSAATHLDKETQTWVIAQVYGMLAQHGLRASRKKHEVFSASKPMIATKLIVNRKPSLSPKKRSQVRTQVRQLEIAAADGVNAEELWDLANKAAQRVGQLGRFHKTPAASLKNRIAIVRGSLPPENQPAITGQTIAPLYQEHPPTGTAPWE

SEQ ID NO: 3734 - protein, 342 aa, unidentified
  source 1..342: note = Related to NZ_CP065406.1; note = Diaphorobacter sp.
MDLYPIKPRYRSNPVKSIAALARGLRWDAQSLVELADRANGMWRTVKPKPGSTRQTFDAMGQLKEIHQRLKLNVFSKVDFPEYLQGSLKGRDYVTNASIHKGKQILICEDVKGFFPSVSAAFVEDVWCGFFRFSPDVAKLLTRLTTKDGYLPQGAITSSFLANLVMWRYEPWLHAKFAQRGITYSRYVDDMAMSSATHLDKETQTWIIAQVYGMLAQHGLKASRKKHEVFSASQPMIATKLTVNRKPSLSPKKQSKVRTRVRQLEIAATSGASTDELRELANKAAQQVGQLGRFHKTPAAKLKSRIAVVRDNLSPEALSVTTAPAKVRLDTVPLVTDARPWE

SEQ ID NO: 3735 - protein, 340 aa, unidentified
  source 1..340: note = Related to CP017420.1; note = Delftia tsuruhatensis
MSLCLSKPSYQAKPIRSIAALARALRWGEQALVQLADRSESMWRTVKPQPGSTRQTFDAMGQLKELHTRLKLHIFSKVVFPDYLQGSLAGRDYVTNASLHAKKKILICEDVKRFFPSVGAIYIEQVWRDCLGFAPDVARLLTKLTTKGGYLPQGAITSSFLANLVLWRHEPLLHAKLKQRGISYSRYVDDMALSSASHLDKDTQTWAIAQVYGMLARHDLKASRDKHDVFAASRPMIATKLIVNHSPSLGAKKRSQVRAQVLQLEMAAASVVDADQIRGLANKAAQRVGQLGRFHKTAAAHLKSRIATVRDTLTADSRVAITGERAAHWEHLEGENPWSY

SEQ ID NO: 3736 - protein, 336 aa, unidentified
  source 1..336: note = Related to NZ_CP094240.1; note = Comamonas sp.
MSLSLSKPIYKAKPIRSLASLAKALGLDEKRLKELALKADTLWRAVKPEPGSTRQTFDAYEPLKRVHERIKRSIFSKVSFPAYLHGSLKGCDYVTNAALHKGQQILICEDVKSFFPSVQSVYVRDVWAGLFGFSSEVADILTALTTKDGALPQGGITSSYLANLVLWRKEPLLQAKLAARGITYSRYVDDMSMSSKTLLDKETQSWVIAQVYGMLAFHGLKASRKKHDVFSASKPMIATKLIVNQKPALPKAKRSNIRAQVKQLELASQSSIPLEELKILANKASQRVGLLGRFHETEANALRLRIKAVRASFTSTEEVRVTGAKLEDGHESSTIS

SEQ ID NO: 3737 - protein, 329 aa, unidentified
  source 1..329: note = Related to JADMKA010000068.1; note = Vitreoscilla sp.
MSLAALARALRLSVGELHALAERADQSYRTVKPEPGSTRQTFDALGQLKTVHRRIKEVVFVNVYFPEYLQGSLKGRDYVTNALLHTNKQLLVCEDVKKFFPSVTAALVEDVWHGFFRFAPEVAKLLTRLTTKSGHLPQGAITSSYIANLVMWRHEPLLQAKFAARGITYSRYVDDMAMSWSCHVDKETQTWVIAQVYGMLAQHGLKAGRAKHEVFSASEPMIATKLIVNRKPSLSAKKRSQVRSQVYQLERAEEDGTETMSVDALAIKASQRVGQLGRFHVTQAAHLRERVKAVRSRLSVEANAAISMPTETPTTPSPEDLSDAPAPWE

SEQ ID NO: 3738 - protein, 342 aa, unidentified
  source 1..342: note = Proteobacteria bacterium; note = Related to JAIUOW010000007.1
MALYLSKPSYRCKPVRSIAALARALNFEEQALRVVAENADQRYRTVAPPPGSSRQTFDALGQLKEIHRRIKTTFFDRVKFPDYLHGSLKGCDYVTNAQLHTKKQLLICEDVKKFFPSVTSEKVEDVWCAFFGFAPEVAHLLASLTTKQGALPQGAVTSSYLANLVLWRDEPLLHAKLAARGITYSRYVDDIAMSFSIRPSKETQTWVIAQVYGMLRKNGLTAGRSKHEIFSASEPMIATKLIVNSKPSLSQKKRSQVRAQVRQLEMAQSSGLDSEMVRVLAEQAAQKVGQLGRFHPTQAARLKGRVKAVRLGLPIESFSSRVTNSTGVSNPSPSEDLRLPWE

SEQ ID NO: 3739 - protein, 345 aa, unidentified
  source 1..345: note = Related to JACDFR010000086.1; note = Ramlibacter sp.
MSLTPHKATYSKEPLRTVKSLCAMLRLEEQALRDLAAHAPALYRRVKPKPGSKRETFDALPRLKVIHKRIKTQVLERVRFPSYLTGSVKGRDYKENAAKHAGQRVVICEDVKGFFPSVTAEMVCDIWQGIFGCSSDVAQLLTQLTTKDGALPQGAIPSSYLANLVLWRTEPLVHAKLDAQGITYSRYVDDITMSSPRRLSVAQKQAAIGMVYGMLSEAGLRAGREKHDVFNGSKPMIVTKLVVNEKPSLTKKKRSAVRAAVFQFQQTLALGEPTADTVITLNKLAQRVGQLGRFHPREAAVLKLRLQATRAFIDKAQPQTLTTGLLPDARLTTPPEGAPAPWDDL

SEQ ID NO: 3740 - protein, 339 aa, unidentified
  source 1..339: note = Cytophagaceae bacterium; note = Related to SEBG01000114.1
MSLFLRKPSYPCKPINSLRSLAAALRVTEDELLSVANIADTLYRKVKLKPGSDRQTFDATPRLKRLHARIKSVILAKVIFPDYLTGSLKGRDYKTNASLHINKSVLITEDVKGFFGSVSDVRVNDVWRHFFRFDASVAETLTLLTTRRGALPQGAISSSYLANLAMWSDEPLLHAKLAARGIIYSRYVDDMCMSSNTPLSIAEKTRTIEDVYGMLMKNGLSARRDKHDITPATGRMLVTKLVVNRKPALPPEQRSRIRAMVFQAEQMARNEADPKLSIAALNKAANKVGQLGRFHCNLSKPLKARLALARAPLPHPLAEPRFTGPDTGSTGDAPGVPWE

SEQ ID NO: 3741 - protein, 335 aa, unidentified
  source 1..335: note = Related to NZ_CP046508.1; note = Variovorax sp.
MSLNLRKPTYPFRPIGSLAALANTLKVSESELVHIAKNAGSLYRAVQLKPGSTRQVFDAKPPLKPIHSRIKEFILSEVHFPSYLTGSLKGRDYKANAEIHAGQAVVICEDVKGFFNSVSETCVFDIWRHFFLFGTAVSQVLTSLTTKDGALVQGAIPSSYLANLALWRDEALLHAKLEAQGIRYSRYVDDIVMSSSTPLEPSRKTELIASVYGMLRRNGLSARRDKHEIAPATKQMVTTKLVVNRRAALPPARRANARTAVFQAEMLVANHGVEAAQAVIAKAAGRVGQLARFHPNLAAPLQERLARLRKQAATRKSLPTMEPSETPTPPPEKDS

SEQ ID NO: 3742 - protein, 352 aa, unidentified
  source 1..352: note = Related to JABMJG010000016.1; note = Variovorax sp.
MSLILNKPSYPFNPIWTNEKLAKALRTELAELEAIAIVADRSYRPVRMDPGSTREVFSAKPRLKAIQRRIKEAILQRVRFPEYLTGSVKGRDYVTNAKLHTGARILICEDVSKFFPSVSAERVWDIWRHFFGFGDDVAHLLTKLTTKAGTLPQGAGTSSYLANLVLWRDEPYLQAKLAKHGLTYSRYVDDMAMSSKLDITPVEQERIIADVYGMLRRNGLSAKRKKHEIFSSSQRMIVTKVIVNTKPSWSKARRSAVRTQVHELEKRVVAEDVGAELHKFADRTSNLVGQLGRFHVREAGLLRARVRKAREVMNRATRIHFTISPTTGAHQSSRLVDVPPWEMKCRRAVKSS

SEQ ID NO: 3743 - protein, 341 aa, unidentified
  source 1..341: note = Related to JACHLK010000013.1; note = Acidovorax soli
MSLILSKPIYPCDPVWTLEKLGEALRIDLAELQAVAAVANRSYTKKLVKKDREVFSARPRLKLIQNRIKMAFLHRVIFPEYLTGSLRGCDYVTNAKIHTNARILICEDVQQFFPSVGSEKVKDIWLNFFGFSEGVAELLTKLTTKAGAVPQGASTSSYLANLVLWRTEPLLQAKLADHGITYSRYVDDMSISSEFQLEPAELERIIADVYGMLRKNGLSAKRKKHEIFRESQRMVVTKVIVNKKASLSKDRRSAIRTQVHVLESRIAAGENSIELSKFLDQTSHKVGQLGRFHKNDYRDLLPRVRAAREALRINPPPFITGDNDRWPEAAPPHAPWELGGI

SEQ ID NO: 3744 - protein, 348 aa, unidentified
  source 1..348: note = Related to AP024684.1; note = Stenotrophomonas pavanii
MSQLQPPPRYRHNPIHSVAALSRVLGYSVETLKHVAGTSSSRYRLAKPILKEDGSFRRPFDALYPLKDIQIRIKQRILTAVIFPAYLTGSLKGQDQVRNAKLHQGASITVCEDIKSFFPSTTSEVIFDIWRGFFGFSEDVSNLLTLLTTKDDLLPQGAVTSSHLANLVFWRREHALYLGLASQGVRYSRYVDDITLSSRLPVTHDDLARHISLVYGMIRSTGHRAHRGKQEIQRAHRGMRATKLLVNRRAALGTAERQATRAAVFALERSFAVTGGVLCPALIKELNSVSGRVSRLARLHANEGQALRARLTKLRNEVGKSHRVRNDFSQVEVIGVEPAPPETGEGMQ

SEQ ID NO: 3745 - protein, 321 aa, unidentified
  source 1..321: note = Related to NZ_JAJITE010000118.1; note = Xanthomonas sp.
MSQLQPPPQYSHKPIHSIAALSRVLGYSIDTLSHVAEVSSSRYRLAKPVVKADGSTRQPFDALFPLKNIQIRIKQRILTAVSFPAYLTGSLKGQDQVRNASLHQGASITVCEDIKSFFPNTTSEIIFDIWRGFFGFSENVSNILTLLTTKDGVLPQGAVTSSHLANLVFWRQEHSLYVRLASEGVSYSRYVDDITLSSLLPLNSNELARHISLVYGMIRSTGHHAHRGKQEIQRAHRGMRATKLLVNRRPALSTAERHAIRAAVYSLERSLAAAEGVLCSSLAKELNSASGRVARLTRLHRSEGLALRERLLRIRNQLDNS

SEQ ID NO: 3746 - protein, 327 aa, unidentified
  source 1..327: note = Related to JADUKZ010000003.1; note = Stenotrophomonas maltophilia
MTQPPPRYPLRAIVRLDKLALVLGVSLDLLLAVSKDASSRYRLAKLIVKPDGSTRQPLDAKVPLKGIQRRIKERILEKVVFPDYLTGSLKGRDARANARLHVGASIVLSEDIANFFPSTKDTLVFKIWRQFFGFAPDVAEILTSLTTKDGELPQGACTSSYLANLAFWREEHRLYEVFRAQGIAYSRYVDDVSVSSKRRLSNEELSACIKNVYGMMGRSGFRPRRKKQEIQRANSPMLVTKLLANRRPAISVKERQAIRASLYQLEQSVAAKAGDDLSSKLESIAGRVNRLCQMHPVEGERLKVRVRVLRGQIGMGASEVCGPVTGQ

SEQ ID NO: 3747 - protein, 318 aa, unidentified
  source 1..318: note = Related to JADUKS010000015.1; note = Stenotrophomonas maltophilia
MSRVPPPSYPHGSIQSLAALSRTLGVPADKLLQIAKDADNSYRLAKPIVKADGSVRRPVDARVKLKGVQVRIKERILDQVRFPDYLTGSLKGKDAVANARLHVGASVVVCEDVAGFFPATSSPAVLGIWRGFFGFSTEVSELLTQLTTLNGALPEGAVTSSHLANLAFWREEHALYEELHREGIRYSRYVDDVSVSSVNQLSRQELAACISRVYTMMGRNGYRPKRAKQQIQWANGPVLVTKLQTNTRVALTKKERHAIRGAVHGLERMALAGPSDELLRRLSSVSGQVARLRRLHPNEGQMLKSRLDALRRLLTAAV

SEQ ID NO: 3748 - protein, 339 aa, unidentified
  source 1..339: note = Related to SCRF01000118.1; note = Rhodanobacter sp.
MNHTAAQPKYTSSPVRSLAALSRSLGLSVAELQRIGDAASSLYRDAKPIIKVDGSIRRTFDAFPVLKNIHRRLQTQFFQRVVFPDYLTGSLKGRDARRNAALHTGAAIVVTEDIKNFFPSTDAKVVYSIWANFFRFAPEVARLLTALTVKDGALPQGAITSSYLANLAFWDREWRLYENLRDKGISYSRYVDDVTFSSKEKLSNERIGCCIAGVYGLMAAKGLKAKRSKHEIRRGNGRMLTTKLMVNTRPALMTRERQNIRAAVHQLEVLSRWNSTDSVSFKSEFSRVSGRVGRLSQLHPMEGAALRARLATLRAGLYANQQLGRQLSQFAGVTLDCVI

SEQ ID NO: 3749 - protein, 320 aa, unidentified
  source 1..320: note = Related to NZ_MWQO01000072.1; note = Metallibacterium scheffleri
MNPKAAQPKYTFSPVRSLASLSRSLGVSVVDLQRIGDTAGGLYRDGKPIIKADGSIRRTFDALPLLKSVHRRIQARFFQRVVFPDYITGSLKGRDARRNAVLHAGAAIVVTEDIKNFFPSTDAKVVYSIWVSFFRFAPEVAQLLTMLTIKDGALPQGAITSSYLANLAFWDREWRLYENLRDRGISYSRYVDDVTCSSKEQLNNEKIGSCIAEVYGLMASKGFQAKRSKHEIRRGNGPMLTTKLMINARPALLTRERQNIRTAVHQLEVLSKNSTDPVRLKSEINRVSGRVGRLSQFHPIEGAALRARLTTLRVGLDLNQ

SEQ ID NO: 3750 - protein, 327 aa, unidentified
  source 1..327: note = Related to NZ_QRBF01000008.1; note = Dyella psychrodurans
MVQLASRPNYKYSPVQSCASLSKVLAVSPSALKALAANSNNLYRLANPILKPDGSVRQPYDALYPLKLVHERLKLRVFAHVSFPDYLTGSLKGKDAIKNASFHAGAKIVVCEDIKDFFPSVTADVVYSIWQGFFNFAPEVSRLLTSLCTKDGSLPQGAITSSYLANLVFWKQEWRLYEDLKSRGIVYSRYVDDVTVSSREGLDKEQLSECIGKVYGLMAANGLRPKRKKQEIQRAHAPMRATKLMVNKRAALSLGERKAIRAAVHQLELEVAQVNMPKELMAKLNSVSGRVARLAQLHVVQGNELKNRIRALRVRIKLLTTLALHDK

SEQ ID NO: 3751 - protein, 326 aa, unidentified
  source 1..326: note = Related to RYZR01000007.1; note = Dyella dinghuensis
MTPDASKPSYRCSPIRSLDSLSRALGVSLETLNRLASRADDSYRLAKAIVKPDGTIRQPFDAQPPLKAIHRRLQKRIFDNVRFPDYLTGSLKGKDARWNAALHTGAKIVVTEDIKNFFPSVTANIVYSIWAGFFRFEGNVAQLLTLLCTKDGMLPQGAIPSSYLANLAFWEQEWKLVANFRAAGITYSRYVDDVTLSSRESLDKPQLTRCISNVYSFMAAQGFRPKRTKQEIRRAHAPMIATKLMVNRRPALLVQERQGIRSAVYQLEREEMRGCDPKEIKAKIDSVAGRVGRLTQLHPTDGHALKLRIAALRRKLASISAVPSAN

SEQ ID NO: 3752 - protein, 326 aa, unidentified
  source 1..326: note = Related to JACJFT010000001.1; note = Luteimonas sp.
MKNPPKRPEYPHRPIGSLDALSAALQISRIELEHVASVTDSQYRLAKPIVKADGSIRQPYDALPLLKNVQRRIQARLLAPVQFPTYLTGSIKGRDARRNAAIHAGAKVVVCEDVASFFPSTSRLLVESIWTGFFGFSPEVAQMLAVLTTKNGSLPQGAVTSSYLANLAFWKKEPILQQQLELNGIAYSRYVDDITISSRRALLNPELSWCIAQIYGMMRGAGMQAKRGKQEIWRGDGRMLATKLVVNRRPALPPNDRKAIRTAVFQLEARFAAGDVEDTFATELNRVAGRVVRLAQFHPVIGAALKGRIASLRQQLSDGQTSAIAP

SEQ ID NO: 3753 - protein, 331 aa, unidentified
  source 1..331: note = Related to CAJPFU010000489.1; note = Anaerolineales bacterium
MNPPQLKPKYDLKSIRDISALSLSLSMPEELLINVAAQADSLYRKAKPIIKPDGSLRQPFDALPPLKSIQRRIKDRILKRVEFPEYLTGSLSGRDYRTNAAMHVGAAIVICEDIEKFFPATSRERVLDIWRNFFCFSEDMANLLTSLTTNDGSLPEGAITSSYLANLAFWNQEPRLQAKLAQKNIVYSRYVDDISVSSKQFMPKEEQTALIAQVYGMLKRHGYKAKRRKHEIFTSGRRMLTTKLMVNRKPALQPKDRQNIRAAVHALEQRIASGESGAEIKTELNRVTSRVGRLGTLHATEAIPLKLRLRNVRQSLQAAILQHTPLIGEPE

SEQ ID NO: 3754 - protein, 320 aa, unidentified
  source 1..320: note = Related to MGXC01000124.1; note = Gallionellales bacterium RIFCSPLOWO2_12_FULL_59_22
MTPPLLKPKYDLKPIRDISALALSLGMPEKLLIDVAAQADTLYRKAKPIVKPDGSIRRPFDALPPLKPIQRRIKDRILKRVEFPEYLTGSLAGRDYRTNAAMHAGAKIVICEDVEGFFPSTKRERVMDIWLNFFRFSEDVANLLTSLTTKEGELPQGAITSSYLANLAFWNQEPRLQAKLAKREVVYSRYVDDIAVSSKQTLTKEEQTALIAQIYGMLKRQGYKAKRRKHETFTSGRRMLTTKLMVNRKPALQTKERQNIRAAVHALEQRIASGERGLGIKTELNRATSRVGRLGTLHPTEAKPLKLRLSHVRHLTNNRM

SEQ ID NO: 3755 - protein, 337 aa, unidentified
  source 1..337: note = Related to JAKJPO010000009.1; note = Lysobacter sp.
MSDPQRRPRYPHQRIQSVASLSAALNVPEGELAAIAKIASSQYRKAKPITKADGSVRQPWDALPPLKRVQKQIQAKLLRRVEYPYYLTGSLPGKSPRENASLHTKPAIIITEDIARFFPTTRAELVHGVWAGLFGFSEEVAGILTALTTKDGFLPEGAPTSSYLANLVFWDCEPRIVDQLAQLDATYSRYVDDVTVSSSKALTPVEIARCMAIVYGMFGSRGYKAKRRKHEIVRANAPMRVTKLVVNKRPALPKADRKAVRAAVYKLEGIVNSGQPLPDDIQTLLNSASGRVSRLGQFHPTQAAPLKARIATIRERLAHLNDSLALTGHGQKTPSKS

SEQ ID NO: 3756 - protein, 339 aa, unidentified
  source 1..339: note = Related to MTHB01000236.1; note = Caballeronia sordidicola
MSFRYNANPIRSLAVLAIALDVTEYELLRLSNRADDLYRKAKPIRKPDGSFRQPYDALPQLKHVHRRIKERLLVNVHFPAYLTGSLPGKSPKANASFHVGAKIVICEDVQKFFPSTRATLVHDIWMGFFGFSQDVATILTKLTTRFGALPEGAITSSYLANLVFWRLEPGLHEQLSIRGIAYSRYVDDICVSSKEFLPDIDKSAAISEIYTMLGRLAYTAKRKKHEIQTSGHQMFATKLMVNRRVAIPHSERHNLKSAVFQLEGKFKHGARDVAFFEELSRTTNRVGRLGQFHMQEATKLKERLKKLRMRLDSEPVVITPSVQTAATIMSAAKAEAPWD

SEQ ID NO: 3757 - protein, 349 aa, unidentified
  source 1..349: note = Related to NZ_PUIP01000011.1; note = Massilia phosphatilytica
MKKPPNSDKSIPYYPCEPIHSIAALEMALGIPERWLKRIAAAANQSYRLAAEEIKKDGSKRQTFDAYPRLKYAQRRIKDRILSRVEYPDYLNGSLKGRSPRKNAEAHVGAKITIGEDIANFFPTISSTLVKAMWCGLFGFSEEVANLLTLLTVKDDGVPQGAVTSSYLANLVFWAREPQLYKQFQRRGYQYTRYVDDISVSCKRRITDSEKSEIISSVYAMLRSAGVQPKRQKHEVHTAGARIVTTKLVHNVRVALPKEMRRGIRTSVFQLEARAAFGEHDEALHKELLTVSSRVGLLNSFHPSEGAPLKARLKKLRKMIEDAAQGLQRTQDVGRQAVGISNSEPAPWD

SEQ ID NO: 3758 - protein, 324 aa, unidentified
  source 1..324: note = Oxalobacteraceae bacterium; note = Related to JACYUQ010000006.1
MKKSLKIDGLAPSYPHEPIYGIAALSRALGVREMRLQRVAQMANDLYRLASEETKLDGSKRQTYDAQPLLKAIQKRIKDRILVRVICPPYLNGSLKRRSTRTNAEPHVGARIVFDEDIANFFPSIRPEIVKRMWLGLFGFSNDVSTLLTLLTVKDQGVPQGAVTSSYLANFVFWAHEPSLVRRFAAQRLAYTRFVDDISVSSKAVVAPQAKSLVISEIYGMLSRHGLEPKRAKHKISTRRDRMTTTKLVINERVSLPKERRRNLRAAVHKLEQRAAFDQYDESLLKEINKVAVKVGQLKGYHVAEGTQLKERLRSIRSRVLLSL

SEQ ID NO: 3759 - protein, 344 aa, unidentified
  source 1..344: note = Related to CP037993.1; note = Herbaspirillum huttiense
MMSEFPNYPHQRIGTLDALARVLAVPKDHLLTVASRAEVLYRIAAQEQKADGSIRQTFDAKPKLKEIQRNIKERLLQKVKFPPYLQGSLKGRSPRLNAESHKGAHLSISEDIQNFFPSVGRDHVMSIWRDFFRFSDEVSELLTALTVKDDGIPQGAITSSYMANLVFWDYEPRLVEQLAAMGLTYTRYVDDVIVSSRHHLTKEVQSLVVAKIYGMLGRYSLRPKRAKHEVSTRSKRMTATKLVINKRVALPKETRQNIRAQVFAIERRVLDGDRGADLVKALASASSRVGRLASMHPTMGQGLKARLKVVRTTLASESPPEAFQVAVASRVPQSVEEDFVPPWV

SEQ ID NO: 3760 - protein, 330 aa, unidentified
  source 1..330: note = Related to NZ_JPXI01000042.1; note = Massilia sp.
MKKTTIEPGLAPLYLHSAIRGLAALSKALGVRQNVLEKLALSAETLYRVARSEVKSDGSIRQTYDALPRLKAVQIRIKERLLQRVIFPSYLHGSLRERSPRTNAATHIRAKITFAEDISNFFPSASRALVHRVWKDLFGFSEDVAALLTTLTTKDGGLPQGAVTSSYLANLIFWDYEPDLVKTLALRGLRYSRYVDDITVSSRLGIKASDKTYVISQIYGMLLHHGFTPKRKKHEITSAAKSMRTTKLVHHTRVSLPITERKKTRAAVYALELRVSAGESGPGVMKELASVSTRVGRLGSFHKTQAMALKKRLDVVRATLNTFEASPTVS

SEQ ID NO: 3761 - protein, 336 aa, unidentified
  source 1..336: note = Related to NZ_LR890523.1; note = Burkholderia cepacia
MDRPIYKHRPVQTISALARALRISESLLLGIAGRATDLYIGPKPKPKKNGGIRYVFDTKPPLKSLLRRINGTFFKHTQFPKYLTGSLSGRDFVANVEIHRDARNAVTEDIAQFFDCISAECVYRIWKDFFHFGDEVAELLTKLTTKDGRVFQGTPTSSYLANLAFWDRECALVEKLKARGIRYSRYVDDITISTVSPLAKGDKRWAISQIYAMIGTAGFKPQRSKHGSFSASSPIRIMGLNANRAPTLPKQERSAIRAQVYQLEQRVAQADQSDDLRAALSAAIGKVGRLKRLHPSEGTALRLRLDAIRRTLDAQPVVTHATIPIQVSDEAASTPF

SEQ ID NO: 3762 - protein, 336 aa, unidentified
  source 1..336: note = Related to JAHPOI010000008.1; note = Burkholderia multivorans
MDRPVYKHRPVQTISSLARALRVSESLLLAIGERSADLYIGPKPKPKKNGGIRYVFDTKPPLKSLLRRINATFFKHTHFPKYLTGSLSGRDFVANVEIHKDARNAVTEDIAQFFDCISADSVYRIWKDFFHFSDEVAALLTKLTTKDGRVFQGTPTSSYLANLAFWDREFALVEKLKARGIRYSRYVDDITISTTSALTEENKRWAISQIYAMIGAAGFKPQRSKHGSFSASHAIRIMGLNANRSPTLPKQERSAIRAQVYQLEQQIVQANSGPELRAAVSSAISKVGRLKRFHPREAEALRIRLNAIRQILDARPVVTNASVPVEVTEDVGAAPF

SEQ ID NO: 3763 - protein, 336 aa, unidentified
  source 1..336: note = Related to NZ_BAYD01000021.1; note = Paraburkholderia oxyphila
MDHPIYKHRPVQTISSLARALRISESLLLGIAGRATDLYIGPKPKPKKNGGIRYVFDTKPPLKSLLRRINATFFKHTQFPKYLTGSLSGRDFVANVEIHRDARNAVTEDIAQFFDCISADCVYRIWKDFFHFGDEVAALLTKLTTKDGRVFQGTPTSSYLANLAFWDREFALVEKLKARGIRYSRYVDDITISTVSTLAEGDKRWAISQIYAMIGAAGFKPQRSKHGSFSANSPIRIMGLNANRAPTLPKQERSAIRAQVYQLEQRVAQADQSVDLSAALSAAIGKVGRLKRLHPSEGAALRLRLDAIRRTLDAQPVVTHATTPIQASNEVDTAPF

SEQ ID NO: 3764 - protein, 337 aa, unidentified
  source 1..337: note = Related to CP049132.1; note = Ralstonia mannitolilytica
MDRPTYPHERIQSIQSLCCALGLSEPTLRAIASRAPNLYIGPKPKPKKNGGIRYVFDTKSPLKPLLKKINSVFFRRVVFPQYLTGSLSGRDFVANVDVHRNSRQAITEDIAQFFDCITADHVYRIWRDFFAFGEDVADLLTRLTTKNGRVYQGTPTSSYLANLAFWDREPILVEKLATRNIRYSRYVDDITMSSVGVLEADDKSWAIAQAYAMIGANGFKPQRTKHAAFEGGSPIRIMGLNANRHPTLPKQERAQIRALVFQLEQSLARGDTGAVFRSRLNTASGKVGRLKRLHSREGEALRLRLNKIRRVLDVLPLVTCPTTPPGERVQGEDAAPF

SEQ ID NO: 3765 - protein, 314 aa, unidentified
  source 1..314: note = Burkholderiales bacterium; note = Related to JAIENU010000130.1
MLRSIIQRAHNLYIGPKPQVKKNGGVRYVFDTKPPLKPLLKKINSIFFRRTHFPPYLTGSIAGRDFIANVEVHKGARVVITEDIAQFFDCITEQHVYRIWREFFRFSDEIADLLTHLMTKDGRVFQGTPTSSYLANLAFWDFEPQLVNRLAARGIRYSRYVDDISISTTNDLSDSEKRWVVAQIYAMIGRGGFKPQRSKHQYLSSARPITIMGLNANSSRAPTITRRERSRIRALIFQLEQRFASGETGPEFRQSLSHAIGKVGRLKRLHKVEGAALRTRLDTIQAALDALPVKTKASAKFESPPADAIDDHPF

SEQ ID NO: 3766 - protein, 336 aa, unidentified
  source 1..336: note = Related to NZ_CP083589.1; note = Herbaspirillum frisingense
MTKGPAYRYAPILSIQALCRALGCNEPFLRSLAERASGMYIGPKPMQKKSGGIRFVYDTKHPLKDVLKKVNRVFFKKTHYPTYLTGSLDGRDYSTNAGIHAGATGAITEDISQFFPSITADMVYEIWTKLFRFGHEPAMLLTALTTKDGVVFQGTPTGSYIANLVFWSTEHIVVEKLQSLNIRYSRYVDDVTLSKASTLSLDEKTWAISQIYSMIGAQGFKPKREKHGILSGKGAIKIMGLNANAKVSLPRKERSLIRAKVHALEKRFESGEIDFSFRTELNKVSGVVGKMSRFHKHEASQLRGRINVIRRSIELIPIITIGSQYPRTVLPQDVQN

SEQ ID NO: 3767 - protein, 381 aa, unidentified
  source 1..381: note = Related to JAFKGG010000183.1; note = Burkholderiales bacterium
ALGHRPFYELIEQLLRNRRFNNLRCGLAFAWHTDSSSSWYASNTKVLTGSHDPIQSVGSLCRALAIAEPLLCSIAERVPNLYIGPTRKPKKSGNGFRDVYDTRLPLKPLLKRINKVFFERVVFPDYLHGSIRSCDFISNARMHEGSVTVITEDIKGFFDHITEEHAYAIWRRFFGFGEVPSELLTKLVTNGGRVYQGSPTSSYLANLVFWDIEPRMVETLGVRGLRYSRFVDDVTMSHPTSIGTEEKTWAIAQVYAMLGSHGFKPARQKHAIFNGSASRTIMRVNVNEHLTITPAERRQVRAMVHQLEQRVRSGENTSEVRQLLSSAIGKIGRIQRLHPSYAEKLRVQARGIQLTLDEMPFSTESQASFIASQADEGDSPF

SEQ ID NO: 3768 - protein, 313 aa, unidentified
  source 1..313: note = Related to nan
MQYLSYTKENRIQNISSLCLALKIKQDDLLEIANNVQNYYKPPYFIEKKNGGQRCIIDTVDPLKPLLKSINKVFFKNVYFPDYLTGSISGRDYISNVKIHRNSKNIITEDITSFFDNITESHVYDIWRRFFRFSDSVAQILTQLTTKDGKIHQGVPTSSYLANLSLWRHEQHFVNDLKKKGFVYSRYVDDMTISSSNVISREDKTWVISHLIGMLSANTLRIKRSKHAVLTSNKPMNIMGLNINGSKPTTPKKDRDIIRATLHRFDKHPASFSVEDLRSLQGKIINIRRMHVSKGEKFLKQFKETLHKNHITI

SEQ ID NO: 3769 - protein, 313 aa, unidentified
  source 1..313: note = Related to JAHUZX010000055.1; note = Hydrogenophaga sp.
MYFVAKTVLKDDGTERTLYDTRQPLKTVLHRINAHFLRQVVYPEYLTGGVPGKDYTDSVKIHVGARTVVKEDISKFYPSVSFDVVRDIWGRFFGFADEVAELLAMLTTRDGHLEQGAPTSGYLANLALWDVESKLITKLDSIGVTRYSRHVDDITLSSAEHLSSQRIDWVVRAVSAALATKGLLVHTGKHEVMQADGQIKILKLVGNAKPSLPPKERSRVRALVHNFCQRVDAGGSQEELEQLLPRVRGQAYKVKRFHLRSGGQLVERVAQAASLLEDRRSKSPPRISHIGSHLDDSDWLSEHPPVGGAPWEL

SEQ ID NO: 3770 - protein, 348 aa, unidentified
  source 1..348: note = Related to NZ_JSZO01000019.1; note = Ralstonia sp.
MNAPRYRHHRVQSIESLRHPLGMGPSELLALAKRASHLYRIAKTVPKDDGTLRVLYDTREPLKAVLGRINEHFLRRVIYPDYLTGGVPRKDYTDSVKIHVGAKSVIKEDISKFYPSVSFDVVREIWSGFFGFADEVSDLLTMLTTRDGYLEQGAPTSGYLANLALWDIESQLIAQIASAGATRYSRHVDDITISSPEHLSTSRVDWIVRMVAGALASKGLRVNASKHEVMQAGGQIKILKLVGNAKPSLPPKERSRVRALVHTFCLRVESGESPEELALLLPRVRGQAHKVKRFHRRAGERLVEQVNQAAQLLKNQTAEAQPVKQPTPNLVFDEAIAGQQPPESDPPW

SEQ ID NO: 3771 - protein, 323 aa, unidentified
  source 1..323: note = Related to NZ_CP017751.1; note = Cupriavidus sp.
MNEAKYLRRRVRSIEALRHPLGMGPRDLQRLALRASSLYFVATTMPKADGTLRVLYDTRKPLKSVLQRINEHFLRKVVYPPYLTGGVPGKDYTDSVKIHAGAKTVITEDISKFYPSVGLEVVRNIWSGLFGFSDEVADLLAALTTRDGHLEQGAPTSGYLANLALWDVEPALINRLTAMGVSRYSRHVDDITLSSLEPLGTSRVDWVVRTVTRTLASKGLQIHPGKHQVMDAGEQIKVLKLVGNIKASLTPEERSRVRALVHNYCKRVESGDGLEELRALLPSIRGQAHKVKRFHPRVGARLVAEVEQAAQQLQHRMVTWIKS

SEQ ID NO: 3772 - protein, 352 aa, Achromobacter sp.
  source 1..352: note = Related to PYAL01000004.1; note = Achromobacter aloeverae
MTAPRYPHDRIQSIGSLRHPLGMDARELTALAKRASRLYFVAKTIPKNDGTQRVLYDTAKPLKPVLQRINDNFLRRVIYPHYLTGGVPGKDYTDSVKIHIGAKSVIKEDISKFYPSVTFDVVCDIWSGFFGFSHEVADLLALLTTRDGHLEQGAPTSGYLANLALWDVESSLIAKLASIGVTRYSRHVDDITLSSQEHLSAARVDWVVRTVAAALARKGLLVHAGKHEVMHAGGQIEVLKLIGNTKPSLPPKERSRVRALVNNFCRRVESGDSVEELQSLLPRIRGQAYKVKRFHRRKGEQLIEQIDRVAKILRARAGEAQPNIDKLQRDMVDSYSANESFGRQSAVVDPPW

SEQ ID NO: 3773 - protein, 302 aa, unidentified
  source 1..302: note = Related to NZ_JACHHM010000015.1; note = Parapusillimonas granuli
MEPNELLRLAKRASRMYFVAKTVPKDDGTQRILYDTRKPLKTVLHRINEHFLRRVIYPDYLTGGVPGKDYTDSVKIHVHAESVIKEDISKFYPSVSFDVVYDIWSSFFSFSNEVAELLTMLTTRDGHLEQGAPTSGYLANLALWDIEAPLVAKLASIGVTRYSRHVDDITLSSPDHLSASRVDWVVRTVATALASKSLLVHPGKHEVMHAGRRAIEVLKLVGNTKPSLPSKERSRVRALVHTFCRRVEAGDSGEELERLLPRVRGQAYKVKRFHQRIGEQLVLQVDQAAKLLRDSPSDVGSR

SEQ ID NO: 3774 - protein, 310 aa, Achromobacter sp.
  source 1..310: note = Related to JAKLXU010000051.1; note = Achromobacter xylosoxidans
MYFVAKRIPKEDGTIRVLFDTRQPLKAVLQRINSQFLRKVHYPPYLTGGVPGKDYVSSTRLHAHATLVIKEDIRTFFPSVHADVVLDIWERFFGFSTDVAQLLTLLTTRDGHLEQGAPTSGYLANLALWDVEARVVSQLARECELTGYSRHVDDICVSSPTPISASQKARAVSLIFGMLASKNLAPKRAKHITMHGGQQIRILKLVANRKPSLSAIEQSRIRAAVHQFCRRAANLGDPTSLRAELPKIRGLAHHLKRFHPRKGAVMLAAIDTVARALNSTDVAQSDVAPTVSTFSGPVATNAPDSQAPWD

SEQ ID NO: 3775 - protein, 318 aa, unidentified
  source 1..318: note = Related to CABVQR010000004.1; note = Burkholderia contaminans
MSSASYPHARIQSVESLRHPLGMGPVGLRRLAKRASDMYFVAHRIPKDDGSERIVYDTREPLKSVLRRINQHILRRVVYPDYLTGGVPGKDYKSNVEIHVGAATVVKEDISSFFPSVSEVLVFDIWHRFFGFSTDVAEVLTALTTRDGHLEQGAPTSGYLANLALWDVEPNLVHRLAEEGFTAYSRHVDDIVLSSNEELEGGEIAWAVSQIYGTLRKKGLQAKRAKHEVMRLNRPIVILKLIGNEKASLPARERSRVRAVVHRFCTNIESGVDIALLEADLPSVRGLVHKVKRFHPTEGNKLVAQVEQAVQLMRASNG

SEQ ID NO: 3776 - protein, 340 aa, unidentified
  source 1..340: note = Related to VIFK01000111.1; note = Spiribacter salinus
MVGNDPLVPRYPHRPIGSIDALARHLGVSRRELERLTRAAPRLYRANPLPKKGGGFRWTYDARPPLKRLHAAIKEKLLQPVEYPSYLQGSIRDPDTPREPLTNADLHAGNYLFIQEDVAGFFGSIGPSVVNDMWRRFFAFPADVSEILTNLTTLKGLVPEGARPSSYIANLALWDVEPQLVRELQGRGFVYSRYVDDVVISAPRNLSHEEKTEVVGRLYGMFAAKGLRAKRQKHSIAKKGQAAGKGRGVTVTGYSVAGGRAAVSKAERNRVRSAVRQIEVEARTRGTSPELQARFQSASSRVDRIARAGSAQGVRLRQRLAELKPSVFPKSNRRDIYGGG

SEQ ID NO: 3777 - protein, 315 aa, unidentified
  source 1..315: note = Xanthomonadales bacterium; note = Related to PAQT01000005.1
MRAHYPKQPIGSISALSRALDVEEDLLTHIGANVSTFYRPGPPQPKKDGTLRITHNAAPELKGIHRKINKRLLQEVQYPDYLHGSIRVINDPRSIKTNAALHTNQKTILCEDVAGFFDATTPALVRKVWQHLFCFPPTVAELLTKLCTHDGFLPQGWRCSSYLANLVLWEDEDRLVRNLRCRGFTYSRYVDDMTISAPRFLSRADKSWVVQSLISTLARNGYRLKRGKHEILKAAGTMKVNGQIVNGKRPTLSTKYRNNVRWNVYALQKMHALDASSEEYRSRWESCSGKAIRVASYHERTGQKLLDQLSAIAPQ

SEQ ID NO: 3778 - protein, 335 aa, unidentified
  source 1..335: note = Related to CP013360.1; note = Burkholderia thailandensis
MKSLQNKPCYKNAPIKNVGALARTLRLTEPQLIQLARNASHMYRRVPVPKKDGTTRHTWDAQKQLKEVHGIINSRIFHRTTFPLFLQGGIHDPLYPRDYVRNADIHVDPSILVTLDIADFFPSTSDSAVMGIWSDFFRFPPAVAKLLTMLTTKDGFLPQGARTSSYLANLAFFRSEHDLVACLERQGWRYSRLVDDITISKQRRASDDELTQVNTTLFAFVNRHGYSVKRSKHDVQRRNARMSVNGLVVNKKVSLPKSQRRSIASVLHRTNAAIDVGEGHTMPVNRVRGQVAMVKRMHPELGEKMLARLKQSISAAESRPAIELNDCETVPLDER

SEQ ID NO: 3779 - protein, 319 aa, unidentified
  source 1..319: note = Related to NZ_CP047386.1; note = Pandoraea fibrosis
MTEPQLLQLARNASRMYRKVPVPKKDGSTRYTWDAQKQLKEVHGHINSRIFHRTMFPLFLQGGIRDRLHPRDYVRNAEIHVDPTILVTLDIADFFPSTSDSAVMDIWSKFFRFSPAVAKLLTMLTTKDGFLPQGARTSSYLANLVFFSDEHDLVARLERQGWRYSRLVDDITISKQQRVNSDEVTETNRMLFAFVNRHGYSVKRPKHDVQRSNARTSVNGLVVNKKVSLPKPQRRSISSLLHRTNLAISIGEESTMPVSRVRGQAAMVKRMHPELGEKMLERLKQSLSVGARRPAVMPDDQEVSPPIRRQTKRKNSPGT

SEQ ID NO: 3780 - protein, 338 aa, unidentified
  source 1..338: note = Related to JAHPLT010000004.1; note = Burkholderia gladioli
MKSPLNKPFYKNAPIKSVGALAQTLQLTERQLLQLARNASRMYRKVPIPKKDGTTRYTWDAQKQLKEVHGLINSRIFHRTTFPLFLQGGIRDQLYPRDYVRNADIHVDATTLVTLDIADFFPSTSDSAVMDIWSTFFRFPPVVAALLTMLTTKDGFLPQGAKTSSYLANLAFFRDEHDLVTRLQKQGWRYSRLVDDITISNQRRVSNDEVAAVNRTLFAFVNRHGYSVKRPKHDIQRCDARMSVNNLVVNKKVSLPKSQRRSIASLLHRTSEAIFVGEECAIPINKVRGQIAMVKRMHPELGEKMLARLKQSISAVENRPTIVLDDQEAVSSTSDAQL

SEQ ID NO: 3781 - protein, 323 aa, unidentified
  source 1..323: note = Related to NZ_FNCJ01000045.1; note = Paraburkholderia phenazinium
MSSRPNKPSYNFAPIKDVRTLALALGLAERQLNRLAVNAGNMYRRKPIAKKDGTERVTWDAHKQLKEVQGRINQLFFHKVLFPLYLQGSIRDKAYPRDYVRNAEIHAGACVAVTLDIADFFPSTRAELVQDIWRDFFRFAPPVAEVLTRLTTKDGFLPQGARTSSYLANLVFWQREHCLVETLEKRGWRYSRLVDDITISKATDTSQAELTDINRIAIGCFQGYGYSVKRSKHKVLRRNHRITVNSLVVNVHPALPKDERRRIGAQVHQVKEALTSGTQADVPSVASTRGKIAKVVRLHPELGSRLSDKLRQAIPLDTEGSPE

SEQ ID NO: 3782 - protein, 325 aa, unidentified
  source 1..325: note = Related to UFTG01000001.1; note = Bordetella avium
MSRPNRPLYKGDEIASSDALAEVLGLTSPQLHQLAANASKMYRENPQRKKDGSLRMTWDAHPQLKKAQKQINLRIFGRILFPLYLQGSIRDRAYPRDYARNANIHSGAAVTIAIDIQDFFPSITPDQVLSAWLGVCHFPWQVAELLTRLTTKDSFLPQGAPTSSYLANLVLWENEHELVRTLQTRGWHYSRLTDDITLSKKAPVEKDEITRTTCTAIGFIQRNGFTVKRSKLKVMKRNVPMTVNNLVINEHPALPKAERRQIRAQLHQAKLALASGALVDAQAINSARGKVGKVVRFHPQLGAKMKGELDQELDSWTVRQLNDEG

SEQ ID NO: 3783 - protein, 354 aa, unidentified
  source 1..354: note = Gammaproteobacteria bacterium RIFCSPLOWO2_02_FULL_61_13; note = Related to MGYT01000040.1
MHPNLLKPFYSHGPIQNLDTLAEVLEISCKQLCRLARKANQMYRLVPQQKKDGSVRKTYDADHALKRVQHLIKTRILSKVRYPLYLQGGIRDPENPRDYARNAAIHAGQACVINEDIADFYPSTTSHQVRDIWKHFFRFPAGVADCLTRLTTRRGFLPQGAKTSSYLANLVFWRTEYELVRHLAAKGLRYSRLADDITGSSSKPLTRGQKSEVISAVYSFIKRDGFSPKYRKHAIFERNEAMLVNNLVVNAHPALPVRERQAVRCLVHRASNTLNAGNGTVSNVPLAHIKGKIGKVKRFHARAGRRLAATLQAALTSVQKLDGSGAHHRGRVDRDHRNARRYDGHLHAPAPAGS

SEQ ID NO: 3784 - protein, 319 aa, unidentified
  source 1..319: note = Related to nan
MNRLCFRGRPIASIEALASTLHVSPRYLWWVIERTDRLYRPMKPIIKPDGSVRQTYNPAAPLKDVQRRINRNIFSRVEFPIYLQGGIRDRKTPRHCVANAQLHTNAAIVINEDIAGFFPSISRQQVQDVWQHFFRFPLAIAETLTALTTYNGALPQGAPTSSYLANLVLWRQEPELVTNLAARGIRYSRYVDDITLSSKRFLNNHLKADAVRQVRRLCNGNGFRMKGRKERIETSGKPMRVNNLQINHGVTLPKKERARIRAAVRVCEVYPAESRDSSEYQKLLNSTLGRVSRLRQLHPKEGADLMRRLTIMRGASRSK

SEQ ID NO: 3785 - protein, 319 aa, unidentified
  source 1..319: note = Related to nan
MNRPRFKGRPIGSIEALARALYVSLRQLHWAIGRADALYRPMKPITKPDGSVRQTYNPAAPLKEIQRSINRNIFSRVKFPIYLQGGIRDRNNPRHCIANAKLHCGATIVFNEDIFSFFPSITRRQVQDVWQNLFRFPPEIAEALTILTTYQGILPQGAPTSSYLANLVLWRQEPELVTNLAARGIRYSRYVDDITLSSRRFICNHQKAEVIQQVRRLCNGNGFRMKGCKERIETSGKPMCVNNLQINHGVTLPKKERARIRAAVRACEVYHSESRDSSEYQKLLNSTLGRVSRLRQLHPKEGTDLMRRLTIMTEVSRSK

SEQ ID NO: 3786 - protein, 315 aa, unidentified
  source 1..315: note = Related to nan
MNQPCFKDKPIASTAALARALHIPHRHLTWATNRADRLYRALQPMVKPDGSIRQVFNPARPLKDIQRRINRHIFGRVDFPFYLQGGIRDRKNPRHCLANAKLHSDAKIVINEDISGFFPSITKRQVQNIWQHFFRFPPDIAIILTKLTIHDGQLPQGAPTSSYLANLALWEHEPPTVEALFIKGIRYSRYIDDITLSSTYFQNDHSKTAMIRKVRSMCNRNKYEVKRSKHRIESSGQPMRINNLQINNGISLPKRERACIRAAVHSCEKHIEEERTANEYHVLFNSTVGRVNHLRQFHRHEGKRLLKRLDACAPL

SEQ ID NO: 3787 - protein, 302 aa, unidentified
  source 1..302: note = Bryobacteraceae bacterium; note = Related to JAIEPW010000014.1
MENAADSLYRPVMVKKKDGTRRECFDAKPPLKAMQARIQNMIMKKVIYPGYLTGGLADPKTPRDYVRNAEAHTGARLMVNEDVAKFFPSTTHEVVYDIWRFVFRFPKEVARTLTRLTTRCGELPQGAKTSSYLANLVFWAHEPRLVQWLHNAGFRYTRYIDDITLSSTADKTREELGQAIGRVASMLRRHGLRFKRSKHHIAYAGERMEVTGLTVGERSVGLSRKRKSMIRASVRQCEWAAKKGIFDDAMQKSAASLVGQYTRLHRNKGKALKRRLAALEVSRKLPAIEPVVSAVGIEPTTR

SEQ ID NO: 3788 - protein, 373 aa, Pseudomonas sp.
  source 1..373: note = Related to JABFMR010000045.1; note = Pseudomonas corrugata
MDAPIYPFKPIHSIRALALALGESEQLLERLATRADQMYRHVPQEKKVKPGKPPEMRDTYDAHEPLKRVQRKLVDRILSKATFPPYLHGGIKDRKSPRSIHSNAAVHAGARFVILQDIRNFYPSILKRHVDALFRGLFGFGASVAALLSSICTREGSTPQGASTSGYIANLVFWDVEPKIVKGLLGRGFQYTRFADDITISCGRKPSSDELTNIVSTITGMLAAKGCHQKRTKLHLRVRGQGIKADGAIFQPVTVTGLSVFNSSPGLTKLERRRIRSAVREFEVMSESTNNWSDLESTYHRAMGRVGRLLACGHPDGAMLKERLNLVMRSYQAPLLERYQQAIVANSNTETSSLAAPPILEYSSEQDGPLPWQ

SEQ ID NO: 3789 - protein, 356 aa, Pseudomonas sp.
  source 1..356: note = Related to SUQH01000001.1; note = Pseudomonas koreensis
MDAPTYPFKPIHSLRVLALALGESEQLLERLAARADRMYRHVPQEKKVKPGKPPETRDTYDAHEPLKRVQRKIVDRILCNATFPQYLHGGIRDRKSPRSIHSNAAIHAGARFVILQDIKNFYPSISIKHVDALFRGLFGFGAGVSVLLSSICTREGCTPQGASTSGYIANLVFWDVEPKVVNDLLGRGFRYSRFADDVTISSGHEPSSDDLTNIISTITGMLAAKGCHQKRTKLHIRVRGQGIEADDATFQPITVTGLSVFNSSPGLTKLERKRIRSAVRELEVMSESTSDWTVLEPKYHRAMGRVGRLLACGHPDGEALKARLNVAKRSCQIPLLERYQQAISESLAKAVEVDVE

SEQ ID NO: 3790 - protein, 374 aa, Pseudomonas sp.
  source 1..374: note = Related to NZ_CP066306.1; note = Pseudomonas putida
MKAPLYPHKPIHSIRALALALGESEALLERLAARADRMYRHVPQEKKVKPGQPPETRDTYDAHEPLKRIQRKLVDRVLSKAIFPTYLHGGIRDCKSPRSIHSNAAVHAGARFVILQDIRNFYPSISKSHVHAMFRGLFGFGAGVAELLSSLCTRSGSTPQGASTSGYIANLVFWDVEPKVVSDLSGKGFQYSRFADDITISCTREPEADELTGIVSAITGMLASKGCHQKRSKLHVRIRGQALKSEGTTFQPITVTGLSIFNASPGLTKSERKRIRSAVRELELSSETTSNWVELEPMYHRAMGRVGRLLACAHPDGESLKVRLNLIKRSYEKPLLERYQQEIVEQSAREINNVSCARTLPSQPTEPVDSPPWE

SEQ ID NO: 3791 - protein, 360 aa, Pseudomonas sp.
  source 1..360: note = Related to NZ_AUEA01000002.1; note = Pseudomonas cremoricolorata
MKSLALALGESEQLLERLAARADRMYRHVPQQKKVKPGMPPETRDTYDAHEPLKRVQRKLVDRLLSKAVFPAYLHGGIKDRQSPRSIHSNAAVHAGSKYLVLQDIQNFYPSISMQQVDALFRQLFGFSTPVATLLSSICTREGSTPQGASTSGYIANLLFWDVEPKIVEDLMGRGFQYSRFADDITVSCRHEPSSDELSDIVSTITGMLASKGCRQKRAKLHIRVRGQGIKADDATFQPVTVTGLSVFNPTPGLTKSERKCIRSAVRELELMSEAGSRWLDLEPVYNRAMGRVGRLIACGHPDGKAFKGRLNAVKLSHQTPLLDRYQLAATGVAESATPPVGVGLREPYSAERDGPLPWD

SEQ ID NO: 3792 - protein, 348 aa, Pseudomonas sp.
  source 1..348: note = Related to CP068034.2; note = Pseudomonas syringae
MEAPIYPFRPIHSTQALALALGESEHLLERLAVRADRMYRHVPQKKKGRPGETRDTYDAHEPLKRVQRKLVDRVLSKAIFPAYLHGGIRDLKSPRSIHSNAAVHAGARFVILQDIRNFYPSISKIQVDALFRGLFGFGASVAALLSSICTRDSCVPQGASSSGYIANLVFWDVEPKVVKDLQDRGFQYSRFADDITISSGQEPSTEEISTIVSTITGMLASKGCRQKRTKLHMRIRGQGIKSNDATFQPVTVTGLSVFNSAPGLTKLERKRIRSAVRELELLRELTSDWADLEPKYHRAMGRVGRLLACGHPDGVALKSRLNVVKRSYQKSLLERYQQSENASPNSDS

SEQ ID NO: 3793 - protein, 348 aa, Pseudomonas sp.
  source 1..348: note = Related to JAFIBJ010000001.1
MEAPIYPFKPIYSAQSLALALGESEHLLERLAVRADRMYRHVPQKKKGKPGETRDTYDAYEPLKRVQRKLVDRVLSKAIFPAYLHGGIRDLKSPRSIHSNAAVHAGARFVILQDIRNFYPSISKIQVDTLFRGLFGFAAGVSALLASICTRGESTPQGASTSGYIANLIFWDVEPKIVKSLTDRGFQYSRFADDITISCIREPSSEELSDIVSTITGMLASKGCHQKRSKLHMRVRGQGIRADDATFLPVTVTGLSVFNGTPSLTKLERKRIRSAVKELEVISGSMPEWAALEPMYHRAMGRVGRLLACGHPDGEALKARLNVIKRSYQTPLLERYQQTLNAEYEGLN

SEQ ID NO: 3794 - protein, 350 aa, Pseudomonas sp.
  source 1..350: note = Related to NZ_JABWQV010000038.1; note = Pseudomonas tehranensis
MDAPTYPFKPIHSIQALALALDESERLLERLAIRADRMYRHVPQEKKGKRRDTYDAHEPLKRVQRKLVDRVLSKAIFPAYLHGGIRDRKSPRSIHSNASVHAGARYVILQDIRNFYPSILKSQVDDLFRGLFGFGASVSALLSLICTRDGCAPQGASTSGYIANLIFWNVEPKIVQDFLAQGFQYSRFADDITISCSREPTSEELSGIVSTVTGMLAAKGCHQKRTKLHMRVRGQGIKGDDATFTPLTVTGLSVFNGAPSLTKLERKRIRSAVKELEVMSESTPGWAVLEPKYHRAMGRVGRLLACGHPDGEALKARLNVVKRSCQIPLHERYQQAISECLAKAVEVDVG

SEQ ID NO: 3795 - protein, 336 aa, Pseudomonas sp.
  source 1..336: note = Related to NZ_CP027732.1
MDAPTYPLKPIHSIQALALALGESERLLERLAARADRMYRHVPQEKKGKKRDTYDAHEPLKRVQRKLVDRILSRAIFPRYLHGGIRDIKTPRSILSNAAPHAGAKYVILQDIKNFYPSISVDQVEALFRGLFGFGVPVSALLSSICTREGSTPQGASTSGYIANLIFWDVEPKIVRSLLDDGFQYSRFADDITISSGRKPSSDELSFIVSTVTGMLASKGCHQKRAKLHMRVRGQGIKEDDQTFKPLTVTGLSVYNSAPGLTKLERKRIRSAVRELEIASESVRDWNVLEPMYHRAMGRVGRLLACRHPDGEALKARLNTLKHSHQKPLLERYQQV

SEQ ID NO: 3796 - protein, 370 aa, Pseudomonas sp.
  source 1..370: note = Related to NZ_UWCS01000683.1; note = Pseudomonas viridiflava
MDAPTYPFKPIYSLRALALALGEDERLLERVAARADRMYRHVPQEKKGTKGEIRHTYDAHEPLKRVQRKVVDRILAKAKFPLYLHGGIRDVSSPRSILSNAMVHAGARYVVLQDIENFFPSISTHQVFRIYRDLFGFGEPVSMLLASISTREGSTPQGASTSGYLANLLFWDVEPKVVNELFIRDFRYSRFADDITISSERKPTPQELADIISTITGMLASKGCRQKRKKLHVRVRGQGVKVAEGDYEALTVTGLSVFNSTPGLTKLERKRIRSAVRELEILASSTPSWSTIEPRYHQVMGRVGRLLACGHPDGEALKIRLNSVKRLCQVPLLERYRLGLSDDKDVLELACSSASGVAPSLGVNEPLPWE

SEQ ID NO: 3797 - protein, 342 aa, Pseudomonas sp.
  source 1..342: note = Related to JAHRDY010000001.1; note = Pseudomonas viridiflava
MEYPLYPHRPIHNLNSLALLLGEPLSLLIKLARNSDKLYRKVPQVKKDGTTRETFDASEPLKSIQRKVVDRLLVKVLFPNYLHGGIRDINSPRSVYSNVKTHVGARSIILQDIKNFFPSITLERVFSVFKGLMGFSDAVSNVLAHLVTRYGAVPQGASTSSYIANLVFWDVEPRLVAWIRNQKMAYSRFADDITISSFDMISDDLKTEVVRRVTGMLAAKGFAQKRQKLHVLKRGQAITKANQSEVAVITGLSVAGPRPGVTKEERKKIRSAVKEFETLALMNPDSDRLKELYNRAMGRIGRLLACGQSDGFALKQRMNIAFEKTKKSIFVKHAFIENTVPD

SEQ ID NO: 3798 - protein, 343 aa, Pseudomonas sp.
  source 1..343: note = Related to NZ_AZRW02000052.1
MDSPLYPYKSIHNIKSLALLLGETVPLLNKLAEDSHKMYRRVPQVKKDGSERETFDAHEPLKSVQRKIVDRLLAKVSYPDYLHGGIRDSNYPRSIYSNVKSHSGARNLVLQDIKNFFPSITIDKVLSIFKGMMGFGDEVAVMLTRLVTKGGIVPQGASTSSYIANLVFWNVEPRLVVWIRALGMSYSRFADDISISSKNIILPDQKTEIVRRVTGMLAAKGFLQKRQKMHVLKKGQTITTAKKPEPVVVTGLSVAGPRPGVTKEERKKIRSAVREFEILAEAGADLIKLRELYNRAMGRVGRLLACGQSDGLALKNRLNLAMRQCNKPLLEKYEKGEVGGISI

SEQ ID NO: 3799 - protein, 348 aa, Pseudomonas sp.
  source 1..348: note = Related to NZ_CP016849.1
MDKPRYSQKPIFNIESLALRLGESPMLLNNLARNSHRLYRTVPQQKKDGSVRETFDAHQPLKAIQRKIVDRIFSGVIFPDYLHGGIRDVNSPRSIYSNVACHAGARVVLMQDIKNFFPSITEDKVLGVFKGVLGFGDDVSSLLVKLTTRRGVVPQGASTSSYLANLVFWDVEPRLVTWVKANNLSYSRFADDITISSKGDVRDELKTDVIRKVTGMLASKGFYQKRQKMHVLKKGQVIVTKGGVEPFVITGLAVSGPNPGVAKFERKKIRAAVKEFEDLIGSGVFVSDVENKYNSAMGRVGRLIACGQSDGIILKERLNAARLKASVPLLEKYLAANIIPVVQAKVEE

SEQ ID NO: 3800 - protein, 347 aa, Pseudomonas sp.
  source 1..347: note = Related to NZ_CP027722.1; note = Pseudomonas chlororaphis
MTTARYTRKPVYSLKTLGLMLGESPELLLRLGASSSGFYREVLQQKKDKSVRVTFDAFQPLKRVQRKIVDRLLIHVSYPSYLHGGIRDVDSPRSPLSNARAHLGAKSIALQDITNFFPSISRDKVRNIFTGLFGFGSGVAELLSLLVTKDGFVPQGASTSSYLANLVFWDVEPRLVSWIHSQNLIYTRFADDITISSKVLVSDEQWTEIISKVTGMLATKGFKQKRTKLHVLKKGQALTKGNKPEPLVITGLGISGSSTGVVKAERHKIRAAVRQFEAAIESGSSFDEVAHLYHSAMGRVGRMLACGQPSGFEFKKRLNEAKRLGQISLIDKYIAETSAVSDEEVRG

SEQ ID NO: 3801 - protein, 346 aa, Pseudomonas sp.
  source 1..346: note = Related to NZ_AP014637.1
MDAILYHCRPIYSLKSLALALGESVEFLGWLACQADSLYRPVQLVKKDGTPRYAYDARADLKKVQRKIVDRILARVVYPKYLHGGIKDADFRRSIYSNANLHTGAKSYIVQDISNFFPSISFAKVYDVFSLFFNFGHVVAHLLTRLVTRAGVVPQGASTSSYLANLVFWDVEPEVVLGLKEKGFCYSRFADDITVSSPSALSADEKTEIVTKVTGMLARKGFKQKRSKMHVLKKGQAIALSNGKYEPALITGLSISGPKPVITKKERNRIRGLVKNYQALIDMGRPDSELEKVFHKVMGQVGRIIACGQAEGAELKKTLNEARRLSKKSIFERHDSLINASESSQA

SEQ ID NO: 3802 - protein, 371 aa, Pseudomonas sp.
  source 1..371: note = Related to NZ_LT629782.1; note = Pseudomonas orientalis
MDAPFYPHSSINSIKALARALGEPAERLLALAQRSSRLYRYVPQTKKDGITPRHTYDAHEPLKTIQRKIVDRVLSKVTYPEYLHGGIRDPKLPRSIYSNARIHIGAKTVILQDIADFFPSITTEHIQRLFVGLFRFSADVASLLASLVTREGQVPQGASTSSYLANLVFWDIEPALVTRFKAQGMAYSRFADDITVSSKTRIASAATTQVIASVTWMLGQKGCLQKRSKLHVRKRGQALITGEKAEAVTVTGLVVNGPIPALPKKARLAIRSAVKQLEDRVRGNSGQLSAEDDKEVRRVMGRIGRLIACGHPEGPRLKARVRVLLARTPLFKRYAAGVEIQPLVVADTPLGLNAVANTLPHGQRELPWYTE

SEQ ID NO: 3803 - protein, 373 aa, Pseudomonas sp.
  source 1..373: note = Related to CP074410.1; note = Pseudomonas syringae
MDAPFYPHSPIHSVKALARALGEPAERLLALAQRSSRLYRYVPQTKKDGVTPRHTYDAHEPLKTIQRKIVDRMLCKVIYPEYLHGGIKDAKLPRSIYSNARVHIGAKTVVLQDIADFFPSITTEHIHRVFVGLFRFSPVVATLLASLVTREGQVPQGASTSSYLANLVFWDVEPALVKRFAAQEMAYSRFADDITVSSKTHISPIATTQIIASVTWMLGQKGCLQKRSKLHVRKRGQALITGDKADAVTVTGLVVNGSIPALPKQARLAIRAAVKQLEDRVEGNSGQLSAEDEKEVRRVMGRIGRLIACGHPEGQRLKARVRAVLTKETLFKRYTADPEFHPHVVAATSEKRGVPVSSIGSIKPLRDPPWNKE

SEQ ID NO: 3804 - protein, 371 aa, Pseudomonas sp.
  source 1..371: note = Related to CP077084.1; note = Pseudomonas tritici
MDAPFYPHSPIHSISALARALGEPVERLIALAHRSSRLYRYVPQTKKDGITPRHTYDAHEPLKTIQRKIVDRILSKVAFPGYLHGGIRDPKLPRSIYSNARVHTGAKTVILQDIADFFPSITNEHIHRLFVGLFRFSADVATLLADLVTREGQVPQGASTSSYLANLVFWDIEPALVTRFKAQGLAYSRFADDITVSSKTRIDQATTSQVIASVTWMLGQKGCLQKRSKLHVRKRGQALITSDKADAVTVTGLVVNGPIPALPKKHRMAIRAAVKQLEDRFEGNSGQLSADDEKEARRVMGRIGRLIACGHPEGQRLKARVRVLLMRAPLMERYADTEFQVQMVAETTADLDVAASSLQIDLPVDLPWKVG

SEQ ID NO: 3805 - protein, 362 aa, Pseudomonas fluorescens
  source 1..362: note = Related to MOBU01000006.1
MDAPLYPHSPIHSINALARALGEPAERLLALAQRTSRLYRYVAQTKKDRITPRHTYDAHEPLKTIQRKIVDRMLRKVVYPRYLHGGIRDRKLPRSIYSNARVHTGAKTVILQDISDFFPSITTEHIQRLFVGLFRFSADVASLLANLVTREGQVPQGASTSSYLANLVFWDIEPALVTRFEAQGLAYSRFADDITVSSRSPISAAVTTQVIASVTWMLSQKGCLQKRSKLHVRKRGQALLSGESAEAVTVTGLVVDKPIPGLPKKVRLAIRAAVKQLEDRVKGDLRQLRAEDEKEARRLMGRIGRLIACGHPEGQRLKARVRVLLTRAPLLESYAADADHQPRLPAAKLPSSYPDTPTISDQ

SEQ ID NO: 3806 - protein, 373 aa, Pseudomonas sp.
  source 1..373: note = Related to MOAT01000002.1; note = Pseudomonas protegens
MDVPFYPHNPIHSVKALARALGEPVERLLALAQRSSRLYRYVPQTKKDGITPRHTYDAHEPLKTIQRKIVDRMLCKVTYPGYLHGGIKDAKYPRSIYSNARVHTGAKTVILQDIADFFPSITTEHIHRIFVGLFSFSAEVATLLANLVTRDGQVPQGASTSSYLANLVFWDIEPALVIRFKAQGLEYSRFADDITVSSKARISPAATTQIIASVTWMLGQKGCFQKRSKLHVRKRGQALITGEKAEAITVTGLVVDKPIPALPKKARLAIRAAVKQLEDRVHGYPGQLSIEDEKEVRRVMGRIGRLIACGHPEGQRLKTRVRALLTRAPLLERYVADAEFQPQMVAATSGELSVMAASALPIDLPLDLPWEAG

SEQ ID NO: 3807 - protein, 384 aa, Pseudomonas sp.
  source 1..384: note = Related to JAJSRK010000022.1; note = Pseudomonas putida
MEAPLYPHSPIYSVKALARALDEPFERLVALAKRSSRLYRYVPQFKKDGITPRHTYDAYEPLKTIQRKIVDRILSKVNYPRYLHGGIKDAKQPRSIYSNARVHAGAKTVILQDIADFFPTITTEHIRLIFTGLFRFSEDVGALLAALVTREGQVPQGASTSSYLANLVFWDIEPALVARFKAQGLEFSRFADDITVSSKSNLRDAVTAQIISSVTWMLGQKGCQQKRSKMHVRKRGQALLRTEKAEAVTVTGLVVDRPTLSLPKKERMAIRAAVKQLELRVVGHQGQFSEEDDREIRRVMGRIGRLIACGHPDGQRLKSRVRALLMAAPLLDRYMGSDEVPVVMLASTDELVSTESAAVEDLDLPWDVNELSLACKQRSQGSET

SEQ ID NO: 3808 - protein, 353 aa, Pseudomonas sp.
  source 1..353: note = Related to JADLJL010000006.1; note = Pseudomonas guariconensis
MEVLRYPYSPIHSLNALARALDEPAERLVAIAKRSSRLYRYVPQKKKDGITPRHTYDAHEPLKSIQRKIVDRMLTKVSYPDYLQGGIKDARNPRSIYANARVHAGSKVVILQDIADFFPSITVAHVREVFSKLFGFSHDVAQLLANLVTREGQVPQGASTSSYLANLVFWDIEPALIERLKAKGLRYSRFADDITVSSKAEITQDSVTQIIGSVTWMLGQKGCRPKRSKLHVRKRGQALISDEKINAVTVTGLVIDRSFPGLPKKERMAIRAAVKQLEDSACEWPEGPPAEEKKAIQRLMGRIGRLIACGHPDGQRLKARVRTVTRLVPLIERYTPNVVESVTLNQTAQDPAQ

SEQ ID NO: 3809 - protein, 345 aa, Pseudomonas sp.
  source 1..345: note = Related to JABWRM010000011.1
MDALHYPHSPIYSVSALARALGEPTERLIALAKRGSRLYRYVPQTKKDGKTPRHTYDAHEPLKTIQRKIVDRILSKISYPCYLQGGIKDVHAPRSIYANARVHAGSKSIILQDIADFFPSITVAHVRQVFSKLLGFSDEVSELLADLVTREGQVPQGASTSSYLANLVFWDIEPALAERFNAKGLRYSRFADDITVSSKTDMPQEVATLVIGSVTWMLGQKGCRPKRSKLHVRKRGQALISGDKVDAVTITGLVVDGSSPSLPKKERMAIRTAVKQLEDSARDWVGGPPLEMQKDIQRLMGRIGRLIACGHPEGLRLKARVRLVTRRGPPLEQHTQIAGNIEVHS

SEQ ID NO: 3810 - protein, 371 aa, Pseudomonas sp.
  source 1..371: note = Related to AP015029.1; note = Pseudomonas putida
MEAPLYPHRPIYSLKALSLALAEPEALLVAIAKRSSNLYRYVPQKKRDGSPRDTFDAFEPLKAIQRKIVDRILIKVKYPVYLHGGIRDVAQPRSIYSNARSHAGSKSIILQDIKNFFPSITTAHVKEIFSGFFGFSSEVSSLLAALTTRAGQVPQGASTSSYLANLVFWNVEPALVKQLGSEGLAYSRFADDITVSSKSEILPEAKSRIISAVTWMLSQKGCQQKRSKLHIRRRGHSLLEVSEPGAVTVTGLTVDRASPGIPKDERRLIRAMVRRIELQAAAEPGPLSIDLEREVRRLMGKVGRLIACGHPDGLRFKARLRTLLVRVPVLERYADTLPINEIEALTSNSDVQDGGIFIPPWEIETPTTDRV

SEQ ID NO: 3811 - protein, 375 aa, Pseudomonas sp.
  source 1..375: note = Related to NZ_KZ987399.1; note = Pseudomonas putida
MDAPLYPHRPIYSLKALSLALAEPEALLVAIAKRSSNLYRYVPQKKRDGSRRDTFDAYEPLKAIQRKIVDRILTKVKYPAYLHGGIRDAVQPRSIYSNARSHAGSKSIILQDIKNFFPSITTAHVEEIFSGLFGFSNEVSSLLAALTTRAGQVPQGASTSSYLANLVFWDVEPTLVKQLSSEGLAYSRFADDITVSSKSEIPPIAKSRVISAVTWMLSQKGCQQKRSKLHIRRRGQSLIQVNEPGAVTVTGLTVDKVKPGIPKDERRLIRAMVKRIEIQAAAEPGPLSIDLERECRKLMGKVGRLIACGHPDGLRFKARLRALLVRLPVLERYTEASPDHENGVVVRGTADQYSSEYGDVIIPSWDIDVPSAHGV

SEQ ID NO: 3812 - protein, 349 aa, Pseudomonas sp.
  source 1..349: note = Related to BMDE01000009.1; note = Pseudomonas fluvialis
MDAPRYPCKSIHSLKALSLALGEPVELLLSLAKRSSNLYRHVPQTKKDGSVRHTYDAHEPLKKVQRKIVDKFLARVRYPDYLHGGIKDPNSRRSIYSNARIHGKAKTILLQDIKDFFPSIGVQHVQQIFSGLFGFSDEVAQVLALLTTRHGVVPQGASTSGYLANLVFWDTEPALVARLHARGLKYSRFADDITISAMTTLERSALTGLVAAVTDMLAKKGCQQKRTKLHIRKRGQSLLAKPKVEAGYEPLTVTGLSVFNEAPGLPKAERKAIRAAVKQAEDQASQGASWAQLEPTFRSVMGRVGRLIACGHPDGERYKLRLKALKTRCQVPLLDRYAAAATGADVPVV

SEQ ID NO: 3813 - protein, 328 aa, unidentified
  source 1..328: note = Related to PARA01000024.1; note = Pseudomonadales bacterium
MDAPRYPYKPIYSLKALSLALGEPVELLKSLAKRSSSLYRHVPQTKKDGSVRDTYDAHQPLKAIQRKIVDKFLARVRYPDYLHGGIKDPSSPRSIYSNALTHGKAKTILLQDIKDFFPSIRVQHVEHIFTGLFGFSEEVAQLLALLTTRNGVIPQGASTSGYLANLVFWDIEPTLVSRLNLRGLKYSRFADDITISAMMPLDGLVLTELVGAVTVMLAKKGCQQKRSKLHVRKRGQTIQAKAGFEALTITGLSVFNAAPSLTKAERKAIRAAVKQVEDQATQGGSWGQLEPTFRSVMGRVGRLIACGHPDGERYKQRLKSVQEHCYKK

SEQ ID NO: 3814 - protein, 348 aa, Pseudomonas sp.
  source 1..348: note = Related to NZ_MUJK01000005.1; note = Pseudomonas laurylsulfativorans
MDAPLYPFKPIYSLKALSLTLGEPAELLESLAKRSSNLYRHVPQTKKDGTPRDTYDAYEPLKAIQRKIVDRLLARVRFPGYLHGGIKDPVKRRSIYSNAHIHGRAQCVVLQDIKDFFPSIKTQHVQQLFVGLFGFSETVAGILALLTTRHGVVPQGASSSGYIANLVFWDIEPALVAKLNTQGLNYSRFADDITITSTKPLDSSALTSIVSAVTNMLAQKGCYQKRSKLHIRKRGQTVLSKNGFEPLTVTGLTIFNAVPGIPKAERKAIRSAVKQLEDQATQGMTWSELEPLVRRVMGRVGRLIACAHPEGDRLKQRLHALKARSQVALLDRYAAALQDATVTGQIPG

SEQ ID NO: 3815 - protein, 300 aa, Pseudomonas sp.
  source 1..300: note = Related to FOAR01000004.1; note = Pseudomonas agarici
MIGLISFWGQEMDAPLYPFKPIYSLKALSLTLGESVELLESLAMCSSNLYRYVPQEKKDGTPRDTYDAFQPLKSIQRKIVDRLLARVRFPAYLHGGIKDPVNRRSIYSNAKVHGNAKFVLLQDIKDFFPSIKVQHVQQIFERLFGFSEEVSKLLALLTTRNGVVPQGASSSGYLANLVFWDVEPMLVARLEAQGLNYSRFADDITISSLTPLNSVMLTKLVSAVTGMLAEKGCYQKRSKLHVRRRGQTLKMKVIDEFVPLTVTGLTIFNQIPGIPKAERKAIRAAVKQLEDQATQGRTWT

SEQ ID NO: 3816 - protein, 342 aa, Pseudomonas sp.
  source 1..342: note = Related to WIGH01000001.1; note = Pseudomonas stutzeri
MNSALLYLDKHKMDFPSYPCSPIYSLNALSRLLGEPLDVLTRIALKSDSLYRHVPQRKKDGTPRPTYDAHEPLKKIQKKIASRILNRIIYPQYLHGGVKDLKSPRSIYTNCAPHLGKNLIILMDIENFYPSISREHVFSIFNKCLGFSSDVSLLLSTLLTRNNQVPQGACTSSHLANLVFWDLESTTFSYLEENEFTYTRFADDITISTDANKDKKQTGEAVSKVIAMLARKGCRLKRTKFHIRRRGQAIVKDEKLTPITVTGLSPFNKHTLAITQRERNKIRSSVKKIEIRAHAGESWKDLAPSYNRAMGRVGRLISCRHPEGDRLKRRLQMLKTYFEAAV

SEQ ID NO: 3817 - protein, 327 aa, unidentified
  source 1..327: note = Related to nan
MELPKYPNAPIYSINSLSRMLSEPPSALQKLSAKADTLYRSVPQKKKDGSPRETFDAYEPLKSIQKKIALRLLNKTKYPSYLHGGVRDPSSPRSIYSNSRPHLGSCHIILLDIKDFYPSITKSHVTNIFQNFFGFSSDVSDTLSRLLTKDGRVPQGACTSSHLANLIFWDVEPQLVHDLQANGFNYTRFADDITISSASNRDNKTTGEVVSKVISMLKSKNCHLKRSKFHIRSRGQSITGKDGEKFPLTITGLSIYNKSKPSISQHDRNNIRSSVKEIEVKTHEGATWSEIAPLYNRAMGRVGRLISCGHPEGTRLKNRLRMVKNCF

SEQ ID NO: 3818 - protein, 356 aa, Pseudomonas sp.
  source 1..356: note = Related to NZ_CP089067.2; note = Pseudomonas aeruginosa
MDAPYYPCKPIYSLRALSLFLGEPAETLLRLSKNADHMYRLVPQKKKDGSLRETFDAYESLKRVQKKLVSRMFGRVRFPAYLHGGIRDFNSPRSIFSNAGVHAGAKTVVLQDIEDFFPSIRFEYVYSIYQGFFGFEHSVAEVLARLTTKHGCVPQGACTSSYIANLVFWDVEPIVYRALAEKGVRYTRFADDMTISSAIELSNDDIGDVISRIVSMLRSKGCRQKRSKLNVRRRGQGLKKAEGFESLTVTGLTVSNFHGVGITQKERNKIRSSVKEIEIKAHMDMPWSDLEVLYQRAMGRVGRLLACKHPEGERLKNRLNTVKSFYDVSNVRETKVVMGDKFVVLDASGDVPPWVG

SEQ ID NO: 3819 - protein, 343 aa, unidentified
  source 1..343: note = Related to NC_007963.1; note = Chromohalobacter salexigens
MEHTYYPHHPINSLKALNRALGIDEDEIFHALSNISYKEVPIKKKDGAIRVTYDATSALKVVQKKVTSNIFHRVNFPHYIHGCIRDTKTPRNIYTNAYPHAGCKQVILCDIKDFFPSIKAKTVFFIFRHCLGFSPNVSQRLTDLCTYNGTLPQGASTSSYIANLAFWDVEPLLVKKLESLGLTYTRFADDITISAKKSISKSLKTQVLHEVRRTIRKRGCSLKKNKTIVLKRSQVIIGKDKETQETTRNPITVTSLSIHHSSVTISKVERRKVRAFVDKLSKTEFNRVSYHEWCRRYSSAMGRVSRLISCGHKEGEPLKQRLKALKDEHKKFHQRSSNVSGRK

SEQ ID NO: 3820 - protein, 343 aa, unidentified
  source 1..343: note = Related to NZ_CP022134.1; note = Halomonas sp.
MDKIQYPHSPINSLKALHRALRVDESVMSNALQNINYKEVPLKKKDGTTRITYDAAPALKAVQKKITSQIFHKITFPYYIHGCIRDANNPRSIYTNASPHAGKKNIILCDIKDFFPSIKEKTVFFIFRECLSFSPEVSQKLTELCTYNGTLPQGASTSSYIANLAFWDIEPLLVEKLSSFGFTYTRFADDITMSTDKPISTTLKTQALHEVRRAIRKRNCSLKKRKTMVLKRGQVIKGIDEKKQKPTDSPITVTSLSIHHKNLAISKQERRKVRACVYNLEKTNMEEISYQEWCRRYSSAMGKVSRIITCGHKEGEPLKQRLKKLKDVHKRHHLRSSKVSGRK

SEQ ID NO: 3821 - protein, 320 aa, unidentified
  source 1..320: note = Related to JAHCLU010000015.1; note = Halomonas sp.
MRSRCELTSTYPHNAIIDPEHLALLLNTPPEKLKDIANVASGSYRPVPQMKKDGTPRMTYDAYPELKRIQHQIVKKILRKVRFPRYLHGGIRDTDFPRDHVSNAALHTGATILVLDDIADFYPSLDRQLVFTTWLRFFGFSPEVSELLTNLTTRHGVVPQGARTSSYLANLAFWDKEAQLVEDLGNIGLTYSRFVDDVTYSSHRQILNSTIGNARAKVYRMLASKGCRPKRSKSHVCRKGQKLEVTGLVTAGSSPTIDKDERKRIRSAVHNLEKAVGKEGMTPENRKKWDSAKGRVGRLVRLKHPESRKLSQRLDAIRQG

SEQ ID NO: 3822 - protein, 318 aa, unidentified
  source 1..318: note = Related to JACCDF010000013.1; note = Halomonas salicampi
MRSICKLTPTYPHNAIIDPQHLALLLNTPLESLKATAKIASGSYRPVPQTKRDGSPRMTYDAYPELKRIQHQIVKKILRKVRFPRYLQGGIRDTEFPRDHVSNAALHTGASILVLDDIADFYPSLESQLVFTIWLRFFGFSPDVSELLTKLTTRHCVVPQGARTSSYLANLAFWDKEAKLVEDLGNMGLTYSRFVDDVSYSSHHQVSNSTIGEARAKVYRMLASKGCRPKRSKSQVCRKGQKLKVTGLVAAGNYPAVGKAERKRIRSAVHNLEKAVGRDGMTPENLKAWNSAKGRVGMLFRLEHLEARSLSQRLDTLL

SEQ ID NO: 3823 - protein, 330 aa, unidentified
  source 1..330: note = Related to VOGA01000005.1; note = Halomonas sp.
MFVSSELTPFYPHNPIVDPEHLARLLNTPLPKLEAIAESASSSYRPVPQKKKDGSPRMTYDAYPALKRVQHQIVQKTLHKVRFPRYLHGGIKDTEFPRDHVSNAALHTGAAILILDDIADFYPSLDRKLVFSVWLRFFRFSPEVAALLTKLTTRKGSIPQGAKTSSYLANLAFWDREAQLVEDLKAMGLTYSRFVDDVTYSSRCRIPDSAVGEARAKVYRMLTSKGCRPKRSKSQVSRKGRKLEVTGLITAGRSPAISKDERNRIRSAVRHLEKAVNEEGMTPENRKAWDSAKGRVGRLVRLKHAEGRRLSQRLDALLQAAPLAHRVDNQ

SEQ ID NO: 3824 - protein, 321 aa, unidentified
  source 1..321: note = Related to NC_020888.1; note = Thalassolituus oleivorans
MKATPPLYLHASIGSINSLSLLLGVSPDSLKSIGDAAQKMYREVPQKKKDGSLRMTYDAHPSLKKIQDKISKLILKKVVYPDYLQGGLPKKDQVSNAAKHSKAIILIQDDIEDFYPSLSDTTVRGVWQQFFKFSPEVAKLLTSLTTLNGKVPQGAKTSSYLANLAFWDCEHLLVQKLLDKDLTYTRFADDIIVSTRAIISNSEIAVVRASIYNMLALKSCKPKRSKSRVCRKGTRLSVTGLNTSLKSPMVNKQERRKIRALLHNLEVSVSLNGYTAENVAAWESIRGKVVRLKRLRHKEALGFDERLHLLKSRLFSSSSVL

SEQ ID NO: 3825 - protein, 332 aa, unidentified
  source 1..332: note = Related to RCHN01000010.1; note = Ketobacter sp.
MLRDRYLIIKIPSIANTSSLASLLEITEKELFYIADNVHEFYKPGKIMRKKNGDPRPTHDAKPVLKQIHARIKNRILKQVVYPYYMLGGISDLESPRSCKTHAQIHSGKKILISEDIANFYPNTSYEVVKKIWKYHFKFGDEVSELLTKLTTFNGELPQGWKASGYIANLALIDKEPELVRILEEKGLSYSRFIDDITVSSPFYLTSNDKQFIISNIYAMLFSCGYKPKRIKHEIVSREMPMSVTSLNVNTKKPTIPSKERKIIRALVYQLECAYPDDGRSIRFYKLWLSVYGKVNRVKSFHAEEGSKLQIRMRQIKPPKHFFSNKKLLSTS

SEQ ID NO: 3826 - protein, 320 aa, unidentified
  source 1..320: note = Related to DACUBM010000007.1; note = Legionella pneumophila
MPRNRYPQPSIPPIANITSLASLLSVNVTDLLYIADNINLFYKPGKILQKKNGEHRYTHDAKRTLKLIHQHIKNRILKKIEYPYFMLGGISDPQNPRSCKAHAQIHCNKKILINEDILDFYPTTSYELVKRVWKHQFNFSDTVAEILTKITTYSGQLPQGWKTSSYIANLALLPIEAHLVELLENKGYSYSRFIDDITVSSPTFISPQEKKSIISNIYGMLFKCGYKPKRTKHEIVSNKEKMIVTSLNVNTETPTLSKQERNNIRAMVYQLEKLFSIQGNTQAYIQKWHSLYGKVNRLKSFHKKNGEQLQERMKLIKPLK

SEQ ID NO: 3827 - protein, 320 aa, unidentified
  source 1..320: note = Related to NZ_LEAU01000005.1; note = Legionella pneumophila
MRKIRYPIANIQPIAKISSLARLLSVREADLLNIIDNIESFHRPGKLLKKKNGDPRPTHDAKSELKIIHARINNRILKKVQFPYYLQGGIADKSYPRSCKEHAQTHSGMKIIICEDIADFYPSTSYITVLKIWKHFFNFSNEVAEILTRLTTYQGALPQGWKTSSYIANLTFWHCEPELVKIIEEKGLSYSRYIDDITVGSRLHISNNGKEFVISSVYGMLFSNGYKPKREKQEIVSSEKPMIVTSLNVNSQKPTIPKKFRNNVRAMVYQLEKSFISIGNSIEYDKKWRSVNGSVCRVKSFHLSEGAKLQERMRQIKPIK

SEQ ID NO: 3828 - protein, 321 aa, unidentified
  source 1..321: note = Related to LVCQ01000131.1; note = Piscirickettsiaceae bacterium NZ-RLO1
MSIKIYTPEPKIQYISKISSLARILSVNSNDLLNISNNTQKFYKQGKLISKKNGEKRVTHDAKPNLKNIHEIIKNRLLKTVNYPFYLHGGIADPSIKRSCLSHAKTHINSHIIFQEDIANFFPNTDKNTIKKTWKYLFNFSDEIAEILSNLTTHENMLPQGWKTSGYLANLVFWEKEAQLVSNLEKKNLSYSRFIDDIVVSSPCRINNNNKNFIISSIYNMLYHYGYEPKRSKHKISTRKDPMSITGLNINPKFKSLTISKSERNEARLAVYNLEKNYNRIEKEDYIRLWNSASGIIARISLFHKKEAKTLREKINKVKLL

SEQ ID NO: 3829 - protein, 322 aa, unidentified
  source 1..322: note = Related to JADGCO010000009.1; note = Magnetococcales bacterium
MSTNNFPIINIPSFSNPASLASLLSVSEQDLFRITSSVDNLYKPGKILQKKNGELRRTHDAKKPLKDLHEIIKNRILKKVVYPYYLLGGIADPFKPRNCTNNALIHSGKKILIAEDIENFFPSSSSDIVFNIWKLCFKFSPKIADILTKLTTYQNQLPQGWKTSGYLANLVFWDNEPDLVRDFEKRGYSYSRFIDDIAISSNQFINDNQKSYIISRIYSMLRLKGYKPKRTKHEIQTQIKSMHLTGLGINRKRPTVPRNRRNNVRLLVYNLEKRHRHEGDTHQYREDWISVSGKVGHIRSFHNNEWEKLKFRLNKIKPNDKV

SEQ ID NO: 3830 - protein, 320 aa, unidentified
  source 1..320: note = Related to VXTZ01000022.1; note = Candidatus Dadabacteria bacterium
MPRDRHPVINISPIAKVSSLASLLSIKESDLLYIAANVDRFHRPGKELKKRNGEPRQTHDAEQRLKIIHGRINNRILKKVDYPYYLQGGIADKKRSRGCRANAIIHSRKKLIITEDIKDFFPCTSKRIVKGIWQYCFRFHPEIADILTRLTIYQNQLPQGWKTSSYLANLVFWDKEPDLVSLLEQRGYSYSRYMDDITVSSGHYINNHQKNYIISKVYEMLFSKGFAPKRSKHEIVSQSQRMDITGLVVNRKNPTVLKSKRRGVRVGVFKLEELPINNRSDADYRECWEHLSGLVSYISAYHPKEGKKLRARLRNIKPNR

SEQ ID NO: 3831 - protein, 335 aa, unidentified
  source 1..335: note = Related to NC_019902.2; note = Thioalkalivibrio nitratireducens
MAPESNKTCSKVGPIAHVKALASILSTTPSELIALSENVPSLWKPGKVLRKKDGTPRPTHDARKALKVVHERIKNRLLRQVDYPGYLLGGISDKLTTRDYSRHAALHAKKKILISEDIQDFFPSTTAEVVQEIWQRLFNFHPDVAELLTRLTIYEGALPQGWKTSGYLANLALWRREPDFVARLHRQGLAYSRFMDDVTVSAPYPLSKTQLTNIISGIYGMLASGEFAPKRAKHKIATGRSRMEVTGLNVNAAKPSMPKKRRDQIRAQVYQCEQGYKRDPRSPEYLTQWRNASGKVGTMKRFNPGEAKSLRTRPALYPQVAQTSRYGAVSFDFIS

SEQ ID NO: 3832 - protein, 332 aa, unidentified
  source 1..332: note = Related to JAICBS010000011.1; note = Candidatus Thiodiazotropha sp. (ex. Lucinisca nassula)
MALENNKACSKVGSIARIEALASVLSTTPAELLELSENIHSLWKPGKILRKKDGKPRHTHDARKPLKVIHERIKNRLLKQVDYPHYILGGISDKQTTRDYSRHAALHSKKKILISEDIRDFFPSTTSDVVLNIWLRFFNFHPEVAALLTKLTTHEGVLPQGWKTSGYLANLALWDREPDFVTQLHRQGLVYSRFMDDVTVSAPYPISKTQVTNIISGIYGMLASRDYKPKRSKHKISTGRHRMEVTGLNVNATRPSMPKLRRNQIRAQVFQCEQLFKQNARSPEYLAQWRNASGNVGTMKRFNPSEAKGLRARLTAVKPCAPRRDCTRGFPC

SEQ ID NO: 3833 - protein, 321 aa, unidentified
  source 1..321: note = Candidatus Thiosymbion oneisti; note = Related to NZ_SMSC01000017.1
MEHQDRKAYSKVGPIGCIDALASMLSISAKDLLTVSKSVESFWIPGKTLRKKSGEPRLTSNAKEPLKGLHEKIKNRLLKRVCYPYYLLGGISDSMMPRDYKCHAAIHSGKNILISEDIKDFFSSTKTDVVHSIWQCLFHTSPDVASVLTSLTTYNDCLPQGWKTSGYLANLAFWDLEPDLVERLEKRGFSYSRFIDDITVSSRCRIGASKKSFVISEIYRMLSLRGYSPKRAKHRIATNDNRMGVTGLNVNKNTSSMPKEKRKIIRAMVHRCENHYMQDRTSEGYRKSWERTSGKVSTLTRFHETEGNKLRKRLQTVKPIR

SEQ ID NO: 3834 - protein, 341 aa, unidentified
  source 1..341: note = Related to PJBX01000118.1; note = Psychrobacter sp.
MGFHPLPQVTPIANISSLANLLEITVEDLEYVLANKDRYWCPGKKLTKPNGEVRHTHNAKPRLKAIHQKILDKLLKKVFYPIYMQGGVADLLNPRSCRTHAAFHCNKSIVISEDIKSFFPNCDYKNIRSIWQGFFCMAPEIAEILTQLTTYQNELPQGWKTSGYLAQLIFYDIEPKLVEELDRQQVAYSRYIDDITISSSRLLTDRQKTDIISKIYSMVFHKAHHPNRKKQTIFSPSVNGVGKTVTGLTVNSKKPTINNDKRKKLRSDIHKLSLRFHTDKNLYSYDKDWRSITSKVGHIKTSHPRQWKKFRQEMNAIKPTFKRKKKTNTKKAVFKGTIDGK

SEQ ID NO: 3835 - protein, 321 aa, unidentified
  source 1..321: note = Related to BQJL01000324.1; note = marine bacterium B5-7
MSSKDLAPRVGSISNIARVSSLARILGTTDDRLLYIAGNIDKYWKPGKKLPKSDGSIRITNDANDVLKNIHERINRNLLKPCFYPRYLNGSLPGRSIRKNAEFHLRSMVLVNEDIENFYPSARFRQIKGIWKYFFKCSDEVAVILTKLTTYKGSLPQGWKPSSYLANLLFWDTEYILVEKLQAAGFSYSRLMDDITVSSRKPYTPEKLSVLISDLNLFLHSKEFKLKRSKHSIKPSYTRQTVNNQIVNGSKVTVPRERRKLIRALVHSLEIDYSYGAVFSDKYKTKWKSASQRVGGLKHGHLSERNSLRQRLQNIKPRIRF

SEQ ID NO: 3836 - protein, 302 aa, unidentified
  source 1..302: note = Woeseiaceae bacterium; note = Related to JABDOQ010000026.1
MAKHLGLPTEHLIEIAQNSASHWRQGPDLVKPDGSIRKTNSATQQLKDVHTRVKFKILRKTFYPDYLYGSLPKTLEQGVRNHIANAELHAGQRLIISADIKGYFPSVDPVVVHGIWQGFYPFAHDVAEVLTKLSTYKNEMPQGWGPSSYLAQLVFYDTEHDVVEYLQSQGFQYSRLTDDITLSTNRSLKKSEITDAIRTLNRMLNRKGTNINRSKTRVDSPKRQQSVNKINVSVRGMTLSQKYRKAVRAKVHNVVTNPELFGDKLHRELQSAKGKISYLGKFHEADAKKLKSRIRNFELSTK

SEQ ID NO: 3837 - protein, 324 aa, unidentified
  source 1..324: note = Related to JAEUQA010000033.1; note = Chromatiales bacterium
MRLSQLSPRYARRRIQRVESLAKLLGTSPTDLAALAANSAHYWIPGRTKTKSDGTKRHTSNALEPLKSIHKAIKNKILRATSYPHYLMGGLPSDEEAGCIRHCEENAKRHSGQRIVVTEDIKSFYPSITASRIHDIWQGFYRFSPEVAELLTKLTTYRGVVPQGWVPSSYLANLALWDCEPGLVAHLERQGLTYTRWIDDITISSKTFVAPACKTAIVTAVYGMLRSANFSPARTKHRIRTRGQNQRVMNLNVSGKRPTVPRQRLAELRATVRNLLRDAGSLSAADYTSKRDRIEGQIGSISRMHPRLAERLRNQLASVRRPAN

SEQ ID NO: 3838 - protein, 307 aa, unidentified
  source 1..307: note = Related to NZ_AP018005.1; note = Candidatus Rickettsiella viridis
MSIVLSSFYPYKPISRLDSLAKVLSVDVSALEKIASLASSYYRENKLKNNRITYTVLSPLKEIQEKIKKNLLDKVVWAYYLHSYIKKRNTKTNATAHLFKKALFNKDIKKYFDNCKEKHIYNVWSKFFNFTDNVASILTKLTIRNGELPQGSCTSPSLSNLIFWKDEPRLVSEFNKIGLAYTRYADDISVSSKNKKLDKVYIIGKIYGMFSKNGFKPAREKHKIYNSSEKMVVNGQTVNSKNVTLDKKYILKVRSYIYKLEKRINTLTKSEFDIDYQSILGKINYIKQYNKKGLGLESRLNKLLDIF

SEQ ID NO: 3839 - protein, 319 aa, Proteus sp.
  source 1..319: note = Related to NZ_QEXA01000001.1; note = Proteus faecis
MKPHYLNKPISSISSLAKCLQTTVDELQNLSTNADKYFFLANRVQKEDGSYRDTYDVRQRLKIIHDKITKNILKKVYYPDYLQGSLAKKDHISNAEIHSGKKVIIKGDISNFFPSISKDIIYQIWIEFFNFSKEVAELLSRLTTFNGKMVQGCKTSSYLANLVLWSREYKFVNLLKSQGFTYTRYVDDVHVSSERIMHKSEKTKIISRIYNLFASINVRPNRKKQEIMPRNQQQIVHKLNVDKSTPNMPKQKRNEIRKLVFICGKAFEDNNITLSEYTKNYNTVMGKVNYLRRLHPKCGNLLLSNLRSISPLKRMKIIS

SEQ ID NO: 3840 - protein, 316 aa, unidentified
  source 1..316: note = Related to WLTV01000024.1; note = Providencia stuartii
MKPRYLNKPISSIFSLAKSLQTTVEELQYLSANADKYFFLASKVQKDDGSYREIYDVSQKLKNIHDKITKNILKKVYYPDYLQGSLSKKDHISNAEIHTRKKVIVKGDISNFFPSIGKNIVYQVWVVFFNFSKEVAELLSNLITFNGRMVQGCKTSSYLANLVLWSRESKLVESLKLQGFTYTRYVDDVHVSAKRIMSKSEKTRIIKGIYNLFASINVRPNRKKQEIMPRNLQQTIHKLNVNKSMPSMPKQKRNDIRQLVFLCGKAFGDNRLAINEYTKMYNSVMGNVNYLRRIHPEEGGRLLSKLKSITPSNRFI

SEQ ID NO: 3841 - protein, 318 aa, unidentified
  source 1..318: note = Related to CP076623.1; note = Morganella morganii
MIVYPYKPISSLKSLSIVLCISEQELHYIYMNSDSYYFLTKDIIKNDGSHRLTYDVKSKLKTIHDKITKLILKKVNYPDYLQGSLSGKDFISNAKNHSKKRIIISEDITNFFPSISKEIIYQTFSKLFNFSPIVCDILSKLVTYKGYLVQGCKTSSYLCNLVLWNREKALVDNFKKKGFTYTRYVDDIHISSNSFINNDEKEYIIKKVYNLMRSINVKPNRKKHKIMTNDNSQSVHGVIVNKKAAFSKEYRNEIRGLVFNCQKKFKLSINEKEYTKFYQSVLGKVNLLKRLNENEAKKHLNTLSKIKPIHFKEKEKHD

SEQ ID NO: 3842 - protein, 314 aa, unidentified
  source 1..314: note = Related to NZ_RCWD01000007.1; note = Photorhabdus hainanensis
MMKFSYQNKPISSIDSLAKALSISVDELFYLYNNSDKFYYVAKIEPKPDGSFRKTYDVKTRLKKIHEKINTNILKCVKYPDYLQGSLKERDFLSDANKHTNKKIIIKEDVSNFFPSISKKIVYQVWAIFFNFTHEVSEMLSELITYKGFVVQGCKTSSYICNLILWNREEKLVNEFKKRGFIYTRYVDDIHVSSCNIIKKENKRYIINNIYKLMYSVGVRPNREKHSVMPKSDVQTVHNVNVDKAIPSFPKQKRNKIRLGVYNCEKLYDIEKHTEKYRKLYFRVLGQINMMKRLHEKEAHKLIQRLRKIRPENI

SEQ ID NO: 3843 - protein, 314 aa, unidentified
  source 1..314: note = Related to NZ_LZGX01000010.1; note = Gilliamella apicola
MIPKYLFKPVADLDLLAKILGITKQELDDLYHSSDSFFFLHERKQKSDGSYRDTYNVKKRLKIIHGKISKEFLKKVNYPDYLQGSLKDKDFLTNAKNHLGQKILITEDITNFFPSISKKIVFEVWVGFFKFSKEVSEYLAELITFEGYLVQGGKTSSYICNLIFWSRESELVDYLAKKGYKYTRYVDDITVSANKIITLKEKTDIIRRIYSLLKSVGAKPNRIKHQIMPRNKRQIIHNLNVNQNKPSMTKKKKNMIKAAVFECEKKFQTDPNSKEYLKLFNKTMGRVNHMKRIHPKIGDVLQKKLKLIKPQDKF

SEQ ID NO: 3844 - protein, 321 aa, unidentified
  source 1..321: note = Related to nan
MSEHSSFRYPYKPIASLEKLAICLNITLEELNYLQENADSFYFLTTREQKKDGSFRECYDVKKRLKDIHEKISIKFLKLIEYPEYLQGGIKKRDYISNASQHTCSFDLIEEDISNFYPSISREIIYQVWVGFFCFSHEVADCLSKLVTFQGYLVQGSKVSGLLCNLILWNRETKLVMNLKRQGLTYTRYVDDVTVSCDRYLSNKEKQQIIRKIYALFYTVGAKPNRRKHKIERKGTRQTVNNLNVTSENPTLPKEQRNKIRAAVFECEKIFRIGNSSLIQYKELFESTKGRVNQLKRFHKKQANSLLKRLEEIHPNKFKAT

SEQ ID NO: 3845 - protein, 321 aa, unidentified
  source 1..321: note = Related to RBKF01000628.1; note = Neisseria sp.
MNDCTSFNYPGKPIASLEKLALLLGISLEDLIYLQKNADSFYFLVKREEKKNGCFRECYDVRERLKNIHEKNFVRLLKVISYPEYLQGGIKKRDYISNANQHTRSHTIINEDISNFYPSISRKIIYQVWVGFFHFSPEVADCLSQLVTFQGKLVQGSKVSGLLCNLILWNREDKLVMSLKSRGLTYTRYVDDITVSSNRYLSNREKQQIIREIYTLFYTVGAKPNRSKHKIAYKGTKQTVNNLNVTSEKPTLPKEKRNEIRAAVFECEKKFQEGSSSIVEYKKIFESTKGRVNQLKRFHKKQANDLLQRLEKIHPNSFKAA

SEQ ID NO: 3846 - protein, 320 aa, unidentified
  source 1..320: note = Related to CP060414.1; note = Neisseria musculi
MNKPVSFCYPHKPIASLEKLAIYLGITLEELLYLRQYSNSFYFLHERKEKADGTFRDTYNVRDRLKNVHEKIAKKFFTILDYPEYLQGGICKRSSITNAKQHIGMNILIKEDISNFFPSISKKIVHQVWTGFFHFSHDVADCLAELVTYQGYLVQGSKVSGFLCNLIWWQREADLVAEFQKQGLVYTRFVDDVTVSTKRNLSNAEKKKIISKIYSLFHSVDAKANRKKQKIMHKGHQQTVNNMNVSIGKPTLPKEKRKEIRTIVFKCELTFQNKEIHITAYEKLFNSAKGKVFYLKQFHTVQAEQLLQRLNKIQPKFFNS

SEQ ID NO: 3847 - protein, 311 aa, unidentified
  source 1..311: note = Related to LR733345.1; note = Enhydrobacter sp.
MAEFAYPHRPIASLEKLAIVLDTTVAELDFLSQNANNFYFKVKSIQKADASYRDTYDVRDRLKTIHAKIVKNFLRIIDYPDYIQGGVPHRDYLSNTAMHTAKQVVISEDITNFFSSVSCTIIYQVWSRFFKFAPVVCECLTNLVTYQGFLVQGAKTSGYLCNLIFWNREQFLVDTLASQGFTYSRFVDDISISSPKVITSEHKTEVIAKTYGMLQSCGVKPNRKKHHIMSKGSSQKVHRVNVVSNKPTFDKKERNAIRAAVHECEMNFSKSKSSSEYEKLFNTTMGRVQKIKRLHIEEANKLLARLQKIKP

SEQ ID NO: 3848 - protein, 313 aa, unidentified
  source 1..313: note = Related to CP011374.1; note = Moraxella bovoculi
MDNNAFHYPYKPIANLKSLALSLDITLERLLFLQKNSDNFFFLQGRVKKEDGSFRETYDVKEELKKVHAKIVKNFFNVLKFPSYLHGGIKKRDYITNAKQHLQPKTIISEDIKNFFPSITKNLVYQIWSNFFKFSHEVAECLAEITTFKGSLVQGSKVSGYIGNLVLWQREPKLVEEFGKKGWIYTRFVDDITISSKRILSNKEKSEIISKVYGLLASINVKPNRKKHSIMKNGKDRQKVTQINVSTQRLTLSKKERNSIRSEVYFCEKFYKNYNKEEYKKLYNSIKGKVYNLRRFHQDEADKLLNKLNKIPP

SEQ ID NO: 3849 - protein, 316 aa, unidentified
  source 1..316: note = Related to CP063120.1; note = Haemophilus parainfluenzae
MSNPIYPHKPIGSLEVLANVLGIRDIDELLLIKKHSDNFFFVASVIKKRDGTLRNTYDIKHKLKSIHRKIKNVFLKKIYYPEYLQGSLAKRDYLTNANIHTNSKCIITEDIKNFFPSISKDIVVSIWKNIFHFPHDVSETLAELITYKGFLVQGSPVSSYIANLALWYKEPELVNTLSQKGFIYTRYVDDISVSSKRPITKKEKTRIIRQIHTMLSSIGVELNRKKHKIMPRNNRQEIHRVNVNTNAPTLPKKEREKIESAVYQCEIMYKSSPKSSEYKTLFNATQGRVNMLSRLHSPLATRLKCRLEKIKPIKNT

SEQ ID NO: 3850 - protein, 315 aa, unidentified
  source 1..315: note = Related to NZ_CP063124.1; note = Haemophilus parainfluenzae
MDILTKVLGLKDTNQLKELKENSDSFFFIAKKEKKRDGTIRITYDVKSELKLVHKKITRKLLKKVNYPDYLKGSLPKRDYLDNADAHTSSKCIITEDIKNFFPSIRKDIVISIWKNIFHFPHDVAETLAELITYKGCLVQGGTASSYIANLALWYKEPALVKELHDQGFRYTRYVDDISVSSKTIITPKEKTKIIRKIHIMLSSIGVKLNRKKHKIMPRNESQKIHRINVNTNNPTLPKNERRKIGSAVYQCEQMFNSSSNSQEYENLFNSTLGRVNMLSRLHDSLAAKLKCRLEKIKPIKKTTMSQASSLVPRS

SEQ ID NO: 3851 - protein, 312 aa, unidentified
  source 1..312: note = Related to CP097335.1; note = Mannheimia haemolytica
MNKPNYPYEPIGSISTLARVLGLETQKLQNLYDNSDDFFFVTKKKLKSDGSFRITYDVKAELKSVHRKIAKELFKKVFYPEYLQGGIARRDYIGNANIHIDSKCIITEDMKNFFPSISKEIVIDVWKNVFHFPPDVSEILAELITYKGYLVQGCVASGYICNLVLWNREAKLVVKLKNRGFIYSRYVDDISVSSKRIFTTKEKTEIIKDIHSMVTSIGVKLNRKKHEIMPRNNRQKIHRLNVNSYQASMPKSEREKIKAAVYQCEKLYITEPSSEKYKSLFNSTQGRVNSLSRLHKDHGDKLNLRLMKIKPY

SEQ ID NO: 3852 - protein, 313 aa, Pasteurella sp.
  source 1..313: note = Related to NZ_CP076656.1
MNSPTYPNSPIGSPAILARVLGIDPNILLSLKKNSNSFFFQAKTEEKSDGTLRITYDVKEPLKTIHRRIAERLLKKVTYPLYLQGSLPKRDYLGNAAIHTNSTCIISQDVKNFFPSISKNTVVQVWKNVFKFPEDISEILAELITYEGFLVQGCITSSYICNLVLWNRESKLVDELKEKGFTYTRYVDDITVSSKRIFTLEEKKEIIKSIHSMLKSISVKLNRRKHKIMPRNSQQQVHRVNVNSDRTTMPKSEREKIKAAVHQCEELYKTLAETEEYKKLFNQTLGRVVHLSRLHERQGKKLKQKLSKIYPRK

SEQ ID NO: 3853 - protein, 329 aa, unidentified
  source 1..329: note = Related to NZ_CP018028.1; note = Alteromonas mediterranea
MNKLSYPHAPIGELDKLAKALNIELSELQTITDKSDSLFFQTKEIIKNDGSSRFTYDARPTLKVIHGKVCEAFLKRVNYPDYLQGSIKRRDYLTDARKHAGSKVLISEDITNFFPSISKKVVHEMWVGVFGFSNVVAECLAELVTLNGFVVQGAKTSSYICNLVLWNREERLVNSLKTRGLIYTRYVDDVTVSSKRLISLNEKSKIINSIYSLFRSIGAKPNRNKHKIMPRNTQQEVHGVNVNKNQPTMPKEKRKKIRAAVHRCEITYKQTPDSIEYCALFNSVMGKVNTLGRMHTSEADKLRLRLSQVKPVSAQSLNKPLVSNTGLIT

SEQ ID NO: 3854 - protein, 314 aa, unidentified
  source 1..314: note = Related to NZ_AULT01000052.1; note = Oceanospirillum beijerinckii
MRKPNYPHAPIGDLDKLALALHVSKKGLQTVTAQSNDLFFLTRKIKKEDGSYRLTYDAKPSLKSLHGKICEAFLKRVEYPDYLQGSIRKRDYLTDARSHVGSKVLISEDITNFFPSISKKTVHEMWVGVFGFSNIVAECLAELVTMNGDVVQGAKTSSYICNLVLWNREAQLVSQLRKKGLVYTRYVDDITVSSRRSLSKSEKSRIISSIYSMFRSIGAKPNRRKHKIMPRNTQQDVHGVNVNKDRPTMPMEKRNQIRAAVHRCEIAFNGRPSSSEYVSLFNSVMGKVNTMGRMHRSEAGKLKARLLQVKPVIT

SEQ ID NO: 3855 - protein, 314 aa, unidentified
  source 1..314: note = Related to NZ_WBOM01000002.1; note = Nitrincola alkalilacustris
MNQPRYPFAPIGDLEKLSLALGVKLLELYDLKARSNELFFQTRDIVKPDGSHRITYDVRAPLKLVHGKICEVFLRRVEYPEYLQGSIKKRDYLTDANKHVRSKVLISEDITNFFPCISKKVIHEVWVGVFGFSNEVSDFLAELVTLDGFVVQGSKTSSYLCNLVLWSREAQLVKRLKMKGLVYTRYVDDITVSSKRILNNKEKSDIINSIYAMFRSVGAKPNRRKHKIMPRSAQQEVHGVNVNRQQATMPKYKRNQIRAAVHECEIIFDSDSSSETYISTFNSAMGRVNTLGRMHKVEAEKLKVRLEAVKPILV

SEQ ID NO: 3856 - protein, 314 aa, Vibrio parahaemolyticus
  source 1..314: note = Related to CP006005.1
MNLPVYPHASVANLSSLALALGLSLKELHELASTSDDYYFLTRKIEKPDGSLRLTYDAQPILKAIHGKISEVFLKRVDYPRFLQGSIKKRDYISDAKQHVSSKMLISEDITNFFPSISKKVVHEVWVGVFGFSNEVADLLAELVTYQGYVVQGSKTSSYICNLVLWKREAELVSKLEAKGFTYTRYVDDVTVSTKRIVSKAEKSEIINSIYSLFRSVGAKPNRKKHKVMPRNNRQEVHGVNVNKTAPTMPKKARDQIRAAVHQCELAFGDDPTTSEYQSAYSSAMGRVNTMGRMHEKEARDLRARLAAVKPVTN

SEQ ID NO: 3857 - protein, 314 aa, unidentified
  source 1..314: note = Related to SGPH01000013.1; note = Pseudoalteromonas sp.
MTPKYPHDPIAHVDSLCLSLGVTQSKLKEIQRKSDTYFFVTKEIVKKDNTIRQTFDVKPELKRIHERICSAFLKKVEYPAYLQGSIKKRDYLSNCALHTGQKLVISEDVTNFFPSISSLVVHQMWVGVFKFSNEIATILTDLVCFNGWLVQGAKPSSFICNLILWNRESKLVEELNQRGLKYTRYVDDITVSSPTNLSKSSITEILSNIYGMLASVNAKPNRKKHQVMPNGKRQNVHRVNVNHSTPTLPKKERSKIKAAVYQCEKDFAIKVSKDEYELLYNQTLGRVNNLKRMHPKMGEELLARLRKIKPCNRS

SEQ ID NO: 3858 - protein, 312 aa, unidentified
  source 1..312: note = Related to NZ_CP023398.1; note = Pseudoalteromonas spongiae
MTPQYPHEPIANLNTLCLALGLTASKLKYLQTNSDSYFFITKEIVKPDQSIRQTFDVKPELKRIHERICSAFLRKVDYPNYLQGSIKKRDYLSNCALHTNKKLVISEDVTNFFPSISSKIVHEMWVGVFKFSNEIASILTDLVCFKGWLVQGAKPSSFICNLILWNREARLVLKLNSMGLTYTRYVDDITVSSSMNLSKSLITEILSDIYGMLGSVNAKPNRKKHKLMPNGSRQNVHRVNVNTDIPTLPKKERNKVKAAVHECSLKFKADNSSIEYKSLYNSTLGRVNNLARMHPKLGKELRTKLIRFKPII

SEQ ID NO: 3859 - protein, 333 aa, unidentified
  source 1..333: note = Related to NC_015572.1; note = Methylomonas methanica
MLIKPTYLHKPIGSIESLAKSLGLSKEDLIELASNSNEYFFIAKKVEKPDKSIRLTYDVKPRLKQIHEKICCNLLKKVNYPDYIQGGVRGKSYLSNCQNHTHKKIVIKEDVSNFFPSISKKIIHEVWAGFFHFPSDVSELLSELVTFNGYLVQGGKASGFLCNLVLYDRESKLVEEFSKKGFKYTRFVDDITISCLRNITKDEQTYIIRKTYGLLKSIEVNPNKRKHKIMSNGVQQQLHGVNLNTNKPTLPKAERKKIEAAVFQCEKAHSENSNSIQYIKQFNSAMGRVNTMKRMHPKAGQALLERLCKIKPQINSRTFEQKHRLEIFRNLVN

SEQ ID NO: 3860 - protein, 312 aa, unidentified
  source 1..312: note = Related to NZ_AXWP01000102.1; note = Psychromonas arctica
MIPLYPHKPIASLNSLAKALGTTSDTLSNLTANSDKYFYLTKVINKPDGSVRNTYDVKPELKKFHERINTFFLKQVKYPNFLHGSLKGKDYISNTKEHTNKKVVISTDVSNFFPSISKKTIHEVWVGVFNFSHTVADCLSELVTHKGFLVQGSKVSSYLANLVLWGRESKLVCFFNKKGYVYTRYVDDITISCDRNLTKIEIADITSQVYAMLKSIDVAPNRKKYAVMTNGNSQSVHRLNVNRSVPTMSKSERAKIKSAVFECESKAAENRGTHEYIKLYNQTMGRVNSMKRLHSDLGDKLISRLKCVKPTP

SEQ ID NO: 3861 - protein, 312 aa, Vibrio sp.
  source 1..312: note = Related to DACQHB010000005.1; note = Vibrio vulnificus
MKPTYPHQPVAKLDSLALALGLTHSELIELASVANSMYFVTRVIEKPDGSKRITHDVKARLKRVHERINSVFLKQVSYPSYLQGSLKGRDYLSNTKQHINKHIIISEDISNFYPSISNKVVHEVWVGCFGFSNEVASCLTALVTHNGHLVQGGKTSSYISNLVLWSRESKLVEELKRKGMTYTRYVDDVTVSSPRPLSKSEITNAISSVYGLFKTINVKPNRTKHEVMSKGKRQTVHRVNVSAGRPTFSKKERSKIKTAVFQCEQLFPKASTTQEYLSMYRSALGRVNTLARLHKKEADSLKERLKAIQPFM

SEQ ID NO: 3862 - protein, 318 aa, unidentified
  source 1..318: note = Related to MSCC01000004.1; note = Photobacterium aquimaris
MTLTPKYNFKTIGSINALARLLQIPLNRVIYLSNNASDFYRVARVEQKKTGGQRITYDAYKTLKVIHRKIQTQIFKKVIYPQYMHGSISGRSYITNIKNHTKSKIVICEDISNFFPTIKAEQVEKMFIRLFHYPKNVAKTLTNLVTLNGSVPQGGICSSYIANLVMWEKESILVARLAREELTYTRYVDDITVSAKSYMSKPKVSEVIALIYGMLRYYGLEPNKKKHEVLGNGTYQTVHRVGVNGRRPSFGHDEKQLIRSAVHNLHILFVDKQCTYENYLKVFSSVSSKVGKLKQLNEYQGKKYRTLLNTIKLSIKDN

SEQ ID NO: 3863 - protein, 321 aa, unidentified
  source 1..321: note = Related to JABSQS010000004.1; note = Moritella sp.
MTLTPKYTLSPIGSINALARLLQLPLNRVQYLAKNSSDLYRIARIEQKKSGGKRVTYDAYKELKSVHRKLQHQIFKKVIYPQFMQGSISGRSYITNVKLHTKSKLVICEDISNFFPTIQAEKVENMFMRLFHFPQDVAKTLTSLVTLNGSIPQGGICSSYIANLVMWEKESVLVLRLNNAKLTYTRYVDDITVSSKNYINKQEISDVIASIYGMLQHYGFKPNRSKHDVLGNGSHQTVHRVGVNGKRASFGKEEKKKVRSAVHNLINLFSDGQCSYEHYLKIFSSVSSRVGKIQQLNEYQGKKYRESLNAIKPSIKRFYHG

SEQ ID NO: 3864 - protein, 321 aa, unidentified
  source 1..321: note = Related to NZ_VKGK01000009.1; note = Shewanella hanedai
MTLTPEYKLKSIGSIDALAFLLDLPLNRVQYLANNASDLYRVARIEQKKSGGQRVTYDAYKVLKAIHRKLQHQIFKKVIYPQYMQGSISGRSYITNVRYHTKCKIVICEDISNFFPTIQAVQVEKMFMRLFRFPLEVAKTLTNLVTLNGSVPQGGICSSYIANLVMWEKESILVSRLLTVKLTYTRYVDDITVSSKSYMTKQEISEVIASIYGMLRYYGVEPNKSKHEVLGNGSHQAVHRVGVNGNRPSFGKEEKKKIRSAVHNLSTLFSDDKCTYEAYLREFSSVSSQVGKLQQLNEYQGKRYRGDLNTMKPSIKRFNLG

SEQ ID NO: 3865 - protein, 302 aa, Vibrio sp.
  source 1..302: note = Related to NZ_CP046798.1; note = Vibrio furnissii
MLQLPVPRIRYLAQNASDFYRVARIKTKANGDKRITYDAYRSLKDLHKTLKVRLFQNVSYPDYIQGAISGRSYIGNVKKHTKSTIIICEDITNFFPTIRESDVEKMFMRLFHFPKEVASILTGLVTLNGTVPQGGVCSSYVANLVMWERESALVSLLQAKNLTYTRYVDDITVSSKYYIEKVEIGNVIASIYGMLKHFGVKPNKAKHEVLSNGMHQKVHRVGVNGKRPSFGKEEKKRVRSAVYNLEALFKDNTCSYDEYLKAFNSASALVAKLKQLNEHQGQKYRESLNLLKPSAKRVELSN

SEQ ID NO: 3866 - protein, 325 aa, unidentified
  source 1..325: note = Related to JQED01000042.1; note = Colwellia psychrerythraea
MNQTPEYPHLSIGSINSLARLLRLPVNRVKYLATNSSDFFRVARIEEKKSGGQRITYDAFKCLKDVHRRLKVQIFQRVIYPSYLQGSLKGCSYITNVKNHTKSKIVICEDISNYFPSIKSPLIEKMFIRLFSFPEDVARILTQLVTLNGLLPQGGVCSSYIANLIMWEKEVLLVGSFEKRGLTYTRYVDDITVSSKAHLTKSEISEVISSIYGMMKHYGIKPNLKKHQVLGDGSHQKVHNVGVNGRRPSFGKEEKKRVRSAVHKLKLLFDSPDCTYEDYLAAFGRASSLVGKLKQLNEQQATKHRGELNKIKPSFRNASNSNLVE

SEQ ID NO: 3867 - protein, 325 aa, unidentified
  source 1..325: note = Related to SYUS01000035.1; note = Enterovibrio norvegicus
MTLIPRYTSLSLGSINALARLLQLPINRVSHLAENSSSYYRVAKITEKKNGDKRVTYDAFKVLKDVHRKLKNQLFNKVIYPDYLQGSLRGRSYLSNVKKHTKSKLLICEDITNFFPSISAAQVEKMFMRLFSFPKCVAEILTKLVTLNGCVPQGGVCSSYIANLVMWNKEAVLVEKLISDGLRYTRYVDDITVSSRRYVTKEKISKVIALIYGMLGHYGVKPNRAKHEVLGNGSHQTVHRVGVNGSQPSFGKDEKKRIRSAVHKLDTMFHDNNCSYADYLKAFGSVSSKVGKLKQLNEHQATKFRGQLNVIRPSVKRLKLDMDNS

SEQ ID NO: 3868 - protein, 319 aa, unidentified
  source 1..319: note = Related to WTCN01000233.1; note = Methyloprofundus sp.
MNSAFYNGKPIASIAALSSALNVPEDILIDMSHNANKYYKKNRPEIKSNGKERIHYSVSESLKAIHQRIKVILFQNVTYPEYLQGSIRDTKKTRDYISDARMHSGKRMLISEDVSDFFPSIKYDQVLKLWMYFFNFPKKIATTLTDLTTYKGFLPQGSKTSSYVANLIFWQYEPALYNKLKAQGITYSRYVDDTTLSFDRYVSDKELGQIISSIFGMMCQVNIKPNREKQDIKSRKNNTTVHNLNVTKKSPTIPKKKKNNLRMAVFNCIKHSDLHGRKSETYKKMYRSTITRVGQLGRLHPNQSQKLKDKLAPYKPFNS

SEQ ID NO: 3869 - protein, 312 aa, unidentified
  source 1..312: note = Related to NZ_JHYQ01000015.1; note = Thiothrix lacustris
MSAYYPHKPIASIESLAKTLDVTEAELLEVAQNSDSLFFVAKCVKKENGKVRVTYDARPALKNIHDRIKIALFRVVKYPFYLQGGISGRDYISNTKIHAGKKFLITEDVSNFFPSIQDSVVKKMWLYFFHFSPEVADVLTKLTTHNGFVPQGAKTSGYIANLILWDKEPVLVEYLRKKGMSYSRLVDDITISCDYKPSKKLLASMISDVYGMLLSKDVKPNRGKHKIMTQGEKQRIHNLNVDKGRPSLPKSKRADIRAAVFQCEEMAKYGRKTEEYNKLFNSTVGRVATMKRLHPTQATILRNRLDMIKPKK

SEQ ID NO: 3870 - protein, 379 aa, Vibrio parahaemolyticus
  source 1..379: note = Related to ABEZCS010000006.1
MNLRPKYTQKPIGSIEALANLLNLTLHDLDKLIQSSNDDYIVADKIEKDDGSIRVTYKAKPKLRTALDSIKSRVFDKVEHPDYITAGQIGKSYVDNAQAHINSRMLMSEDIRNFFPSISVKEVNRIFQHFFCFPPKVSNALSELSTKEGFLVQGSPLSGEIANLIFYRDEPELVKFCQDQGLRYTRYYDDIHISSDEKDFYELIPHLKSEIYRIFGKSGVKPHRAKKKSHFSTCSSRLSVHDVTVNSKKTNPSQKRISKVRQLLFTYEYMVDNNCDIEDIIKKYRSIHGHINTLQQQGYSQAGKLKEHLSLITCRISESEAKKYARKYRKVKSKKELTQFSSKVSILKRISGRVAMVINSEKKCANDKIKKKLSRNSSM

SEQ ID NO: 3871 - protein, 379 aa, unidentified
  source 1..379: note = Related to NZ_SODO01000025.1; note = Oceanimonas baumannii
MNLQPKYTQKPVGSIKALANLLNLTLNELEELIQSSNNDYIIASKIEKADGSLRVTYKAKQKLRIALDTIKSRIFDKVKHPDYIAAGQLGKSYTNNAKAHINSKMLMSEDIKNFFPSISTKEVNRIFQHFFCFPPEVSNALSELSTKDGFLVQGSPLSGEIANLIFYQDEPELVEYCQSQELRYTRYYDDIHISSDKKEFHELIPHLKSKIYRIFGKHGVRPHRSKKKSHFSTCSSRLSVHDVTVNSKKTNPSHERISKVRQLLFTYEYMVDNNSNIEDIIKKHRSIRGHINTLQQQDYSQVNRLKEQLSFITRKINESEAKKYARKYRKVKSKKELTQFSSKVCILKKISVRVAMVINSEKKAADDKIKRKLSRNSVS

SEQ ID NO: 3872 - protein, 351 aa, Vibrio sp.
  source 1..351: note = Related to RBZH01000046.1; note = Vibrio vulnificus
MHLRVERVYIVANKIEKDDGSLRVTYKAKPKLRVVLDSIKSRIFDKVEHPDYITAGQIGKSYIDNAKVHINSRMLMSEDIRNFFPSISIKEVNRIFQHFFCFPPKVSNALSELSTKEGYLVQGSPLSGEIANLVFYRDEPELVKYCQDQGLRYTRYYDDIHISSDKKEFNELIPHLKSEIYRIFGKSGVKPHRSKKKSHFSSCSSRLSVHDVTVNSKKTNPSHKRISQVRKLLFTYEHMVDNNFNIEDIIKKYRSILGHINTLQQQGYSKAGKLKEQLSLITCRISESEAKKYARKYRKVKSKKELTQFSSKVYILKRISGRVAMVINSEKNLQMIKLRKSYLVIQIYNQH

SEQ ID NO: 3873 - protein, 379 aa, Vibrio sp.
  source 1..379: note = Related to NZ_AP024087.1; note = Vibrio nigripulchritudo
MRNLSPVYKQKPISSIDALCRLLQVEQRDLLSLAEKSNSHYLKKTVEKSGSKPRVTYKASPELRPILDSLKDRVFSCVSFPAYIAAGQLGKSYVANAESHIGAKMLMSEDIKDFFPSITQSQVENVYKHFFKFAPNVSLLLSELCTKDGKLVQGSPLSGYLANLVFFREEHSIVASCIEHGLHYTRYYDDIHISSCQLFYEEVHDLKQLLYGMMGRVGVSPHRSPKKCNIKLSNTRLYVHDVTINSHKTSPSRKRVSTVRNLLFNFNNCVSSGCDIETLVKHYRSILGHINTLQQQGYGKSKTLKKELREAVHHIDEKSAKKYARGYRKVKNSKEFKAFSLKASILKRISGRVASVINAEHDTAKKKLERNRASRKPTS

SEQ ID NO: 3874 - protein, 376 aa, unidentified
  source 1..376: note = Related to WOBG01000017.1; note = Aliivibrio fischeri
MCNLSPIYNLKPIGSIEALCRVLQIEQSLLFSIAKNSNAHYFKKTIKKNNGKPRITYKASPQLRNILDKLKHRVFSHIVFPSYISAGQLGKSYVDNANSHTGAKMLMSEDIKDFFPSITQLQIQQVYKHFFKFTPEVSLLLSELCTKDGKLVQGSPLSGYLANLVFFKEEHTIVDLCIKNGLHYTRYYDDIHISSHTPFFEEVSELKQQLYGMMGRVGVSPHRSQKKCNIKLSNTRLDVHDITINSHKTSPSKKRVSRVRNLLFQFQKSVSLNDDIEGIINQYRSILGHINTLQQQGYLKSKALKKELSNIALCINEKNAKKYARGYRKVKNDKELKAFSAKVSILKRINGKVASVINAEQDAAKRKLKNRQSKSN

SEQ ID NO: 3875 - protein, 371 aa, unidentified
  source 1..371: note = Related to ASZI01000003.1; note = Osedax symbiont Rs2
MVTNLQFKYTNKPISSYESLSKTLSISIQEIHDIESKSNDFYTISKKIKKPDGSLRVTYKVHPRLRCVLDLLKKRVFDSVEAPEYILAGQKNRSYILNAKTHTESQMLLCEDIKSFFPSIHKKFVKKIFQHFFFFSPDISESLAEISTLNNYLVQGSPLSGEIANLIFFDLEPALVERLKKYNLRYTRYYDDIYISSKEHNFYEHTEEIKRQIYRMFNTVNLKPNRKKNKISKQSSRISVHNITVNSSKISPSKERLSMVRKKIYIFKCSIENNIDIQDLIGQYKSLQGHISTLKTQEYTKHKITKRELELLISKIDERLAKKYSRKFRSVKTKENFNKLANSSNLLTKISPRVTGVYKDEKMKAKKRLWK

SEQ ID NO: 3876 - protein, 383 aa, unidentified
  source 1..383: note = Related to NZ_JAESDJ010000001.1; note = Alteromonas lipotrueae
MVSEANTVENFQCRQSQIGSIKALAKTLSLIESELIDLAECSDQYYKVSKEIPKSDGSVRRTYSVSYPLKKVLIRIRSRIISNVDYPDYILAGRLGRSYLDNANKHKSSAMILSEDITRFFDSIKQEYVEQIFKYFFHFPPDVAKTLSQLCTLDGYLVQGSPLSGDIANLIFNEKEPNVVKLAAELGLKYSRYYDDIYVSSLTNNFDAHIGTLRTAIYGMFASVEVKPNKSPQKSRVMRSSHRMDVHDVTVNSHKLSPSKKRTSKVRLSVDRLRKMVAEDAAISDILKVYRSTFGQLITLKSQGSPKYVKMRSELDQIMKSIEPAKARKFARKFRNIKTEADFKSFAQKISVLKRISPSVAGVINAESKSAKLKIKFKQATTH

SEQ ID NO: 3877 - protein, 378 aa, unidentified
  source 1..378: note = Related to DNJR01000290.1; note = Alteromonas macleodii
MVSETDPVNDFQCKQSQVGSIRTLAKTLSLTEPELVRLAKHSDKYYNVSKEIPKSDGSVRLTYSVSYPLKKVLIRIRNRIISNVNYPDYILAGRQGKSYLDNAKKHKSSTMILSEDITRFFDSIKQEYVEQLFKYFFRFPPDVSQTLSQLCTLDGSLVQGSPISGDIANLIFHEKEPSVVRLAASLGLKYSRYYDDIYVSSATTNFDSHVGTMRTAIYGMFASVEVKPNKSPQKSRVMRSSKRMDVHDVTVNSHKLSPSKKRTSEVRLRIDRLRKMVADNAEMADILKFYRSTFGKLITLKSQGSPKYAKMRSELDGVMKSIEPAKARKFARKFRKIKNQSEFSSFAQRISILKRISPSVAGVINAESAIAKFKIEAK

SEQ ID NO: 3878 - protein, 374 aa, unidentified
  source 1..374: note = Related to JAGJEH010000010.1; note = Pseudoalteromonas luteoviolacea
MERFNFFYTQKQIGSLSVLAKTLSITVNELNRLRANSDSYYQIAKRVVKADGSERITYDVKYPLKTILQKLRSRVIKNVQLPKYILAGRKGKSYLDNAMEHMSTKMIQSEDISNFFDSIKSKYVINVFKYLFKFPNDVAEALTDLCTFKGHLVQGSPVSGDIANLIFYHKEPQLVQAIESLGLKYTRYYDDIYVSSKEGNFYQHVSFLKAQIYGMFSSIQVKPNRSLSKSRVMRNSSRIDVHDVTVNSHKLSPSRKRVSNVRAQINKLKNSVNSRGCLSETISLFKSTLGQVNTLKAQGSPKAKDMLKNILDALKGIDEAQAKKYCRKARKVKELRQLNKLAQNLSVLKKVSPTIAGVANAELKQARERIKKKQ

SEQ ID NO: 3879 - protein, 371 aa, unidentified
  source 1..371: note = Related to NZ_MODU01000004.1; note = Alteromonas sp.
MSSQIEYPQAGIASIDSLASALRIPSSELVALANNTSNLYRKSEQIEKDDGSKRITYDALPPLKIVLSNFRKRIIDKVLLPEYISAGKKGKSYIDNAEVHAGSKGLLSEDIKNFFPQVSFKSVFEAFKYLYKMSPEVAEVAALLCTKDGYLVQGSPVSGSLANIIFYAKEPFLVDRLKLLGFRYTRYYDDVHISHKTDDFSRDIGELRTKVYGIFISQGLQPHRTAKKSNYANSSRRMSVHGIVINNEKIKPNPKKVSDTRAMLFKFERLLETDYTIDSVVSLYRSIRGKIQTLKAQGSTKSEAYLTTLNSLMRKVDEAKAKKFVRKVRKVKTIKEYNKLSSKLSVLKKINVKVTRVVKIECDLAKKSLKA

SEQ ID NO: 3880 - protein, 370 aa, unidentified
  source 1..370: note = Related to CP015750.1; note = Pectobacterium wasabiae
MHKNWSYSNRPLANIESLLKMLETNEERLAYVLKNKKNYFKTVPVLRKGKKRTTYKVVGELLKIHELIKQHVFSKISLPEYITGGRRGVSYLDDCISHCNKSIIIQEDIKDFFPSIKEELIAKAFQYYMNFSPEVSSLIAKLSTLEGSLVQGTKLSTDIANLIFLEEEALISAEVGKLGGNYTRYVDDITISFESEVNNEDISKIKTMILSMALKSGVRLNRQKSKVLRNGHSKIVHGVKVIKELRPTQKRKDSIRMCLFNLKKKVIEKESIMDILALYFKIRGLINTLKQQGDKNHAEYIKQANQLVAAVDKKDAIKSIRKMRKVKDVKKLRSFYSKLKPLGNISKTISVILDSEYKTCKCKFNNKSIE

SEQ ID NO: 3881 - protein, 366 aa, unidentified
  source 1..366: note = Related to NZ_CP065946.1; note = Pectobacterium parmentieri
MHKNWNYSNRPLANLESLFKILETKEERLGYILKNKMVYFKKVPVIRKEKKRTTYKVIGELSKIHDLIKQRIFSKITLPEYVTGGRRGISYIDDCMSHCDKSIIIQEDIKDFFPSITEELIAKAFQYYMNFSPEVSSLIANLSTLEGSLVQGTKLSTDIANLIFLEEEVLISEEVAKLGGNYTRYVDDITISFESEVNNEDISKIKTMILSMAIKSGVRLNKKKSRVLRNGQCKIVHGVKVIKELRPTQKRKNNIRMYLFNLRKKVFDKENVMDVLSFYFKIRGLINTLKQQGDINHAKYLKEANQLVADIDKKDAIKSIRAMRKVKDIKKIRALYSKLKPLGNISKSISAILDAEYKSCKYKFNN

SEQ ID NO: 3882 - protein, 367 aa, unidentified
  source 1..367: note = Related to NZ_APMV01000009.1; note = Dickeya zeae
MHKNWTYSDRPLANLESLFKLLETKQERLTYILKNKKIYFKKVPVIRKGKKRTTYKVTGELSRIHELIKQRIFSKITLPEYITGGRRGISYIDDCISHCDKSIIIQEDVKDFFPSITEGLIAKAFQYYMNFSPEVSSLIANLSTLEGSLVQGTKLSTDIANLIFLEEEIFISEEVTKLGGNYTRYVDDITISFESEVNNKDISKIKTMIFSMAIKSGVRLNKKKSRILRNGQSKVVHGVKVIKELRPTQKRKSDIRMCLFNLRKKILDKENIMDILSFYFKIRGLINTLKQQGDAKHTEYLNEVNHILTGIDKKDAIKSIRAMRKLREVKKLRVFYSKLKPLGRVSENVSTILDVEYRACKSKLNKI

SEQ ID NO: 3883 - protein, 331 aa, unidentified
  source 1..331: note = Related to JAAZOJ010000541.1; note = Candidatus Methanofastidiosa archaeon
METNPIYKGKQISTIQDLSEILNVEVNRIKHILYRANSFYIENPQPKDDGTMRMTYIIKPPLQQIQERIKDNIFSCVEFPHYLMGGIRDEANPRDHIRNAKIHSGKKWLISLDIKNYFPSIKNEYVYFMWRKFFGFSDEVSRVLTRLTTYNGFLPQGSKTSSGIANLLLWDKEPHFVDSLNKQDFVYTRFVDDITISSTKLVEKEMVSKIIVDMKHLLRQYDLKLKGKKTKFQTRSQKMTVNKVTVNGKKPTISSEERNNIRLEVHLFEKKADNTKNWNEIDHDYYSLMGKLNYIKKVHSAYAEKLISRLEIKREEFYSKNYEKDGNGCRL

SEQ ID NO: 3884 - protein, 311 aa, unidentified
  source 1..311: note = Related to JACKCF010000001.1; note = Anaerolineaceae bacterium
MDKPQYKKKPIGYVDSLAKALSAERDHLIRVANDADSFYRLHKRIEKPDGTFREIYDARYPLKLFQRRINRKLISRVDFPQYLHAVKHRSHITAASKHNIPLLLLNLDISNFFPSISSELVFDIWRLFFRFPKHVSQMLTKLTTYNGFLPQGAPTSPGLANLAFWDIESKLVEGMNAKGFVYTRFVDDVTISSERKVQMDELAPIIASIFGMFRNRGVKANRNKIHISTSGHEMLVHNLNINSGVPTIPKRERGRIRAAVKDCEITYTEIIQTEVYKKLWHSTLGRVNYLNHFHPTEAQKYHQRLQAVRPS

SEQ ID NO: 3885 - protein, 313 aa, unidentified
  source 1..313: note = Related to JACDGI010000160.1; note = Anaerolineae bacterium
MDKPQYQKKPIAHIDSLAKLLSVDTNKLVNLADQADSFYYLSERIEKPDGSFRDVYGVRDELKILQQQIVNKIYSNVRFPNYLYGSIKGTNHIMDAYVHAHAQLLVKMDISNFFPTLTSKNIFNIWKRFFNFSEPVAKILTKLTTFNNFLPQGAPTSPGLANLAFWDIESAIVDRLQRNGFTYTRFVDDVTVSSKSRTEMHKLNTIFKSVFGMFRSKGVKANRKKTNISTSGYRMAVHNLNINSGTPTISTKKRSQIRSAVRGCEKSYQDQKQSEDYKKLWESAIGRVNYLSQFHPTQAQALHKRLQAVLPVS

SEQ ID NO: 3886 - protein, 343 aa, unidentified
  source 1..343: note = Related to NZ_KE383931.1; note = Oceanobacter kriegii
MSQNHLSKSLQTPLLAPKFSGTRISSVESLSFVLKTPIDELVSIADTSESYYRIHKEIEKPDGSIRKIYSVREPLKGIQRKINSLILKKCKYPEYLTGSLPNCTHIKNINFHVGQKTIISIDATNFFPSINASDVMNLWAEFFNFESQTSTLLTQLCSFQGGLAQGAPTSSYISNLVFWDVEPLIVQEFHRKGYIYSRYVDDICISKSSRTTKEEKTWAIKTAQKVFISKGLSIKSRKTKIMEKGSRQEVNKKTIHNGKVNASKADKDKIRAEIHNLKIRIDKNLLPDIPYEKRYLSIRGKILYLEKFNKTAAQKLQNQLDELVAYIKSKGVIWRSPKNKYIP

SEQ ID NO: 3887 - protein, 341 aa, unidentified
  source 1..341: note = Trueperaceae bacterium; note = Related to JADLCU010000112.1
MAELEYPFAPIGSLNALARHLGLSRWYLDGAIAKAGPRAYRVRKVTPSDARGVPDKVEYAPAPWLKELQRTINRRLLKAVEMPAYVIGGVPGRRIEDAIQRHACSQALLSFDVRRFYESTSAAEVRKVFMRLLRFPPELTDALLALTTVRGHLPRGAPTSSYLANLVLFDVEPELVDFLSGLQPRALRYSRWVDDINISSPWPIDERLAGEVKDRVSTMLRRHGLSINWTKYRENLRTKSVVVHHVRIEGSRFSVAGSKRRNVRAAVHNLELASQKRPLSASELSELTRQRSRVEFIRPFHPREMEPLRIKLQAIKEKQPGRSKSKDGPDWRSTVWGCTKT

SEQ ID NO: 3888 - protein, 335 aa, unidentified
  source 1..335: note = Related to MGHL01000006.1; note = Candidatus Woesebacteria bacterium RIFCSPLOWO2_01_FULL_44_14
MSTKKQSPELRPLVSLSYLEYLLGTKRDRLQKIATSAGSYYQPFDIHKKGTDKWRHIDNPQHPLKTLQKRILKNILNRNIRRLPDGMTGGISGRSIVENAKIHIGKECIGVIDIKNCFPSTNYHQINQVWIDHFGCGYKTANLLTKLTTFQHRLPQGAPTSPLLCNFALAPVFGEIKAVADSAGLDITIFIDDITVSGSKKSITDSIEPIIKILVKHGYAVRKRKVKVITSNYSQKVTGIPVNRKLSIGRGHIQQIRNLILETASLKGYIPSNDYCKIQGKISFAKSVSKTQGVKLGKFAEKMLVHPLMQVGVKKDEASRDCKRFSDNHKYTERN

SEQ ID NO: 3889 - protein, 326 aa, unidentified
  source 1..326: note = Related to PFRF01000009.1; note = Candidatus Levybacteria bacterium CG_4_9_14_0_2_um_filter_35_21
MNNSLISLKKLEFTLCTSRDELRRIADRVGRLYEPYDLHKKGTDKWRHIDNPHDELKKLQRIINKNVLKKNISLLPERMTGGITGKSIIDNAKNHVGKEYILIVDIKNCFPNTDQLKILHVWRTYFGCGNTTARILTQLTTFQARLPQGAPTSSLLCNFALLPIFRKIDHYASLNNLSFSIFVDDITISGRKADVIKSIKPIIKILKEHDYAVKKKKIKIFASGYSQRTTGINVNKKLSVGRRKLNEIRKLIIESAKLKGYLPSTLINKITGDINFTKQVSPNDGKKLKELANKLLIAPIKIVKSESDCNTRTCNDFKRNHKYILD

SEQ ID NO: 3890 - protein, 325 aa, unidentified
  source 1..325: note = Related to DMZH01000002.1; note = Candidatus Woesebacteria bacterium
MSTLQKTKIKSVAELSQTLKVGVKEFVKTAKNANLFYRPFDLSKKGSEKWRHIDNPTGKLKIIQKAINKQILRDLMFQLPPNIMGGIENKSILENAKVHVGQEMVVTIDIKNCFPKTKNEVIFTIWKNLLGFEPNSARLLTQLTTTKGHLPQGSPASPSLSNLALLPISKEILNYSKKHHLNFTIYVDDITLSGKKSSALDSISPVVKIIQKYGYAIRNKKVKKMPSYKTQTTTGIQLNSEISIGKQKIDEIRKEIINLAKLQKPYITKKSIFSKIDYVKKISPEKGQKLLEFANMILEEDIDYIAVDPEKDEKRDCNGKACLAK

SEQ ID NO: 3891 - protein, 341 aa, unidentified
  source 1..341: note = Related to MGFX01000001.1; note = Candidatus Woesebacteria bacterium RBG_16_42_24
MSGHEHQLNIPSPFPILSVNKLAFILRTKPNELKKLSENAGNYYTPFDRKQIKDNGKVKWRHIDNPAPKLKKIQQKINRVLLKAKVESLPTGMTGGIKGRSIFTNAAQHLNQKAVVTIDLKDCFPRTSNKRIFRVWRNHLGTSECVANILTKLTTFQRRLPQGSPTSSSLCNLALFPLFKKTKRYCQKEKFNLTLYVDDITISGQTIPIRLAIGRIINFIQEEGYAVRRNKIKIMTASVQQKTTGLIVNKQLSVSAKAREEIRKEIFILSRQEMFSSKRMRSLWGKINYIKKVSPKQGGKLASLAHTLLLDTLASHSYENVTSEKEVTRECKNTRRHKYSL

SEQ ID NO: 3892 - protein, 335 aa, unidentified
  source 1..335: note = Planctomycetes bacterium; note = Related to JADZCA010000099.1
MSLARPQIVSWNLIRQVTGFSADELRSVAERAGGLYESRDRLAHKAKKPKWRHIDDPVPELKRIQRALVRGLLRPIPLPAFFCGSVSGRSPVDAIKPHVGRPSILALDLRDFFPRTSHKRVYRAWTRVVGCSPEIAGVLTQLTTLHRRLPQGAPSSPPLANLAFLEIGLAIESACRNAGLRVTFFVDDILISGDQPGTVLDEIIDLLQQSGYGVKRSKMEFMGPRERHAALGAVFNRFISYGRGPFAIIRQRILALIDSAEVTPSQIRSLTGAAHYVRFLNKNQGDKLLALIVQLRPTVEDGPREPKAQWETCRGGNKCKAKPRGSRPLVTTTGS

SEQ ID NO: 3893 - protein, 348 aa, unidentified
  source 1..348: note = Related to JADZDC010000110.1; note = Candidatus Eisenbacteria bacterium
MTQSPAADPGLVPLVSMRRLEQLLGRSREDLIRLAEHAGRYYAPFDEFKPNRAEPRHIDRPVGELKLVQERIQTSILRHIPLPPTMLGGVKRCSIRDNAQYHLGSPLVVTIDLRDCFPRTHDLAVYSAFCRVLGASEKIARLLTKLTTYQHRVPQGAPTSSLLVNWVLLPLHDAIQTIAQGADCRCTFWVDDITVSGPAALDVVEPIVMAIQRHGYSIRHRKLHLMPACRPQEVTGVLVNRHPAARREYRTELRATILQLSSEVEVSARKLERIKGRISHVRHLHPRHGESLDQLLERTMMGRRVDELGACPPKEVRTRVRCNHVRRHRAGRRASARSRADTGGIAGE

SEQ ID NO: 3894 - protein, 357 aa, unidentified
  source 1..357: note = Related to NZ_JMCB01000022.1; note = Hyalangium minutum
MSEATARTFYSKAGLGFHLKRDWSTLESLAEHAGAHYRSFDEWMGNKWRHFDVPSKRLADVQREIARFLKARVKFPDTMLGGLKGGSPKKNAEAHRGQGLVFKLDIRDCFPSIGHRRVFRMFREQLKFSDPISNLLTKLTTFQNRLPQGSPASSVIANLVLMELHESIQLECEALGLKCTFFVDDITLSGERVREVIAPVVRLVQRHGFSMRPCKVRLLAAHREKLSVTGVLVNRRRLSVGRTRKNKLRARIHQLSRGERVTDSDLRSIQSSVVQVKHISNHQGETLERLVQEKLPKRGVQTPKERAKKIRRVCKCTHKHRHKRNEESVTATHQPASSVAAGLPRQHFVHTLEAGLR

SEQ ID NO: 3895 - protein, 320 aa, unidentified
  source 1..320: note = Related to JAIOJS010000141.1; note = Thermoanaerobaculia bacterium
MMLSAKPLVSRRELSFRLAFPRDRLESVAERAGRYYRPFDREKKPGAKKWRHIDNPIEPLKWVQKRIGRGILKSVDFPAELTGGLSGRSLVDNARPHIGQPTLVCLDLDSFFPHVNHDRVYDALRRHLGCSGEIANLLTKLTTFQKRLPQGSPASTFLANLVLIDIVEELRAIARDRHLALSCYIDDLTFSGIGAEEAIGDVVAVLKAHHLKISREKLSIAHEHEARSVTGIGVSRRLTKPRDKMLEARDFINSLAASETVSERDLARARGIVAHVGQVNKSQAAYLARRLARLPPAGDDAPQEVEKTKTRRCSSFLRPH

SEQ ID NO: 3896 - protein, 325 aa, unidentified
  source 1..325: note = Acidobacteria bacterium; note = Related to RFGL01000253.1
MINSYSDLSPLVSIRRLERLLGFDRQAIQWIANRAGRYYRPFDVRRVGTRKWRHIDNPQGKLKTIQKRILTNILKTVNFPAAILGGIAGASIKENARVHLGQPILVVIDIKDFFPNITHRKAYSAYKTCLGCSAKIAGLLTKLTTFQRRIPQGAPTSTLLANMSVLTLHDELKELADNLGLRVTFWVDDIAFSGPNADKIIGAAVEIISRHGFAVSSKKIRVMGRGSRQEVTGVPINRKISAGRKYIEELRNSILDFKRTGITAHEFASLRSKISHVRWLCPSQGIKLEEFAKEQLSDLVLSIGCKAAKNEYRKCEDWSRHRREP

SEQ ID NO: 3897 - protein, 327 aa, unidentified
  source 1..327: note = Acidobacteria bacterium; note = Related to JACQZW010000093.1
MAGTAPPAESIFPIKSLRRLERLLCVPREELRFLADAAEHHYRPFDRFRPRADGTVKVRHIDNPVDRLKSVQARINSRLLRTVPFPATMIGGVRRRGPRDGASLHCASPDLVTLDLSNCYPRTTNRQVFAVFRNTLGCSEEVARLLTRLTTRQGHLPQGAPTSGLLSNLCLLDLHQTIAGLAASRGLAFSQYVDDFALSGPGARNALGDILPMFFGHASARLNRSKLRCCGRGSRQEVTGICVNRRTMSARGPKYEALRNRVRSFDPNASDAGTERQAILGAIAHVRSINQLQADSVVRLAERCGLRRDGCRDTPDSVRPVGRAAGD

SEQ ID NO: 3898 - protein, 323 aa, unidentified
  source 1..323: note = Related to JAHJDO010000130.1; note = unidentified bacterium
MSRRKIESLLGEKIEYLEHVASKVGNYYKPFDIYTPGKKPRHIDNPNSDLKKIQKKIKSRVLETVILPETMMGGIKDKSHKDNALRHIDKKVVITLDLKSYFPKTNNRNIYDVFINVFGCNRETAHLFTKLTSYQRRLPQGAPSSTLLANMCVLPMHNDLQELFNRNDITWTFYIDDIAFSGDNADKVIDEAIKIIQNHGQGVSCKKKKIMYANNRQMVTKLCVNRKVGIKKEKINKIREDIINLSWQPNIDNRKLQAIKGSINYVKSICAVRGQSLDNLYKKMLPAKTGLIGKKPKIKTTSCKCSKKHREYVKGVRNISNKE

SEQ ID NO: 3899 - protein, 309 aa, unidentified
  source 1..309: note = Related to CP011806.1; note = Acidobacteria bacterium Mor1
MKSLNQDDNVKLRSMRRLESLLGRSRKDIKRIAENSGRYYRPFPKRQGDKVRTIDNPTGELKQIQKRIQERILTDFELPESMLGGVKGRSIKLNAKLHCGAPTVVHLDLVKCFPRISNKVVYKAFVEHLGCTPRIAGLLTQLTTYRRRLPQGSPASTMLANICLLRMHNELRDVAQTNGSMLSFFVDDIGLSGNRPEVLIEQMIGIVRNHGHSVSHRKRKIMRSHEPQTLTGLSLNRRPLVPRTRRAQVRKQIYHWASQGNCTDELQRIRGAVNFVRWVSEHQGEALERTLSRAQSSTSAESDRSRQGC

SEQ ID NO: 3900 - protein, 303 aa, unidentified
  source 1..303: note = Candidatus Omnitrophica bacterium; note = Related to JADFXX010000012.1
MTSSEQQKSSPNPFPLESPNKFAWIIRVKPHELQEVAAVAESLYNPYFEKKKGKKPRLIHNPSDRLKIIQKKINTWILQKYPFPDFIVGGIKGKALEDHFKLHLRKDIVVTLDIKNCFPSITNKHIYDVFKDKLGALSDTARLATLLTAYKGQLPVGAPTSPLLANLVLLPVLIEIKKLVNSHGFEMSQFIDDSAFSGKRLPVELVSEVCKMMARAGFTISHKKTLVMPKSDSQTVTKRIVNQTPGIPRKEMNRIRSAVNELKNTPKNDPLYGKRLASVKGRVISIRKFYPQVAEKFLQEIGG

SEQ ID NO: 3901 - protein, 312 aa, unidentified
  source 1..312: note = Related to NZ_QICN01000006.1; note = Sinimarinibacterium flocculans
MVAAPILSIRDLAARVGTPIERMTEIADDIDSHYRPTALYDEKRGRSRMLNVPRKELKALQQRIHRVILDPIELSACVHGAVSGRSPRTNAEQHLGKPCVICVDVKSFFDSVRHYVVYRMFRNDLGFGRDVARLLTRLTTYDSQLPQGAPTSPAIANLVLAFQVDKPLEAAAASLDLTYTRFVDDIAISGGDPRPLINVAAKLLSARRLKVHRATGRGRLKPKLKIMSGGVQQKITGLVVNSASAPTIPRRYRDQVRAAIHQLREMQSGASFNRSVDSIRGRIAHVRRLHPSGAARLAGELARVIENRRECG

SEQ ID NO: 3902 - protein, 307 aa, unidentified
  source 1..307: note = Betaproteobacteria bacterium; note = Related to SCTY01000068.1
MILVQPILSVRDLAARLGIEAGYLREVGRDIESHYKIQPLKQGAKVRMLAIPQAELKMIQRRINRAILAKVPLAKAVYGGVAGGSPRKNAAEHANQRCVITMDVKHFFPNVRHYMVYRMFRSELGFGRDVASILTRLTTYRSYLPQGAPTSTAVANLLLAAPVDVPMSAEAERQGVRYSRFVDDIAISGENPRPLINKVAKLLSSRRLPVHRRKINGPSKLRIAPSGVAQRITGLIVNAQNGLSVPRERRDKVRAAIYALRRAPKHELKKAVASIRGKITHIAQFNAAAAKRLNTYLDGTLRQRLDG

SEQ ID NO: 3903 - protein, 312 aa, unidentified
  source 1..312: note = Related to JABWMJ010000023.1; note = Schlegelella koreensis
MNEPILSLQKLAWRLGVPVNRLRQLADEISRDHREHYNAFALKTGKDKIRQIRPPKEELKAIQRKIVKRVLAPIGLAPTAHGGVPGRSQRSNAELHLGQARVVTVDVKNFFDRVQHRRIYRMFRNEHGFGADVSRLLTRLITLRGSLPQGAPTSPAAANLFLRRAVDEKLGSTLAKLPVTYSRFIDDLTFSGPDPRSLITTVAHLLSECGLTVKKSKVKIAPRHCPQKVTGLLVNSATGGRLTIPRAQREAVRAAIHQLPRLAIRKEWDKQVRSIRGRIAHVERYHPGDGARLRKCLRVALDGQQPKSDAPL

SEQ ID NO: 3904 - protein, 301 aa, unidentified
  source 1..301: note = Acidobacteria bacterium; note = Related to JADYYY010000015.1
MRSPVDHYSDAWLSFELRHPVDRLRLLAGMVPEDLYSVRRVEINRKVRDISNPCDELKAVQRSIRERLLLPIPLSPIVYSDVPGHSAAQNAERHLHQANVGSADIRDCYNSMTNAMVFRVFRHTLRLGDSLADLLTGLTTSRGHLPHGAPTSGALANLILSPIDVELERIAVELDLKITRYVDNIDFSGQRTRHAFLPIVALIQSLGFAVKRRKVFNASRQRVQIVTGRTVSGRVLRLPRAKRANVRANVHEVLCRRRDGLPIQDKQINRLRGRLNYLRTQGHPKEARDLATRLAAVGINI

SEQ ID NO: 3905 - protein, 300 aa, unidentified
  source 1..300: note = Related to MEKY01000029.1; note = Acidobacteria bacterium RIFCSPLOWO2_12_FULL_59_11
MRMPVEHYSERWLSFTLSHPRERLRVLASTAERLYKSGWRDVKGKQRYITEPFEELKIVQRAIREHLLLPIPLSSIVYSDVPGRSATMNAVQHVNQPNVASIDIRDCYPSMTNAMVFRVFRGPVGLGDNLAHTLTRLTTLSGHLPQGTPTSGALANLILSPVDVILEQIAEGLRLVVTRYVDNIDFSGVRSREAILPTIVALQAAGFSVRHKKVMNAGYRRAHVVTGNLVDGCRLRLPHRKRANVRAAVYEIVQRYEDGLPIATKAMNRLRGRLQHLRTQGHPRDAERLAAQLVAAGIAI

SEQ ID NO: 3906 - protein, 304 aa, unidentified
  source 1..304: note = Candidatus Delongbacteria bacterium; note = Related to JACKCN010000006.1
MPYNVKSIKSLAKLLDVDVEELVRIEQNPEKYYEPFEKKRGEKSRSIDNPTGELAALQIRIKKFLLCDVDVFRPIATGGVKGHSTKTSALLHTNKDCVATVDVKSFFPCVTNNKVYKVFCNLGYSPPVSRMLTRITTYKGHLPQGSATSTIIANLALYNFDEYLYNQSLRLGCDCIRFVDDIIISGSYGKVTELVSLVFPALHRMRFSVHRAKKLKIMKSNKRQEVLGLTVNRAVGVTKSYVEEVRTQIACVEKCSVTSCVYLKLVGKIQYIGTTKPIIAGNLMRKLRNSLMRPEKECLASIEQ

SEQ ID NO: 3907 - protein, 337 aa, unidentified
  source 1..337: note = Acidobacteriia bacterium; note = Related to JAIQGL010000020.1
MTVDLPEKNIDLAAAPKLDLLSIRELEFKLGLERGYLRTLAAHAGGHYNPFVKPEKVFPFQRRFKNKKKRIIDNPDEQLRDVQKRIYRRLLRPESLPDYIYGGVTNKCIQDNVNRHLGARMLVTVDIANFFPSVTNEYIYWLWNHVLRCSSEISILLTKLTSFERHLPQGAATSTPLANILICTIDKQIRSECERMGITYSTWVDDLAFSGDDPRRIIPVVIGALRKSGLRLSRKKITIMGPATRKVLNGIVLGKKLGVTREVRSRIRAGIHRLKTGAVPIQDQPKYMRSLIARIRQAETINSSQIQKLRSQLAAVLRDRSIALTERQQFLKQLGCA

SEQ ID NO: 3908 - protein, 318 aa, unidentified
  source 1..318: note = Related to JADJOS010000001.1; note = Acidobacteria bacterium
MSIPQLSIVSVNDLAQRLRIDPKKLRHIAAHAGDYYKPFKQRKKPKPFAKKSKPAKVREIDNPSELLKTIQRRICDNLLCGVPWPEHVFGGIKERNTVKNAKLHLGNEKLVTIDIRSYFPSISNKVIYDIWFRFLGCGSEVSAMLTQLTTFRRRLPQGAPTSTALANLVLISIDGELVEFCRQNSITYTTWVDDLAFSGENAELALEKAISSLRRAGLRVARNKVKVMRGSKPQILMNQTLNNSMGVNKIYRSNVRSAINKLVTHPPLNLKEQFASINSKIRYVDTINKNQARALTKNLNSTLNRIKNSSLSPYTKAI

SEQ ID NO: 3909 - protein, 302 aa, unidentified
  source 1..302: note = Acidobacteria bacterium; note = Related to QHXL01000591.1
MNRNGRNQLRLNIGSLDVLGYALGLSPEDPFIKISNPAPFAADPIEPKQRKIDNPILITKEIQKRINRSLLRPLHLPGHICGGVKGKTLLDNIIPHLNARVIVTADIKGFFPSITTFQVYAIWSRLLGCSPEIAAILTRLTTFERRLPQGAPTSSTLANLILFSFDQPIRSFCAQHGITYTTWVDDLIFSGAESRSVINVAVAALREGGFSLPHKKLKIMTAGKRMRVTGVLLGKKPGVIRRYARDTRAGIYRLTKGDLAEPKVDRYVKSIRGRIAHINRLNPNVARSLDHQFQLALKRAVS

SEQ ID NO: 3910 - protein, 329 aa, unidentified
  source 1..329: note = Related to FNSD01000001.1; note = Terriglobus roseus
MTLQRNKRLPLDQLPLRSLRELEHLLGASREALLRLAEWEANYSPFEQAKPLKPHAKKPQTKKLRKIDNPGVELKKIQRRILSRLLLPLNLPNFLFGAVPKRSVREHAAAHLGATTIVKMDIKSYYPNLTNEHVYKVWHEILCCSAPVSKILTKLTTCDFHLPQGAPTSPTLANLFLASIYGPIIQDCVAKDIVATVWVDDLTFSGERSRDVMELVRQTLACNGLRDSRKKRVILTGKSSKLVTGARLGREELRACKLKVREIRAGIHNLKRGKVTTRGRSKDVQSLLGKVGFVRSLCPSDAIPLEKQLRSINVSIPSQAGLTSRSAKG

SEQ ID NO: 3911 - protein, 320 aa, unidentified
  source 1..320: note = Related to NZ_CP042596.1; note = Granulicella sp.
MDLPQTKPIVGSLSDLEHRLGIKRGDLAVLLQCRAGLYRPFKIPKKQHPYPGKLRRLKASEPVKYRQIDDPVKQLKDIQRRILATVLSRVELPAYMFGAVSGRTLLGHAKEHVPNQSSIVVRMDISSYYPNITCEHVYYVWNVVLGCPPPIARLLTELTTFDWHLPQGAPTSPAIANIFLASIYAPICLASEQAGLTITTWVDDLIFSGVAAHTVMETVRATLAAHGFKMAPDKREIFGPKDQKNITGTRLGRFEVRVTHKKMSELRAAIFRLAIGALEPGELEKYRRNLSARIAHIATIHKGDAAKVRRHAIKSSVILK

SEQ ID NO: 3912 - protein, 324 aa, unidentified
  source 1..324: note = Related to SOIB01000190.1; note = Candidatus Stahlbacteria bacterium
MMIMKKKNKHKLITISDLALHLGISEGYLQDILSELYSEDTKLYRSWDKIKPNGETRPMDAPRDKLKFIQKRINGRILQRTQISKIATGGVRGRKLKDNLIPHLRQQMVANFDLKRFFPNITNKQVYEIFILIGVSPDVARVLTRLTTFKNRIPQGAPTSSMLANLVAGYGGSHCLDGRIENLCAINNFNLRRWVDDISISGPNYIKKFEPTIEKIIFESGFIPNRDKTAFISKNNAQIITGHLVNEKANVVKQERRRIRAILHKCKTSGLDGYSKNRIDHLKRSLRGKIAHISSINPRSGNKLLDKFNSIEWSSLINEMTNSA

SEQ ID NO: 3913 - protein, 332 aa, unidentified
  source 1..332: note = Planctomycetaceae bacterium; note = Related to JAAYAY010000168.1
MLRIRQVKHLARRLKFPTRVLEKIAEAPELWCEELVLLDPAKPTKPRNVLNVRGQLRQLQSRMLRSILLPVLPVSQFSHGSTRQRHIKSNIEPHLRSTFAFTTDIADFYPSVSHNRVYRLFAKTLECSPDVARVCTKLCTYDHHLALGLITSPILADQTMHQIDRRIGLACWKAKLVYTRYVDDLTISGGYDLAKSGFANLVQGILEEHGFAVNPDKHRFGRLEEGTTITKIRVNRGHPDVRRQYVTELERQIEDAHRLAVDEQFDGPYYTEGQIWGRIQFVSWVNPGRQRALVRKFRAVPWNKVKEVAECRGLVCLKKVLSKRILASPGTV

SEQ ID NO: 3914 - protein, 327 aa, unidentified
  source 1..327: note = Planctomycetes bacterium; note = Related to JABMRQ010001902.1
MLNIQQVKHLAHRLGVSVKHLEEVAESPEGYCEELVLLDPAKPEKPRDVLDVRGPLRKMQLQLLREVLLPKLPISAHSHGGVRGRHIKSNVTPHLDSTFVFGTDISDFYPGIKHNRVYRLFTQQFGCAPDVARICTKLCTYQYHLALGLITSPILADQVMGPIDERIGTACRKAKLVYTRYVDDLTISGPFDLHENKSGIAGLVQRILNDHGFATNPSKNSFGRLADGVPITKIRVKRGHLDVRGEYVKELERQLADAASLANGGDFDGPYYTESQIRGRVQFVCWVNPGRKRELMRHFHVVPWDKVGQEAVRRGLVATKKVLMKRT

SEQ ID NO: 3915 - protein, 337 aa, unidentified
  source 1..337: note = Related to NZ_CP063458.1; note = Proposed Humisphaera borealis
MLNLKTPKNLAYRLGVSLSVLRDVADRPDDWIETLLLNDPTRPNKQREVLNVKGKLKQIQTRLLRVVLLPVLNVSPYSHGGISGRNIKTNASCHLNANYLFSADISNFYPSIGHRRVYQLFSKRLNCSPDVSRLCTKLTTYDYKLALGLPTSPILADQLFHPIDARIAGACRSMGLSYSRFVDDIAISGSFDLSPESCGVSALLERIVTGNGFELQLEKSRFGRLSEDEMTITQLRVRNGRLDVREQYVLELERQLADAGELSNDRHFDGPFYTESQVRGRVQFVGWINRDRKRQLLQRFREVNWTQAMAVGRSRGLVVQKKTLIRMQKSDLDSTET

SEQ ID NO: 3916 - protein, 331 aa, unidentified
  source 1..331: note = Related to NZ_AP021861.1; note = Lacipirellula parvula
MLKIRQVKHLASALSTTPAEMAAVLKSPADFYEELELRDPSRPDKPRIVVNVTGALRALQSKLYRRILLPKLSQSAHSHGGVSGRSIKTNVEPHLGSKFVFKTDIANFYPSIHFRRVYKLFVEDFECSPDVASVCTKISTYRHHLALGLICSPMLADQVLRRVDRRIGGACAGLGLVYTRYVDDVAISGPFNIETSGLPRLVEDILAKDGFKANADKHLFGSLAEDLSITSLREVRGHLDVRREYLDELERQIDDAASLARDGEFIGPYFTSEQILGRVRFVCWVNPGRRRSLISRFRTVKWKKARKVAKRRGYEVTRKTLTKLPRREEPS

SEQ ID NO: 3917 - protein, 330 aa, unidentified
  source 1..330: note = Related to PABB01000067.1; note = Planctomycetaceae bacterium
MLRIRQTKHLLETLGVSSDELSAILANPSDYYEELLLTDPQKPHKPRAVVNVTGRLRTLQSRLYRRVLLTKLCPSIHSHGGVRGRSIKTNAEPHLGSAFVFRTDISDFYPSIHFRRVYRLFAERLECSPDVARICTKICTYRHHLALGLICSPILADQVLARVDRRLGGACAKENLTYTRYVDDIAISGPFDFEKSGFANLVQRILATDGFKVNPQKHVFGSLAKDCTITNLREVRGHLDVRHEYVEELQRQLADASSLAQDREFEGPYYTFGQILGRVRFVCWVNPGRRRDLMLRLRSVNWRTVKAIARKRGYEVSKKTLSKRDGPLAQ

SEQ ID NO: 3918 - protein, 330 aa, unidentified
  source 1..330: note = Related to NZ_JAHPZK010000007.1; note = Paludisphaera sp.
MLNVRSERCLADILGVTVHALKVDLGRLNRDVREFQLIDPARPDKVREVIQIVGAWRRHLDRLMERLLLPRITPSIHNHGGVKGRSIFTNASAHAENVYVYTADVRDFFPSIHHRRVYRLFFGRFGCSPDVASICTRLCTHNYHLAVGLPSSPLLADQAMREVDERIHGACQSAGLTYTRFVDDLTISGGFDFAGSGFLKLLPRILEKHGFRLNPRKIEIGRLDDGPQVTKLWVNRGRPDVAREFIQRLMEQMEDAERLANGGDFVGPYFTPDQIYGRVCFVRSIRWGRGRDLMRRYRSVQWSKVEAEAGRLGLVAERKRLIPKPKEEAG

SEQ ID NO: 3919 - protein, 334 aa, unidentified
  source 1..334: note = Related to PBQK01000137.1; note = Gimesia sp.
MLHIGYDKLLARMLGTTRAELNDILDNADEYFDELSLFNPEKPDKPRDVISVRGKLRTFQAKFYRKVLLRKLSVSPHSHGGVKGRNIKTNAKPHLNSRYIYKIDLQDFFPSIKQPRIYRLFNSKFACSPPVAKLCTRLCTYEHHLALGLITSPILADQIMQSVDTRIGSMCDNAKLEYTRFVDDLTISGPFDFEESGIPDLINQILLESGLTPNPKKYVYGKIDNGISITGIRKNQEGKIDVEEEYALKVEEQLEASKSLELGNWPDLSCLYHTPAQIRGRIDHIKWINESRGKKLLNIYKKINWSRVDEEARKLKLVVSKKRLTKKTKTLLVD

SEQ ID NO: 3920 - protein, 337 aa, unidentified
  source 1..337: note = Related to NZ_WRPR01000072.1; note = Candidatus Laterigemmans baculatus
MLNLWRLDQLCRLLKTDPEKLASALESPSKFIKELLLCDPAGEKRPRRVIDVSGDLRLVQERFYRRVLLQRLWPSHNSHGGIRGRSIKSNVIAHAGSRFAFKSDIRNFYPSIHRRRVYRLFADRLHCSADVARACTALTTFNHHLALGLVSSPILADQILCPIDNRIAEACKSIGVVYTRFVDDITLSARYDLRRSNVASIVRKILGDHGFEIHPGKEAFGRLEDLAITGIRMRDSKLDVTREYADRLDQQLKDAKSLADGAHFDGPFQTFNQLRGKVQFVGWVNPGRKAYLMRRLFSIGREKYRREAINRGLVASKTGLMSLDPTPAAQLRVFTPG

SEQ ID NO: 3921 - protein, 343 aa, unidentified
  source 1..343: note = Related to LECT01000054.1; note = Rhodopirellula sp.
MSSIGMDAKLFSLHRPRQVADRLGLDESWLLRLSEELRTAEGRSNYIREFTLFDPRPGKKPRDIISVRGDLRLAQRRLHQRLLSHSIEPTPYSHGGVRGRSIKTNAGQHARNRFVYLTDIANFYPSIHSSRINDFFKSNGCLPAVARLLTSLTTLDYHLALGLITSPILAEAIIQPVDRRIAVACDRQGLVYSRYVDDICISSKHSLHGSGIDATVRTILRQSGFKVRVSKDRFIRVDEGCAVTGVRIHRGRLSVTPSYIGELETDLSSALSFARGGHHTGLFFTKEQLWGRVQFVRWINPGRAKPLIRLFRQIPWRRYRVAASQSGLIAAKAFFAERKSYVL

SEQ ID NO: 3922 - protein, 332 aa, unidentified
  source 1..332: note = Related to JAJTEK010000018.1; note = Pirellula sp.
MQNPATRSKYINEFTIVDPREDRKPRDVISIRGDFRTVQRRIYQRILSQVIKPGPSSHGGIRGKSIKSNAEAHLGNVYAYQTDIANFFPSIHRDRVRSVLQNYVGSRDVAELLAQLVTLDDHLALGLVTSPILAEAVIQPVDTRISGACRKMGLTYSRFVDDICISGSFPIDKSCIPRMVRGILQNNGFKIRPEKDRFVSLSTDLFSLTGIEIRKNRLRVPQRYINDLVHDLESANAIAMGCEHPVTLYYTREQIVGRIQFVRWVNKGQSSILVKKFKKINWRLHSKQALLRGLIVLKPRSVDRSSGAVSDGTVVGESTPLQSKKRSIKSVD

SEQ ID NO: 3923 - protein, 328 aa, unidentified
  source 1..328: note = Related to JAAYCR010000064.1; note = Phycisphaerae bacterium
MESSNLQAMNCKTLRIRTIPHLANQLGIHENGLIDVAENTERYYRDFKRNVKGKDRDLVMSINPLAMLQRRILDRILHRLPISDYAYGAIKGRSILDNAKKHSNSLFIAKFDVKSFYPSVRYQKIYDFFMGQECAPDVSRILTLLTTRKYSLPLGTSTSPMLADQVIQPLDKRICGMAAKAGLKYTRYVDDITISGSYPVEQFTDLVIEIIRQNGFKVKQSKIDVYAPGDGKERIICGVRVQNGKVSASTDYIKTLRGELLKAIQQSQHRDISGDFDTRNQYRGRIGFVMWLDRPEGLKLLSLYRKVKWRHLEWILYERNKSPQKTSL

SEQ ID NO: 3924 - protein, 322 aa, unidentified
  source 1..322: note = Planctomycetes bacterium; note = Related to JAFGPY010000231.1
MEPDSPSSDGLRIQRIEHLASQLGFPVDRLVDCAEHAGDFYHDFKRNVKGKDRDLTMARPPLSVLQRRILDRILCRLPVSEHAFGAIKGRSIRDNAVAHARAPFVAKLDIRDFYPSIRYQKIYDFFMAQGCSPDVARTLTLLTTRNYSLPLGTSTSPFLADQVVHPIDTRIGGLAKAKGLRYTRYVDDVTLSGPFDLEQLAKQIVTIIRQAGFAIKRTKMEFYRPDDGKERIITGVRVQDGKVSAPSNYIELLKRDLVLARKASLHEVVHQDFDTRDQFRGKIGYVMWLDPKAGRKLIRLYRKVKWSHFEYATSRRKSMAKV

SEQ ID NO: 3925 - protein, 319 aa, unidentified
  source 1..319: note = Sedimentisphaerales bacterium; note = Related to JAFGTU010000518.1
MIKRIVDKLRIVEVKHLSMHLGSTPVELAHVCSSISRHPSQYYRWWNKCFPNGKTRPMVEVRGRLREILDRLNDLLQHVCLPEYVNGGVPGRSVLSNAMPHLNKPMLMKTDLANHFPRVSPGRVYAMFRKQQECSPEVARILTRLTTQSGGLPQGSPTSVAVSNLVTLGLSRRLRRFAEARGAVLTQYVDDYIFSGGKRLAGCKEKIISIVKQEGFKANEAKTVSVPADKEQIVTGIRVNGSQMDAPSSKVADVRKAIRRLRCELEVTGSVPTKRIKSIEGKISYIAAYNRGTGKYLRRQLDHIKTPGVRIAGREEIAG

SEQ ID NO: 3926 - protein, 314 aa, unidentified
  source 1..314: note = Related to JADHYA010000193.1; note = Phycisphaerae bacterium
MKRRIYNLRIRDVQHLAKLLSTTPQELHALCDTVASHPKRYYVQWSKPTKKGKIRPMVKIHGRLRAILDQLKSLLHTIALPSHVHGGVPKRSTYTNAIPHLGKPMLLRIDLQNHFPSVSHHKVYAMFRNEQGCTPDVARLLTRLTTLNGGLPQGSPTSTIISNLVTLHLSKRLRGFAQSRGAGCTQYVDDYTFSGERRLAKHSGRIVSIVAQEGFKANPTKTIAVPADCEQVTTGIRVNGKQADVPTSNLKDIRSDLNSLDKQIALGSKSSEKIIKRIEGKIRYVRRWNPGAAKSLTRKLTRITLKPATSASTV

SEQ ID NO: 3927 - protein, 321 aa, unidentified
  source 1..321: note = Related to NZ_JAKWBK010000001.1; note = Niabella hibiscisoli
MAFHQGTTMVCNNLDNYQENGLSPINFMISTKAALYNTLKFTEKHIWYIIKNIAKHYKEKEVDKTKYGKPQLDKNGSIRKRNLRIPTYPLDRIQKTIHEFITAQSAFPDYMYGSIRGRNHIQNAFRHCNNVYFLKVDLKNFFPNISHRQVYGSLVKFGLPHDIARIVTPLTTVEGKLPQGAPTSCIIANLVLQNVARRLHDFARTNNLTFTCYLDDLTFSSKEDFRALNEKILNIIKEEGFFPSPKKISYRKISCEITGIIVKNNTLDLIHEMKREALTNLHIYHYYMSFLKQRDSLFNLSYPNTFSNAFLGAPRNITSPQ

SEQ ID NO: 3928 - protein, 306 aa, unidentified
  source 1..306: note = Related to JAFLBK010000001.1; note = Chitinophagales bacterium
MIKSVHNLYSFLGLTPGELDSITSRITENYYQRSRPKIKYGEFQRDDSGNIKYRDLLIPSYLLKSRQQRIARLLSGITLPVYMFGSIKERSNIQNARQHLNHQYFFTLDLKKFFPNINHRQVNMMLCENGFSFSVSRILTQLTTYQASLPQGAPSSPVIANLVFMPTGNRLNELAKMNNIIFTTFLDDLTFSSDHCFKKRIPEIIKIVKQGGFYPAYDKMHYRKGYSEVTGLFVKGDRLELPYSMNKKTRENHHIKSYKEQVRKYNSVRPCLIKHCKKDLRLFEANKKGHRLVTLAPLQNLPTGGL

SEQ ID NO: 3929 - protein, 303 aa, unidentified
  source 1..303: note = Related to JADKIE010000002.1; note = Chitinophagaceae bacterium
MPQKEMINTLTHLAFELKFKLPEIESIINNIDKFYYEKVEIKPDKFGNPKLKNGVIQKRVLNPSITRLKLLQKNIQRNILLKLEMPDYAFGAVKGKDNVQNAKQHQGKKYIFTTDLKSFFPSINHKRVFEMFRSFNFSPTVARVLTQLTTFKGRLPQGAPTSPTVANLVFVKTGKKLLEFAKENKLTFTSFVDDLTFSAPTDFKSKAQFIIETLQADGFKISHNKTNYKTKMPVVTGVVVKNNKLSLTDNFKIKLNNTEDSTPERIKGLQQYAAKVAKTNSSPLLTAIRQPLTGGLALLGQTW

SEQ ID NO: 3930 - protein, 311 aa, unidentified
  source 1..311: note = Related to JADJTY010000010.1; note = Chitinophagaceae bacterium
MNSSQFKKNEFKKLCATIGFKPAQVEELISKLDTYYKEWVEQKTDKKTGDFKRYKDGTIKQRTIRPSLKELKVIQTNIKTRILAPIALPNSVHGGVKKRSNISNAKPHQGNKYQFTTDLQEFYPNIDFKRVYNTFIGLKFSPHYAHWLTKLTTWKYELPQGTPTSTHIANLVFLETDIKLIDLCNKNGITYTRYVDDLTFSSQQDFRHLLNDILQIVTSGGFKLSYRKTKYSDNQTITGINVFLNKIDAPEKIIEKANAEKNTKFNTKPFTNYLNNIRKTNRAKRKPATNKSIAAIGAGRKPNHQQCISKL

SEQ ID NO: 3931 - protein, 300 aa, unidentified
  source 1..300: note = Related to DMPU01000444.1; note = Chryseobacterium sp.
MNSSQFKINEFKKICSIVCFKPNEVENIAKNLDKYYKEWIEKKLDKKTGLPKKYLDGTEKQRTIRPSQKELKLIQSRIKNKILVPIKLPAEIHGGVKGCSNITNAKPHQGNKYVFTTDLQEFYPNITSQRVYDTFCKLKFSPHFSHWLTNLTTWKYELPQGTPTSTHIANLVFLDTDIKLIELCNANNITYTRYVDDLTFSSQQDFKHLLNPILDIVTSGNFKLSYRKTQYKGKQTITGVDVFLNKIDAPEKIIQKSKIEVDTKADLKPYTIYLNNIRKTNSLRKSLPPTLGLAKVGRTE

SEQ ID NO: 3932 - protein, 316 aa, unidentified
  source 1..316: note = Related to NZ_QPMM01000003.1; note = Chitinophaga silvatica
MIKSLRHLEAVIGYKLKDIDAVLDNLHKYYNSFSRTKKSGKKRDIDSSENILRDLHNRINDRIFSQISLPYHVTGSVKYRSAVLNAKYHSGKKYHFQTDLVGYFQFVSNRLVYSTLVSFGFSADVASYITKITTYKGHVPQGVPTSPFLCNVVGLRILDGEILEFCKSRSIIYTRYIDDLTFSSDVDIKDFIPDILQIINNKNFLYSHRKTIYKAGDIVVTGVLTTCNGLKMPERLIEKMSNEVDIIKRKGYENFANQIQRIHKLGTLNAIVDRQRELVFPGRLKDRKKKNASSAVLDLVSLENKKLEIEREINLY

SEQ ID NO: 3933 - protein, 302 aa, unidentified
  source 1..302: note = Related to JAFDXL010000007.1; note = Bacteroidetes bacterium
MIKSKKIFSLVLGYELKTIDNIIECLEDEQKRGKYYNPYKVKKSGGKFRVIAPSRGELKKIQARIHENIFSHIQLPFYVTGSLKRRSGVINGKIHSGKKYHFQTDLVNFFGFVSYRNVLKALKMLGFSHDVAFYITKLTTYDGHLPQGVCTSPFLANLVGLNIDDAMLDFCKSRNITYSRYVDDLTFSSQSDFKDELKIFLSGIIAQGFIYSYRKTKYKIGSIDVTGTKVTNEGIKGTDKQYGRALLIDTKSSSFKGLVGHLEYVEEINDKFNLTTYRNENIFLRFPTRLFPYMNFKKKESK

SEQ ID NO: 3934 - protein, 312 aa, unidentified
  source 1..312: note = Candidatus Kerfeldbacteria bacterium; note = Related to JACPSJ010000001.1
MGGFDYASSLRLDGLAAALGVTVSFLEKLQIYPGAYYDDFAKKKDGGLRKIVKVDWPVRRLQERLHHNVFGKIKLPDFVECQSGRSSIDHALRHKNQTQIITFDIESYFPSITYRRVRQTLAFFGFNQLVSAVIARITIRDGSLPQGTPTSTDIANFVGTFLDRRLLGLCEKHNWVYSRYVDDVAISGFKNMGWAKKLINKIIISEGFRISTKQGGLSVTMVKDVPLVTGVRINKTFIQAPKEYYRSVRQKIYLWQKFGYESAYPGFSKKQSISKLHGKVHYLMYLDKVSKRFNGQGYQLFKQFQKLHKDPA

SEQ ID NO: 3935 - protein, 305 aa, unidentified
  source 1..305: note = Related to WODC01000002.1; note = Pseudodesulfovibrio alkaliphilus
MSLPSSLTKWTPSLVTPPDPLCPIVGIKSPKSLARILGYPLSQLEELCGNIESNYHKKEITKKNGAVRVLSVPSGALRKVQTAILRQLQKHPLHPAAYGAVQRRCHIDNAKRHAAAPYVYCLDFSSFFPSISSNRIYKLLAEQLGCSPPVSNILTKLTTYKYKLPTGSPTSPVLTNILCFPLDNRLNSLACDYGLTYTRFIDDLTFSGRRIPEGFIRKTKEIITSFGLLLNDEKEELFTPYKGKLVTGINVNTNKVRVSRYYKKSVRAQKHQFGLFKDYMTDSEKSKEESRIDGKEQYIRLVQRR

SEQ ID NO: 3936 - protein, 302 aa, unidentified
  source 1..302: note = Related to nan
MSHLHFPINTVSELSTLLSMPIRDLWRLAKNTDKSYFTWKEPKSSGGFRSLCTPDSRLKEVQKKLHKLVFSKIIHSRFSHYGLKKKSNVTNASEHYGNDVIFAFDLKSFFPSIRPERVRKALIDEVGCPAPLASLITKLVTLNYQLPQGAPTSTDIANIVTFRLQRRLYSLAKQWGIKKFTIYADDITFSGNNIPHGFMKLAKKVVREEGYKIHPEKGGVFDKSGNQIITGINITHGLTVGKMNKIWRAERHQNFLQYLKGQLPTTEFDSSEKRFNSRIVYSNFIKKSGLKVADNYLSSAYK

SEQ ID NO: 3937 - protein, 466 aa, unidentified
  source 1..466: note = Related to AMFJ01036084.1; note = bacterium (gcode 4)
MEKWCILPNNLIQKLNKDDVIVASLTRFCKCSTDELFAVLKNRSKENRWWWYGYTQYTKNNGKKIRTISVPRKNLKKIQEAIKDRLDQIPVSLASTAWKIGDSAEKNIELHKHNLYLLSMDIKNAYPSITTHRVYKNLQWALPLKYRCPQLITDEDKDIFIRTITHLCVHDNQLPQWASTSGQIQNIVFSSLDIQIEKKIPELVWSHMVYSRYADDMAISFPHFSTLEILKEKMEKYIQTLKKHRERRSILLDEFSKDTFIVTDNFEQKYLQKKIEDIKELMKWSWLPDEEIYKHIGTLDAYKKNIKYSTWRISDIHDEILKVIWWEWRKINNIKTNMRTPQSDREREINGITLDEEGNKWLNKRKRAQYLKIFNHLIKHSQNDLKGFTFYREKFNTLENFDICSSTITQIIDGIYHRIARIYGTGRIPKPLHEAYQKAKHKRSSHEIYLTYLPNNSDTNNEELLF

SEQ ID NO: 3938 - protein, 321 aa, unidentified
  source 1..321: note = Related to JAGCVL010000005.1; note = Candidatus Saccharibacteria bacterium
MRNNEIRTLKRLCSLLHLKEEYILDLASRANSCYYSYDKKSRKKDGTAKIRHIDSPNIELKNIQKKIDSAIIKPYVNLLPDYIHGARTGKSIVTNATNHAGYEAILSLDIENCFPSITSKRIYYIFRNTIHCSDKVASVLTTLTTKDGVLPQGCPTSASLCNLVLVQMIEKLSEIDGSLDYNISHYIDDIFYSGRYCDLQKIRKPAMTEIGKNGFRPNTKKTLLVKNGRPMKVTGITVNTKVSAGRRRIRKIQRKILKITEKDKAEYDIVLKNRKRNNNSKIKACKIEKLFGEISNVISINKEQGYKLKKKIEAKLNDLIT

SEQ ID NO: 3939 - protein, 326 aa, unidentified
  source 1..326: note = Phycisphaeraceae bacterium; note = Related to JAHBWW010000006.1
MRQEPPTIRRPLEPRVVTIQQLAALVNLPVNQLDRFVLEAPKLYSSFEVPKPNGKTRTIRPPARPLRDLQRMLLEVLQECVRYPRWLMGGVPKRSIFDHAKPHVGWKMVATFDVKAFFPSTRSAMIRPVLERIGISDAAADAVLRLVIKDDELPQGSPTSGFLANLTLEPADRRIDALCRRHGLNFTRYVDDMAISGNTDLTKFQGAIVEAVKESGYEVAPEKIHYMDRSKTQLITKLRVNDKIRPTREFIAEVKADIWECLNVGAAVVAIERGVQLHRLKSSLTGKVSHIRSADREAGEKLKGMLYGVDWNQQLHTKFDVPSLTA

SEQ ID NO: 3940 - protein, 317 aa, unidentified
  source 1..317: note = Phycisphaeraceae bacterium; note = Related to JACKHF010000001.1
MRAEPPVVRYNRSLQISTLDQVAGWVGVELSPLSDTINRASTMYSCFEIKKPNGGSRTIRPPNKVLRTLQHNILRELQSMVRYPRWMMGGIPRRSIFLHAGPHVAKRMVATFDVKSFYPSTNSCLVRSVLERLGFSGEALDAMVQILIKDDELPQGGPASGLIANLALEPADRRIDAICRKHDLRFTRYVDDIAISGEHDLRVYQGAIIDAIGLCGYEVAPDKIKFMGKEQCQVITKLVVNEQLRPSKSFIFEVKAKIRECLANGAFVVAVEHGISVPQLKSKLNGKVSHIKQADQRLGKSLQRKLNGVNWSRQLPD

SEQ ID NO: 3941 - protein, 318 aa, unidentified
  source 1..318: note = Pirellulales bacterium; note = Related to JAHBXR010000005.1
MNMLSQHTMQQNDWPPPISTRERLARTLNVSPVVIGEFVAEPARWYSQFTVPKPSGGNRIIQPPKKPLRRVQRALLRLLYSRLQVPPYLHGGVPKRSILTHARSHLGRKMVATLDVKNFFPSTQQKFVQPIFEMAGIVDEALTDALAITMLAEGLPQGAPTSSLLANLAFVPVDKAVIALCRSRNLSFSRYVDDIALSGNVDFRELKGPLIDRIHAAEYEIAEHKVRFMPASERQVVTGLVVNQKLRPTAEFVATLKSDIRVCLGHGVDFLADSEGISTRGMRMRLSGRAAHIAAADPKLGKRIRGMLCGVKWTTASR

SEQ ID NO: 3942 - protein, 319 aa, unidentified
  source 1..319: note = Related to NZ_CP036270.1; note = Symmachiella dynata
MPIQLHATRKAANLVSNLDGLGKLLGFPVVRLNAVIECPSRHYSSFDVPKKNGGVRTIEPPHRPLREIQRSLLNRLYRRIKIPKHIHGGVPRRSIFTFARPHVGKSMVATLDIKDFFPSVGPSHLEPVFFQLGFRGEALNAVVSLTMLRDCLPQGAPTSCLLANLSFSNADASFNAVCRKRNLLYGRFVDDIAISGNVDFGELRGTFLGIIEAKDFQAAEDKIHFYAQSQRQIVTGLVLNEKLRPTREYVASLKQRIHNCRTFGPTFIANSDGLTVRKLKNSLTSSARFVGQSDPKLGKKLRGLLCSVAWGASTNRFSD

SEQ ID NO: 3943 - protein, 348 aa, unidentified
  source 1..348: note = Related to JAGQOA010000100.1; note = Planctomycetes bacterium
MSYRHLLKPGARRAEALVDVDGLARACGQDATRLRRLRENLPSAYGRIERPKPKGGFRIIRPPRQDLKEVQRGLLDWLETRFTAKPWMHGGVAQRSIISHAQPHCGKAMVAVLDVRDFFGSVRRERLAALLTAAGLEGEALETLLDLVTLDDTLPQGAPTSCLLANLAFFPADQRFRRVSAKRGLVYTRYLDDLALSGDEDFKELRGPLVEALTLEGFQVAAEKVAFMGRHEPQVVTGLVVNDRLRPTRAFREALIAEINDCQIEGLGARSDRLGTNPQRLRARLLGQIRHLARFDPAPARRLERRLRSAPGGRATQSSRARRRTSKASSSSSAYLAQESSEPPSRRA

SEQ ID NO: 3944 - protein, 327 aa, unidentified
  source 1..327: note = Related to nan
MHYELLRRRPAQDALADVSDLARALLLPRKGLCELAENTESHYIEIRIPKRHGGLRRIHAPDPSLKKAQRAVLRLLEDRMVPKSWMHGGVTGRSIVTHAAPHCGRCWVAVLDLADFFPSVRRSRVQAILEAAGFTGDALKVLLALTTLGGALPQGAPTSSHLANLALFPLDRRLRSLARRWGLTYSRYLDDIALSGKRPLRPLKGPLHDAVIREGFRPSPSKTAFMGRHEPQVVTGLLVNDRLRPVKSYRRALVEEVEACRQDGPKVRAALQGISVARYRSRILGRIRHWARFDAEKAERLERRFRHLPRPGAAARETDGREKVGLR

SEQ ID NO: 3945 - protein, 302 aa, unidentified
  source 1..302: note = Planctomycetes bacterium; note = Related to JACKGY010000008.1
MWRVLNDDFAHWSPRRLAELLGRDLDRLVQLTEGTAGRYRAIRLPKRGGGHRELAVPEPELKALQHDLMVLLDRALEAPPWVLGGRRGRSFVDHAARHQGRSWLLTVDVADFFGRIGPALVAPVLREFGLPEASITLIVALAFRHGALPQGAPSSPLLANLAMAPIDLRLRRLARRRGLAFSRYFDDLAFSGDRDFGELRGPIAALLRQAGLPLAEHKTRYTGRDRPQVVTGLVVNDRLRPTRSFRGELEEELRLLQGGALPRPRLEARVEGRLHHLARFDRREADRLRRRYGRALPSSSSS

SEQ ID NO: 3946 - protein, 310 aa, unidentified
  source 1..310: note = Related to MFNO01000025.1; note = Candidatus Levybacteria bacterium RIFCSPHIGHO2_01_FULL_38_26
MLKIVPLKLNSIAEIENILGFSFDKIKKIVENKNNFYSKVSIVIKGKMRILDIPNSSLKIIQGKLAHYFGENVVWPYYVQGGVRNRSVKTNARQHSGKKFVLNLDIKDFFPSITTKMVKNSLMELGLNQKVSTLISELSTYENRVPQGSPSSTYVANMFFLKIDKLINNFCKKHSLIYTRFVDDLTISGKNNIFPYKGTIIQYIARNRLIVSEKKTTIRSSSEKQIVTKLVVNDKIRPDKKYILTLKKDIRETWKGNEGIRKVALKNNITMPKVKGNLWGRTNYIRQFDKKIGREVRALLVKSNFVDVSS

SEQ ID NO: 3947 - protein, 323 aa, unidentified
  source 1..323: note = Omnitrophica WOR_2 bacterium RIFCSPHIGHO2_02_FULL_52_10; note = Related to MHGR01000114.1
MKLLKFLFDITLNLTIHPHKSLKPHQIQTEQDVARLANQEVSALQEIISNKEEHYGFFRQEKKDGTLRDIHPPRKKLKLIQRKIKKFFDHFPWPRYVQGGIRKRSILSNARLHCGKKMVAWLDIRKFFPSTNPSMVLESLEKIGIGKAASKLIVELGTYKNALPQGSPASVSLANLVFLDADDRFELFCKKHRLIYSRYIDDISISGDIDFRPHKGQFLKFIEQKGYVVAKDKIDFIGRDRPQIVNNLVVNDKVRPNKDFINDLKNDIRCCWTEEGMELLAADFGLLPRELQRSLWGRINFTKQFDPKLYKDLKAIMIGAFFK

SEQ ID NO: 3948 - protein, 313 aa, unidentified
  source 1..313: note = Related to JAAZNU010000228.1; note = Veillonellaceae bacterium
MPEKRTEGIKQITQECVATLESILKNKSALYYEFKIPKKSGESRVITPSKPPLKNIQHRINKYFARKQFPACVHGYVRNRNVLTNAQSHVGKKWVITIDLKDFFPSCDTIKISQAFLNIFSNDQTINLLTELVTFNNQLPQGTPTSPIISNLVLHNLDQEFVRLSKKHGFTYTRYADDLTLSTNGKNPHDFLKAFTDIITSNGFKINPDKLKVMPCSARQIVTGFVVNKYDGNGFLKPTKKYISDFKILIRNCYQLNMFQQIAADQGKTVPKLKRSIEGKILYIKHANPALAREISNLRYPLKPSATEITVNI

SEQ ID NO: 3949 - protein, 383 aa, unidentified
  source 1..383: note = Related to JADJQZ010000001.1; note = Candidatus Obscuribacter sp.
MTHQDSKLTIDDIGNKLGVTPQFLLEAASAASTQYELFDLPKKSGGTRTICSPKNELKRLQRTILEELLHTFAMPDYVHGCVKGRSIVTNAKPHTNKPLVLTIDIKDFFGSINPEQINRIFRISFNCDDKSAEVLTALTTYGTFLPQGAPTSPALANIAALPLDAAILDICEQSGLQFSYTRYVDDITISGDNRLALMLASFYKTVSAHGFTASPGKLRVGRPSNRQKVTGIIVNKKMAPPKKLIRKIRQQLYYCEKFGIEDHCRKEGIEEQEFLNQINGMLGFIRLTQPTTADLFKIKLTTLQGYTFVSVDESVLLILKHAVEEEKHVNFVYHGSTRKVAPVEVFIDDEGMKFMRGYQTVPEQKWERYMIPDIQSLRLSENA

SEQ ID NO: 3950 - protein, 383 aa, unidentified
  source 1..383: note = Candidatus Obscuribacter sp.; note = Related to JADKJY010000001.1
MTHQKSKLTIDDIGKRLGLTPQFLFEAAKTAETQYELFDLPKKSGGARTICTPKGELKRVQRAILEELLQQFEMPEFVHGCVKGRSIVTNAKPHVDKPLVLKIDIKDFFGSIKPARVLEIYKDIFDCDEKSAEALTALTTYGNFLPQGAPTSPALANLVALPLDRTLLDICEQSGLQYDYTRYVDDITISGDSRLGQLLAAFYKAIQHHGFIASPGKLKVSRPCNRQKVTGIIVNKKMAPPKKLIRKIRQQLYYCEKFGLEDHCQKEGIEEEEFLDRINGMLGFIRLTQPVTADLFKSKLTRLQKFELVDQDESILLLLKLAVEEERHVIFSYHEATRKVAPVEIFIDDDGFKFMRGYQTMPEPKWERYLIPDIRSLRIFEKL

SEQ ID NO: 3951 - protein, 404 aa, unidentified
  source 1..404: note = Cyanobacteria bacterium SZAS-4; note = Related to JAFEAT010000019.1
MTSNLSLTLTDLCDELELPSQFVLDLANSAEDEKRYHSYKRLKKSGGARYINASVGSLKRLQRSIHERILSRHKMPEHLHGGIKGRSIVTNAAAHVGKKLVINIDLTDFFSTIKVAVVKQIYMRDLHFDDETATVLAQVSTFKGALPTGAPTSSALANLAGLVVDDAVISTLTKKIERTEFGYSRYVDDITISGDDRIVEILPDIFEAVKSAGFTCNDKKTRILRRSTRQWVTGVVVNRKLNPPKNIVRKIRQYLYYMHRWGVEEHCETHGINPYRFMRQITGYIAYVRLTQPELADEFLRSLKPHLARFHQVDEESAPSTLNILKVMIDKEEIAHFLYDREDRAVNHPSYEPVAVSVAPESLDVDDDGTLTMRGFELAPKQRWGIYHLESISALSDKPLTDVT

SEQ ID NO: 3952 - protein, 438 aa, unidentified
  source 1..438: note = Related to MEZY01000015.1; note = Candidatus Berkelbacteria bacterium RIFOXYA2_FULL_43_10
MHSLALEAVIADLGKENCRAALTLLAEMVGVERQAILDCLELLNRHGEVEDGERVVAYTSFYRPKKSGGKRLIIAPVEPIKDLLRKVKDEILCRSSLPRFVHGYRTRRSWLTNARVHFDAGAVYAINLDIKDCFPSTKIQLVRRVYWQTTGRMLRDEGIPEEVARAAVEILTALSTLKYGRSKVPVLPVGSPTSPALVNLVLTPACIRIARALKRLPGEYAFSIYGDDLTVSSREPLPPEVKMIVLREWQRLGYRANPGKTRVMRRDGSGTPIEVTGLILGRDRILLPDDWLQRTELMLIAYAGSPKYPGDKAKRGLQSRVSMVRKLYGVEMPGRVGNCLKSLIAQAKSNLVMRERLAELLRGKMPEVVEGSEEAPEPAMEQAVEQDRDWRTEYGPVPQSMDARGQLFWDFDDDSPGGADDPFVPEHGQLEQGEWEGE

SEQ ID NO: 3953 - protein, 310 aa, unidentified
  source 1..310: note = Burkholderiaceae bacterium; note = Related to JAIESO010000413.1
MNSKQAMKWADIRPILQSSEGLSRHLSVSEDTLFRLSRTASRLYTRREIEKGRILNLPSGELKRIQSLIHKKILLFAPYHASIHGYRKGRSQRSAAEPHQDKPMLLKGDIQKYFPSISPDAVLKAFRQLGISYQVSKLLVDLCTHEGQLPQGAPTSPLISNLIWSRPARRIRGFADQHGFDHTIFGDDVFISGACRAKKFKNLLKRIIREEGLSVSERKTQALPCTTRQVVLGLVVNKNLGVDKDVRRDIRQVIHNYVSKGFSDPLGSNLRAAKTSLAGRIAHIKHINPSQGQKLQREFKRINWEEGASV

SEQ ID NO: 3954 - protein, 301 aa, unidentified
  source 1..301: note = Related to MSXM01000005.1; note = Nitrospira sp.
MKWGEVRAHLQSIDSLARYLGVGKDTLFRLCRTSSRCYVRGEEPKDSGGVREFYKPRGELKEIQRLIHKSILLFAPSHEAIHGYRKKRNQRTAAMPHLKKDMLVKADIKTFFPSVKPKQVYDAFMGIGLPHCVADMLTKLCTHADQLPQGAPTSPMVANLLWLRPARRIQGVADKHGFGHTILGDDVFLSGKKRAAKYKSFLKRVISEEGFRANDRKTIAVSHNGPQTVAGLSVNQKVNVPKAYRKALRNEIYRYALSGEDENGLARQKGRASLEGKIAYVKQFNSLQGAKLQQKLAAGRK

SEQ ID NO: 3955 - protein, 302 aa, unidentified
  source 1..302: note = Related to WIAI01000061.1; note = Nitrospira sp.
MFDSRLATVEELSVLIGVPSGELIYFATAIEKNYRRKVEHKPDGDTRIFFVPSPGLKKIQKCIHRRFLRKLPVHESIHSYRRRRDTISNASVHVGKQILAKLDIKKFFPSILPQRVYRVFLSRGCSPSVASLLTKLTTFENQLPQGPPTSPGIANQVLTPLAKRLKGVCDQHNLTLSIFADDIFVSGSEHVPQVNNLLKRIVESEGFTFNLRKTEMRWPGEKKIVTGISVTARINIEKGYYRKVRALVHHAANHGYMHLFPGVTPLSAKDKLQGMIRYISRLNASKGHQLQIKSLQIADATK

SEQ ID NO: 3956 - protein, 332 aa, unidentified
  source 1..332: note = Related to PHGD01000001.1; note = Nitrospira sp.
MRSNNCFSKSKVFVWPIWARSLDNHVQDGIPLADLTDLSDLARKLSVTETDLQAIAQTHSLYYRRKDKVKPDGRRRTFYIPHGDLKKIQGAIAKKLLAPLPLHRAIHSYRKGKSTLTNARVHLGSPFMVKLDIEDYFPSISRDHVFKLLGRLEFSGPIARMLAVLTTFKNQLPQGAPTSQAIANLVFDEIIKKRIAPLCEAHNLEVTVYGDDLTISGSKRIVGLKRLLETIIKEEGFKVSTKPSKNQLLREHDQKMVTGYVLRGDKLDVPKSRYREVRAIIHNCLKNGGASQFDCDVKTAKLRLRGKIEYIRKVNPLRGGKLMRDFERISWM

SEQ ID NO: 3957 - protein, 303 aa, unidentified
  source 1..303: note = Related to JAGRAM010000124.1; note = Bdellovibrionales bacterium
MSLKVPPSSIPSLGQTLGLPDGALEACIRDLPGLVSRCPKRKPSGSMRRVYAPRDPLHDIQQRILHKLLRPIEHSSELHGSVVGRNPKTNVTPHVGAFVSISMDITDFYPSISKARVNRIWIDLGYSRRVAQALTHLTTFDQHLAQGFPPSSDIANIVLEQDLLPRLRPLCSQHHLTLTMYQDDLTISGGARLRSLGNLIQRILLQSGYPVNVDKTRISNPGQRHMSTGLVYNTKPNIPKERYRALRGELHRCLTNGVITEAVDRPIWQYKHHLASRIEHVRYHNPSRANNLQIVFDRIDWGI

SEQ ID NO: 3958 - protein, 329 aa, unidentified
  source 1..329: note = candidate division Zixibacteria bacterium SM1_73; note = Related to LJVD01000036.1
MKCTKIIINQTNKEEGILRINTIDELAERLGHSPGELKRIANTKIRYYKVNEKIKPSGKLRTLYEPMGPLSKILKLIKERLLDGIELPECMHGYRTGRDYISNACVHVGKNIICKLDIKNFFPSIHHGRVFNILMDLGCSKQVAKLLTRLVTCDNHTPQGFNTSPTLSNIVVSNLARRLQGLCNHYRLTLTIYSDDITISGNIEQKKFEGLFYKELLPIIEEIIKQEGFSLNFGKIKLVKRRDSQKVTGIIVNKKPNIPKQKRRELLSTIKEYQMNGVSISHDSDLLKVKQSLRGKIANAQRVNRSFGQLLLREFEKIDWSRRVSFSSN

SEQ ID NO: 3959 - protein, 511 aa, unidentified
  source 1..511: note = Related to JACNLI010000952.1; note = unidentified bacterium
MLKNTLNIQSIEELAEKLDESPEYFKSISKRIPKLYYSPTKRKKPKGGVRKTNEPINKLKSLQSKILRNILESVPLNSCIHGYRKNHSPLTNAKPHVGKKFLLKLDIKDFFPSIHYKRVEKLFSDLGCSLEVSRMLTQLTTFQHYLPQGAPTSPYISNLIPANVDKQLQKICRRNNLPPHKRYGDDITISGNKNFSKLIPEIENTIKQNGFKISKKEFLTPKDRKVVTGLIVNTKVNVPKEKVRKVCAIIHNCIKYGPDSQNREGKPNFKDSLRGHVEYIRSINPPLGDKLMQEFNKIEWNSPEKITISSVSIENNEVVEIFVDGATSPNPGPSAIGWIAFRKENKLEEYFEYIGCTTNNIAEYTAVIRALEAAQSKWPQEKIIIRSDSELVVNQVNGSWNINQQYLADLCKQVKKSGKDTEWQLLWVSRKENLAHKLSMRGLYEEKIKARASGLAVRKSSPGIYKVESASGHGMYDVTLAPDSCTCLFFQKRKCVCKHIFAARIAGKADN

SEQ ID NO: 3960 - protein, 327 aa, unidentified
  source 1..327: note = Related to JAKLQW010000066.1; note = Candidatus Omnitrophica bacterium
MDGKISEFAGSALYSLTYKIGYNEEKLRYILSHFREQYYKRKELDKKGKKRIISSPSKNLLKLQRLILAYISKKTLFPETFHGYKKKRSNLTNARCHLNKRVITKLDIKDFFPSVHFKKVLALFGSLGFNEQESKILSRLTTADYCLPHGFSTSPTLAALMLINLDKRLKTLFMKIGLDYTYTFFSDDITISGNKGIKTLKKLICKIFRQEGFIVNESKIKEQNFWEKQEVTGISVNEKLNVPYDYRHNLRAIVHNCITLGPRTQIDRFNSEFCLDRKLDLSLSKFRERIFGKINYIKPINRELYNQLLAYFNKINWRTNNPVSVLV

SEQ ID NO: 3961 - protein, 319 aa, unidentified
  source 1..319: note = Related to MHGQ01000042.1; note = Omnitrophica WOR_2 bacterium RIFCSPHIGHO2_02_FULL_50_17
MCAVNERNYFDTPSIQSVAEKLRLSANALHEVLDKFHTHYRKKSETKSGKTRTYHCPFPVLRDIQKRINKYILKAIPLPSSMHGYVAKRSILTNATVHLGKKNIANVDIKSFFPSIHYQRVQRIFRQIGFNEGETLVLTRLTTADCCVPHGFPTSPRLANLVLINADKRLRDLFGQQKINHTFYSDDITISGNKNLRQLLQPIRTIFRQEGFRIHRKESSPQKPYFKRQKITGLLVNNKRLNLPREDIRSLEAIIHNCLVKGPSSQIAEFEAHFGPPKRELSTVQKFKERVLGKLNNVRRVNCDQYKKLKKDFDRIDWN

SEQ ID NO: 3962 - protein, 300 aa, unidentified
  source 1..300: note = Related to DPTL01000176.1; note = Elusimicrobia bacterium
MCEQSIITNLKTVEDIAFTIGVDEFQLREISQNIPLHYKQIYIRTSPTKIRKISKPNEKLKAIQKLVNKRILQRIPLPDSVHSRKKRSILTNAEQHVGKEVIVSLDIKDFFPSISSLRVNQLFKKIGYNSEASAVLTRLTTLDGCLPQGAPTSPSIANLIITDMDKRFETLCAEQEFTYTRYTDDITISGDQYVRKFLPLFCKIVRQSGFLVNEKIKVEPRSRRQETTGIVVNVRPNIPKEKHRKISAIIHRCKTFGPSSVTNEDLSKFRERLLGHISYMSHINPTLGRRLLNDFNHIAW

SEQ ID NO: 3963 - protein, 303 aa, unidentified
  source 1..303: note = Candidatus Brocadiales bacterium; note = Related to JAFNKF010000236.1
MSLVVIGSDFHSPEELVEFLGLDYSEIQHILQTLSYQYRPLLIPKAEDEWRKLLAPKRELKHTQRVVLDMLLDDVPFPDSIHGYRKGRSILTNAEPHIQQELVINIDIENFFPSVHPERVKRNFLMLGYRDPVAKFLVRLCTFNHQLPQGAPTSPALANLAISRTMLALEKFCKKRGINFTGYSDDLTFSGPQAIEKHIETLMSIIRENGFRVNKNEIKIQPSSQLQEVTGLVVNDKVNLNKSLKKKVRAMLHTARTNGPESLHRDNKPYRKDQLLGLILHTKNVDQKLGEKHLKEFYEIDWE

SEQ ID NO: 3964 - protein, 305 aa, unidentified
  source 1..305: note = Related to JAENIR010000027.1; note = Parcubacteria group bacterium
MKKIITHKNLCKDIKTTDDFCRILSLEKSFVQKHIRLCPLLYVEIPLKKKDGTPRPIRAPKDKLKIIQRAILKNILSDIKLPPCCYGFSKNKSIIENAKVHSKNDFLLNLDIQDFFPSVHYKKVQQIFLDVGLNDQIAGILCSLTTYEYRLPQGAPTSPFLASFALSNLDYRLMQLAKSNYLTYTRYFDDISFSGNKRVVVLEKDIMRIIKEGGYVVKIKKRKLFTKKEVKEVNGILITDKKLSLKNTDELFNYVSDINKYGLSKLQTDNPEKERQSIKGKIAFLKQIDETVTHSIETIFNKINW

SEQ ID NO: 3965 - protein, 304 aa, unidentified
  source 1..304: note = Candidatus Zambryskibacteria bacterium RIFCSPLOWO2_01_FULL_42_41; note = Related to MHWC01000010.1
MIIRNLSKRVETIDDFCHLILLDKLYLQKLVRLCPLHYIEIPFKKKDGTPRPIRAPKEKLKIIQRVILDNLLSCIKLPPCCYGFSKGKSIIENAKAHLRGDYLLNLDIKDFFPSVHYTKVEKIFLGMGLDRDFTNILCNLTTHEYKLPQGAPTSPKLASVVLHNLDYRLLKLAQSNHLTYTRYFDDISFSGNKRIITLEKDILRIIREEGYSVHTSKDKKKLFAKNETKEINGILLKDKKLSLKNIDELFSYVENINRHGLSRLITDNPEKERQSIAGKISFLRQIDPERSHKLKVLYDFIEWL

SEQ ID NO: 3966 - protein, 336 aa, unidentified
  source 1..336: note = Related to LBPL01000006.1; note = Parcubacteria group bacterium GW2011_GWC1_34_10
MDQEIDFDSHEDLPVLPPHSSPFCWRCFVFMKKILQIQKSKSSIDTREKLISFLGLKKEKFEECFKVIPLLYELTPILKKNNAGYRKLSIPKQELRDIQRCVLDKIFTDIKLPSCVYGFSSGKSIVENAKYHSKNDYLLNLDIKDFFPSVHFERVRQIFKDLGFNDSVSEILCILTTYNHELPQGAPTSPLLASLALNNLDKRLMKLASLNHILYSRYFDDISFSGSKRILDIEETIKQIIRSENYRINSKRYLYGKGEAKEINGISISSGKLFLKNTDDLMGYLEDLKNFGVSKLRSDNPEKERKSLIGKISFLKEVDIEKGVEAKNLLETIKWL

SEQ ID NO: 3967 - protein, 307 aa, unidentified
  source 1..307: note = Related to MHNL01000005.1; note = Candidatus Ryanbacteria bacterium RIFCSPHIGHO2_01_FULL_48_27
MKKIYPQTFSRFKDLRIELLPNLFGVRDMEFYRVSSNAHFLYRPIEIKKKSGGVRQIYAPSGRLKFLQRRILSKLLEKVRLPPFVFGGVKGKSIINNASCHLGSKYLLNLDIENFFPSVNWQLVRKLFIDLGCDSSVADVLTRFTTLDYRLPQGAPTSPYILNLVLSNLDRRFFLLACSNRLTYSRYFDDITISGGKRLIGLEESFLEILRQEGFTINLKKKYLYGPSEDKKVTGLVLKSGGRMELVSMSGLLKYLNELITEGLSNLDGINLEKEKQTLLGKIEFVKSIDKVDGQNLNTLFNKIKWV

SEQ ID NO: 3968 - protein, 379 aa, unidentified
  source 1..379: note = Related to QMZE01000001.1; note = Archaeoglobales archaeon
MTHGFSNTEVVMIKTPDIPEDMPFLIDDCTLAFFLGFNTRILWYAITRKDELYTRLTIPKKSGGSRVIHAPDKVMKLFGKRILERLLNPLQKQLGDHVTAYREGRSTQMAVEQHVPECPICDTAPPGTEHDCPHRGTYFNLDLKNFFPSTRRVWIRQYFKQVIGYSHYVSDLLASLVTVYAFTDSSGYQFSGVPQGNPASGAICNLVADWMLDTPMLALIDDLNKEQGLEGEYAWKYTRYADDLAFTCGKRFSYYKRMAILNKLMNVCTRSGYAVNHTKTRIWDGRHRKALLGAVFNTHTNIPRDQYISVRSLTYNCWKHGFESQCSRAGKDSEEELRWWLLGRINYMEQIHSGKGQQLKSVYNAAVQKYDKNKTHPTA

SEQ ID NO: 3969 - protein, 385 aa, unidentified
  source 1..385: note = Related to QNCB01000002.1; note = Planctomycetes bacterium
MTYGFTESTFETITVPDTEFLLLDDCTLAFFIGFRNKTMWHLLQNKSDQYKVFHIPKSNGKKRIIHAPSPLMKVFLHRLHARLLLPLQEQLGDHVTAYRPSRSIVDAVSRHIPACDICDTAPKGQTPQQHTCPKQGVYIKMDLKNFFPSTRRAWIRHYFQSIGYSFHVSGLLANLMTVPIKNSKGIDDDKYRGTPRQQFFHGTPQGAPTSGAICNLVANHRFDQRILEYFNDRNKREGLESPWDWRYSRYADDLTITCGQDIPAAEKKEIAKDVTQIVESSGYKINRAKTRIASAFYRRKMLGIVMNQKPNIEYNEYLRIRAIVHNCMVSGIETQHERAGMTTPEELLQYLRGKVSFIRQVHSDKGDKLKAELDVAIDNWKAHDK

SEQ ID NO: 3970 - protein, 346 aa, unidentified
  source 1..346: note = Related to PFIR01000325.1; note = Armatimonadetes bacterium CG_4_8_14_3_um_filter_58_9
MPSYRETRVDIVEFPLEVPYELPHAIDDMSLAFHLGIRNSTMWWMIHDKKKMYKVFKLPKRGRPGRYRNIQNPIDVLKNVQKNILSRFLSAVPVMAHIGAYVPGRSCRDTAAQHVGKGVIVSLDIQDFFPSMRRSMVKQCLHRKIGYGYRVASLLAELMTYTNFVPQGAPTSGLIANLVAHDRFDRQILRDLKELDPQWTYTRYSDDIDLSHPEVQEPDRLTAIIALVRDAVESAGFKLNQRKTKVEPHWKRQKVLGMVVNERVNIPRYEYMRTRSIIHNCLVDGFDNQFERAGMNSASGLKSHLRGKLAFFRQVDPIKAQRLKDQFDLACQMHADVQDNEVRFDS

SEQ ID NO: 3971 - protein, 345 aa, unidentified
  source 1..345: note = Related to NZCM01000006.1; note = Pseudomonadales bacterium
MSSYKETELSYIDLPSDSCLQTTWPWLLDDFALALQLGIRCKTLWFCITTKDKQYKRFTIPKRTGGRRPIHAPEPVIKWIQQQIHERILKPFPILDCVGAYVEGKRCADSAQVHVGAGVRIGMDLKDFFPSHGRARIRNFFKRHYGYNHQVASLLADLCTVREGAHHYAPQGSPASPMLCNMMAQETLDREIMRVLGPHGWAYTRYSDDLSLSHKDDLPSKEVNQAIKQVTKISKESGYRINLKKTKVQRRWRRQQMLGIVTNEKLNISRPLYRQYRAILHNCLHQGVEVNALRFGWDPPESFISHLEGKISYFASISETRGGKLKTMLHEVKRALEEENAQTHP

SEQ ID NO: 3972 - protein, 372 aa, unidentified
  source 1..372: note = Related to PCRT01000055.1; note = Candidatus Moranbacteria bacterium CG23_combo_of_CG06-09_8_20_14_all_41_28
MELNQLQQQLSSQNPVYPQLSLYPVASPLFTIQTNRQLALKLKMKFANRLTYVGMNKLNHYSTLSIRKRGAAGKYRTLYNPDQPMRLIQFKILKEILEQVQVPDYLYAFEKGRSIPAMAQKHVGKKVIVSVDLKDYFQSIKQYHLNQVFKHLGFGEKPALLLSELCTYKSFVPQGALTSPKLSNIITTYTFGPLIKEYCEERGYTLTIYADDITISSDSLIDDMGSDTVHSLISYLKETVGRFGFRVNSEKTKVMKYYQRQYVCGAVVNSKVNLQKSERNTLRAIIHNCEINGIEAEASKTQITEDEFISAMNGRLNWFNQLNPQAGSHFINQFKEIYGRSTANVRNSQDVRVEELVSQGVNNVEVQQAQTA

SEQ ID NO: 3973 - protein, 421 aa, unidentified
  source 1..421: note = Related to nan
MIKKIIERFLSIFKREGTTSEKELPETEHKPELHTNLPSINPIKTSHKSSVTQNLLKERLKEDNILLLGHLVSKDEGKSNLKIPGIPNFNTISDVLEYFEKEYKIKKSKLANFASFSSKTNQFYIERKILQKSSKIGNKARYIYIPKPFVKFVQKVILKDILEKVETPPQLVGFTKNKSIKDAVVSHVKKDVVLILDIEKFFQNTTAKKVFNIFKNIGYSREVSLFLTALTTTKVKVENKKGFKGKRALPTGSPTSPYLSKLALIDFVAELNELIKKWQNMPIKDVDFSVYADNIIISFNTENKEKRKEISKGIIENLQELLKKHGYKLNKEKTKILTKKKKVLGLVINEKINIDRNYYRKLRAEIHNLWKNKQRFGESSFQIDEKLIQKIRGKLNYLKLINPSKYNSLFIKYSTHLEELF

SEQ ID NO: 3974 - protein, 389 aa, unidentified
  source 1..389: note = Related to nan
MLKNIFNYIKKILKLENKNKTKSVYLSGLKIKTTDNLKTNPLEYFKSEERKLLEVNSSINPDIPYFPSIKEILKYFNDNYKVLPKMLINFALFNTKTSDFYIEKRIITKNKERYIYIPKNFTKKIQKIIKKDILDKLTFPEEICGYIKNKNIKLAVEKHVKKDILILIDIKNFFPGIGRIKVRKAFENLGYPSDVAAFLTALTTTKIKYQEDNKIKTKCALPIGSPTSPTIANLIITNINNQIKNYFKTLQNDNNISSIDHTIYADNIIISFNTSLKGQDLKNITNKIIIELKKIIAKNKLKINDSKIRVLKKRKIVLGLSINQKININKKYYKNLRAEIHNLSFNKNKLTKEKIETLKGKLSYLNFINPNKYNNLYKKYHTRLSEIFQ

SEQ ID NO: 3975 - protein, 1018 aa, unidentified
  source 1..1018: note = Related to WJKO01000099.1; note = Candidatus Lokiarchaeota archaeon
MNSINYSTKYKFVDDNLFLIAKINPKTKKQCLVFQQIDKESRNVIFSRQLTCIHTAVTRISIADYESMINDDSERKKFNNNLLNIISTENLEPIDLELDEKYFAFKSWVQGIAESGLSAILIQDEIERMALINNPISIFLSSCLIKAEPDFIDDYLALIKQSCKNKDIWNKGNENRDNWHRSSLIASVDRIITIIKELDETELLVETVYKLIKFYITESLPTCVINFILEKFDFNILGDLLAELEYDWIVKIYNDSQLEERNRDLIFSFRIETDSEFVNDYLEVIKKEANIKIKRDNSGKEDDRGENPSLKKKVKKIIYVINHIKKEQSRRELSYKFFKLYFTESLPLQVMILIFENINSYTLSNILDNLENDWIKKILNDYIQSIKIKCKNNYEQRESDKIYESWNKQSLRYSISIILTFIERMENPKKRSEVLYSVFKFYFTECLPVYVLNYIFKTVKKKFLREVLSDLERNWVITAYNTPDLKKEHKFLIFSFLIATDSEFLNDYLKVIKLCNSGKDHNRENVSSLKKSVKKFIRVINDIENYRIKKKLLYKLLDLYFTESLPSYILRLIFDTMNKKNHSNILDLMQNMPNNWIVAIHNIEDFYNKKCLFNQFCRKHDLSDLLFIQDYSIWNSTMSHRWRVFDVLKHIDREEINKKARKNNIDSFFIRNCITKVKSKKNTIEELVKHKTKVPKIGSIYEFCVLANYNPKKLKRWLAPQISLHKSYIEKKIPKRKGGYRTLHIPYPKLKRIQVWIKEEILDKLPALQCATGFIKNKSTKNNAKPHCQKKLIIKMDLMDFFPSIKFWQIYRIFRSLRYIHEISIVLTYLCTVPLAKHITHKGNQKEYFLETSFRFLPQGAPTSPGLSNLVLIEADKELQNLTKSLNMSYTRYADDLTFSVNDSEFKIRPFIQKVFNIVRKHHFWVNKKKIKILRPYMQQRVTGLVVNKEVHIPRSYYMRIRGILHKLENYGSEMPLEERKTLKNMVSGMIAYMHSIQPRKAEKMINWYNRIKINVSK

SEQ ID NO: 3976 - protein, 452 aa, unidentified
  source 1..452: note = Related to JAAFKL010000269.1; note = Candidatus Heimdallarchaeota archaeon
MIAKKKVKKSKIEKLPVRVKKMLNIGLWSYEVQVPDDQTLERLHLLDRDIIKRKKDIHIPETGKKQIYRQAEKQYDKHSSKKRSERKKLAPIRQIKKKEDWEEFKKVNFVHLGTSVSNWLNLRVENTDKLNKVGLPSISDSHQLAKLLGISIAQIKYFAYHRKSSQVNHYVDFYIPKGKRGRRLISRPKKELENIQSIIKKEILDKISFSDAVFGFIPGKSHINNAQEHVKRDFIINIDIQDFFPSTNFYKVRSIFRNLGYSGEISSVLALLTTKQDTRSITIGEDQYHTFTENRYLPQGACTSPTLSNLALVKVDNQLIKRSIELGYKYSRYVDDLTFSINKPISKIKTLLYMVRKTLEYHGYEANPHKTKILGKNNSQNITGLVINSGESNVPRYWRRRLRAAVHQFQYIKDDEIKSIELVRLLGCINYLKISHSRLAQNYFELVTKYYQ

SEQ ID NO: 3977 - protein, 334 aa, unidentified
  source 1..334: note = Related to JAAYWD010000064.1; note = Thermotogaceae bacterium
MKLNDFNDVSCVLGEELKMLTYLKKLKNRLYTSYYIKKRNGKREINTYLYKRRLSDLEDDIPQLHGYELAKLSRASEKLEEIHRKIDSRILDEIELPECVNGFKKGESIKKAVQPHVGNDYVACLDIHNFFPSVKSDYVLEGLQSCGIGADAAWLIARLVSYKGHLPQGAVTSPKASNIAFMKVDKQILELSRSKGITYTRYADDLVFSANFELKDFVEEAIQLVTNAGYTINSQKIKFYGPKEPHYILGIIANSKLNMPRDKRRNLEAAIHNYVDKHLVPAGVNEIRYKKTLLGKAAYMLSINPNLGRLQKLVMKLREFDPNGIEFERIYLGD

SEQ ID NO: 3978 - protein, 343 aa, unidentified
  source 1..343: note = Related to NZ_AP014509.1; note = Thermotoga caldifontis
MNAEAVALEIQEPLKKLTYLEKIRNRLYVEYYISKRSGGKREICVYLCDSKEAQARLKNKLRTLKKNDAELEKLVRAAQELKTVHRKLKELLDRIPLPDCVFGFRKNESIVTCARKHVGKKYVISLDIKDFFPSVTSDMVLRQLKREGFEDTGAWLIARLVAFKGVLPQGAITSPAASNVAFKPYDEKLQKYFEERGFVYTRYADDVTVSTDQEVTDEMIQQIVEETSQIIAPFKWNAKKIKIYGPNEPHYVLGLIVNAKPNVPKQKRRLIRAMVHNFVRKHALPQGEDPIRYKRKLMGKLAYCLFVNPHIESLLELYEELRKFDPNRVSEWKSLYVSEEEGE

SEQ ID NO: 3979 - protein, 320 aa, unidentified
  source 1..320: note = Related to nan
MQKIGYANRLNLPRKLLTYLEKIRSRLYADYYLRKKDGSKREIAVYVCDSRIASQLDEKLVEYSKVLKLVHRRIKNLLDETIDLPDCVFGFKKNCSTKIAASKHVGKKYIFSVDIKDFFPSITSDMVQQALMNEGVEQNDAWLIARLVAYKGRLPQGAITSPTVSNVVFKPKDLQILKLCERYGLTYTRYADDLTFSTNDEINWVEFTDELEKILQPEYRINTKKLKIYGPKQAHYVLGLIVNRKVNTPKSYRRTLRAAVYNYLNGKVPYGVDPVKYKATLKAKLGYALYINEIPSLRRLYEQLKRFDPNEVKNWEHIVV

SEQ ID NO: 3980 - protein, 307 aa, Vibrio parahaemolyticus
  source 1..307: note = Related to KK081893.1
MRLIKQLAQELNKSEIEVSHFLLNAPKKYKVYTIPKRTSGHRTIAQPSRELKEYQRKYLELQQLPIHDVAMAYRQGVSIKQNAIAHKNNPYLLKMDLENFFNSISNILFWEVWESIQPLPSKQDKKVLEQLLFWCPSKITGGALILSIGAPSSPLVSNFFMYLFDCALSEKCGEKNITYTRYADDLTFSTKSEGVLFDIPKLVEELLHEKFGNHIKINRKKTKFSSKAHNRHVTGITLSNDGKLSLGRSRKRYIKHLVHQIQVGCLSDEDILHLKGLLAFAEHIEPTFLQALKKKYSVELITQIIKG

SEQ ID NO: 3981 - protein, 307 aa, Aeromonas sp.
  source 1..307: note = Related to NZ_JTBG02000005.1; note = Aeromonas caviae
MGLIKQLAQNLCKSEAEVAHFLLNAPKMYKVYTIPKRTSGHRTIAQPSKELKEYQRKYLELQQLPIHEAAMAYREGIGIKQNAIAHKNNPYLLKLDLENFFNSISNLLFWEVWKSIQPLPSSKDQKALEQLLFWCPSKITGGRLVLSIGAPSSPLVSNFFMYQFDCTISEICRHKNIVYTRYADDLTFSTKIKGILFDMPNIVKDHLSLHFGDAININKKKTKFSSKAHNRHVTGITLNNDGKLSLGRERKRYIKHLVHQVKLGCLENEDKQHLVGLLAFVKHIEPMFLESLKNKYSVELITKIIEG

SEQ ID NO: 3982 - protein, 310 aa, Vibrio sp.
  source 1..310: note = Related to AAXMWT010000001.1; note = Vibrio vulnificus
MSLIKQLAQKLNKSEIEVSHFLLNAPKKYKVYTIPKRTSGHRTIAQPSKELKKYQRKYLELQQLPIHEAAMAYREGISIKQNAIAHKNNPYLLKLDLENFFNSISNSLFWKVWKSIKPLPPRQDQRALEQLLFWCPSKTTGGSLVLSIGAPSSPLVSNFFMYHFDFDISEICRKKGITYTRYADDLTFSTKNKEILFELPQIVKEHLEEHFENSIKINKKKTRFSSKAHNRHVTGITLNNDGKLSLGRKRKRYIKHLVHQVQIGCLSDEDRLHLKGLLAFAKHIEPMFLQSLKKKYSVDLITQIIEDSNG

SEQ ID NO: 3983 - protein, 307 aa, unidentified
  source 1..307: note = Related to PZOH01000095.1; note = Photobacterium damselae
MSLIKQLAQKLNKSEVEVSRFLSNAPKKYKVYTIPKRTSGHRTIAQPSKELKEYQRIYLEVQQFPLHKAAMAYREGISIKQNAMAHKSNPYLLKMDLENFFNSISNNLFWNVWEKIKPLPLPQEQLIIEKLLFWCPSKTTGGSLILSIGAPSSPLISNFIMYQFDTVINQMCVNKNITYTRYADDLTFSTKGKGELFDIPKVVEEYLFEIFGNAIKINKKKTAFSSKAHNRHVTGITLNNNGNVSLGRQRKRYIKHLVHQFKLGCLSEEDRLHLRGLLSFSKHIEPMFLQSLKKKYSVELIDQIIRG

SEQ ID NO: 3984 - protein, 310 aa, Vibrio sp.
  source 1..310: note = Related to NZ_RSFA01000069.1; note = Vibrio pectenicida
MTLIEQLALELKKSEDEVARFLLSAPKRYKVYTIPKRTSGHRVIAQPSKELKEYQRKYLELQQLPIHDSAMAYRKGMSIKQNAIAHKNNPYLLKLDLENFFNSISDKLFWKVWESILPLPSDQDKQTLENLLFWCPSKTTGGALVLSIGAPSSPLVSNFFMYQFDCTLSKLCVEKEIMYTRYADDLTFSTKHKDSLFTLPELIKEKLAVLFGSAIRINRKKTRFSSRAHNRHVTGITISNDGSLSLGRERKRYIKHLVYQVKLNKLDAEDRQHLRGLIAFAKHVEPVFVQSLKRKYSAELITQIVEESNG

SEQ ID NO: 3985 - protein, 310 aa, unidentified
  source 1..310: note = Related to WMCU01000006.1; note = Photobacterium phosphoreum
MTLIEQLALELKKSEEEVNRFLLSAPKKYKVYTIPKRTSGHRVIAQPSKELKMYQRKFLELQNLPIHSSAMAYREGLSIKQNAIAHKNNPYLLKLDLENFFNSISNKLFWNVWESIQPLPSEQDMRTLEKLLFWCPSKTTGGTLILSIGAPSSPLISNFFMYQFDCILSGLCFEKGIVYTRYADDLTFSTKYKNILFDLPILIKEKLSDLFGSSIRINRKKTKFSSKAHNRHVTGITINNEGCISIGRERKRYIKHLIHQSQLNRLDADDRQHLRGLIAFAKHIEPMFFQSLKRKYSAEIITQIVEESNG

SEQ ID NO: 3986 - protein, 307 aa, unidentified
  source 1..307: note = Related to WOBA01000001.1; note = Aliivibrio fischeri
MSLIKQLAFSLKKNEDEVIRFLLNAPKKYKVYTIPKRTSGHRVIAQPSKELKIYQREYLELQQLPIHDTAIAYREGISIKENAIAHKDNQYLLKLDLENFFNSISNHLFWEIWESIIPLPLKSDKQILDNLLFWCPSKKTGGNLVLSIGAPTSPLISNFFMYKFDSIVSKACLEKNITYTRYADDLTFSTNYKDTLFEVPLFIKKQLTALFGNSIRINRKKTKFSSKAHNRHITGITINNDGKLSLGRKRKRYIKHLIHQFQLNTLGKEDKLHLKGLMSFAKHIEPIFIQSLVKKYSFELITKIMEE

SEQ ID NO: 3987 - protein, 310 aa, Vibrio sp.
  source 1..310: note = Related to NZ_CP051108.1; note = Vibrio fluvialis
MTLVERLALELKKSEGEITHFLQSAPKRYKVYTIPKRTSGHRVIAQPSKELKEYQRKFLEIQQLPIHGSAMAYRKGISIKQNAIAHKNNPYLLKLDLENFFNSISDKLFWEVWGAILPLPSNQDKQTLENLLFWCPSKITGGALVLSIGAPSSPLISNFFMYQFDCALSEFCAEKKITYTRYADDLTFSTKNKDTLFVLPEFVKEKLSELFGSSIRINRKKTKFSSRAHNRHVTGITISNNGNLSLGRERKRYIKHLVHQVKLSKLNSEDRQHLRGLIAFAKYIEPVFIESLKRKYSEDLITQIIEEPND

SEQ ID NO: 3988 - protein, 310 aa, unidentified
  source 1..310: note = Related to NZ_MUFR01000019.1; note = Salinivibrio costicola
MTLIERLALELKKSEDEITHFLQSAPKRYKVYTIPKRTSGHRVIAQPSKELKEYQRKFLEIQNLPIHESAMAYRKGVSIKHNAIAHKNNPYLLKMDLENFFNSISDKIFWKTWESILPLPSSQDKKTLENLLFWCPSKKTEGALVLSIGAPSSPLVSNFFMYQFDCAVSNFCSEKEIVYTRYADDLTFSTKHKDSLFFAPSMVKENLRELFGGTIRINRKKTRFSSRAHNRHVTGITIANNGSLSLGRERKRYIKHLVHQAQLNKLDIESRQHLRGLIAFAKHVEPVFLKSLKRKYTSELITQIIEESNG

SEQ ID NO: 3989 - protein, 314 aa, unidentified
  source 1..314: note = Related to JAKRFY010000043.1; note = Pseudoalteromonas sp.
MELEMTLIEQLALKLKKSEDQVAHFLLSAPKRYKVYTIPKRTSGHRVIAQPSKELKEYQRKYLELQKLPIHDSATAYRKGTGIKQNAFAHKNNPYLLKLDLENFFNSISNKLFWEVWESILPLPPEHDKQALERLLFWCPSKTTGGALVLSIGAPSSPLISNFFMYQFDCALSKLCVEKEIMYTRYADDLTFSTKHKDSLFALPELVKEKLVEHFGSAIRINRKKTRFSSKAHNRHVTGITISNNGNLSLGRERKRYIKHLVHQVQLNKLDAEDRQHLRGLIAFSKHVEPLFVQSLKRKYSAELITQIVEESND

SEQ ID NO: 3990 - protein, 310 aa, unidentified
  source 1..310: note = Related to NZ_FLRB01000014.1; note = Marinomonas gallaica
MTLIRKLALELEKSEDEVANFLLNAPKRYKVYTIPKRTSGHRVIAQPSKELKEYQRKYLGFQKLPIHDSALAYRKGISIKQNALAHKNNPYLLKLDLENFFNSISDKLFWKVWASLLPLPSSQDRQTLKNLLFWCPSKKTGGPLVLSIGAPSSPLISNFFMYKFDSIMSKFCSEREIVYTRYADDLTFSTKHKGSLFQLPEVVKEMLSELFGGAIRINRKKTRFSSKAHNRHVTGITINNNGDISIGRKQKRYIKYLVHQVELNRAGREDIEHLRGLIAFASHIEPMFIQSLKKKYTTEIISKIIEGQNG

SEQ ID NO: 3991 - protein, 310 aa, unidentified
  source 1..310: note = Related to JABSRB010000040.1; note = Oceanospirillaceae bacterium
MSLVKQLSLGLNRSEEEVSRFLLNAPKKYKVYTIPKRTSGHRVIAQPSKELKRYQRQYLEIQKLPIHHSAMAYRQGISIKENAAAHQKSRYLLKLDFENFFNSISSHVFWKVWESIHPLPSELDRQTLEKLLFWCPSKKSGGPLVLSIGAPSSPLVSNFFMYHFDCHLSQICLEKEIVYTRYADDLTFSTNHKDILFDLPLLVKEQLVTLFGGTIRINRKKTRFSSKAHNRHVTGITINNNGKLSLGRERKRYIKHLVHQVKLKKSDKEDRLHLRGLLAFAKHIEPLFMQSLIKKYSAELILKIVEEPND

SEQ ID NO: 3992 - protein, 310 aa, Pseudomonas sp.
  source 1..310: note = Related to NZ_JAEIOI010000003.1; note = Pseudomonas anguilliseptica
MTVVEQLALVLKKSPTDVTLFLNNAPKKYKVYTIPKRTSGHRVIAQPSKELKIYQRKFLELQDLPIHESAMAYRKGLSIKNNANAHKNNRYLLKLDLENFFNSISSELFWKVWGSILPRPPETDKRTLENLLFWCPSKTTGGRLILSIGAPSSPLVSNFFMYKFDGAVQVLCAEREIKYTRYADDLTFSTNQKNTLFELPRLIEIQLMTLFGSEIRVNRKKTKFSSTAHNRHVTGITISNDQKLSLGRSRKRYIKHLVHQYILNKLDPEHTQHLRGLLSFAKHVEPSFLHSLAKKYSTELIVKIVESRDE

SEQ ID NO: 3993 - protein, 310 aa, Pseudomonas sp.
  source 1..310: note = Related to NZ_FRBQ01000002.1; note = Pseudomonas punonensis
MSLIEKLASALKKSEAEVLIFLKNAPKKYKVYTIPKRTSGHRVIAQPSKELKEYQRKYLELQDFPIHNSAIAYRKNFSIKDNANAHKKNRYLLKLDLENFFNSISNHLFWRVWESILPMPPEADKRILENLLFWCPSKTIGGRLILSIGAPSSPLISNFFMYKFDDAIYEICMEREIKYTRYADDLTFSTNRKNILFELPHLVETLLFSLFGSAIRINKKKTKFSSTGHNRHVTGITISNNQKLSLGRDRKRYIKHLVHHYMLEKLSNEDTQHLRGLLSFAKHVEPLFLHSLENKYSTGLIHKIVEGRDD

SEQ ID NO: 3994 - protein, 307 aa, Pseudomonas sp.
  source 1..307: note = Related to NZ_JACKQK010000005.1
MSVIEKLALALEKSEAKVIAFLRNAPNKYKIYTIPKRTSGHRIIAQPSKELKLYQRKFLMLQKLPVHKSAMAYRNGLSIKDNAELHKRNRYLLKMDFENFFNSISSELFWSVWKNTIGTPTDLDKYTLERLLFWRPSKNTAGRLILSVGAPSSPMVSNFLMYKFDCLVHEICASKEITYTRYADDLTFSTCHKDVLFEVPALIEANLEHLYDGALRINKRKTKFSSMAHNRHVTGVTINNKASLSLGRSRKRYIKHLTHQFVLDKLSSDDRLHLRGLIAFAKHIEPTFFQSLVKKYTAESISKIIED

SEQ ID NO: 3995 - protein, 310 aa, unidentified
  source 1..310: note = Related to NZ_FRDS01000164.1; note = Moritella viscosa
MSFIKQLAQKLNKSESEIEHFLVSAPKRYKVYTIPKRTSGHRVIAQPSKELKTYQRAFLDIQSLPIHNAATAYRTGLSIKENALAHKNNQYLLKLDLENFFNSISSRLFWKVWQSILPKLASEDKTLMENLLFWCPSKATGGPLVLSIGAPSSPLISNFFMYHFDIAISQFCSENKISYTRYADDLTFSTNQKDLLFSVPTFVGEQLKNLFGNGIKINRKKTSFSSKAHNRHVTGITINNEGKLSLGRERKRYIKHLVHQYQLNKLNQEDIFHLKGLLAFAKHIEPKFINTLKSKHSDELITRIFEEQND

SEQ ID NO: 3996 - protein, 310 aa, unidentified
  source 1..310: note = Related to NZ_WEIA01000002.1; note = Pseudoalteromonas maricaloris
MELIKKLATKLNKSESEVIRFLASAPLKYKVYTIPKRTSGHRVIAQPSRELKEYQRAFISLYRLNIHDAAMAYREGLSIKDNAKLHCKNRYLLKIDLESFFNSITSELFWTIWQQHYEMPNNDEKVLMERLLFWSPSKSSTGKLVLSIGAPSSPLLSNFFMYQFDELVTQHCESLEIKYTRYADDLTFSTKAKNVLFDMPRYISDTLTNLFGSALIINRRKTAFSSKAHNRHVTGITIDNESDLSLGREKKRYIKHLVHQYRLNKLDKENVFHLKGLLAFAKHIEPKFITSLEIKYSAEVITQIFEERNG

SEQ ID NO: 3997 - protein, 310 aa, unidentified
  source 1..310: note = Related to JAERPS020000004.1; note = Rheinheimera sp.
MEFIATLAAKLSKSEPEVVSFLASAPLKYKVYTIPKRTSGHRVIAQPSRELKEYQRTFLSIYKLKIHSAAMAYREGLSIKDNAQAHCKNRYLLKIDLKNFFNSISNELFWNVWQQHYTLPAKREKVLMERLLFWSPSKSSKGKLILSIGAPSSPLISNFFMYQFDELVTQQCETLNITYTRYADDLTFSTNEKDILFDIPKAVTEFLTLLFGNSMIINRRKTVFSSMAHNRHITGITINNKSELSLGRERKRYIKHLVHHYQTKQIDQETILQLKGLLAFSSHIEPDFIKRLEAKYSSAVISQIFEEQNG

SEQ ID NO: 3998 - protein, 310 aa, unidentified
  source 1..310: note = Related to NHNK02000003.1; note = Marinomonas agarivorans
MSLIKKLAKKLEKSEAEVATFLANAPLKYKVYKIPKRTSGHRVIAQPSKELKKYQRAFISLFKLTIHNSAMAYREKRSIKDNANKHKHNPYLLKLDLENFFNSISSELFWKVWQAHYPIPQTEDKVFMEKLLFWSPSKSVYGKLILSIGAPTSPLLSNFFMYQFDHIIHDLCVHREIIYTRYADDLTFSTKHKGALFNMPDLVTEQLRKCFGEAININRRKTAFSSKGHNRHITGITIDNNDNLSLGRERKRYIKHLINEYKFNKLGKEDINHLKGLLAYAKHIEPSLMTRLEHKYSTELMTQLFEENYE

SEQ ID NO: 3999 - protein, 310 aa, unidentified
  source 1..310: note = Related to JAESQF010000097.1; note = Oleispira sp.
MSFLEELASVLQKSEAEVEGFLEGAPKKYRTYKIPKRTSGFRTIAQPSKELKEYQRAFLKIQSLPIHNAAKAYRKNLSIKDNATVHKSSRYFLSMDLENFFNSISSDLFWRVYSRHFDSFSGQDKRVMESLLFWSPGKSNKQGLVLSVGAPSSPLLSNFFMYTFDLIMSNYCDETNILYTRYADDFTFSTNDKNILFSVPEVVKGFLEKCFGRGINVNKRKTVFSSKAHNRHVTGITINNNGDLSLGRERKRYIKHLIFQYSINKLEEGMLQHLQGLLAFSNHIEPMFIFTLNEKYTKELMLRISEERHV

SEQ ID NO: 4000 - protein, 310 aa, unidentified
  source 1..310: note = Related to NZ_AULO01000011.1; note = Marinospirillum minutulum
MSFLRVLASKVNKTETEVIQYLANAPLKYKVYTIPKRTSGNRVIAQPTKELKEYQRAFLQIKSFPVHQVATAYCLGLSIKDNALSHKANSYLLKMDLKNFFNSINNNLFWKIWAVNKKLPEAKDKELIEKLLFWSPSKSLQGKLILSVGAPSSPLLSNFIMYSFDEHLFKACNKLNVTYTRYADDLTFSTNKKDILFKVPNLVAEQLRFEFGSSIIVNRKKTKFSSKAHNRHVTGITLNNNQAISLGRKRKRYIKHLVHQLLLNKLTVDDINHLKGLLAFAKHIEPTFILSLEKKYSLAKITHIFEAENE

SEQ ID NO: 4001 - protein, 310 aa, unidentified
  source 1..310: note = Candidatus Enterovibrio escacola; note = Related to NZ_RPGH01000128.1
MEIVRSLAQKLNITEQEVSSFLASAPLKYKVYKIPKRTSGFRIIAQPSKKLKEYQRAFIELFPLACHQAAYAYREGISIKDNALIHKKSKYLLKIDLENFFNSITNELFWDIWQKNSVLPDLNEKVLLERLLFWSPDKKISSRLILSVGAPSSPSLSNFFMYDFDESLSRYCLEKKIRYTRYADDLTFSTYEKGILFEIPDFVSHILRQLFGDKLSINRRKTIFSSKAHNRHVTGVTLSNEESLSIGRQRKRYIKHLVHQYLLNKLDQDDVSHLKGLLAFAKHIEPDFLDRLKAKYSDKTISQILGERNG

SEQ ID NO: 4002 - protein, 310 aa, Chromobacterium sp.
  source 1..310: note = Related to JAHDTB010000015.1; note = Chromobacterium subtsugae
MGIIESLAGKLDKSPSAVKKFLASASLKYRVYTIPKRTHGYRLIAHPSKELKKYQRAFLELMPLAIHPCAMAYRKGLSIKDNALAHVDKKYLLKLDLENFFNSIDPNIFWKVYHLHEEVCEPSSLGERLLIDQLLFWCPSKRKGGKLVLSVGAPSSPMVSNFCMLFFDVVISKYCKINHISYTRYADDLTFSTNEKGALFKIPELVRDTLFSEFGNRVVLNNAKTKFSSRAHNRHVTGVTLSNSDTISVGRERKRYIKHLVHEYQLGRMNYEEILHLKGLLSHVSHIEPVFINSLAKKYGPDVLKRIHKE

SEQ ID NO: 4003 - protein, 313 aa, unidentified
  source 1..313: note = Related to NZ_CP019697.1; note = Paenalcaligenes hominis
MGIVKQLASELDKSEAEIMAFLSRAPLYYKVYKIPKRTHGERTIAQPTPELKNLQRTFLLLNPLPMHSAAMAYRSGLSIKDNANAHKRNSYLLKLDLNSFFNSITPAIFWAEWDKFFDPLDSNEKTLIERLLFWSPSKSLSGSLMLSVGAPSSPAVSNFVMHGFDTKLDQLSRNKGVVYTRYADDLTFSTRNQGVLMGMPELVTDLLVECFGAALTVNRSKTIFSSKAHNRHVTGITLTNEAKLSLGRKRKRYIKHLVHQFTLQQLGLEDVNYLRGLLSFAKHIEPDFIYALEKKYGAAALIAIYEVNDGGSK

SEQ ID NO: 4004 - protein, 310 aa, unidentified
  source 1..310: note = Related to CP065725.1; note = Oligella ureolytica
MAIVSFLATHLDIPEDQVESIVQRAPLLYKVYKIPKRSFGTRTIAQPTPELKKLQRAFLLTKPLPVHSAAMAYQPGLSIKKNALHHLHNKYLLKLDLLNFFNSITPDILWQEWKQHFEIPPPKEKKHIENLLFWAPQRKPNTHLMLSVGAPSSPNLSNFILYRFDERLQNLCKKLNITYTRYADDLTFSTNTRYALFSIPEQVAMLLNELFTGRININKRKTIFTSKAHNRHVTGVGLSSENKLSLGRAKKRYLKHLVHQFTLSLLADEEISHLQGWLAHAKHIEPTFIESLTNKYGQDIIHKIFETNHD

SEQ ID NO: 4005 - protein, 349 aa, Aeromonas sp.
  source 1..349: note = Related to NZ_CP083625.1; note = Aeromonas enteropelogenes
MVAIVSPPNLVPRLGGETIASSSKELSPRAKSWAFLWTVLMGVIEQLASALGKKDEDVIDFLVTAPRKYKVYTIPKRSVGHRLIAQPSQELKIYQKKYIELNPLPVHDTAMAYRQGLSIKENAKAHQKNSYLLKMDLENFFNSITTDVFWQEWLAFYPQPSDVDSIILERLLFWAPNKKLDGKLILSIGAPSSPALSNFIMHRFDEAVVNNCVAIGVKYTRYADDLTFSSNTKDILFTLPGLIENILMMLFNGAIRVNKRKTIFSSKAHNRHVTGVTISNDNNISLGRERKRYIKHLVYQYMNGKLEKDQVNHLQGLLSFAKHIEPNFITSLNIKYTHKIIHSIMSDKQ

SEQ ID NO: 4006 - protein, 310 aa, unidentified
  source 1..310: note = Related to FO818637.1; note = Xenorhabdus bovienii
MTVLFGLVKTLGISEREAITFLSDAPKKYKVYSIPKRSSGHRIIAQPSKRLKEYQTAFLKCCLLPVHPSAMAYRQGLSIKDNANYHKDNQYLLKMDLENFFNSITPNILWESWNKKELFIDDNDRKILQRLLFWCPSKKNSGKLVLSIGAPTSPAVSNSFLYNFDEELYNFCLKYQIAYTRYADDLTFSTNQTGVLFTVHEMVKKLLIKHFDRQITLNHGKTIFSSKAHNRHITGVTITNDGKLSIGRQKKRYIKHLVYQFELGVLSIEDICYLQGLLAFAKHIEPLFIPRLVQKYSKETLKNIFDIGSS

SEQ ID NO: 4007 - protein, 356 aa, unidentified
  source 1..356: note = Thiotrichaceae bacterium; note = Related to CACVAY010000001.1
MFSHSKLVSLLLPPLECKNIAVFSKEPMSKLVTSLGFLSRALKMKTILEFASRTEQSPDQVMRYLKSASKKYKVYSILKRTHGRRIIAQPAKELKQYQNIFLDTHSLPVHSCAYAYKKGVSIKENAQQHVENNYLLKMDLENFFNSITPDILWNQWEDHFGWKFQSIEKVLLEQTLFWSTSKKLNRGKLVLSVGAPSSPALSNLCMYSFDRELQEICQTYGVSYTRYADDLTFSTQLKGRLIKFPDYVENLLNKHFSKKILINNRKTVFTSKAHNRHVTGITLANNGVISLGRKRKRYIKHLMHQFILGNIDDEERMHLRGLLAFSNHIEPSFISTLRNKYGNDVVQRVSEVINEK

SEQ ID NO: 4008 - protein, 307 aa, Vibrio sp.
  source 1..307: note = Related to AAXMUQ010000002.1; note = Vibrio alginolyticus
MKIISQLAKYLNKPEDSIEDILLIGPERYKLYYIPKRTHGVRLIAQPSRELKEYQRAFLSFYKFPIHDCAMAYREGISIKDNAIAHKNNSYLLKLDLENFFNSINPIIFWDVWQKLELSNLSANEKKWIENLLFWNLHGDLVLSVGAPSSPTISNFCMYIFDSILTYHCNNIGITYTRYADDLTFSTNEERVLFKIPSVVETMLYDCFEGKLCLNKGKTAFSSKAHNRHVTGITLTNEGKISLGRSRKRYIKHKIHQFSLGKLDNYDIMHLKGLLSFARHIEPKFYDSLLNKYSKELVLSIFEANYE

SEQ ID NO: 4009 - protein, 307 aa, Vibrio sp.
  source 1..307: note = Related to NZ_CP022741.1
MSIISLLAQTLKKPEYVIEDILFIAPIRYKIYYIPKRTHGFRQIAQPSKELKECQRAFLRFCNLPTHNCAMAYREGLSIKNNAIAHKNQAYLLKLDLENFFNSITPNIFWHTWELTGAELPTKDNQQWIEKLLFWNLEDKLVLSVGAPSSPSVSNFCMLIFDQILQDQCQNLGIKYTRYADDLTFSTNEKDILFKIPESVENILSKCFNGNLRLNKGKTIFSSKAHNRHVTGITITNSGEISLGRSKKRYIKHKIHQFSLDLLNNHEVMHLKGLMAYARHIEPSFHESLIIKYSKEIIERIFEVPNE

SEQ ID NO: 4010 - protein, 320 aa, Chromobacterium sp.
  source 1..320: note = Related to NZ_MUKV01000069.1; note = Chromobacterium haemolyticum
MAQDSHLGPFPLGKLMGIIYQLAEKLEMSELTVKKYLANAPNKYKVYKIPKRTYGFRIIAQPAKELKKFQRAFLDVFDLPVHNSALAYRKSISIKDNAILHCKNAYLLKMDLENFFNSITPDLFWKEWNKTLKILPRTEAQWLELLLFWRPSKKRNGKLILSIGAPSSPHISNFCLFNFDIIMSTKCEALGITYSRYADDLTFSTNKKNILFTIPKFVDSILTASFDGKLTINKNKTVFSSKAHNRHVTGITITNDGNISIGREKKRIIKHLVHNYKIGTLPPEEIDYLKGLLAFSGHIDPTFIDSLKKNIQQRLSKKYI

SEQ ID NO: 4011 - protein, 313 aa, unidentified
  source 1..313: note = Oceanospirillaceae bacterium; note = Related to PBYJ01000041.1
MSVIEKLALTLDKEQREVERFLVNAPNKYKVYSIPKRTHGSRVIAQPSKELKTYQRAFIDLYEKYLPIHDNSFSYRKGVGIKQNADVHKKNPYLLKMDLESFFNSIVPSMLWEEWERSIGNTPNAREKMWIERLLFWNPSKRSGGKLILSIGAPSSPMISNFVMHSLDKVLSVECSEKGVSYTRYADDMTFSTRNKDTLFIFPELVSNIIKSLFGNRISINRSKTVYSSKAHNRHVTGVTLTNEGRLSLGRDRKRYIKHLVFEFREKRLDIDTFNHLKGLIAFAKYIEPDFIIRLEKKYSTRLIKKVMDGDYD

SEQ ID NO: 4012 - protein, 313 aa, unidentified
  source 1..313: note = Related to NZ_FTMN01000018.1; note = Marinobacterium stanieri
MSVLEKLAITLGKEQAEVESFLLNAPNKYKVYSIPKRTHGNRIIAQPSRELKKYQRAFIDLYEVYFPVHKNAFSYKKGIGIKQNAEVHKNNPYLLKMDLENFFNSIVPNMFWEEWERSIGDTPNKNEIKWIERILFWSPSKKSNGKMVLSIGAPSSPLISNFVMHSFDKILTSECEKKGVSYTRYADDMTFSTKNKNTLFSLPETVSNVIRGVFGNRVSINRSKTVYSSKAHNRHVTGVTLTNEGKVSLGRDRKRYIKHLIFEYQKNNLDAEKFNHLRGLIAFARYIEPCFIDRLENKYSARLVKKVMDGDYE

SEQ ID NO: 4013 - protein, 310 aa, unidentified
  source 1..310: note = Related to NZ_WHZZ01000002.1; note = Photorhabdus khanii
MSVINRLATSLHQNELEVRAYLENASGKYKVYRIPKRTTGFRIIAQPAKMLKEYQRAFLQLYRFPIHDCAMAYQKGKSIRDNALMHAHNPYLLKTDLEDFFNSITPDIFWQCVEQTSVNVSLFLPEDRRYVDQILFWKPTKRSTRLMLSVGAPSSPIISNFCLHEFDQLIHEICRNLDIVYTRYADDLTFSCNVRDVLGSLPSMIETLLNKLFKKKLRLNRGKTIFSSMAHNRHVTGVTLNNKGKLSLGRERKRFIKHLINQYRYGLIDESDKAYLVGLLAFASHIEPEFIIRMNNKYSTELMDRLRRQQ

SEQ ID NO: 4014 - protein, 310 aa, unidentified
  source 1..310: note = Related to NZ_JAFBFW010000005.1; note = Pantoea coffeiphila
MSLINRLATSLQQSELKVNAYLEGASGKYKVYRIPKRTTGFRIIAQPAKALKDYQRAFLQLYRFPIHECAMAYQKGKSIRDNALAHARNPYLLKTDLEDFFNSITPDIFWQCVERSSSSELQFQLADRRYVDQVLFWKPTKRSTRLMLSVGAPSSPVISNFCLYEFDTLINEYCRELDIIYTRYADDLTFSCNTREVLKSVPAIIETLLNKIFSKKLRLNRGKTIFSSMAHNRHVTGVTLNNEGRLSLGRERKRFIKHLINQYRYGMIDESDKAYLVGLLAFASHIEPDFILRMNDKYSYELMDRLRRQQ

SEQ ID NO: 4015 - protein, 310 aa, unidentified
  source 1..310: note = Related to NZ_LMLK01000022.1; note = Erwinia sp.
MSVINGLAGLLNQSELDVVLYLQSASRKYKVYKIPKRTTGFRIIAQPAKALKDYQRAFLQLYRLPVHKCAMAYQKGKSVRDNALVHAQNSFLLKTDLEDFFNSITPDIFWESIERSPSDTPQISAEDKGYVEHLLFWQPAKRSKRLILSVGAPSSPVVSNFCLYEFDNLISEFCLPLNIAYTRYADDLTFSCNTRDVLGVLPLIIEKLLNKLYRRKLRLNRAKTVFSSMAHNRHVTGVTINNEGELSLGRERKRFIKHLINQYRYDMIDEADKAYLVGLLAFAKHIEPEFILRMNRKYTTELMERIRRQQ

SEQ ID NO: 4016 - protein, 310 aa, unidentified
  source 1..310: note = Related to CP063241.1; note = Pectobacterium brasiliense
MSFINKLGVNFNQSPLELKVFLENAPSKYKVYKIAKRTGGFRIIAQPVKALKVYQRAFLQLYNFPVHGSAMAYQEGKSIRDNALMHARNPYLLKTDLEDFFNSITPDIFWKCVELSSADAPQFSVEDRRYVEKILFWQPAKRSKRLMLSVGAPSSPVISNFCLLEFDKLISHECRELGIVYTRYADDLTFSSRIPGVLSPLPAMIEQLLKKLYKSKLRLNRSKTIFSSMAHNRHVTGVTLNNEGGLSLGRERKRYIKHLINQYKYDAIDESDKAYLIGLLAFASHIEPAFILRMNDKYSTELMDRLRSQQ

SEQ ID NO: 4017 - protein, 308 aa, unidentified
  source 1..308: note = Related to DAFWUX010000006.1; note = Klebsiella variicola
MSVINDLGRCLNQSDLVVKAFLENAPSKYKVYRIPKRTTGFRIIAQPAKELKRYQRAFMGTYRFPVHECAMAYQEGKSIRDNALAHAHNPYLLKTDLEDFFNSITPAIFWQCIESCPVDAPQFQDEDRRYVERLLFWQPAKRNKRLMLSVGAPSSPIISNFCLLELDRFLCEECERLGVSYTRYADDLTFSTSLPGVLSAIPALIESLLKRLFNSKLRLNRNKTLFSSRAHNRHVTGVTLNNEGELSLGRARKRFIKHLIHRYDKLDEADKAYLVGLLAFASHIEPEFIIRMNAKYSTEVIDRIRRQQ

SEQ ID NO: 4018 - protein, 310 aa, Citrobacter sp.
  source 1..310: note = Related to UFVV01000001.1; note = Citrobacter koseri
MSVISELAMLLNQNEQDLRAFLKNASSKYKVYKIPKRTLGFRIIAQPAKALKECQRAFIQRYPLPVHACALAYREGKSIRDNAFIHAQNSYLLKTDLEDFFNSITPEIFWQCVDASHDGAPVFDGSDRVDIERILFWQPAKRSQRLILSVGAPSSPAISNFCLYDFDRLLSESCQTMGVAYSRYADDLTFSCSMPNVLRTLPAIIEALLNRLFNRRLRLNRGKTVFSSKAHNRHVTGVTLSNEGLLSLGRERKRYIKHLINQYRYDLLDEEDKAYLVGLLAFASHIEPEFILRMNAKYSSELMDRIRRHK

SEQ ID NO: 4019 - protein, 311 aa, unidentified
  source 1..311: note = Related to NSCM01000023.1; note = Photorhabdus bodei
MSVISGLATLLHQSESDVRLFLENAPRKYKVYRIPKRTTGFRIIAQPAKRLKEFQRAFMQLYLFPVHESSMAYRKGKSIRDNASAHANNQYLLKTDLEDFFNSITPAIFWRCIEMSSEQAPQFLTQDKPYVERILFWQPVKRSKSRLMLSVGAPSSPAISNFCLYEFDRQMNEECQNLGITYTRYADDLTFSCNIQDLLRTVPAIIEALLNKLFKNALRMNHGKTVFSSKAHNRHVTGITLNNEGKLSLGRERKRFIKHLINQYKYGLLDDADKAYLIGLLAFASHIEPEFITRMNEKYSNELIERIRRQR

SEQ ID NO: 4020 - protein, 310 aa, unidentified
  source 1..310: note = Related to NZ_JXSK01000003.1; note = Photorhabdus luminescens
MSIINGLATVLHRSEADVRSFLENAPRKYKVYRIPKRTTGFRIIAQPAKELKALQRAFLQLYSFPVHETSMAYRKGKSIRDNALAHVNNPYLLKTDLEDFFNSITPDIFWRCIDTSSIETPKFSVQDRPYVERILFWQPVKKSKKRLMLSVGAPSSPDISNFCLYEFDRKLSEDCQNLGITYTRYADDLTFSCDMRDVLRTVPVMIEALLKKIFNKALKINHGKTVSSSKAHNRHVTGVTLSNEGNLSLGRERKRFIKHLINQYKYGLLDEADIAYLRGLLAFANHIEPDFIGRVNNKYSIELMERLRRP

SEQ ID NO: 4021 - protein, 311 aa, Citrobacter sp.
  source 1..311: note = Related to CP047307.1; note = Citrobacter freundii
MSVIRGLASVLRQSDSDISTFLATAPRKYKVYKIPKRTTGFRVIAQPTKGLKDIQRAFVQLYSFPVHDASMAYMKGKGIRDNAAAHAGNQYLLKADLEDFFNSITPAIFWRCIEMSSVQTPQFEPLDKIFIEKILFWQPIKRRKTKLILSVGAPSSPVISNFCMYEFDNRIHTACKKVEITYTRYADDLTFSSNIPDVLKAVPSTLEALLKNLFGSALRLNHSKTVFSSKAHNRHVTGVTINNEETLSLGRDRKRFIKHLINQYKYGLLDNEDKAYLTGLLAFANHIEPGFITRMNEKYSLELMERLRGQR

SEQ ID NO: 4022 - protein, 312 aa, unidentified
  source 1..312: note = Related to NZ_CP023467.1; note = Dickeya dadantii
MQIIKALAAILRQSESDVRLYLQNAPLKYKVYRIPKRTNGFRIIAQPAKALKEYQRALIQLYSFPVHDVAMAYRKGKSIRDNAIAHANNRYLLKTDLEDFFNSITPTVFWHCFEQCSVDTPQFSTQDKNYVEKILFWQPVKRSKHTLMLSVGAPSSPTVSNFCLYEFDRLLSDECLRLDIVYTRYADDLTFSTNTPNLLRLLPSFIQVLLTKLYKNALRLNHGKTVFSSKAYNRHVTGITLNNEGQLSLGRERKRFIKHLINQYKYGLLDEADIGYLCGLLAFVNHIEPEFIIKMNEKYTVSLISSIHRSNQ

SEQ ID NO: 4023 - protein, 312 aa, unidentified
  source 1..312: note = Related to NZ_DF820431.1; note = Serratia liquefaciens
MQVIKELAAILHQDESDIRLYLKHAPHKYKVYRIPKRTHGFRIIAQPAKVLKAYQRTLIQLYPFPVHDAAMAYRKGKSIRDNALAHADNRFLLKTDLEDFFNSITPEIFWRCIERCSVDAPQFSAQDKSYVEKILFWQPVKRSRHTLMLSVGAPSSPMVSNFCLYEFDRLLSDECQSTGIVYTRYADDLTFSTNTPNLLKLLPAFIQALLAKLYKNALRLNHGKTVFSSKAHNRHVTGITLNNEGQLSLGRERKRFIKHLINQYKYGLLDDVDTSYLRGLLAFANHIEPEFITRMNEKYTAALVGSIYRSKQ

SEQ ID NO: 4024 - protein, 314 aa, Aeromonas sp.
  source 1..314: note = Related to NZ_CDDH01000001.1; note = Aeromonas australiensis
MSVIKELATFLHQSEFDVSLFLQNAPRKYKVYRIPKRTSGFRIIAQPAKALKVYQRALMQLYTLPVHDAAMAYRKGKSIRDNALAHAQNQYLLKIDLENFFNSITPTLFWNCIDECLVNDPKFSSTQDRIYVEKILFWQPVRRSKKTLFLSVGAPSSPAVSNFCLYKFDHLLTEECQTLGIVYTRYADDLTFSTNIKDILKLLPALIQTLLKKLYNSALRLNNGKTVFSSKAHNRHVTGVTINNQGNLSLGRERKRFLKHLINQHKYGLLDDTELGYLRGLLAFANHIEPQFIMRMREKYTVDLISSITGAIND

SEQ ID NO: 4025 - protein, 311 aa, unidentified
  source 1..311: note = Proteobacteria bacterium; note = Related to JAGTSE010000026.1
MGIIKELSIFLHQDESDVSLYLQSAPRKYKVYRIPKRTNGFRVIAQPTKTLKEYQRAFVHAYPLPVHEAAMAYRVGRSIRDNAEAHTANQYLLKTDLEDFFNSITPAIFWRCIEQCSAEVPTFLHQDKIYIDRLLFWQPTKRSARTLMLSVGAPSSPAVSNFCLYEFDRLLSDECKRLDIVYTRYADDLTFSTNTKDLLKILPAFIQSLLKELYKNALRLNHGKTVFSSKAHNRHVTGVTINNEGKLSLGRERKRFMKHLINQYKYGLLDDADTNYLRGLLAFASHIEPEFITKMSKKYTDALIRRLYRSN

SEQ ID NO: 4026 - protein, 312 aa, Proteus sp.
  source 1..312: note = Related to CVRY01000004.1; note = Proteus penneri
MQMIKQLADSLQQDESDIKKFLQNGPRKYKVYRIPKRTTGFRIIAQPSKKLKEYQRYFIEFYPLPTHKAALAYRKGKSIRDNALAHVNQSYLLKMDFENFFNSITPAFFWHSLTSCTSSIPQFTDVEKSYVEKILFWQPIKRSKNTLMLSVGAPSSPVISNFCLYEFDRRLSQICEEYGVIYTRYADDLTFSTNIKNLLPKFPSIIHSLLQELFNGILKINHAKTVYSSKAHNRHVTGITLNNEGQLSLGREKKRFIKHMINQYKYNVLDDEDKNYLCGLLAFSLHIEPEFIVRLEKKYTSELIKKLTGKTL

SEQ ID NO: 4027 - protein, 341 aa, unidentified
  source 1..341: note = Related to NZ_WOBT01000016.1; note = Aliivibrio fischeri
KKYVHFAVSSKELSPRVLKLLGFFVERFMNLVQQLAKHLKKNESDVIRFLVDAPNKYRVYKIPKRSHGHRVIAQPTKELKEYQRAFISIFKFPVHHSAMAYCEGKSIKENALAHVENSYLLKTDFENFFNSITPAIFWQSIEHCRVDAPIFTAQERKLVEKLIFWCPSKEKNGKLVLSVGAPTSPTISNFCLYEFDNLISNACNAQQITYTRYADDLTFSTNKRDILCTIVSSIQQLLLTIFSHHIKLNYSKTAFSSRAHNRHVTGITISNESKLSLGRERKRYIKHLINQFKYNLLDDSDIRHLQGLLAFAQHIEPVFISRLKTKYTNELIQRIYEASHD

SEQ ID NO: 4028 - protein, 313 aa, Vibrio sp.
  source 1..313: note = Related to NZ_LT960611.1; note = Vibrio tapetis
MNLVKQLARHLRKSESEVIRFLVDAPSKYRVYKIPKRSHGHRVIAQPSKELKEYQRAFLAIYTFPVHPTAMAYCEGKSIRENALAHVQNNYLLKTDFENFFNSITPAIFWQSVGSCTVDTPMFTTQEKRLVEKLIFWCPSKTELGKLVLSVGAPTSPSISNFCLYEFDRFMTNVCSDQKITYTRYADDLTFSTNEKNTLNTIVPVIQQLLVEFFSYSLKLNHSKTAFSSRAHNRHVTGITLSNESRLSLGRERKRYIKHLINQFKYNLLDGSDIRHLQGLLAFAQHIEPVFISRLKTKYTSELIQRIYEASHD

SEQ ID NO: 4029 - protein, 312 aa, Vibrio sp.
  source 1..312: note = Related to BGNF01000084.1; note = Vibrio harveyi
MNLVHQLAKQLRKSELEVIRFLENAPNKYRVYKIPKRSHGHRIIAQPTKELKEYQRAFLSICNFPVHHSAMAYCEGKGIKENALAHVNHNYLLKIDFENFFNSITPTLFWQAIENAKCDIPAFTTQEKEIVEKIVFWCPSKLKHGKLVLSVGAPTSPIISNFCLNEFDRFISDICNDQKITYTRYADDLTFSTNTRDLLYTIIPSIQDLLALMFSHDLKLNHSKTVFSSRGHNRHVTGVTLSNDGTISLGRERKRYIKHLINQFKYNLLDEGDTRHLQGLLAFAQHIEPDFIRRLNAKYTIELMRSIKEANS

SEQ ID NO: 4030 - protein, 313 aa, Vibrio sp.
  source 1..313: note = Related to NZ_CP045070.1; note = Vibrio harveyi
MNLVKQLAQHLGKSEYEVSLFLVDAPNKYRVYKIPKRTYGHRVIAQPSKELKKYQRAFLDIYPFPVHSAAMAYCEGKSIKDNAQAHVQNDYLLKTDLENFFNSITPTIFWSCIESCSLDTPSFTTHEKKLVESLLFWCPSKTKNGKLVLSVGAPSSPTISNFCLYEFDRYLSTICNFQNITYTRYADDLTFSTKKKDILYTVIPSLQDLLVKLFSQSIRLNHSKTVFSSRAHNRHVTGVTLNNDRRLSLGRQRKRYIKHLVNQFKYDQLDEVDTRHLRGLLAFAKHIEPTFIKRLKDKYSSELIKRIYEARNE

SEQ ID NO: 4031 - protein, 319 aa, Vibrio sp.
  source 1..319: note = Related to NZ_CP009264.1; note = Vibrio coralliilyticus
MNLVSKLALYLEKSESEVIRFLSDAPNKYRVYKIPKRSHGHRIIAQPSKELKEYQRAFLELYEFPVHDSAMAYCKGKGIKENALAHSKNSYLLKTDLENFFNSITPPIFWQCMEKCASTVPQFTKQEKVLVEKLIFWCPSKDRNGKLVLSIGAPSSPAISNFCLYQFDDFMSDVCYDHKITYTRYADDLTFSTNEKDLLHTIINSIQYSLNYFFSNSLKLNHSKTVFSSRAHNRHVTGITINNHGRLSLGRERKRYIKHLVNQFKYNQLSESDIFHLQGLLSFARHIEPKFIFRLKDKYTNELVQRIYEAGNEQQNKKQ

SEQ ID NO: 4032 - protein, 340 aa, Vibrio sp.
  source 1..340: note = Related to NZ_CP027030.1; note = Vibrio vulnificus
MYEHFAVSSKELSPRAPLLLGFFVERKMNLVKRLAHHLGKSEPEVIHFLADAPNKYKVYKIPKRSYGHRVIAQPTRELKLYQKAFLELYSFPVHSSATAYCKGKSIKDNALSHVKNHYLLKTDLENFFNSITPNIFWKSIENDSIATPKFSTSEIALVERLIFWRPSKLQGGKLVLSVGAPSSPTISNFCLYQFDEYLSIICKEQNISYTRYADDLTFSTCDKDVLHTVIPLIQSLLDYFFASELKLNHSKTVFSSKAHNRHVTGITLNNEGKLSLGRERKRYIKHLVHSFKYGKLDNTEIRHLQGMLSFAKHIEPIFIDRLKEKYTDELIKIIYEAGHE

SEQ ID NO: 4033 - protein, 312 aa, unidentified
  source 1..312: note = Related to NZ_CP080413.1; note = Shewanella sp.
MDLVKNLANNLGKRESEVRRFLADAPNKYRVYKIPKRSYGHRVIAQPSKELKDYQRAFLQLYTFPVHRAAMAYCKGKSIKENAQAHASKKYLLKTDLENFFNSITPRIFWEVVRKNTDLMKVFTSQEVKLVEKLLFWCPSKTKSGKLILSVGAPTSPTISNFCMSEFDKQLSQLCKVKDIVYTRYADDLTFSTNEENLLFKIIPEIQSLLTKNFSFNIKLNHSKTVFSSKAHNRHVTGVTLSNNGKISLGRDRKRYIKHLIHQFKHNQLDTSEIHHLRGMLSFAKHIEPIFIKRLSIKYTDELIRNIYEAQL

SEQ ID NO: 4034 - protein, 313 aa, unidentified
  source 1..313: note = Related to NZ_LS483250.1; note = Moritella yayanosii
MSVIELLAKKLNKSESEVMSFLSDAPKKYRVYKITKRSHGYRVIAQPTKELKDYQRAFLTLYTFPLHESAIAYREGLSIKDNALVHVENQYLLKTDLENFFNSIPPSVFWDSLGSCSGVTPHFSVQDQQWVEKLLFWSPSKKSNGKLVLSVGAPSSPMISNFCLFEFDLSLSSLCKKQAISYTRYADDLTFSTDEKDVLYTMIPSVKNVLFNNFKDHLKVNNSKTVFSSRAHNRHITGVTLNNEGQLSIGRERKRYIKHLVHQFKYNELDSSDISYLQGLLSFAKHIEPVFIERLKIKYSNALIQCIYEANHE

SEQ ID NO: 4035 - protein, 309 aa, Vibrio sp.
  source 1..309: note = Related to DACQYM010000007.1; note = Vibrio vulnificus
MSFIERMAKELNKPQIEIEDFLFFAPNKYKVYSIPKRTHGFRTIAQPTKELKDYQRAFTSWVELPVHNCAMAYCQGRSIKDNAYAHKKNAYLLKLDLENFFNSITPDTFWRVWSSRWNLPNKNERQWVERLLFWNNKEKLVLSVGAPSSPLISNFCMVQFDKDLYLYCQSLGVTYTRYADDLTFSTNKRNILFSLPSDINQFLEKHFQSDLKINPSKTAFSSKAHNRHVTGITINNDGKLSLGRERKRYIKHKIHQFKLNVLDAYEIQHLKGLLSFAKHIEPTFIESLEKKYSKSLIEIIFEAKYDERK

SEQ ID NO: 4036 - protein, 306 aa, Vibrio sp.
  source 1..306: note = Related to PIFQ01000001.1; note = Vibrio splendidus
MTFIQRLAKELNKSRDEVEDFLFFSPEKYKVYRIPKRKHGFRVIAQPTKELKTYQRAFISLIQLPVHECAMAYCKEKSIKDNAAAHKNNKYLLKLDLENFFNSITPEIFWEVWASFTSLPSEEDRKWMEKLLFWDKQGKLVLSVGAPSSPLLSNFCMTNFDKELTSYCKKKDVSYTRYADDLTFSTNKRDALFSFPAVISEFLDKHFSSRLMINHSKTAFSSKAHNRHVTGITITNEGKLSLGRERKRYIKHKVHQFKIEKLDPYEIQHLKGLLAFAKHIEPKFIKSLNNKYSKLLIKKIFETNDD

SEQ ID NO: 4037 - protein, 305 aa, Enterobacter cloacae
  source 1..305: note = Related to JAKMJP010000001.1
MKLVGQLAHILSISEQDTLRLILNAPFKYRVYTIPKRTHGRRVIAQPTKVVKKLQKGFISLYNFPVHSRCMAYRKGLSIKHNAEMHLDNSYLLKMDLSDFFNSLTPKIFWNTWKEFWQLPDGLEQRLIESIIFWNNNSILTLSVGAPSSPAISNFCLYPFDEKLDKYCIEKGIAYTRYADDLTFSTKENNLLFILPSIVSGMLHDIFGGSLTINNKKTVFSSKAHNRHVTGITITNEGSASIGRERKRYIKHLLNKYKFNELNSNDINHLRGLLAFAFHIEPDLLTSLSNKYTHELLEKLKQEGE

SEQ ID NO: 4038 - protein, 305 aa, Enterobacter sp.
  source 1..305: note = Related to JAJCXF010000001.1
MELVAQLAHILSISEQDTLRLILNAPYKYRVYTIPKRTHGRRVIAQPTKAVKKLQKSFLHLYDFPVHSKCMAYRNGISIKDNAEKHLENPYLLKLDLSDFFNSLTPKIFWNTWQKFQQVPDALEQRLIENIVFWNNNSKLTLSVGAPSSPVISNFCLYFFDEKLEAYCLKEDIVFTRYADDLTFSTKKNNVLFNLPNIVSKYLNDIFDGALTLNNNKTVFSSKAHNRHVTGITITNEGNASIGRERKRYIKHLLHKYKLNHLNYNDINHLRGLLAFAFYIEPNFATTLSKKYTRELLEKLNEERG

SEQ ID NO: 4039 - protein, 313 aa, Vibrio sp.
  source 1..313: note = Related to JAKEUX010000006.1; note = Vibrio brasiliensis
MKIVSVLAGELVVSEQEILSILLGASKKYKVYPIPKRTHGIRLIAQPTKKVKVLQRAYVDMMNFPVHSNSVAYRKGYSIKDNAQFHASNPYLLKMDLSNFFNSITPKIFWGMWEKLWDLPEPLEKHLIENLLFWNIDKGSSISRLVLSVGAPSSPIISNFCLYEFDELMTKHCISRDIYYTRYADDMTFSTKKRNVLFDIPNFVKSLLYDVFGSSISVNYNKTVFSSKAHNRHVTGITLTNDGEISLGRERKRYIKHLVNEYRYNKLSSEDFNYLKGILSFSKHIEPKFVRSLINKYGEDVITSIFSGDLNET

SEQ ID NO: 4040 - protein, 305 aa, unidentified
  source 1..305: note = Related to NZ_CAKODS010000001.1; note = Kosakonia cowanii
MKIVMALAQQLKYSEPELLQLVLKAPYKYRVYTIPKRTHGRRTIAQPTKSVKELQREFLKYKVFPFHASSMAYRKGMSIKDNAASHSTNSFLLKMDLANFFNSLTPDVFWSVWADHWEPLSPLEHRLVENILFWDNKGKLMLSVGAPSSPTISNFCLFFFDVAITNYCSGIDVTYTRYADDLTFSCNTPGILSTIPAFISRILKDKYNGKISINHQKTIFSSKAHNRHVTGITITNDTKLSIGRYRKRYIKHLINQYKYKLLDSDSIYHLKGMISFANHIEPDFLISLKNKYSSKLINEIIGVHK

SEQ ID NO: 4041 - protein, 305 aa, Citrobacter sp.
  source 1..305: note = Related to JAASMA010000001.1; note = Citrobacter koseri
MKIVSVLAQQLKCSESDILKLILNAPYKYRVYSIPKRTHGRRIIAQPTKAVKELQRSYLKYKDFPFHINSMAYRKGFSIKDNAESHRLSAYLLKMDLANFFNSLTPDVFWDIWRQHWEPLQSLEHRLVENILFWDNSGKLMLSVGAPSSPAISNFCLYFFDNAVSEYCEKINVIYTRYADDLTFSCNDPNILPTLPEFISRVLKEKFSGKILVNHQKTIFSSKAHNRHVTGITITNDEKLSIGRYRKRYIKHLINQYKYNLLDAETIYHLKGMISFSNHIEPDFLNSLRKKYSSNLIDEIIEVNK

SEQ ID NO: 4042 - protein, 306 aa, Vibrio sp.
  source 1..306: note = Related to MCZP01000152.1; note = Vibrio breoganii
MELITSLARAIEKSEPDTLNLVLSAPYRYRRYTIPKRTHGRRLIAQPTKEIKAVQKAFVKIRTFPIHPAAMAYRKGVSIKDNAQAHKLNSYLLKMDLTDFFNSITPSVFWRVWEKVWPLPERLEMLLIERIIFWSNEDELMLSVGAPSSPVVSNFCMYFFDDYISTLCDQFDLVYTRYADDLTFSTNKTNLLFEMPSIVGAVLKTEFNDFLAINKSKTIYSSKAHNRHITGITITNNNELSIGREKKRYIKHLVHQHLVCKLSIEDSNHLRGLLSFVSHIEPTFIKSLKNKYSEETIDKLLRGSYE

SEQ ID NO: 4043 - protein, 313 aa, Vibrio parahaemolyticus
  source 1..313: note = Related to NZ_QPQH01000001.1
MNLITKLAKELETSEPNVLSTVASGPLKYKVYSIPKRTRGRRIIAHPSRELKQVQKAFLALYQFPIHSSAMAYKKGVSIKENAECHRLNKYLLKMDFENFFNSITPLLFWKVWSLNYPEPTFLEKRVIENILFWAPSISERDNLMLSVGAPSSPTISNFCLYQFDLIITKYCDDNEITYTRYADDITFSCNTPKGLSKIPKAVRKTLKNLYGTQIEINNQKTVFSSQAHNKHVTGITITPDGKLSIGRERKRYIKHLVHQYTLGALEQEDINHLRGLLSFAKHIEVSFFNSLITKYSADVMLQITRGNNEKNF

SEQ ID NO: 4044 - protein, 312 aa, Vibrio sp.
  source 1..312: note = Related to NZ_SZZR01000017.1; note = Vibrio gallaecicus
MNLLQRLSIELGVSESHILSITASGPLKYKVYSIPKRTHGRRIIAHPSKDLKKLQKSFIKLHNFPIHTNAMAYKEGVSIKDNASFHKSNKYLLKMDFENFFNSITPVLFWNVWNQHFPKSSYFDKKIIENILFWAPNIHERERLILSVGAPSSPMISNFCLFQFDSILTHYCIERSIFFTRYADDLTFSTDTPDLLKTLPGVISNLLRQLYEGQIEINNQKTVFSSQAHNKHVTGITITPEGKLSIGRSRKRYIKHLVHQYILNKLKSSDFNHLRGLLTFSMHIEPQFITSLENKYSTNIIENIVRGINEQN

SEQ ID NO: 4045 - protein, 321 aa, Vibrio sp.
  source 1..321: note = Related to BBSA01000008.1; note = Vibrio ishigakensis
MSVVSYLTNSCHCNSDDLFRLAINAPRRYKVYSIAKRTSGYRTIAHPSAELKKVQYQIISAFSEGNRPLAQLSIHSQAMAYKTGVGIKENAKMHSHNSYLLKMDFEQFFNSITPELFWRSYHALNPETTLSRTDKKLIDLFLFWAPNKYDLSRLVLSVGAPSSPLISNFCMYQFDELIHRFCHERKITYTRYADDITFSTNVPNVLFTVPKKVDELLKELFSGLIMINNQKTVFSSRAHNKHVTGVTITPQGGLSLGRNRKRYIRHLVHQFTLGRLATDDLNHLRGLLSFSQYIEPSFVLSLKKKYSIPIVDSISRGRYEC

SEQ ID NO: 4046 - protein, 312 aa, Vibrio sp.
  source 1..312: note = Related to MCXQ01000034.1; note = Vibrio lentus
MDLVKKLASEVGVTEREIKAFLYLAPRKYKVYTIPKRKSGVRVIAQPTSELKELQRKYVQMMDLPSHECSMAYKKGVGIKENAERHQGNTYLLKMDLENFFNSITPEVFWGTWSNFYAFPTSIEKLYLEKLLFWCPSKKNSNKLILSVGAPSSPAVSNFCMLVFDNVVSQYCISKQIVFTRYADDLTFSTQQKNALFEVPSLIQRVLSEIFGRKLTINHSKTTFSSMAHNRHITGITINNDGELSIGRDKKRYIKHLVNQFNYNKLDEQDLYHLRGLLAFAKYIEPNFINSLNKKYSSDVMNKLLRGGNEKI

SEQ ID NO: 4047 - protein, 312 aa, Vibrio sp.
  source 1..312: note = Related to NZ_CP025953.1; note = Vibrio campbellii
MDLVKKLASEVGVTEQEIKAFLHLAPRKYKVYTIPKRKSGVRVIAQPTSELKKLQRKFVKIVNFPTHECSMAYKKGVGIKQNAEIHQANTYLLKMDLENFFNSISPDIFWKVWSEFNPLPTSVDKLYIEKLLFWCPSKKNSNKLILSVGAPSSPNISNFCMSKFDDVVSKFCQDRNIIFTRYADDLTFSTKKRDVLFEVPSLVQHALSEEFGRRLTINHSKTTFSSMAHNRHITGITINNEGNLSIGRDKKRYIKHLVHQFKYNNLDEQDIYHLKGLLAFAKYIEPSFLGSLNEKYSFEVMKKIIRGDNEEV

SEQ ID NO: 4048 - protein, 303 aa, unidentified
  source 1..303: note = Related to NZ_LOFH01000001.1; note = Pseudoalteromonas sp.
MKLLSEKSNLTEDQISRILVNGSRKYKVYLIPKRSHGNRVIAHPAKKLKLLQKDFLKIVDFPYHECSMAYEKGTGIKKNAFAHSKNEFLLKMDLAEFFNSITPTIFWSAFSKYFNITPNHIDSYFVNNLIFWLKEGDKAVLSVGAPSSPKISNFCMFQFDEIVFQYCNESFITYTRYADDMTFSTNVREILFTIPSFVESLLFQLFGTAIAINYSKTVFSSKAHNRHVTGVTITNEGALSLGRKRKRYIKHLTHQFVTGVIDKENIAHLRGLLAFSNDIEPSFLSTLDRKYGPGITTKIMEIK

SEQ ID NO: 4049 - protein, 302 aa, Aeromonas hydrophila
  source 1..302: note = Related to CP000462.1
MDKKAIYIERFLVYAPRKYRVYKIPKRKHGSRVIAQPTAELKKLQRAFINRSKIPVHECAMAYKDGVSIKDNAQLHSTNTFFLSMDFENFFNSITPDLLWGVFNKFGKVISPNEKLWLSKLLFWCPSKKNSNKLILSVGAPSSPKVSNFCMYFFDEYISTYCQDRNITYSRYADDLSFSTNEKDILFQIPGVVKETLLKLFGRDITINNSKTVFSSKAHNRHVTGITITNEGELSLGREKKRYIKHLIFRFKNGLLDVSDVSYLRGILSFAFYIEPAFKTSMVKKYTKATIDSIFNGVDDGK

SEQ ID NO: 4050 - protein, 305 aa, Citrobacter sp.
  source 1..305: note = Related to DACSXM010000001.1; note = Citrobacter freundii
MFIATLAQKMGKNDREIREFLINAPEKYKVFTIPKRKHGYRIIAQPSRELKVYQRQLEDLISFPVHYRAMAYCKGRSIKINALHHVKNSYLLKLDLENFFNSITPDIFWKVWSKTWDLPCDEDRIYIEKLIFWRFQGTLRLSVGAPSSPLVSNFCMYYFDEKIEEICLNNKVSFTRYADDLTFSSNVKNILFEIPRLVQDTLENQFHTGFSINTSKTIFSSRAHNRHVTGITLDNTGKISLGRDRKRYIKHKVHHYTLNILDEDEINHLRGLIAFAKYIEPVFFHSLEAKYTANMMSKLLEGKDE

SEQ ID NO: 4051 - protein, 304 aa, unidentified
  source 1..304: note = Related to NZ_CP090245.1; note = Klebsiella oxytoca
MFTEAFARKMGRDELEITEFLMNAPDKYKVYAIPKRKQGYRIIAQPSRELKHYQRQLQDFIIFPKHKCAMAYRKGLSIKNNALSHVNNSYLLKLDLENFFNSITPDLFWSVWSRTWSLPSKEDQLFLEKLIFWRFQGSLILSVGAPSSPSISNFCMYYFDGEIEAICTKMKITYTRYADDLTFSSNVRNILFEIPVLIENILNEQFKGLLRLNSSKTIFSSKAHNRHVTGITLNNNGKISLGRDRKRYIKHKVHLYTLGMLDATELNHLKGMITFARFIEPAFFKSLETKYNSNVIFRLTQEKI

SEQ ID NO: 4052 - protein, 301 aa, unidentified
  source 1..301: note = Related to NZ_JABEBB010000004.1; note = Pantoea ananatis
MLLSALAQKMGISEDVAEQFLINAPEKYKVYSIPKRGIGFRLIAQPSKELKVYQKTLLNLIVLPINDTAKAYRLGESIKSNALIHSGNAYLLKMDLEDFFNSITPDVFWSVWQRFWELPDEYDMSVIESVTFWKKDNSLVLSIGAPSSPMISNFCLFFFDEEINKFCVKNNISYSRYADDLTFSTNIRNVLFSLPKLIAKVLKENFSGALKINRGKTIFSSKAHNRHVTGITLSNDGKISLGRARKRYIKHKIHHYKLGLLDFDEINHLKGLIAFSKFIEPLFFESLEIKYSKITLMKLME

SEQ ID NO: 4053 - protein, 310 aa, unidentified
  source 1..310: note = Related to JACGVM010000019.1; note = Colwellia sp.
MGVIDKLANKLNFTKKDVAFFLFDAPKKYKVYNIPKRSFGHRVIAQPSKELKEYQRTFLELYQFPHHANSMAYSSGKSIKDNAEVHRKQRYLLKMDLENFFNSITPEVFWNAWGKFKALPDDNDKEWIERLLFWQPRSTRSNDLKLSVGAPSSPSISNFCMYLFDEVVTEHCQKESVYYTRYADDLTFSTNKKDILSSIPSVIKTKLKECFDHRLVINQRKTKFSSKAHNRHVTGITISNDEKLSLGRERKRYIKHLVHQFQLNKLDQKDIRHLQGLIAFARHIEPMFISSLTKKYSETLIQRIIEAHNE

SEQ ID NO: 4054 - protein, 309 aa, unidentified
  source 1..309: note = Related to NZ_CP016181.1; note = Marinomonas primoryensis
MDTADFLSKLTNKSRSSIVDFLRLAPNKYRVYTIPKRSYGYRTIAHPTANLKFLQRTFSENFAFPTHAAAQAYISGKGIKSNATQHKNNCYLLKLDLEDFFNSIKPDLFWGVWDKAFQELPSPASKEMLEQLLFWRPSRRIGHTLVLSVGAPSSPAISNFCMYFFDVAITNICELLEVKYTRYADDLTFSTNQKNILFELPALIESTLKEEFSLQLNINKKKTKFSSKAHNRHVTGVTITNDSTLSLGRSRKRYIKHLVHRATLKQLNTDELNHLIGLLSFAHDIEPDFLTRLDAKYGDGSIQRIRSSI

SEQ ID NO: 4055 - protein, 312 aa, unidentified
  source 1..312: note = Related to MEIT01000084.1; note = Snodgrassella alvi
MREIIKYADSLEISVENLQIFLLNAPKMYKVYKILKRTHGYRVIAQPAKQLKEYQRKFIKIFSQYLVVHEYAMAYQKNKNIQQNAEIHKNNSYLLKMDFENFFNSITPALFWNEWENINPDIFDENEKNLFSRLLFWNPNRKRTQRENLILSIGAPSSPLISNFVMYRFDKLITQYCLDKNINYTRYADDLTFSTNIKNILYQIPVEVSKNLNLLFGNKLRINNSKTVFSSKAHNRHITGITITNNNKLSLGRERKRYIRALVHQYKYAQLEKADIQYLKGLLNFCKSIEVSFIHSLAQKYGNETLKNIMKE

SEQ ID NO: 4056 - protein, 312 aa, unidentified
  source 1..312: note = Related to MEIK01000040.1; note = Snodgrassella alvi
MQAFLKFAESLKISARELAIFLHNAPKMYKVYKIPKRTHGYRVIAQPTKQLKEYQRKFIEIFSTQMPVHEYAMAYQKNKNIQQNAIFHKDNSYLLKMDFENFFNSITPAILWNEWEKINPGVLNIIEKDFFSRLLFWNPNIKRKKQEKLILSIGAPSSPSVSNFVMYGFDDLITQYCNAREIKYTRYADDLTFSTNSKNILYPIPAEVDKTLKLLFGHNLRVNNGKTVFSSKAHNRHITGITITNNNKLSLGRNRKRYIRALVHQYQCAQLDKNDIQYLKGLLNFCKSVEIAFIKSLMRKYGEEIIENIMKE

SEQ ID NO: 4057 - protein, 312 aa, unidentified
  source 1..312: note = Related to CP091515.1; note = Snodgrassella alvi
MKNITKYAKSLDLSVENLQEFLLNAPKMYKVYKILKRTYGYRTIAQPTKQLKEYQRQFTNLFTQYLPVHDCAMAYQKNKNIQKNAEIHRNNSYLLKMDFENFFNSITPDLFWSEWESANSDMLDKDEKLLFSRLLFWDPNIKKTKQENLILSIGAPSSPLISNFVMYRFDELIKEYCVCIEVNYTRYADDLTFSTNKKNILYTIPAEVNKNLKNLFNNKLRVNNSKTIFSSKAHNRHITGITITNDNKLSLGRQRKRYIRALVHQYKYTQLEKDDIQYLKGLLNFCKSVEISFIHSLAHKYGYEVLKNIMKE

SEQ ID NO: 4058 - protein, 310 aa, Enterobacter cloacae
  source 1..310: note = Related to CP010512.1
MNIIHLLARSLNEDDITIKNYLAKAPLKYKVFAIPKRTHGHRIIAQPARELKRYQRAFINYIEFPIHDCASAYIKNRSIKNNAEHHKENSFLLKMDLENFFNSITPQIFWDAWRENFPLPDKEQMYYFERLLFWDVGNNELVLSVGAPSSPMVSNFCMYLFDSTIYSFCKSRSITYTRYADDLTFTTNLKSNLFDIPNEIQVILKNNFSDQIKINRSKTKFSSKAHNRHITGITITNDNKISIGRNRKRYIKHLIHQFSISKMEQSDLYHLKGLISFAMYIEPEFFNALTKKYGSSIINCIMSNNNGKNN

SEQ ID NO: 4059 - protein, 312 aa, Citrobacter sp.
  source 1..312: note = Related to DACSVK010000003.1; note = Citrobacter freundii
MEIIKNLSKHLNRTESHIKSYLIQAPNKYKIYTIPKRSHGVRVIAHPAKELKEIQYAFLSILKFPVHEAAMAYVPQKSIKTNAHAHKNNQFLLKMDFENFFNSITPNIFWYHWNNAFPVIDAEERFWIERIIFWNNKDLKSNLTLSVGAPTSPTISNFCMYSFDEEVTKYCREKDITYTRYADDLTFTSNTKGILFNLPKHIDKTLKKLFFSAININNKKTKFSSKAHNRHITGITITNDEKLSIGRKRKRYIKHLVHMYVLNLLDRNDFEHLKGLLSFVYDIEPTYIYRLEKKYTKFIIDNIKEGKYEQKH

SEQ ID NO: 4060 - protein, 314 aa, Acinetobacter sp.
  source 1..314: note = Related to JALGBR010000010.1
MSNIDVVKQLTKHYSKSPKELFVFFVDAPRKYKVYEIPKRTSGTRIIAQPTPELKDYQRFIISILKDHLPTHECSMAYIQGKDIKQNAQMHSKNSFFLKMDFIDFFTSITPTLFWHACERQELNFDWLDKELLEKVLFWRPSKYSKKLVLSIGAPSSPYISNFLMYSFDQELNNYCKQNGITYTRYADDLTFSTKKSKVLFDIPECVRKFLIKFYGQKIQINHFKTVFSSKKHNRHVTGLTITNDSSISIGRAKKRYIKHLVHRFVKENISVEDLNYLKGYLGFIQYVEPNFLYSLERKYTISIINKIRAGRGV

SEQ ID NO: 4061 - protein, 312 aa, Acinetobacter sp.
  source 1..312: note = Related to VYTC01000001.1; note = Acinetobacter junii
MSNIDVVKQLTEHYSESPKELFVFLVDAPRKYKVYEIPKRTSGTRTIAQPIPKLKEYQRFVISILKDYLPTHECSMAYLRGKDIKQNAQIHSKNSFFLKMDFMNFFNSITPTLFWHACERQEINFDWLDKELLEKILFWRPSRYSKKLVLSIGAPSSPYISNFLMYSFDQELSNYCNQNGISYTRYADDLTFSTNKSEILFNIPERVRKLLIILYGQKIQINQFKTAFSSKKHNRHVTGLTITNENSVSIGRAKKRYIKHLVHKSIEEEISVEGLNYLKGYLGFIQHVEPKFLMALERKYTEAVIKKIRLGC

SEQ ID NO: 4062 - protein, 312 aa, Acinetobacter sp.
  source 1..312: note = Related to KB851203.1; note = Acinetobacter seifertii
MSRVEILEKLKLKFNKTPLELFQFLDDAPRKYKVYEIPKRTSGTRIIAQPISELKDYQRFVISILQTDLLLHDCCMAYVKGKDIKKNAEAHSQNSFFLKMDFMDFFNSITPSLFWHACERQNIDFDWFDKELLEKILFWRPSKYSKKLVLSIGAPSSPFISNFLMYSFDNEISDFCRKNNITYTRYADDLTFSTSNALVLFSVPNFVKKVLLKIYGQKIQINQFKTVFSSRKHNRHVTGLTITNENSVSIGRAKKRYIKHLVHAFIEQKVDPQDLNYLKGYLAFIQYVEPKFLNSLEQKYTAAVIQEIRIGN

SEQ ID NO: 4063 - protein, 315 aa, Acinetobacter sp.
  source 1..315: note = Related to NZ_PYIX02000002.1; note = Acinetobacter sichuanensis
MSNIDVTQYLIEHHMEIHKSKEGFESFIKGASRKYRSYEIPKRTSGTRKIAQPMRQLKDYQRTIVTIFETTFLIHDCCMAYMKGRDIKTNALIHSGNSFFLKMDFTDFFNSITPKLFFEGCERQKIDLNWADKETLEKILFWCENKYSKELVLSIGAPSSPFISNFVMYSFDEVLNEYCKKNGITYTRYADDLTFSTSTSGILFSVPDIVRGTLLQFYGTKIQINQFKTAFSSKKHNRHVTGLTITNDNNISIGREKKRYIKHLVHNFIEEKITLEDLNYLRGYLGFIKYVEPSFLISLEQKYTQSVIQKIRLGN

SEQ ID NO: 4064 - protein, 312 aa, Acinetobacter sp.
  source 1..312: note = Related to LSZI01000016.1
MSRMDIAGHLTTHYSKTPQELFVYLVDAPKKYKVYEIPKRTSGTRTIAQPTPELKKYQSFVVSILKEYLPIHNCCMAYTDGRNIKQNAQIHSRNSFFLKMDLMDFFNSIIPKLLWEAFEREGVQLDWLDKEFLEKILFWKRSKYSKKLILSIGAPSSPFISNFLMYSFDKVLDEYCENNGITYTRYADDLTFSTKEKDVLFLIPDVVRETLVKFYGQKIKINHFKTAFSSKKYNRHVTGITITNSDEISIGRAKKRYIKHLVHKFVEERISLDDLNYLRGYLGFIKYVEPKFLISLEKKYTQNVIEKIRIGN

SEQ ID NO: 4065 - protein, 315 aa, Acinetobacter sp.
  source 1..315: note = Related to CP031984.1; note = Acinetobacter haemolyticus
MSKVDIIEYLMSKQVHNFDSKMDFFKFFGEAPKKYKRYEIPKRTSGTRTIAQPIRELKDYQRALIDLFQGYFPVHDSSMAYVKGKDIKRNAEIHSQNIYFLKMDFTDFFGSITPKIFWKACERAGIEFDWLEKEIIEKTFFWKPSKYSNKLVLSIGAPSSPFISNFIMFSFDCEIAQYCEEQGITYTRYADDMTFSTNTPNLLFSMSDTVRNVLIEFYGNTIKINHLKTVFSSKKHNRHVTGITITNDDELSIGRAKKRYIKHLVHKFIEEKISLEDLSYLRGYLGFIKYVEPNFLITLEKKYTQNVIQRIRVGN

SEQ ID NO: 4066 - protein, 315 aa, Acinetobacter sp.
  source 1..315: note = Related to NZ_VPEY01000001.1
MSKVDVIEYLMSQQIHNFDSKMDFFKFFDEAPKKYKRYEIPKRTSGTRTIAQPIRELKDYQRALIDLFQENFPIHASSMAYVKGKDIKKNAEVHSQNIYFLRMDFTDFFNSITPKIFWNACERAGIEFDWLEKEIIEKTIFWKPSKYSNNLVLSIGAPSSPFISNFIMYSFDNEIAKYCQERKISYTRYADDLTFSTKLPNVLLDLTRVIGNTLIGFFGNAIKINHLKTAFSSKKHNRHVTGITITNKDELSIGRAKKRYIKHLVHNFIEEKISPDDLNYLRGYLGFIKYVEPKFLASLEKKYTQNVIQKILLGS

SEQ ID NO: 4067 - protein, 315 aa, Acinetobacter sp.
  source 1..315: note = Related to CP018254.1; note = Acinetobacter baumannii
MKNLNILKSLEEKFSIPQHELQEFIKSSPRKYKVYQIPKRSSGTRTIAQPTAELKEYQRHLVSIFSPILPVHETSLAYIKGKSIKDNALIHCKNRYFLKMDFANFFNSITPNIFWNCWEESKNQNKINDLDKEILTNLIFWKPSKYQKNLVLSIGAPSSPLISNFCMYKFDIALSEICHKKNISYTRYADDLTFSTEYANILFDLPLIVSKILMDLYGGSLEINHLKTAFSSKKHNRHVTGITITNEGKISLSRKKKRYIKHLIHKFIFGSIEINELTYLKGYFSFIQHIEPDFLSRLKSKYSDETINLIRSMEL

SEQ ID NO: 4068 - protein, 313 aa, Acinetobacter sp.
  source 1..313: note = Related to DADATW010000032.1; note = Acinetobacter baumannii
MNNLNILKILEEKFDVPQHELLEFIKSSPRKYKVYQIPKRTSGTRTIAQPTAELKKYQRYLVSIFTPILPIHKNAFAYIQGKSIKDNALVHSSNSYFLKMDFSNFFNSITPNIFWNFFEETNVKFSGLDRILLSHLLFWKPSKYQQNLVLSIGAPSSPLISNFCMYKFDVVISEFCKNNNINYSRYADDLTFSTNIANSLYNLPLIVSKSLKELYGNSIEINPLKTSFSSKKHNRHITGITITNDGKLSLSRKKKRYIRHLIHKFMMKSIETNELQYLRGYFSFIQHVEPDFLSRLISKYSEETIRLIRLMEN

SEQ ID NO: 4069 - protein, 312 aa, Acinetobacter sp.
  source 1..312: note = Related to CP009256.1; note = Acinetobacter baumannii
MSILEHLISNTSYSRKDLLEFLENAPRKYKIYHIPKRTYGFRTIAQPIPELKNLQRITIKFLENELPIHNSAAAYIKGKSIKHNALSHCKNKYFLKLDFENFFNSINTTVFWKMWDSYTNVQVPTQDKTYIENLLFWRPSKTSKKLILSIGAPSSPFISNFCMYEFDQAVEEICLKHKVTYTRYADDLTFSTNTKGVLFDFPKYINSILLDVYDGQLRLNSLKTKFSSKAHNRHVTGVTITNDKKISLGRARKRYIKSLIFKYINSNIDLEDISKLKGLLSFSYSIEPTFILSLKSKYSAEVIDEIFEKTKS

SEQ ID NO: 4070 - protein, 312 aa, Acinetobacter sp.
  source 1..312: note = Related to NZ_CP090180.1; note = Acinetobacter johnsonii
MSILEHLVENSSYSSQELIEFLDNAPRKYKVFHIPKRTYGFRTIAQPIPELKDLQRIAIKYLENQLPVHKNAMAYLKGKGIKQNATKHCKNKYFLKLDFENFFNSVNTTVFWQMWSLYSEFQIPLQEQAIINNLLFWRPSKTSKKLVLSIGAPSSPFISNFCMFQFDEAITELCLIYDVTYTRYADDLTFSTNTKNVLFDFPKHVTTILLNIYQGQLRLNSLKTKFSSKAHNRHVTGITITNDKKISLGRSRKRYIKSLVYKYMASELDNENLAKLKGLLSFSYSIEPTFILALKLKYSAEIIDKLFEKTKP

SEQ ID NO: 4071 - protein, 308 aa, unidentified
  source 1..308: note = Related to NZ_GL883764.1; note = Parasutterella excrementihominis
MGIISRMAVRLNMSEPLLVSHLNGGARKYKLFFIPKKRGGKRAIAQPSKEIKFLQRVFLSAVHLPTSNFVYSYKQGKNIFQNASLHKGNKYFLKLDFDNFFNSITPRIFWEQWKLAFPEQNYLNAVDKICLEQLLFWQPSAYKSDLVLSVGAPSSPAISNFCLLSFDNEIHSYCYQRGITFSRYADDLTFSTNEPNVLYEVLPFVQELLTQKFNGAIRLNPSKTVFTSKKHLCKVTGLIITPEGKISIGRNNKRYIKHLTFEYLQGRLEEEDVMKLKGFLSFAKSIEPSFIHSLQKKYSPVLLSKLGI

SEQ ID NO: 4072 - protein, 309 aa, Acinetobacter sp.
  source 1..309: note = Related to NZ_CP083989.1; note = Acinetobacter guillouiae
MCLIDDLVTEFSKSKNEILEYSFVAPNKYKVYKIPKRKTGERVIAQPTKELKSFQRYIVNKKLNILPIHNCAFAYVKLKNIKENANQHKSNSYLLNMDLEDFFNSITPSLFWKVWGRILINLPDLEDRKLYENFLFWKPKKFSNKLILSIGAPSSPFISNFILYELDDFLFEFCKINSITYSRYADDLTFSTNIKDILFSIPNEVESKILELYEGAINLNTSKTYFSSKARNRHVTGLVLSNDGKISIGRSKKKFVKHLIFQYMLNRLNHEEILFLRGYLNFIKDVEPEYISILKRKYSDNLILRIMVD

SEQ ID NO: 4073 - protein, 312 aa, Acinetobacter sp.
  source 1..312: note = Related to KI530706.1; note = Acinetobacter gyllenbergii
MSLIDELAFEFNKSKEEIRTYLLQAPSKYKVYLIPKRKVGKRVIAQPTKDLKLIQRFILAKKLKHLPIHDAAFAYVKNKSIKNNAAVHLSNSYLLNLDLEDFFNSITPKLFWRVWKRTIDQVPEVEERRIYNQFLFWQPKKNSKKLILSIGAPSSPYISNFILYELDRYLTVFCKNNFISYSRYADDLTFSSNVRNSLFKVPKVVEDKLFDLYEGEINLNHSKTVFSSKAKNRHVTGLVLTNDGKISIGRAKKRFIKHLVYRFKIGELEQSSFQYVSGYLNFIQDVEPVFLESLKFKYTEEVVNKIMLGVWE

SEQ ID NO: 4074 - protein, 313 aa, Acinetobacter sp.
  source 1..313: note = Related to NZ_MABW01000006.1; note = Acinetobacter baumannii
MNLLDELAIKFNKSKDEIRTYSLKAPDKYKMYLIPKRKKGKRLIAQPTSELKLIQRYIVIHKLQKLPIHPCTYAYRKNISIKDNASVHVKNSYLLNLDLENFFNSITPRLFWKVWERTLNNLPDKEEQELYENLIFWRPRKSSHKMILSIGAPSSPYISNFILYELDSFLSSYCDEKSINYSRYADDLTFSTSKRNILFDIPNIVEGKIFELYNGLISLNDDKTTYSSKARNRHVTGLVLANDGKISIGRRKKRFIKSLIFKSINNELPLESISYLSGYLSYINDVEPSFIYSLERKYSYEVIHKIMGSKNEN

SEQ ID NO: 4075 - protein, 313 aa, Acinetobacter sp.
  source 1..313: note = Related to LWHP01000001.1; note = Acinetobacter pittii
MDLISRLEIKFSSLSRVDVRSYLSKAPDKYKVYPIPKRKGGTRVIAQPAKETKILQNFVIDEIFYNFPIHQAAMAYRKNHSIKMNASIHASQKYLLSMDFENFFHSITPQLFWDVYARLIQEPITFEDKNYYQNLFFWRPKKQSDKLLLSIGAPSSPFISNFVMYEFDTFIYDFCKSVGIKYTRYADDLTFSTNQKDILFEIPHLVAKKLDELYKNRININRNKTSFSSKAHNRHVTGIVLTNENKISLGRKKKRYIKHLVHEFKLGKLSIADKNYLCGFLNYANFIEPEFILSLENKYTKEIIALARRNINE

SEQ ID NO: 4076 - protein, 314 aa, Vibrio sp.
  source 1..314: note = Related to QJUD01000001.1; note = Vibrio furnissii
MDLKLYQYLESQNSNFTNLLRATPSKHYKVYKIPKKRLGFRTIAQPTPAVKVIQKQIVDYLIPKTSIHTSALAYVSGKGVKDNALQHVKSDYLLKVDLENFFNSITPKMLVKALKHQGINISQTDIMVLSQFLFWNITKKTNGKLVLSVGAPSSPFVSNLVMFAFDQRMSKLCRSTGITYTRYADDLTFSTTHKNILFQHLNEVRKVLKKEFGARLVLNESKTVFSSKAHNRHVTGVTLTNNNKISLGRDKKRYISSLIHKFKLGLLDQEDIYHLQGLISYAKHIEVRFLRNMSLKYGANVLDSIRKYSGEDDA

SEQ ID NO: 4077 - protein, 314 aa, Vibrio sp.
  source 1..314: note = Related to SYUN01000005.1; note = Vibrio kanaloae
MDLKLYQYLNERNLNFKSLLEATPSKHYKVYKIPKKRLGFRTIAQPTPAVKIIQKEIVDYLTPKVSIHTSATAYVPGRSVKDNALVHVKSNFLLKVDLENFFNNITPKMLFKSLKKQGIVVSGVDLIVLQQFLFWNISKKRSGKLALSVGAPSSPFVSNVVMLSFDERMTKLCRKSGINYSRYADDLTFSTTQKGLLFEHLFVVRKALKKEFGARLVLNESKTVFSSKAHNRHVTGITLTNNNKISLGRERKRYISALVHKFKLGLLDVEDTLHLQGLISYANHIEASFVQKMSIKYGDNVLTEIIKYSGENDV

SEQ ID NO: 4078 - protein, 319 aa, unidentified
  source 1..319: note = Related to PYNL01000004.1; note = Photobacterium kishitanii
MDLKELHLLQYVISKNMHTVSLLDDHPSLHYKVYKIPKKNIGFRTIAQPTAPLKKMQRDIVEYMTPRVCIHKNAMAYIEGVGIKNNALAHAKSTYLLKVDLENFFNSITPEMLFHSLKNQGFKINSIDWAYLKELLFWNIAKKKNKGKLVLSVGAPSSPLISNIIMYNFDVRMTSLCEKQNINYTRYADDLTFSTKDKNILFEHLKIIRKVLDNEFKGELVLNESKTIFSSKGHNRHVTGITLTNNNKISIGREKKRYISSLIHKFKYQKLNEDDIYHLQGLLSFASHIEKDFIYRMSKKYGIDTIKKIKLFSGDKNDQ

SEQ ID NO: 4079 - protein, 316 aa, unidentified
  source 1..316: note = Related to JABAIP010000015.1; note = Shewanella sp.
MDIKLYEQLNSTNIGFNELFLRSPSKHYKVYKIPKRTLGFRTIAQPTPAVKRIQKQIVSIISKNAKVHHCATAYVRGKGIKENANKHVCSEYILKVDLENFFNSVTPKMLFKALKKQKIVLSQIDEKVIEQFLFWNMSKKINGKLVLSVGAPSSPFISNLVMYSFDKKMEEYCSKESIVYTRYADDLTFSTKSKGILFTHLQFVRKMIAKEFSSKLMLNESKTVFSSKAHNRHVTGIVLTNNNKLSLGREKKRYISALIHKFKLGKLLIDDIYHLKGLLSHASHIERDFILKMSEKYGAEVVLEINKFSCGESNDG

SEQ ID NO: 4080 - protein, 312 aa, Vibrio sp.
  source 1..312: note = Related to CAOA01000025.1; note = Vibrio nigripulchritudo
MDLRLYRQLEQRNPNFIRLLNRYPSRHYKVYKIPKRTFGFRTIAQPTPNVKQVQKLVISLLSEKVNVHPCATAYVQGKSIKDNASYHVKSEYLLKVDLENFFNSITPKMLFKALKKQSISLTDQDMLVLEQCLFWNMSKKLNGKLVLSVGAPSSPYVSNVIMYSFDKRMSKICAKNNINYTRYADDLTFSTNTKGLLFGHLNEVRKLLKKEFGAKLTLNESKTVFSSKAHNRHITGVTITNNNKLSLGRDRKRYISALIHKFKHSQLSEDDIYHLKGLISHALHIESKFVHRMIKKYSKETLNSIRKYPSGA

SEQ ID NO: 4081 - protein, 312 aa, unidentified
  source 1..312: note = Related to NZ_FNXF01000018.1; note = Rheinheimera pacifica
MKSGIYGILKAEFCDFDAFLSSKPPLHYKVYKIPKRTIGFRTIAQPTPTLKKIQKTLVGLIEPHVKIHPNAAAYRIGKGVKENALSHVNSSYLLKVDLENFFNSITPHMLFKTLKQQHIEINDVDKYVLEQIFFWNRSRRKNGRLILSIGAPSSPFISNVIMSKFDNDISIICDKKGVSYTRYADDMTFSTKEKDVIFSVMADVRRLLRNNFSNKMNVNELKTIFSSKAHNRRVTGVTLTNDNKISIGRDKKRYISALTHKFKFGKLDISDIYHLKGLISYARHVDVGFIRKLQKKYGVTTLELINKYSSEG

SEQ ID NO: 4082 - protein, 315 aa, unidentified
  source 1..315: note = Related to NZ_AXWP01000001.1; note = Psychromonas arctica
MDLNLYQRLETDNCNLNKLLSSLPSTHYKVYKIPKRTIGFRTIAQPTSEIKDIQRKIIEILSPKVQLHPIATAYIKGQSIKSNALKHVNSEFLMKIDLENFFNSINPEMLMKALSKQKVEISSEDEKILRELLFWNRSKRINGKVVLSVGAPSSPFISNLIMYEFDSKLESMCTKRKVICTRYADDLTFSTCDKGELFSLLPEIRKLLYRTFGNRLVVNDSKTVFSSKKHNRHVTGITLTNSNRLSIGREKKRYISALIHKFKNKKLDEQDIMHLKGLLSYAVHIEDIFVHRMGKKYGYETLEAIKKFSLGECNE

SEQ ID NO: 4083 - protein, 313 aa, unidentified
  source 1..313: note = Related to JADYXL010000005.1; note = Pseudoalteromonas sp.
MHLELSDFLHKKIPEFDAFLQSRPSTHYKVFKIPKRKIGFRVIAQPTPQVKAVQSQIVSFLEKKSKIHPCSMAYQKGCSIKKNALAHSDSEFILKVDLENFFNSINPEMLFNALESQSIVISDDDKFILEECLFWNRSKKRTSKLILSVGAPSSPYLSNIVMYDFDRVIHKICINLNVNYTRYADDLTFSTKEKNVLSEMISKIREALKTFFTSKIIINESKTIFSSKAHNRHVTGITLTNNNKISVGREKRRYISALIHKFKNSLLDESDIYHLQGLFSFACHIEVDFKKRMKKKYGDDVVHNLIKYSSREN

SEQ ID NO: 4084 - protein, 320 aa, unidentified
  source 1..320: note = Related to CP015750.1; note = Pectobacterium wasabiae
MSIDIETTLKKAYPDFEILLKSRPATHYKVYKIPKRTIGYRIIAQPTPRVKAIQSDIIKILKEYVYIHDAATAYVDGRNILDNAKIHQNSVFLLKLDLVNFFNRITPEILFKALSRQGLHISDDNKNILRQFCFWNRSKRKNGALVLSVGAPSSPFISNVVMKSFDEELTSFCESNKINYSRYADDLTFSTNERDVLGLAHQKVKTTLSHFFGTRIIINNNKIVYSSKAHNRHVTGVTLTNDNKLSIGRERKRYISSLVFKFKEGKLSGDDINHLKGLIGFSFNIEPLFIGRLEKKYGKSTIKSIKKYSEGGVNGTDLTE

SEQ ID NO: 4085 - protein, 312 aa, unidentified
  source 1..312: note = Related to DAFWTN010000002.1; note = Klebsiella quasipneumoniae
MSIDIETTLQKAYPDFDELLKSRPATHYKVYKIPKRTIGYRIIAQPTSRVKAIQRNIIEILRQHAHIHDAATAYVDGKNILHNAKIHQNSVYLLKLDLVNFFNKITPEILFKALARQHLDISDEDKNILKQFCFWNRSKRKNGALVLSVGAPSSPFISNLVMNSFDEEISSFCKKNKISYTRYADDLTFSTNERDILGLAHQKVKTTLIRFFGTRLIINNNKVVYSSKAHNRHVTGVTLTNNNKLSIGRDRKRYITSLVFKFKEGKLSNVDINHLRGLISFAYNIEPTFIERLEKKYGDSTIKSIKKYSEGG

SEQ ID NO: 4086 - protein, 312 aa, unidentified
  source 1..312: note = Related to UGYN01000002.1; note = Serratia quinivorans
MSIDLESELTEKFADLQQLLKSRPSTHYKVYKIPKRTIGFRLIAQPTKKVKDVQRIIVENLSKIALVHDVATAYIKGRNILYNASLHQDSDYLLKLDLEDFFNSITPDFFFKELERQSISLSINDKFLIEQLCFWNRSKKRNGALVLSVGSPSSPFISNVVMYSFDKKLHGICLAEKINYSRYADDMTFSTKEKDSLKFIHNEVKGLLQEYFGNRILINQSKIVYSSKAHNRHITGITLTNNDKLSMGRDKKRYISSLVYKFKNGQLDFDDIQSLKGLIGYARSIEPVFLLRIQKKYGPSIIEEINKYSSEE

SEQ ID NO: 4087 - protein, 312 aa, unidentified
  source 1..312: note = Related to CP034474.1; note = Pantoea agglomerans
MIIDLKGELSEKVDDLQQLLKSRPSTHYKVYKIPKRSIGFRLIAQPTKKLKHIQKLIVDLLLNKVKVHKNATAYIKGKNISFNASIHKNSEYLLKLDLENFFNSIKPGMFFKELERQNIRLSNEDTAILEQFCFWNRSKRKNGALVLSVGAPSSPFISNVLMYTFDQELYEFCASKKIAYSRYADDMTFSTKEKNVLLSIHKHVDFLLIKYFSKNLRINDLKVVYSSKAHNRHVTGVTLTNDNEISIGRDKKRLISAMVYNFKNNSLGLDDTHTLQGLIGYAFSIEPDFIKRLQAKYGSTILEDINKNLLRT

SEQ ID NO: 4088 - protein, 314 aa, unidentified
  source 1..314: note = Related to JAGJEM010000002.1; note = Pseudoalteromonas luteoviolacea
MNYLLLKNVATDIKFFETLYSSPSNHYKVFKIPKRSIGFRIIAQPTKNVKDYQRKIVRVLEPLTAIHSAATAYKKNQGIKDNAFIHKNSEFLLKLDLVNFFNSITPEMFFNALNVQKIKYSENDRMAMSEYLFWNINERRADNKKLVLSVGAPSSPFISNFVMFAFDKKISQFCLANSINYSRYADDLTFSTKDKNVLFNVISEVQTTLKACFGHKLKINTSKTIFSSKAHNRHVTGITLTNNNQLSIGRERKRYISALVHKASLNMLPKEDIHHLQGLISFARHIEPTFIQRLERRYGKDIIHNIINTDLDKF

SEQ ID NO: 4089 - protein, 315 aa, unidentified
  source 1..315: note = Related to NZ_NBOE01000008.1; note = Colwellia polaris
MEFKIVQALIKEFPELKELVKKTPSTHYKVFKIPKRTIGFRTIAQPTSSLKDVQRKVVDLLLPHVKVHHAAKAYIKKCSIKDNAAVHLNSQYLLKLDFENFFNSITPIMLFKVLAEQGVSVSKSDSKILSEILFWNRSKKINAPLVLSIGAPSSPLISNIVMYSFDRKIEDICKALDINYSRYADDLTFSTNIKSVLFNLVDMVNEALQIEFEGEININSSKTVFSSKKHNRHVTGITLTNSNKLSIGRIRKRYISALVHKFKTNQLNDLTEINHLKGLLGFAYYIEPNFIVRLTKKYGSDIMIRIRKFNSEDLK

SEQ ID NO: 4090 - protein, 315 aa, Vibrio parahaemolyticus
  source 1..315: note = Related to NNIR01000014.1
MKLSVLSHISPEVFPVEFSHYLAKKPSGHYKVYKIPKRTFGFRVIAQPTPELKCIQRAIVEQMKPYVQIHSSAKAYINGINIKENASAHVESSYLLKLDLENFFNSLTPSMFLKALNYQEIELVNNDIEPLIELLFWNRTKKKSPNLVLSVGAPSSPFLSNFIMYEFDKIVTSYCTKSNINYSRYADDLTFSTSEKNLLFVIPKYIENTLRDLFDDRIKLNRSKTFFSSKAHNRHVTGITISNNNKLSLGRDRKRYIRALLHKFSIRSLDNEDDIEHLKGLIGFAKTVEPIFIDKMKNRYGEKVFIDLFRYSGGD

SEQ ID NO: 4091 - protein, 315 aa, unidentified
  source 1..315: note = Related to SEZJ01000011.1; note = Aliivibrio finisterrensis
MKLPILSRISSEVFPSEFSHYLAKLPSSHYKVYKIPKRTFGFRVIAQPTPELKCIQREIVKQIKPYVKIHNVAKAYVDGVNIKDNAYVHVKSNYLLKLDLENFFNSLTPSMFLSALNYQEIELVNKEVDPLIELLFWNRTKKKRPNLILSVGAPSSPFLSNFIMYEFDKIVMNHCMKLNINYSRYADDLTFSTSEKGVLCMIPKFIEKVLCDLHDGKIKLNYSKSVFSSKAHNRHVTGITLSNNNKLSLGRDRKRYIRALLHKFSTESLQYEDDINHLKGLIGFAKMVEPSFFEKMKTRYGSKVFVDLFRYGGEH

SEQ ID NO: 4092 - protein, 315 aa, Vibrio sp.
  source 1..315: note = Related to JAKEVQ010000003.1; note = Vibrio brasiliensis
MQVSILSRIPPEAFPNGLSQYLGEKPSSHYKVYKIPKRTFGFRVIAQPTPELKDIQRAITTQIKPFVQIHSSAKAYVEGVSIKDNAIVHVQSNYLLKLDLENFFNSLTPTMFLDALNYQNIRLVDGEVESLMELLFWNRTKKKTPNLILSVGAPSSPFLSNLIMYEFDTIVSSHSAKLNVNYSRYADDLTFSTSEKDVLFSFPQFIENVLNDLYDGRIKLNHSKSVFSSKAHNRHVTGITLSNNNKISLGRDKKRYIRSLLYKFSVQALQDEEDIKHLKGLIGFAKTVEPSFLERMKARYGISIFKDLFRYDGDD

SEQ ID NO: 4093 - protein, 315 aa, Vibrio sp.
  source 1..315: note = Related to PIZL01000016.1
MKLPILSRIPPDIFPKGFNDYLASNPSAHYKVYKIPKRTFGFRVIAQPTPELKNIQRSIINRIKPLVRIHNSAKAYVDNVGIKENASVHIKSNYLLKLDLENFFNSLTPPMLLNAIDYQNIELVDEEIYPLVELLFWNRTKKKTPNLVLSVGAPSSPFLSNLIMYEFDRIVTEYCGLNDVNYSRYADDLTFSTLNKGVLFNIPSFIEECLHELFKGKIKLNRSKTTFTSKAHNRHVTGITLANNNKISLGRERKRYIRALLHKFSTNSIKDKEDIEHLKGLIGFAKYIEPSFFDKMKVKYGEKLIFKLLKYDGIS

SEQ ID NO: 4094 - protein, 315 aa, unidentified
  source 1..315: note = Related to JAEFCD010000023.1; note = Alteromonas sp.
MQLSILSCFTPEDFETDLNQYLAEKPSHHYKVYKIPKRTIGFRVIAQPTPKLKSIQRKIVEKMMSYLVVHSAAKAYVKSCSIKDNALVHANSNFLLKLDLENFFNSLTPDMLKRAVQYQGFSIVEKEANALNELLFWNKSKKKKANLYLSVGAPSSPFLSNVIMFEFDEAVTKLCKQLGISYSRYADDLTFSTSVKNVLFEVPKIIEEILLQMFGGKLKLNYSKTRFSSKAHNRHVTGITLTNNNKLSLGRERKRYIRSLLHKFSNSLLSEDDINSLKGLISFAMNVEPAFIAKMKAHYGTALFDELNRYNCGNN

SEQ ID NO: 4095 - protein, 315 aa, Vibrio sp.
  source 1..315: note = Related to VTYC01000009.1
MQLSILSRISQEDFNSSLNQYLAESPSTHYKVYKIPKRSFGFRVIAQPTPQLKNIQRKIVGEIKGYMHVHSAAKAYVKDCSIKDNAIVHVNSNYLLKLDLENFFNSLTPAMLARALKYQGLSLLESEVAALNELLFWNRTKKKSPNLVLSVGAPSSPFLSNVIMYEFDEAVSKFCSESGLSYSRYADDLTFSTSIKDILFEVPKFIESILFQLFQGKLKLNYSKTTFSSKAHNRHVTGVTLTNNNKLSLGRERKRYIRAMLHKFSCEELCDYDVQALKGLISFALNIEPTFVDKMKGRYGAKLFDDLFKYNNGDN

SEQ ID NO: 4096 - protein, 317 aa, unidentified
  source 1..317: note = Related to WMDD01000002.1; note = Photobacterium carnosum
MKLSILSRISQEAFCSNLTQYLAKNPSKHYKTYKIPKRRFGFRIIAQPTPQLKLIQRKIVEMLKVHLKVHPAAKAYVKNCSIKDNAEVHVNSNYLLKLDLENFFNSLTPDMLAKSLFYQGVMFSENEVAGLNELLFWNRTKKKTPNLVLSVGAPSSPFLSNIIMYEFDDIVSARCSELQVSYSRYADDLTFSTLEKGILFDISELIESVLFELYQGRVKLNYSKTTFSSKAHNRHVTGITLTNNNKLSLGRERKRYIRALLHKFSNEALSDYDIQVLKGLIGFSRSIEPMFIEKMKIRYGIELFAKLYKQTNSNGDT

SEQ ID NO: 4097 - protein, 314 aa, unidentified
  source 1..314: note = Related to JADZHL010000041.1; note = Shewanella algae
MKLNIEKVLAEKNPNLNIGELLASIPSKHYKVYKIPKRTIGFRLIAQPTPKIKNIQRSIIAELAPLLKIHKSATAYIQGKSILDNARVHRASNYLLKLDLENFFNSITPDIFINSLKNQGIELSAKNSNLLIQLLFWNRSRKRNGNLVLSVGAPSSPFISNIIMYDFDKKLYQYCKSIGASYTRYADDLTFSAKEKSVLQRIPNEVKRLLFKEFSNEIRLNNSKTVFSSKAHNRHVTGITLSNNNKLSLGRDRKRYISALVHKFTLSLLDEDDILHLKGLIGLAKFIEPEFIERLESKYGNSFILNLNRYLIKD

SEQ ID NO: 4098 - protein, 318 aa, unidentified
  source 1..318: note = Related to PAZB01000040.1; note = Idiomarinaceae bacterium
MSLDLHSYLSQFDSDLDAFLLTRPSKHYKAYKIPKRKVGFRVIAQPTPKVKMLQRKLVKQLSTILDVHDAAYGYRVGRGIKQNAEKHVDSEYLLKMDISNFFNSLSPNVFFDAIHSQNIRLSKQDREILREICFWNRTKRSTGKLVLSVGAPSSPFITNVIMFSFDEKVSKYCEKIGVTYTRYADDLTFSSKEKNLLQKVREQIVRDLESLYSGVLVINEAKTIFSSKGNNRHVTGIVLTNNNRLSIGRRRKRYLSALVHKFKCNELDALDSRMLQGWLSQARHIEPSFYERLEVKYGKEILKQISSFNIEVEDEPGT

SEQ ID NO: 4099 - protein, 317 aa, unidentified
  source 1..317: note = Related to NZ_CP054160.2; note = Serratia fonticola
MKIEIPYQDIGISRIKLASTARRSPLKYKVYKIPKRRSGVRVIAQPTPEVKDLQRKLVDFLRTQLTVHSCATAYEPGKGIRENAQQHVNNPYLLKMDFSNFFNSITPEIFKNALLHDSVEIDDNTLMLLINIFFWCPGKKLSGKLVLSVGAPSSPFISNYVMKKFDQLLSVLCEQAGITYTRYADDMTFSTQRENVLFTLKEQIATLIVQSGYENITINESKTVFSSKAHNRHVTGVTLTNDNQLSVGRKNKRYASSLIFRFKLGELSTDETLMLKGLLAHYFHIEPEFKLSMQKKYGVEIISDIVNYQELINESDS

SEQ ID NO: 4100 - protein, 317 aa, unidentified
  source 1..317: note = Related to JADTXI010000006.1; note = Serratia ureilytica
MKIDIPYKDIGINEKKLFLTAHRIPLKYKVYKIPKRHSGVRIIAQPTPEVKEIQRKLVGFLRTRLRIHNCATAYEAGKGIKENALKHVKNQYLLKMDLANFFNSITPDIFQNALAHDSVELDETTWTTLVNVFFWAPGKKLTGKLVLSVGAPSSPFISNYIMKRFDEQVSDLCEKSGVTYTRYADDITFSTNQQNILFSLKENIGSLLQANGYKSININESKTVFSSKAHNRHVTGVTLTNDGKLSVGRDKKRYASSLIFRFRLAELCHDDILFLKGLLAHYFHIEPSFRFSMEKKYGKNIIHALMKYQGDVHEPDN

SEQ ID NO: 4101 - protein, 312 aa, unidentified
  source 1..312: note = Related to CP059036.1; note = Serratia marcescens
MQLERKLCESFNLTPLQLSVLSSKAPKKYRVYYIPKRTSGLRAIAQPTKELKNIQRFLASELDAYCPIHPAAMAYRNGKSIKDNAECHKNNPYLLKMDFQNFFNKIKPDIFFEKLNALDVKYDGKDKKHLRNFLFWKPGQKRSITHILSIGAPSSPFVSNFVMFDFDFEISKWCAEFDIVYTRYADDITFSTARKNILFSVPKIVKNILSKHASGITINEAKTIFTSKAHNRHVTGVTITNDGKLSIGRKKKKYLFSLVFKYSIGELTRDEIFYAKGLMSHCMHIEKNIISRMKNKYGADVINKFLKEGGDE

SEQ ID NO: 4102 - protein, 327 aa, unidentified
  source 1..327: note = Related to NZ_JACHAQ010000007.1; note = Pectobacterium brasiliense
MLAAISAASISEMNIMQLERKLCEKFELTPLRLSILSSKAPKKYRVYYIPKRNSGLRAIAQPTKELKDIQRFLISELEPYLPVHPSAMAYRKGVSIRDNAECHKNNPYLLKMDFQNFFNKIKPNVFFDKLNDFGFEYDYKDKIYLHNFLFWKPGQKRSITYVLSVGAPSSPFISNFVMFEFDMAVSKWCAEFNIIYTRYADDVTFSTSRRNILFSVPKMVKNMLAQYASGITINEAKTVFTSKAHNRHVTGVTITNDGKLSIGRKRKKHLFSLLFKYSMGELTKDEILYAKGLMSHCMHIEKNIIARLKMKYGSELINDFFKDGGDE

SEQ ID NO: 4103 - protein, 327 aa, unidentified
  source 1..327: note = Related to NZ_LR607333.1; note = Klebsiella aerogenes
MLAAIVAASIFEIDIMQLAKKLCEKFSLTPLKLSMLSTKAPKKYRVYYIPKRTSGFRAIAQPTKELKEIQRFLVSELEPILPIHSSAMAYRCGISIKNNAEKHKNNSFILKMDFQNFFNKIKPGIFFEKFNNLDIQCNSHDRYLLHNFLFWKPGQKRSVTHILSVGAPSSPFISNFVMFDFDSAISEWCAKFDIVYTRYADDITFSTSRKGILFSVPKIVKNMLAEYASGITLNEAKTIFTSKAHNRHVTGVTITTDGKLSIGRKKKKYLYSLVFKYTKGELTNEEILYAKGLMAYCIHIERNIITRLKKKYGSEVINQFLKETGDE

SEQ ID NO: 4104 - protein, 311 aa, unidentified
  source 1..311: note = Related to LGYX01000010.1; note = Pantoea sp.
MQIEKLLCEKHKVTTLQLSVIAAKAPKRYRVYYIPKRTTGFRVIAQPTKKIKEIQRTLVAYLKDFLPVHSSATAYQNNISIKDNANRHKRNDYLLKMDFQNFFNKVKPELFFAKLNKLDFNITRKDESLLRDFLFWKPGQKRSKTHILSVGAPSSPFISNFVMYEFDKAMHEFCVSMGVVYTRYADDITFSTSSKGMLFVIPRIVKALLAEHASGLTVNESKTVFSSKAHNRHITGVTITNEGKLSIGRKKKRHLSSLIFRYSLNELTEEEVLNAKGLLSYCIHIEPDFILRMKVKYGHDLINKFLAEGAR

SEQ ID NO: 4105 - protein, 314 aa, unidentified
  source 1..314: note = Related to JACHAS010000001.1; note = Pectobacterium polaris
MTVQIEKILCDHLDYPTYELTSIAIRAPKKYRVYYIPKRNGGLRVISQPTKQLKKIQRVLVAHLTNLLPVHSSAMAYRRGISIKHNAILHKENTFLLKMDFQNFFNKIKPDFFFSRLNSIDINLVANDAFLLKNFLFWKPGQKRSVTYILSVGAPSSPFISNFVMYEFDEAINEWCKNHGITYSRYADDITFSTNKKDLLFSVPKIVKSFLAKHTQGMTINEAKTVYSSKAHNRHVTGVTITSEGKLSVGRKRKKHLSSLLHKYSLNLLNPEEILRAKGLMSHCINIEKDFLLRMKKKYGKDIVDNFMREGNYD

SEQ ID NO: 4106 - protein, 310 aa, unidentified
  source 1..310: note = Related to PQJY01000001.1; note = Leclercia sp.
MQLTSKIIKKFNYERLAFEQLLNEAPKKYKVYYIPKRGAGFRVIAQPTKELKNVQRFIVSLLEPILPVHHKAMAYQLNKSIKDNAYLHKDNSYVLKMDFQNFFNKIKPDLFLTKIEASNLELESLDKFVLRNLLFWRPGTKRSITLILSIGAPSSPFISNFIMYDFDRNVDDWCLNHGVVYSRYADDITFSTNTKDLLVSVPKMVKKMLSEYVPGLTVNESKTIFTSKAHNRHVTGVTLTPEGKLSVGRERKRMLYAKMHQYYLGMLSTEDINKVRGLVTFANYIEGDFIFRLKKKYGNELIDRFLKEGC

SEQ ID NO: 4107 - protein, 311 aa, Escherichia coli
  source 1..311: note = Related to CP026641.1
MQLTSKIISKFNYNRLAFQLLLNEAPKKYKVYYIPKRGAGFRVIAQPTKELKNVQRFIVSLLQPKLPVHHKAMAYEYKKSIKDNALLHKDNNYILKMDFQNFFNKIKPDIFFSKLENTGLKLDSFDENTLRNLLFWRPGKKRSTTLILSVGAPSSPFISNFVMYDFDKSLDDWCRNNGITYSRYADDITFSTNIKDILCRVPKVVKKMLSLHVPGLSINESKTIFTSMAHNRHVTGVTLTPQGNLSIGRDRKRMLFAKIHKYSLGLLSSEEINKTKGMIAFANYLEGDFLLRLQKKYGCELITKFLMEGNK

SEQ ID NO: 4108 - protein, 311 aa, Enterobacter sp.
  source 1..311: note = Related to JAHEUL010000001.1; note = Enterobacter mori
MQLTSKIISKFNYSNLAFHLLLADAPKKYKVYYIPKRGSGFRMIAQPTKELKHVQRFLVSLLEPNLPVHYKAMAYQKNKSIKDNALLHKGNNYILKMDFQNFFNKIKPELFFSKLQNANITLESGDRAVLRNLLFWRPGTKRSMTLILSIGAPSSPFISNFVMYDFDRKIDDWCESNNIVYSRYADDITFSTNSKDLLSSVPKVVKKMLATNVPGLSINESKTIFTSMAHNRHVTGVTLTSDGKLSIGRDRKRMLYAKIHKYSLGLLSSEEINKVRGLISFADYLEEDFLLRLRKKYGHDLIDKFMKEGGL

SEQ ID NO: 4109 - protein, 309 aa, unidentified
  source 1..309: note = Related to LFJS01000012.1; note = Serratia marcescens
MTIRKELSKKLELPELQIVLFCINASKKYRVYSIPKRKVGRRIIAQPTKELKKYQRVLVEILQPYLKVHECAYAYKTDISIKDNAEQHRRNTYILKMDFQNFFNKIKPELFFSKVDSVSIKLSREDRSLLMDILFWKPGSKRSTALVLSVGAPSSPFISNFIMFDFDKAIFEYCKNIGVTYTRYADDLTFSTNKKDVLFGVPVVVKAALSALAPGMIINDSKTVFSSKAHNRHVTGVTISNEGELSLGRSKKRYISSLIHKYSLGTLPDSEIDYLRGLLSYAQHIEPMFLTRLKNKYGEKLINHIRSGA

SEQ ID NO: 4110 - protein, 312 aa, unidentified
  source 1..312: note = Related to JACYNT010000005.1; note = Pantoea agglomerans
MSISILLAKKLNITEHQLHSFCLNAPKKYKVYTIPKRSMGKRIIAQPTKTLKRVQREALGILLPFLEVHFSSYAYKKGLGIKDNAMLHKDNSYLLKMDFQNFFNKIKPDVFMAKLRNKIPDISYSDEELLKNVFFWKPGLKKSKTLILSIGAPSSPHISNFVMFEFDSEIESLCRGLGVVYTRYADDLTFSTNKKDVLFQLPKIIRGLLSTCMPSLTINDSKTVFSSKAHNRHVTGVTITNDGMLSLGRKKKRYLSSLIFKYSLNQINYEDFSHLRGMLGHAKYIEPAFVFRMKAKYGAELVDKIILGESYE

SEQ ID NO: 4111 - protein, 311 aa, unidentified
  source 1..311: note = Related to UHIX01000001.1; note = Yersinia enterocolitica
MSIYNQLCEKMKVDPADLDFFSHNAPKKYKVYSIPKRTVGHRLIAQPTSELKEYQRALVSILEKSLPIHESAYAYRKNIGIKQNALKHVANSYLLKMDFQNFFNKIKPEIFFSKLLKANIEISDDDRKILKNLLFWKPGLRRSVTLVLSVGAPSSPLITNFVMYYFDEHMTNWCKKNKISYTRYADDITFSTNTKSILFSVPSIVRTILKQEIPGMSINESKTIFSSKAHNRHVTGVTLTTDNKISLGRKKKKEISALLHRFTLKILPPEDISFLIGLLSHAKNIEPIFLSRMKSKYGEDTFYNLRGDYHV

SEQ ID NO: 4112 - protein, 311 aa, Escherichia coli
  source 1..311: note = Related to CP057778.1
MEILSAVSKELGVNVNELRRLSSVAPKKYKVYTIPKRQSGFRLIAQPTSEIKRIQREVVKILASKLIVHDAAKAYKVSIGIKDNAKIHMANSYLLKMDFQNFFNKIKPALLFDKLRSQGVVLSGEDKEFLEGILFWKPGKKRSITLVLSVGAPSSPFVSNFVMYDFDNYINNWCSVRNISYSRYADDITFSTDEKNILFEVPKVVRFALSLCAKGISLNESKTVFTSKAHNRHVTGVTLTVDGELSLGRQKKRMISSLLHKYTLGLLAKEDVISLKGFVGHALYIEPKFIARMKIKYGKEVIHALFSEEGM

SEQ ID NO: 4113 - protein, 315 aa, Vibrio sp.
  source 1..315: note = Related to CP003330.1; note = Vibrio cholerae
MNILTTLREQLLTNNVIMPQEFERLEVRGSHAYKVYSIPKRKAGRRTIAHPSSKLKICQRHLNAILNPLLKVHDSSYAYVKGRSIKDNALVHSHSAYVLKMDFQNFFNSITPTILRQCLIQNDILLSVNELEKLEQLIFWNPSKKRNGKLILSVGSPISPLISNAIMYPFDKIINDICTKHGINYTRYADDITFSTNIKNTLNKLPEIVEQLIIQTYAGRIIINKRKTVFSSKKHNRHVTGITLTNDSKISIGRSRKRYISSLVFKYINKNLDIDEINHMKGMLAFAYNIEPIYIHRLSHKYKVNIVEKILRGSN

SEQ ID NO: 4114 - protein, 315 aa, Vibrio sp.
  source 1..315: note = Related to JAHUGH010000003.1; note = Vibrio fluvialis
MNILTTLREQLLANNLLMPQEFEKLEAKGSHAYKVYSIPKRKAGRRTIAHPSKKLKICQRQLSHILSPLLNIHDSSYAYIKGRSIKDNALVHSHCDYLLKMDFHNFFNSITPSILRKCLVQNEILITEYDINKIEQLIFWNPSKKRYGKLILSVGSPISPLISNAIMYPFDKVISETCTKNGIRYTRYADDITFSTNRDNVLHNIPELVEHVLNKIYFGQIIINKRKTFFSSKKHNRHVTGITLTNDNKVSIGRSRKRYISSLVFRYINKNLDIDDINHMKGMLAFAYNIEPMFIHRLSHKYKVNIVEKILRGHD

SEQ ID NO: 4115 - protein, 315 aa, Vibrio parahaemolyticus
  source 1..315: note = Related to JACBSQ010000003.1
MKIVPILQQQLTKRKTVSDADFRKLLALGSHAYKVYTIPKRKAGHRLIAHPSKSLKECQRQLTSILELYLPVSDSSYAYMKGRSIKDNALVHVHSSYILKMDFQDFFNSITPEIFRQHLERNDIIISETEFKILEQLIFWNPSKRKYGKLILSVGSPISPFISNTIMYYFDEYINNLCSQLNINYSRYADDLTFSTNQKDILFSLPQFVSDILHKEFSGRIVINHRKTVFSSKGHNRHVTGVTITNQNKLSIGRKRKRYISSLVFNCINNNLSNEEIMHLKGLLAYCYNIEPMFIHRLSRKYKFNIIKNLVKKDD

SEQ ID NO: 4116 - protein, 329 aa, Vibrio sp.
  source 1..329: note = Related to AAXMKO010000002.1; note = Vibrio alginolyticus
MCLGCFYVGGKLKILPLLEQSLANNEVVSNSDFRKLQMLGSHAYKVYTIPKRKAGKRVIAHPSVKLKKCQSNLVSILELYLPVHDSSYAYVKGRSIKDNALVHAKSDYLLKMDFYDFFNSITPPLLSEHLDKVGLTVDLYELAKLNQLLFWNPSKKKHGKLILSVGAPSSPFISNTMMYFFDEKISKLCAKNNINYSRYADDLTFSSNKKGILFLLPDVVKKILKQEFKDKIVINDSKTIFSSKKHNRHVTGLTINNNGSISLGRKRKKYISSLVFEYLNNRLDEGEFYHLIGLLAFSYNVEPMFLHRLSRKYKVNVIDSILKKGRLNE

SEQ ID NO: 4117 - protein, 317 aa, Vibrio sp.
  source 1..317: note = Related to MCWW01000053.1; note = Vibrio cyclitrophicus
MKILSILELRLSEREKISYADFLKLQNLGSHAYRVYSIPKRKAGNRTIAHPSSKLKECQRQLVSILEMYLPVHESAYAYMKGRSIKDNALVHSKSAYLLKMDFQDFFNSITPETLERHMRKLGLTLPINEQKALEQLVFWNPSKRKYGKLILSVGSPISPFISNSVMFFFDQKMFDICTKHNINYSRYADDLTFSTNSKGLLFSIPELVKQAIKQEFNGELVINDSKTIFSSKAHNRHVTGITINNNGQISLGRQRKRYVSSLVYQYTKNELSEEEIDRLKGLLSFCHNVEPYFLSRLTRKYKLNIVDELLRKGTKK

SEQ ID NO: 4118 - protein, 314 aa, unidentified
  source 1..314: note = Related to JACAWH010000114.1; note = Aggregatibacter actinomycetemcomitans
MESKLFHTLCTNLNLSTSELMEFISNAPISYKVYSIPKKNGGRRTIAHPSKKLKKIQRELLVLLEKTLQIHQSAFAYIKGKNIINNAELHKNNKYLLKLDFYDFFNSISDVIFINYLDKIGLSLSELDSKLVSHIFFWNPNNKDKTHKKLILSVGSPSSPMISNAIMYFFDSEIKIHCDSMSIVYTRYADDLSISGNDKDKLKEITQFIRSRLYDLFNGKIILNDLKTILVSPGYNKFITGITLTPQGGLSIGRKRKKYIFGLIYKYIKNELKDDSISHIKGMLSFSYSIEPSFIRRLELKYGKDTIRRIINEK

SEQ ID NO: 4119 - protein, 314 aa, unidentified
  source 1..314: note = Related to NZ_QEPT01000001.1; note = Haemophilus parainfluenzae
MESKFFHTLCKKLNLSTSELMEFISNAPVSYKIYSIPKKNGGRRVIAHPAKKLKKIQRELLLLLEKDLKIHQSAFAYIKGKNIIQNAEPHKNNKYLLKLDFYDFFNSISDDIFINYLDKIGLVLNELDKELVKHIFFWNPNSKDKRHKKLILSVGSPSSPMISNAIMYFFDSEIKTYCDSISIVYTRYADDLSISGNDKDNLKDVIMFIRSKLYDLFNGRIILNDLKTTLISPGYNKFVTGITLTTQGGLSIGRKRKRYIFSLVYKYIKNELKEDAVLHMKGMISFSHLVEPSFIIRLESKYGKNIINRIINGK

SEQ ID NO: 4120 - protein, 318 aa, unidentified
  source 1..318: note = Related to CP069510.1; note = Haemophilus parahaemolyticus
MKSKRKFELFYKLHEGERFSSKLNELIALTPTAPISYKVYSIPKKKGGRRTIAHPTKKLKEIQKKLLELLQLQIHKSAYAYRKGRNIAQNAETHKENKFLLKLDFHDFFNSINNIIFTRHLDKIGIHYNEDDKWLINHIFFWNPNKKDNSHKKLILSVGAPSSPTISNAVMYFFDKEIEEYCESKSMKYSRYADDISISGNNKNELKTIIPVIREKLNELFNGRIILNELKTVIISPGYNKFITGITLTSQGSISIGRKRKRYIFSLVYKYKINELSKDLIPHLKGLLLFSKNIEPSFIVRLELKYGKEIIRRILDEK

SEQ ID NO: 4121 - protein, 345 aa, unidentified
  source 1..345: note = Related to NZ_CP060440.1; note = Serratia marcescens
MQSPAFVPCPGAAPFASFSKESYAQGLPWALQLEAMMLFSDRICDELGYSKRQLNSFLKNAPRKYRVYSIPKRTVGYRTIAHPSKKLKEIQRVCDALLQDILPVHHCAYAYKKGCSIKKNAMLHVSQSYLLKMDFSNFFNSITPDMFWSKVDGFKIGINKKERGKLTKAMFWQPNRHDSDKLKLSIGAPTSPLISNFVAYEFDCFLSEWCISQGIIYSRYADDLTFSTFNAGILFSVPRVVKAFLNKYFDGITINEAKTKFSSKKHNRHVTGITLTDDGRISLGRGEKRRIFHFVHVFSLGELDPDLLPKLRGKIVFYEHIQPGFIKRLSDKYTEELISSLLNGD

SEQ ID NO: 4122 - protein, 312 aa, Aeromonas sp.
  source 1..312: note = Related to JAEHHT010000028.1; note = Aeromonas veronii
MLLIEKIIKESKLSRPELTILSHKAPYMYKVYAIPKRRSGYRIIAHPAKPLKLIQRLILQLLEPSVKIHDNVHAYVKGRSIITNATVHKKNKYLLKMDINNFFNSIKPELFWSSLNKQDIMLPKIHQKTIERLIFWNPSKKKDGKLILSVGAPTSPFISNIVMFSFDSKLSSVCDKLGISYSRYADDLTFSTKKKNILFNLPHIVKILLQEEFSGAMTINEQKTVFSSKAHNRHVTGITITNDKQLSIGRARKKYIYHLIHQATLGNLDDERMNHLLGLISFCRSIDANFLDKIANKYGSSFVKDLIKRELK

SEQ ID NO: 4123 - protein, 316 aa, Vibrio parahaemolyticus
  source 1..316: note = Related to NNJO01000006.1
MLQRLYSKLQKKLEIPRYKIESFSSSAPNRYKVYTIPKRTSGRRVIAHPSRELKKYQRALVSILTPLLSVHKCSFAYKKGVSIKENALEHAKNSYLLKMDFNDFFNSIDPELFFLMNKSNGVEFSDSEKKLIQNLVFWNKTKSYEQKLVLSVGAPSSPFISNFVMFKFDELIEKFSKKNNITYTRYADDITFSTNKRNALFLIPEEVNNILREHYGYRITVNSTKTVFSSKAHNRHITGITINNEGQLSIGRDRKRMISSLIHKYSIKVLDISDFQYLQGLLSFASHVEPRFLDSMTRKYGHETITNIVKGDFYDS

SEQ ID NO: 4124 - protein, 314 aa, Vibrio sp.
  source 1..314: note = Related to PIFK01000090.1; note = Vibrio splendidus
MMFKLYFKLSKKLELSRSRIESFSKNAPNMYKVYTIPKRTSGRRVIAHPSRELKVYQRALVEILASSFEPHHCSFAYRKQLSIKENALVHSRNSYLLKMDFSEFFNSIEPDMLFSAAKVRNIGLSDAEKRLVENLVFWNKTKSHNTKLVLSVGAPSSPLISNFIMFEFDRLMYEFSKNNSIVYTRYADDITFSTNRKNTLFDVPNEVNRVLSKFYDYRISINSTKTVFSSKAHNRHITGVTITNDGKLSIGRSRKRMISSLIHQFTLKKIDSCDFSYLQGLLSFASHIEPSFIFSMKSKYGDEIITQIIKGDFS

SEQ ID NO: 4125 - protein, 328 aa, unidentified
  source 1..328: note = Related to NZ_LT897828.1; note = Salinivibrio costicola
MLQLSAAPFSLSRAMFKLYFKLAQKLDVSRRRIDTLASGAPNKYKVYTIPKRTSGLRVIAHPSREVKVYQRALIKILQDVLRVHHCSYAYKKKLSIKDNALRHASNRYLLKMDFNDFFNSITPEVFEDALNHVEVDFSEAETKLIKHLVFWNKNKSFPPHLVLSVGAPTSPLISNFIMYEFDKAMYDFCEENLITYTRYADDITFSTNVKDILFKVPNKVNKILEEKFNGAISINQSKTIFSSKAHNRHITGITITNQGSLSIGRSRKRMISSLIHKFMIGEIDYSDFKYLQGLLSFSSHIEPSFISSMRKKYGEGIIGQVIKGDFNE

SEQ ID NO: 4126 - protein, 320 aa, Proteus sp.
  source 1..320: note = Related to NZ_NBUT01000010.1; note = Proteus vulgaris
MLKIFLKLQNELASSKNDGVLPTRARIESFARRATNCYKVYSIPKRTSGVRVIAHPSKELKNYQRALISILEQQLEPHSASYAYQKGKSIKLNAQKHTKKKFLLKMDFNDFFNSITPQIFLTELRYRRIFLSKAEEKLLINLFFWNKTKSEDKKLVLSVGAPSSPMLSNFIMYRFDELVSKYAKENSIVYTRYADDLTFSTNIKNVLFSVPEYIKGILRDLYQHYITINDSKTIFTSMAHNRHVTGITITNNFELSIGRERKRLISAMIHKFKIGVLNEDDLCYLQGLLSFAINIEPNFINRLSRKYGKEIVHVIRKGGL

SEQ ID NO: 4127 - protein, 318 aa, unidentified
  source 1..318: note = Related to NZ_CP011025.1; note = Pseudoalteromonas arctica
MAQKLFSKLIDILPLVSASRSKIERFSLTAPNRYKVYSIPKRTSGRRIIAHPSKELKIYQRALLSSLEYLLDSHDSAYAYKKDRNIKANAKRHVRKKYLLKMDFNDFFNSITPDMLFTQFVKEEVIFSEAEKRLLKNLLFWNKTKSFDGKMVLSVGAPSSPSVSNFIMKEFDEFVYRYSKEKSIIYTRYADDLTFSTNKKDTLFDMPNFIKKVLGEVFEHKLTINESKTIYTSMAHNRHVTGVTLTNKSTLSIGREKKRLISLLVHKYKINEIDESDFNYLHGLLSFSHHIEPSFTKRLSKKYGSDILKNIIKGIYCE

SEQ ID NO: 4128 - protein, 310 aa, unidentified
  source 1..310: note = Related to NZ_CP080635.1; note = Shewanella putrefaciens
MRIKLFSNLQTKLNCSRKKIETFSEKAPYKYKVYTIPKRSSGLRVIAHPSKELKVYQRALLSVLGDHLISHKSSFAYKLNTGIKDNAYQHMHNSYLLKLDFSNFFNSIVPDMLLAALNFRGIEVSDAELRLLSNLLFWNKTKTSDNKLVLSVGAPSSPAISNFIMFRFDKVVFKYCKEKSIIYTRYADDLTFSTNIKDALFELPRYINGLLGSMFDHRIMLNERKTVFSSKAHNRHVTGITITNENNLSVGRARKRTVSSLVHKYSLNKLDQFEFEQLRGMLSFILHIEPHFLHRLEKKYGRSLLIKIRS

SEQ ID NO: 4129 - protein, 327 aa, unidentified
  source 1..327: note = Related to NZ_PYMJ01000011.1; note = Photobacterium frigidiphilum
MLLISLQEFSLTIRLYKAFEDELGVTRSRLMNFAKTAPKRYKVYTIPKRTSGYRVIAHPSKSLKKIQKFLAGFLADIFITHPNSFAYKKGVSIKDNASVHLGTKYLLKMDFSNFFNSITFDLLVSSCKECEVKISLAELRLLEGLLFWNKTKTINGDLVLSVGAPTSPLVSNFVMYKFDIFISDYCKINNINYSRYADDITFSTNDKNKLFGVTRVVKDILSEHYSNKITVNNVKTTFSSKAHNRHITGVTLTNDNKLSVGRERKRLISTLIHKYVINDIEKQDVTYLQGMLSFAIHVEPDFRGKMSKKYGSNVVTEILKLRVENDE

SEQ ID NO: 4130 - protein, 319 aa, Vibrio sp.
  source 1..319: note = Related to MCYX01000113.1; note = Vibrio splendidus
MTIRLYRAFEEDFGITRARLTTFAKTAPKKYKVYTIPKRSSGYRVIAHPSKSLKEKQKFLVAFLSDFFVSHSNSFAYKKGVGIKDNARMHLGTKYLLKMDFSDFFNSITVDLLALACDENGIKVSSAELKLLESLLFWNKTKTIRGSQNLVLSVGAPTSPLVSNFVMYKFDTLMSDYCSQNEINYSRYADDITFSTNKKNHLFQVTRVVKDILSDHYSNKITVNNIKTVFSSKAHNRHVTGITITNNNKLSVGRERKRLISTLIHKYTIGSIDIDDTVYLQGLLSFAIHVEPDFRVKMSNKYGFEVINTILKLRVENDK

SEQ ID NO: 4131 - protein, 316 aa, unidentified
  source 1..316: note = Related to ABIC01000002.1; note = Shewanella benthica
MKLKLYRALYESLSITRSSLNRFAESAPKKYRVYTIPKRTSGQRVIAHPSKQLKAVQKELVKILVFPLKSHETAYAYKKGLSIKDNAEQHLNTAYLLKMDFSDFFNSITPAVLFLICENNNIKWSDAEKRLLKNLLFWNKTKSFNGKLVLSVGAPSSPLISNFVMYDFDVKISDFCKKNKINYTRYADDITFSTNVKEILFEVPKLVKTLLNEIYNNLITINDLKTIFSSKRHNRHVTGVTISSENKLSIGRSRKRMISSLIHKFKINVISQEDTCYLQGLLAFSISVEPIFIERMKNKYTESVIHNILKIRVENE

SEQ ID NO: 4132 - protein, 313 aa, unidentified
  source 1..313: note = Related to NZ_WHZZ01000005.1; note = Photorhabdus khanii
MQLHLYKNITEMLSWSRSQITSFARNAPNKYKVYTIPKRSSGQRLIAHPSRKLKLLQRALVEILSNNLIPHECAFAYRNSISIKENAQYHLDNQYLLKMDFSDFFNSITPDILFSVCEIKEITLSEAEKWLLQRAFFWNKTKSHDGKLVLSVGAPSSPLISNFIMYPFDEAINLYCTQHSIYYTRYADDLTFSTKIKNTLFNIPDIVKWALKKHYASQISINEFKTVFSSKAHNRHITGITITNDNKLSVGRERKRMISSLIHKYKIGIVNEEEKTYLQGLLSFSFHIEPMFKIRMSKKYSPEIINEILKFRK

SEQ ID NO: 4133 - protein, 313 aa, unidentified
  source 1..313: note = Related to NHOK01000005.1; note = Yersinia frederiksenii
MQLHLYRSIIDKLSWSRSRITSFARNAPNKYKVYTIPKRSSGQRLIAHPSKNLKLIQKKWIEILSDIFVSHQSAFAYKDNMGIRENAQHHMKNQYLLKMDFTDFFNSITPEIFFSICLKKEIIMSNAEKWLLQQTLFWNKTKSYDGKLVLSVGAPSSPLVSNFVMFPFDEIISEYCNSHHIKYSRYADDLTFSTDEKNCLFTIPNLVKSALQKIYAYQISINEFKTIFSSKAHNRHITGITITNDNDLSIGRGRKRMISSLIHRYRIGVMDDIEKAHLQGFLAFSFYIEPLFKTRMIKKYSSEVITDILKFRK

SEQ ID NO: 4134 - protein, 380 aa, unidentified
  source 1..380: note = Related to NZ_WMDE01000055.1; note = Photobacterium carnosum
MSSRALRQTQIYWGTIPVAVKNFPRAGVRTSHPDRGKFSTASFSKGESPVLSFQYRHFYLRICTDMHQKLYSKLVDKLDSTRSTINSFSKNAPNKYKVYTIPKRTSGHRVIAHPSKELKKYQRALVSILSDILNIHPTSYAYRTGFSIKDNAYKHRKNQYLLKMDFSDFFNSIEPKLLFFVFDECEIHFSSSELRLLEKLLFWNKNKSVDAKLALSVGAPSSPLISNFIMCIFDEKINYFCEKNGITYTRYADDLTFSSNKKNILFNVPNIVKNLLKEEYKNLILVNDLKTCFSSKAHNRHITGVTINNDAELSIGRDRKRLISAMINNYKKGILLSEDFDYLRGILSFANNIEPDFISRMKRKYGKCILLKIKKGLPNE

SEQ ID NO: 4135 - protein, 315 aa, Vibrio sp.
  source 1..315: note = Related to JAKEUP010000008.1
MRQQLYSKLQIKLGRSRSSIKSFANNAPNKYKVYTIPKRTSGRRVIAHPSKLLKDYQRALTDILKPALTVHPAAFAYRTGFSIKDNAQMHKNHQYLLKMDFNDFFNSIDPELFEDILIRRGIRFSNAEMSLLTRLLFWNKTKSHDEKLVLSVGAPSSPLISNFVMSIFDAKMKLHCLKRQITYTRYADDLTFSTNKKDVLFNIPQLVKDTLTKDYSHKILINELKTIFASKAHNRHITGVTINNASELSIGRERKRLISALVHKYTVKQLDTDDIHYVQGLLSFAQNIEPHFVDRLSKKYGFDVLSKLIRDKGDE

SEQ ID NO: 4136 - protein, 314 aa, Vibrio parahaemolyticus
  source 1..314: note = Related to AAZQRX010000007.1
MHNKIFSKLQASTSRARSTIESFSRNAPNKYKVYSIPKRTSGSRTIAHPSKELKYYQRALAIILRPILTVHIRAYAYRTGLSIKDNAAIHAKNKYLLKMDFNDFFNSITPVMFFKICDKRKIKFSASEQRLLTRMLFWNKSRSANEKLVLSVGAPTSPLVSNFTMSLFDFLLHDECLSRGITYSRYADDITFSTNHKGILFDIPLYVKAVLAERYDYGITINESKTVFSSKAHNRHITGITINNEGKLSLGRERKRVISSLVHQFKLNKLAIEDFAYLQGLLAFAQHIEPAFIIRLKNKYGESTVSNINKGLNI

SEQ ID NO: 4137 - protein, 317 aa, Vibrio parahaemolyticus
  source 1..317: note = Related to CP066247.1
MHHKIYSKLQLKLKTSRSSIDNFALNSPNKYKVYTIPKRTAGFRVIAHPSRELKCYQRHLVEILTPHLKNHSSSIAYTKEKSIRENALIHVRNDYLLKMDFNDFFNSITPELFFHICRVQEVFFSQAEERLLTKLLFWSKSKSKDEHLVLSVGAPSSPLISNFTMYTFDELITSICHENGISYTRYADDITFSTNRKNILFSIPSLVKSILLNKYEYKITINDSKTVFSSKAHNRHVTGITLNNEGQLSLGRNRKRMLSSMIHKEKIGSLSLDDFTYMRGLISFAKHIEPAFIFRMRVKYGNETVDNIIKGVRNVTN

SEQ ID NO: 4138 - protein, 315 aa, Vibrio sp.
  source 1..315: note = Related to NZ_JAFNJW010000049.1; note = Vibrio crassostreae
MYQKLYSKLQNELKRSRSSIESFSKTAPNRYKVYTIPKRTSGHRVIAHPSRELKLFQKALNTLLLDTLKTHFCSVAYAKGLSIKDNALRHAGNSYLLKLDFNDFFNSIEPDLFFVICDLQEINFSNAEKRLLTQLCFWNKTKSNNTKLVLSVGAPSSPMISNFVMTVFDELMYKHCRVQGITYTRYADDLTFSTNKKNILFDIPTFVEAVLVAYYASKISINPEKTCYSSKKHNRHVTGITISNTGELSLGRERKRMISAMLHNFKVGRLDSDDYAYLQGLLSFARHIEPKFVDKFRKKYGDGLIDTITKGNFNE

SEQ ID NO: 4139 - protein, 320 aa, unidentified
  source 1..320: note = Related to JABCPW010000001.1; note = Serratia marcescens
MRLHLYAKLTEIQSRNRRQIDNFLYNAPNRYKVYSIPKRNGGERVIAQPSGELKDFQHNLINILESNFLIHSSAVAYKKGFGIKHNAAMHSGNPYLLKLDFTDFFNSITPELFFMACVWNRYDLSTAEKRVFTKGLFWNKAKSQSGRLSLSVGAPSSPLVSNIIMYLFDEEFSRRCEKRGIVYTRYADDLTFSTHHKNSLFSLPDEVRVFLNKNYHNRITLNERKTIFTSRAHNRHVTGVTLTTQGGLSVGRERKRFISSLIHKYTLGILEPDMAYYLQGLLSFAIYIEPEFRTRLSKKYSQETILELLKLRKEDGTENE

SEQ ID NO: 4140 - protein, 328 aa, unidentified
  source 1..328: note = Related to PEHA01000001.1; note = Serratia marcescens
MRLNLYAKLTEIQSRNRRQIDSFLFNAPNRYKVYSIPKRNGGERIIAHPSSELKSFQHSLIDILESNFLIHKSAVAYKKGWGIKHNAALHSNNPYILKLDFTDFFNSITPDLLLMACAWNGYTLSIAEERVLTKSLFWNKAKSQSGRLSLSVGAPSSPLISNIVMYLFDETFSSLCEQREIIYSRYADDLTFSTQHKNILFSLPDEVRTFLNKNYHNRITLNERKTVFTSRAHNRHITGITLTTKGTLSVGRERKRFISSLIHKYKLGLLEPEMTYYLQGLLSFAIYIEPEFRTRMSKKYSQEIILEIIKLRKEDGTYKKLKIYQTHI

SEQ ID NO: 4141 - protein, 320 aa, unidentified
  source 1..320: note = Related to AP021969.1; note = Raoultella ornithinolytica
MRLNLYAKLIEIQSRSRRAIDSFLYNAPNRYKVYSIPKRNGGERIIAHPSRELKTFQYDLIRILEPHFRIHTSAVAYKKGSGIKQNAAMHSHNPYILKMDFTDFFNSITPDLLFMACAWNECNLSAAEQRVLTKGLFWNKAKSQSGRLSLSVGAPSSPFISNIIMFLFDETFSRLCEQRGIVYSRYADDLTFSTHHKNILFTLPDEVRIFLNKNYHNRITLNERKTVFTSRAHNRHITGITLTTQGSLSVGRERKRFISSLIHKYTLGILEPEMTYYLQGLLSFAIHIEPEFKTRMINKYSTDAVMEIITLRKKDETYRT

SEQ ID NO: 4142 - protein, 321 aa, unidentified
  source 1..321: note = Related to CP019077.1; note = Klebsiella pneumoniae
MRLNLYAKLVKIQPRNRRQIDSFLFNAPNRYKVYTIPKRNGGERIIAHPSRELKTFQYGLITILETHFRIHESAVAYKKGLGIKQNATLHSNNPYILKMDFSDFFNSITPDLLFMACEWNDYELSSAEKRVLTKGLFWNKAKNQSGRLSLSVGAPSSPLISNVIMYLFDDSFTNFCQQREITYSRYADDLTFSTHHKNALFDLPNEVRHFLNKEYQNRITLNERKTVFTSRAHNRHITGVTLTTQGSLSIGRERKRFISSLIHKYKLGLLDPDTSYYLQGLLSFAIYIEPDFRVRMSKKYSTNTVTEIIKLRKEDEAYRKQ

SEQ ID NO: 4143 - protein, 321 aa, unidentified
  source 1..321: note = Related to CP023009.1; note = Lonsdalea britannica
MRLNLYAKLIEIQPRSRRQIDRFLANAPNKYKVYTIPKRDIGERIIAQPSRELKKFQHYIISILESLFEIHTSAIAYRKGTGIKQNANMHSANPYILKMDFSNFFNSITPDLFFLACKWNNYSLSAAEERLLTKALFWNKSKTQDGRLALSIGAPSSPLVSNIIMYLFDEEFNTLCKDNGIVYSRYADDLTFSTSHKNLLFSLPDKVRAFLFKHYNNRITLNERKTVFTSKAHNRHITGVTLTNEGTLSVGRERKRLISSLVHKYKLGLLEPDMVYYLQGLLSFASYIEPNFRFRLARKYSAETITKLIKLRKADGKFKKQ

SEQ ID NO: 4144 - protein, 320 aa, Proteus sp.
  source 1..320: note = Related to NZ_CP029133.1; note = Proteus mirabilis
MRLNLYTKLVKIQPRNRRQIDSFLYNAPNRYKVYSIPKRNGGERIIAHPSRELKNFQYNLIDILEPLLKIHPNALAYRKGLGIKKNASLHAQNSYILKLDFSDFFNSITPDLLFTACTKNEYELSSAEKRVLTKGLFWNKAKSQSARLSLSVGAPSSPLISNIIMYYFDETFTDICNQREIVYTRYADDLTFSTNKKNILFNLPDEIRFFLNKEYKNLITLNERKTVFTSRAHNRHITGITITTEGSLSVGRERKRLISSLIHRYTLDSLSPDMTYYLQGLLSFAIYIEPDFRDRMSKKYSSHIITKLIKLRKEDGTYCE

SEQ ID NO: 4145 - protein, 320 aa, Enterobacter sp.
  source 1..320: note = Related to NZ_RXRP01000001.1; note = Enterobacter asburiae
MHLNLYAKLDGVQSLTRKQIDSFLANAPDRYKVYSIPKRNGGERIIAHPAKRLKQFQYHIVDIMEEVCEIHPCAMAYSKGKSIKENALSHADNQYILKLDFSDFFNSITPEMLFKALTDNNLNVTKAEERALSKSLFWNKSKTVNSRLALSVGAPSSPLISNIVMYSFDAFFANFCKQHGMHFTRYADDLTFSTNIKGVLFRIPDMVRKYLNEYYKNNITLNERKTVFTSKAHNRRVTGITITPQGTLSLGRERKRLISVLIHKYTLGILESDTLSYLQGMLAFAFHIEPVFYESMKRKYSSETIYNLMPIRKKNVESTS

SEQ ID NO: 4146 - protein, 316 aa, unidentified
  source 1..316: note = Related to NZ_CP051652.1; note = Pectobacterium carotovorum
MKLHLYAKLTKDLDKSRSAVERYIYNAPMKYKVYTIPKRTSGQRVIAHPARKLKVFQRALIKVIEPHFNLHIKAMAYRNGIGIKHNAAIHQNNNYLLKLDFNDFFNSITPDLLFTHFLKKEILLSDAEKKLLTNTFFWNKPKKKDGKLVLSVGAPSSPFISNLILFPFDELIDDYCSKKNISYSRYADDLTFSTSEKNILFQLPSLVKRHLSSIYKNKITINEFKTVFSSKAHNRHVTGVTITNTGELSIGRERKRLISSLIHKFKIGELNLDLTRYLQGLLSFASDIEPSFKSRMELKYSLSTIEKIIEFRGENE

SEQ ID NO: 4147 - protein, 320 aa, unidentified
  source 1..320: note = Related to NZ_LR134116.1; note = Yersinia intermedia
MKLHLYAELTKKLNRSRNSVERFISNAPMKYKVYTIPKRTSGQRVIAHPAKKLKVLQRALVAVLQPHFSIHDKAMAYRKGLGIKQNATLHQKNDYLLKLDFNDFFNSITPEIFIKYCTQKEIELSDAEKKLLIKTFFWNKTKKTDGKLVLSVGAPSSPFLSNVLMFGFDEFIENYCSQKNISYSRYADDLTFSTSDKNVLFHIPKLVKTQLGLMFFNQITINEFKTVFSSKAHNRHVTGVTLNNNGELSIGRGRKRLISSLIHKFMHGELDIELTRHLQGLLSFASDIEPIFKSRMEIKYSHKLIESIVKFRGEHEQENQ

SEQ ID NO: 4148 - protein, 319 aa, Salmonella sp.
  source 1..319: note = Related to AAXBOI010000003.1; note = Salmonella enterica
MKLNLYAKLTDKLGRSRNTVERYISNGPMKYKVYTIPKRTSGQRVIAHPAKKLKVIQRALVSVLEPHLKIHHKAMAYRKGLGIKDNAVLHKENEYLLKLDFSDFFNSITPELFINYCMQNDITLSTAEKNLLIKTFFWNKTKKNDGKLVLSVGAPSSPFISNTIMYFFDEAIDKYCITKNITYSRYADDLTFSTPDKNVLFHIPTLVKKQLGIIFSNQITINAFKTIFSSKAHNRHVTGVTINNDGEISIGRERKRLISSLIHKFILGQLDIEHIRYLQGLLSFATDIEPKFKSRMISKYSNQVIENLIKFRGSDEQTN

SEQ ID NO: 4149 - protein, 316 aa, Enterobacter sp.
  source 1..316: note = Related to NZ_LRCR01000003.1
MKLHLFSNLVKETKFSRNAIERYIYNAPMKYKVYTIPKRSSGQRVIAHPAKKLKILQRALVSILMPFLNIHDRAMAYRKGIGIKHNATMHKNNEYILKIDFNDFFNSITPDMILERFSKNNIELSSAEKKLIIKCFFWNKTKRIDGKLVLSVGAPSSPFLSNVLMFDFDEFFSNYCKENSIVYSRYADDITFSSSKKNVLFIIPDLVKKQLAILFKNKITINEFKTIFSSKAHNRHVTGVTINNNGELSLGRERKRFISALIHKFTLKTLSLDQAQQLQGMISFASDIEPSFRLRMEKKYSEGIICKIVKFRGSYE

SEQ ID NO: 4150 - protein, 315 aa, Proteus sp.
  source 1..315: note = Related to JADSTR010000010.1; note = Proteus mirabilis
MSVHLYKRLSEAMATPRNTIDSYIRNAPMKYKVYTIPKRTSGQRVIAHPAIRLKKIQRALVVLLQEYMFIHQKAMAYKTGSSIKKNAELHRTNDYILKIDFNDFFNSITPDLFVNYCNNLGLKLTSAEMNALIKILFWNKSKKNDGKLVLSVGAPSSPFISNVILYSFDEIVDNYCNERNIVYSRYADDLSFSTKEKNILFSVPEFIKKQLNKLFSNAITINELKTTFSSKAHNRHITGVTIDNDGRLSIGRERKRYISSLIHKFSLKKLEFNDAKHLQGLFAFACNIEPRFKARMEKKYSKLIIDDLIKLKELL

SEQ ID NO: 4151 - protein, 317 aa, unidentified
  source 1..317: note = Related to JAGVVN010000001.1; note = Methylovulum psychrotolerans
MQIYEFLCKELLVSKQEINEFVLSAPKKYKRYTIPKRTSGKRVIAQPAKRLKDYQRALIKLLEQILPVHDAAFAYKKNIGIKENARRHQKSSYLLKMDFRDFFYSITPDLFFAILKKLDIVFSPQDCYLLTQVLFFNPSKKTGGKLIMSIGAPSSPFISNSIMFFFDKAIYESCLKKGICYTRYADDLTFSSNKKNALFELPVLVKQLLVEHFCGCITINESKTVFSSKSHNRHVTGITITNDDRLSIGRQRKRYISSLIHKFSLNQLADEDINYLQGLLAFACHIEPNFKQRMIDKYSAETISQIVTCVRRGDEKA

SEQ ID NO: 4152 - protein, 313 aa, unidentified
  source 1..313: note = Related to JAATWI010000006.1; note = Methylococcaceae bacterium WWC4
MQIYDFLCKEISVSKQEIYDFVSSAPKMYKVYTIPKRTSGKRVIAQPAKRLKDYQRALVKLLEKVLPVHDAAFAYKKQVGIKENAMKHQKSSYLLKMDFQNFFYSITPTLFFSILYKLNIDLSSEDRYLLTQILFFNPSKKTGGKLVLSIGAPSSPFISNSIMYFFDMSIYEYCINNNINYTRYADDLTFSCQKKDILFAVPTHVKQLLVEYFDGRITINESKTVFSSKSHNRHVTGVTLTNDNRLSIGRQKKRYISSLIHQFSLNQLADEDISYLQGLLAFACHIEPNFKQRMIDKYSAEIIAKIITRKRTL

SEQ ID NO: 4153 - protein, 319 aa, unidentified
  source 1..319: note = Related to WTAZ01000264.1; note = Methylococcaceae bacterium
MQLYQFLSTELSTSKQEIDKFILSAPKMYKIYTIPKRTSGKRTIAHPAKKLKEYQRTLISLLEQSLPVHDVAFAYKKNTGIKQNAAQHQQSKYLLKMDFQDFFHSIKPKLFLSILEKLKVDLTQEDRYLLSQILFWNPSKRSGGKLILSIGAPSSPFISNVIMFFFDQALYTECHRQNITYTRYADDISFSTNTKNTLFEIPHLVKKLLVNHFNGAITVNESKTVFSSKAHNRHITGITLTNENKLSIGRQKKRYISSLIHQFSLGQLPTEDIQYLQGLLAFACHIEPEFKQKMIKKYSFETINQISTSVEGEDEPIRR

SEQ ID NO: 4154 - protein, 316 aa, unidentified
  source 1..316: note = Related to JACJDY010000010.1; note = Pseudoalteromonas sp.
MHICQALCAELKLDKTQVIDFALESPKMYKVYAIPKRTSGKRIIAHPAKRVKVAQHALLRQMKVIFPIHHCAFAYQEGLSIKLNAQEHCHNQYLLKMDFQNFFNSITAPLFVRMLDKLSIKISPQDTFLIEHLAFWCPSKETGGKRILSVGAPSSPFISNWIMYGFDKIVFELCRKENIVYTRYADDLTFSTNKKNVLYKIPKQIKSILREQLDGGIVINDVKTIFTSKKHNRHVTGITLTNQGLLSIGRKRKRHISLLLHKFSLGLLGTEDILSLRGLLTFANHIESDFKARMTKKYSSQVIQQLLAYDRVHNHE

SEQ ID NO: 4155 - protein, 316 aa, unidentified
  source 1..316: note = Related to JAHKQX010000026.1; note = Shewanella sp.
MLICQSLCTELNLNQTQLIDFAIEAPKMYKVYAIPKRTSGKRIIAHPAKRVKIAQRALLTQMETIFPIHRCAFAYQQGLSIKLNAQQHCDNQFLLKMDFQNFFNSITAPLFVSMLDKLSINISSQDLFLIEHLAFWCPSKETGGKRILSIGAPISPFISNWIMYGFDKTIFDLCRKENIVYTRYADDLTFSTNKKNILHRMPKKIKSILRDELGGNIVINDIKTILTSKKHNRHVTGITITNHGDLSVGRDRKRYISLLIHKFSLGLLSEEDIASLCGLFSFANHIEPDFKDRMVKKYTAQVIQKLFSYDRVYKHE

SEQ ID NO: 4156 - protein, 311 aa, unidentified
  source 1..311: note = Related to RCHN01000034.1; note = Ketobacter sp.
MHLAHFLSTSLSISNQEIITFSSSAPNRYKVYSIPKRTSGKRTIAHPAKKLKLVQRLLSNHLSTILPVHESAFAYRKGLGIKDNAQYHMNGRYLLKMDFQNFFLSIVPELLFITLKKNAIEFSEEDEFLMSRLLFWRPSKSSSGKLVLSIGAPSSPLISNFIMFQFDQEMAAKCKSKGVRYSRYADDLTFSTNVKGALFDLTSLVKELLEKHLLGYIAINETKTVFSSKAHNRHVTGVTLTNDGQLSIGRQRKRFISSLIHQYSLGKLPAEDLSYLQGLIAYANDIEPVFVKRMSKKYSPQTMDQLIKGVK

SEQ ID NO: 4157 - protein, 314 aa, unidentified
  source 1..314: note = Related to NZ_SLZR01000017.1; note = Reinekea marinisedimentorum
MDFFERLARDLDISEQDVRGFALTAPNRYKIYRIPKRTSGSRVIAHPSRMLKAYQRLIISYVTELLPVHSCAYAYRQGVGIKDNARVHAKSSYLLKMDLQNFFNSINPSLFFDVVEKVGLEVADRDKWLLTKLLFWSPNKSSSGRLILSVGAPSSPLVSNFIMYPFDIRMSEYCFANGLKYTRYADDITLSTNKRGCLFDLPDYIKGVLANEYQGKLSVNESKTVFSSKAHNRHVTGITITNKGSLSIGRQRKRYISSLIYQFSSDQLDPDDTLHLKGLLSFAFDVEPDLRRRFEKKYTSKVIHQILTCEKGND

SEQ ID NO: 4158 - protein, 314 aa, unidentified
  source 1..314: note = Related to NSDJ01000001.1; note = Rahnella variigena
MKIVEFLSNKTGKNIQALIRLIDQAPRMYKVYKIPKRSVGFRVIAQPSKEIKELQRFTVEMLEKILPVHEKAMAYQKGKDIRSNALLHVKNDYILKMDFEDFFNSINPEVFHKSLEIDEISINNTELYFLTRLLFWNPSKRKNGKLILSVGAPSSPIISNYIMHRFDCAIEEFCNSNAIMYSRYADDMTFSTSKKNHLFSIPEIVRKTLRNKYYKRISIKQSKTIFSSKAHNRHITGVTLNNEGKISIGRSRKRMLSSLIFKASKNAIDDESLSSLTGQLGQAFYIDNFFKESMIKKYGESLIKSILGKKNEKA

SEQ ID NO: 4159 - protein, 314 aa, unidentified
  source 1..314: note = Related to NZ_CAJCKX010000049.1; note = Serratia sp.
MYIVEYLSKKTGRGMQELSRLVDQAPRMYKVYKIPKRSAGFRVIAQPSKDIKELQRFAVEILKQILPVHDKAMAYQKGKDIKTNALLHARNDYILKMDFEDFFNSINPELFNISVEKDKINITKNELYWLTRLLFWNPSKRKNGKLILSVGAPSSPLVSNYIMYRFDCAIEEYCNSNSITYSRYADDMTFSTSKRNVLFMIPEIVRKILKNNSYKRISIKQSKTVFTSKAHNRHVTGVTINNEGKVSVGRSRKRMLSSLIFKASKNELDHEVLSSLTGQLGQAFYIDVCFKESMIKKYGASIIKSILSGNHEKT

SEQ ID NO: 4160 - protein, 314 aa, unidentified
  source 1..314: note = Related to AP022371.1; note = Providencia rettgeri
MTIVKYLSEKTGTEIQELNKLISQAPRMYKVYKIPKRSLGFRVIAQPAKSIKKLQRFAVEILETILPVHESAMAYQKDKDIKKNALLHVKNNYILKMDFEDFFNSINPELFIKSLKKDKILISKIDLNHLTKLLFWNPSKRKNGKLILSVGAPSSPLISNYIMYRFDCDIEEYCQLKNITYSRYADDMTFSTKEKDRLFEIPGFVKKTLKKQSYKKISIKQSKTIFSSKAHNRHVTGVTLNNQGNLSIGRARKRMLSSFIYKACKNELNQEELLSLVGQLGQAFYIDKIFKKSMERKYGLLTIKSILGGNNEKI

SEQ ID NO: 4161 - protein, 314 aa, Citrobacter sp.
  source 1..314: note = Related to CP058318.1; note = Citrobacter freundii
MQIAEYLSTKTGKSVHDIGSLISNAPRMYKVYRIPKRTGGYRVIAQPSKVIKSLQRHAVEMLRDYLPVHLHAMAYQKGKDIKLNAQVHCKNEYILKMDFEDFFNSINPELFKKCLKLDGLHFSESDINLLIKLLFWNPSKRKNGKLILSVGAPSSPLISNYIMYRFDCAIEKYCKQENITYSRYADDITFSTLKKDQLFIIPDIVNKTLKQNSYKRISIKLSKTVFSSKAHNRHVTGVTLNNDGDISIGRARKRMLSSLIFQAMHGKLDNDELSSLKGQLGQAFYIDSKFKASMHKKYGISIINKIIGGNSEKT

SEQ ID NO: 4162 - protein, 318 aa, unidentified
  source 1..318: note = Alteromonadaceae bacterium; note = Related to JABSOI010000029.1
MNLLDLLNRELNKTTFSISESDILIFSMNAPKKYRVYSIPKRSAGTRIIAHPSKELKVYQRHLVDLFKNILPTHHTAYAYRQGLSIKENAECHKKNKYLLKMDFENFFNSINPLILKNELVKNKIKFTKEDFKLLEQLCFWCPSKKIGGKLILSVGAPSSPSISNFIMYQFDEIVENWCKQRKITYTRYADDISFSTSLKDALFEVPKLVESTLTSNFGKRISVKASKTVFSSKAHNRHITGVTITNEGELSIGRDRKRYISSLIHKFKLNMLAQQDIEHLKGLLGFAFHVEPVFRERMINKYSKKTMDEINQFRSES

SEQ ID NO: 4163 - protein, 308 aa, unidentified
  source 1..308: note = Related to NZ_CP014322.1; note = Alteromonas stellipolaris
MSILTLLSNDLGISENELKALLVNAPRKYKVYSIPKRTGGRRTIAQPIPALKQAQRSFNKCINLNVHEAAMAYRTGLSIKENANIHRMNPYLLKMDLENFFNSITPSLLWLNLKKQNIEFNLYDNHYLENLLFWRPRKSSKIILSVGAPSSPYVSNSLMYNFDITVHELCSNMHIKYSRYADDLTFSTKEKNHLFEVPKAINNLLLKEFGNNLTINTSKTVFSSKAHNRHVTGVTINNQGNLSLGREKKRYIKHLVHKFSFDLLDDSEVPYLKGLLSHANHIEPDFIVRLQKKYSDEIIQCLVNGTNR

SEQ ID NO: 4164 - protein, 310 aa, Aeromonas sp.
  source 1..310: note = Related to NZ_CDBH01000035.1; note = Aeromonas dhakensis
MDLIDALSSSLKINKSTLQDFCTLAPNKYRIYSIPKRNSGYRIIAHPSKELKKYQRTLNDLIKNILPVHSSAFAYRNGLDIKKNALRHAKNPYLLKMDFHDFFNRITPDVFWKQVGNKFLSLTRKDADIFEKLIFWNRSKKNDGKLILSVGAPTSPLISNSVMYNFDCSISEWCVKNDITYTRYADDITFSTRKKNILFTVPEKIKNEIIMHFGNAMLINDGKTIFSSKAHNRHITGITITNEGIPSLGREKKRYIYHLLHQYSLNLLEHDDILHLKGQFSFSCYIDKSLMHRAEKKYSSELVQKLIHYV

SEQ ID NO: 4165 - protein, 315 aa, Aeromonas hydrophila
  source 1..315: note = Related to NZ_CP027804.1
MQLIDFLSSKLEKTPQEIEKFALTAPKMYKIYTIPKRKAGHRIIAHPSKNLKSYQHLVIDYIKIKLPIHGAAQAYKTGHSIKTNALAHINGEYLLKMDFNNFFNSITPELFSLECAKRNIDLTRSELSLIKKLIFWNPSKKKGGKLILSVGAPTSPLISNFVMYGFDYLLSEYCHKNYISYTRYADDLTFSTRKKNNLFQIPSIVKDFLSAELNKRISVNESKTIFSSKAHNRHITGVTLTTENKLSVGRERKRYIYSLLHSFSLGNMAKPDIEHLQGLFSFACHIDETFKSRAENKYSKLIISQLHEGRLNNEK

SEQ ID NO: 4166 - protein, 337 aa, unidentified
  source 1..337: note = Related to QEKR01000001.1; note = Pectobacterium versatile
MTTLRQHLLTSPLVAELAFSLLSSSSKKVTKPDVDKWLILSLAKVMLSGPKMYRVYTIPKKNGGKRTIAHPSKVLKVFQKGLVEFLINKLPVHDAAYAYRKNISIKDNAFQHVKNSYFLRMDLADFFNSIDTSLFEEQIEKHKVQLADSDKVLLRRSAFWSPKKINSGNLILSVGAPSSPMISNFIMFSFDETITSICEPLKIKYTRYADDLFFSTSHKDVLFKMPKLIQYVLYSEFGKKITINEVKTSFSSKAHNRHIAGITITNNDTLSLGRERKRTISSMIHKYSLGNCTDFELAKLQGLLSFSKHIEPLFIERMKKKYSVSLIDVIISGQWRK

SEQ ID NO: 4167 - protein, 338 aa, unidentified
  source 1..338: note = Related to JAENMV010000007.1; note = Lelliottia amnigena
MTTLRHHLLTSPLVAEHAFSLLSSSSSKKVTKSDVEKWLTISIATVMTSGPKMYKVYTIPKKNGGKRTIAHPSKVLKVFQKGLVEFLVNKLPVHDAAYAYRKNISIKDNALQHAKNAYFLRMDLADFFNSIDVNLFEKQIEKHKIELAAADKALLRRSAFWSPKKMSSGNLILSVGAPSSPMISNFIMFSFDETITSVCDPLRIKYTRYADDLFFSTEHKNILFKIPSLIQYVLTSEFGKKIAINEVKTSFSSKAHNRHIAGVTITNNDTLSLGRERKRLISSMIHKYSLGNSNDIELAKLQGLLSFSKHIEPLFIDRMKEKYSISLVENIITGRWRK

SEQ ID NO: 4168 - protein, 338 aa, unidentified
  source 1..338: note = Related to CP002824.1; note = Klebsiella aerogenes
MTTLKHHLLTSPLVAEQAFSLLSTSSSKKVTKLDVEKWLTVSLAKVMVSGPKMYRVYTIPKKNGGKRTIAHPSRALKVIQRGLVEFLNDKLPVHDAAYAYRKNISIKDNALQHVTNPYFLRMDLADFFNSIDVNLFEERIEKHKIQLSAADKALIRRSAFWSPKKTNTGTLILSIGAPSSPLISNFIMFSFDETISSICAPLKITYTRYADDLFFSTKNKNILFKIPSLIQYVLSTEFGKKLTINEVKTSFSSKAHNRHIAGVTITNNDTLSLGREKKRIISSMIHKYSLGKSDDIELAKLQGLLSFSKHIEPLFIERMMKKYSVNLVDKIISGQWRK

SEQ ID NO: 4169 - protein, 340 aa, unidentified
  source 1..340: note = Related to JAADJV010000002.1; note = Rahnella aceris
MKKLTIFFASSPFIEAWLHIVKPSDEENFTSEQKIAHIKQSIALIMRSGPKMYKVYSIPKRNGGKRVIAHPAAMLKAFQRDLCLHLANLLPVHSAATAYQPASSVKINALAHASNHYLVKMDLANFFNSIDVDIFAAELRRHKIALTLKELSFIRQCTFWSPSKTSTGRLILSVGAPTSPLISNFVMHAFDDIIQKICEPLAVTYTRYADDLFFSTNVRDISFKIPDLVAYVLAKTYENHFSINQAKTRFSSRAHNRHVTGVTITNEGALSVGRQRKRIISSLIHKYTLQKINLAETKILQGLLSWAFCIEPTFVISMRKKYSDNVIQSIISGNWNNDRA

SEQ ID NO: 4170 - protein, 337 aa, unidentified
  source 1..337: note = Related to NZ_CP050508.1; note = Raoultella terrigena
MKKITNFFVTSPFVDAWLQTTVPSVGELSTEQRVACIGHNLALITRSGPKMYKVYSIPKRNGGKRVIAHPAAMLKAFQRDLNLHLVSLLPVHNAATAYRVSSSVKTNAKAHASNPYLLKMDLYNFFNSIDVDIFVAELRRHRITLAVKELSFIRQCTFWSPSKTSTGRLILSVGAPTSPLISNFVMYEFDNIIHKICESLSVTYTRYADDLFFSTNVQDVLFKIPDLVTYVLTNTYNGKFSTNQTKTRFSSKAHNRHVTGVTITNEGRLSLGRQRKRMISALIHQHCLKKINLVETKKLQGLLSWASNIEPTFVISMRKKYSDKVIQSIISGNWNDD

SEQ ID NO: 4171 - protein, 338 aa, Vibrio sp.
  source 1..338: note = Related to MCYT01000164.1
MAKLIEQLIHSTPVTAYANSVLSEYTDKFTAKDIEIIATQTLNDVKARGPKMYKVYTIPKRNGGKRLIAHPSKPLKATQRALVELLQKQLPVHEAAFAYRDGVSIKDNAFAHSKNPYFLKMDLSDFFNSIDTELFEDQLKSHSIFIRNKKLLHNTIFWSPAKELNNKLKLSVGAPSSPLISNFIMYNFDEAISTICHSSNIKYTRYADDLFFSTNTKNLLFNIPSLVNYLLEKQYDNKLSVNESKTSFSSKAHNRHITGVTITNDNNLSIGRKKKRYISSLVHKYKLGSLDVENIETLQGLLGFAKHVEPSFMIRLCKKYSQNTIDSITRGAWKNNEK

SEQ ID NO: 4172 - protein, 337 aa, Vibrio sp.
  source 1..337: note = Related to CP030798.1; note = Vibrio owensii
MAKLIDQLINSSFVVSYAYSVLSACTGKFTQEDVKLLATQTINDVKARGPKMYKVYTIPKRNGGKRLIAHPSKPLKATQRALVEVLQKKLPVHEAAFAYRSGLSIRDNALVHSKNRYFLKLDLSDFFNSIDVDLFESQLASNRIFIRNKTLLNQIIFWSPTKDLQSKLKLSVGAPSSPLISNFIMYRFDKDMSKICDSLNVRYTRYADDLFFSTNIKDILFDIPELVNYILDKRYDNKLLVNKSKTSFSSKAHNRHITGVTITNEGKLSIGRGKKRYISSLVHKYNLGLLEYEDMEKLQGLLGFAKHIEPSFIIKLSKKYSHQSVEYIAKGGWKNNE

SEQ ID NO: 4173 - protein, 339 aa, unidentified
  source 1..339: note = Related to NZ_UGHC01000001.1; note = Grimontia hollisae
MTKLKNQLINSTSVRSYAYDVLSEQSTRISEDDIEALAQKTVHDVWDNGPKMYKVYTIPKRSGGRRTIAHPSKPLKAVQKALVELWEAELPIHSAALAYQKGKSIKENAECHRYNKFLLKVDLSEFFNSIDIEVFESQLLGNNIKFDKRDSRLIRNILFWSPQKSLSSKLVLSVGAPSSPFISNFVMYTFDSLISEVCESLNIIYTRYADDMFFSTQVKNTLFKVPEIISFLLKNKYNNKLLINESKTIFSSKAHNRHVTGITITNDNKLSLGRSRKRYISSMVHKYKLGMLDFEDIEQLQGLLGFAKNIEPEFLVRLKKKYSSETVNIILNGKWKNEK

SEQ ID NO: 4174 - protein, 342 aa, Vibrio sp.
  source 1..342: note = Related to NZ_AP014635.1; note = Vibrio tritonius
MTKIAKQLLSSPFIHSYAYKELDELMDNVTQKDIDSFVELTVDDAIINGPKMYKVYAIPKRNGGRRIIAHPSQPLKAVQRDLIEILKSQLPIHDAAFAYQQGKSIKGNAEVHRFNKFFLKMDLSNFFNSIDVDLFYNHLDLNSVNIDIEDKSTIKNIIFWRPQKNETGELRLSVGAPSSPLISNFIMYKFDSIISEVCASFKIKYTRYADDLFFSTTVKGVLFKIPDIVEFILKSKYDDVLTINKSKTSFSSKAHNRNITGITITNSNELSLGRNRKRYISALVHKYRIGLLDDNATESLQGLLAFAKNIEPKFLMRLKNKYSNDVIESIISGRWKNHESEE

SEQ ID NO: 4175 - protein, 327 aa, Vibrio sp.
  source 1..327: note = Related to CP036500.1; note = Vibrio cholerae
MENIFNYLLSSPNVVDFSNESKKTKQPKLPQDILHDVLLYGPKMYKVYTIPKKNGGKRVIAHPSRGLKVVQRDLVVFLEKILPVHNSAYAYIKNRSIKDNAHYHSKNRYHLKMDLSNFFNSIDTELFFTQLDTNGVTFNSDEMYLLQRSLFWSPTKSEIGKLITSVGAPSSPLISNFIMNTYDFMISDICKSLEVKYSRYADDMFFSTNIKDILFTLPNIVDYILDTIYSGKLRVNSAKTKFSSKAHNRYITGLVITNDAKVSIGRSRKRLISSLVHKHQLGLLEPDSVSSLQGLLGFVRSVEPEFLDRLVKKYGDYEIQRIIKGLV

SEQ ID NO: 4176 - protein, 336 aa, Vibrio sp.
  source 1..336: note = Related to NZ_SLWI01000001.1; note = Vibrio crassostreae
MKKLLNYLASPETADNLKKYFELAYPQIKYDEDVFNLMAKHHIETLLKSAPKMYKIYTIPKRNGGNRTIAHPAKGLKATQRDLSKYLVDILPVHSCAFAYTKNKSIKDNALVHSKNKFLLKMDLVNFFNNINDTLLNNELVENDIPLTTLEITQVNKLSFWCPTKDDDGKMILSVGAPISPLISNFIMYRFDSKLSELAVNNKVKYSRYADDIFLSTNAPNVLGLFVNVVELLLLELYGGKLVINKTKTVFSSKANNRHVTGLTINNSGEVSLGRKRKRVISSLVHKFSIGILDSSEIESLRGLLSFSSSVEPEFITRLEKKYTFKLIDKIVRGLS

SEQ ID NO: 4177 - protein, 333 aa, unidentified
  source 1..333: note = Related to JAJVEH010000001.1; note = Aliivibrio fischeri
MKKLLDYLTSSDNLKNYLKLTYPQISYDDDVFLIMGKYHLSSLYKSAPKMYKFYTIPKRNGGRRAIAHPSKKLKVTQRDLSTYLEKILPVHDCAFAYRKNKSIKDNALIHVGNKFLLKMDLVNFFNSITPKMLINEIKESDLSFEESELDYIKKLAFWCPSKEDNGKLILSVGAPSSPLLSNFIMYRFDSVLSEVAKSNKVKYSRYADDIFLSTNVPNVLKLFVNIVKIILKEMYHDELIINEMKTVFSSKAHNRHVTGITITNDNKISLGRQNKRMISSLVHKYSLGVLDTSKIIRLRGLISFASSIEPDFIIRLENKYTFNLINKLIKGLD

SEQ ID NO: 4178 - protein, 339 aa, unidentified
  source 1..339: note = Related to NZ_JWGX01000025.1; note = Shewanella sp.
MEELQKSLLASNPVKEFFSQKASHIFGESGQKLPMAAESLALAALQNVKVQGFKMYKVYTIPKRSGGNRVIAHPSKELKAFQRGLVDILESELPIHSCAHAYVKRKSIKSNAMAHAKNQYLLKMDFLNFFNSVDIELLAKACSGNKKIEEVGLMQFANLVFWSPTKQRDGKLVLSVGAPTSPLLSNFVLYEFDNLISLVCNSMHVTYTRYADDLFFSTNEADILKSVPNIVKYFLDYIYGDKLRVNDAKTAFSSKAHNRHVTGLVIANSGRISLGRERKRFIKSLVYKSTKNELDVEELNSLMGLLSFSQHVEPDFIMRLVCKFGQDAVDYIVNAQWRG

SEQ ID NO: 4179 - protein, 308 aa, Enterobacter sp.
  source 1..308: note = Related to NZ_CP041062.1; note = Enterobacter ludwigii
MNIIEIISKKTMLASSNVITFIHTAPYRYKKYYLPKNNGGSREIAQPSRELKIMQRLILQLLLPYLPVHENAFAYVEGKSIKRNALMHRNNEYFLKMDFSDFFNSIKPIDLRNVLLKNGYETIPLNLNLIDNLFFYKKTKKSGLSLSVGAPSSPLISNAVLYDFDVRVSELCKQEDITYTRYADDLTFSCNEKGKLLVFQKEIAKILRKIQSPKLKLNDKKTIYASRSVSRRVTGIVINNNGELSLGRHKKRMISSLVHRYTLGKLIPDDIHKLKGYLAYAKHIESGFIVSMRNKYGADVIDSILKYN

SEQ ID NO: 4180 - protein, 308 aa, unidentified
  source 1..308: note = Related to NZ_CP031104.1; note = Leclercia sp.
MNIIEIISKKTMLSSSNVITFIHTAPYRYKKYYLKKNSGGVREIAQPSRELKIMQKLILELLVPYLPVHENAFAYVEGKSIKRNALMHHKNEYFLKMDFSDFFNSIKPLDLRNTLTDNGFETIPVNLNLIDKLFFYKKTKKSGLSLSVGAPSSPLISNAVLYDFDIKVTELCERQDIIYTRYADDLTFSCNEKGKLIGFQKEIVRILRKMKSPKLKINDKKTIYASRAVSRRVTGIIINNNGDLSLGRHKKRMISSLIHRYTLNQLNNDDILKLKGYISYAKHIDINFVSSMNKKYGAETLNSITKHN

SEQ ID NO: 4181 - protein, 308 aa, unidentified
  source 1..308: note = Related to NZ_JAIVKM010000013.1; note = Mangrovibacter yixingensis
MNIIDIISKKTLLPSPNVMVFINTAPYRYKKYYLPKNSGGVREIAQPSRELKVMQRIIIEKIADFLPIHESAFAYVKGKSIKENAQKHKRNEYFLKLDFSNFFNSIKPSDLRRVLIKNGFENNTFNLLLIDKIFFYKKTKKSGLTLSVGAPSSPLISNAVLYEFDVKVTELCNKEGITYTRYADDLTFSCNEKGKLIGFQKSIIKILRKIPSPHLRLNDKKTIYTSKSVSRRVTGIVINNDGQLSLGRKNKRMISSLIHHYTLNKLNAEDVYKLKGYLSYAKHIETTFINSMTIKYGVDTINAILKSN

SEQ ID NO: 4182 - protein, 308 aa, unidentified
  source 1..308: note = Related to NZ_JAAQVP010000001.1; note = Providencia rettgeri
MNIIDIISKKTMLPSSNVITFINTAPYRYKKYYLKKNNGSLREIAQPSRELKIMQKLILNILSEFLPVHENAFAYIEGKSIKLNALKHKENKYFLKMDFSDFFNSIKPIDLRNILIKNGFESNMYNLKLIDNLFFYKKTKKSALSLSVGAPSSPLISNAVLYQFDIELSEICRNENITYTRYADDLTFSSNEKGKLIDFPKVVYLILRKMHSPKIKVNNSKTIYTSKAVSRRVTGITINNQGELSLGRHKKRVICSLIHKFLQGELDNDEIHKLKGYLSYAKHIEINFIKSMEKKYGVELLNSIKKVV

SEQ ID NO: 4183 - protein, 310 aa, Salmonella sp.
  source 1..310: note = Related to CP074606.1; note = Salmonella enterica
MDIIKKIADETLMPVSKVSAFIFTAPYRYKVYPIPKRNGGFREIAQPSRALKFMQRIVIAELEKVLKVHENAYAYVKGRSIKDNVEKHQRNSYILKVDFCEFFNSISPCDLELCLKNNGLDSLLSSKELLNKLFFYKKSKRSALSMSIGAPSSPFLSNAIMYNFDSVISDMCSNKNITYTRYADDLTFSTNEKGILYEFIHEIDKVLEGIDSPKLKLNDKKTIFASKKCNRHITGIVINNEGELSIGRDKKRYLSSLVHKFSLNALNEEEIEHLKGYLAYVNKIEPSFISGMKRKYGVEVVNSIITFNPL

SEQ ID NO: 4184 - protein, 313 aa, unidentified
  source 1..313: note = Related to JAKUDL010000001.1; note = Shewanella sp.
MVIDDCITKMLKNQLLLSDAELLYFASTAPHRYKKYFIPKRNGVDLREIAHPSSQLKYVQRLLVESMVKTFPIHSSAVAYRKGISIRDNATLHLKNNYLLKMDFENFFNNITPEIFFDACEDNNISYSEKDKNLLKNILFYKKRRASGLSLSIGAPSSPLVSNFIMYQFDVLVSDFCAARNIVYSRYADDLFFSTRKSDELSQVAGFIKEILRTMYRGRLKINDAKTIHTSKKNKRLVTGVVLSSEDKLSIGREKKRFYSSMIHKFTLKLLDGDEIHKLQGYLSHAKNIEPLFISRMEKKYGHKALAEIMSYN

SEQ ID NO: 4185 - protein, 316 aa, unidentified
  source 1..316: note = Related to WBJR01000006.1; note = Hydrogenovibrio sp.
MSLLAFLSDNLMFHSSELKKFISTAPHRYKHYPIPKRSGNGFRIISQPSKELKFIQKILVEHLEEVVIIHHKALAYRKGLSIKDNALLHKANPYLLKMDFKDFFPSIVPELFFDALLKQDIHFSKQDYALLQKVFFMKKTRKSPFILSIGAPSSPLISNAVMFEFDKQIDELCQKRNITYSRYADDLVFSSKIDGALFDLPKLVEGVLDKDYFGLIRINKDKTVFSSKAHNRHITGVTITNDNKLSIGRDKKRLLSSKVHRYSLNQLEAELAAKLSGEISFAIFIEPSFKAFLIRKYGRDVVESLLRFNFENTPEL

SEQ ID NO: 4186 - protein, 311 aa, unidentified
  source 1..311: note = Related to NZ_UGYV01000001.1; note = Shewanella morhuae
MNLIKFLKETTLIPEDELLKFASTAPHRYKEYDIPKRNGKGVRHIAQPSKELKFFQKIIVNYLSDILPVHEKATAYKQRVGIKENALYHCGNEFILKMDFENFFPSITPDVLFHLFKRLDIKFDKTDEFFLEKLLFKKGRRDRNSYLSIGSPSSPFISNCIMYFFDIEADRVCWNRGITYSRYADDITLSTKKRNNLFDMPKLLNEMLTRELLGFIKVNKDKTVFSSKRHNRHITGVTLNNDGDISLGRDRKRLISSMIHRFKSGQLDSIQTAELQGFISFSYYIEPLFLNRLKLKYGTDIIDRIKSYNLL

SEQ ID NO: 4187 - protein, 311 aa, unidentified
  source 1..311: note = Related to PJAR01000040.1; note = Glaciecola sp.
MSIYVFLSDSLLISESDLEKFSSTAPYRYKVYDIPKRNGKGFRTIAHPSKELKLIQRLCVQYLENKLYVNDAATGYRRGLSIKDNAAAHSKNKYLLKMDFEDFFPSIKPLLFFYICKQREIKFTVKEKAFLRYILFRKSRGEDVFRLSIGAPSSPLISNFVMSTFDEIVLKYCINNKITYTRYADDLAFSTNVRNSLFDVPKTIQERLHDATRGTIKVNSSKTVFSSRKHNRHITGVTLTNDGLLSLGRKKKREISSLVHKFSIGTLEQTKISNLQGQLSFAYHIEPEFLIRLQKKYGQAIIDKIKGKTDK

SEQ ID NO: 4188 - protein, 309 aa, unidentified
  source 1..309: note = Related to NZ_AQXX01000010.1; note = Hahella ganghwensis
MNIEEYLTELLYVGPDLLYKFASTSSRRYKTYQIKKRSGKGVRTIAHPSKELKYIQRLLVEKLEQLLPVSDNAYAYIKGKSIRDNAQQHVNNKYFLKIDFSDFFYSITPDIFFFMLKKHKIEYSQKDQFLLKNLLFWRKERDGGLTLSIGAPSSPLISNFVLYDFDKSINSWCQGNKIVYTRYADDISFSTNKRNALFDVLANVKKTLNDCGLENIKINDSKTIFSSKAHNRHITGVTITNDNKLSIGREKKRLLSSMIHHFSQGNLPKEKYEELSGHLAHAFFIDPDFKNFVIKKYGNEVLKNLFQRK

SEQ ID NO: 4189 - protein, 310 aa, unidentified
  source 1..310: note = Related to NZ_BMLS01000007.1; note = Bowmanella pacifica
MIIEHLSETLFLAEHDIVRFSLSSPHRYKVYEIPKRNSSKTRTIAHPSKELKFIQRALVEFLSKILPIHEAAFAYKKGMGIKDNAKQHSKSKYLLKMDFKDFFPSITPDLFFRVAEDYGIEFNENDRIVLTGLLFWKPKRSDGLVLSIGAPTSPLISNFVMFEFDKKVSSDCLNKKITYTRYADDITFSTRVKDALFEIPPFISSVLNETVKGIELNPEKTIFTSRAHNRHVTGVTLTNDGEISVGREKKRLISSMIHKSKYSKLSSEAAANLLGLISYATHIEPEFMDRMIKKYGAEVIQAIKARAIGS

SEQ ID NO: 4190 - protein, 310 aa, unidentified
  source 1..310: note = Related to nan
MIIKHLSDTLFLAEHDIVRFSLSSPHRYKVYEIPKRNSKKTRTIAHPSKELKFIQRTLVDYLSKILPVHGAAFAYKKGIGIKDNARQHAKSKYLLKMDFKDFFPSITPELFFSVAKAHGIEFNKEDRIVLTGLLFWKPEGSDGLVLSIGAPTSPLISNFVMYIFDQKLSDECLNRKVTYTRYADDITFSTRIKNTLFELPHLITSLLTKTVDGVVINPDKTVFTSRAHNRHVTGVTLTNEGELSIGRERKRLISSMIHKSKFSKLSSEDASNLLGLISYATHIESQFLDRMTKKYGAEVLQAIKDRAVGS

SEQ ID NO: 4191 - protein, 310 aa, unidentified
  source 1..310: note = Related to BMOT01000001.1; note = Shewanella aestuarii
MIIEYLSESLFMAKYDIVNFALTSPHRYKVYEIPKRNSKNTRTIAHPSKELKFIQRELLKKLIEILPVHDAAFAYQKGIGIKDNANKHSNSKYLLKMDFKNFFPSITPSLFFSIAEKNGIVFDKNDQLVLKGLLFYKSKANKELTLSVGAPTSPLISNFLMHIFDQKISYECSLKKVTYTRYADDITFSTNIKNILFELPEIIMQLLQETVVGVEINPEKTIFTSKAHNRHVTGVTLTNEGGLSIGRDKKRLISSMIHKSKFNTLANDDACYLLGLISHASHIEPEFLERIIKKYGLEVIQNIKLSAITS

SEQ ID NO: 4192 - protein, 310 aa, unidentified
  source 1..310: note = Related to JADYXE010000008.1; note = Pseudoalteromonas sp.
MIIEYLSESLLIAEHDLTSFALTAPHRYKVYEIAKRNSKKTRTIAHPSKELKFIQRSLVELFEKSLDIHKAAFAYKKGFGIKDNAKAHINSKYLLKMDFKNFFPSITPSLFFTVAEKKGVVFTAADRAILTGLVFWKPQGRDDLILSIGAPTSPIVSNFVMNYFDEAVFDLCINRKITYTRYADDITFSTKLKDNLFDLPKIIETILNETVQGIEVNSEKTIFTSKAHNRHVTGVTLTNDNHISVGRDKKRLISAMIHQSKFKSLTPEDASHILGLISFAIHIEPEFLDRILRKYGAEVLNNIKAKAGGI

SEQ ID NO: 4193 - protein, 310 aa, unidentified
  source 1..310: note = Related to PGZF01000002.1; note = Gammaproteobacteria bacterium HGW-Gammaproteobacteria-15
MIINYLSDSLFMSKDDIVRFSLTAPHRYKVYEIPKRKSGQKRVIAHPSKELKFIQRSLIDILKLYLPVHDAAFAYRKGIGIKENAKQHLNSKYLLKMDFENFFPSITPALFFKTLEEHGFVLDGDDKLVLSGLLFWKKKDFDGLTLSIGAPTSPLVSNSVMYLFDKKISEICLSRKISYTRYADDITFSTNIKNILFDIPELVSSVLNELVDGVKLNCKKTIFTSKAHNRHVTGVTLTNDGKLSIGRERKRLISSMIHQSKFCNLTMDEASKLLGLISHAEHIEPGFLKRMIHKYGEEVLNNIKSRASGV

SEQ ID NO: 4194 - protein, 311 aa, unidentified
  source 1..311: note = Related to NZ_CP027426.1; note = Klebsiella oxytoca
MDILQHISDLLLTKKSEIISFSLTAPYRYKIYRIAKRNSDKKRTIAHPSKELKFIQRAITEYLSDKLPVHECAFAYKKGSSIKTNAQIHLHTKYLLKMDFENFFPSITPRLFFSKLRLANIDLTADDKVILENILFFKSKRNSNLRLSIGAPSSPLISNFVMYFWDIEVQKICSKIGVNYTRYADDLTFSTNNKDVLFDIPDMLENILPKYSLGKIRINHEKTVFSSKGHNRHVTGITLTNDNKLSIGRERKRKISAMIHHFINGKLPADEYNKLIGLLAFAKNIEPSFYKSMVIKYGPDNIHKLQKQKDK

SEQ ID NO: 4195 - protein, 319 aa, unidentified
  source 1..319: note = Related to NZ_WUBS01000016.1; note = Acerihabitans arboris
MNISKHLCEKLVMDEDEIFKFSITAPYRYKVYEIPKRNSPKKRTIAQPSKELKFIQRIIISLLKDVLPIHASCYAYRKNLSIKHNALVHLNTKYLLKMDFEDFFPSISPHLFFEILKLTKIQFEDNDLILLEKLLFFKPKRNSTLRLSIGAPSSPFISNFVMYFFDIEVQSLCDAHGINYSRYADDLTFSTNNKDLLFDMPIIVSDILSKHSFDSIKINNRKTIFSSKGHNRHVTGITLTNESNLSVGREKKRLISVMIHYFVTGRLDVDDVLKLQGMLSFARFVEPKFYLSMCKKYGLVNIKKLNSLQIASGDKSSYI

SEQ ID NO: 4196 - protein, 304 aa, unidentified
  source 1..304: note = Related to NZ_LUUH01000065.1; note = Methylomonas methanica
MSKPEIIRFCLTSPHRYKTYKIPKRNSDQKRTISHPSKELKFIQRVLNDYLREKLPIHDCAYAYKQGLNIKDNAEVHASTKYFLKMDFEDFFPSITPDFFFTMLDKAGLEINEIDSILLKNFIFCKASRKSGLFLSIGAPSSPLISNFVLFGFDENIKRFCAEKNINYTRYADDLTFSSNIKNSLFEVPEIVKFYLDKETNGKIKINKRKTVFSSKAHNRHVTGVTLTNDEKLSVGRNRKRLISAMIHHFKCGKLDPTEIDKLKGLMSFVNYIEGDFYRRMIIKYGSETIDKLNNYKQVKRDAK

SEQ ID NO: 4197 - protein, 307 aa, unidentified
  source 1..307: note = Related to MAJP01000040.1; note = Aliivibrio fischeri
MNIFEQLSDILCVDANELMDFASTSPHRYKVYTIAKRNSNKRRLIAHPSKELKFIQRILIKILEPKLKVNNVAHAYIKDKSIKTNAMQHVNSKYLLKMDLENFFPSITPNLFFSCLTKSGVEITERDKELLTGFLFWKPRHSYKLLLSIGAPSSPLVSNFILNSLDEELSVYCESNKIKYTRYADDLTFSTNVKDILFSLPEVVSESLYNNYNGDIKVNKDKTIFSSKGFNRHVTGIVLTNDNVLSIGREKKRVISSTIHKLKLGALDDNEVNQLQGIFAHACFIEPDFYNRMLKKYGAETLNKIKK

SEQ ID NO: 4198 - protein, 309 aa, unidentified
  source 1..309: note = Related to NZ_MKZZ01000010.1; note = Rodentibacter pneumotropicus
MKIVDVLSLKLLMSNTDIVKFANTAPHRYKVYQIPKRNSSKKRTIAQPSKELKFLQRILCGILEDILPIHNSAFAYKKNIGIKQNAEFHSKNKFLLKMDFKNFFPSINPNLFLRQIESHAISLDEVDKKLLINLIFRKPYREGILELSIGAPSSPLISNFIMYNFDKAISEKCNSMSITYTRYADDITFSTNSVNILFNIPKIVESLLHDIYQGDISLNKEKTVFSSKAHNRHVTGITLSNDSKLSIGRYKKRVLSSKIHHYLLGHLKEDEIQKLKGELAFSFHIEPILKKRFIRKYGKECFLKLDKEL

SEQ ID NO: 4199 - protein, 308 aa, unidentified
  source 1..308: note = Related to LZOY01000008.1; note = Haemophilus haemolyticus
MKIIELLSSMLLMENSDIIKFSNSAPYRYKVYQIPKRNSLKKRTIAQPSKELKFIQKLLYQILGKELPVHKSAFAYQKYIGIKQNAEQHVKNRFLLKMDFKNFFPSVNPELFFIEIEHYGIELDKIDKSLLTNLIFRKPYRKGGLELSIGAPISPLISNFVMYRFDDFISIKCNEMNVKYTRYADDLTFSSNCKDILFEIPGIVEKALFDIYKGNIVINKSKTIFSSKAHNRHVTGITLSNDDSLSIGRNKKRILSASLHYYTLGRLTKEEIQKLKGYLAFSFYIEPNLESKLIRKYGKECLDNLMKE

SEQ ID NO: 4200 - protein, 307 aa, Pasteurella sp.
  source 1..307: note = Related to NZ_CP028926.1; note = Pasteurella multocida
MNILSSISDKLLMNNSDLLEFSRTCPHRYKIYTIPKRNSKKKRVIAQPSKELKFIQRILIQNLENKLPIHNMAFAYRKGISIKNNAQKHLYNDYLLKMDFKDFFESITPKIFFRELEKHKIILSSEDIKFLTGVIFRKEKNELLLSIGSPISPLISNFVMFSFDKIVYELCLKKEITYTRYADDITFSTNRKNILFNIPSMIEDVLLANYEGEIILNKEKTRFTSKAHNRHVTGVTLSNENKLSIGRTKKRELIVALHYFINNKLDIDSIEKLRGELAFAFYIEPDFKNRLIKKYGQNSLDRIRHNN

SEQ ID NO: 4201 - protein, 309 aa, unidentified
  source 1..309: note = Related to NZ_CP063116.1; note = Haemophilus parainfluenzae
MNIVDYLSDLILMDRRELLKFSSTSPYRYKVYEIPKRNSNGKRTIAQPSKELKYIQRALLKFFDGVIPIHDSVFSYKKGISIKDNACCHVNYKYLLKMDFKDFFPSITPSILFNEFEKYKLYFNDDDKKLLSGLLFWKKNRKNDFLQLSIGAPTSPFISNFILYSFDKAISDICSEKNVVYSRYADDITFSSNVKNVLFEFPKIVIELLYQLYNGNIKINKDKTVFSSRAHNRHVTGITLSNDGFLSIGREKKRKLSSCFHYYITRKLSKIEIDKLKGELAFAFYIEPDFKNRLMGKYGEKTLELLMRE

SEQ ID NO: 4202 - protein, 309 aa, unidentified
  source 1..309: note = Related to NZ_SLYB01000005.1; note = Cricetibacter osteomyelitidis
MTILDILMDTLLLDMQELKKFASTSPYRYKVYQIPKRNSKKKRTIAHPSKELKFIQRALNGILSNILPVHEAVFSYKKEVSIKDNAQKHLKSQYLLKMDFKNFFPSITPEIFFDQLDKNNISYSVEDREIISRLLFWKPSRYKEYLSLSIGAPSSPLISNFIMYSFDKKINDYCNNINVTYTRYADDITFTTNVRNILFDIPNEIKKILLEEFSGKIIINNKKTIFSSKANNRHVTGIRLTNDNKLSIGRNKKRVLSSKVHHYSLGKINDDEAKKLQGELAFTFYIEPEFESKLIKKYGLETLLKLNKI

SEQ ID NO: 4203 - protein, 309 aa, Aeromonas sp.
  source 1..309: note = Related to NZ_AP022188.1; note = Aeromonas media
MSIVDYVCDALCIEKMQLMHFAVTAPHRYKKYEIPKRSGNGTRTIAQPSKQLKFIQRIIISELEKILTPHPSAFAYIKGISIKDNAEMHVKNRYLLKMDFKDFFPSITPDLMFQEYARFGVTFSPEDSALLSNILFFKLRKNSKLKLSIGAPSSPFISNIIMRHFDAVISELCQHKKISYTRYADDITFSSNIKNVLFEIPEAITVALKKEGYKCIKINKEKTVFSSKRNNRHVTGITISNEDKLSVGRTKKRILTAAVHKFSLGYLSESDIEKLKGELSFVFFVEPAFKDRLIKKYGYDVCHKLWKHA

SEQ ID NO: 4204 - protein, 309 aa, Aeromonas sp.
  source 1..309: note = Related to NZ_AP022264.1; note = Aeromonas veronii
MSIIDYVCDALCIEKTQLIQFAVTAPHRYKKYDIPKRSGNGTRTIAQPSKQLKFIQKIILLKLEKLLTPHQSAYAYVKNKSIKDNATVHINNRYLLKMDFKDFFPSITPELMFQEYARFGIMFSNDEQTLLSNILFFKLRKNSKLKLSIGAPSSPFISNIVMRHFDTVVSELCENKKIKYTRYADDITFSSNIRDVLFEFPQIIANTLKNEGYHDITLNIEKTIFSSKRNNRHVTGVTLSNDGNLSIGRDKKRLLSASIHTFSLGKLCEKDIEKLKGELAFAFYIEPEFKIRMLKKYGSSTCSRLWKVD

SEQ ID NO: 4205 - protein, 310 aa, Aeromonas sp.
  source 1..310: note = Related to NZ_JMGO02000012.1; note = Aeromonas enteropelogenes
MNIVSYVCDTLCIDEKQLMLFAATSPHRYKTYEIPKRSGNGTRTIAHPSKQLKFIQRLVISQLEKIVSPHKAAVAYIKGLSIKDNAILHAKNSFLLKMDFKDFFHSITPELMFQTYEQLGVSFSIKEREFLSNILFYKVRKNSHLRLSIGAPSSPFISNIVMHHFDDSMSKYCSEKEIIYTRYADDLTFSSNIKGILFHLPDEVRFHLDETGYKSIVVNIEKTTFTSKKHNRHVTGITISNDSTTSIGRQRKRNLSAAIHKFSLGNMTEDEIEKLKGDLSFAFFVEPDFKLRMKQKYGEKIYGMLFKKNS

SEQ ID NO: 4206 - protein, 312 aa, unidentified
  source 1..312: note = Related to NZ_PEAX01000003.1; note = Alteromonas flava
MSIFDSIVDSLCTSPEHLRNFAATSPYRYKVYDIPKRSGSGKRKIAHPAKQLKYIQRLAVHELEKFFTPHESAFAYVKGKSIRDNAKVHVRNEYLLKMDFKDFFPSITPELFFAQVEKLGTTFCDEDKVFLSNILFYKLRSYSKLRLSIGAPSSPFVSNIVMREFDIKISEFCKTKSIAYSRYADDLCFSTNISGLLFELPKLVTKTLKSNGYAELKMNRSKTVYSSKGHNRHVTGVTLSNDEKLSVGRSKKRETIARVHHYLNGRLTPEQVESLQGYLSFVFHIEPEFKIRLHKKYGNEAIEMLLSERKID

SEQ ID NO: 4207 - protein, 310 aa, unidentified
  source 1..310: note = Gammaproteobacteria bacterium; note = Related to DQNK01000125.1
MVKIVNFISESLCIEESELISFAHTAPHRYKIYTIPKRSGNGRRTIAHPSKQLKFIQRLTLRLLQDVLPIHESALAYKKSISIRDNANIHRKNQYLLKMDFKDFFPSITPSLLFRELERKNIIVSDEDKNFLASILFFKLRSNSSLKLSIGAPSSPLISNFIMHHFDQILSSECKKMKICYTRYADDITFSTNIKDSLFKIPSIVKNILKNEKYPELKVNEEKTVFSSKAHNRHVTGITITNEGALSVGREKRRLLSASLHRYIEGKIDGETKNTLKGQLSFAFFIEPQFKIRLQKKYGERALEKLFSNE

SEQ ID NO: 4208 - protein, 311 aa, unidentified
  source 1..311: note = Related to JAEINI020000025.1; note = Alishewanella sp.
MNILNSVSKESGLSVTDLLAFSKTCPHRYKVYFIAKRNSDAKRVIAQPSKEVKYLQGAVIKIFKSFDLVHEAAFAYKDGINIKQNAQVHANQKYILKMDFKDFFPSITPDLLFSQLNIAKVFLSEKDKEFLSGLLFWKRRRNSKLRLSIGAPSSPLMSNIVMYFFDSYIESYCRLNRIRYTRYADDLCFSSSMAGGLDSVKDTVNKALRSFFGRKIRLNTAKTIFASKAMNRHITGITLTNDGKLSVGRDRKREIIAAVHKVSQGNSPDCSLKTLAGLISYVHSVEGDFKDRLIKKYGEVIVQKIFDSLRE

SEQ ID NO: 4209 - protein, 315 aa, Acinetobacter sp.
  source 1..315: note = Related to NZ_CP055277.1
MIELNLLKSLNTDFPLGEDNILSFARTAPHRYKTYEILKRDGVSKRKIAQPSKEVKLLQRSALKVLEPILPVHPLAFAYTKARSIKHNALIHKESKFILKLDLTNFFNSITPKLLLEKFHTANISLTHNDQDLISHLFFWKEKRNESPKLSVGAPSSPLLSNFIMYNFDTKIIEVCKKNGCLYSRYADDITISSTENFYQLNLPFIIAKILREEFGESITLNNTKTKYISSAYRRQVTGVILTNDQDISIGHRKKRLLSSKIHHFKIQRLLDPNEIQKLKGELAFAFYIKPELRKKFEIKYGQNTITKILKYKRL

SEQ ID NO: 4210 - protein, 313 aa, Acinetobacter sp.
  source 1..313: note = Related to MVON01000005.1
MIELNLLKFLNIEFPLGEENIISFVNTAPHRYKTYEILKKDGKNKRKIAQPSKEVKLLQRSALKLLEPILPIHDLAFAYTKNRSIKNNAMIHQNSKFILKTDLSNFFNSITPKILLEQIRKTNISVSSKNEELVSNLFFWKETRKDGLKLSIGAPSSPLLSNFIMYNFDNKIVEVCKQYDCAYSRYADDITISSSKNFYELNFPLIIKKILLEEFGESIKLNSNKTKYISKAYHRNVTGITITNDGSISIGSNNKRLLSSKIHHFKNNKIKDTNEIFKLKGQLSFAFHIRPQLKEQFEKKYGKDTIYKILKYK

SEQ ID NO: 4211 - protein, 315 aa, Acinetobacter sp.
  source 1..315: note = Related to JADWNN010000006.1; note = Acinetobacter bereziniae
MKELNLLNLLNLEFPLGQDNILSFSRTAPHRYKTYEILKKDGISTRKIAQPSKEVKLLQRSAIKILESNFPVHYSAFAYVKNRSIKQNAIIHQNSNYIFKTDLSNFFNSITPLIFLEKIKQNNIILSDKNSQLITHLFFWKENRNDSLKLSIGAPSSPFISNFIMFNFDEKILEICKKHNCEYSRYADDITISSRNNFFELNFTSIITALLNEEFKGNIKLNTKKTKYISKAYHRNITGITITNDHNISIGHRKKRLLSAKIHHFKNNKIKNQSDILKLKGELAFAFYIMPHLREKFENKYGNDTILQILKFKTD

SEQ ID NO: 4212 - protein, 335 aa, Acinetobacter sp.
  source 1..335: note = Related to NZ_CP012808.1; note = Acinetobacter equi
MSNFLQKLKQFVYQLFNSKSEKNVLKISYPTNINQQKFKNKKSFLDFAYSAPYKYKNYYIPKRNSTQKRLISQPTAELKFVQKDVINQLSAFLPIHNCAYAYVKNRNIKDNAELHRHSNYVLKLDFKHFFHSIRPKILFNQLEHHQIKLSEIDQTILSFIFFWREKKDSPLKLSIGAPSSPVLSNFIMYRFDEMLNQLCEKHQCIYSRYADDITISSKYHFYDLNFPQHVQNLLDQEFQGKIKLNTQKTKYLTRKHRRFVTGITLTNDAKLSIGRQQKRLLSAKIHHFKINKLNDEQQILSLKGQLAFAFYIQPELKVQFSRKYGEELLHKIMSD

SEQ ID NO: 4213 - protein, 301 aa, Acinetobacter sp.
  source 1..301: note = Related to DADAZD010000003.1; note = Acinetobacter baumannii
MSDSELFDLAKTCPHRYKVYEIDKKNGGKRLIAHPSKELKYIQKLILDILKANLSIHHSAYAYVAEKNIKENASLHVNNSYLLKMDFKDFFPSITPGLFFDECEKHNIFFSKEDKDLLANILFWKKKHAKKLVLSIGAPSSPFISNFIMFSFDALISEYCNTNGIKYSRYADDLTFSTNKKEKLSKLPKLISEKLNSLYRKSIRINIEKTTFVSKACSRKVTGLVITNNNTISIGRERKRQISAMVHQYSIGKMTNSKDIEKLVGLVNFAIYIEPQFLNFLLKKYGREIVNSIYKLKNKNK

SEQ ID NO: 4214 - protein, 312 aa, Acinetobacter sp.
  source 1..312: note = Related to NZ_CP061828.1; note = Acinetobacter seifertii
MNIDIKRHLRNNLFISDLEIFELSKTCPHRYKVYEINKKNGGTRTIAHPSKELKYIQTLIINVLKTQLPIHRCAFAYVAGKNIKENALLHVKNPYVLKMDFKDFFPSITPGLFFNECEKHSLYLSKEDQQLIANFLFWKKKRAHKLILSIGAPSSPFISNFIMYSFDVVVNEYCSEKGIIYSRYADDLTFSTKQAGLLSHLPKIVSEKLNSLYKKSIRINSEKTTFVSKAHSRKVTGLILTNQNNVSIGRTKKRNISAMVHQYKIGKIIDKKEIEKLIGLVNFAVYIEPDFLNFLIKKYGKDTISKIYKIDT

SEQ ID NO: 4215 - protein, 301 aa, Acinetobacter sp.
  source 1..301: note = Related to NEGC01000003.1
MSEKELFNFSKTCPHRYKVYPIPKKNGGERIIAHPAKELKYIQRVIVKILKTKLSIHHSSYAYMNNISIKDNAALHSNNDFILKMDFKEFFPSITPLIFFNALNTQNIHLSKIDSALLANFLFWKPYRKQKLVLSIGAPSSPLISNFVMYEFDNQISSLCRNLNITYSRYADDLTFSTQEKNVLYVLPKQIQQILNTTYKKGIRINPEKTSFISKAFQRKVTGLILTNENNISIGRDKKRLISSMLHKYKIGLNTQKEDIEKLTGLLSFAFYIEPHFKESMIRKYEIDTINKLFKNKENPS

SEQ ID NO: 4216 - protein, 312 aa, unidentified
  source 1..312: note = Related to NZ_JAGKLI010000001.1; note = Providencia rettgeri
MSLLQFIANGLYITEDEAIRYIVTIPRRYKKFNIRKRNSNEFRLIAQPAKQVKSIQRIVLKYVISDFHVHERAFAYESYKDIRKNALVHHNNDYILKMDFKNFFPSIRPFHLMNCFANMNIKLDEMDFFVIENLFFWKPRRNSPLQLSIGAPSSPKISNVIMYSFDCEIFSRCKEMGIEYSRYADDLTFSTTKKGILFDIPKIVREILNEVNLKSIKINHEKTIFSSKKFNRHVTGITITNDGGLSLGREKKRILRSKIHHYICGVLPDVEILKLRGELGYAKFIEPSFFKAMVNKYGYDVIDSIAKYGNCS

SEQ ID NO: 4217 - protein, 312 aa, Proteus sp.
  source 1..312: note = Related to CP049941.1; note = Proteus mirabilis
MNLLQFISNGLYLTDDEAISYIMTIPRRYKKFYIKKRSSQEYRLIAQPARQVKSLQKVVLKHIDKHFHVHENAFAYEYNKDIRKNALLHSKNQFILKMDFKNFFLSIKPILLKKYFNEIGIELDKKDIIVIENLFFWKLRRNSPLRLSIGAPSSPKISNVVMYFFDCEISKKCKQLGIEYSRYADDLTFSTNINNILFSIPKIVRETLNQVGLNDIKINHKKTVFSSKKFNRHVTGVTITNDKKLSLGRERKRLLRSKIHHYTCGILSETEILKLRGELGFAKFIEPTFFESMVNKYGYKVIKSITTYGNLS

SEQ ID NO: 4218 - protein, 310 aa, unidentified
  source 1..310: note = Related to NZ_CP025933.1; note = Morganella morganii
MNLLQFIANGLYLTEDEAMRYIVTIPRRYKKFYIRKRNGIDYRLIAQPARQVKFLQKATLKYMGKYFHIHESAFAYKSGKDIRKNALVHCNNEYILKMDFKNFFLSIKPIHLKNYFSRMGITLDEKDIFVLENLFFWKLRRNSPLRLSIGAPSSPMLSNVVMYLFDVEINNQCEALDVTYTRYADDLTFSSNVKGILFDIPKIVKEVLTKVNMKGIKINREKTVFSSKKFNRHITGVTITNNGTLSLGRERKRLLRSKIHHYICGLLPDVEILKLRGELGYAKFIEPKFFESMMSRYGYEIIESIAKYGN

SEQ ID NO: 4219 - protein, 310 aa, Salmonella sp.
  source 1..310: note = Related to CP074281.1; note = Salmonella enterica
MELLSYISKGLFLSEEEAKRYIVTIPRRYKKYPIAKRNGNGYRLIAQPARQVKALQKAVINHMLANLKVHENAFAYEADKSIRSNALMHCNNDYLLKMDFKNFFMSIKPHNLLSVLKEYGVELTGTDIFVLENLFFWKLRRNSPLRLSVGAPSSPIISNTVMYFFDEEISKRCKELDITYSRYADDLTFSTKIKGALFDVPKLVREVLNIVNLRNIKINHEKTVFTSRKFNRHVTGVTITTEGYLSLGRDRKRLLRSKIHHYVCGVLSEKEILTLKGELGYAKFIEHKFFLSMIKRYGNAVISEISKYEI

SEQ ID NO: 4220 - protein, 310 aa, unidentified
  source 1..310: note = Related to NZ_CP033901.1; note = Klebsiella quasipneumoniae
MELLNYIANGLFLSDEEARKYISTIPRRYKKYHILKRNGKAFRLIAQPARQVKSLQSAVLNHISDVLQVHESAFAYESSKGIKANALIHCRNDYLLKMDFKNFFLSIKPFNFLRNLKEFGIELNETDVFVIENLFFWKLRRSSPLRLSIGAPSSPKISNVVMYFFDEKMTKKCAALGITYSRYADDLTFSTKVKGVLFNVPKIVREILNEVSLRNIKINHEKTVFSSSKFNRHITGVTITPDGHLSLGRERKRLLRSKIHHYVSGVLSPKEILTLKGEMGYAKFIEHSFYQSMINRYGVAVIDAIAKYEI

SEQ ID NO: 4221 - protein, 310 aa, unidentified
  source 1..310: note = Related to NZ_CP049115.1; note = Pantoea stewartii
MELLSFISNGLLLTEAETKKYISTIPRRYKKYQIPKRNGHGNRLIAQPAKQVKLLQKAVLNFICEHLQVHESAFAYEENKSIRANALIHCSNQYLLKMDFRNFFLSIKPHNLINYFQTKGVVLTESDIFIIENLFFWKLRRNSPLRLSIGAPSSPKLSNVIMYNFDEKISLKCSKMNIIYSRYADDITFSSHVKGSLFEIPRIVRETLNEVNLKNIKINHQKTVFSSRKFNRHITGVTITTEGHLSLGRVRKRLLRSKIHRFINEKLTSKETASLKGELGYAKFIEYSFYQSMIDKYGFDTINKIAKFPQ

SEQ ID NO: 4222 - protein, 310 aa, Escherichia coli
  source 1..310: note = Related to ABCQBJ010000001.1
MNLLQYIANGLFLTEDETKRFIITAPRRYKKFTIAKRNGLDRRLIAQPARQVKSIQRAVLKHIRENIKVHEHAFAYEKERDIKKNASLHKDHDYLLKMDFKNFFLSIKPVNLLNVIKMQGISLENDDVFVLENLFFWKLRRNSPLRLSIGAPSSPFISNAVMFFFDTVMSEKCKKIEVTYTRYADDLTFSTNRKNVLFEVPRLVREILNETSLRNIKINHEKTVFSSKKFNRHVTGVTLANNGVLSLGRERKRLLRSKVDYYRKGLLSPEEILTLKGELGNAKFIEPEFIERVESKYGSDVIREIQKYNI

SEQ ID NO: 4223 - protein, 310 aa, unidentified
  source 1..310: note = Related to NZ_CP023484.1; note = Dickeya sp.
MSLLKYIADGLFLTEEETKRFIITVPRRYKRFTIAKRKGLERRLIAQPARQVKSIQRAVLKYIRDEIKVHECAFAYEIDRDIKKNAFLHKDNSYLLKMDFKNFFLSIKPINLLNVIKRHGIELEGNDIFVLENLFFWKLRRNSPLRLSIGAPSSPFISNAVMFFFDKMLSEKCEQMGVVYTRYADDLTFSTNRKNILFGMPRLVREVLNETNLRNIKINHEKTVFSSKRFNRHVTGLTLANNGVLSLGRERKRLLRSKVDHYKKGLLSPKEILILKGELGYAKFIEPVFIERVKQKYGRDVVHQIQKYNI

SEQ ID NO: 4224 - protein, 312 aa, unidentified
  source 1..312: note = Related to RJLS01000002.1; note = Dickeya undicola
MKLLEIISKGLYLTEDEAKRYIATMPRRYKRYHIAKRNSDKKRLIAQPARQVKSIQRSVISIIHDEILIHENAYAYASGRDIKKNAEMHRKNKYILKMDFKNFFLSIKPHNLFHVFERQGIILDDEDFFVYGCLFFWKQRRNSPLRLSIGAPSSPFISNAIMFFFDDVISNKCKEMDVSYTRYADDMTFSTNNKGILFDLPKLVRNTLNDVGLKNIKINHEKTVFSSKKFNRHVTGVTITNDEALSIGREKKRLLRTKIDYYRKGLLNPGEVMKLKGELGFAKFIEEGFIERMIKKYGIELIESIKKFEINE

SEQ ID NO: 4225 - protein, 311 aa, unidentified
  source 1..311: note = Related to JZYL01000045.1; note = Pluralibacter gergoviae
MSLLEKISNGLMLSKADAKNYISTIPRRYKVYTIKKRNSEETRLIAHPSKQVKSLQRAMLTYFKDKLPVHSSAYAYISGKSIKENAERHVNNSYILKMDFRHFFLSIEPLHFINVIYNHGFELNEEDKFVIWNLFFWKRRSNSPLRLSVGAPSSPFISNAIMYFFDEAISETCAKMNVTYTRYADDLTFSTNNEDILFNIPRMVKGILKANGLSKIKINEAKTVYSSKKFNRHVTGVTLSNDGCISLGRERKRLLSSKIHHFSQGRLSDVEVLKLKGELGFAKFIEPLFIERMSIKYGLDIINHIQKFNPS

SEQ ID NO: 4226 - protein, 311 aa, Citrobacter sp.
  source 1..311: note = Related to JADVIA010000001.1; note = Citrobacter braakii
MTLLEKIANGLMLSKDDAKNYVSTIPRRYKVYTINKRNSEEKRLIAHPSKQVKALQRAFMSGFKKNIPIHSSAYAYENERDIKKNALQHVSNPFLLKMDFRHFFLSIEPRHLIKVMNDHGFELNDEDKFVISHMFFWKRRSNSLLKLSIGAPSSPFISNAVMYFFDEALSIACKDIDVVYTRYADDLTFSTCQSGVLFGVPKMVKNILKANGLSKIKINEKKTVFSSKKFNRHVTGVTLNNEGAVSLGRERKRLLSSKIHHFCNDLLDEDETLKLKGELGFAKFIEPSFVEKMKNKYGVDIIMAIQKYNPN

SEQ ID NO: 4227 - protein, 309 aa, unidentified
  source 1..309: note = Related to MVGB01000005.1; note = Serratia marcescens
MKIVNFISDKFFMPEQEVRNYLRTVPRRYKQFTIDKRNGEPRLIAQPAKQVKALQVSVLSELKRYIPIHECAYAYQSGRNIKANALLHAKNSYLLKMDFKNFFLSIKPEVFLNVLSKHGIAVSEDDALSIANLFFWKLRRNSPLRLSIGAPSSPFISNATMYFFDSYLSAECKKIDVDYSRYADDLTFSTKTKGILKDIPLLVKKALEMNDLKTIKINNSKTVFSSKKFNRHVTGITLNNNGDISLGRNKKRFLSSRIHYYSLGLLNNDDILELKGLLGFANYIEPIFLERMKVKYGDDLIVSIQKYIG

SEQ ID NO: 4228 - protein, 310 aa, unidentified
  source 1..310: note = Related to NZ_CABHXL010000034.1; note = Yersinia kristensenii
MNLFGIVSNSLFLSDMEIRNYVSTIPRRYKRYSIPKRNGIEFRIIAQPAKQVKVLQRIVLPFLQQIIPIHGNAHAYEKNKSIKTNALVHSKNEYLLKMDFKNFFLSIKPNDFIDIMKKHEIKITDDDKFIIENLFFWKLTRRSPLRLSIGAPSSPFISNAVMYFFDEIISHECEALDVKYTRYADDLTFSTNVKDILFLVPKIVKGVLKSSGLKNIKINTNKTVFSSKKFNRHVTGITLTNDGEVSLGRERKRVISVRIHYFTLGLLSTDDILKLKGDLGFAKFIEPEFIYRMERKYGLENIEKLRKFMG

SEQ ID NO: 4229 - protein, 310 aa, unidentified
  source 1..310: note = Related to NZ_CACSJK010000006.1; note = Rahnella variigena
MTIVEYISQGLFISESEFVSYTNTMPRRYKQFYIKKRNGEDRLIAQPAKTVKNLQLTVVGLLRDELRIHPAAMAYVKGRSIKDNAQKHVHNQFLLKMDFKNFFLSIKPAMFLMCLKKQGVNLDERDEHVISNIFFWKLRRNSTLRLSIGAPSSPFVSNVVMYYFDEAVESLCRMLGVVYTRYADDLTFSTNKKNVLFELPSVVKNVLNDVGLKAIKVNKDKTVFSSKKFNRHVTGVTLNNSGELSLGRERKRTISAMIHHHKLGLLNNEDVTKLKGYLGFAKYVEPLFLTRMERKYGEQLISQIQKFIPG

SEQ ID NO: 4230 - protein, 309 aa, Enterobacter cloacae
  source 1..309: note = Related to JAJFTC010000002.1
MDIVEFLAQAVFLSEKEFVSYVNTMPRRYKQFYIKKRNGDDRLIAQPARTVKTLQLTVVGMLQHDLKIHDASMAYVKGKSIKDNALQHVNNQYLLKMDFKNFFLSIKPEMFLTCVRKQGLKLSERDSLILANLFFWKLRRNSSLRLSIGAPSSPFVSNVTMYYFDEMVSDICNEYGITYTRYADDLTFSTNKKGILFSLPPLIKDSLKQTGLNDIKINNKKTVFSSKKFNRHITGVTLSNDDKISLGRERKRMISAMVHHFKNEVLEVDEIYKLKGYLGFANYIEPMFIARLKRKYGENVIMQIQKFIV

SEQ ID NO: 4231 - protein, 309 aa, unidentified
  source 1..309: note = Related to JPOT02000001.1; note = Pantoea agglomerans
MDIVEYLAQGVFLSEKDFLSYVNTMPRRYKQFTVKKRNGEDRLIAQPARTVKTLQMVVVSLLKNHLNIHEAAMAYVKGKSIKDNANAHVQNKFILKMDFRNFFLSIKPDIFLACIEKQGLILSDQDKMVLSNLFFWKLRRNSSLRLSIGAPSSPFVSNVTMFFFDELISKICKDKGIVYTRYADDLSFSTNQKDILFSIPALVKESLKVVGLKNIKVNNAKTVFSSKKFNRHVTGITLSNEGVVSLGRERKRSISAMVHHFTLGLLDKESIYKLKGYLGFAKYIEPSFVLRLKIKYGDEVVLKIQKFND

SEQ ID NO: 4232 - protein, 315 aa, unidentified
  source 1..315: note = Related to NZ_CP034938.1; note = Pectobacterium odoriferum
MNILNQLSNTLFMDKDSLKSFISTAPRRYKKYTIPKRNGDGVRIIAQPSKQIKSLQRYAANLLSKHLRVHYAAHAYVRGKGIKTNAAAHRNSNYILKIDFKDFFHSITPDIFLKTLETNNNIIENEDKFIISHLFFWKLRGNSPLRLSIGAPTSPIISNAIMYCFDEELTNYCTEINVTYTRYADDLTFSSFHSLSLATIQSTVQRLLIKHYKRKIKINREKTIYCNKAMNRNITGVILNNENELSLGRKKKRMISSLVHKFSYSLLNQKEINYLNGILGHASHIEPQFIERLKEKYGHDVIAKIKKSITYAHIT

SEQ ID NO: 4233 - protein, 315 aa, Citrobacter sp.
  source 1..315: note = Related to JADVFW010000007.1; note = Citrobacter braakii
MSILNQLSATLFMDKDSLKSFISTAPRRYKKYTIPKRSGDGVRIIAQPSKQIKSLQRFTANLLSEHLKVHYAAHAYVPGKGIKTNAAAHKNSQFILKIDFKDFFHSITPDLFIKTLEANEANISEEDRFIIAHLLFWKLRGNSPLRLSIGAPTSPLISNAIMYCFDEELTNYCTDLNVTYTRYADDLTFSSFHGLSLATIQRTVQTLLIKHYNRKIRINRDKTIFCNKAMNRTITGVVLNNSNELSLGRKKKRMISSLVHKFSYSLLNQKEINYLNGILGHAFHIEPQFIERLQVKYGHDVIDKIKQSITYDDIT

SEQ ID NO: 4234 - protein, 315 aa, unidentified
  source 1..315: note = Related to JAKZMT010000006.1; note = Pantoea ananatis
MSLLEQFSSALFMDRASLKSFIYTAPRRYKRYAIPKKNGNGFRTIAQPSKQIKSLQRFGISLLAIFLKTHYSAHAYVEGKGIKTNAAAHQGSDHLLKMDFKDFFHSITPDILMNTLDKNGGKEILDEEDRHIISHLFFWKLRGNSPLRLSIGAPTSPIISNAIMYDFDEEIADYCAELNVKYTRYADDLTFSSKDRESLTTIPNEVNIVLRKNFGSKIRINKEKTLHCNKSMNRSVTGIVLNNTNDSLSLGRKKKRMISSFVHKFSFSLLDQNEINYLNGILGHAAHIEPQFIERLKEKYGQDVIAKIKASIEYL

SEQ ID NO: 4235 - protein, 314 aa, unidentified
  source 1..314: note = Related to JAAAXN010000025.1; note = Serratia fonticola
MSLLDHLSEVFFMDKASLKSFIFSAPRRYKKYPIPKRNGEGDRIIAQPSKQIKSLQRFTINLLIDYLKVHHAAHAYVSGKSIKTNAAAHRKNSYILKMDFKDFFHSITPDLFLKVLSDRDNDGKLTEEDSFLISNLFFWKLRGNSPLRLSIGAPTSPIISNTIMYDFDEELTNYCLELNIVYTRYADDLTFSSSDRESLSIIPIAVRRVLIKNFNRKIRINSGKTIFCSKAMSRNITGVVINNNCELSLGRKKKRMISSLVHKFSYSLLTQDEMNYLNGILSHAHYIEPAFIERLKSKYGSDVIDKIKHSITFP

SEQ ID NO: 4236 - protein, 313 aa, Vibrio sp.
  source 1..313: note = Related to NZ_CP049914.1
MTNLFETLQEQLSLSDDELLSYLHTVPLRYKRYYIDKRNSTEKRLIAQPSRTVKILQKYVASELEEVIPVHQSAMAYCKGRGIKENAKKHAHSRYLLKMDLKRFFDSITPTILSDVIMKHGIELSEKDYILVSQLFFWKLRRNSPLRLSIGAPSSPFVSNAIMYFFDEEISKHCEELNIVYTRYADDMTFSTNKKNVLFELERTVVKLLRLNFGKDIKVNKEKTVHSSKAHNRHVTGVTLSNTGKLSIGRENKRNIRVSIHRFINGKTNDRDVQNLKGNLGFAKHIEPEFVKSLEDRYGVETIKKIQTFDILP

SEQ ID NO: 4237 - protein, 310 aa, Vibrio sp.
  source 1..310: note = Related to NZ_CP053541.1; note = Vibrio europaeus
MFQLFDTFREQLALSNDELSSYLHTIPFRYKRFYIDKRNSDEKRLIAQPAKAVKTLQRYAISEIEDELPIHSSAMAYCKGRGIKENALVHAKSRYLLKLDLKNFFESISPEILLSVISKHSIELCDNDKFLISNLFFWKLRRNSHLKLSVGAPSSPFISNVIMYFFDKDLAEKCNEMNVSYTRYADDMTFSTQDSNILYKIETIVRKLLKFHFDNKLTINRSKTVHSSKAHNRHVTGVTLDNHGRISLGRDNKRSLRAGVYNFTQGRLNKDEAMKLRGKLGFAKYIEPKFILRLEKTFGKDVIDELKKYN

SEQ ID NO: 4238 - protein, 314 aa, Aeromonas sp.
  source 1..314: note = Related to NZ_LR134376.1; note = Aeromonas encheleia
MTNIFRGLCEQLLMSENELKSYISSVPFRYKRYYIPKRNSNELRLIAHPAKVVKSLQRHAVSKLEPLLPIHKCAMAYCKGKGIKENAYQHKNNRFLLKMDLRDFFGSINPSIFLGVLKKHDLTLSKEDVFLLSNLFFWKLRRNSPLRLSVGAPSSPFVSNAIMYFFDKELHEYCNDNDIVYTRYADDMTFSTSKKDILFALEKTVKAFLKKNFGSFLRVNHNKTFHSSTAHNRHVTGITITNNKKISVGRNRKRKIRACVHSFKNGLLSNNDALKLKGELGFIKHIEPDFIINLTNKYGLDTIKKIQTFESVDT

SEQ ID NO: 4239 - protein, 314 aa, unidentified
  source 1..314: note = Related to CP001796.1; note = Pseudoalteromonas sp.
MNIIERISEDLLMPEKELLNFSSTAPRRYKKYTIAKRNSDERRLIAHPSKEVKFLQRLLVTHLEDKLTIHASANAYVKQKGIKSNALAHKDNQYLLKMDFKNFFLSITPSILIEQMLAFGIGLDDRNIEFISGILFWKLRRNSPLRLSIGAPSSPFISNVIMYNFDRLIEKECKVMGITYTRYADDLAFSTNIKDILFEIPKLVKNTLKKLYGSKIRVNTKKTVFSSKKFNRHITGITLTNNNLLSIGRKKKRFISSLVHKYTLELLSDEEILQLKGLLSHVSNIEPLFIGRLSNKYGTNIMTDLAPSKFFIGN

SEQ ID NO: 4240 - protein, 314 aa, Vibrio parahaemolyticus
  source 1..314: note = Related to NZ_CAJOAG010000011.1
MNIIESISEALLMPEKELLSFSSTAPRRYKKYTIAKRNSDERRLIAHPSKEVKFLQRLLVTHMEDKLPIHDSASAYVKQKDIKSNAFCHKNNQYLLKMDFKNFFLSITPDILLEQMLSFGIKLDSNNMDFISGMLFWKLRRNSPLRLSIGAPSSPFISNVVMYNFDCIIEKECKHMGITYTRYADDLTFSTNSKNILFEMPKLVKKTLKELYGTRIRVNSDKTVFSSKKFNRHITGVTLTNNNLLSVGRAKKRYISSLIHKYTLSLLSEEEILQLKGLLSHASNIEPLLIGRLSKKYGVDVMANLAPKKFFIGN

SEQ ID NO: 4241 - protein, 311 aa, Vibrio sp.
  source 1..311: note = Related to MCWA01000032.1; note = Vibrio splendidus
MSLISEISDDVLMTKDELLSFSFTAPRRYKKYHILKRNGNGLRLIAHPSKEVKFFQRLAISKLEILLPIHDCAIAYVKGKSIRDNAEAHRRNRYMLKMDFKNFFMSITPDLFISSLERNDINLEAQDIKFLEGVLFWKLRRNSPLRLSVGAPSSPFISNFVMTAFDIFMFGYCKDKGITYTRYADDLTFSTREKDLLFTIPKVVRDALKEYCNSKIRINSKKTVFTSKKFNRHVTGVTITNDEKLSLGRERKRLISAMVHHFVDDKYSLSHEEIQKLKGYLSFAKSIEPDFINRLSKKYGREYILKIQSFN

SEQ ID NO: 4242 - protein, 311 aa, unidentified
  source 1..311: note = Related to WMDC01000029.1; note = Photobacterium carnosum
MSILSDISKDVLMTESEILNFSSTAPRRYKRYYILKRNGKDLRLIAHPSKEVKFFQRLVISKLDGKLPIHHCAMAYVKGKSIKDNADAHKKNKYLLKMDFKNFFMSVTPELFISSLKKNNIILDTNDLIFLEGILFWKLRRNSPLRLSVGAPSSPFISNFIMKSFDDYIFNTCKEMNVTYTRYADDITFSTNIKTLLFTFPVIIKNALKEHCDKKIRINSEKTIFTSKKFNRHITGITINNNNNLSLGRNKKRLISSMVHHFISKDHSLTADEILKLKGHLSFAHFIEPDFIQRLSDKYGNEEIINIIKHI

SEQ ID NO: 4243 - protein, 307 aa, unidentified
  source 1..307: note = Related to NZ_BMYW01000013.1; note = Vogesella alkaliphila
MRISKKLADELLLDEAELRKFCATAPYRYKKYEIPKRNSDKTRLIAQPSKEVKFMQRLVVKYLRDILPVSRHAMAYESGTSIVKNASIHKNNPYLLKMDFKNFFLSITPSLFFGLMSDGGVEFSDDDKILLSNLLFWKLRRNSPLRLSVGAPSSPFISNVVMYHFDCLMESQCAAMRIRYSRYADDMTFSTRERDALSEMPGFVRSVLKRDYDGKIKVNSEKTIFLSKAKRRTVTGITITNDDTLSVGRDRKRNISAMVHHFSLGKLSAEEVQKLKGYLSFVAAVEPNFIYRMMSKYGNKVIEALFI

SEQ ID NO: 4244 - protein, 317 aa, unidentified
  source 1..317: note = Oxalobacteraceae bacterium; note = Related to JACYUE010000003.1
MSIFSTLADKLLMSEEELLRFALTMPRRYKKYEILKRNGIDTRQIAQPSRESKFIQRMIIDELRGVLRVHKAATAYEKETGIRLNALRHLNSRYLLKMDFKNFFPSITPELFFAVAESSGVDFEQADKVFLEHALFFRATRRSRLRMSIGAPSSPFISNFVMNTFDHAMMKFCVERNISYTRYADDLTFTTNEKNILFDLPKMVATLLAEYCFKKIRINSSKTVFSSKRFNRHVTGIVLTNNNELSIGRARKREIASLINSFRYGALSEDATLKLKGLMAHAYHIEPDFIARMKLKYSYEVVNAILRYPLAIQTLEQ

SEQ ID NO: 4245 - protein, 313 aa, unidentified
  source 1..313: note = Related to NZ_JACHXD010000002.1; note = Massilia violacea
MSLASILANKLVMSNADLFGFVLTMPRRYKQYKIFKRNGIETRHIAQPSKEAKFIQRIIVEELRKLLPPIHKAATAYEPGTGIKANALRHLNSRYLLKMDFKNFFPSITPEFLFLAAESSGIKFDELDKILLENALFYKSTRRARLRMSIGAPSSPFISNFVMSGFDNDMFDYCAKRNISYTRYADDLTFTTNEKDVLFEIPKIVESTLINACFRKIRINSKKTIFSSKKYNRHVTGVVLTSDGQLSVGRARKREVSSLINSFKYGKLDEKERLHLKGLIAHVHHIEPDFIFKMRKKYSDEVVNSLMKPPTAG

SEQ ID NO: 4246 - protein, 315 aa, Alcaligenes sp.
  source 1..315: note = Related to JAKUDK010000002.1
MNLISKLTEKLMMTEEELLRFALTMPRRYKQYFIPKRNSNERRLIAQPSQEAKFIQRIIIAELRELLTVHKAATAYEKGTGIRLNAIHHVGNRYLLKMDFKNFFPSITPELLFMILRDCGIKYDDRDRTILEHALFFKSTRRSRLRLSVGAPSSPFISNFIMNIFDENLAAYCLQQGITYTRYADDLTFTCNKKGILFNVPDVVKQFSKEHCHGKIRINSSKTVFSSKAFNRHVTGIVLTNDNQLSIGRARKREIASLVNSFKYGHLDLDESSRLKGLLAYANHIEPDFIARMKTKYSADVIDAIFHLDSTQKDH

SEQ ID NO: 4247 - protein, 311 aa, unidentified
  source 1..311: note = Related to NZ_CP086370.1; note = Massilia sp.
MNFLQHMCDKLFMSQDELINFARTMPYRYKKYRVGKRNGSGYRIIAQPSSEAKFIQRILLKELRRLLPVHECAMAYEPGVGIRKNAMRHLHSDYLLKMDFKDFFPSITPDLFFFFTKKIGLELGEKDKELLENVIFWKSTRSSYLKLSIGAPTSPFISNFVMHEFDKSMNQFCISKAITYTRYADDLTFTSNAKNILFEIPSLVSGHLKKDCLGLIKVNTKKTVFSSKAFNRHVTGIVLANDNSLSLGREQKRTLSSIIHRFSLGKLSEKETSRLKGHLSFAHHIEPKFIDRMKKKYGNDLIDLIFLHSCE

SEQ ID NO: 4248 - protein, 308 aa, unidentified
  source 1..308: note = Related to NZ_CP048832.1; note = Janthinobacterium lividum
MMSILSFVSDALMIDKVEMMMFAQTAPHRYKKYFINKRNGAGVRLIAQPSKETKFIQRVVLSKLREILPVHRCAMAYEKSVGIKLNAMHHKDGRYLLKMDFRDFFPSIMPNMFLALAKDCGVEFSDEDKEFLSRILFFRSTRKSLLRLSIGAPTSPFISNFIMYKFDVAMAEYCQENGINYTRYADDVTFSSNVKGILFDVPDIVKKNLRQYCCGQIKINPLKTIFSSKAFNRHVTGIVINNDSSLSLGREKKRIYSSMIHKFSLGLMDEKERERLKGFLAYAIYIEPDFIERMKKKYSSDLIAAIML

SEQ ID NO: 4249 - protein, 314 aa, Pseudomonas sp.
  source 1..314: note = Related to DAFPVK010000010.1; note = Pseudomonas aeruginosa
MSITTALCEKMLTGKSELLSFSHTVPRRYKTYYIKKRNSTEMRLIAHPAKTVKFIQRLAVEELRNYFPIHHCATAYEKGTGIKMNAFQHRRNQYLLKMDFKNFFLSITPELFFRVSEDLGVVFDSEDKALLEGLLFWRLRRNSPLRLSIGAPSSPFVSNLVMYKFDAALCEICESMGVVYTRYADDLTFTTNRKDVLFAIPDIVRQNLKAQCYSKIRINSEKTVFSSKAFNRHITGVTITNEGRLSVGRERKRLVSALIHKFTLGALSDQQIENLKGQLAHVKNIEPDFVVRMKKKYSDEAIAKIFAWKREGFL

SEQ ID NO: 4250 - protein, 312 aa, unidentified
  source 1..312: note = Related to JAKFZQ010000002.1; note = Pseudoalteromonas sp.
MNFLSKLNDALMIGEKALLSFILTSPHRYKKYEINKRNGKGKRLIAHPSKQLKYIQRLLVKELEEQLPVHESAMAYKKGVGIKNNALAHKDSKYLLKMDFKDFFYSITPEMFFKATASKGLHYSESDKLVLSHLLFFRLNRNSPLTLSIGAPSSPLISNFSMNLFDEAISNYCAELEVTYTRYADDIVFSTNSKNALFSIPSKVEKTLKSECFGCVKVNTGKTVFSSKAHNRHVTGITISNEGKLSLGRDRKRKISSLVHKFGLGLLNVREINELRGLLAFASDIEPLFLARLRGKYGSKCLSSISNYKQEE

SEQ ID NO: 4251 - protein, 308 aa, unidentified
  source 1..308: note = Related to NZ_LR877185.1; note = Pseudoalteromonas sp.
MDIMLLLKTMLVISESEILKFSATAPHRYKKYRIPKRNGNGKRRIAHPSKELKFIQRLIVNKLESILPVHDSAKAYKKGVSIKDNALAHKNTRYMLKMDCKDFFPSIEPQLFFKVASSCGINFSNLDKELLSNLLFYKLTRRSRLKLSIGAPSSPLVSNFVMYFFDAAIYEYCSELGVNYTRYADDLTFSTNRKEVLFEFPKVISEQLKKHCNGSIKVNSIKTVFSSKGHNRHVTGITITNDSKLSLGRSKKRTISSLIHKYSLGILTDEQKDCLRGHISFAKFVEPAFFIRMEKKYGKEVIQSIFSD

SEQ ID NO: 4252 - protein, 313 aa, Vibrio sp.
  source 1..313: note = Related to NZ_LBGP01000014.1; note = Vibrio metoecus
MNLSEILASSLFMDDEEIRSFAASSPYRYKVYTIAKRNSQERRVIAHPSKELKFIQRLIVSLLEKRLPIHYTAKAYTKGLSIKDNAQPHMKSKYLLKMDLKDFFPSIKPSLFFRECRVHGVELSELDVELLEGFLFWKRRRATQLVLSIGAPSSPIVSNFILYRFDEVISEYCMRLGINYTRYADDLTFSTNEKDLLIKFPARVRKVLNHLYDGQIKVNLKKTVLSSKAHNRHVTGITLSNDGKLSVGREKKRKLSASIHHFIMKKLSVEEILKLKGELAHTTFIEPLFLERMIEKYGYDAINELKHFSDESS

SEQ ID NO: 4253 - protein, 313 aa, Vibrio sp.
  source 1..313: note = Related to NZ_SMJS01000013.1; note = Vibrio echinoideorum
MNLSELLESFLFMEEEEIVSFAASSPYRYKVYSIAKRNSEERRIIAHPSKELKFIQRIIVDQLAGQLPIHNTAKAYMKGLSIKDNARPHAKYKYLLKMDLKNFFPSIKPSLFFKECRLHGVELSELDIDLLEGFLFWKRKRATHLVLSIGAPSSPLVSNFILYRFDEAISRYCKSLGINYTRYADDLTFSTNEKDVLLKFPAKVRKTLNYLYDGQIKINLRKTVLSSKAHNRHVTGITLSNEGKLSVGRETKRTLSASIHRFTQQKLSDDDILKLKGNLAHTVFIEPDFLDRMIKKYGRNAIYELKHYTPSSN

SEQ ID NO: 4254 - protein, 313 aa, unidentified
  source 1..313: note = Related to BMPZ01000002.1; note = Shewanella gelidii
MNLSELLASLIFMDDEEIISFAASSPYRYKVYSIPKRNSEERRIIAHPSKELKFFQRVIVKQLSERLPIHSAAKAYTKGLSIKDNALPHANSKYLLKMDLKDFFPSINPSLFFKECRRHGIDFSDLDIELLEGFLFWKRRRATKLVLSIGAPSSPLVSNFILYKFDEDISRYCNSIGINYTRYADDLTFSTNKKDVLLKFPTKVRNTLNSLYDGQIKVNLRKTVLSSKAHNRHVTGVTLTNEGKLSVGREAKRNLSASIHSFTLQKLSNEEIFKLKGHLAHAEFIEPDFLERMVKKYGQEAIWELKHYTHSKN

SEQ ID NO: 4255 - protein, 312 aa, unidentified
  source 1..312: note = Related to NZ_BLRF01000013.1; note = Shewanella xiamenensis
MNLSELLASLLFMDDEEIISFATSSPYRYKVYSIAKRNSSERRIIAHPSKELKFIQRLIIQQLTVILPVHKAAIAYTKGLSIKDNARPHANSKYLLKMDLKDFFPSINPSLFFKECKKNGIDFSDLDMKILEGFLFWKRRRTTNLVLSIGAPSSPLVSNFILFKFDEIISNHCAILGINYTRYADDLTFSTNEKNVLLSFPAYVRKVLNTLYDGQIKVNLKKTVLSSKAHNRHVTGVTLTNEGCLSVGRNKKRQLSAAIHYFSLKKLSNEDIFKLKGSLAHSVFIEPDFLLQMERKYGKEIIFQLIHYALDD

SEQ ID NO: 4256 - protein, 313 aa, Vibrio sp.
  source 1..313: note = Related to JAEMEZ010000008.1; note = Vibrio cholerae
MSLFESLSMMLLMDEGELRSFALTAPYRYKVYTIAKRNSEERRVIAHPSKELKFVQRLIINQLEPKLPIHPSATAYIKGKSIKDNALPHVNSKYLLKMDLKNFFPSIKPELFFKECRHHGIELTDVDKSLLEGFLFWKTRRSNKLTLSIGAPSSPMVSNFILHRFDEKMSKLCLAEGVRYTRYADDLTFSTNKRGTLLSYQSKVRRIIGILYDGNIKINLRKTVLSSKAHNRHVTGVTLTNDGNLSVGREEKRKISAAIHHYSFNMLEHEDVLRLSGRLAHASFIEPEFLEKMIKKYGQDTISKLMKSGTEPV

SEQ ID NO: 4257 - protein, 309 aa, Vibrio sp.
  source 1..309: note = Related to NZ_CP026321.1; note = Vibrio campbellii
MNLFESLSAMLLMDEKELRSFALTAPYRYKVYTIAKRNSDDRRIIAHPSKELKFIQRLIINMLLPKLPVHSAATAYIKGKSIKDNAIPHASKKYLLKMDLKDFFPSIKPDLFFKECRHHKIEISETDKSLLEGFLFWKTRRSNQLKLSIGAPSSPFISNFILYRFDEEVSKLCRAEGVTYTRYADDLTFSTNKKGVLLSYQSKVRRIIGTLYNGNIKVNLKKTVLSSKGHNRHVTGITLSNDGSISLGREQKRKISAGIHHFSLNLLEHEDVLKLGGKLAHASFIEPSFLEKMIKKYGQEAISRLMKTT

SEQ ID NO: 4258 - protein, 316 aa, Vibrio sp.
  source 1..316: note = Related to VHSP01000001.1
MNLSETLSTVLFMDEAELRSFASSAPYRYKVYAINKRNSDEKRIIAHPSKELKFIQRLIIKQLQPRLPVHTVATAYIRGKSIKDNALPHAKSKYLLKMDLKNFFPSIKPDLFFKECKHQGVPLSDSDKELLEGFLFWKSRRAKGLSLSIGAPSSPLVSNFILYRFDKAMNQLCQSEGVTYTRYADDLIFSTNKKGVLLAYPPKVRRLIGTLYDGNIKINLRKTVLSSKAHNRHVTGITLTNDGRLSVGRDDKRKLSAAIHHYASHMLTPEEVQILRGKLSYAVFVEPELLERLIRKYGKQVIADLQKVNPTLNLKS

SEQ ID NO: 4259 - protein, 315 aa, unidentified
  source 1..315: note = Related to JACJEU010000008.1; note = Shewanella sp.
MSISKLLSKNLFMDELELRSFSLSSPYRYKVYKIPKRNSKELRTIAHPSKELKFVQRLIVRELGQLLPVSEAATAYMKGISIRDNALVHSNTRYLLKMDLKNFFPSITPEIFFNECLRAGVEFEQLDIDLLRGFLFWRPRRSKKLILSIGAPSSPLVSNFILNQFDENIINFCKTIGVRYSRYADDMTFSTDIKGVLFTFPLMIKKILKTLYGNSIKINQDKTVFASKAHNRHVTGVTLSNDGCVTVGRESKRKISASIHHFSLGILQPNNIIQLKGLFAHSTFIEPKLKNQMVEKYGIEIIERLMSYQPNDLKK

SEQ ID NO: 4260 - protein, 312 aa, Vibrio sp.
  source 1..312: note = Related to RKQY01000017.1; note = Vibrio crassostreae
MNISTLLSEHLFLDDIELRSFADSAPYRYKVYKIPKRNSEELRTIAHPSKELKFVQRLIAKELSSVLPLHQASMAYRKGTSIRDNALVHSNSSYLLKMDLKDFFPSIKPELFFRECSRYGLEWTDLDKTLLNGFLFWKPRRAKKLVLSIGAPSSPLVSNFVLYQFDEHIANYCKELGVNYTRYADDMTFSTDRKDLLFKFPIQVRKTLKALYGSSIKVNLNKTVFSSKAHNRHVTGVTLSNEGKVTIGRERKRVLSASIHHFSLGVLGHDEILKLKGHFAHLIFIEPLVKEQMIKKYGSSLIGRLTSYQGSP

SEQ ID NO: 4261 - protein, 309 aa, unidentified
  source 1..309: note = Related to NZ_FOHV01000012.1; note = Thorsellia anophelis
MNIEKYLSENLSINISALHSFSRTAPHRYKVYSIPKRNSKGERIIAHPSKELKFIQKMIIKKLTDILPLHESVISYRKKKSIVNNVIPHLNSSFLLKIDLKDFFPSIEPDLFFEQCKLLDIHFSDNDKKLLTGFLFWRNRKSSKLQLSIGAPSSPLISNFILYRFDDRITKLCASYNVNYTRYADDLSFSTISNSILLKLSEEISAMLQEIFQGRFLINHEKTIFSSKASNRHITGITITNSGEMSLGRNFKRNISACIHKFTLNQLPQEELLKLKGHLSFFKHVEPYFILRMESKYGKHILDKIRKSQ

SEQ ID NO: 4262 - protein, 312 aa, unidentified
  source 1..312: note = Related to NZ_CP088265.1; note = Leclercia sp.
MTNNLKSLRKLLQSTLFLSDDLINIFITTAPYRYKIYEIDKRSSDEKRKIAHPSKELKLIQRIIVKELSNMLPVHDCAYAYRTGRGIKENALIHSKNSYLLKLDLSNFFNSLTPEIFFAECRRNNIDFDKDNASIISNCLFYREHRKSSLKLSVGAPSSPFISNVIMYSFDQIIETECRKREITFTRYADDMTFSTSIKNTLIGFDELIKKVLFDLFKGAISLNQDKTILSSKAHNRHITGITISNNDNISLGRERKRLISSAIHRFSYGKLDQEAVDKLKGLLAFAYYIEPSFIATMEKKYGRETINKLKK

SEQ ID NO: 4263 - protein, 315 aa, unidentified
  source 1..315: note = Related to CP020501.1; note = Serratia marcescens
MSNNPKSFRKLLQSTLFLSDELINTFIATSPYRYKIYDIAKRNSDEMRRIAHPSKELKFIQRIIVKELSDLLPIHECAYAYRPGRGIKENALFHSKNSYLLKLDLSNFFNSLTPKIFFSECKRNNIFFDEDDTSIISNCLFYREHRKASLKLSVGAPSSPFISNAIMYSFDKRIEEVCNNKGVSFTRYADDMTFSTNTKNVLVGFDRIVKEVLFDIFKDAIFLNNDKTIFSSKAHNRHITGVTISNDDNISLGRDRKRYISSAIHHFSLDKLSENEIEKLKGLLAFAEHIEHSFVDRMVKKYGSDVMKKLKKTDK

SEQ ID NO: 4264 - protein, 312 aa, Pseudomonas sp.
  source 1..312: note = Related to NZ_JADBHI010000015.1; note = Pseudomonas arcuscaelestis
MLILEELASKLLISTAELVKFVNTAPYRYKVYSIPKRSGRGLRTIAQPTEVLKVIQRMVLDSYLKGLPIHDCATAYRDGLSIKENAAVHLGSKYLLKMDFSDFFPSIGPSDLITHIKKHRKDIAREDAYAVRKIFFWATKKDPAHRLSIGAPSSPFISNTLMYEFDCKVFDECTRLGVRYTRYADDLTFTTNVRGILFELPDIVTKTCAEIGYPTLRVNQDKTVFSSKGNNRHVTGLVLTNDNKISLGREKKRYFRSLIHRYSLGGMSSEDIYALKGRLAFAKHVEPTFYYAVVQKYGAELIKSIMEYQILK

SEQ ID NO: 4265 - protein, 312 aa, Pseudomonas sp.
  source 1..312: note = Related to NZ_CP025261.1
MLILEELASKLLISTAELVTFVNTAPYRYKVYTIPKRSGRGVRIIAQPTEVLKVMQRMVLDSYLKGLPVHDCATAYRDGVSIKENATAHLDSKYLLKMDFSDFFPSISPSDLISHIKRHRGSVSREDAYAVKKIFFWARKKDPLHRLSIGAPSSPFISNTLMYEFDCKVFDECARIGVRYTRYADDLTFTTNTQGVLFGLLDIVNKICAELAYPTLRINSDKTVFSSKGNNRHITGLVLTNDNKVSLGRERKRYFRSLIHKYSLGELSGEDIYALKGRLAFAKHVEPTFYSAVIQKYGAELIASIMVFQILE

SEQ ID NO: 4266 - protein, 316 aa, Pseudomonas sp.
  source 1..316: note = Related to NZ_CP067098.1
MTILAYLSNKLLISSAELIGFVNTAPYRYKVYPIPKRSGRGVRIIAQPTDVLKVMQRMVLESFLVGLPVHHCATAYRDGVGIRENATEHLKSKYLLKMDFSDFFPSIGPKDLILHIKKHRGEISKEDAYAVKKLFFWTKKKDPVHKLSIGAPSSPFISNTLMYEFDCRIFEECARLEISYTRYADDLTFTTNKQGILFELPSLVVRICREIDYPTLNINADKTVFSSKGRNRHVTGLVLTNDDKISLGHEKKRYVRSLIYRYSLGGMSSDEIYSLKGMLAFAKHVEPSFYQSVVRKYGEAVVGSIVSFQLIKQVAQ

SEQ ID NO: 4267 - protein, 312 aa, Pseudomonas sp.
  source 1..312: note = Related to DORR01000095.1
MTILTELSQKLLISSEELKEFINTAPYRYKVYPIPKRNGRGVRVIAQPTEVLKAMQRMVLDDFLAGLPVHACAMAYRDGLGIKDNASLHVKNQYLLKMDFSDFFPSIGPDDLISHIRRHREGIGREDAYAVKKLFFWARKKDPTHRLSIGAPSSPFISNTLLYDFDCRVNDECTRLGIIYTRYADDLTFTTNNKGVLFGIPDFITHICKLVDYPTLKVNHEKTVFSSKKNNRHVTGLVLTNDNKISLGHDKKRHIRSLIYKYSLGGIPSEEILALKGMLAFAKHIEPVFYQAVMRKYGFHVLDSIMSFQPKE

SEQ ID NO: 4268 - protein, 313 aa, Pseudomonas sp.
  source 1..313: note = Related to NZ_JAHSTY010000001.1; note = Pseudomonas azadiae
MTILADLAKKFLISSVEIAHFVNTAPYRYKVYTIPKRSGRGVRVIAQPTDVLKVMQRMVLETYLVGLPVHNCAVAYKEGQGIKENAIAHVNNQFLLKMDFSDFFPSIGPQDLISHIKKHKGQISREDAYAVKKLFFWARKKDPTHRLSIGAPSSPFISNTLLYEFDCLVSHACSKLGVVYTRYADDLTFTTNEQGVLFDVPVFIFKICDAVEYPRLKVNSDKTVFSSKANNRHVTGVVLTNDNKISLGHARKRQIRSLVYKYSSGEMTTEEVYSLKGMLSFARHIEPTFFQGLIRKYSYEVVGSIVRFESIKA

SEQ ID NO: 4269 - protein, 321 aa, Pseudomonas fluorescens
  source 1..321: note = Related to LKEF01000044.1
MSILELLSQKLMMSSSELRLFIKTAPYRYKVYPILKRSGKGIRLIAQPTDVLKMMQRMVADESLSGLPVHACATAYREGLSIKDNAEAHAKNQYLLKMDFSDFFPSMGPSDLVKHIEKHKGSITAEDAYMVKKLFFWARKKDPIHRLSIGAPSSPLISNTLMYDFDCALQEYCDKLSITYTRYADDITFTTNTKEILSAIPNYIEGLCERISYPKLKINNQKTVFSSKKNNRHVTGLVISNEDKVSLGRERKRYIRSLIHKSIAEAMTSEEIYNLRGLLAFSKHVEPTFYQSVIKKYGQPAIYFIETFQSAQKAAKVINKT

SEQ ID NO: 4270 - protein, 311 aa, Pseudomonas sp.
  source 1..311: note = Related to FOQB01000015.1; note = Pseudomonas syringae
MSILELLSQKLMMSTSELRSFIKTAPYRYKVYPVPKRSGKGVRIIAQPTDVLKMMQRMVADEFLSELPIHACATAYREGLSIKDNAEAHVKNQYLLKMDFSDFFPSMRPSDLVKHISKYKGSITAEDAYMVKKLFFWARKKDPIHRLSIGAPSSPLISNTLMYEFDCILQEYCDKLSVTYTRYADDITLTTNIKGVLLGVPNHVKELCGHIAYPTLKVNDAKTVFSSKKNNRHVTGLVISNEDKVSLGRERKRYIRSLIHKSVVGDMTNEEMYNLRGLLAFARHIEPTFYDAIAKKYGLSAIYFIETFQPA

SEQ ID NO: 4271 - protein, 325 aa, Pseudomonas sp.
  source 1..325: note = Related to NZ_CP077085.1; note = Pseudomonas shahriarae
MSILESLSQKFMISANELRSFIKTAPYRYKVYPIPKRSGKGFRLIAQPSDVLKMMQRMVLEEFLSELPVHSCAAAYREGLSIKDNAEAHAKNQYLLKMDFSDFFPSMAPADLINHIVKHKGAITSEDAYMVRKLFFWARKQDPTYRLSIGAPSSPFISNTLMYSFDCVLQDYCEKIGVTYTRYADDITLTTNVKGLLLNMPNYVRSICKEIAYPTLKVNEQKTVFSSKKSNRHVTGLVINNENQISLGRERKRYIRSLIHKSSLGGLTDEEMHNLKGLLAFAKYIEPTFYKSVLDKYGLPALYLIETFQSNPKVIESLEIKRQFP

SEQ ID NO: 4272 - protein, 311 aa, Pseudomonas sp.
  source 1..311: note = Related to NZ_VDNQ01000002.1; note = Pseudomonas oryzihabitans
MSILESLANKLLIKPGELFSFIKSAPYRYKVYSIPKRNGRGMRIIAQPSEALKVMQRLVLDDYLMGLPIHNSATAYIVGKSIRDNALRHANNPYLLKMDFSEFFPSISPADLSLHVKKYKGVVSPEDEFMLRKLFFWAQKHDTRHRLSIGAPSSPFISNTLMYEFDSKLSRACSEKEVVYTRYADDLTLTTRNKDVLFSMPEFIAGLCQQIEYPRLQINSEKTVFSSKKHNRHVTGIVINNKNELSLGREKKRFIKSYIYRFSSDELSSVEIIQLRGLLAFAKHVEVSFYNALIAKYGLETVSRIERYQPV

SEQ ID NO: 4273 - protein, 312 aa, unidentified
  source 1..312: note = Related to NC_015554.1; note = Alteromonas naphthalenivorans
MDIYNALSELLLIDEVEIVSYINKAPHRYKVYKIPKRNGSGSRVIAQPAKELKVLQKSALNMPLLDLPVHKSAFAYMEGIGIKQNAQKHSKNQYLLKMDFSDFFPSIVSSDLLSHVEKHKGKLEIKEKVALKKLFFWCVKGSTEHRLSIGAPSSPFLSNTILFDFDTIVNDYCTQEKITYTRYADDLTFTTNVSGVLFELPTYIEGVLKKLEYPTLKINHSKTVFSSKKNNRHVTGLVLTNDNAISLGRDRKRYIRSLVYGFCNKKLSDDESIKLRGLISFAKHVEPTFFRSLVKKYSLAVISDIERYYPDN

SEQ ID NO: 4274 - protein, 311 aa, unidentified
  source 1..311: note = Related to JADZHD010000030.1; note = Shewanella algae
MDIYESLSEMLLIDESEIVEYINKAPHKYKVYEIPKRNGHGTRTIAQPARELKVFQKLSLEHPLLNLPVHDAAFAYRDGIGIKQNAEVHAKNQYLLKMDFADFFPSILDTDLITHIEKHHGKIDQRNKTAISKLFFWRKKRDIINRLSIGAPSSPFISNTLLYDFDEEISNICTPLMITYTRYADDLIFTTNEPGILSNIPNVVVETLKSIKVPTLRINPQKTVYSSKKNNRHVTGLVLSNDDKVSLGRTRKRYIRSLVFQYHSENLASDDIVKLKGLLGFAKHIEPTFYSSLINKYSLDLILSIEKYDPA

SEQ ID NO: 4275 - protein, 308 aa, Chromobacterium sp.
  source 1..308: note = Related to NZ_CP029554.1; note = Chromobacterium phragmitis
MSIIKYLADQLLLSEEDIRLFIKKAPYKYKVFAIQKRNNHGERIIAQPAKELKSIQQMVLIEFLKELPIHSCAMAYRHGISIKDNAKVHSSNTYLLKMDFADFFHSIRPEDLIEHYEKYKAKLSADDRVSLKKIFFWASRKPPEIKLSIGAPSSPFISNTILFDFDSIVSKVCIAHEITYTRYADDLTFTTNIRDTLFDIPNLIARVIKDIDYPRLKINHTKTVFSSKRSNRHVTGLVLTNENQISIGRSMKRKIKTMIFLYSKKNLSPDDIKFLRGYLSHIHNVEPTFLHSLTKKFGTRIVTSIFHQ

SEQ ID NO: 4276 - protein, 314 aa, unidentified
  source 1..314: note = Related to NZ_KB913033.1; note = Hydrogenovibrio halophilus
MSLIDFLKEKTGVHKSTLKSFVRSAPHRYKTFPIDKRNSDKKRLIAQPSRLLKKIQNLVVSEYEFLINLPIHPCVMSYVKGKSIRDNALVHKDSSYLLKMDFKDFFPSIKPSDLIEHIEKHKRVSLDDDEKDYLSRLFFYSQSRKEEIVLSIGAPSSPYISNTVLYDFDVTIAAECDSTGVKYTRYADDLTFSSNDKQSLINLHNAMESILSSLQYPKLALNTNKTTFLSKRVNRHVTGLVINNDGGVGIGRKKKREIKSLVHRYLNHSLEDERHPYLRGYLAYIWGVDKQFVAQLEAKYEISILDVVKQLEAD

SEQ ID NO: 4277 - protein, 313 aa, unidentified
  source 1..313: note = Related to JAKISK010000029.1; note = Thiomicrorhabdus sp.
MSIVDFLVEKLVVPKSIVETLVLTAPHRYKTYEVTKRNGKGKREIAQPSKELKYIQRIVLKEFDLMQNLPIHDSAMAYRKNIGIQDNALMHKDNQYLLKMDFSNFFPSIVPTDLIKHIEKYKGLKLDEEDIKCLSRLFFYTKEKGSGLVLSIGAPSSPYISNTLMYDFDILLQKKCEQKNIVYSRYADDLTLSTNVPKILFDFPAVVNGILKEILTPKLLINDSKTVFLSKGTNRNVTGLVISNEGKVTIGRDKKREIKSMVYKYSLSHQLDPESEIPYLKGYLNYINGVEPSFLKSLEKKYGIDLIKLIRNS

SEQ ID NO: 4278 - protein, 314 aa, unidentified
  source 1..314: note = Related to BLYD01000277.1
MSILEGLSKKILLNEPDLWKFISSAPHRYKKYKIEKRNGKGFRDIAQPSKELKFVQNTAVFGIDLFQNLPIHHSAKAYIKKINIKDNAEAHKLNSYFLKMDFSNFFPSIKPVDFINHIEKHKNLTLSEKDKLIISKLFFYKKYRKSELVLSVGSPTSPYISNTLMYDFDDIVYKYCIEKKITYTRYADDLTFSTMTKVDLFEIPVFIKSTLNELLYPRILINNDKTVFLSKRTNRHITGLVITNDGKVSIGRKKKRYIQSLVYKYCNSNISEESTSYLKGYLAFCLGIDVDFVISLEKKYGKENIDSIRGLNKG

SEQ ID NO: 4279 - protein, 313 aa, unidentified
  source 1..313: note = Related to nan
MVTIIQDLSSLLSIDAERLRKYIATCPHRYKVYGIPKRNGSGIRTIAQPAKELKTLQKLVYEKYLESLPVHEACTAYRKNISIKDNALAHVKNNYLLKMDFLNYFPSITPKDLIKHIEKHLNWNEWEEDKFVIERLFFYVRNRGEGLRLSIGAPTSPFLSNTILYEFDSKITELCNLQNITYTRYADDIAFSTNKKDILFDFAGVVADILSQCEYPSISINPDKTVFLSRKGNMHITGLVLSNDRKVSIGRSKKRYIKSLVYRFLNNNLTEDEKLYLSGYLSFCVSVEPDFIEKLKSKYGANTINELMGRQSG

SEQ ID NO: 4280 - protein, 324 aa, Pseudomonas sp.
  source 1..324: note = Related to NZ_KE384408.1; note = Pseudomonas azotifigens
MNIVSYLSQTLYIAENEVEKFINTAPHRYKQYQIPKRNNNGVRLIAQPAAELKIMQLLAIAQFQQFLPVHSSATAYCRGKGIMDNAKAHAKNSYLLKMDFKDFFHSIKPSDLIRHCSQHMGGIDDATAKQITKLFFWTPKRTSSLILSIGSPASPFISNTVMYQFDCLMSEICSEKGIVYTRYADDITFTTNVKGLLFQIPSLVIDICKKIDYPRLSVNSEKTVFSSKGNNRHVTGVTITNEGKLSLGRHKKRKIKSLVFDCLNNKLDSAERRSLSGLLAHAKHIEPSFFLSLTKKYGYSEIAKIASNKPTLEVVVANPLTICD

SEQ ID NO: 4281 - protein, 316 aa, Pseudomonas sp.
  source 1..316: note = Related to JACAOT010000014.1; note = Pseudomonas tolaasii
MKIISFLSKTLYLPEHEVTAFINTAPYRYKEYSIPKRNGTGTRQIAQPSSEVKVLQTLAIEKIKNNLPIHSSAMAYREGLSIKDNASMHAKNKFLLKMDFENFFHSLLPHDLLLHTEKYYSSISEEDKKTLSKLFFWATKRDRKLKLSIGAPSSPFISNTLLYDFDEAVSNVCRPLDITYTRYADDLTFTTNTNKILFEIPDLIQKICETLTYPKLKINKGKTVFSSKKHNRHITGITITNEATLSLGRHRKRHIRSLVHQHMLGKLSSKQITELKGLLAFSKHIELTFYKTLVNKYGFKTLLDIQATQTKNSDTP

SEQ ID NO: 4282 - protein, 311 aa, unidentified
  source 1..311: note = Related to CAJHIV010000001.1; note = Methylomonas albis
MILQFLSNLLNLEKREIIKFIASSPYRYKVYSIPKRKKGEFRLISQPSSQLKFIQKATLDHFFSDLPVHSSAMAYIKGKGIKDNALMHAGNAFMLKMDFQDYFPSIKPEDFVNHIKSSSQLRFSEEDEFVVCRLFFWSPVRGKPLVMSIGAPSSPFISNTVMYPFDEKVDSYCKNNGVIYSRYADDLVFSTCSPQILSLVPKFIEETIRLLSYPKLKINREKTVFSSKKHNRHITGLTITNESTVSIGRARKRYVSSLVHRYTLSQLDNAQIVYLKGYLAFCSDVEITFVKRLEKKYGESVISELLKNTGG

SEQ ID NO: 4283 - protein, 313 aa, unidentified
  source 1..313: note = Related to nan
MNILNKVSEMSGIPQDMCAKFIISAPMRYKRYEIPKRNGSGTRLIAQPSKIVKPLQKICIDQLRKTLPIHSAALAYEVGTSIKKNANKHRYNRYLLKMDFTNFFPSIKPDVLLRTFEEHGLVITEEDKFVLSSLLFWKPRRRAPNLELSIGAPSSPFISNAVMYFFDVAVTEHCSNRGIVYTRYADDLTFSTNIADTLFEIPNFLYDLVQQTNMSFLRFNTDKTVFASKKVNRHITGVTITNDGRLSLGRKRKRKISAMIHRFSLQQLRSNDEINELKGILGFAKHIEPIFVRRMCDKYGKDTIVKIQKFNSD

SEQ ID NO: 4284 - protein, 313 aa, Vibrio sp.
  source 1..313: note = Related to NZ_QLYY01000008.1
MNILDKISELSGIPQDMCARFVVSAPVRYKRYEIPKRNGGGTRLIAQPSKSVKPLQRVCISELRGVLPIHGSALAYEAGTGIKRNANKHRYNRYLLKMDFTNFFPSIKPDVLLSTFEQHNVALTEVDKFVLSSLLFWKPSRSESTLELSIGAPSSPFISNAVMYFFDVAVTEYCERKGITYTRYADDLAFSTNTADILFELPKFLNELVQQPSMSFLRFNTDKTVFASKKVNRHITGVTITNDGRLSLGRKRKRKISSLIHRFSLQQLRCDEEVNELKGMLGFAKHIEPIFVRRMCQKYGEEIILKIQKFNSD

SEQ ID NO: 4285 - protein, 313 aa, Vibrio sp.
  source 1..313: note = Related to JAHVKH010000015.1; note = Vibrio hangzhouensis
MNILDKISEVSGMPRTMCLRFIVSAPIRYKRYEIPKRNGRGVRLIAQPSKSVKPLQKACIGELRDILPIHPAALAYEVGTGIKRNANKHRYNRYLLKMDFTDFFPSIKPDVLLSTLEQHNVELTEEDKSVLSSLLFWKPTRGDSNLELSIGAPSSPFISNAVMYFFDVTVEDYCKQRGIVYTRYADDLFFSTNASDILFDVPRFLSGLVQKPNLAFLRFNNDKTVFASKKVNRHITGITITNDGRLSLGRKRKRKISSLIHRFSLQQLTNPEEINELKGLLGFAKHIEPIFLIRMYNKYGRDTILKIQKFNSD

SEQ ID NO: 4286 - protein, 312 aa, Vibrio sp.
  source 1..312: note = Related to MSCG01000002.1; note = Vibrio splendidus
MNILNQISEKTGMPKRLCASFIITAPKRYKRYEIPKRNGRGVRLIAQPAKSVKLLQRICVESLRKSLPIHQAATAYEVGTGIKMNANRHRFNKYLLKMDFADFFPSITPEVLFNTFESHGVELSDENQYILKNLLFWKPTRDSSLELSIGAPSSPFISNAVMHEFDSKVTEFCDSLGVRYTRYADDLVFSTNTPNVLFDLPEVLGSLLSEPSLSFLRFNSDKTVFASKRNNRHITGVTLTNDGRLSIGRKRKRRLSSLIHRYKLGQLTASKDIEELKGHLGFAKHIEPIFIARMTKKYGIETIQSLQKFKSE

SEQ ID NO: 4287 - protein, 315 aa, Vibrio sp.
  source 1..315: note = Related to NZ_CP049331.1; note = Vibrio ziniensis
MELINKISTITGVPKGTCISLIVTAPRRYKRYEIPKRNGSGTRLIAQPAKSIKTLQRVCIEILRDYLPVHGVAMAYEVGVGIKRNANRHRYHRYVLKMDFSDFFPSITPEVLLNTISRHGVVLSDIDKMVLTNLLFWKPTRHNDNLQLSIGAPSSPFVSNAVMFFFDSMLNEKCRQLGITYTRYADDLIFSTNLKDVLFEVPSLLSRDVLANTEFNFLCINEGKTVFASKRNNRHITGVTITNDGRLSIGRKRKRVLSSLIHKFTTGELKDPIEIMKLKGLLGFAKHIEPIFIQRMAVKYGSEVIEQLKKYPTKI

SEQ ID NO: 4288 - protein, 310 aa, Vibrio sp.
  source 1..310: note = Related to RHPA01000002.1; note = Vibrio cholerae
MSYLEQFTEITSLSSVEILNFVKSAPYRYKQYYIPKRSGRGVRLIAQPSKEVKYMQYIGKQLILDELPVHAAAYAYQKGASIKANASQHVSNKYLLKMDFSDFFPSIKPPLLLDVIQSKVGTLSTHDTTLIKRLFFWQRERISPLQLSIGAPSSPLISNVVMYDFDEFIHAYCSERGINYTRYADDLSFSTNERGLLFHIPELVSSYLTENEHLGLSINSGKTKFSSKKHNRHVTGLVLNNENQLSLGRERKRKIRTLVFLFSQSALDLDETYHLKGLLAFALNIEPNFILRLRSKYSSEMIDSIFRYQE

SEQ ID NO: 4289 - protein, 310 aa, Vibrio sp.
  source 1..310: note = Related to AAXPSE010000001.1; note = Vibrio vulnificus
MSYLENFTEITSLGSQEILDFVKSAPHRYKQYTIPKRNGRGVRLIAQPSKEVKYMQYIGKQLILDELPVHSAAYAYQKRTSIKANASQHIANKYLLKMDFSDFFPSIKPPLLLGVIQRQVGELSADDITLIKRLFFWQRDRMSPLQLSIGAPSSPLISNVIMYAFDEYLYSYCAQRGISYTRYADDLSFSTNERGLLFHIPEVVSNYLSTNEHLGLSINTTKTKFSSKKHNRHVTGLVINNDDQLSLGRKRKRKIRTLVYLFTQSALETDEVFHLKGLLAFASNIEPEFILRLKSKFSNEVVDSIWRYQE

SEQ ID NO: 4290 - protein, 311 aa, unidentified
  source 1..311: note = Related to OBMM01000001.1; note = Thalassospira xiamenensis
MQPSNLICKRFMMSKAELYHYANTCPHRYKTYSIDKRSGGKRKISQPSRDLKAVQRFVLSEYLEKRLVIHSSAKAYRVGVSIVDNAKEHVAQKYLLKMDFSNFFPSILSSDFMKLLRRDKIVDSEEEVKLLSKIFFMNDSGSLRLSIGSPGSPSISNAIMYDFDEVISKKSIDNSIFYTRYSDDITFSTNEKDILFSWPNVVSDVLRGIDFPKLKINTDKTKFSSKKFNRHVTGITLANQGYLSIGREKKRLIRARVHNAMNLDDEEILSLSGDISFACQVEPNILEKLWRKYPDQMNLILRRKEKTNQLE

SEQ ID NO: 4291 - protein, 304 aa, unidentified
  source 1..304: note = Related to GG703517.1; note = Ruegeria sp.
MTVSDLIRRRFSFSPAELRVYAQTCPYRYKTYPIDKRNSQQKRWISQPSKDLKAVQRLVLSEFLGPKLTVHDSAKAYKSDTNILDNAGPHLKNRYLLKMDFRDFFPSIRAQDFVRYLLGSGIVQDEAEANLLARIFFKYCDGELCLSIGSPGSPVISNALLFPFDENISDICQKNIVAYTRYSDDLTFSTNTRDLLFSWPQKVEEALTALQSPKLELNREKTVFSSKKFNRHVTGITITNDDKASIGRDKKRALRTRIYNAPNLNEEELARLRGYISFVNQVESDMISKLWKKYPKQMGRILRQ

SEQ ID NO: 4292 - protein, 314 aa, unidentified
  source 1..314: note = Related to AMRK01000002.1; note = Celeribacter baekdonensis
MSDIIQRIKRRFAFSDSEFNTYLNTAPFRYKNYTIPKRSGGVRLISQPSKDLKSIQRFILSEFLLPKLEIHECATAYREERNIADNARPHLQNQFLLKMDFKDFFPSIRAIDFSQYALRRSIVESEEEATMLGKIFFKSTNNGLRLSIGSPGSPPISNAVMINFDKQISSMCRDSGIAFTRYSDDLTFSSNSKGILFGIPNQVQEVLEVIQRPKLMINAEKTKFSSKKFNRHVTGITITNDGLMSLGRQTKRRVRSEVYNAPSMQPKERQRLRGYLSYAKQFEPSFVIKLWEKYPAQMALIKNSAFTKRNGDPQ

SEQ ID NO: 4293 - protein, 318 aa, unidentified
  source 1..318: note = Related to LMCG01000004.1; note = Pseudovibrio sp.
MGAGERVVTIIDHIQHEFGFSRNELVAYAGTCPHRYKTYNIRKRNGDPRTISQPSKDLKAVQRFIVSRFFEDQFVIHEAATAYRKGVSIVDNAKPHLNSSYLLKMDFKNFFPSIKSDDFVTYLVEMGIYEDEARILSRIFFKKERDELVLSIGAPSSPIISNALLHEFDERVAQYSKERSLNFTRYSDDITISTNVENVLFDVPNYINELLGDIRLPRLRINEEKTVFSSKKFNRHVTGITISNEGQASLGRSKKRRLKAAVHSADKLTEIERFKLRGRLAFAKQVDPKFIELLHAKYPKQISLINSAQWAWDLSDFL

SEQ ID NO: 4294 - protein, 313 aa, unidentified
  source 1..313: note = Related to NZ_VFSV01000069.1; note = Paenimaribius caenipelagi
MKPTQILKKELFLADIELKRYVSSCPRRYKRYPIDKRSGGKRIIAQPTPDLKAVQRLLVSQFLEKCLQVHECAMAYQVGKSIVDNAKIHSKNSYLLKMDFKDFFPSIRSKDLCHLLVAQGHLDQGDEIELRTISRVFFMLENDELVLSVGAPSSPFISNALLFEFDTIADEYCKEHGISFSRYSDDLTFSTNIKDALFAVPGFIKEALKAMEYPSLLVNDGKTVFSSRAHNRHVTGITLTNDGKLSIGRKKKRSIRTQVFLFSASRLSTQEARSLQGYISFARSVDAAFYSSLLSKYPVAMAQLEAANFGEIN

SEQ ID NO: 4295 - protein, 316 aa, unidentified
  source 1..316: note = Related to JAKCFH010000010.1; note = Rhodovulum sulfidophilum
MRPKDVLRQNLFISGSELDRYLSSCPRRYKHYKIDKRGGEKDSKRPISQPTPELKGLQRTLLDEFLLERLPVHEAAMAYKKDTSIADNAKVHARNPYLLKMDFENFFPSIKSFDLCSLLIDTGKLDKDDQLDLRIISRVFFMREGPELVLSIGAPSSPFISNAMLFNFDSIVTEHCSSLNISYSRYSDDLTFSTKEKGILFDIPTFIRETLKLIKYPKLSVNEKKTVFSSKAHNRHVTGVTLSNSGEISLGRSKKRSLRTQVYLFSRGQLLPKEAAALQGYIAFSNSVEPKFVESLLEKYPEAMRALAAARFSLDD

SEQ ID NO: 4296 - protein, 306 aa, unidentified
  source 1..306: note = Related to FONF01000022.1; note = Marinobacter sp.
MSLIEQLSKRTNLPLDSIQKYAKTCPVRYKVYSIPKRNGKGFRVIAQPSAPVKALQRELVSILEDYILVHECAMAYREGVSIFDNASKHKDNDYLLKMDFKDFFPSIDPATVLGLIMSQCPVAEKSDTLYLLSILCRKPRGSDRFIVSIGAPSSPFISNAYMYVFDDILSKLLVDKGISYTRYADDLTFSTRKKGALFEVPALVKKVLVDSGYRTIRVNEEKTVFSSKKHNRHVTGLVLTNDGRVSLGRSKKREIRTLIFKYLHGELSKPEVESLKGLASHARHIEPEFWERLKSKYGIDDSFFKL

SEQ ID NO: 4297 - protein, 320 aa, Desulfovibrio desulfuricans
  source 1..320: note = Related to NZ_CP072608.1
MLNSALITYFSVKTGLDKSVCLHVALSAPKRYKAYSIPKRNGEMRTIAQPTPVVKHLQRLALRLFDGKLPIHKAATAYRKGSSIVSNVSPHLGNSFILKTDFNSFFNSIKPQDLDLLDLGGTIGLKSEEVYILKHLFFWLPKGASDFCLSIGAPSSPMLSNYLLFQIDTKIYNYCIEHNIEYTRYSDDITLSTDKKFILKDAYDCINGICTRTSSPSLVINQRKTVFTSKKHKRFITGLVISNDEKISLGREKRRLIKSILFNFVNNKETTIQSLEQLNGLLAFAAHIEPEYVMRLCKQYEAHLSHLYDKGVFLIRYASK

SEQ ID NO: 4298 - protein, 311 aa, unidentified
  source 1..311: note = Alphaproteobacteria bacterium; note = Related to JAFXQN010000116.1
MVIDEILKKIIYPRPMLEYLILTAPRRYKVYDIPKRNGKGSRTIAQPTKLIKAIQRECIEYLSKLFPVHFTATAYVKGKSIRDNALKHKNNRFLLKMDFKNFFNNITEYDFRKYIQKHRTDYNISWTEKDCEDLCNIFFWCPKNTYKRILSVGAPSSPSLSNILMYDFDAIIYKYCSENDVVYTRYADDLTFSCNKAFKLKDVEKYVTDISKAIDSPTLVINEDKTVHTSKKKNRHVTGITITNDGQLSLGYKRKIVLKSLIHKYANNELDENSILYLKGMLNFATSIEPDFIQRMKNKYGEDTVSAILRY

SEQ ID NO: 4299 - protein, 303 aa, Vibrio sp.
  source 1..303: note = Related to NZ_CP014041.1; note = Vibrio alginolyticus
MLLELISKSTLIEKDQVLDIANKASISYARFTIPKKDGSQRLIYQPSMAIRALQKVVYDEVLDKLPVHDACYAYRKKRSLKDHANVHKNNNYLLRIDLKDFFESITRSDIEKYCHESISKVFPHFNEEDFKLMTNIICRKDTITIGSVTSPSLSNSICYTLDERISRLAKSHGVKYTRYADDMFFSTSNKNVLCIIQKGVSGIIKGLEYPTLTINKKKTKHSSKKNRMSVTGVVITLDKKLSIGRGNKRFIREQVYKWSSLSSEDKSYLSGYLSFVKSIEPSYINRLCNKYSSQKIQEILRFS

SEQ ID NO: 4300 - protein, 303 aa, Vibrio sp.
  source 1..303: note = Related to NZ_AEIU01000111.1; note = Vibrio caribbeanicus
MLLELISKNTLIEKDQVLDIANKASTLYARFTIPKKDGSERLIYQPSMAIRALQKVVYDGVLDKLPVHDACYAYRKGRGLKEHANIHRNSKYLLRIDLKDFFESITRSDIEKYCNEYVSKVFPIFNEGDFNLMIDIICRKNTITIGSVTSPSLSNSICYNLDEKISRLSDSYGVKYTRYADDMFFSTTNKNILKIIQKEVSSIIKKLDYPKLTINNKKTRHSSKKNRMSVTGVVITVDKKLSIGRDKKRFIRGQVYNWKNLSIEEKSYLSGYLSFVKSVEPSYINRLCDKYSSHVIQEILRFS

SEQ ID NO: 4301 - protein, 307 aa, unidentified
  source 1..307: note = Related to JAKEVJ010000129.1; note = Shewanella sp.
MILEEIQKRTFLDIDYIRSIINRSNSLYSKFYIFKRDGSKRWIHHPKKELKLIQRVVNDNILDKLKIHPSSTAYRRGCSVKKNALLHVNNDFLLRMDFKSFFDSISYDDIENFLDKEFSISEPNWTYSDTKLLAKLLCYKNSLVMGAVTSPCISNAICYKLDKKLSGLCQNHNVIYSRYADDLYFSTSERNTLFFIEKEVLKIVANLELPSGLTINKNKTFHSSRKRKKQVTGLILTHDKKLSIGRNKKRTVKSKVHNWATLNENERSYLSGYISYIHSIEPQFINRLCLKYGADLVGEIISYNSKL

SEQ ID NO: 4302 - protein, 312 aa, unidentified
  source 1..312: note = Related to PBKZ01000009.1; note = Rheinheimera sp.
MKLILDVIHSKTFLEVDYIIILLGKVNSLYSRFSIDKKNGSGRRTVYHPSKELKAVQRVINDHIITKLDTHDACKAYKLGCTTKKNAEPHLNSRFLLRMDFKSFFESIEYKDVHKFCQEFIKKHFIEWTDEDSEIFSKFVCYKGRLVMGSVTSPALTNAMCVGLDNLLYEKCESIGVKYSRYADDLYFSTDAPNILKKLEKDVYKIVSSLKIPSSLKINSDKTYHSSRKRRMIVTGLVITNSGTISVGRGKKREIKSLVFNWESLDEEFKKYTSGYLSYIKSVEPEFLNNLCLKYGAEKIRVVMTYNQSLKI

SEQ ID NO: 4303 - protein, 306 aa, unidentified
  source 1..306: note = Related to QGUA01000011.1; note = Idiomarina loihiensis
MLLELIKAKTLLDEDYIKETCLNSNALYSSFYLPKKNGKLRKIYHPHKELKAFQRILHDNVLAYSKVHSASMAYSSGSSIKRNAERHSEKKFLLRMDFRSFFESISSKDVFQFCEKTLSNQFSGWDRFDSDMFTNFVCYKNSLVMGAVTSPSIANLILYEFDDSLSTFCSSIGVTYTRYADDMYFSTNTRNVLKEVERRVYKIVEKLQLPNDLKINTSKTYHSSKSRRRLVTGLVLTCEGSVSLGRKKKREVRSLIFKWDSLTDEEKQSLSGYLSYAKSIEPDFINRLCMKYGSNIVKNVLEYSPE

SEQ ID NO: 4304 - protein, 306 aa, unidentified
  source 1..306: note = Related to LZFG01000013.1; note = Photobacterium phosphoreum
MLIKLISEKSLIDEDFILDFANKQQVNYFKFQIEKRTGGMRTIYHPSKELKYIQKILLDDVISSLPIHNCCYAYVKNRNIHTHAIQHKNAKYLLRLDFRNFFESISYKDIYEFCETTMGIYNKGWTSSDSEIFSKLVCYKDRLTIGSVTSPSLSNAICYDLDIKLSQLALSKSVKYTRYADDMFFSTKIKGVLYALQNDINNIISTNTLPSKLKLNLEKTHHTSKKRKMAITGLVITNDGNISLGRRKKREIKSKIYKWDTLSTDERTYLSGYLAYIKSVEPEFINNLCDKYDANLILEIIKFNTK

SEQ ID NO: 4305 - protein, 313 aa, Vibrio sp.
  source 1..313: note = Related to SMCU01000001.1; note = Vibrio crassostreae
MLLELISSLTLLEEEYILNIAQTSSQRYKKFYITKKNGNLRAIYHPSKELKGIQRVIHNELLQKLPTHPASAAYKKGCSIKKHAEQHKKSKYLLRLDFKNFFESISEIDIRCFANNNIIGVIKGWSEEDTKLLVELATFKGGLTIGSITSPLLSDALCYQLDIALFSLSHELGVTYTRYADDLYFSTNHRNTLKKIPSNVDTIIKELEYPKKLKINYSKTNHSSKKNRMMVTGLTLTNDFKVSIGRSKKREIRSKIYKWSELNKDDKLHLSGYLSYIKSVEPSFINTLCGKYGATIIQSIIRFNSKKDPNLKS

SEQ ID NO: 4306 - protein, 308 aa, unidentified
  source 1..308: note = Related to NZ_WMDI01000001.1; note = Photobacterium carnosum
MLLEMISNLTLLEKEYIQNIAKTASKRYKRFLIPKKSGGNRVIYHPSKELKGIQRVIHEELLQKLPIHLASAAYNKGCSIKKHAEQHRKAKYLLRLDFKNFFESITEIDINCFVNNKFIDIFDDWSEEDTKLLIDLTTFKGGLTIGSITSPLLSNAICYQLDIALFSLSHELEVTYTRYADDLYFSTFHRDVLKKIPSKVDIIIKELEYPKNLKVNNNKTNHSSKKNRMMVTGLTLTNDFKVSIGRSKKREIRSKIYKWVDLNQDDKLQLSGYLSYIKSVEPSFINTLCGKYGAKVIQQIIIFNSKNI

SEQ ID NO: 4307 - protein, 307 aa, Vibrio sp.
  source 1..307: note = Related to NZ_ADAF01000002.1; note = Vibrio mimicus
MLLELLSRLTILEEEYILNIAQTSAQRYKKFHIKKRNGTLRAIFQPSKEVKGFQRIIHDEVLKRLPSHPASAAYKEGSSIKKHAELHKRSKYLLRLDFKDFFESISEHDIRKFASENLTGKIKGWTDEDTNLLVKLCTFKGGLTIGSITSPLLSDAICYNLDVALYSLSHELGITYTRYADDLYFSTNKSGVLKKIPERVEEIISRLECPNKLKINKSKTHHSSRKNKMKVTGLTITNDFKISIGREKKREIRSKVFNWDGLSPEEKAHLSGYLSYIKSVEPAFINNLCTKYGASIIKEITVFNSKK

SEQ ID NO: 4308 - protein, 307 aa, Vibrio sp.
  source 1..307: note = Related to NZ_JPTQ01000476.1; note = Vibrio harveyi
MLLELISNITILEEDYILNVAQTSSQRYKKFYIPKRNGSLRAIFQPSKELKGIQRVIHDEVLKKLPSHTASSAYKEGSSVKKHAEQHRKSNYLLRLDFKDFFESISDHDIRKFANQNLVEKITGWTEDDTNLLIKLATFKEGLTIGSITSPLLSDAICYNLDVALFSFSHELGITYTRYADDLYFSTNNRGVLKTIPSKVEDVISNLDYPSQLTINRSKTYHSSKKNKMMVTGLTLTNDYKVSIGRTKKREIRSKIYNWSALDLEQKHHLSGYLSYIKSVEPAFINTLCTKYGANVIREISVFNSNK

SEQ ID NO: 4309 - protein, 309 aa, Vibrio sp.
  source 1..309: note = Related to NZ_CP046834.1; note = Vibrio vulnificus
MLINLISKLVLLEKEYIVSIADTASRRYKRFFINKKNGKLRAIYHPAKELKAIQRVIHDEVLKKLPSHEASCAYKQGCSVKKHAEMHKGARYMLRIDFKNFFESIRTEDIRHFADKKMMSYIEGWTKADTELLVKLTSFQEGLTIGSITSPLLSDAICYDLDVSVFSLAHELGVKYTRYADDLYFSTNKKGVLKSIPPKIEAILLDLKCPHNLKINTAKTHHSSKKSRMMVTGLTITNDNNISIGRTRKREIRSQIYNWTSLNDEDKKYLSGYLSYVKSVEPEFINALCCKYGAYKIKEIIVFNSSGIN

SEQ ID NO: 4310 - protein, 305 aa, unidentified
  source 1..305: note = Related to NZ_MAJU01000015.1; note = Aliivibrio logei
MILLKYLAKELLLDESYIEELANSASNHYKSFTIPKKSGGDRLINQPSRELKALQRTLHDNILSKLPIHDSAFAYRDGQSIDKHAKVHLSARYLLRLDFKDFFESIKAHDIYRFINKHGINLLDNWSELDTKLLVDIVCYKQKLTMGSVTSPILSNAICFALDKQLEKICYMHDVKYSRYADDLFFSTSKPNVLRKIEKDVFNVVAALNEPEKLKINRKKTYHSSKKNRMSVTGIILTTDGNISIGRDNKRKVRTMVFSWNKLDVVEKRYLQGYLSFCASIEPEFINSLCNKYGADKITEIQRYN

SEQ ID NO: 4311 - protein, 305 aa, Vibrio sp.
  source 1..305: note = Related to MCZC01000024.1; note = Vibrio lentus
MILLEYLARELILDKGYIKDLAINSSLNYISFSIPKKSGGERIIHQPSRELKALQRALHDNLLKKLPIHESAFAYRKGKGIDQHAKVHLSARYLLRLDFKQFFESIKAKDITSFINKNKDLLLSGWTDSDTKLLVDIVCYKHKLTMGSVTSPILSNAICFLLDKELEKICYLNDVKYSRYADDLFFSTSKPNVLRKIQKEVFKIVSELDEPGQLKINVNKTYHSSKRNRMSVTGLILTNDGKVSVGRCNKRKVRTMVFNWDTLDEKDKFYLQGYLSFCSSIEPEFINSLCNKYGSEVIVKIQTYN

SEQ ID NO: 4312 - protein, 307 aa, unidentified
  source 1..307: note = Related to JQED01000055.1; note = Colwellia psychrerythraea
MKLLDHLSSSLLLDKTYIMELAETASQRYKQFSIPKKTGGFRSILHPARELKTLQRIIHEDILVKLPIHNSAFAYRKKLNIFDHANVHIGASYLLRMDFKNFFESISSKNIAKFLDSKANYLLKDWKAEDTELLVKLVCYKSSLTIGSVSSPTLSNAICYELDEALHKLCYVRGIQYTRYADDLYFSTNEPNILNSIQNNVYEIVNSLSIPDKLRINSSKTHHSSRKNRMSITGLILTNSGDVSIGRDMKRKIRSLIFKWCSLDVKEKKYLAGYLSFCASIEPEFLNSLCKKYGADIIYEIQNFMNK

SEQ ID NO: 4313 - protein, 303 aa, unidentified
  source 1..303: note = Related to NZ_VWXD01000007.1; note = Pantoea sp.
MLIEHLSDTLILTNDFINDLADTASKNYNKFSVPKKNGGTRVVYQPNKELKLLQRVIHDDFLKILPVHPACSAYLDGASVKENAERHKNNKYLLRIDFVDFFKSITHNDILSFLIENKIHPQWNDNDTELLLKLVCYNGRLTMGSVTSPMISNLVCNKLDKAIESICNIQDIIYSRYADDIYLSTNTPNILGMMPKKITNILRKIDYPKHLIINTSKTQHSSKKTRMTITGLKITNMGTISIGREKKREIRSLVHKWDTLPIEKKKYLQGYLSYCVSVEPLFINALCEKFSAKIIKKIQSYKF

SEQ ID NO: 4314 - protein, 303 aa, unidentified
  source 1..303: note = Related to NZ_CABDVS010000002.1; note = Raoultella planticola
MLIDHLSDSLILTHNFINDLANTASKNYNKFSVPKKNGGTRVVYQPHKELKLLQRVIHDDFLYSLQVHPACTAYIDGSSVKKNAEKHRHNKYLLRLDFVDFFKSITHNDILLYLMENKIHPQWTDEDTEIFLKLVCYNGRLTMGAVTSPMISNLICIKLDKAIESICSPLNITYTRYADDIYLSTNTANILGLMPKKIIHILRTIEYPKNLIINTSKTQHSSKKTRMIITGLKITNDGEISIGRDKKREIRSLVYKWDSLSIEQKKYLQGYLSYCVSVEPLFINALCEKFSAKVIKKIQTYKL

SEQ ID NO: 4315 - protein, 303 aa, unidentified
  source 1..303: note = Related to CP077366.1; note = Pantoea agglomerans
MLIEHLSDSLILTENFICELADTASKNYNKFSVPKKNGGTRVVYQPHKELKLLQRVIHDDFLVKMPVHPASTAYLKGASVKNNAEKHKNNKYLLRLDFVDFFKSITHNDILSFMMENKIHPDWNEYDKEIFLKLVCYNGRLTMGAVTSPMLSNLICNKLDRIIDSICSQQNITYTRYADDIYLSTNTAGILGSMPQRIINVLRLLEYPKHLIINSSKTKHSSKKSRMMVTGLTITNTGNISIGRDKKREIRSLVYKWDQLTIEKKKYLQGYLSYCVSVEPLFINSLCEKFSAKIIKKIQSSKL

SEQ ID NO: 4316 - protein, 303 aa, unidentified
  source 1..303: note = Related to CP026980.1; note = Pectobacterium parmentieri
MLIEHLSENLILTKQFILNLADSSSDCYNKFSVPKKGGGTRVIYQPNKELKLLQRVLHDDFLTKMPVHNACTAYRDGSTVKLNAELHKDKKYLLRLDFVNFFKSITHNDIFLYLQENKLSPNWIDDDTELFLKLVCYKGRLTMGAVTSPMLSNLVCEKLDRAIEGICNHDALTYSRYADDIYLSTNTPNILSQVPKKVIAVLRNLEYPKNLIINTSKTLHSSQKRRMLVTGLTITNQGNISIGRDKKREIRSLIHKWEALPTDKRKYLQGYLSYCASVEPLFINSLCEKYSAKLIRKIQSYKF

SEQ ID NO: 4317 - protein, 303 aa, Enterobacter sp.
  source 1..303: note = Related to FVZI01000003.1
MLIEYLSKSLVLTPDFIKEIADTANERYNKFSIPKKNGGTRVIYQPQKELKVLQRSLHDHFLKKVPTHQAICAYQEGSSIKKHAELHSKNNYLLRLDFIDFFKSITSNDILHYLMEHKLHSEWTENDSQLLLKLVCFKGRLTIGSVTSPLLSNLVCNHLDRCISEIAISRGITYSRYADDIYLSTSSKDILFDMPKKIISVLRNINYPKNLILNSTKTIHSSRKKKMTVTGLIITNDKTVSIGRKKKREIRSLVHKWDVLTLEKKKYLQGYLSFCAGIEPLFINSLCEKFSARKIRDIQKQKL

SEQ ID NO: 4318 - protein, 305 aa, Enterobacter cloacae
  source 1..305: note = Related to BPMY01000001.1
MLLNYLSNNLVLTPEFISNIADTANERYNKFSISKDNGKNRVIYQPQKELKLLQRVLHDDFLRRIIPHPCCTAYKDGASTYKNAIQHIENRYLLRLDFVDFFKSITSNDIFLFLKENSSKLHPEWTEEDNELFLKIVCYKGRLTMGSVTAPGVSNLVCKALDYRISDLCAARGITYTRYSDDMYFSTNKENILLNLTPEIIAIIRNIDYPKHLIINSSKTKHSSRKRKMSVTGLVITNDKKISLGRDKKREIRSLVHKWDNLDSKRKKHLQGYLSYCASVEPLFINSLCIKFGAATISKIQKYIP

SEQ ID NO: 4319 - protein, 317 aa, unidentified
  source 1..317: note = Related to NZ_CABHYG010000014.1; note = Yersinia proxima
MLIKYLSDNLVLTTDFIQELANTADDRYNKFSVPKKNGGTRVIYQPQKELKLIQRVLHDDFLKKIIAHPACSAYCDGSSVKKNAERHKSNKYLLRLDFVDFFKSITSNDVLHFLADNKLHNDWTTHDTELFLKLVCFKGRLTMGGVTSPILSNLVCNNLDVAINDISISLGITYSRYADDIYLSTNNPNILFCMPGKVISLLRSIEYPNYLILNTKKTNHSSKKNKMMITGLILTNDGEVSLGRKKKREIKTLVYIWETLSIERRKYLQGYLSYCASVEPLFINSLCEKFSAKKIKDIQSYKFQSSNSSVPSKILTK

SEQ ID NO: 4320 - protein, 304 aa, Proteus sp.
  source 1..304: note = Related to NZ_CP054157.1; note = Proteus vulgaris
MLIKYLSDNLVLTTAFIHELADTADNRYNKFSIPKKSGGTRVIYQPHKELKLIQRILHDDFLKKIPVHPACTAYSDGSSVKKNAEKHKHSKYLLRLDFVDFFKSITSNDIYYFLSENKLHSNWVKEDNELFLKLVCFKGRLTMGGVTSPILSNLICYELDIAINELSQSLGVIYSRYADDIYLSTNNPNILFNLPARIIKILRSVKYPKNLILNTKKTVHSSKKRKMIVTGLTITNDNQISIGRKKKREIKTLVYLWKGLTPEKKKYLQGYLSYCSGVEPSFINALCEKFSAKVIQDIQQYKIN

SEQ ID NO: 4321 - protein, 308 aa, unidentified
  source 1..308: note = Related to CQAZ01000033.1; note = Yersinia pekkanenii
MLLKYLSESLILTADFITNLSNTADERYNKFGIPKKNGGTRVVYQPQKELKLLQRVLHDDFLKKINVHIACTAYCEGSSVLKNANIHKENKYLLRLDFVDFFKSITSNDIRLFLNEKKGEFSDSWDDLDSDLFLKLVCFKGRLTMGGVASPMISNLICYKLDLLINELCLSLGVTYSRYADDMYFSTNTPDILFTIPKRVISILRQLDYPKKLILNTNKTKHLSKKRKMIITGLVITNTGTVSLGREKKREIRSLVYKWNILDDKKKKYLQGYLSYCASVEPLFINALCEKFSSQAISEIQTYCPPST

SEQ ID NO: 4322 - protein, 304 aa, unidentified
  source 1..304: note = Related to AODU01000021.1; note = Pectobacterium peruviense
MLTEYLASSLILTTDFIRDVADTADERYNKFGIPKKNGATRVVYQPQKELKILQRVLHSEFLVKLKVHSSSTAYSDGSSVIKNANLHKNKKFLLRLDFVDFFKSIRSSDIRLFLNERGSELSDQWTNDDSDVFLKLVCFKGRLTMGGVTSPAISNLICYKLDSALSEICLSLGVTYSRYADDMYFSTNVPNVLFSMPNRLIKILRSIDYPRSLYINTEKTKHSSKKRSMKITGLTLTNNGEVSLGREKKRRIRSLVFNWSNLTVDEKKYLQGYLSYCASVEPLFINSLCEKFSSKIITNIQKYK

SEQ ID NO: 4323 - protein, 305 aa, unidentified
  source 1..305: note = Related to JADUBR010000008.1; note = Serratia marcescens
MLLDYLSSSLVLTNEFVSLIANTSDERYNKFSIPKKNGGTRVVYQPQKELKLLQRVLHDDFLSKIPLHSACTAYCRGSSVIKNANMHRGNKFLLRLDFVNFFKSITSNDIFNYLNENRDKLDGHWTNEDLELFLKIVCYKGRLTMGSVTSPVISNLVCSMLDSKLQAVCVPLGVTYSRYADDMYFSTNGKNILFDIPSRVIGIIRTLGYPKGLILNTSKTSHSSKKRKMSITGLVITNDGKISLGRDKKREIRTLVYMWDSLTVKKKKYLQGYLSYCASVEPLFINSLCVKFSSAVISKIQSFTP

SEQ ID NO: 4324 - protein, 309 aa, Escherichia coli
  source 1..309: note = Related to CP057980.1
MLIEYLAKVLLLEADFILKVANDANSHYGKFSVPKKGGGTRIVYQPSKELKVLQRLLHDNVLSKLPIHPNAVAYQQGSSVFKHASIHKAKRFMLKMDFEGFFDSIKKSDVERFINDNKHFFSDDWSKDDTDLLVKIVCFNGRLTMGAVSSPVVSNAICYELDHILNEFCLSKGITYTRYADDMYFSTNEENVLKQIPPFLRSNLKNLKYPSKLWINRKKTLHMSKKNKMMVTGVTLTTDGGVSLGRDKKRMVKSLIFKWEALDEKKRLFLQGYLSYCKSVEPLFINRLCAKYSSELIDEIQRYQPVVSE

SEQ ID NO: 4325 - protein, 325 aa, unidentified
  source 1..325: note = Related to NZ_JAEMHM010000012.1; note = Geomesophilobacter sediminis
MLLEFIAQHLILTPEYILTVANTASKRYKEYYIDKRDGTKRLIHHPSKELKSIQRCINQGILPRLPVHHCAAAYKPGAKLIDHVTRHKNSKYLLRLDFKDFFHRLTDMDIMLCLDEYKHFLPSDWNVLDSDLLIKLVCRYHKLTIGAATSPSLSNILCFKLDTQIQTLCDHLGVEYTRYADDMYFSTIKPNILYDVRSSVYNIVNSLKYPSNLLFNNRKTKHTSKKHRRVITGLVVTPTAKISIGRDKKRDIRSKIYNWNGLSVAEKYSLKGYLSYCNSVEPSFINSLCDKYTAGTINLILKYDESAEAPKPKLLSPIEAIAASA

SEQ ID NO: 4326 - protein, 311 aa, unidentified
  source 1..311: note = Acidobacteria bacterium; note = Related to VFZY01000080.1
MIRERMASAIGVTIEYISGLANGASHAYKTYRIPKRDGRLRTIHHPSKQLKALQRWLLQNVIENLPVHSAAFAYKKSTSMFDNARAHSKNRFLLRIDLNDFFPSITDTDVRRFIQDRATMFEGWTNGDIDAFCKIICRNGHLTIGAPTSPAISNVLCFDLDSALSSLASKLGVTYTRYADDLFFSTNQAGVLRPLQESVEQTVRVATLPGNLAINHGKTRHSSKKRLRRVTGIVIGSDGKAHVGRGVKRKIRGMIHRFDSLNDQDRASLAGLIAYVIGFDPAFLNSLVTKYGHAAVSRARFPTRPSGVNVN

SEQ ID NO: 4327 - protein, 303 aa, unidentified
  source 1..303: note = Acidobacteriia bacterium; note = Related to PSRJ01000392.1
MMVDKMALDLGLTRKFVANFSRGASHAYKFYTIPKRNGGERPIHHPSKQLKSMQRWLLAYVIEPLPVHPAATAYRKHRSILDNARAHAASKFLLRMDCENFFPSITEDDVLLYIQQRPSLFPGWTAFDIEVFCKLICRNGRLTIGAPTSPGISNALCYEMDSALADLGLKRSVNYTRYADDLFFSASKPDVLRPLQSDIEQLITDLELPGGLKINPAKTRHSSKRGRRRATGIVLGSDGQPHIGRALKRKVRSLIHGVDSLDPAARQSLAGLVSYAIGFDPDFMNSLVIKYGHAVMQKVRFPT

SEQ ID NO: 4328 - protein, 312 aa, unidentified
  source 1..312: note = Acidobacteriia bacterium; note = Related to JAIQGJ010000040.1
MMLEQMANGIGIPVVFIENLANAASYEYKTYTIRKRSGGLRTIHHPSRRLKALQRWLLANVIQNFPVHLAATAYAPGRSIFKNASVHATSRYLLRMDFTDFFPSITQNDVRSYVNTNTRFFEGWNSTDVNAFCNLISRNGVLTIGAPTSPAISNALCYDLDARLELFCSKSGVTYTRYADDLFFSADRSGTLRQIEEGVLRIVSELEIPRCLVINRAKTRHSSKRGTRRVTGIVLGSDGKPHIGRTLKRKIRASIHQFAALDDAGKDSLAGLIAFAVGFDPDFLNSLIKKYGLAAVRIAMKKPSAKTGGKPL

SEQ ID NO: 4329 - protein, 341 aa, unidentified
  source 1..341: note = Related to JACHEB010000003.1; note = Edaphobacter lichenicola
MTTELGLTWEFVANLAGSASYEYKKFIVRKKSGGLREIFHPSRKLKAVQIWLLRNLLGQLPVHESATAYRTGISIYDNATRHTKSRYLLRIDLENFFPSIRDSDFSAYVDSNQENFKGWTEIDKAIVTSLMFRNGELTIGAPTSPALSNALCFQLDVQLSKLANNRGLVYTRYADDLFFSSIKPGVLSSVLDEAQSIIDELPIPATLKINRAKTRHSSKKGRRQVTGIVLGSDGKPHISRTFKRSIRSMVHKFDLLREDQKVALPGMISFVAGEEPGFLNSLITKYGFELIARVTTIQSLAERQRIHLPKVKPSPPKKVRAKSSTQVLFDTLRNAGFDVDD

SEQ ID NO: 4330 - protein, 303 aa, unidentified
  source 1..303: note = Related to NZ_JACHIP010000003.1; note = Granulicella aggregans
MIIEKMSAELSLPLKYVDFLALTASHQYKQYTIPKRTGGERIILHPSRKLKALQRWLLSNVIAVWPVHPAAMAYRPGVSIFDNANIHVQSQYLLRMDMTNFFPSIEVRDLVAFMAKRPTLFQDWTDRDKSYFARLVFRHGKLTVGAPTSPALSNALCFELDSALAGITSAQGVAYSRYADDLFFSANKKQVLISIEAEAKAVLGEIKIPANLSLNQAKTKHSSKRGARRVTGIVLGSDGKAYVSRDTKRTIRTLVHQLDTLKDEERIRLAGLISYVSGFEPAFLNNLILKYGADKVSSAKQHT

SEQ ID NO: 4331 - protein, 306 aa, unidentified
  source 1..306: note = Related to SHBB01000070.1; note = Sandaracinaceae bacterium
MSIVDSAAASLGVSRDKILTLADQANHSYVTYSIPKKSGGEREIHHPSKPLKAVQRWFLRRWISLLPVSPLATAYEPGSSVLKNALVHEGAKYAVRIDLQDFYWSISSDDFRSYLATVPAGAEIDFGDVETVAALLFRHGRLTVGSPTSPSLSNRMCRKLDTECEALAVKIDARYSRYADDMYFSATHPGILSAIESSLESILSGLDTPGSLRINKSKTQHFSQKTGIFVTGLVIGSDGKVYLGRRRKREIRALIHNLESLDLDARRRLAGKISFARSIEPAFVNALIKKYTVGRFRSASRPDSAG

SEQ ID NO: 4332 - protein, 308 aa, unidentified
  source 1..308: note = Related to QHPH01000062.1; note = Verrucomicrobia bacterium
MLIELLSQRLLLPEKYISNLAAGASHHYKTYYVSKRRGGARLIEHPSKQLKAVQRWLAANIICHFPVHAAATAYKSGVNIADNARRHASSSFLVRIDLQDFFPSLRAVDVKRLAETSLVFVPGGGQWSSDNIDVFVCLSCKDGRLTIGAPTSPPLCNALCYHLDLQLTAFAQQRELTYSRYADDLVFSARAPDQLRGVPAQVAATLENLEVPRGLKINTSKTWHASRRGRRKLTGVVITSDGKLSVGRQLKRRLRTLVYRHYTLDKTQKKNLARWLAHVRSIEPEFINSLILKYGADRVVDAMQPHSG

SEQ ID NO: 4333 - protein, 313 aa, unidentified
  source 1..313: note = Related to NZ_FOXY01000012.1; note = Donghicola eburneus
MLIELLSKTSNVPESKLLSLSLTASRRYKVYTIPKRTGGDRLIEHPSRELKAIQRWIVQALFARFPVHEAATAYRKGTGIRENAERHRQSKFTNRYDFSNFFPSFSQDRVLHYVSEQSKNLGIDLTQRDLDFVGNIVCRHGRLTIGAPSSPAISNAMMFEFDSRMHEASQSRGLVFTRYADDIFLSSFEPGKLEGLEALILKSKRDIPHLRLRLNRQKTAYLSKKYSRKVTGIVITPQHTLSIGRERKREVKALIHQWIKGGIEPERFYYLKGLFAFAIDIEPQLEARLMEKYGKEKIQLLRSADFDFPIGLI

SEQ ID NO: 4334 - protein, 313 aa, unidentified
  source 1..313: note = Related to NZ_LGHS01000039.1; note = Pseudorhodobacter aquimaris
MLIELLSRTAKIPEAKLVSLAESASRRYKVYTIPKRTGGERVIEHPSRELKAIQRWIVRALISRFPLHESATAYRKGTGIRENAERHRKTKFTNRYDFASFFPSFSQARVVQYIGEQAKAVGIDLSERDLEFIGNIVCRNGRLTIGAPSSPAITNAMMFEFDRRMHEDCHAKGLVYTRYADDLFVSSFEPGQLDGIEKVIVKNKRGISHLRLRLNHQKTAYLSKKYRRVITGVVITPQHTLSIGRERKREVKALIHKWIKGDIDPTNFYYMRGLFSFAIDIEPEFEKRLAEKYGAARIRQLRSADHDFPIGLI

SEQ ID NO: 4335 - protein, 313 aa, unidentified
  source 1..313: note = Related to NZ_RBIG01000007.1; note = Oceanibaculum indicum
MLIELLSRTSGIPDERLLRISATASQQYKLYTVPKRTGGERLIEHPSRELKAIQRWVIRALINRFPVHDSATAYRIGSGIRENAERHRTSKYTNRYDFMNFFPSFRKEHISIFIKEQSDIIGIDLSERDIDFIANIVCRNGRLTIGAPSSPAITNAMMFAFDKKMHDACKSRDLIFTRYADDIFISASEARKLFNIENLIIDSKRDIHYLNLRINHKKTAMLSKKYHRSITGVVITPQHTLSIGRDRKREIKSLIHRWINGQIDAEKTEYLKGLFSYAIDIEPSFETRLIDKYGADIIKSLRSPENAINTNRS

SEQ ID NO: 4336 - protein, 325 aa, unidentified
  source 1..325: note = Related to CP069017.1; note = Pseudosulfitobacter pseudonitzschiae
MLIDQIARSSQLEVDELVRLAQNASQHYKLYNIPKRNGEPRRIAHPSRELKAIQRWIVKVIIQRFPIHDAATAYRTGGGIRENAERHRISLYTNRYDFANFFPSFKREQVQSFIQSESEKVGLLLSDDDADFVGKIVCRYDRLTIGAPSSPSITNAMMFPFDQILFDYCVKRDLIYTRYADDIFISANKSDQLNNLEVRIADAKRKIPHLSIRLNRQKTAYLSKKYHRSITGVVITPDHKLSVGRSRKREIRALVHRWINGKLDPIEVSYMRGLIAFARDIEPKFEVALRAKYGPQRIEEILRRPDLTTTPGWPKEGNNDDDVPF

SEQ ID NO: 4337 - protein, 321 aa, unidentified
  source 1..321: note = Related to NZ_CP010725.1; note = Phaeobacter inhibens
MLIQQIARTTKLDEQDLRHLAASADRRYKVYLIPKRGHGHRKIEHPSREIKALQRWITKVIIDRFPVHHAATAYRKGNGVRENAERHRTSKYTNRYDFANFFPSFGQAQVENFVKQEAEKLGMLFDNDDLRFVGNIVCRFGRLSIGAPSSPALTNAMMFDFDRTLFDWCQSKELIYTRYADDLFISANEPDRLNKLEPLIAKAKRDVAHLTLRLNRRKTAYLSKKYTRLITGVIITSDHKLSIGRERKREIKALVHRWLNGKLEAGEIYYMRGLLAFARDIEPEFEKNLRSKYGDAAINEVLRHPSLGKAPDPEFQLPPWL

SEQ ID NO: 4338 - protein, 309 aa, unidentified
  source 1..309: note = Related to JAGRDV010000235.1; note = Rhodobacteraceae bacterium
MLIEMLARTTSFDLDRLSRISMTASRRYKIYTIPKRTGGVRTIEHPSRELKAIQRWIIKALFAKFPVHESATAYRKGFGIRENALRHKQTSYTNRYDFADFFPSFQQSSVEKFLALQAKILQIDLSPLDIRFVGNVVCRNQRLTIGAPSSPAITNAMMFKFDENLNNSCESDKLIYTRYADDIFVSSNEPNKLFDVEVRIENAHRGIDYLSLELKNEKTAILSRKYARKVAGVVITPTHNLSIGRERKREIKALVHSWSVGALEKDRFAYLRGLLAFARDIEPDFERRLRAKYGDPTIDRLLFAPDLYA

SEQ ID NO: 4339 - protein, 315 aa, unidentified
  source 1..315: note = Related to NZ_MBST01000045.1; note = Ensifer sp.
MLVELLVRASKISEAKLTSLAATASNRYKVYEIPKRSGGKRTIEHPSKELKAIQRWIAKAVFARFPIHSGATAYRQGFGIRENAERHRQSKFTNRYDFSNFFPSFTQAEVQNFLRSRSAAVGLVLTEKDIGFVGNIVCRNGRLTIGSPTSPIITNTMMFDFDVTLDNFCAERGLIFTRYADDMFVSSNKEGQLFSVEDGIHLAMNSIPNLNLEVNHKKTALLSKKYLRRVTGVVITSDHRLSIGRHRKREIKALIHKWRTGTLEVEKLHYMRGLVAFARDVEPNFEQRLRLKYGDQAIDEIVHSSDLSIVFDKNT

SEQ ID NO: 4340 - protein, 311 aa, unidentified
  source 1..311: note = Related to RHWX01000009.1; note = Brevundimonas sp.
MLLERLEKHTGLPRSLLERYAETASKRYRVYTVEKRNGDRRTIEHPSREIKAIQRWLIRALIGNMPVHEASTAYSKGASIRKNAERHVRSRYTVRLDFEGFFPSFGGADVIAYLKKTHDDPIMVLSAEDLSFIRRIVCRHDALTIGAPTSPGLTNAMMFEFDSALADWCAARALIYTRYADDLFISASAPGALAGVEAKAAELAAAFPYAKLALNREKTAHLSRKYRRSITGLVITPEQTLSIGRDKKIRLKSDVYAYSKGNLQSEQRSRTAGLIAFVRDVEPAFYETLLRKYGRETIEGLQKGLRSSLKG

SEQ ID NO: 4341 - protein, 302 aa, unidentified
  source 1..302: note = Erythrobacteraceae bacterium E2-1 Yellow Sea; note = Related to JADCLP010000001.1
MLLDELSAETGLRPDRLEYYADSASRRYYSFTIKKRNGDPRWIRHPAKPLKSLQRWLNSNVISRMRVHQCAMAYQPGSNIRSNALRHASSNFTVRIDFEDFFPSFKRSGIVKFLKDQEKFGLKLGRRDITFLSKIVTRFDELTIGAPSSPLLTNAMMYSFDKEVSEFCERKGLTYTRYADDIYISSVAPNGLDGVLQRVAAAAKKFPYAKLRINSSKTSYTSRRYRRMITGLVITPDHKISLGRKRKREIHSLVHMASVDKLDLEKLSYLQGMLAFTKDVEPSFFETLVAKYGRKTVERILL

SEQ ID NO: 4342 - protein, 302 aa, unidentified
  source 1..302: note = Related to NZ_CP033204.1; note = Sphingopyxis sp.
MLIDWLCAETGLQRERLIAFAASASKRYFVFRIKKRDGSERQIAHPAKPLKGIQRWLNSRVIKSWKVHDAATAYQRGASIRLNALRHAETNFTLRVDFKDFFPSFQAKGIEKFISDQPNGGKKFDKVDLKFITDIITRNGRLTIGSPSSPFITNAMMYSFDEEVSLFCDASGLVYTRYADDIFVSSHNPGNLAQAYDFLCSAANKFPYANLSINHNKTKFLSRKYRRTITGIVITSDRKISIGRPRKKEIKSLINSYIYGKLDDEKEMYLKGMVSFACDADNVFFLSLEKKYGKKVMGRLIG

SEQ ID NO: 4343 - protein, 303 aa, unidentified
  source 1..303: note = Related to VBWB01000009.1; note = Rhodospirillaceae bacterium
MLLERLRKQSGLTTAQIEMYAATASKRYKIYTIKKKNGGDRTIEHPSRALKSLQRWVNKSIISKLPTHVSATAYAKGCSIRKNAQHHLGSIFTLHVDFKSFFPSFKSDGISDFFRIKSKELGIELSEEDVNFITRIVCRNNCLTIGAPTSPSITNAIMFEFDDVVNEWCNQRRLVYTRYADDLYISAFEPGMLSDVIPFLISALDKQRFVRLKINHDKTAFLSKKYRRAITGIIITTEGKLSIGLKRKKLIKSMVLDFKYGRLPMEDKSRLHGLISFALDIEPAFHETLIRKYGENTIKSIST

SEQ ID NO: 4344 - protein, 309 aa, unidentified
  source 1..309: note = Related to NZ_AP018907.1; note = Blastochloris tepida
MLLERLERQSRLSRGQLEQFAITASKRYKIYNIPKRNGGERQIEQPSRAIKAIQRWLNLNLIRKFPIHISSTAYNKGSSILRNAEFHKNTNFTVRIDFEDYFPSFRDNGIERFLQENRSVIGDPLDDNDISFIRNIVCRHGRLTIGAPSSPLLTNAIMFQFDGIVYQFCQSRGLVYTRYADDIFISATRANSLGDVADFVASVSTGYPYANLTINCRKTVFLSKKYRRVVTGMVITPQGSVSVGRNLKDEVRSGVYKFKNGIIDGDEIARIRGLVAYIYGVEPSFLGILERKYGDETIGRLLGGRPLVK

SEQ ID NO: 4345 - protein, 312 aa, unidentified
  source 1..312: note = Related to NZ_BACU01000350.1; note = Azospirillum sp.
MLLEKLKDHSGLSERQLDRYAATASNRYKVYTIPKKPFGVRTIEHPSREIKAIQRWLNSNIIRKLPVHSSATAYHRGASIKENAIRHAGSNFTLHVDFQNFFPSFHGHHIEKFLRWWSEENKINLNDNDISFFRKIVCRNNALTIGAPSSPILTNAMMFDFDGTVALWCTSNGFIYTRYADDIFISSVLPGKLGNALEFLKETCPSFPYANLSINHNKTAFLSRRYKRSITGLIITPERKISIGRAKKEEIKSEVYKFSKGELTSEEIGRLRGKIAFTRDVEPSFYDRLLNKYGYSTIHTLEFLGEGDLLGK

SEQ ID NO: 4346 - protein, 310 aa, unidentified
  source 1..310: note = Related to NZ_JACNMM010000013.1; note = Oceaniglobus trochenteri
MLREVLAEKSGISPKRLQFIQENASRMYKVYPISKRDGTDRIISQPTPELKALQRWLSRGIFQRLPVSSCAMAYKKGASIRENAKAHVKTSFTLHLDFEDFFPSFSTDHIIRYLSENTKLNSDDIQFCSDVVCRHGRLTIGAPSSPAVTNALMHSFDLQVDSWCSGRGLVYTRYADDINISSAGSGSLGDVEGFISATAKDFKYASLTINGKKTAYLSKKYRRSITGINVTPEGCISIGRARKREIKSLVHSFKLGSLEPELLWKLGGLIAFAHDVEPDFVVSLKKKYGSATVEAILHQKTPRGLRGPKE

SEQ ID NO: 4347 - protein, 309 aa, unidentified
  source 1..309: note = Related to NZ_CP033435.1; note = Cereibacter sphaeroides
MLREVLAAKSGMSLSRIERLQCNASKMYKTYPIPKRDGSDRMISQPTPELKAVQRWLARGIFQRLPVSACATAYKKGASIRKNAEAHVASSFTIHLDFKDFFPSFSHGHVSRFLSEATRLSQEDILFCSDIVSRHGCLTIGAPSSPSVTNALMYSFDVSVERWCMKRGLIYTRYADDINISSKCPGALREVEDFVRDASGAFEYANLVINERKTAYLSRKYRRSITGVNVTPEGRLSIGRDRKREIKSLVHQCVMGTLQVDMLWRLGGLIAFSSDVEPHFVDALKNKYGADVIEKILHQKTPRGAWVAD

SEQ ID NO: 4348 - protein, 306 aa, unidentified
  source 1..306: note = Related to NZ_LGSQ01000001.1; note = Pannonibacter phragmitetus
MLRDALSNLAGIPISRISRIQENASKLYKVYEIPKNNGKKRTISQPTPELKAIQRWLIRNVFAKLPVSTYATAYKKGASIRLNAEFHRNSLFTLHMDFENFFPSFTENNVFDFLKENTNLNQDDISFCVDLCCRFGALTVGSPSSPALTNAMMYAFDQQISDWCAERKLVYTRYADDINISSSSPDALGDAEGFIKDASKEFKFGNLKVNEVKTSYLSKKYRRSITGLNITPQGSISIGRDRKREIKSLVYKYKEELLPKELFWQVGGLIAFANDVEPTFVRSLIEKYGQKTIEELLHQRTPRGLK

SEQ ID NO: 4349 - protein, 304 aa, unidentified
  source 1..304: note = Related to NZ_LSRP01000113.1; note = Pararhizobium antarcticum
MLIETLSKQSGVTIENLKWLAETASKRYKTYEIPKRTGGVRTIHHPSRGLKGIQRWVSKFLLARLPVHTAAQAYVRGASIRKNAELHAGSKFTLRIDFANFFPSFSSEHVEVFLATAERDRSIGLTDQDISFVSRIVSRHGQLTIGAPSSPILTNAMMHFFDGQIAEFAERQNLTYTRYADDLFFSSSKPDNLTDALEIVQQVSVAYPYANLRVNPDKTAFLSRRYSRRVTGLVITTDGKVSIGRERKRMVKAQVHKFLQGQLDIFEVPKLRGYLAFVQDVEPEFWEGLKRKYGADAMITVTGG

SEQ ID NO: 4350 - protein, 311 aa, unidentified
  source 1..311: note = Related to FMVA01000017.1; note = Rhizobium sp.
MLIEALIKQSGMNDVSLEWLALTASKRYKTYDIPKRNGATRTIHHPSKSIKSIQRWVSKFLLRRLPVHVAAQAYVRGASIRKNAELHAGSKFTLRIDFSDFFPSFSREHVELFLAAVERDRSIGLTNRDISFLSRIVSRHGQLTIGAPSSPILTNAMMHFFDSQIAEFADRKNLIYTRYADDLFFSSNKPDNLTDVLAIVQQVSATYPYANLRINPDKTVFLSRRYSRRVTGLVLTTDGKVSIGRARKRAVKAQVHKLIQGEFDNFELPTLRGYLAFIQDVEPEFWESLKSKYGADAMLTVVGKQHFSNLL

SEQ ID NO: 4351 - protein, 311 aa, unidentified
  source 1..311: note = Related to NZ_QJRY01000001.1; note = Rhizobium wuzhouense
MLKETLSKQSGVTIENLEWLAETASKRYKTYEIPKRNGGLRTIHHPSRGLKGIQRWVSKFLLRRLPVHVAAQAYVRGASIRKNAGLHANSKFTLRIDFADFFPSFSKEHVEVFLAAVERERQIGLVQQDISFVSRIVSRHGRLTIGAPSSPMLTNAMMHLFDSQISEFAERQKLIYSRYADDLFFSSNGPDNLSDVVATVRQIADSYPYANLRLNPDKTVFLSRRYSRRVTGLVLTTDGKVSIGRERKRAVKAQVYKFIQGELDNFEVPTLRGYLAFIQDVEPEFWESLNRKYGADTMLTVRGKQHFAALL

SEQ ID NO: 4352 - protein, 312 aa, unidentified
  source 1..312: note = Proteobacteria bacterium; note = Related to JACZKU010000431.1
MLVEALQKQSGLPTSVIMRIAETASKRYKAYKIPKRSGGWRDISHPSRELKAIQRWINRTLFMKLPIHESATAYAKGSGIRRNAEIHAWSSYTLRLDFENFFPSFDIHGISEFIAAQSDEREWGLTKQDVLFVGMVVTRYGRMTIGAPSSPILTNAMMYMLDSELAEISEKRKLSYTRYADDIFLSAYAPDSLADMIPIAKEIVGRQKFVRLKFADEKTAHLSKRYKRSITGLVVTPDQKISIGRERKRTIKSLVFRFINGELGDVELMRLSGTIAFVYDVERAFYDSLVRKYGEDVIGKIQKPHLADAEST

SEQ ID NO: 4353 - protein, 324 aa, unidentified
  source 1..324: note = Related to JAIUNO010000183.1; note = Proteobacteria bacterium
MLLEKLQIQSNQSLERLERFATSASKRYKVFQIPKRSGGFRIIEQPSKEIKAIQRWLIEALFDEFPIHHSATAYIRGKNIRSNAEVHAESNFTLKLDFENFFPSFTERHLIKFLRNYPLIEKKQINDRDINFISRICLRNGRLTIGAPSSPTITNAMMYQFDTLMSARCAEDNFSYTRYADDVFVSSRSYINVGEIILFVENLLSKYEYASLRLNKDKTAILSRKGRRSITGCVITPQRGISIGRKLKKSIKHKIYESINGRLSSLEATKLMGYLGFLKDIEPNYFESLKKKYGADAIKTITSGNYDEIKLVPLILDDLDDTPF

SEQ ID NO: 4354 - protein, 307 aa, unidentified
  source 1..307: note = Related to NZME01000040.1; note = Thalassospira sp.
MILEWIAKETGVGAAQIATIVRSANNRYCTYSIPKRDGTPRQISQPSKKLKFVQRWLAKRVFVNLPVHKSATAYLPGVGIRKNALEHASSKYLLKMDMSDFFPSIREEDIVKLMLLNSEKWAGFEDADANFIGKAVSYRGALTIGAPSSPVLSNAILFEFDELVHEYCINNELVYSRYADDISISSKGRIDLHAVSGVVEEFVQKLETPKLNINREKTVIVSKKHQRFITGLNLTSDGNVSVGRLRKREIRTLIFKFKSADLDFSEIGYLKGWMAYLNAVEPSFVERARLKYGDRTVQKIFEYDVDG

SEQ ID NO: 4355 - protein, 326 aa, unidentified
  source 1..326: note = Related to JAEUOZ010000023.1; note = Rubrivivax sp.
MNYAELLQAWCRLLRATPQDVTVLLMRGPYQYKHYQIEKRTGGKRDIFHPTPNLKAVQRWLVNEHLQTLPVHDSVYSYRVGRGIRQHADAHVHSNFLLRLDFKDFFPSITQDWLLQFLLQSAHEGSLSLDDRAIAACMRVLCRFNKFDGSLALSIGAPSSPAISNAILFPADVDAHSRCAELGCLYTRYADDIYVSSREKNVLVEAERQVKAAFSQHAPRLQFNADKRINVSKKAKRVVTGLTLTPDRKLSIGRELKRSIKTLVYLHVSGKLDPVERPRLCGLVSYVRDVEPAFYNSLVLKFGHVTMEELFRCGPGEALYLPNEGL

SEQ ID NO: 4356 - protein, 316 aa, unidentified
  source 1..316: note = Related to NESB01000001.1; note = Limnohabitans sp.
MTRNDLIFALAKLLRASHEDIQKLILTAPYQYKHYKIKKRTGGYRDIYHPTASLKAVQRWLVSNCFLHLMIHPSVFSYREGVGIRQHASQHLHSNFLLRIDFKDFFPSIDQSWVLDFFYQEVNAGRLPIQLETVPTLARLVCRFAKEEKTMALSIGAPSSPLLSNAMLFALDQDMDEYCRAHDCVYTRYADDIYISTKHPNILSGIRDLLTSKILEFTPKLVINDKKTINVSKKIKRVVTGLILTPDRQVSLGRNLKRSIKTKIYLFTHGQLPVDEVEHLRGLVAYASDAEAVFYDALIHKFGSASIDRLLNRKKN

SEQ ID NO: 4357 - protein, 321 aa, unidentified
  source 1..321: note = Related to NZ_CP093331.1; note = Pseudoxanthomonas daejeonensis
MNYSDLLSSAAKLLRTSSIEAERIIITAPYRYKHYKIEKRNGGQRDIHHPTPALKAIQRWLVSTPLANLPVHDCVYSYRKGRNIAMHAAMHVESNYITRFDFSDFFPSITATTIRRFLLEETMKGTIDLDTAAINAIVRLVCRAEDKSGKLVLSIGAPSSPHLSNAVLHDFDHVMESSARIAGGMYTRYADDIYVSGRTKETVALLEKAFIRETSKLLPYLKINERKTQRLSRKRRMAVTGINVTPQRKLSVGRDLKRSLKTKVHLALLGQIAPEELSALRGMIAHVASVEPAFMDSLSKKFGVERLESFLTSREIEEVSR

SEQ ID NO: 4358 - protein, 314 aa, unidentified
  source 1..314: note = Xanthomonadales bacterium; note = Related to JAFLDZ010000021.1
MKNADLERALSAYLRIKPPDLRQIVRTAPYRYKHYQIDKRNGGKRDIFHPSPELKAIQRWLVENVLLNIPVSPSAMGYEKGCSIRDHARQHLQSNYFTKLDFSNFFPSIQLDWITRFLLESLPDYDNEAIHSIARLACRWADAGMPLALSIGAPSSPALSNRIMFALDTALSEVASANDVTYSRYADDIYFSCAKANTLHDLEREARKIIIEMTPALRLNEQKTLHTSRKRKVLISGVGITSTRKLSIGRNLKRSIRTQVFLWSMGSLPAENFPKLRGLLNFANDIEPEFLASLHRKFGDDLIKRFLAGDFERN

SEQ ID NO: 4359 - protein, 316 aa, unidentified
  source 1..316: note = Related to JAFECW010000526.1; note = Proteobacteria bacterium
MNRNQLIAELAAQLRVSPANIERVIASAHRRYKRYTLIKRTGGSREIFHPTPELKAIQRWLIKNVFDQLPTHPSVHAYEPNCSIARHAAAHRRSNFFLRMDFSDFFPSISAQWVKNFLLESIQAGLVDLDKDSVDSICRLVCRRGRLEVESKLTIGSPSSPSISNRILYTFDSKLFEACHERGVIYTRYADDIYFSTREPDVLHEIEQIVTDLVRATVPELSLNRKKTQRASRKRRVLITGLVITSDRKISVGRDLKRSVRTQIHLWKQGNLPLEDIPRLRGLVSFIAGTEPEFLSSISRKYGAESIERLLNPAIN

SEQ ID NO: 4360 - protein, 326 aa, unidentified
  source 1..326: note = Related to DNQH01000067.1; note = Candidatus Andersenbacteria bacterium
MMNNDNLITAWSGLLRSSSEDVIRFIFTAPHRYKHYKIPKKTGGFRDIYHPTPELKAVQRWLNANIFSSLRIHDAVYSYRNGRSIKDHASIHLSSNYFLRLDFKDFFPSIELSWVEEFLRFNSNNNIIPCDLTTISTISHVVCRYSEKEKTNALSIGAPTSPILSNAILYDLDQAVSRLCSENDVIYSRYADDIYLSTKHKNSLDRIGSDVLELVGKLVPMLQINQKKTIYSSRKRKVNITGLNISTERNVSVGRELKRSVKTEFHLWCIGKLPNEKLTRLRGMISYVKGVEPSFFDALRNKFGAEKMESFLSLNIAPIEFVEIPF

SEQ ID NO: 4361 - protein, 322 aa, unidentified
  source 1..322: note = Related to QFOJ01000011.1; note = Pseudoxanthomonas spadix
MNKNELLIKLATHLDILPEEVEHILKSAPYRYKHYTLKKRGGGARDIYHPTPEMKAIQTWLVANIFAALPVHESVYSYRSGLSIADHARVHVKSKFVTKLDLQSFFPSIAGIQVRAMLRAANAAKKVALTDDAIATIVRFCCRGDRGGGDLRLSIGSPSSPAISNAILYGLDENLKKASHHVGVTYTRYADDLYFSTSDRDVLAGVERAARSIIARYGFLKVNEDKTQRTSKKRRVVITGLTATSAGGVSIGRGRKRKIKTELYLHFSERLPLDKIGTLRGLVSFSMGVEPNFYHSLCLKFGENRMRAFIAEGGNGGQSAPF

SEQ ID NO: 4362 - protein, 321 aa, unidentified
  source 1..321: note = Related to JACPTK010000096.1; note = Betaproteobacteria bacterium
MTLLSRMAADMGLSSAYIHKIAVSASHRYKVYSVRKRTGGRRVIEHPARELKLLQTWLLDKLFSHFRASDSVYSYRIGKSIRGHANNHRRNSFLLKIDLKDFFPSITSEDVYKFLKDRQNDLSSPLTPTDCRLIAAIVCRRGRLTIGAPSSPAISNSILYRFDLAIATFCRQRGVTYTRYADDLFFSTNTPNLLTEINKEVRRCLSALPYPRLKINPEKTVFTSRKRLRLVTGVVLTSDKRLSVGRAKKRMLRTLVYLFSTDRLDEKKTAYLRGNLAYVASIEPTFIGSLEKKFGKRVLDRLHKQPLINLKPKSRSAEGFK

SEQ ID NO: 4363 - protein, 305 aa, unidentified
  source 1..305: note = Related to DMQK01000160.1; note = Nitrospira sp.
MFLQQLVKITGLSEAYIIKLARTASHRYRTYQIPKRKSGVRTIDHPSRHLKFLQRWLVRNIFSYAPVHPSVYSYKEGVSIRQHASLHVKSKYTLRIDFRDFFPSIKSADVQKLLDKNVERFPFQLTDRDIHIILSLSSKDGKLTIGAPCSPAVSNAIMYDFDKHWSQRSKRLNVIYSRYADDIYFSTNRSGVLSKILSELKEHLATRDSPRLILNNAKTVFASRKRRRVVTGIVITPTRKLSLGREKKRQLRTLTFLFGKGQLDRDRAKSLQGFLSYASTIEPIFISRLRKKFGDELISKIVQMP

SEQ ID NO: 4364 - protein, 337 aa, unidentified
  source 1..337: note = Related to NZ_WESC01000006.1; note = Parvibaculum sp.
MILERIARETGIGVDHLRVIVKTASRRYKTYTIPKRTGGRRTISHPTPEVKFLQRWLVRNMFSALPVHHAVASYREGVGIADNAQAHVRKNYLLKIDFKNFFPSIRAADIRHLLEKNSSRFSDILTDDDVQVITDIVCKNGALSIGAPSSPILSNAILIDFDEFVFQASKDREVIYTRYADDLFLSTDKPNCLSVMMELIRIRLSSGGQPSLSINEEKSVFTSRKRNRTVTGLVLTSDRTLSVGRKKKRQIRTMIHLYQEDKLSAESISYLRGYLAFVHAAEPDLLVRLQQKFGQETMDQLMCYPLVPRKGHGRGAQRPAIPLGAHKTGSPQNSSDS

SEQ ID NO: 4365 - protein, 309 aa, unidentified
  source 1..309: note = Related to CP053449.1; note = Proteobacteria bacterium
MRIAQIIAKQTSAVTAAHLIALANSANHRYKTYKISKRNGQHRTIEHPSRQLKFVQRWLGRKLFSKFPIHSKAFAYVRGKSIAHHAEIHVSNNYLLRIDFKNFFPSITAENIKHKLNDFRYKDGSNLEPAEIDFITKIVTKSGQLTIGAPSSPIISNILMYEFDHYWDQYSSERGITYSRYADDIYFSTNVPNLLNQCLIDVREYLRENPNPRLFINDNKVVHTSKKRNRTVTGLTLTSDRKVSIGRDRKRQIRSLIFKHKNGLLNEQQIGQLSGILSYVRSVEPEFITSIEQKYGGAFINSISGVNQT

SEQ ID NO: 4366 - protein, 317 aa, unidentified
  source 1..317: note = Related to JACQAP010000013.1; note = Betaproteobacteria bacterium
MILRSMAADMRVPVAYIELIATTASHRYKIYRIRKRTGGTREISHPSKELKGLQRWLVLHVFSQLPIHDSVYSYRNGLSIRDHAEVHKRNNYLVRIDFKDFFPSITAKDVARLLLANRQNLPLTITAADLKAICWIACRNGRLTIGAPSSPVISNAVLYPLDEYWFNTCEQRGISYSRYADDIYLSTNAPNVLATIYKEIRKDLEEREWPKLQINQRKVVFTSRKHNRNVTGLILTSDRRVSIGHKKKRWLRSQVFKFMEGQLPAEQVSYLRGYLSFAKSVEPSFLTRLRKKYGASVIHQIANIQPMQLKLVKVRKK

SEQ ID NO: 4367 - protein, 317 aa, unidentified
  source 1..317: note = Related to SCTX01000106.1; note = Betaproteobacteria bacterium
MILRKMAEDMRVPLAHIELLATTANHRYKIYRIPKRTGGTREISHPSKELKSLQRWLALHLFSRLPIHDSVYSYRIGVGIRDHAEIHKRGNYLVRIDLKDFFPSITSKDVARLLIENRQKLGQIITATDLKAICWIVCRNGRLTIGAPSSPVISNAVLYAVDEYWSVTCEQRGITYSRYADDIYLSTNRPNILAGTYDEMRKDLENREWPKLQINRRKVVFTSRKHNRNVTGLILTSDRRVSIGHEKKRQIRSQVFKFTQDQLSAEQVSYLRGYLSFAKSVEPSFLTRLRKKFGVSVIHQIANTQSIQIKKVKARKQ

SEQ ID NO: 4368 - protein, 306 aa, unidentified
  source 1..306: note = Related to JAIQGJ010000086.1; note = Acidobacteriia bacterium
MILERISAQLALPTPFLGKLARTASHRYKEYPIKKKSGGTRTIHHPARELKLIQTWLLHNVLIRLPVHAAATAYRQGFSIKRNAEMHVSHNYLLRIDFQNFFPSLTGIDVVGILQANRQKLADVEVTDQDIIFITQIVCRYNSLTIGAPTSPQLSNAIMFKFDETWSRMAQALEVTYSRYADNLYFSTNRPDTLREILGRLRESLNEVGHPALKINEDKTIFSSRKRRRLAAGLVLTSDRKISIGREKKRWIKSLVNRFKYKQLKPEEVASLRGWISYLRSIEPTFVLSLERKYGLDLAANSTWEV

SEQ ID NO: 4369 - protein, 314 aa, unidentified
  source 1..314: note = Related to DQSS01000385.1; note = Arcobacter sp.
MNIFQEEISSHFSKSYRDIFRYALSASRRYKSYTIPKRTGGSRDIVQPSKELKEYQRYIVSTLFNKLPVHYAVYSYQKEKNIKQMATKHINARFLLRIDFKEFFPSIKGEHIRSFLKSNVDYLETSINDYDLTLINLLVCKSNKLTIGAPSSPVISNTILYELDNFLFDKCNVEGIVYTRYADDLYFSTIHPNKLKTILPLLKQYLKTFFIRLVINEDKNIYTSKKRRQQITGLTLTTDKKLSVGRKKKRYIKSLIYKYSQQNIVPEEINYLKGYMSYLYSIEPDYIEKLRKKYSSELVGELLPLRHKEENDEE

SEQ ID NO: 4370 - protein, 309 aa, unidentified
  source 1..309: note = Related to JAIZOJ010000089.1; note = Sulfurovum sp.
MNIFQEEISRHFEKSYRDIFQYASRASRRYKSYTIPKKTGGSRKIIQPSKELKEYQRYLIETIFNKLPVHDAVYSYREGRSIKQMAEKHIDARYLLRIDFKEFFPSIRGEHIREFLTSNIHHIELSISDYDLTLINLLVCKSNKLTIGAPSSPIISNTILYELDKFLFDTCHAENIIYTRYADDLYFSTMCPNKLQTLLPILKQYLKTFFIRLAINEDKNIYTSKKRKQQVTGLTLTTDKKISVGRKKKRYIRSLIHKYSQQNITGEEANYLKGYMSYLYSIEPDYIENLVRKYSKETIAELLPLKNNN

SEQ ID NO: 4371 - protein, 309 aa, unidentified
  source 1..309: note = Related to NZ_CP041235.1; note = Sulfurimonas sp.
MNTFQKQLSEKFEKPFLEIYQFAYSASRRYKTYNIPKRTGGNRIISQPSKELKEYQRYLITKVFSKFPIHESVYSYQDGKNIKGMALNHVNKRFLLRVDFKSFFPSIKGEYIRGFLVKNIELYELSLSKNDITLINMFVCKSNQLSIGAPSSPIISNILLYELDSYLSEICTNLNIIYTRYADDMYFSTNQTNQLEKILPLLKEYLKSFYIKLVVNEDKNIFTSKKRRQIVTGLILTTDGNISVGKNKKREIKSLIYQYIKQTISSADLNYLKGYLPYLYSIEPSYIDILKRKYTEKIICKLLPLKQDI

SEQ ID NO: 4372 - protein, 308 aa, unidentified
  source 1..308: note = Related to MUXE01000017.1; note = Arcobacter caeni
MLKFNELLKKEDDIDFFKLYLFSLDASRKYKTYSIKKRKGGLRTINHPSKELKKYQRILSKLIFSKLPIHESVFSYKKRISIKNLAEQHKNNRFLLRIDFKDFFPSLTSKNIRELLEKNLSLFDFELSKDDITLINNIVCKSNKLTIGAPTSPIISNALLYDFDCEMNNFSKKIKYSRYADDLYFSSNIPNLLQNIIPYIKTFLLNYKIKLQINEDKNIYTSKKRKRCVTGLVLTTDNEISIGREKKKYLKSLIFKYIKKTITSEELIYLKGYLSFVKSVEESFLNNLIKKYNPVIIKEIQELKNIVI

SEQ ID NO: 4373 - protein, 307 aa, unidentified
  source 1..307: note = Related to CP021072.1; note = Aliarcobacter cryaerophilus
MIFLESICKRFEKNLNQIVDFSTTANKRYKTYKIKKRTSGTRTIEQPSQELKLYQKFISEKIFLNLPVHEAVFSYKKNISIKNLADKHKNNRYLLRIDFKDFFPSIKGDNIRLFLKNSNLKLSDLEITLINLFVCKNNKLTIGASSSPSITNAILFSFDDDVYKFCLEQNIIYSRYADDLYFSTNEEGILSSILEYVKNYIFSYKIDLHINYDKNIYTSKKHRRIITGLTITTDGNISVGRKQKQYIKSLINSYKYKCLEDEQINYLKGYLNFLVYIEPTYIDNLKNKYGEVIINELFINKFNNKCN

SEQ ID NO: 4374 - protein, 310 aa, unidentified
  source 1..310: note = Related to CP053451.1; note = Proteobacteria bacterium
MIVKRIAQETGLDSAYLDKVVRTASHRYKTYKIAKKNGGLRIISHPAKELKFLQRWLVSNLFCHLPIHSAVFSYREGRNIKQLAETHIANNFLLRIDFEGFFPSILVRDVSNLLKNSIDVLPFQLSRSDVNKIGMIVCKDGRITIGAPSSPMLSNAILFNIDTEIADACVKKGVVYTRYADDLYFSTNEPMVLQEVFEGVKGVLRKNKSPKIRINAEKTIFTSRKHKKMVTGLYITPDRRVSIGRQKKRAIKALVYSYINQSIAEEDMSYLRGYLSYIKSVEPGFLRSLEKKYGQEVLQKIMIHEYVKRK

SEQ ID NO: 4375 - protein, 331 aa, Chromobacterium sp.
  source 1..331: note = Related to JAFBBB010000001.1; note = Chromobacterium violaceum
MNLIKVMADKFGLSPDFVQKTISFAPRSYKRFEISKKNGQKRTVYQPARKVKLLQSFVSDEIIKRFPLHPAVFSYREGLSIRDNAEQHRRNNYLLRLDFRNFFESIEIKDVIQFFIRNVKNAPFVLSHDDILLLSQLCCFRADDGKLRVVIGAPSSPSIANAILYDFDVEVFDHCKSQGIIYTRYADDLYFSTNHQNLLSKIPEFVSRVLSQTSSPRLMINEKKTYHTSKKHRRIVTGLTITSENRISIGRDRKREIRTLVFKCISNSIDIDKKEYLRGLLSYVSSVDPDFFFSLLRKFGEDAIYSIQKNQPQSDRNVLSTEESDSGEFPF

SEQ ID NO: 4376 - protein, 305 aa, unidentified
  source 1..305: note = Related to JACRMO010000001.1; note = Gammaproteobacteria bacterium
MIIQQIAKSSGIEASYLRTIVSTASHRYKIYKIPKKTGGEREIHHPSRELKYLQRWLVDNVFAYLPVHEAVFSYRDGKSIRDLAKKHANSRYMLRLDFASFFPSIVGSDVVRLLKNNVGSVPISLTTHDLMDIRNIVCRFGRLTIGAPSSPVISNAILFEFDNYIYSKCKQIGIRYTRYADDLIFSSQKTGVLSRVEADVIAALKHLPGPKLAINDKKTVFSSGKNRRKVVGLVITSEKKISIGRDKKRYVKSLVYKYINGILSADELVYLRGYLAFVNSVEPEFLAMLSAKYGSDKIRLITHPV

SEQ ID NO: 4377 - protein, 324 aa, unidentified
  source 1..324: note = Related to PAHM01000018.1; note = Bdellovibrionaceae bacterium
MTLNEIAKNLGVRISTLQSIARQANYLYISYRVKKYDGSYRTINHPSRRLKAIQREILKQVFSKAPVHVNVYSYKKGISIGDLARYHAGASYLTRFDFTKFFESILQSDIDLLIEKLIDSGSIDLLKSDIQTISKLVTLKGALTIGAPSSPMISNCIMYSFDVFCADYCRSKGVKYSRYADDIYLSSSSPNVLKPLGAFLITNFSKHTSLKLSLNRDKSLFTSKKHGMKVTGLTLTSDGKVSLGREKKRKIRSMLHHFSHGRLDERQAESLRGYLNFALNMEPTFITSMKAKFGKEIKQLSISPPKPKRWPFYSRQSIGIRGSY

SEQ ID NO: 4378 - protein, 333 aa, unidentified
  source 1..333: note = Thiotrichales bacterium; note = Related to JAFGUG010000057.1
MSIVKKIAEENGVPEHLINRIVNSSNHAYKTYEIAKKNGDTRTICHPSKKVKALQYWLNQNVFCHLPVHSSVYSYRSGLSILDVAKEHVGKKYFLKLDFKAFFPSITADDLRRHLHKHNNLVELDRDDIEVALKIVSYQEALTIGSPSSPILSNSILYDFDDKLTLFCIDKGVTYTRYADDLTFSTNDSNVLTEINSFTRELLQGFDGVKLKINEDKTQFLSKKGRVRILGLILTSDGKISVGREKKREIRSLVNRFKYDAIEPDHDSNGNVLSTIEEKKRSLQGYISFIESIEPDFISSLKNKYDENVIEAIKKFSYEEAIQSRTVIDRTPS

SEQ ID NO: 4379 - protein, 315 aa, unidentified
  source 1..315: note = Related to WGNH01000025.1; note = Alphaproteobacteria bacterium
MMIYPRTLTGTIDIENFLRKRPMLIDKFSKEIGLPRPSVQKIAASANYLYKHYTIPKRSGGERDIYHPTPRLKLVQRWITRHVIRDLPVSDAAMAYRKGKSITDNARLHAGKRFLLKMDFTDFFPSIKARDLQPILTSRGYDPEDVNFILTICFKSGSLTIGAPSSPAVSNIVMFALDQEFKGIADRRKLTYSRYADDLTFAGNVRGNLIEAKKDVERLIGTWASPNLTLNQRKTVLVSSAHRQKVTGITLTTDGEISIGREKKRELRAIVHRSTYQKLEPEVEAYVQGWLAYANSIEPKFVDSLRKKFDTYLDF

SEQ ID NO: 4380 - protein, 313 aa, unidentified
  source 1..313: note = Related to FNEQ01000013.1; note = Duganella sp.
MSLRDRLEKSLPFSRKEIDLLVLSAPLRYKTYQIPKKTLGKFREVSQPTPEVKLLQRWLISNVFGDFAVHDAAKAYRNGIGLLQNVAPHKNHRYLLKLDFSNFFPSISSGHFFEFMDGKGYDHDDLIVMSRVFFKNYRKTASLRLAIGAPSSPALSNILLYDLDVAISNFCRNLDITYTRYADDLSFSTNTAEVLSEVEKNISKIIKENCIINLTLNEEKTVHASKKNGRKITGLTITSDNKISIGLQQKKLLRAKIDRYQKGLLTQDAIDSLKGYIAFVDSVEPEHLVRLTKRYGIEIMRQLYTRINLENNI

SEQ ID NO: 4381 - protein, 312 aa, unidentified
  source 1..312: note = Related to NZ_WWCJ01000015.1; note = Massilia guangdongensis
MSLRDQLLRALPFNATELDLLIWSAPLRYKTYYIKKRQPGLFREVSQPTPEVKLLQRWLVANVLSNFPVHTSAKAYKRGTGLIENVQPHVQHRFLLKVDFENFFPSIKADHFIRFASDAGIDDLDSNLMKQVLFKRTKGTGSLALAIGAPSSPHLSNLMLHSLDCALALTASRENIAYTRYADDLSFSTSTPGVLSEFEKKLPLIIRENCDIPLKLNAEKTIHASKKSGRRITGLTITPQGTISVGLEQKKLLRSQIHRFSKNELNAESIQSLTGYIAYLASIEPAHLVRLARYYGIDVMRALYPPISDLLV

SEQ ID NO: 4382 - protein, 305 aa, unidentified
  source 1..305: note = Related to JABXFH010000020.1; note = Janthinobacterium sp.
MSLKKILEKSLPFSSKEIDFFVMSAPLRYKVYKIKKKEPGKFREVSQPSAEVKLLQRWLMLNVLVKFKVHDSAKAYKAGVGLLDNVSPHVNNRFLLKMDFENFFPSITSGDFFDFMVGKGYDYEDIVVMVSILFKKDRADDSLRLAIGAPSSPLLSNILLYNFDVALDDYCQTLGVVYTRYADDLSFSTKNSGVLNGVEKALGGIIESSCSISLKVNRDKTIHSSKKNGRKITGLVIGSDNKVSIGLERKRLLRSQVYRFKKGFLDPEQVGSLKGYIAFLQSVEPEHVKRLINIYGRETMFLLLS

SEQ ID NO: 4383 - protein, 306 aa, unidentified
  source 1..306: note = Related to AHJE01000051.1; note = Cupriavidus basilensis
MSLKDRLLRALPFSRQELELLISTAPFRYKEYKIPKRKEGAFRLIAQPTPEVKLVQRWLVKNELSTLPIHSAAKAYKADTGLIENVIPHKNHRFLLKLDFENFFPSITASDFHQFMEDNGFSNTDIPTLINLLFKRDHATKSLRLAIGAPSSPTISNILLYPLDRALDNHCSDLAVSYTRYADDLSFSTNLPGILKDIEQSVPALIKASCSLNLRINKNKTTHTSKKRGRRVTGLVITSENEISVGRFRKRLLRAQIHHFGAGKLPPEETEALRGYLSFLNSVEPDQIDRLRIFYGKELMSRLMSR

SEQ ID NO: 4384 - protein, 305 aa, unidentified
  source 1..305: note = Related to NZ_JACOGA010000020.1; note = Undibacterium flavidum
MSLRTRLLANLPFSKNELNLLIASAPIRYKEYSIPKRQPNKRREVSQPTPEIKLIQRWVVENELNKFPIHESARAYKKNVGLIANVLPHKNNRYLLKVDFKDFFPSITNHDFRKFMIGTEFSDDDLHDLSQILFKADHKTKTLRLAIGAPSSPLLSNILLYSLDSVIHDHCKEIEVTYTRYADDLSFSTNRPNLLTSLYENLPILISSGTDIHLTVNIEKTVHTSKGNGRRITGLTITEKNEISIGRERKRILNAQVFRFKNNLLSIEDIEKLKGYISFLRSVEPEHINRLIQKYGESTILALQR

SEQ ID NO: 4385 - protein, 305 aa, unidentified
  source 1..305: note = Related to JABFMQ010000002.1; note = Herbaspirillum sp.
MLLKELMLESLPFSSGELEVLIGTAPFRYKEYKIPKRDSDKFRQISQPTPEVKLLQRWVVVNVLSQFPVHPAATAYRSGRGLLENVRPHQKNRFLLKVDFKDFFPSITSENFKVFLKESSYSDAEIRILCNILFKLDRRTEQLRLAIGAPSSPALSNILMYRFDEVISKFCDRLYVVYTRYADDLTFSTNERDVLCKVEKALPEVIAEFGLIALTVNQEKTRHASKKTGRQITGLNISSEGEVSIGRDRKRLLRVQIFKFSKGELTADEIDSLRGYIAFLQYAEPAHVTRLRSSFGDDLISRLCS

SEQ ID NO: 4386 - protein, 305 aa, unidentified
  source 1..305: note = Related to NZ_JABUXU010000010.1; note = Advenella sp.
MSLKTDLLQALPFTEHELTMLIATAPRRYKEYTIEKRRRPERRNIAQPTPEIKTLQRWLSKNVLSKFPIHASATAYRKDVGLSANVSPHLGNRFLLKIDFKNFFPSIESDDLVAYLEKKAELTNDDCYILTQILFKKNVEKGKLTLAVGAPSSPQVSNILLFQFDEAVSNYCLAHNIAYTRYADDLSFSTSTPVILRDCLSVVRKIIQDLPYPKLVINEEKTVETSKKRGRRITGLTITNDDTISIGRLQKRKLRVLIHRFKTGNLDACEQESLRGYLAFLNSVEPKHVERLKISFGVDTLALLL

SEQ ID NO: 4387 - protein, 305 aa, unidentified
  source 1..305: note = Related to NZ_CP089848.1; note = Paralcaligenes sp.
MSLKVDLLQALPFTAQELDVLIATAPRRYKEYTIEKRNKTGRRNIAQPTPEIKTLQRWLSKNVLSNFPIHASATAYRTGVGLAQNISPHLNNRFLLKIDFQNFFPSITSDDLLAYLEKRKEFTDDDRYVLTQILFKRDAERRKLTLAVGAPSSPQLSNILLFQFDEDISAFCIENKIAYTRYADDLSFSTSTPEILRGCLNTVRQILRDLQHPRLLINDGKTVETSKKRGRRITGLTITNEGAISVGRLQKRELRVLIHRFLNGHLDACEQESLRGYLAFLYSVEPTHIERLKASFGASTLASLL

SEQ ID NO: 4388 - protein, 304 aa, Achromobacter sp.
  source 1..304: note = Related to ALJE01000030.1; note = Achromobacter marplatensis
MSLRSKILMDLPFTERELSLLIISAPRRYKEYWIPKRNGRQRLIAQPTPEIKLLQRWLVQNYLSGFPVHAAATAYRQGIGLKENVLPHLRNRYMLKLDFENFFPSLKSSDLLNFLKDAPLDQVDINMLAQLLFRKADLGLELAVGAPSSPHLSNVLMYKLDDRINGFCTANGIAYTRYADDLTFSTSKPHVLRECLQFVTSALAETASPKLRLNAEKTVETSKKRGRRVTGLSISTESKISIGRDKKRDLRVLVHRFTKGDLNAEEIQKLRGYCAFLRSVEPEHLDRLAKSFGVEVLLALTEGY

SEQ ID NO: 4389 - protein, 306 aa, unidentified
  source 1..306: note = Related to QTOY01000016.1; note = Burkholderia stagnalis
MALKDLMLESLPFTSTELDRLIETAPLRYKEYEIPKRNSDDKRPIAQPTPEVKLMQRWLMDEVLRKFKIHHAATAYRKGVQLVDNVRPHANNRFMLKLDFRNFFPSIIAKDFASYLVKSGWRNRDDIHLLCNVIFKFNRRRKLLELSIGAPSSPMVSNFLMFDIDQEIYQYCKDNEITYTRYADDLTFSTNRTEILRDCKDFVVDVLDNTDSPLLRLNVDKIVETSVKRGRRVTGLGITSDNKVSIGREKKRALRLEIYRYINGYLSATDSEALRGYLAFLKSVEPEHIQRLQKSFDDDRLGGLLP

SEQ ID NO: 4390 - protein, 315 aa, unidentified
  source 1..315: note = Candidatus Nitrotoga sp. HW29; note = Related to CAKMAA020000066.1
MSIFDRMLRELPFSASELKYLIATAQYRYKVYKIPKRQSNQFRTIAQPSPEIKLLQRWLMSDILSTFPINKAATAYREGRSIADHASLHAKKKFLLKMDFKNFFPSISAEDVHRYLIEYRKVSPEDTRLIGLLVCWRNKTDGKLCLSIGAPSSPLLSNAMLYTFDKVVTKLCRDQKVTYSRYADDLAFSTNKKEVLSVITTNIYDICNNLVYPRLVINEQKTVSISRSYRRVLVGLVLTPTGKVSLGREKKRRLRSELYRFSQGRLNLADVPKLRGELAFAWSVESDFIFTLLRQFSEGVFRQLDLPFSLPNEIN

SEQ ID NO: 4391 - protein, 315 aa, unidentified
  source 1..315: note = Related to NZ_QYUN01000002.1; note = Noviherbaspirillum sp.
MSLLQKMLIDLPFSGDELKALISTAPYRYKVYQIPKRQPNQFRTIAQPSAEIKVIQRWLIKNVLSSLPIHKAATAYRLGESISDHAVIHADKRFLLKMDFEDFFPSISAADIQMHLIQSGKLSQDDARLVRQIVCWFDKIKGGFCLSIGAPSSPLLSNALLYTFDKKITQLLKGKKVSYSRYADDLAFSTNRTDVLSTIPAQVQSICDELEYPQLRINHSKTVSTSRAFRRTLVGLVLTPTGEVSLGREKKRRMRSELYRFSKGLLAVTETPRLRGELAFAWSVERAFINSLVRQFGIEVFRILDLPFGEEYDLN

SEQ ID NO: 4392 - protein, 312 aa, unidentified
  source 1..312: note = Related to NZ_CP031704.1; note = Solimonas sp.
MNLLDRMIDELPFSKEELLEIIATASYRYKVFQIPKRQPGQWRTIAQPTPEVKLLQRWLVDNVLSQLPVHRAATAYREGVSIYAHAEKHVDKKYLLKMDFQDFFPSISADAVQQHLLGVGKIKEKDATLIRALVTWRNKVSGKRCLSIGAPSSPILSNTMMYRFDTEISIIAKRYGAVYSRYADDMAFSTNRKGVLTELSREVESLCGKLPYPRLTLNKQKTVYTSRAYKRVLVGLVLTPDRKVSLGREKKRELRSKLYRLLKGAPGVDSASLRGELAFANSVEPEFISSLVRQFGTDAFLQLGLPFGSSKA

SEQ ID NO: 4393 - protein, 312 aa, unidentified
  source 1..312: note = Related to NZ_ARWF01000001.1; note = Methylotenera sp.
MSIFNRMLTELPYSKDELLNLIATAQFRYKVYKIPKRKPNQFRTIAQPSPEIKLIQRWLVKSVLADLPLHKVATAYRKGKSIADHANLHKKYQFLLKMDFKDFFPSINVLDVRNYLIETANMSEDDARLVSSLVCWKDKEKNRLCLSIGAPSSPHLSNIIMYEFDEQVSIMCKELNVSYSRYADDLAFSTSQKNVLEKIPNIIKNICLALEYPKLIINDSKTVSTSRAKGRVVVGLVLTSEGNISLGREKKRQLRYELYKFSKGVLDHESISKLRGDLAFVWSVEERFIHTLLRQFGNEVFTNLELPFQKAD

SEQ ID NO: 4394 - protein, 313 aa, unidentified
  source 1..313: note = Related to JAGKSE010000017.1; note = Acidovorax sp.
MKLLQLLLREVPFEKQELLTIIATASRRYKVYQIPKKDGKSVRTIAQPAPEVKLLQRILHEKLIGKWPIHKAATAYISEQSIADHVRRHVNSKYLLKLDFKNFFPSITAADIRQHARRHSKLGEDDLDIFVNIVAWRNNLDHSFCLSIGAPSSPAISNSMMFEFDESISAFCKKKEVTYSRYADDLAFSTTHRDTLKEVEAEVHRLTLSIQSPKLTINEKKTVNVSKKYNRSLVGLTITPDQKVSLGRERKRDIRAKLYLYGRGYLNGEDVAHLRGLLAYAWSIEPTFILSLAEKQGNELFAKLELPFRNLKD

SEQ ID NO: 4395 - protein, 308 aa, unidentified
  source 1..308: note = Related to JAGOGO010000002.1; note = Deltaproteobacteria bacterium
MVVSLLAKLSKDLLLPKERLEYLIRSAPYRYKVYEVPKRSGTGMRTIAQPAKEVKRLQYWVIENLFPRLPIHPSATAYIKAKNILNNSELHVAKPYLLKLDFVDFFPSIKGDDFIQYIRELNNLDLDELDLQLLVRILFWYPKRIHNLQLSVGAPSSPYLSNAIMHRFDSEIESYCCQRSITYTRYADDMTFSMMEKAARSEVLNRVLQVIQQLPFPKLQINQKKTIFGSKAHRRMVTGLVLSNAGRVSLGREKKRRIRAQIHHLITGHLTPQEKSSLRGMLAFARSIEPNFVERMEQKYGKRVLSNI

SEQ ID NO: 4396 - protein, 311 aa, unidentified
  source 1..311: note = Desulfobacterales bacterium; note = Related to JACRDD010000019.1
MISSLLGSMSADLLIPKDRLDYLLRSAPYRYKVYQIPKRSGSGTRTIAQPAKEVKSLQYWVIKNIYPFFPIHPSATAYTIGKSILKNSEAHATKPYLLKLDFKDFFPSITGNDFLQYSKNIKQLALSDRDLRLLMRLLFWLSERNYDFRLSIGAPTSPFLSNAIMYQFDQVVFDYCNERNISYTRYADDMAFSMHNIKMRSEVLEMVQNTLTSLPFPKLQLNHKKTIFGSKAHRRIVTGLVLSNNDTVSLGREKKRRIRAQIHHLLLGRLDNKEISKLKGMLAFAHDIEPAFVERMVEKYGEKVIKSLRSA

SEQ ID NO: 4397 - protein, 306 aa, unidentified
  source 1..306: note = Planctomycetes bacterium; note = Related to VRUF01000040.1
MTLLGQMSKDLLVPKGGLVYLMRSAPHRYKVFPIPKHSGKGQRIIAQPAREVKRLQYWVIKNLFPRLEIHPAATAYIHGRNIRYNTEIHSQLPYILKLDLKDYFPSLKGDDFKRYASNHSGLSLSDEEVDHLVRLLFWQRDKDSQLQLSIGAPSSPGLSNALMYSFDSEIFSFCNANGINYTRYADDMAFSMREKEKRGDALRKVTEILEVMESPKLHINDGKTVFGSKAHRRMLTGLILTNDGRVSLGREKKRRIRSQIYHFIKGDLSDTKRQYLQGMLSFSKDVEPEFIRRMEKKYGIETLNSI

SEQ ID NO: 4398 - protein, 309 aa, unidentified
  source 1..309: note = Related to PHBJ01000028.1; note = Deltaproteobacteria bacterium HGW-Deltaproteobacteria-13
MKDVLLEKMSYDLLLKKEQIIHLILSAPHRYKVYQIPKKSGAGMRTIAQPAKEVKILQYWVIENCFPLMPIHRAATAYVKDKNIRDNCEPHIKNPYFLKLDFKDFFPSIKSDDFIQYMKNIGNITFDDIDIQRLARILFWCPKEYTGLQLSIGAPSSPYLSNAIMYRFDNEIDLYCTQHNISYTRYADDMTFSMLDKTLRENVQQKVIELLQSIPFPQLELNNKKTIWGSKAHRRMITGLIISNDEKISLGRERKRRIRAQLNYAINGKLTPEQKKSLSGMLAFVRNIEPDFVLRLEKKYGRELISNLR

SEQ ID NO: 4399 - protein, 305 aa, unidentified
  source 1..305: note = Syntrophaceae bacterium PtaU1.Bin231; note = Related to MVRX01000406.1
MLADRIADDLLLPMEMLQYLVRSAPHRYRVYRIPKHSGSGFRTIAQPAREVRMLQYWVMKNIFPELPVHSAATAYCAGKNIRDNCAPHAANPYLLKLDFRNFFPSIKAGDFIQYAAEARHLPFDPPELRMLACILFRRPKGKKEMVLSVGAPSSPYLSNALLYGFDDEMSRYCESRGIVYTRYADDMAFSMQDKAKRLEVLHKVRDVLRQMPFPRLTLNDRKTVFASKAHRRSITGLTLANDGRISLGRERKRQISAQLHHFVNGKLPQEERGKLRGLLSYVKDIEPAFFTRMAEKYGREKIAGI

SEQ ID NO: 4400 - protein, 306 aa, unidentified
  source 1..306: note = Chlorobi bacterium; note = Related to VGGK01000004.1
MANELLISQMSNDFMLPEKKLKKLILSAPYRYKVYSIPKRSGKGYRVIAQPAKEVKILQYWIVRNVLCKFVVHDAARAYVKGCGLLSNVSPHCYSKYLMKLDFKDFFYSIKAGDFLSYFSLYKDFGYSDMDIQEMVKILFYARNKGDYCLSIGAPSSPLLSNIIMSDFDKRVVEFCSSRSIVYTRYSDDMTFSMSDSLLRREVFFEIKRLLDIIPYPRLKLNEDKTLFLSKANKRMVTGLVLSNDGRISIGHDKKRMLRSKIYKYTKGHLDVDEVNQLKGMLAYVNSVEPDFICKMKIRYGDLIIF

SEQ ID NO: 4401 - protein, 309 aa, unidentified
  source 1..309: note = Related to NZ_LT907975.1; note = Pseudodesulfovibrio profundus
MGSKSVSFSLISKISSDLLIPVENLRYIIRTSPYRYKKYSIPKRRGRGVRSIAQPAKEVKKLQYWVIKNVLSKYPVHPAATAYKKESSILQNAEIHLDSRCLLKLDFEDFFPSILATDIVHFFEKGSLEFDEEEVNALASILSWARTRTAERVVAIGAPSSPMLTNIMLYDFDSVVRRWCDETKINYTRYADDISLSGDSKESLAEAKRKIAELLEEMNSPRLSLNNDKTVFAMKPFRRFVTGLYLSNEDKISLGRDKKRAIRAKVHHFVNGKFNQDQIQHLRGVIAFARSVEPEFVERLENKFGKLFQ

SEQ ID NO: 4402 - protein, 307 aa, unidentified
  source 1..307: note = Related to MEKZ01000132.1; note = Acidobacteria bacterium RIFCSPLOWO2_12_FULL_60_22
MLKNLGAALLLSQQELSRLISSAPHRYKTYLIEKRNRGQYRTIAQPAKEVKALQYWVIQNVLNMFHVHPAAIGYQRGKNIADNARSHVNSRFLLKLDFKDFFPSIRSADFDLYIRKQQIQITDQEVAALSRILFWNPKGTKDMCLAIGAPSSPGLSNILMFEFDSAVEAFCSEAGVSYTRYADDLSFSANLSDELRRVEEWVTHLCDNLESPRLSLNREKTVRVSKKRARRVTGLVLTNDSKVSIGRDQKRRIRASVHHFATGRLPEDQSRKLRGLLAYINSVEPSFLNRLRHKYGADTIKRLQSAT

SEQ ID NO: 4403 - protein, 316 aa, unidentified
  source 1..316: note = Related to FUZY01000002.1; note = Burkholderia sp.
MDLIDRLQSAFPLSRPEVELIIRTAPLRYKLHFIEKRNGRGQRQIAQPTAELKLVQRWLVSEFVNNLPVHPAAVAYRPQLGIKDHARKHAAKRYLLKLDFKDFFPSIQARDFHAHLARYTELSLPDKHALTRLLFRLDRETKEMVLSIGAPSSPAVSNTVMYRFDSMVSDYCKDLRVEYTRYADDLAFSTDQPHVLDEIQNHVRQLCRAMEYPSLTLNEGKSVFTSKKHQRQLTGLILTNEGKVSLGREKKREIRAMAHRFSNGDLSAEDVSRLRGLLAFAMSIEPQYVESLVRMIGQQSYHSLMRPGRRTHSSDQ

SEQ ID NO: 4404 - protein, 314 aa, unidentified
  source 1..314: note = Related to NZ_LMEK01000025.1; note = Variovorax sp.
MNLIERLQIAFPFSRREVELLIHTAPRRYKIHSIEKRNGRGLRMIAQPTAELKLVQRWLVSNYLQSLPVHSAATAYRPSLGIKDHAQLHASGKYLLKLDFEDFFPSIRGEDFRQHVARFSDVTLPDQTAMVRLLFRADVDAKRLILSIGAPSSPAVSNTVMYSFDLAVKEYCEQAGVRYSRYADDLAFSTNVPHILEAVKTRVVEICRTLEYPRLRLNEGKTVFTSKKHQRQLTGLILSNDGRASLGREKKRKIRATAHHFAQGVLSPEEVGKLRGLIAFAMSIDAEFVASINNMLGEQIFKELMRGNGEVAEG

SEQ ID NO: 4405 - protein, 308 aa, unidentified
  source 1..308: note = Related to JAIZPW010000002.1; note = Burkholderia contaminans
MNLIDRLQAAFPLSRAEAASMIETAPRRYKIHLIEKRNGRGLRQIAQPTAELKLVQRWIVANYINALPVHQAAMAYRPDLGIKDHAKEHATKKYLLKLDFRDFFPSIKANDFKQHLTRHTEISEADKVAITRLLFRYDRENQDMRLSIGAPSSPSVSNTVMFHFDTIASDYCNAAGVQYTRYADDLAFSTNTPHILDELQNFVRETCRQLDYPRLTLNEEKSVFTSKKFQRQLTGLILTNEGSVSLGREKKRLMRAMAHRFNLGTLSLDDTKKLRGLLAFAISIEPEYVNSIIRMIGEPSYKSLMRGN

SEQ ID NO: 4406 - protein, 310 aa, unidentified
  source 1..310: note = Related to NZ_CADFAD010000001.1; note = Burkholderia gladioli
MDLIDRLQAAFPLSRAEVELLIKTAPRRYKIHTIEKRNGRGLREIAQPTAELKLVQRWIVSTYINELPVHSAAIAYRPGLGIKDHAKKHAARKYLLKLDFKDFFPSIRAGDLRAHLTHHTDLSTADKSALMRLLFRLDSENGAMVLSIGAPSSPAISNTVMYPFDIAIADYCRENDIAYTRYADDLAFSTDTPHVLDALQDFIRKTCRGLIYPSLTLNEKKTVFTSKKFQRQLTGLILTNDGTVSLGREKKRDLRAMAHHFSRGALSNEEMSRLRGLLAFAMSIEPQFVHSIIRMIGKEAYAQLMHASGT

SEQ ID NO: 4407 - protein, 305 aa, Alcaligenes faecalis
  source 1..305: note = Related to DOIE01000002.1
MNIIENLQKAYPLSKEEVEFFIQSAPRRYKVHHIEKRNGRGLRVIAQPTAELKIIQRWVTKKFINKLPVHDSAMAYRLGKGIKNHANSHAQQKYLLKLDFKDFFPSIKPRDLKLHLANYTDLHKDDISVILKLLFRYDKSKGLSLSIGAPSSPAVSNTIMYPFDEMVSDYCKKRKIKYTRYADDLAFSTNHPHILDVLQNFIRELCESLKYPKLKLNEEKSVFTSKKFQRQLTGLILTNDGKISLGRDKKRLIRAMAHNYKIDKLDPKEVSRLRGWLAFALSVEPEYVESIKRMLDKDIYEKLMK

SEQ ID NO: 4408 - protein, 327 aa, unidentified
  source 1..327: note = Related to CP063848.1; note = Massilia sp.
MDATNSELLELLCDEHPLTRAEAWELILTAPRRYKIHYIEKRNGRGRRLIAQPTAELKAIQRWIISKYIAAMPVHEAATAYRPHKNISDHARVHAKNKYLLKVDFKDFFPSIRDRDFVQHAVKHLGISTRLASELSFLLFRRDENKGLSLSIGAPSSPSVSNSLMYEFDLKLSEYCDANEIVYTRYADDLALSTNKPHELDKANEFIRELLGCIRYPRIEINPEKTVFTSKKFQRQLTGLILSNEGKVSLGRDRKRSIRAMADHYRKGKLAPELHTKLKGWLAFSLSVEPDFVRSIRTMMGEFHYFKLVSVNEKMEAEGIIPSGDEW

SEQ ID NO: 4409 - protein, 327 aa, unidentified
  source 1..327: note = Related to NZ_WWCS01000001.1; note = Duganella margarita
MDATNSQLLELLCEEHPFTRAEAWELIRSAPKRYKVHFIEKRNGRGRRLIAQPTAELKTIQRWIVNKFIAPLPVHDVAMAYRPGKNIADHARSHAGNKYLLKIDFKDFFPSIRARDFTRHIVKHLGVNTRLASELALLLFRKDENKRLSLSIGAPSSPSISNTLMYEFDCKLSEYCKENEITYTRYADDLALSTNKPHQLDKANEYIRELLNCVKYPRIMINPEKTVFTSKKFQRQLTGLILSSEGKVSLGRERKRLIRVMADHYRKEKLDPNLHTQLKGWLAFSLSVEPDFVRNIRALMGEEYYSKLISIDVKVATEQLIPADDET

SEQ ID NO: 4410 - protein, 338 aa, unidentified
  source 1..338: note = Related to WNKY01000030.1; note = Duganella radicis
MTRSAAKPMRRSMDATNSQLLNLLCDELPFTRTEAWELIRSAPRRYKVHFIEKRNGRGKRLIAQPTAELKAVQRWVVTRFISQMPIHDAASAYRTNRSIGDHARLHARNKYLLKIDFKDFFPSIGARDFKRHAIKYLAIDARLASELALLLFRRDEHKRFTLSIGAPSSPVLSNTLMYEFDSKLSEFCEPKGITYSRYADDLALSTNKPHELDTAFKFINELLNDLAYPRLTINQEKTVFASKKHQRKLTGLTLTNAGDISLGRERKREIRAMADHYRKGKLEGNRHGQLKGWLAFALSVEPEFVRTIRKLLGEEMYAALLSFGDVSAPLVTQLDDRE

SEQ ID NO: 4411 - protein, 323 aa, unidentified
  source 1..323: note = Related to PEFN01000001.1; note = Janthinobacterium sp.
MVDNNSELVDMLCDELPFTRTEAAVFIDSACRMYKIHFIEKRNGKGKRLIAQPTAEVKEIQRWIIKKYIKNLPIHNAATAYREGRNIFDHARPHVKNKYLLKVDFKDFFPSIRAHNFSKHIRKHLGISKPLAIDLARVLFRQDEKRRLSLAIGAPSSPSVSNTLLYEFDSQLSIFCQANNIQYTRYADDLALSTDTPKILDEALKFIEKLIKDIPYPKLSINNEKTVFTSKKFKRELTGLILSNDGSVSLGREKKRMIRTMAHKYSSGELHDSLIGRLKGFLAFAHSIEPIFAAKIREKIGEEKYNSLTNFQETNHQKKVQDF

SEQ ID NO: 4412 - protein, 307 aa, unidentified
  source 1..307: note = Related to JACPYR010000019.1; note = Nitrosomonadales bacterium
MNLIEHIQKDFSLSLHDARVLIFTASRRYKLHYIEKRHGRGKRLIAQPTAEIKLLQRWAIESYLSKLPIHRAATAYRPGRGIKDHAEVHADNRYLLKLDFQDFFPSILGRHFLMHLKSHASIADDDAKFLMRLLFRFDRDSQDYVLSIGAPSSPAVSNTIMYDFDNALTDYCKTHDIIYSRYADDLALSTSKPKVLDDAFNFVKQLCKDVPYPRLQLNDTKTVFTSKKHRRQLTGLILTNEGKPSLGREKKRLIRSMAHRFSLSELPDDQILHLRGLLAFAYSIEPLFFSSINRMIGGEAFQRLMKG

SEQ ID NO: 4413 - protein, 307 aa, unidentified
  source 1..307: note = Gallionellales bacterium GWA2_55_18; note = Related to MGWP01000046.1
MNIIERIQSDFSLSLHDARVLIFTAAYRYKLHYIEKRHGRGKRLIAQPTAEIKLLQRWAVEKYVGQLPIHKAATAYRSGTSIKDHAALHAENCYLLKLDFQDFFPSILGRHFLMHLKSYMKISDDDANLLMRLLFRFDRESQDYVLSIGAPSSPAVSNTVMYDFDNKLTNYCRTHDIVYSRYADDLALSTSKPKVLNNAFDFVKKLCGDMPYPRLQLNDAKTVFTSKKHRRQLTGLVLANDGKPSLGREKKRLIRSMAHHFSLGELPQDQVLHLRGLLAFSFSIEPLFFSSINRMIGEEAFQRLIKG

SEQ ID NO: 4414 - protein, 309 aa, unidentified
  source 1..309: note = Related to NZ_JQKP01000004.1; note = Ferriphaselus sp.
MGLIERIQQDFTLTRREVQLLLLTAASRYKLHYIEKRHGRGRRLIAQPTAEIKILQKWAVANYVNLLPIHNAATAYRPGRSIKDHAVAHAGNRYLLKLDFENFFPSITGNNFFDHLKSYLEVSDEDANLLVRLLFRYELVSRNYVLSIGAPSSPAVSNTIMFKFDTALAEYCDANQIAYTRYADDLALSTNTPKVLNDAYNFVRQLCRETQYPRVSLNEKKTVFVSNKFRRELTGLVLSNEGRPSLGREKKRQIRSMAHHFSLGQIPPEDVPHLRGLIAFAISIEPEFIESIKRMISIELFQSLMSGQA

SEQ ID NO: 4415 - protein, 308 aa, unidentified
  source 1..308: note = Related to NZ_ARWC01000001.1; note = Methylotenera sp.
MKLITAIQNDLPLSISEIQLLLLSAPHRYKVHEIQKRHNRGTRVIAQPTSEIKVLQRWATTNILAKLPIHSAATAYVAESNTKKHAQAHAKNRYLLKLDFKDFFPSIKADDYLQHLIKYAKIDIDDARLLCRLLFWRDRVSNSLKLSIGAPSSPMVSNTVMYDFDTFVSEFCLKIEVVYTRYADDLAFSTDNPKVLESVHEFIITLCKNLPYPNLQLNEEKTVFVSKKHKRYLTGLVLTNDGKPSVGRDKKRQIRAMVNTYANGNMPDDELNRLRGLIAYAHGIDEKFIDSLIRMVGTENYNKLISGR

SEQ ID NO: 4416 - protein, 323 aa, unidentified
  source 1..323: note = Rhodocyclaceae bacterium; note = Related to SSDX01000104.1
MCQGQERITKFIRSNDMNVIRTIVNAYPLSLREAAVLIQTAPARYKVHQIEKRHGRGTRTIAQPTAEIKLLQKLLVREVIEKLPVNDAAKAYRSGQSIADHARPHASNRFLLKLDFKDFFPSIRGADFLKHLHKHSEIGTEDSKHLVKLFFWRPRGTRSLVLSIGAPSSPAISNTIMFDFDSALSDFCTREHVVYTRYADDLAFSTNGPEVLHRVHEHVINLCRTLKYPRLTLNDAKTVYTSKKHHRSLTGLVLSNDGKASLGREKKRQLRAMVHRLKYDLLNQEERAKLKGWIAFALSIDEEFVRSLKRIMGDQTFESLMRG

SEQ ID NO: 4417 - protein, 307 aa, unidentified
  source 1..307: note = Related to NZ_CP073754.1; note = Methylomonas paludis
MNVIEIILHEFPLGRQEVERLIRTAPSRYKVHEIEKRNGRGKRTIAQPTAEIKLLQRYLVDRYISNLPVNDAAKAYRLNHNILDHASPHAKNQYLLKLDFKDFFPSIRAVDFIKHLRKYSALSREDMKTLSRVFFWRPKGQRDLILSIGAPSSPAISNTILFDFDSAVIEHCIKNEITYTRYADDLALSTNQPNILNDAYIFVEMLCRSLKTPKLTLNADKTVFTSKKHHRQLTGLVLSNAGTASIGREKKRTIRAMAHHYKQGILSQEEHGRLRGWLAFMMSIDREFVTTIEKMIGEVAFQKLMQD

SEQ ID NO: 4418 - protein, 309 aa, unidentified
  source 1..309: note = Related to NZ_NWMV01000032.1; note = Macromonas sp.
MNVLELLQKKLPLSRSELLLLIATAPNRYKVHTIDKRHNRGKRVIAQPTAEVKALQKLLLGILRGKLPVHSCAKAYQPGTSIRDHALPHAPNRYLLKLDFKDFFLSIKGGDFSSHIKRHLDIPDVEIEIFTHAFFWTPKKTMDFVLAIGAPSSPWISNTILFEFDELLTDYCDSKNVKYTRYADDLAFSTNTPHVLKDVHAFVQDICKEIAYPRLNINESKTVFTSKKNSRSLTGLILSNEGSVSIGRAKKREIRAMAHKYQIGALDLESTLHLQGLLAFMQSIDPDFNQSIARMVGNDRYLTLTKQLQ

SEQ ID NO: 4419 - protein, 307 aa, unidentified
  source 1..307: note = Related to NZ_CP009962.1; note = Collimonas arenae
MKVLDQLFTDFPMSPQQLRILMLTAPYRYKFFHIPKRSGGRRLISQPAKEVKWLQRYVIEIIRKKIPVHRCATAYEPGSSIFANAEAHVQNRFLLKMDFKNFFPSITDMDVSHLIKSAYPDIEDGELELIVRLLVMSDKKNEKFVLAAGAPSSPFISNALLNQFDTELHLHCLSQNVVYTRYADDIALSTNAPLLLSELHKFIRVLVNEMKHPVLKINEEKTVYTSKKHNRKVTGLTLNSQKQVSLGRDMKRELRAAVDKFRKNELSQEAVSTLRGKLAFALAVEPEFVLRLRTHYTDEVITRLFQS

SEQ ID NO: 4420 - protein, 310 aa, unidentified
  source 1..310: note = Related to NIQA01000002.1; note = Pusillimonas sp.
MNMKSLISLLVDELPFSEREIRELLNSAPSRYKVHYIEKRKGRGLRQIAQPTAEIKLLQRWAINQYRDQLPVHPTAKAYISDSGIRQHAAAHVKNSYLLKLDFKDFFPSIKGIDVRRHLAKHLGAPSEDLSLLMKLFCWKGKPVGGLRLSIGAPSSPFISNSIMFEMDEKIQKKCSDYDATYTRYADDLAISTNQKDALSAIYEHILELCDSSKYPSLKINPGKTVFTSKKHNRHLTGLTLSSDGKVSLGRDRKRLIRAMTHAYTTGKLNPDELGKLRGWIAFAYSIEPDFVESLERMIGLQALNRIRRT

SEQ ID NO: 4421 - protein, 300 aa, unidentified
  source 1..300: note = Related to NZ_OU745373.1; note = Cardiobacterium sp.
MSLLQELSDKFQLHEQLMESFIKSAPYRYKFHKIDKRHGGKREIAQPVKSLKIVQRWLVKHYLSKYPTHSKSAIAYIKNKNIKDFAEPHRNNIFLLKLDFKDFFNSIKISDFYIFCEKLSIPEEDKIFLGLLLFCKNKQDEPYLSIGAPSSPTLSNVLMFNFDNEVFNLCKKDGIIYTRYADDLAFSTNQPNVLRQLLSNIKELCAKLNYPRNLQINTQKTIFTSKKYNRTLTGLVISNDGNVGIGREKKRKLRAIAHQAKLGRLSQDKVGSLLGKIAFLKGIDPSFAKQLEDKYLKHIS

SEQ ID NO: 4422 - protein, 300 aa, unidentified
  source 1..300: note = Related to CP005967.1; note = Haemophilus influenzae
MLINDLKEKFSLNEKEILSFINSSPSRYKSYNIKKRHGGTREIAEPTRSLKILQSWALNKYLSKYKIHPSAIAYVKNKNIKDFVLPHSNNKYLLKIDFKNFFNSIKGIDFLHFLEDKKSDLSNEERHLLTNIFFCKNKTSESKELYLSIGAPSSPFISNIIMIDFDDQISQLCANIGVTYTRYADDLAFSTNNPNILDELLEEIEIICKNLNYPKKLEINSEKTVFTSRKHNRTLTGLVISNDGKISIGREKKRKLRVIAHKASLRLLDQESLDKFKGTLAFLLSIDPDFSNYLKQKANI

SEQ ID NO: 4423 - protein, 302 aa, unidentified
  source 1..302: note = Related to LUAO01000054.1; note = Neisseria sp.
MLSVLENFKKTFSFSTVSAIIFIQTAPNRYKFHTIQKRHGGEREIAQPTKSLKIVQRWVINQYFQNSPIHKAATAYIKGKGILDHAEQHKSNKYLLKLDFKNFFNSINIQDFYEFINRSMPQFSEEDRDILGLLLFCKNKDDNYYLSIGAPSSPHVSNIILYKFDCLIQEICSKKGVVYTRYADDLAFSTNIPHILKGILCDIEHILSNLEYPKNLKLNQEKTVFLSRKHNRTLTGLVISNTGKISIGRDKKRKLRAAIHNAIHGKLTDEEIQTLKGRIAFLKGIDKEFAIKLEQELQSANL

SEQ ID NO: 4424 - protein, 306 aa, unidentified
  source 1..306: note = Related to NZ_LXSJ01000026.1; note = Eikenella corrodens
MSTIFDKICETFSLNPHEAEIFIKTAPERYKLHSISKRHGGVRYIHQPTKNLKFIQRWLVNSYFSSMPIHSCAHAYVKNRNILSNAKPHSHNKYLMKLDFSDFFTSITIRDFLIFAHDNLREFSYEEHHILASLLFCRHKINGDFVLSIGAPSSPIISNIMLYHFDQVLYDFCRTKYVYYTRYADDLSFSTNQPRILKEEVFPFVEGLCKTISYPNYLKLNKNKVVHVSKKFNRRITGLVLSNEGNISIGRDKKRQLRAMAHQMSLNKLPPEKINKLLGYINFLKGKIDPEFAEQLIQKLNNKHNK

SEQ ID NO: 4425 - protein, 319 aa, unidentified
  source 1..319: note = Related to NZ_LPEB01000197.1; note = Burkholderia ubonensis
MNIINAPLFERLLALSPFSARELGILIATAPHRYKDHYIEKRNGRGKRLISQPTAELKFLQRLIVKHEFSSLPIHGAATAYRSGSSIKAHALPHAHSRYLLKLDFSDFFPSLKANALRYRLSRDASYTEQELWILCQLLCRQPRRDAGLQLSIGAPSSPCVSNYLMWEFDSRLAEFCAACGTAYTRYADDIAVSTTFADVLDVVEAEVRRLLGELGYLGLSLNEGKTVNVSTKSRRTLVGLVLANDGTVSIGREEKRRLRATMHRLTQGGLSGDEVARFRGQLAFAHSIDASFVDLLCARHNFPNVASIGSPDGGDLTD

SEQ ID NO: 4426 - protein, 319 aa, unidentified
  source 1..319: note = Related to CABVPW010000018.1; note = Burkholderia lata
MSIANEPLFERLLALSPFSARELGTLVATAPYRYKDHYIEKRNGRGKRLISQPTAELKFLQRLIVRHEFSSLPIHEAATAYRPHRSIKAHALPHASARYLLKLDFRDYFPSLKASALRYRLSRDATYTEQELWILCQLLCRKPKRDAELQLSIGAPSSPHVSNYLMGEFDSRLTDFCGACGAEYTRYADDIAVSTSFPHVLDAVEGEIRRLLGELSYLGLSLNEGKTVNVSKKNRRVLVGLVLANNGVVSIGREEKRRLRATMHRLVQGALPADEVAHFRGQLAFVYSIDPAFVTSLCARYDFPNVGSIGAPSGGDSTD

SEQ ID NO: 4427 - protein, 319 aa, unidentified
  source 1..319: note = Related to NZ_JAELTS010000025.1; note = Paraburkholderia sp.
MSIINEPLFERLLTLSPFSARELGILIATAPYRYKSHYIEKRNGRGKRLISQPTAELKFLQRLVVKHEMSSLQIHNAATAYRPNRSIKEHALPHARARYLLKLDFRDFFPSLKATALRHRLLADANYSAQELWMLCQILCRRPRRDAELQLSIGAPSSPYVSNYLMYEFDSKLARSCEACGAEYTRYADDIAISTSFPQILDIIEVEVRRLLGELDYLGLSLNEGKTVNVSTKNRRTLVGLVLANDGNVSIGREEKRRLRAAMHKLTQGKLPVEETARLRGQLAFAYSIDPDFVNDLCARSNFASVAAISQPDNGKQTD

SEQ ID NO: 4428 - protein, 315 aa, unidentified
  source 1..315: note = Related to NZ_SNVI01000005.1; note = Paraburkholderia dipogonis
MSIVNEPLFDRLLALSPFSARELGVLIATAPHRYKNHYIEKRNGRGKRLISQPTAELKFLQRLIVKHEMSSLPIHDAATAYRSQRSIKEHALPHARARYLLKLDFRDFFPSLKATALRHRLLLDANYTEPELWMLCQILFRKAGRHTDLQLSIGAPSSPHISNYLMWEFDKKLAQFCELLGAEYTRYADDIAVSTSFPHLLDAVEAEIRRLLGELDYLGLSLNEGKTVNVSTKSRRTLVGLVLANDGTVSIGREEKRRLRATMHRLVQGLLAGEEVARLRGQLAFVYSIDRAFVDSLCARHGFTSVGSIGQPTSD

SEQ ID NO: 4429 - protein, 317 aa, unidentified
  source 1..317: note = Related to CP007783.1; note = Burkholderia cenocepacia
MNIISTPLFSRVLENSPFSERELLMLVLTAPERYKDHYIEKRHGRGKRLISQPTAEIKYLQRLIVARELSELPIHPAATAYRVGCSIKDHALLHASNRYLLKLDFTDFFHSIKQDAVLSCLSRDTSYSVNEQWMLVQLLCHRPRGAGDLQLSIGAPSSPFMSNYVMHEFDNKVDRMCRASGAVYSRYADDMAISSSLPRVLDAVEHQIRALLLEMKSPKLRLNESKTVNVSKKNRRTLVGLTLSNEGSVSIGRDEKRRLRAMMHALTEGRLDVTSVSLLRGKLAFAQSIDSVFVSQLCRRHGFSSVKDIRPPISSIG

SEQ ID NO: 4430 - protein, 316 aa, Nitrosomonas sp.
  source 1..316: note = Related to QWIC01000028.1
MSFAREPLFVRLLDLTPFSERDLAILIATAPRRYKDHYIEKRNGRGKRLISQPTAELKFVQRLLIKHELTHLQLHEASVAYRSGSSIMDHASPHASARYLLKLDFKDFFPSLKASTLQYRFTKDSDYSENEKWILCQLLCRGSLITGDLQLSIGAPSSPYISNYLMWEFDTKLTEFCKKYSAEYTRYADDLAISTSQPHALDKIESEVRRLLMELSYLKLTLNEDKKVNVSKKNRRTLVSLRLANDGNVSVGRQRKRQLRAAMNALIHGRLSTAEISRFRGMMAFVYSIDPNFVDQLCSKNGFATISAIDAVKIKK

SEQ ID NO: 4431 - protein, 315 aa, unidentified
  source 1..315: note = Related to CP001132.1; note = Acidithiobacillus ferrooxidans
MSIVTEPLFQRLLAWSPFSEHELVVLIATAPSRYKAYYIEKRGGRGQREISQPTKEIKFLQRLLASKELRELPIHDVAVGYRSGRSILDHAQPHASARYLLKLDFTNFFPSLKSKALDHRLSRDTAYSTAERWILRNLLCRRTPGTGNYQLSIGAPSSPHISNYLLCEFDQLMSDYCGIRVVRYTRYADDLAFSTSIPSVLNDIETEVRRLIQELDYLGLSLNEAKTINVSTKHRRTLVGLTLSNDGRASIGRIAKRELRQAIHSLRHGLLSQSEIANLRGRLAFTYAIDPEFIEHLLHRYGFESISTIDGPQTD

SEQ ID NO: 4432 - protein, 330 aa, Chromobacterium sp.
  source 1..330: note = Related to NZ_MKCR01000001.1; note = Chromobacterium amazonense
MIPEYESLFARILAQSPFSSKELVTLLGTAPDRYKDHFIQKRNGRGLRQISQPTAELKFLQRLLVNFEFCNLPVHNAATAYRAEKSIKSHAVEHAKNSYLLKLDFKDFFPSIGSDAIKHRLRLDMNYSETELWMLCQILCRRDRLTNRLQLSIGAPSSPFLSNYIMWEFDCRIQSYCDQLGVSYTRYADDLAFSTSVPHILDVVHEYVERLLRELSYLGISLNKEKTVNVSKKNRRSLVGLVLSNSGNVSIGRAEKRNLRAAMHALINNKLTQDEAGKLRGKMAFLLAIDPDFVNGLCVKYNFTRVADIQATNYDSSQPQKNDGTDDLPF

SEQ ID NO: 4433 - protein, 312 aa, unidentified
  source 1..312: note = Related to CP045571.1; note = Acidithiobacillus thiooxidans
MNFRSANLFTRLLEMSPLSARELSRVIATAPHRYKSHFIEKRHGRGKRLISQPTAELKYFQRWLVDNELNQLPVHDAATAYRKGRSILDHATPHAKQRYLLKLDFKDFFPSLNEHALRHCLERDCNYSEEEIEILCNLLLKSASIEGGPLQLSIGAPSSPFISNYLMWEFDIAMQQYCEVMGVMYSRYADDLAFSTDTPRLLDKVFDTVQKILASISYLPLILHPDKTVNVSKKRRRLLVGLTLANDGNVSIGREEKRRLRAALHAYTQGRLPCDEVARLAGMLSFVWSIDPKFVENLCQRHGFSRISDLLR

SEQ ID NO: 4434 - protein, 316 aa, unidentified
  source 1..316: note = Related to NZ_CP012371.1; note = Nitrosospira briensis
MRISDASLFERIIENTPFSEAELVLLILTGPTRYKDHWINKRHGRGKRLISQPTAELKLVQRWLVSSELSSLPVDVHATAYRKGLSIRDHVSPHTRSHFLLKLDFKDFFPSLTDSALRYRLEHDANYTELEVLILTKLLFRKKQSEETYRLSIGAPSSPFISNYLLLDFDRRLADYCESNYLHYTRYADDIAISVNRAGTLDFAKVFVERLISELPYLGLRLNEEKTVNVSKKFRRQLVGLVISNQGKVSLGREEKRRLRAAVHSLALGKLDVRQSVQLRGQLAFCLSIDRDFVITLCNRHGFQRVCDLPSGSDAS

SEQ ID NO: 4435 - protein, 315 aa, unidentified
  source 1..315: note = Related to JABFSF010000055.1; note = Methylotenera sp.
MKLSSTPLFLRLLELTPYSEYELATLILTAPTRYKEHYIVKRHGRGKRLISQPTAELKLLQHTTINKELNKLEIHNSATAYRCGSSILHHAQPHANSNFLLKLDFKDFFPSLTDKALKHKLRADTNYSELEIDILRNILLKKDRKSGNFNLSIGAPSSPYVSNYLMNEFDMLVSIYCKTKKLAYSRYADDIAISSTKPYLLDEAKSYIDDVLLKLDYLGLILNQEKTVNVSKKHHRELVGLVLSNDGQVSLGRDGKRNLRAGVNALINGKLDEIAASKLKGQLAFYMAIDRDFVLNMCKKYGFNSIVELSKKSKP

SEQ ID NO: 4436 - protein, 326 aa, unidentified
  source 1..326: note = Related to JACPOI010000036.1; note = Burkholderiales bacterium
MSFLETNMFARMVERSPFSYTDLAILILTAPKRYKEHHIKKRSGGLRLIAQPTKELKFVQRLLISNELSHLKVSEAAAAYVKERSIKEHAEKHAGNRYLLKLDFKDFFPSITKDAINRLLIQQTDLSADERYIACQLLLRSPKKEETLRLSIGAPSSPFISNCVMYEFDEKLLGYCQANGITYSRYADDIALSTQNPRTLDPAKAFVEGLLSQLDYLKLSLNPAKTVNVSTKNRRTLTGLVLSNEGTASIGRDKKRLIRAQVHSMIKGQLSTEEAVSLKGHLSFLYSVDKSFVVNLARRYGLDAKSLMTYRTSSTDSLPPQPDKSS

SEQ ID NO: 4437 - protein, 341 aa, unidentified
  source 1..341: note = Related to NZ_PVLR01000019.1; note = Malikia spinosa
MAEFDNNNLFLTLLNQSPFSSGELKTLISTAPQRYKNHFIEKRNGRGRRLISQPTRELKGLQRSLLSIIDEVIAPSAVAVAYRKGKSIKDHAAPHAKNSYLLKLDFKDFFPSIDWFTISHCFKETGKFSDDEIKIMNFILCRYDSEPISLRGSFKLSIGAPSSPPISNFIMRDFDETLENFCKNESVTYTRYADDLALSCSIPRKLDEVKNFIASILDEKKYLNLFLNEGKTVNVSKKNKRSLVGIVLSNEGVISIGRDKKRLIRATLHKASQGLLTEKQLEKLKGHLSYYINIDRDFVYSLVGKYGFGSVSQVSFETIKYPEVFSARDNLFFGRDDGIPF

SEQ ID NO: 4438 - protein, 311 aa, unidentified
  source 1..311: note = Related to NZ_AP022673.1; note = Sphingomonas sp.
MSQLLPLFVAESGMDPHDIVRIIRTAPRRYKVFFIPKRSGEPREIAQPARELKVLQRILVDKVLCKLPVHDAATAYRKGLSILDNSDPHSGSTPILKLDFENFFPSITESDWLRYCRENSILREDDREIAARILFRRAKGERTLKLSIGAPSSPMLSNILLYRFDSLVEAAALKRGLKYTRYADDMSFSGQRAGMLKDMIKEVAEAARIARYPRLKLNKSKTTFVTTATRRSVTGVILSNDGTVGIGHGRKRLISSKVHHAMLNKLSVDEVRQLAGELAFVNVVEPIFLAWLRNKYGEQTIDNIKRLILPI

SEQ ID NO: 4439 - protein, 309 aa, unidentified
  source 1..309: note = Related to NZ_CP016456.1; note = Sphingobium sp.
MSDLVNLFVAESGMAHDDVLRIIRSAPQRYKVFSIPKRSGGTREIAQPARELKVLQRVLVDSILCNLPVHSAATAYRKGRSILDNAIPHKGGLPILKLDFENFFPSIVADDWINYCNDHDIFDNNDRLMSAKILFRRAKGERILKLSIGAPSSPIVSNILMFEFDTLVTESANKRRLNYTRYADDMTFSGQRAGMLKDMVKEVASAARSVSYPRLNLNRSKTTFVTAATRRSVTGVVLSNDGEVGIGHQRKRIISAKVHYSTQGKLNIDQLRTLAGELAFINVVEPAFLSWLSAKYGEPAIEKIKHLEI

SEQ ID NO: 4440 - protein, 312 aa, unidentified
  source 1..312: note = Related to JADKHG010000002.1; note = Sphingomonadales bacterium
MLSKFLKQLSVHTGLSEADLLKIWTNAPDRYKVFRIRKRSGGWREIAQPARELKLVQRALVEILLSQLPVHDAATAYVRGRSILDNATPHRGDTPILKLDFRDFFPSILAEDWEAYCAAHDVIQGSDVHLTSRMLFRRPRSSTKLRLSIGAPSSPMLSNVLMYEFDDAIDKIAKDKGIAYTRYADDLTFSGQRIGMLQDMVRAVKKTLRNQSSPKLRLNQSKTVFVTMASKRTVTGVVLANDGTAGIGRGRKRELSAAVHHAKMGKLEKSELKELCGHLAFANAIDPDFLKFLAKKYGSEVIRAIQSAVELK

SEQ ID NO: 4441 - protein, 310 aa, unidentified
  source 1..310: note = Related to APMP01000001.1; note = Caulobacter vibrioides
MSDLIRLLSAETGLSNSDLIRIIRTAPRRYKVFYIPKRTGGMREIAQPARELKVLQRVLVGRLLGALPVHDAARAYRTGMSIRDNAAPHAGSGPILKMDFRDFFPSIRSTDWQRYCRDHDILSEEDREITSLIFFRRNKGEKIFRLSIGAPSSPVLSNVLMYDFDTQVSAEAERRGIAYTRYADDLTFSGQRAGMLKDMVGEVEKAARKVKYPRLQVHGEKTTYITASRRRTVTGVTLANDGALSLGRDKKRLLSAGVHHASLGKLSAEQMEELAGQLAFANVVEPEFLDRLRAKYGEAVDLVRRSVRSS

SEQ ID NO: 4442 - protein, 311 aa, unidentified
  source 1..311: note = Related to JADPJG010000026.1; note = Bradyrhizobium sp.
MSRVVSLIAVETGLPTDDIHRLIRSAPRRYKVFHIPKRSGGTREIAQPAREVKLLQRVLVTHVLSSLPVHDAAMAYRTGRSILTNATCHAGHGPILKMDFKDFFPSIRAEDWMVFCRNAQLFDESDAELSAQILFRKAKHEHVLKLSIGAPSSPVLSNVLLVPFDVMVAAEASKRGIKYTRYADDLTFSGQRIGMLKDMIDVVRLTTKQIRRPKLTINSEKTTFVTAKHCRVVTGVTLANDGALSLGRDRKRMLSARVHHAVLGKLNPDELLRLSGDLAFANVAEPSFIDRLSNKYGSEAIQTIRHAPRSS

SEQ ID NO: 4443 - protein, 311 aa, unidentified
  source 1..311: note = Related to nan
MSKLVDLIVSETGLPPSDVLRLIRSAPRRYKVYRIPKRSGGEREIAQPAREIKLLQRVLVDKVLSSLPVHRAATAYMKGCSIAANASYHAGSGPILKMDFRDFFPSIRAEDWVLFCRNTHVFDENDAELSAQILFRRAKHEHVLKLSIGAPSSPILSNILLMPFDTMVMAEASKRHIRYTRYADDLTFSGQRIGMLKDMIDVVRLTVRQVQRPKLTVNLDKTTFVTAKHRRVVTGVTLANDGLLSLGHDKKRRLSAAVHRAIHGGLDSKELLSLSGDLAFAKVIEPSFLDRLARKYGPEAVQMIRHAPRQS

SEQ ID NO: 4444 - protein, 311 aa, unidentified
  source 1..311: note = Related to JAFWCE010000141.1; note = Loktanella sp.
MGNLINTLSVQTGLSPSDVRLILRTAPRRYKVYTIPKKTGGERVIAQPAREVKLLQRALMSALLEKLPVHENAKAYKMGTSLLGNAQPHSGQSPILKMDFADFFPSIHGIDWLRYCAQSAILDREDSIFSANLLFRLAKHERTLKLSIGSPSSPLISNILMYGFDEIILREATKRKISYTRYADDLTFSGQRVGMLKDMPSIVEKAIREAKGPRLSINKSKTTYVTSRFQRRVTGLVLANDGTVGIGRDKKRLIRSKVHRAINGKLDVKQASELAGYLAYVNSVDPELILSLESTYGIKIFGELIPKLLSK

SEQ ID NO: 4445 - protein, 306 aa, unidentified
  source 1..306: note = Related to NZ_PHSI01000091.1; note = Cereibacter azotoformans
MNSLTSLLASQSGLSHADVLRILNTAPKRYKIYSIPKRGGGMREIAQPSREVKLLQRIFVDEVLTKLPVHSAATAYRKGCSIRQNAEAHLGATPILKMDFKDFFPSLHGVDWLRYCRHNRILNESDAALSANLLFRKAKKDRTLKLSIGAPSSPALCNVLLFDFDSYVAEAASRRNIVYTRYADDLTFSGQRFGLLKDMPEIVRTAIREAKGPRLRVNEDKTVFVSSKFQRRVTGLVLTNTGTVSIGREQKRKIRASVHRALLNKLEPNEVASLKGYLAYIKSVEPEFLQVISRTYSDFDTEWLLP

SEQ ID NO: 4446 - protein, 315 aa, unidentified
  source 1..315: note = Related to NZ_CP039435.1; note = Brevundimonas sp.
MIDDLIGLLSRMTGLPPSAVRRIILSAPRRYKVYYIDKRSGGKREIAHPARELKLLQRAFLDAVLEDLPVHVSATAYIKGKSLKDNALPHVGAGPILKMDFRDFFPSIRAKDWIAYAREHRVFSNDHDAELSALLLFRRPKGESVLRLSVGAPTSPALSNILMYNFDQAVWASVGERFVTYTRYADDMTFSAARTGFLQGVQTRVSAIIREMSYPKLELNHQKTRFVTEKYHRDVTGLTLSLDNRVTIGQLRKRNIRAGLHQAKLGQLSREELQTLSGHIAFAADIEPEYIGKMKERYGEDLLDWITKGRQSDDR

SEQ ID NO: 4447 - protein, 315 aa, unidentified
  source 1..315: note = Related to NZ_SGIS01000054.1; note = Sphingomonas populi
MRSKLVDLLIRELRIGERELAALIATAPDRYKTYFIPKRSGGRREIAHPAFELKIAQRAIISGFLNELPVHHCATAYKKGSSIRQNAERHCHNRAILKYDFKDFFPSITEQAWLSYCDRRKVMDRSDAVLAGRLLFRRPKGGRILRLSIGAPSSPILSNVLLYDFDCQVHERVTAHKITYTRYADDMTFSSERTWNLREVDKILRSVINSLGTPSLTINGSKTTLVTPKYHRQVTGLVLTLDGRVSLGRDRKRLIRARVHHAVSGKLSKAALVNLAGTLAFAKDVEPEFYNRLELTYGRENLETIKYSVRDYHRE

SEQ ID NO: 4448 - protein, 315 aa, unidentified
  source 1..315: note = Related to NZ_JAKRET010000004.1; note = Sphingomonas sp.
MTSKLVEFLTRELRIGERELAALISSAPDRYKTYFIPKRSGGKREIAHPAFELKIAQRAMINGFLKDLPVHPCATAYRKGSSIRQNAERHCHNRAILKYDFKEFFPSITERAWLTYCDRHSVLDRSDAISAGRILFRRPKGGRILRLSIGAPSSPILSNILLNDFDREVHQRVSAHKITYTRYADDMTFSAERTWNLREVDGILRSVIRLIGTPSLTINSAKTTLVTPKFHRQVTGLVLTLDGRVSLGRERKKLIRARVHYAINGKLDRHAMAHLAGTLAFAKDVEPEFYTRLERIYGRDNMELIKHSVRGYSRS

SEQ ID NO: 4449 - protein, 315 aa, unidentified
  source 1..315: note = Related to JALHLF010000113.1; note = Novosphingobium sp.
MTSPLVELLIRELRISEREVLHLIATAPERYKVYTIPKRNGGRREIAHPAKELKVAQRAVVNSYLNNLPIHDAAMAYKIGRSIKDNAAYHAGSGSILKYDFVEFFPSITEFAWIAYCDRHAVMDRADAIRSGRILFRRPKGGRILRLSIGAPSSPILSNILMHDFDEEVTQLVAEHKIKYTRYADDLTFSAERTGYLTAVDKILRGVIARSKAPKLKINDSKTVLATPKVHRQVTGLILTLDGKVSIGKNKKREIRVKLDYFRKGLLGEREVAPLAGYMSYIWDVERDFYIKMQRHYGEEVLARLQKQGQHKISP

SEQ ID NO: 4450 - protein, 326 aa, unidentified
  source 1..326: note = Related to NZ_WMHO01000038.1; note = Sandarakinorhabdus rubra
MTSPLITFLMNELHLGEREVVRLILTAPERYKVYQISKRNGGKREIAQPAPEVKAAQRAIVRAYLLSLPVHPSATAYSPGSSIIKNASAHSDAGPILKYDFKDFFPSITEKAWISYCLRVGLFSKEDAVRSGRLLFRRPKGGRILRLSIGAPSSPIVSNLLMYDFDERLSKLLEGHKIVYTRYADDLTFSAPRTGNLLEVPKAIRAAMNSMSHPKLALNSQKTVLVTKRYQRNITGLILTLDGNISVGRSRKRLIRAGIDHFIRGKLDVDQTVKLAGIIAFTKGVEPTFFAKLTTRYGNDVMGKIMASTKDYKRPRPETVNRTKRR

SEQ ID NO: 4451 - protein, 318 aa, unidentified
  source 1..318: note = Related to NZ_JACIJH010000001.1; note = Sphingopyxis panaciterrulae
MTSKLIEFLVSEVGLSARNIERLIQTAPERYKVYHIRKRSGGWREIAQPATELKIVQRAIVEKYLKHLPIHPAATAYVPGSSIRRNAAIHSVNGPILKYDFKEFFPSITERAWLRYCEIHGIFDRVEAIQFGRLLFRRPHGGTILRLSIGAPSSPILSNVLMYEFDKMLHERVAQHSVTYTRYADDLTFSARRTGYLNSVNRILRSTISQVQLPKIKINEEKTVVATEKYRRQVTGLILTNDKRVSLGRERKRNLRAALHHFREGKLDIDQSVKLAGLMAFARDVEPEFYTRMELTYGKDLLSQLKYLVKGYRRPEYR

SEQ ID NO: 4452 - protein, 316 aa, unidentified
  source 1..316: note = Related to DPST01000077.1; note = Erythrobacter sp.
MSALISVLQQSLGIDAMSVRRIIATAPERYKVYSIPKRGGAGRRIIAQPAKEVKALQRILLKTFLSDLPVHPSAFAYVPGKSIRTNAVTHVANGPILKMDFQNFFPSIRSYDWLSYCHDNGVFDSEADARMASKILFRREKGESILRLSIGAPSSPHVSNLLMYEFDRAISDKVAEDYVTYTRYADDLTFSAERTGYLTRVEKDVRKTLRDLRYPRLFINDRKTVLATTKYRREVTGLILTNDHRVSLGRHKKRLLRAQIHRYSKGELNNIATAKLAGNMAFASDVEPTFYTRMERVFTKEVMDRLKDSVNRQDQS

SEQ ID NO: 4453 - protein, 314 aa, unidentified
  source 1..314: note = Related to JABFWP010000009.1; note = Sphingomonas sp.
MSRLLAVLTEATGLSGYDLARVIATAPHRYKQFTIPKRQGGTRLIAQPAREVKAMQRAIVRAYLSDLPIHPAVTAYEPGTSIRENASRHATNGPILKLDIADFFPSIRADDFLSYCAEHSLFDDESERIAATKILFHRPKGARVLRLAIGAPSSPHISNLLMYHFDRAVASEVGDQFVTYTRYADDLTFSAKRTGYLNPVEKIVRKVLREIGYPRLKLNDSKKVVATKKYHRQVTGLVLSNDGRVSLGRKRKRELRAALHHFAGGKLEPKAQKHLHGMMAFAKDAEPDFYARMQARYGRNVFEALSEALREADE

SEQ ID NO: 4454 - protein, 332 aa, unidentified
  source 1..332: note = Related to JADCAE010000108.1; note = Phenylobacterium sp.
MSELLPVLIGATGLSDSDIRRIVSNAPSRYKHFTIKKRNGKDRHISQPSRELKALQRALMEFKLSQLPVHPAAMAYKHDVSILENATAHAGNGPILKYDFVDFFPSIRSKDWQRYCDYYSIFEKSEDKWISERILFQRDKGSRILKLSIGAPSSPILSNIIMNEFDTVISQKVASDNVVYTRYADDITFSAPRVGYLNRIDRIIRRTIKEVPWPRLKINEEKTVLATSKYRRQVTGLVLANDGSVSIGRDRKRSVRAALHRAQHDRLTDQETAYLCGMLAFINSVEPEFLARMENHYGVELLQRLRRHASIGRRPTERSRAKGEDLRIDGSD

SEQ ID NO: 4455 - protein, 314 aa, unidentified
  source 1..314: note = Related to JAGRQC010000004.1; note = Sphingomonadaceae bacterium LXI357
MSKLISILIESTGLTERDVMKIISNAPRRYKHFRIKKRNGSLRDIAQPARELKALQKVIVEKYLLELPVHQAAMAYRKGRSIRENALAHVDNGPILKMDFKEFFPSIRVRDWQAYCEDRSLFMDGDDLHHTSKILFHQSKGESYLKLAIGAPSSPHLSNLLMYKFDALVSQLVQKDYVAYTRYADDLTFSAKRTGYLTGVEKAVRRAIKEVPWPRLSINENKTVVATPRYHRQVTGLVLTNDQEVSLGRDRKRKISAAVHHAKHGELTVEAAARLSGTLAFVNSVEPEFLLRLERKYGREVIDNLKQFPWKLEK

SEQ ID NO: 4456 - protein, 324 aa, unidentified
  source 1..324: note = Related to NZ_CP054151.1; note = Agrobacterium vaccinii
MSEILKALSTATGLSDRDLRAIISNSPDRYKVYSIAKRRGGRREIAQPARELKVLQRALNDIVLSKLPVHPAAMAYRPGIGLKQNAQAHSHNGPILKFDFQDFFPSLRAEDWQEYCHRHKVFNDEEDVELSSKIMFRRKNRHSTVLRLAIGAPSSPPLSNILMFDFDIAMQAYCASQKVTYTRYADDITFSAQRTGFLTGVPKALERIVKDLRSPRLKINHDKTVLATKKYKRMVTGLILTNDGSVSLGQQRKRNIRAGVHRWTLGVLSNADICRLAGHLSFAEDIEPAFISRLANKYGAQAIADIKRAYLQQGSDSSQNPVKI

SEQ ID NO: 4457 - protein, 316 aa, unidentified
  source 1..316: note = Related to FTMQ01000001.1; note = Rhizobium sp.
MSEILRALSEATGLSDWDLRAIISNAPDRYKVYHIDKRRGGRREIAQPARELKVLQRALHDIFLAKLPVHPAAMAYRPGIGLRQNALAHSHNGPILKFDFQDFFPSLRAEDWEAYCRRHNVFINEEDVNLSSKIIFRRKSRHSSVFRLAIGAPSSPAVSNILMFDFDKTVQSYCESQSVIYTRYADDLTFSAQRTGYLTGVPKALERIIKDQKSPRLKINSEKTVLATKKYKRMVTGLILTNDGDVSLGQLRKRSIRAGVHRWTLGGLSPADTCRLAGHLSFAEDIEPAFVARLARRYGAQAIADIKNAYRQSGAP

SEQ ID NO: 4458 - protein, 315 aa, unidentified
  source 1..315: note = Related to NZ_JACHEG010000009.1; note = Rhizobium wenxiniae
MSELISVLSQATGLSDFDLRAIISNAPDRYKVYYIAKRKGGRREIAQPARELKVLQRALNDSILSKLPVHPAAMAYRPGVSLRRNAQAHSHNGPILKFDFQDFFPSLRAEDWEDYCRRHGVFKDDEDIELSSKIMFRRKNRRSSVLRLAIGAPSSPLLSNILLFDFDENLAKYCDSQKITYTRYADDLTFSAKRTGFLNGVEKFLVKLIKDADHPRIKLNLNKTVLATKKYKRMVTGLILTNDGKVSLGQLRKRNMRAGVHQWILGNLSEADTCRLAGHLAFAEDIEPDFVARLTVKYGAQVIAEIKMAYRRRVL

SEQ ID NO: 4459 - protein, 314 aa, unidentified
  source 1..314: note = Related to NZ_NWSV01000001.1; note = Rhizobium chutanense
MSELLRMLSEDTGLSEIDLRTIIATAPNRYKTYEIDKRRGGKREISQPARELKVLQRAMVQRILSGLAIHSAAMAYRPGISIRNNAAYHAGDGPILKFDFKDFFPNIQAVDWEKYCEKHSIFDHQEDVKLSSRILFRKSSRYSPVLRLAIGAPSSPMLSNILMFEFDEYMQSYAESQKAKYTRYADDLTFSAPRTGYLNGVEKVLRQAIHKIKNPKLQLNEDKTVLATRKYKRMVTGLILANDGSVSLGHQRKRNMRSAVHHWLLGKLSSAEQANLAGLLAFAEDVEPSFVFALARKYGTSTLKDIKKLADIES

SEQ ID NO: 4460 - protein, 341 aa, unidentified
  source 1..341: note = Related to NZ_JADNQW010000005.1; note = Methylosinus sp.
MPQSSKQLKGCNVSDVVQALVAASGLSERDVRTIIATAPSRYKTYSIPKRRGGERIISQPAREVKFLQRIIVEEILSRLPVHDAAMAYREGRSIRDNAAVHAGGGAILKFDFADFFPSIKADDWAAYCRRHSVFKDVDDIRLSANLLFRRTKYGSVLRLAIGAPSSPHLSNILMREFDQRVTEAVAKEKVKYTRYADDLTFSAKRAHNLIGIERVLRRIIREVASPHLRLNEDKTVLATRKYRRVVTGLVLADDGKVSLGRDRKRDIRAALHHYALGQLNGHETARLSGLLAFVNAIEPEFLERLVDKYGPAVIERIKARLPPTANCQQPHDPIIEFKFRE

SEQ ID NO: 4461 - protein, 302 aa, unidentified
  source 1..302: note = Related to NZ_JAEPIV010000062.1; note = Azospirillum sp.
MSESDVRLIVLTAPSRYKTYTIPKRNGGERIISQPAREVKFLQRVLVNDVLSQLPVHSAAMAYREGRSIKDNAAAHAGGGAILKFDFSDFFPSIVASDWRAYCERHGVFDNEEDIRLTANLLFHRTKRSSKLRLAIGAPSSPTLSNVLMFDFDQCIAGLVAKDKVRYTRYADDMTFSSKRAGNLSNVERVLRKVLKDLVSPRLRINEKKTVLATKKYRRVVTGLVLSDDGKVSLGRDRKRIIRAMLHHYTLGRLNGEETARLSGLLAFVNAVEPMFLKRLIDNYGVEIVDRLKASLHPNSIF

SEQ ID NO: 4462 - protein, 337 aa, unidentified
  source 1..337: note = Related to NZ_VSTH01000095.1; note = Bradyrhizobium hipponense
MSKLLPLLVAGTGLSEPDIIRIVSNAPLRYKSYRIPKRRGGNRTISQPARELKVLQRILTEEFLSKLPVHQSATAYRAGTSIKHNALAHALNGPILKFDFANFFPSIGARDWTVYCEREGLMLEARDIWISSNIFFHRWSRQGRLSLAIGAPSSPCLSNVLMNEFDEKIANAVASDQVTYTRYADDLAFSAKRTGYLNQVEKILRRTIKEIKFPNLTLNESKTILATKKYKRFVTGLTLTNDGKVSLGRERKRKIRAALKHYADDRLNIHEQAKLAGLISFAHDVERDFVLRMERTYGSELLQALKLVRLPSTRGGGGGGVEFDSDVSDASDPDDDF

SEQ ID NO: 4463 - protein, 318 aa, unidentified
  source 1..318: note = Related to RXJE01000056.1; note = Bradyrhizobiaceae bacterium
MSKLLPLFISDTGLSEHDVLRIVRDAPIRYKTYRIPKRTEGTRVISQPARELKALQRILTAELLSKLPVHPAATAYRPGVSIRANAAAHAPNGPILKYDFKDFFPSITSKDWRNYCENNHVFDNDEDLWISTNILFQKRRGESRLTLAIGAPSSPSISNILMRDFDSTVSALVAKDYVTYTRYADDLTFSARRTGYLTVVDKILKKTLRDMKSPSLTLNPSKTAIATTKYKRFVTGLVLTNDGAVSLGHDRKRKIRATVHHVTLGKLSERQLAELAGMLAFVNDVEPQFLAKLERTYGVDLIQKIKTGRGSSKNFDLD

SEQ ID NO: 4464 - protein, 318 aa, unidentified
  source 1..318: note = Related to nan
MSKIIQILMEETALNEPALRRIIYTAPSRYKTFYIPKRNGKNRRIEQPARELKAIQRVLVQKLLSTLPVHPSATAYRPGLSVRDNAARHAHNGPVLKFDFEDFFPSIRARDWRVYCEKKGLLETEEDIYLTQQIFFRREKGSSVLRLAIGAPSSPALSNILMWDIDAAIAEMIDGEQVSYTRYADDLTFSARRTGYLNGIEKGLRAILRSAGGPRLKINEEKTVLATKKFRRQVTGLILANDGHVSLGRDKKRLIRAAVHRETLGLLETSEREQLAGMLAYVNVAEPLFLARLKKKYGVEAIEELKKAVRPGNEPERP

SEQ ID NO: 4465 - protein, 304 aa, unidentified
  source 1..304: note = Related to NC_015976.1; note = Sphingobium sp.
MIEHTGLSRSDILSIARNAPQRYKTYTISKRNGGKRTISQPAREVKVLQKILLEHVLYKLPVHSAATAYRQGISLKENATRHVHNESIKKFDFKDFFPSIKGRDWIKYCGDHGVFADTVDVGLSTHILFHQPANSTILRLAIGAPSSPALSNVLMFEFDKIITDEVAKDEVIYTRYADDLTFSASRMWNMIDVPKVIARAIKNNHYPRLNINPDKTISATKKYKRQVTGLILTNDGKVSLGRKRKREIRAEVHRALIGQLTNDQLMHVQGILAFVEDVEPDYLRRLESYYGAEFIRNLRKRVRE

SEQ ID NO: 4466 - protein, 311 aa, unidentified
  source 1..311: note = Related to NZ_SMBO01000002.1; note = Novosphingobium sp.
MSKIIRLLTAETGLPTHDVRAIINRAPISYKHYTIKKRSGADRPIAQPAREVKRLQKILMGFLSDLPVHSAATAYAPGASIKDNAERHAKNGPILKFDFTNFFTSIRERDWKNYCAKYNLFDDPDDVTLSTKLFFCRVPGSTLLRLAIGAPSSPWLSNVLMYEFDDLISRRVRQDQVTYTRYADDLTFSARRTGYLTRVEKILNRTLSEMENPRLTLNQEKTVLATMKYRRVVTGLVLANDGRVTLGRERKRRIRAALHSAFAGKLDAEAMTRLAGMLAFVKSVEPEFFEQIAARYGENVISKLAGSQSQL

SEQ ID NO: 4467 - protein, 309 aa, unidentified
  source 1..309: note = Related to NZ_CP039695.1; note = Novosphingobium sp.
MGHLIEQLASGSGLLENDVRKIVATAHRRYKHYTIKKRNGEDRPISQPAKEVKLLQRLFQKQFLQNLPVHPSATAYEKGLSIKENAGRHMHNGPILKLDFKNFFPSIKASDWVAYTEAHGLLDDLEDRELSARLLFKSTRTSAGMRLAIGAPTSPHISNLLMYDFDRLMAERAAREMVTYTRYADDLTFSAKRTGYLQPIEKIVRTTLREINRPRLTLNDEKTVFATTKYRRVVTGLTLTNDGTISIGRERKKLIRAMIHHYEKGLLDAENLRKLVGLLAFANDAEPAFVLRMKLKYGEKLMAEILDLS

SEQ ID NO: 4468 - protein, 316 aa, unidentified
  source 1..316: note = Related to JAFVHE010000060.1; note = Sphingopyxis sp.
MSKLIRLLSIQTGLTEQDVERIINRAPDTYKSYTIPKRNGKGNRVISQPAREVKVLQRVLTERLRSLPIHDAAMAYRKGISIRANALKHAQNGPIRKYDFESFFPSIKGLDWEQYCLQNPVFSDPEDILRSINLFFHRAKRHNVLRLAIGAPSSPWLSNVVMFEFDDAVSRAVAKDRVTYTRYADDLTFSAPRTGHLTVVDDIVRKAIRNIQCPRLKLNEAKTTVATKKYRRVVTGLILADDGEVSIGRDKKRLVRAEVHHALTIGVGWEKADKLLGYIAHVRSVEPSFYYRLLAHYGEDFEARVRAKNGPPVFDL

SEQ ID NO: 4469 - protein, 313 aa, unidentified
  source 1..313: note = Related to NZ_CP011310.1; note = Aurantiacibacter atlanticus
MSDLIKHLSSETGLSDADVERIIARAPRSYKFYTIDKRTRGKRLISQPAREVKALQRALVKYLDALPIHESATAYRKGKSILDNAAPHSQSGPIKKYDFKDFFHSIRARDWETYCAEKGVFEDQEDVALTARLMFHVTPGSSILRLAMGAPSSPWLSNVLLHDFDKRLADELAKEKIIYTRYADDLTFSAPRTGHLNSVDGILKDIIRDTDAPELTINALKTVVATTKYRRTVTGLVLANDGRVTIGRDRKRYIRSAIYHALKGANTAEENQMLLGYIAFIGSVEPDFVEKLKAKYGPNFVERLSEAHIANNQ

SEQ ID NO: 4470 - protein, 338 aa, unidentified
  source 1..338: note = Related to NZ_CP092689.1; note = Gluconobacter frateurii
MMKEHLVTEGEPAVRFPDVLQILSEETGLLISDIRHIISSAEVSYKTYTIPKRSGGMRVISQPSRQVKILQQAIINRILLNLPIHESATAYRKGKSILDNAHPHQGAGRTILKIDFSQFFPSIKSADWVHFCKKNKLMNDIDQYYTSKILFKKEPNMRGLRLAIGAPSSPLISNILMYDFDNAVNELIVSEEVVYTRYADDLTFSAPRTGYLVDVESKLRKIIRKNVHPRLKINEEKTVYATSKYRRSVTGIILTNNGNTSIGRQKKRIISSCVHHAKCGLLSAEDLKKLSGYLAYISSVEPDFLQYLRKKYGDEIIELLKKIGNPNTKVELIPKISV

SEQ ID NO: 4471 - protein, 330 aa, unidentified
  source 1..330: note = Related to NZ_JAERLO010000011.1; note = Gluconobacter cerinus
MSEENFVTAQEYRFDNILQILSEETGLLLNDINYIISSAPKSYKTYNIPKRSGGTRTISQPARQVKILQKALIKNVLLNLPVHPAATAYQKGKSILNNAQPHQGEGRSILKIDFSEFFPSIKHFDWIDYCKKNRILNEQDQHYTSRILFKKEVGMRGLRLAIGAPSSPLLSNILMFDFDSAVNDLIVTDKIAYTRYADDLTFSAPRAGYFGEIEKKLRTIIRGMSHPKLKIKEEKTVRATPKFKRSVTGLILTNQGKTSIGRDKKRIISASVHHAKNNNLSQEQMKKLSGYLAYIKSIEPSFLDYLRRKYGEAIMDSLRKMGHPDYRVEN

SEQ ID NO: 4472 - protein, 336 aa, unidentified
  source 1..336: note = Related to NZ_CP068419.1; note = Gluconobacter sphaericus
MKNQAPHSITDRFNRSAIENFDLIQILSEETGFLSSDIKRIIHSAPKSYKTYEIPKRTGGKRIISQPAREVKILQRVIIEKVLSHLPIHQFATAYRPGISILNNALPHKGAGRSILKMDFENFFPSIKSHDWITYCEELEILSNEDRALTASLFFKSQPPKRGLRLAIGAPSSPILSNILMYEFDKKIEKEIYGKEIIYTRYADDLTFSSERTGYLLDVRSIVRKALMEIKYPKLKINKEKTKYFTSKYRRSVTGLVLTNQGEVSLGRDKKRSISAGIHNALNGKLNDEEMKSLSGYLAYANSVEPNFLKKMSEKYGDDIMKTLKKFGNPEVNIKI

SEQ ID NO: 4473 - protein, 315 aa, unidentified
  source 1..315: note = Related to JAEULJ010000003.1; note = Altererythrobacter sp.
MSDLIALFVHETGLGEHDIRKIVATAPARYKTYAIKKRNGIDRRIISQPARELKLLQRTLIDAVLKNLPVHRSATAYRTGMSIIDNVRPHINSGAILKLDFSDFFPSLRESDWREYCVRNEIFRSEEDIEVSGLVLFKKERQRRELRLSIGAPSSPIVSNILMFDIDSEIESKIVSEEVVYTRYADDMTFSARRTGFLNKVEKNVREILRGSQSLRLQLNDDKTVYATKKYKRQVTGLIITNDATVSVGRERKRNLMAAIHAALSGKLSGDQVRETLGMVSFVISVEPDFKKRIERKNGEDALALLSKLASTKGT

SEQ ID NO: 4474 - protein, 310 aa, unidentified
  source 1..310: note = Related to NZ_JAINWL010000001.1; note = Proposed Citromicrobium bathyomarinum
MGSLYDLLKRETALPDRDLQKIIATAPARYKTYKIPKRNSEKMRVISQPAKEVKLMQRVLMREFLSNFPIHKAATAYKSGSSIRDNAAAHVGRGPILKFDFKDFFPSITENDWRKYAEGRGIAELDIEISTKIFFKKEFNRSLLRLSIGAPSSPILSNILMFGIDERISAEIASDEVSYTRYADDITFSAPRTGYFNGLERHLRMILREIEYPALKINSEKTVYATSKFRRQVTGLVLTNDGQISVGRDRKRNLFAAVHHALNGRLNDEQIEEVLGLIAFVSSIEHDFKDRLEKKYGPEVVRRLYRCKQN

SEQ ID NO: 4475 - protein, 325 aa, unidentified
  source 1..325: note = Related to QFOF01000021.1; note = Azospirillum brasilense
MMSWITRMLALHTGLQESAIHRIMVTAPVRYKTFFIPKRNGELRQISQPAREVKLVQRAFSEIILKKLPVHPCATAYIDRKSILHNAQPHAGHGQIVKMDFKNFFPSIRRVDWIHYCQENSIFDSQIDADLSSSLLFQKNKNSGLMRLAIGAPSSPILSNILMYNFDYLVSKAVLKDHVTYTRYADDMTFSAPRTGHLVNVVRIVKSVCRSLNYPRVEINENKTVYATAKYKRAVTGLILTNDGRVTIGRDQKRLIRAMVHHAINTNLTKEALERLAGNLAYINSVEPAFMETLTRKYGAENIQRIRCIWRKDSPKNSTSKKSLT

SEQ ID NO: 4476 - protein, 317 aa, unidentified
  source 1..317: note = Related to NZ_MLCO01000142.1; note = Roseomonas deserti
MSELVRKLAQETGVPEPLVREIMLTAPVRYKEFHIVKKSGGLRKISQPAREVKLLQRIATKILLNQLPVHPCATAYRINSGLLNNVKPHAKNSQILKLDLKEFFPSLRLVDWYQYCRRNFMNISSEDITLAGRLFFRKTPKKVSLRLAIGAPSSPSMSNILMYEFDTLVHKYCLTENIVYTRYADDMTFSAPRTGYLVGVIKNVSRIIRKLKSPNLEINSGKTVYATQKYKRSITGLILANNGSITIGRDAKRLTRARVHHAIKGRLTEDEIIKLSGYLSFIMSVEPSFVYTLQVKYGAHQINQILHASLTPKERIE

SEQ ID NO: 4477 - protein, 317 aa, unidentified
  source 1..317: note = Methylobacteriaceae bacterium; note = Related to JACKJE010000004.1
MDLLILETGLGERDVRAIAATAPIRYKTYEIEKRNGGKRLISQPARELKALQRVIVNEVLDKLPVHPAATAYRPSLSIKDNAKPHTVSGAILKLDFKDFFPSLREVDWESYCKQHNIFETPEDIHLSSRILFHRKKTASTLRLAIGAPSSPTLSNVLMFELDTHISKLVASDGITYTRYADDMTFSAPRAWNLVGTLRKVRKLLRDTASPRLQLNTDKTVLVTKKYRRVVTGLVISDDQRVSLGHERKRLLRAAVYRFIQGKLSIREQARLAGNLAFAYSIEPEFIQRLEDRYGTSTITDIKRAPRLLQSSGDNQNR

SEQ ID NO: 4478 - protein, 304 aa, unidentified
  source 1..304: note = Related to NZ_CP088280.1; note = Bradyrhizobium sp.
MKLSPWKQGWMWHLSRALCEVHPLDIEPIAFPNVSQPAVEVKALQRGLIEILLRDLPMHHAATAYRVGISIKDNAMRHAGNGPILKMDFKDFFPSIKPRDWSAYCKRTGVLSDSVDIHLTSLLLFQRPKGSSVLRLAIGAPSSPFLSNALMFDFDQAIAEAVAKDHVIYTRYADDLTFSAPRTGHLVNVEKIVRATLRALQYPRLTVNDDKTTRVTRKYGRKVTGLTLTNDGKISIGHKRKRLIHAAVHHASLGKLSPASLGELKGLLGFANSAEPQFINTLRQRYGAALIQRIQTFDIPKRAR

SEQ ID NO: 4479 - protein, 315 aa, unidentified
  source 1..315: note = Related to JAFKKC010000005.1; note = Hyphomicrobiales bacterium
MAAIIERLALATGMDVGLVGRVLRSAPVRYKTYLIPKRTNGFREISQPAVEVKALQRGLIEILLRDLPVHEAATAYRVGMSIKDNAQRHAGNGPILKMDFKDFFPSIKPRDWISYCTETGVLIDQTDIHLTTLLLFHRPKGTSGMRLAIGAPSSPFLSNALMFNFDKAIAEAVAKDHVRYTRYADDLTFSAPRTGHLVNVEKIVRSVLRGLEYPRLLVNQDKTTRVTRKYGRKVTGLTLTNDGRVSIGHGRKRQIRAAVHHASLGKLDERSLAELKGLLGFANSAEPQFVITLIEKYGADIIHQIQKSPNRPRKI

SEQ ID NO: 4480 - protein, 316 aa, unidentified
  source 1..316: note = Related to RJJT01000004.1; note = Rhizobium pisi
MMGKIVEALAIETGMDVGLVERIMRSAPARYKTYRIPKRTKGFREISQPAVEVKALQRGLIEVLLRNLPMHEAATAYRVGMSIKDNALRHAGDGPILKMDFKDFFPSIKPRDWSAYCKQTGVLMDPVEIQLTSLLLFQRPKDSSVLRLAIGAPSSPFLSNALMFEFDKAITEAVAKDHVVYSRYADDLTFSAPRTGHLVNVEKIVRATLRALEYPTLTVNDDKTTRVTRKYGRKVTGLTLTNDGKVSIGHERKRFIRAAVHHASLGKLSTASLGELKGLLGFANSAEPQFIGTLKERYGAELIQFIQTFDIPKREQ

SEQ ID NO: 4481 - protein, 318 aa, unidentified
  source 1..318: note = Related to NZ_FODE01000022.1; note = Paracoccus alcaliphilus
MSSNIVKALSLQTGMDVLLVERIIQTAPIRYKTYRIPKQAGGFREISQPAIEVKALQRGLIEILLRNLPLHEAATAYRTGMSIRDNALRHAGDGPILKMDFKDFFPSIRPADWSAYCEKTGVLTEADDVKATSLILFHRPKGSSIHRLAIGAPSSPFLSNALMFDFDKLVTDAVGRDHVRYTRYADDLTFSAPRTGHLVNVDRIVRAAIKSIDRPRLKINDDKTTRVTRKYGRKVTGLTLTNDGSVSIGRERKRLIHAAVYRASKGELDLPSLAELKGLLGFANSAEPAFIMTLRERYGDEVIKYIQRYRIPKRIPQQ

SEQ ID NO: 4482 - protein, 319 aa, unidentified
  source 1..319: note = Related to SRUN01000004.1; note = Mesorhizobium sp.
MVGIIELLAINTGMDTGLVERIMVTAPVRYKTYFIPKRHGGLRKISQPALEVKVLQRALIEVLLNELPVHDAATAYRTGMSIKDNALRHAGHGPIMKMDFKEFFPSIFARDWDQYCETTEVLTEPREIYLTTRLMFQRPRDSSLLRLAIGAPSSPVLSNALLFEFDEMLTAEVAKDHVVYTRYADDLTFSAPRTGHLVNVEKAVRTVIKAIRRPKLTINEDKTQRITTKFGRHVTGLTLTNDGEVSVGHERKRQLHAAVHRALHGKLDVIELGKLKGILGFVNSAEPEFIVTLRKKYGSKIIDSIQKTPVPLRPRPFKK

SEQ ID NO: 4483 - protein, 319 aa, unidentified
  source 1..319: note = Related to WUFV01000007.1; note = Rhizobium leguminosarum
MVGIVEILAIESAMDVGLVERIIRTAPVRYKTYQIPKRAGGNRTISQPAKEVKLLQRSLIDVLLRNLPVHDTATAYREGLSIKDNALRHAGDGPILKMDFKNFFPSITPFDWAEYCKESGTLTDPQDIHMTSLLMFQRPKGSSALRLGIGAPSSPFVSNALLYEFDKRVTAAVAKDHVKYTRYADDLTFSAPRTGHLVNVEKMVRSTLEGLKYPKLAINDEKTTRVTRKYGRKVTGLTLTNDGQVSIGHKRKRLLHSQVHKASLNQLDVDEMVALKGMLGFVNSAEPQFLKVLTRRYGEGVLTRIRRFETEPAGRGTFN

SEQ ID NO: 4484 - protein, 316 aa, unidentified
  source 1..316: note = Related to RPJK01000002.1; note = Sinorhizobium medicae
MAGIIEMLAIETAMDTSLVERIIRTAPIRYKTYQIPKRSGGYRTISQPAKEVKLLQRALIDVLLRKLPVHDTATAYREGLSIKDNALRHVGDGPILKMDFKDFFPSIRPGDWAEYCKETGALTDAQDIKLTSFLMFQRPKGSSTLRLAIGAPSSPFVSNALLYDFDNRITAAVAKDHVRYTRYADDLTFSAPRTGHLVNVEKLVRSTIHGLKYPKLMINAEKTTRITRKYGRKVTGLTLTNDGQVSIGHDRKRLLHAQVHRASLNHLDADELLNLKGMLGFVNSAEPHFLEVLRRRYGDAVLTRIQRYEVEPPQKP

SEQ ID NO: 4485 - protein, 315 aa, unidentified
  source 1..315: note = Related to NZ_KI912610.1; note = Mesorhizobium ciceri
MSDIVRILAIETGMEMSLVERIIRTAPVRYKTYQIPKRSGGHRTISQPAREVKLLQRALIEVLLRRLPVHEAATAYREGMSIRDNALRHVGGGPILKMDFKDFFPSIRPHDWVEFCKETGAISDLVDIQLTSLLMFQRPKRSSTLRLAIGAPSSPFVSNALLFEFDKRISEAVAKDHVIYTRYADDLTFSAPRTGHLVNVEKMVRSTLRGLGYPKLTVNNEKTTRVTRKYGRKVTGLTLTNDGKVSVGHARKRLLHATVHRASQDKLNSTELGVLKGMLGFVNSVEPQFIEKLRERYGSALIGRIQAYDIPKRKW

SEQ ID NO: 4486 - protein, 318 aa, unidentified
  source 1..318: note = Related to NZ_WOAC01000018.1; note = Mesorhizobium sp.
MSIIDILSFESGLEATTVERIIRNAPLRYKTYQIPKRSGGSRTISQPAREVKVLQRALSDVLLRVLPVHEAATAYRPEMSIKDNALRHAGDGPILKMDFKDFFPSIKPRDWTLYCKETGALTDPVDVRQTALLLFQRPKGSAVMRLAIGAPSSPFVSNALLYEFDKRIAAEVARDHVTYTRYADDLTFSAPRTGYLVNVEKMVRTTLAGLEYPKLLINGQKTTRITRKYGRRVTGLTLTNDGRVSIGHERKRILHAQVHSATKDLLDNDQIAELKGMLGFVNSVEPQFLDVLRRRYGHSIITFIQRFESNPPTLDLLE

SEQ ID NO: 4487 - protein, 356 aa, unidentified
  source 1..356: note = Related to JAJAVB010000031.1; note = Aurantimonas sp.
MAGDGNRLLERERPGQVQQHPSGFEGRNAMSGIIETLAVETGIEPGLVDRIVRTAPSRYKTYPIDKRGGGTRLISQPAKEVKILQRALNDVLLKHLPVHASATAYRESLSIRENALPHAGIGPILKLDFAEFFPSIKLHDWKKYCEKTGCLTDVHDVEMSGRLIFHRPKGRSTLQLAIGSPCSPFVSNALMHEFDFLVVEAVAADKVVYTRYADDLTFSAPRLGHLRDVEKIVRRILRGLSFPRLRLNINKTTYVTSKFGRRVTGLTLTNAGGVSIGHARKRKLHTAVYRASQNNLNADELAELKGMLGFAHSVEPEFIEILRRRFGNDIVSFIQSYPIERKRSAKVIAVEPDETR

SEQ ID NO: 4488 - protein, 327 aa, unidentified
  source 1..327: note = Related to NZ_MKIN01000018.1; note = Rhizobium taibaishanense
MTNLLRSMAIETGLSEVIVQRIMQSAPNRYKHYSIEKRSGGKRLISQPAIEVKLLQRAFVSLYLSKLPVHAAAIAYRPNKSILDNALPHVSSGSILKMDFKDFFPSIRKAHWMNYCAEFGIFETQSERELAASLLFHRPKGSSVMQLAIGAPSSPTLSNVLMYKFDEIISSEVATDKVIYTRYADDLTFSADRSWNLVDVERIVKKTLQNISYPKLQLHPSKTIHVTKKFSRSVTGLILANDGRVTIGKKRKRIIHAATHAASLGRLDDRQLQKLAGMLAFVHSVEPSFIALLERKYGFETIKGLQKIGANDRRNLRAAVGEADFGT

SEQ ID NO: 4489 - protein, 321 aa, unidentified
  source 1..321: note = Related to JALBGV010000046.1; note = Neorhizobium sp.
MVSLLRAMAIETGLSEVVVQRIMQSAPHRYKQYKIDKRSGGKRLISQPATEVKLLQRAFVELYLSKLPVHPAAMAYRPNLSIFDNATAHAGSGSILKMDFKDFFPSIRKANWMSYCAEFSILENHSERELAASLLFQRPRSSNAMQLAIGAPSSPALSNVLMFQFDEIISAGVAKDKVIYTRYADDLTFSADRSWNLVDVEKTVKRALREIAYPRLQLHPDKTTHVTKKFSRSVTGLILANDGRVTIGKRRKRAIHAATHAASQGRLDDRQLQKLAGMLAFVHSVEPGFIDVLERRYGLETIMRLQTIGAKDRRNLRPPDA

SEQ ID NO: 4490 - protein, 326 aa, unidentified
  source 1..326: note = Related to JAFJZW010000005.1; note = Agrobacterium rosae
MASFLRTMAVETGLSEVVVQRIMQSAPHRYKHYEIDKRSGGKRQISQPATEVKLLQRVFVELYLSKLPVHPAAMAYLPNKSILDNANAHAEAGSILKMDFKDFFPSIRKASWMSYCAEFSILENHAERDLAASLLFQRSKGSGAMQLAIGAPSSPALSNILMFQFDEVISSEVSKDKVVYTRYADDLTFSADRSWNLVDVEKTVKRALREIAYPRLQLHPDKTIHVTKKFSRTVTGLVLANDGRVTIGKRRKRAIHAATHSASLGRLDDRQMQKLAGMLAFVHSVEPAFMGVLERRYGSETIMRLQTVGSRDRRNLRPINETLDKK

SEQ ID NO: 4491 - protein, 328 aa, unidentified
  source 1..328: note = Related to NZ_LANJ01000022.1; note = Devosia epidermidihirudinis
MVTLLRAMAIETGLSEVIVHRIMQTAPHRYKQYTISKRSGGKRLISQPATEVKLLQRAFVDLYLSKLPVHPAAMAYRTSLSISDNAKAHAGSGSILKMDFRDFFPSIRKASWMTYCAEFSILDNSFERELSASLLFQRPTGSHGMQLAIGAPSSPALSNLLLFQFDEIISAEAAKDKVKYTRYADDLTFSADRSWNLVDIERTVKRVLREIAYPRLRLNPDKTIHVTKKFCRNVTGLILANDGRVTIGKKRKRTIHAATHAASQGRLDDRQLQKLGGMLAFVKSVEPAFLDVLRRRYGFETIMKLQTIGAKDRRNLRPQIDAVEISGG

SEQ ID NO: 4492 - protein, 328 aa, unidentified
  source 1..328: note = Related to NZ_CP013068.1; note = Pannonibacter phragmitetus
MVSLLRTMAVETGLSEAVVQRIMQSAQHRYKQYYIDKRSGGKRLISQPATEVKLLQRAFVDLYLSKLPVHPAAMAYRPGRSILDNASAHADSGSILKMDFKDFFPSIRKASWMAYCANHSLFDSQSERELSASLLFQRPKGASSLQLAIGAPSSPALSNVLMFQFDEIVTGEVSKDNVTYTRYADDLTFSAERSWNLVDVEKTVKRALREIAYPRLVLNTDKTTHLTKKFGRSVTGLVLANDGRVTIGKRRKREIQAATHAASLDRLDARQMQQLAGMLAFVNSVEPDFLGVLERRYGIETIMRLQKVGAKDRRNLRPQTLEEDAGHL

SEQ ID NO: 4493 - protein, 315 aa, unidentified
  source 1..315: note = Related to VRUZ01000039.1; note = Methylobacterium sp.
MSALVAKLVLATGIDQSSVRRIMLSAPRRYKSYYIAKRNGGLRKISQPAREVKVLQRALIDLLLSDLPVHRTAMAYRVGTSIKDNANAHKTSGPIIKIDFTNFFPSIKRSDWADYCQKTGCLNDPTEIGLTSSLLFQYQKEHASQRLAIGAPSSPMLSNILMYEFDSEIESRLQGTRIVYTRYADDLTFSAPRTGYLHDVMKIVRETMRAIPYPRLKINPDKTTYVTTKYRRSVTGLTLSNDGRVTIGWRKKRELHAAVHNAKLDKLNAKGLQALAGYLAFVQSVEPSFLSVLRNKYGTEIIMKIKAANVKKALR

SEQ ID NO: 4494 - protein, 325 aa, unidentified
  source 1..325: note = Related to NZNS01000009.1; note = Parvibaculum sp.
MSQLLDKLSFETGMRANELRRIMYTAPNRYKIYSIPKRVGGFRSIAQPAREVKLLQRTLAKTFLTTLPTHAAATAYKPETSLRSNALPHAGRGPVLKLDFRDFFPSIRDRDWIAYCRQTGCLTEDEDIYLTSRLLFHRRKGESHLRLAIGAPTSPILSNILMYEFDVRVVETVVADGVTYTRYADDMTFSAQRTGNLTHVIRDVGRVLRDIQYPRLALNPEKTTLVTAKYGRRVTGLTLANDGRVTVGRDSKRKIRAAVYQAVNGRLDPEQMQVLTGMLAYVNAVEPEYLDVLRRKFGTQAILKIQRAPRGEKIRRRSPALAQNR

SEQ ID NO: 4495 - protein, 328 aa, unidentified
  source 1..328: note = Related to NZ_LWMO01000047.1; note = Rhizobium anhuiense
MTELLRQLSTETGLAESAVRRIIANAPERYKVYHILKKNGGKRKIAQPARELKLLQRALVELLLSKLPVHPAATAYVKGRSIRDNAERHCHSGPVLKMDFKDFFPSITDRDWAAYCSQTGCLTDAEDIRLTSLLLFHRPVGGRVLRLAIGAPSSPIVSNLIMFPFDAMISEVVAVDHVIYSRYADDLTFSGPRTGHLTGVARSVKRALREIPFPTLKINAEKTTYVTMKYHRQITGLTLANDGRVTIGRDNKRALRAQLDHYSKGTMPKADVPRLAGRLAFVKSAEPSFFLNLLENHGWERIQEILRQSNQKARRAKPLASDENDFAG

SEQ ID NO: 4496 - protein, 325 aa, unidentified
  source 1..325: note = Related to JACHZB010000001.1; note = Rhizobium sp.
MTELLKQLSIETGLVESTVRQIIANAPERYKTYHISKKNGGTRKIAQPAREVKLLQRALTALLLSKLPVHPAATAYVKGRNIRDNAELHCHSGPILKMDFKDFFPSITARDWAAYCTRTNCLADPEDIRLTSLLLFHRPAGGRVLRLAIGAPSSPIVSNLIMFPFDQMISEAVAVDHVIYSRYADDLTFSGPRTGHLTVVAKAVKNALKEIQYPSLKLNPEKTTYATMKYHRQVTGLTLANDGRVTIGRDRKRALRAQLDHYYKGILPLKEIPRLAGNLAFVRSAEPSFFFKLVERHGYQKIHDILRQSNRKNKKLPSGRNESPI

SEQ ID NO: 4497 - protein, 326 aa, unidentified
  source 1..326: note = Related to SGNZ01000005.1; note = Agrobacterium salinitolerans
MREMTDLLKRLSVETGLPESTVKSIISNAPERYKEYLIHKKNGGYRKIAQPARELKLIQRAFIDIVLSKLPIHSAASAYRRGKNIRDNAMPHSHSGPILKMDFKDFFPSITERDWSAYCQQTGCLTDPGDIRLSSLLLFHKPSGGRILRLAIGAPSSPILSNVIMFQFDEAISNAIAKHQVIYTRYADDLTFSAPRTGHLNSVAKAVKNALKEIPYPQLKINHEKTTHVTMKYHRQVTGLTLANDGRVTIGRDHKRSLRAQLHYFINGKLDEAETAHLAGKIAFVKSVEPEFYFSLLEKLGAEKINFLLSKSNRKKLSLKKSPKLN

SEQ ID NO: 4498 - protein, 326 aa, unidentified
  source 1..326: note = Related to NZ_FMAG01000002.1; note = Rhizobium multihospitium
MTDLLKQLSIETGLPEYTVKSIISNAPDRYKEYYIKKKNGGSRLIAQPARELKLIQRAFVDILLSKLPVHSAATAYRKGKSIRDNALPHSHSGPILKLDFKDFFPSITESDWVAYCKHTKCLTDPNDVRLSSLLLFHRPSGGRLLRLAIGAPSSPVLSNIIMFPFDEAISAAVAHDHVIYSRYADDLTFSGPRTGHLTGVSKAVKKALREIPYPTLKINHEKTTHVTMKYHRKVTGLTLSNDGRVTIGRDNKRTLRAQLHHYLSGKLNESEVAHLAGRIAFVKSVEPSFYFTLIERHSDRVIQMLLTKSNQKHAKEKRQPISFEGG

SEQ ID NO: 4499 - protein, 315 aa, unidentified
  source 1..315: note = Related to JACVBP010000001.1; note = Ensifer sp.
MSEIIEKLVAASGLNPFVVRRILATAPRRYKEFSVPKRNGGKRKIAQPAKELKILQRAFVDEFLSELPIHPAATAYRAETSIKDNAERHAGFGPILKMDFKDFFPCITDRDWEHYCQRNNLFEDPLERRLSTLLLFHRPKGGSKLRLAIGAPSSPTLSNVLLFEFDRYISELVAPDKVLYTRYADDLTFSAPRTGHLTGVKRAVSRAINHVDFPTLRINREKTTYITTKFHRSVTGLTLANDGRVTIGRDKKREIRASVHRFTLGKLDEDSIERLHGYISFINSVEPEFIDVLTKKYGSGMMQNLRDASVAIRRA

SEQ ID NO: 4500 - protein, 305 aa, unidentified
  source 1..305: note = Related to JACGXN010000001.1; note = Phyllobacterium myrsinacearum
MSEYSIRKILATAPERYKEYRIPKKSGGYRDIAQPAKELKILQRGFANNFLMKLPIHHTAMAYRHKQGIRDNAQRHAGFGQILKIDFKGFFPSIRVEDWRSYCAATGFLIEAEDIDLSSLLLFHRARGTRGLRLAIGAPSSPILSNILMYEFDQRVSEIVAQDKVIYTRYADDLTFSAPRTGYLLDVKKNVSKILDELQFPRLEINHKKTTHVTTKYHRVVTGLTLANDGRVTVGRERKRLIRATIHAYIQGRLVAEDVGRLAGLIAFVKSAEPEYFGLLKHQYTPEKIIEILKWSSGTLNLFDD

SEQ ID NO: 4501 - protein, 315 aa, unidentified
  source 1..315: note = Related to NZ_CP043489.1; note = Labrys sp.
MKFLIQESGLSEQTIKRIAIDAPQRYKAYEIKKKNGGVRQIAHPARELKILQRAIVKHVISGLPVHDAAMAYRKGRNIRDNAKRHAGTSIILKMDFKDFFPSIKAQDWHQYCEDNRILTSSEDIWLTSQILFYRARGTRLLRLAIGAPSSPALSNALLYDFDKRVTELVSQEEVVYTRYADDLTFSAARTGYLTGIQKLISRALREMETPKIKLNHKKTTHVTTKYSRNVTGLVLSNDGRVTIGRERKRKIRAMIDHFIKGRLNNRQKAHLSGMIAFAKSAEPEYYTYISEKYNNVLREILNSRAKKTCRIEASR

SEQ ID NO: 4502 - protein, 325 aa, unidentified
  source 1..325: note = Related to NZ_CP073063.1; note = Brevundimonas diminuta
MTPLIRALSASSGLSAADTLKLVKDAPDRYKIFDIDKRRGSEKRKIAQPAAEVKYLQRIVVEILLSRLPVHSAATAYIKGGSLRDNAAPHAGVGRPILKMDLKQFFPSIRSRDWESYCSDNEVFSDAQDAYLSSRLLFHRPPGGRVLRLAIGAPSSPMMSNILMYEFDKRISAAVEEDEVTYTRYADDLTFSARRTGYLVDVRKRVYRVVRELNYPKLDINRSKTVYATSRYHREVTGLILSNDGRVTIGRDKKRVIYSMVHRYLKGGLNGAEIQHLAGILAFVKSAEPDFLLNIDRKYEIGTVSDIAKTAGRIHVSDRQSYWQS

SEQ ID NO: 4503 - protein, 325 aa, unidentified
  source 1..325: note = Related to JAHCDM010000009.1; note = Roseococcus sp.
MLTQYLAQATGLSTLEIERIARSAPRRYKDYMIPKANGGHRLISHPAREVKALQRALVEWLSDKFPVHHCATAYKKGGSIALNADQHAQNGPIMKMDFRNFFPSIKSHDWIKFITENNFPLNEFDRELTRTILFHKRPSMPDLRLAIGAPSSPFISNIMMYDFDCYVHDKTKAEKITYTRYADDLTFSSARAWNLRDVEPIIKKAVRDHAFSKLEINNEKTRVVTTKFRRIVTGVTLANQGHISVGRNAKRELRAIMSRLSLRQTPKQNPSQIVGILGFLGSIEPKYLQSLKEKYGKDTFDFLYSLAGDLRTDNRQGQADAATED

SEQ ID NO: 4504 - protein, 322 aa, unidentified
  source 1..322: note = Related to NZ_JXMU01000014.1; note = Ahrensia marina
MSKIIRDLVLETGISASTLQVIINSAPESYKVFSIPKKTGGTRIIAQPSKQLKIIQRALIEVLLHDFPIHEAAKAYVKGSSIRVNADQHAGSQPIQKYDFSDFFPSITSSDWRKYCDHNQVNLSTADLHLCTKILFRRAHGERTLRLSIGAPTSPILSNILMFDFDKKISEKLAGDEVKYTRYADDLTFSAPKTGYLNAVPRALRECIQEIQFPTLKLNAKKTAKITAKHRRIVTGLTLANDGRVTIGRDKKRLIRSKVHKFKLGQLDRLALDKLTGELAYINAVEPEYISVLKRVYGDECISKITRNKPLRKYTPPSRNGS

SEQ ID NO: 4505 - protein, 303 aa, unidentified
  source 1..303: note = Related to FOBJ01000004.1; note = Variovorax sp.
MLGANDLLSQMSSDFGMLPNHLQSIVRTAPIRYKVFYIPKRSGGLREVAQPAREVKAIQRWLMAHFGPLLPLHEAATAYRPGASIKNNALRHVDSDYLLKMDFRNFFPSILMTDIIRHLKIHCGQQYDASAIKLIAYVCTWAPGRQGPLRLCIGAPSSPLLSNSVMFDFDTQLSSVAAADGVRYTRYADDLALSVCRSGALKNYPSLVSKIVADLKYPQLKLNEGKTVFASRAGRRVVTGVTLTADHQLSIGRTRKREIRAMYHRMVLGKLSAEEQRELAGLIAFADDIEPGFAAWLSSPKKL

SEQ ID NO: 4506 - protein, 305 aa, unidentified
  source 1..305: note = Burkholderiales bacterium; note = Related to JAFKGB010000002.1
MLSANDLLSQMASDLGMLLSHLQSIVRTAPIRYKVFHIPKRSGGLREVAQPAREVKAIQRWLTAHLGQLLPLHEAATAYRTGASIRSNALQHVDSDYLLKMDFKNFFPSILITDIIQHLEVYCGRQYDSSAIKLIAYVCTWAPKRQKPLRLCIGAPSSPLLSNSIMYSFDMRLSSAAAADGICYTRYADDLTLSTHHPRVLANYPALVADIAASLNYPRLKLNEKKSVFASRSGRRIVTGVTLTPDRHLSIGRIRKREIRAMYHRMTLGQLNQEEQRELAGLIAFANDVEPGFAAWLSGSKKLET

SEQ ID NO: 4507 - protein, 303 aa, unidentified
  source 1..303: note = Related to NZ_NRRT01000126.1; note = Rubrivivax gelatinosus
MLRANDLLHQMSSDFGMLTSHLHGIVRTAPIRYKVFYIPKRSGGLRELAQPAREVKAIQRWLMERLEPLLPLHEAATAYRAGASIKSNALRHVESDYLLKMDFTNFFPSILMTDIVRHLETHCGQQYDASAIKLIAYVCTWAPKRQGPLRLCIGAPSSPLLSNSVMFDFDRRLMDFAAHDQITYTRYADDLSLSARTSGALNAYPKLVAELTESLEYPKLALNTKKTVFASRAGRRIITGVTLTSDHQISIGRARKREIRAMHHRMTMDQLNLDEQKRLAGLISFAEDIEPGFSAWLTKTTEA

SEQ ID NO: 4508 - protein, 303 aa, unidentified
  source 1..303: note = Candidatus Accumulibacter sp.; note = Related to JAFLDL010000016.1
MLCANDLLLKMSSDFGMLAGHLQSIVRTAPIRYKVFYIPKRTGGLREVAQPAREVKAIQRWLIKRLKPLLPLHDAATAYRSGASIKKNAQRHVESDYLLKMDFRNFFPSILMTDIVRHLEIHCGQQYDPSAIKLIAYVCTWAPKRQGPLRLCIGAPSSPLLSNSVMFDFDKQLSSAAASDSVTYTRYADDLALSSRTSGTLNNYPGLVAKLAGSLNYPQLELNERKTVFASRAGRRVITGVTLTADRQTSIGRKRKREIRAMYHRMILGKLSPDEQRELAGLIAFADDIEPGFSAWLSKSIDT

SEQ ID NO: 4509 - protein, 303 aa, unidentified
  source 1..303: note = Related to FP475956.1; note = Thiomonas arsenitoxydans
MLSQADILQRMAADLAMLPSHLAKIIQTAPLRYKLFEIQKKSGGRREVAQPAREVKAIQRWLIRELGPRLPVHECATAYREGSSIRKNAEAHASSRYMLKLDFTNFFPSIVRSDLHAHLDRHCSDYLDPSARKLIAHVSCWARHREPPLRLCIGAPSSPLLSNSLMFEFDNRLAAVAKDDGVVYTRYADDITLSSRDRGKIDRYTEIVQTLLESLQYPKLTLNEGKTVLASRAGKRVVTGLILTPEGSVSIGRDRKRLIRAMYHRSLTKQLDSKETQVLAGLIAFADSIEPGFSQRLKGSVRP

SEQ ID NO: 4510 - protein, 302 aa, unidentified
  source 1..302: note = Related to WWER01000012.1; note = Pusillimonas sp.
MQREPDIILQMAADLGMLPSHISLLIRTAPLRYKVFYIPKKSGGMREVAQPAREVKTIQRWLIRYLKDRLPIHEAATAYTTGSSIRANAAAHCHSRYLLKLDFSNYFPSIVKHDIQMHLERYCADFLGESARELIAQTCCWMPRREHPLRLCIGAPTSPMLSNSVMYDFDRLLGNIANDEHVTYTRYADDITLSAEEPGKLDRYVEVVMQLLRDLAYPRIELNMAKVVRASRASKRVVTGLVLTPSGSISIGRDRKRLIRAMFHRKIQGKLNAEEAQVLEGFVAFAENIEPGFRKRLERSML

SEQ ID NO: 4511 - protein, 303 aa, Achromobacter sp.
  source 1..303: note = Related to CYTI01000014.1; note = Achromobacter xylosoxidans
MTSLLDDMAIAFGMPRKRLLNIIRTAPLRYKVFFIKKKAGGLREVAQPAKEVKAIQRWLMSSLAEHLPLHSAATAYTPGSSIKRNAEAHLGSQFILKMDFENFFPSISEDNIKAHLRNFCSDYYTENDIAIIARACTWARKRSPPLRLCIGAPSSPLLSNSVMFSFDDMLFQHANQDEVIYTRYADDLTLSSSHPDVLKEYPKIVAGILEKLAYPALSINQRKTVHASKAGNRTVTGLVLASDDKISIGRERKRLIRSMYHRYKTGKLDPELIPKLFGLLNFAEDIVPGFRANLERGYENVDI

SEQ ID NO: 4512 - protein, 309 aa, unidentified
  source 1..309: note = Related to NZ_JAJEJQ010000001.1; note = Paraburkholderia sp.
MAYPDLLRKMAGDLGMLPRQLASIIKTAPLRYKVFAIPKRDGSPRVIAQPAREVKAIQRWLINELRPQLPVHEDVMAYEPGTSIKKNAERHLGSRFMLKMDFSNFFPSISAEALHMHLESYCGNTYTLVDRQLIVRACTWLPQRTRATALQLCIGAPSSPLLSNSVMYEFDCAVSEKAQSEGVVYTRYADDITLSTTERGILSEYADFVSDTLATLAYPRVTVNRRKTVHASRAGLRMVTGIVLTPDGGLSVGRDRKRLARSMFHRRTLGLLTADESAELDGLLAFIDSVEPGFSATLRTSLLNKKPHP

SEQ ID NO: 4513 - protein, 310 aa, unidentified
  source 1..310: note = Related to NZ_UWYX01000002.1; note = Burkholderia gladioli
MAHADILLRMAADFGMLPTQLASIIKTAPLRYKVFEIPKRDGSPRTIAQPAREVKAVQRWLINELRPHLPIHDAVMAYEPGTSIKKNAETHLRSQFLLKMDFSNFFPSISAEALRLHLELHGGSRYTLADRHAIVRACTWLPERTEWTSSLQLCIGAPSSPLLSNSVMYEFDCVIAEKAQFDGVTYTRYADDITFSSNERGILTLYSDFVNDTLGKLVYPRITVNGSKTVHASRAGRRVVTGLVLTPDGQISVGRDRKRLARSMFHRKTLGLLSAEEAAELDGLLAFIDSVEPGFSDRLRDGTRNSQQHP

SEQ ID NO: 4514 - protein, 307 aa, unidentified
  source 1..307: note = Related to QTRZ01000002.1; note = Burkholderia cenocepacia
MAHADILARMANDLGMLPGQLANIIKTAPLRYKVFTIPKRDGTRRTIAQPAREVKAIQRWLINELRPQLPIHDAVMAYEPGTSIKKNAEMHLRSQFILKMDFSNFFPSISAEALRLHLELHCGNRYSLADRHSIVRACTWAPERAPTLQLCIGAPSSPLLSNSVMYEFDCAIAQKAKSEGVTYTRYADDITFSATERGILAPYFIFVKEMLQQLAYPKITINERKTVHASRAGRRVVTGLILTPDGKISVGRDRKRLARSMFHRRALGLLSADESIELDGLLAFIDSVEPGFSDRLRAAARNSRPHP

SEQ ID NO: 4515 - protein, 309 aa, unidentified
  source 1..309: note = Related to NZ_JOMH01000001.1; note = Polycyclovorans algicola
MRNSRIFQEMAEALGMLPGHLEKIVRTAPLRYKKFSIPKRDGTPRLVAQPAREVKLIQRWLISNLRDHLPVHPSATAYEKGSSIVINASAHQESNYFIKMDFQNFFPSIKGKDIDLHLQSLSRINLSQEDRDVVVRSCTWAPHRIPPLELCIGAPSSPVLSNSILFEFDCAVESYLIEEKLPVRYTRYADDLTFSSLSGGWLHDVRNQVKMIVRGLEYPKLRIKEEKTVLGSRAGRRVVTGLVLTPDKKLSVGRERKRTARAMYHRFWKGELDESEVMQLEGLLAFVESVEPGFKSRLQDYYRKKNPAA

SEQ ID NO: 4516 - protein, 309 aa, unidentified
  source 1..309: note = Related to JACVAP010000002.1; note = Xanthomonas sp.
MDKLESSHLIRVLSLESGLLPEQVANIVRTAPFRYKSFKVKKRTGGLRQLAQPAKEVKWIQSRVVDFLRPLLPMHDAVNAYEVGSSIKKNAGIHASSRFLLKMDFSNFFPSILESDIVAHINCFAPSISEVDAFVITRSCMWANGRKFPLQLCIGAPSSPFLSNSVMYSFDDLISKKAAERDITYTRYADDLTFSSRREGILADFQSMVEVVISEILYPRLKLNTAKTLHASRAGRRVVTGIVITPEGELSVGRDRKRLVRAMAHRDSMSQLDSDGVDKLEGLINFIDGIEPGFAQKARRWRNKKVAGA

SEQ ID NO: 4517 - protein, 302 aa, unidentified
  source 1..302: note = Related to PBYA01000036.1; note = Salinisphaera sp.
MKISESQLFGRMCQDLSLQSESLKRIISTAPLRYKKFRIPKRSGGWREVAQPAREVKKLQYWIIRELGDILPVSDHATAYRDSISIKNNALVHDGSNYLLKMDFASFFPSIKFSDLSQHLSKYVKELTADDIGVIALTTLWTPNREPPLRLCIGAPSSPLLSNSILFDFDALVSKSLPDSVKYTRYADDLFFSTQESNQLSYVERLVRETVHELAYPALSFNDNKTVNVSRNSRRSVTGVVLKPDGGLSVGRERKRIARAMCHKLSIGRLSADEEAKLRGLLAFISSIEPRFAERLKSKYSI

SEQ ID NO: 4518 - protein, 308 aa, unidentified
  source 1..308: note = Related to JAIOAJ010000071.1; note = Stenotrophomonas maltophilia
MDGLISNVAALVGVSSASCRRIANGAHRRYKVFTIAKRGGGRRVVAQPAREVKAVQRAVCQLLSENLPVHDSATAYKAGTSIAANAAAHAGAQFLTKLDFSDFFPSISGDLISDLLRRRCEHLTEAEIEFVVDVCTWRPDGRKVLCIGAPSSPLLANAVMFEFDCEAFEAASEMCVSYTRYSDDIALSSMVPDTLRQAETAVRRIIASRPALRVNERKRVAVGRGTSMVITGLTLTNQGGVSVGRSRKRGVRAGVNRYLLGELDEADTLKLKGEVAFVLSIEPEFRGVLVRTYGLRVWTLLPRMVAGG

SEQ ID NO: 4519 - protein, 307 aa, unidentified
  source 1..307: note = Related to NZ_MDEE01000039.1; note = Xanthomonas dyei
MIGLVSKVSSLVGVSTSSCRIIARGAYRRYKIFAIPKNNGGRRVVAQPAREVKAVQRAICQILSDKLEIHQSATAYKPGSSILANAAVHKGAKYLTKLDFTDFFGSIDGESIFHLVESRCPDLSAAELKFIVDACTWRPQGRAVLCIGAPSSPFLANAIMFEFDAKAFDLANRVDAKYTRYSDDIAISSLKPDLLKGLEENIRNLVRGSRLPYIRLNDQKRVAVGRSTSMSITGLTLTNQGGVSVGRERKRGVRAGVSRFFNGQLSPAEIAKLKGEIAFVLSIEPNFRGVLINTYGLRAWELLPKSQ

SEQ ID NO: 4520 - protein, 305 aa, unidentified
  source 1..305: note = Related to JADUKR010000001.1; note = Stenotrophomonas maltophilia
MNGLVAQVSQMAGISSSSCRLIARGAHRRYKKFTIRKKNGGIRVVAQPAREVKAIQRAICVILSEKLFVHASATAYKIGSSILSNAAAHAESRYLSKFDFSDFFPSIGADSLINLLAIRVPNLSEAEVRFVVDACTWQPNGRAELCIGAPSSPLLSNAVMYSFDENIFSALAEMGVSYTRYSDDISISSKREGILADAELLLRAAVARSRFPVLRMNEEKRVAVGRGVSMTVTGLTLTNQGGVSVGRARKRGVRAGVEKFVRFGATEVEFARLKGELAFVLSVEPEFRQVLIRTHGERILRLLPR

SEQ ID NO: 4521 - protein, 316 aa, unidentified
  source 1..316: note = Related to MIGM01000010.1; note = Xanthomonas arboricola
MIGLVSTVSFLAGISTDSCRRIAASAHRRYKVFTIPKKNGRDVRVVAQPAREVKAIQRAICAALNEYLHVHPTATAYVKGSSIIANAGMHKHCKYLTKLDFKSFFPSIDGESIERALRSKIADLSESEIQFVLNACTWRPEGRQVLCIGAPSSPLMSNAVMYDFDQLANIECRNMGVIYTRYSDDISISSEQPDKLSLAENRIREIIQIQSQPRLFFNDSKRVAVGRGTAMRVTGLTLSNEGKVTVGRTRKRGVRAGISRYMRGLVDEEALQKLRGEISFVLSVEPEFRKVLIRTYGISVVRILPPRIASKTGDIK

SEQ ID NO: 4522 - protein, 311 aa, unidentified
  source 1..311: note = Related to NZ_JQNL01000001.1; note = Luteibacter sp.
MSEFIDQVAASLGLSRGVCENIARTAHRRYKVFLIPKKNGRGFRTVAQPAREVKAIQRTLVLMLDQLLPVHPAATAYRPGSSILRNARAHVRAKYITKLDFEAFFPYIDRTSLGRHLRQHLSHLDGDDIAFILSACCWTPKGTTTQRLCIGAPSSPMLSNSIMHDIDSDIQTYCEEVGAVYTRYSDDICISATMPDVLAPLEQRIRHRIRESTRPTLTLNEAKRVAVGRGSAMNVTGLVLSNEGTVTVGRERKRGVRAGVMRYLKGALDLNETARLKGELAYVISIEPGFRFVLAKTYGMEIQALLPSAGI

SEQ ID NO: 4523 - protein, 311 aa, unidentified
  source 1..311: note = Related to NZ_CP093547.1; note = Lysobacter gummosus
MIGLVSQVAEKVGISSQACRRIASSAYLRYKKFVIPKSNGRDFRFVAQPAKEVKAIQRALVEILGAYLPVHDSATAYRIGLSICDNARRHASAKFITKLDFSDFFPSIDAPALSAHLRAHIANISDAEVMFIMNACLWRPEGRQVLCIGAPSSPMLSNSVMFEFDTLISGLASQADVVYTRYSDDITVSSREPDKLRGIEIAIRKACATMSHPKLEINEKKRVAVGRGNAMRVTGLTLTNAADVSVGRLRKRGVRAGINRYVNGDLDDDQVERLKGELAFVLSVEPNFAEALLRSYGAMSLSKILPRKVLP

SEQ ID NO: 4524 - protein, 309 aa, unidentified
  source 1..309: note = Related to JACVAK010000003.1; note = Pseudoxanthomonas sp.
MNGDLLSFVVAQTGLSRQAVIRISETARHRYKVFSIDKKRGGKRIVAQPAREVKAVQRAIVAALSSRLPVHESATAYVPGSKLINNAIPHAGQKYLLKFDFENFFPSIDDSAIRKALSGETQNGFSQDDILLVVGSCLWRPPGSSLLGLCIGAPSSPFLSNAVMFEFDGIVSRLARELGISYTRFSDDVTFSGPDASSLSKMELGFRETCRELNAPKLVVNEKKRTFCSRGAAMRVTGLTLSNGGGVTVGRARKRGVRAGVDNYLRGTLDLKKVERLRGEVAFVISIEPLFRDVLIATFGDRVRDVLPS

SEQ ID NO: 4525 - protein, 313 aa, unidentified
  source 1..313: note = Related to JACVAG010000005.1; note = Pseudoxanthomonas sp.
MTLGLISAIASEAGISKGSALRVAVSAYKRYKVFKIKKRSGDGTRTVAQPAREVKAIQRAIVQFLSSRLPVHDAATAYVGGSSIYANANFHAGARYLLKMDFSNFFPSIRPLDIERHLLRHLGSEISPAEVSFVIQACIWRDPEMGGFGLCIGAPSSPFISNTILHEFDTSVRSVCDEYLAKYTRYSDDMTFSADGPDVLAEVERRVRAVVKEMRSPVLLLNENKRVAVSRSAAFRVTGLTLPNQGGVSVGRKRKRGVRAGVHKFVLGQLDAKGVEKLKGELAFVLSIEPEFRYVLVETYGGAIHQLLPGKWH

SEQ ID NO: 4526 - protein, 318 aa, unidentified
  source 1..318: note = Related to NZ_FUXP01000009.1; note = Lysobacter spongiicola
MTTRLVNRLSQQVGLPAGDIERIISSAPRRYKEFKIRKRSGSGFRDIAQPSRELKILQKAVVEELKPHLPIHDCVHGYVIGRGIKSNAAAHRKGRFILKMDFADFFPSIKPVDFRAHLRESLPDRYDDIEARQLELLLFWLKRGERTLRMCIGAPSSPSISNYLMYAIDSRITENCRLNAVTYTRYADDLTFSCGEEGILGEVEGAVSRIVGETVHPRLRINPDKTIHISRKQRRTVTGVNITPTGELSIGRDRKRLIRAMVHRHIRGLLDLRGQNELIGLLGFAHDVEPSFAQKMWASLKGAPALKRSRRVDYMLEG

SEQ ID NO: 4527 - protein, 312 aa, unidentified
  source 1..312: note = Related to NZ_CP041965.1; note = Xanthomonas arboricola
MTTNLVHLLSREVGLPISDIEKIIASAPRRYKEFKILKKNGRGVRDIAQPSRELKALQRAVVSKIAPRLPVHDCVHGYVLGRGIKSNAQSHLGGSFILKMDLSDFFPSIKPVDLRHHLNKFLPEEFDDVELRQLELILFWIKKGTSILRMCIGAPSSPLISNTIMFDVDLEIDNLCRQYDVKYTRYADDLTFSCSEKGVLSLIQRGVSLIVRSSKSPIIKINEEKTLHLSKRAKINVTGVNLTPDGSLSIGRERKRLIRVMAHHHSLGSLDAEGQNKLIGLLGFAFDIEPNFAMGVWGALAGAPKLLRTERR

SEQ ID NO: 4528 - protein, 308 aa, unidentified
  source 1..308: note = Related to VCME01000014.1; note = Xanthomonas hortorum
MSTPLVKLLSMSVGLTPTDVMRIISSAPRRYKEFLIPKNNGRGHRKIAQPSREVKLLQRALCESVLTGFPVHNAAHGYVRGRGIRTNAEAHQSANFILKMDFENFFPSMKPNDLRLHLQMYASTRFDENEVRQLELILFWLEKGSDSLRMCIGAPSSPMLSNTFLYSIDAQLTAVCDKSGVTYTRYADDLTFSSSEPNLLKEIQNETELIIGKADYPKLKINKDKTIHISKRQRRTVTGINITPSGKLSIGRGRKRLMRSMAHRHSQGILSTEDQKMLGGLIAFAADIDPGLAVDIKLSLLNHPPLAK

SEQ ID NO: 4529 - protein, 314 aa, unidentified
  source 1..314: note = Related to JAAAEX010000007.1; note = Stenotrophomonas maltophilia
MTTGLVQMLSQRSGLPQADIERIVASAPRRYKEFTIPKKSGRGLREIAQPSRELKLLQRIIVDAVLSRMQVHECAHGYVAGRGIRTNAAAHARSKYILKMDFKDFFPSLVPLDLRSYLQKHQPSGFTEQEVRQLEQILFWRKKGSNVLRMCVGAPSSPALSNALMYELDQSISDASSTRGVTYTRYADDLTFSSRQKDVLGSLLTEVIAIVSESKSPYLRINPSKTISISRGQRRTVTGVNITPDGRLSIGRESKRLIRSMVNYHASGKLDEEGQARLIGLIGFATDIEPDFSARMRIALLNSPPLLATPSRSV

SEQ ID NO: 4530 - protein, 311 aa, unidentified
  source 1..311: note = Xanthomonadaceae bacterium NML93-0793; note = Related to NTJG01000001.1
MTTRLASSLSKWSGFALPDVEHIIATAPRRYKVFTIPKKRGGLRQIAQPSRELKSLQVLLIGRVLHHLPVHDAAHGYVIGRGIKTNAQAHSKSNYLLKMDLRDFFPSIRPRDLRAHLKVQAEGYLTDEEVGQLCNLVFWRPKGQRGLRLCIGAPSSPFLSNTIMLGVDQKLAEVARSLGVLYTRYADDLAFSSNEADVLPALEARVIDVVEGSRFPKIFVNREKTVHISRAQRRMLTGLILNSVGDVSLGRDRKRLIRAMVQSSRYGRLDEKELEKLNGLLSFAHDVEPGFAMKMRARMALPQVDDGLGEV

SEQ ID NO: 4531 - protein, 320 aa, Nitrosomonas sp.
  source 1..320: note = Related to FODO01000031.1
MDLILQLANDLGLANRDILLIANSAPYRYKEYKIPKKKPNTFRDIAQPAREVKILQRWVIENVLTKLPIHNAATAYIKDRNIKYNAMLHAGNPFVLKMDFSNFFPSIVPKDFKTHLLRHLPNMYTEDEINLLLRILFWRNKKEERFQLSIGGPSSPNLSNSIMFEFDSLISDECNSLNIVYSRYADDLVFSSIDFDLLKRIHNQVAIYLKKIPYPKLTLNNDKTMFLSKRGNRTVTGVIITNDGSLSLGRDRKREISCQINWHKKGNLKRSDTLKLHGMLCFANDIEPGFIDRMRTKYGIDTIHELIHLDTSKDQKTIKI

SEQ ID NO: 4532 - protein, 307 aa, unidentified
  source 1..307: note = Related to NZ_BMMF01000004.1; note = Salinarimonas ramus
MKLLREVAIENGLAPEELIYIGPSLPSRYREFAIMKRDGTPRWIAHPARELKGIQRSIVRSLISQFPIHDSATAYRLGFNIRKNVEPHVRQEFIVKMDFANFFPSIRPHDLISYLSNTQFKLSDTEIKFLTHALFWKPKKASDLRLSIGAPSSPPLSNALLYDFDVHVDALCRVNQVKYTRYADDMTFSATNTQSLEVVHKQIVRFVKEMKSPSLRLNTTKTIWLSKAHRRNVTGLIVTPNGEISIGRDRKRLISAKLHHYSLGRLGVAETKHLHGLLAFANAIEPQFVDRMRRKYGVEVLALRHQK

SEQ ID NO: 4533 - protein, 317 aa, unidentified
  source 1..317: note = Related to NZ_RXOL01000001.1; note = Croceicoccus ponticola
MSLLSELIWATGLPQPELMRIITTAPSRYKVYQIPKRTGGWREIAHPARELKALQRLMLNKYLINFPVHQSAMAYVKGRNIGDNAAIHTDSNFFLKLDFERFFPNIKVKDWIRFLKNNNFQPFLSDEIPITSQILFWGSGHRKPQCLSIGAPTSPILSNILLYDLDVELSAHAQAMGVRYSRYADDITISGQTIDQIIAFESLVRQRIRHLASPKLKFNDSKRGVYGRSVKRMVTGLVVTPAGAVSIGRDRKRAISSLVHRFSLGQLDQDQLGYLKGMLGFAKANEPEFLDRLRAKYGDAVIDAATKLHLPPRNRKD

SEQ ID NO: 4534 - protein, 321 aa, unidentified
  source 1..321: note = Related to NZ_CP069354.1; note = Microvirga sp.
MRLLEELAINLGLGTAEIETIVETAPARYKVYDIPKRSGGTRTIAQPSRELKALQRYILSTKLVKFPVHKSAMAYLPGKNIARNAEEHLNGNILLKLDFENFFPSILVKDWESFAKKHPVQVIPVEDIKLYSKILFWGQRSRTPRCLSIGAPTSPMLSNLLLFTLDEQLDEAARKCSVNYTRYADDITVSGSTVEQVTAFEKLARKIVKSLRSPRLIFNEEKRGLYTRGQRRMVTGLIITPNGTLSIGRERKRTISAMLHKALLGELDLESTGHLKGLLGFSLANEPLFVNRMREKYGDAIVDRVLRLKLPERILQEGKQG

SEQ ID NO: 4535 - protein, 322 aa, unidentified
  source 1..322: note = Related to QRGO01000001.1; note = Undibacter mobilis
MSLLTELVQEFGLGQSDLLRIIDTAPARYSVYPIRKRNGGFRTIAQPSREVKAIQYYILEKKLGVFPVHPSAMAYVKGRNIRQNAASHASSGPILKLDFQEFFPSIGVRDWERFVKSHPVDAIDLSDLKYYSKILFWGQHRKSNVPKCLSIGAPTSPIISNILLYDLDVKMSALAELLGVVYSRYADDITVSGQCVDEVLEFERLARREVKSAKSPKLTFNEEKRGLYFRGQRRLVTGLVLTPTERVSLGRKRKRTISSLLHKSTLGQLDPKRRGYLKGLLGFSVANEPEFLGRLRRKYGDEAVNAALVYFVPKRIDQEALF

SEQ ID NO: 4536 - protein, 327 aa, unidentified
  source 1..327: note = Related to SALN01000219.1; note = Mesorhizobium sp.
MSLILELAEATGLSSGDIERVIRTAPARYKTYPIEKRSGGIRIIAQPSRELKVIQNYILKEKLKDFPVHSCAMAYEKGRNIFDNAASHVGSRVLMKLDFKDFFPSIKVKDWERFIAASSVETISPTEVYLYSKVLFWGEKRRSSVPKCLSIGAPTSPKVSNILLYDFDMTMSGKARSLGLSYTRYADDITISGDTVEQILLLEREAKQILRKMAHPKLTFNEAKRGIYSKGQRQMVTGLIVTPQAVVSIGRERKREISSLLHRSLLGQLDNDRRSLLKGLLGFCVANEPEFIGRLRRKYGNGAVNAAMKFHAPKRARVQPPPPPTLF

SEQ ID NO: 4537 - protein, 316 aa, unidentified
  source 1..316: note = Related to NZ_CP011479.1; note = Hoeflea sp.
MELVEAIGLSVADINHVIDTAPARYRVYPIEKRSGGERMIAQPSRELKAIQRFILREKLSSFPVHHCAMAYEEHRSIYANAQMHKNTRAILKLDFQEFFPSLKVADWEMLVSKLKPNAINISDIKLYSKILFWGQQKGSKFPRCLSIGAPTSPKMSNLLMFDFDSIVAEKAIEHGLNYSRYADDITISGDSTLKITTLERDIQKLVRSMKSPRLTFNEEKRGLYTKGQRRMVTGLIITPAKDVSIGRDRKRNISSMLHRDTLRKLDVDSRGQLKGFLGFCAAVEPQFIDRLRHKYGDAAIDRAMKYHTPKRSINET

SEQ ID NO: 4538 - protein, 318 aa, unidentified
  source 1..318: note = Related to JAHBYX010000006.1; note = Mesorhizobium sp.
MSLLLELVQHTGLSAAELRRIIQTAPKRYRAFPISKRNGTERIIAQPSREVKELQRYLLDQKLTGFPVHDSAMAYEAGTSIRKNAYRHKNGNYILKLDFKEFFPSIKPRDLENLIRRSKREEIAVSDIPIYLKILFWGGLDKSTIPQCLSIGSPSSPRISNILMFDIDERICSEVQKFDVMYTRYADDITLSGKGLEVVRAAEDKVVQVVRKSRFPKLEFNRDKRGIYSRAVRRMVTGLVITPVGSISIGRERKREISALLHRSSLNQLVTEERGHLKGLLGFCVACEPEFVGRMREKYGHKTIDEAMKYHVPKKRGR

SEQ ID NO: 4539 - protein, 316 aa, unidentified
  source 1..316: note = Related to RXIO01000070.1; note = Ancylobacter aquaticus
MPILDDLVSDLGFSFKDVSRIISTAPARYKVYGIPKRDGGFRIIAQPSRELKLIQRYILENKLNKCKIHECATAYVKNKSIYENAEVHKSADKIIKLDFINFFNSIKPRDWRAMAPKLDGCLFEASDLEIYIKIFFWGHVKNSSVPRCLSVGAPTSPSISNILMYDFDQAVFAAAKDLNINYTRYADDITLSGDSISHLHKMESHVRKSLKIISFPKISINEKKRGLFTRAGRRSVTGLIITPDGSISIGRDKKRLISAMVHHFVTGEMTEEGKAKLKGWLAFCVDNEIEFVERLRIKYGNEAISKALKYYIKPLS

SEQ ID NO: 4540 - protein, 326 aa, unidentified
  source 1..326: note = Related to JAIETA010000075.1; note = Reyranella sp.
MTIGLLKELGIKLGMGRSDLLRIISTAPKRYKVYQIPKRRGGTRTIAQPSRELKAIQRVLLKAVLSKFPVHAAATGYVENRSILDNAVAHMSSRVLLKLDFRDFFPSIVPDDWRRLARAKFVDLDEDEVWLSTMILFWGQKSTTPRCLSIGAPTSPMLSNIVMYSLDVRLAEAAAATNTTYTRYADDITASGPTIEDVRQFEAYAREIVGRSVSPQLTFNDQKRGIYSSGQRRMVTGLVLTPSNSVSIGRERKRLISSMLDHWIKDSLDNERKARLKGLLAFCIAAEPAFVSRLRAKYGDGPVNDVLRYHIVRKGPPPRQAGKSSS

SEQ ID NO: 4541 - protein, 320 aa, unidentified
  source 1..320: note = Related to CP090554.1; note = Neorhizobium galegae
MSLFEDLLFFTGLSAPDLRRIIATSPARYKQFTIAKKSGGERLIAQPSRDLKVLQRYIQGNILSKGTIHASATAYKNGASIKHNANIHKYNRVILKCDFKDFFHSIKPRDWILYAQENFHSLSQDDVGLCARVLFWGRGTSKPACLSIGAPTSPVLSNLIMFDLDEKLTRSAEKIGATYTRYADDITLSADKIETVLLLEKRLKSAVAKSKYPKLTFNGDKRGLYTTAHRRNITGLNITPDEEISIGRDRKRMISSMIHKYSIGQLSEKDAGKLKGYLAFAYDCEPDFIERMIRKYGEEQISIIRQLHLPPRQRDIEFPE

SEQ ID NO: 4542 - protein, 317 aa, unidentified
  source 1..317: note = Related to NZ_PCDP01000036.1; note = Rhizobium tubonense
MTLFDELSILTGLGASDLNRLIYNAPARYKEFPIKKRSGEDRIIAQPSRELKIVQRYIAGLVLNRLPIHSAATAYKEGANIFANVQSHSANRIILKLDFTDFFHSIKPTDWRNYAKVHIPSLSKEDVELSAKVLFWGMKSNRPICLSIGAPTSPVMSNLIMYDLDEQFFQITNDIGVTYTRYADDITLSGSNKESVIEAEKAIRVAVRKCKSPKLLFNESKRGIYSTGQRRHITGLNITPSGKISLGRERKRMISSLIHKYSLMLLDANDVGKLKGYLAFSLACEPEFLGRMRIKYGSTLIEEIQKTHIPARTLPES

SEQ ID NO: 4543 - protein, 321 aa, unidentified
  source 1..321: note = Related to NZ_FPAJ01000001.1; note = Sulfitobacter marinus
MSELDLLRTVALNVGLSEESTLEIIRDAPQRYKVYPIPKKGKGHRIMAQPARELKPIQRSIADIVLEKFPVHPSAMAYRRGVSIADNAKVHAGKNSILKLDFESFFNSISAAAWRRFMKAQEIIELESHELALLTKALFWGAGQRTPYCLSIGAPSSPLVSNIIMFEFDRQMHDFAEKHGIRYTRYADDITASAREFKNLAAFERHLRTYISRNKTPSLKINEEKRGIYSSSDRRLVTGLVLTPDGKVSLGRERKREISSLVHKSTLGQLDIEQLGYLHGMLAFAISSERDFVNRLRIKYGEDAISSVLRYRVPRRDGTAR

SEQ ID NO: 4544 - protein, 306 aa, unidentified
  source 1..306: note = Related to NZ_SDEA01000022.1; note = Paracoccus luteus
MSDASVLEIIQNAPKRYKVYRIPKKGSGFRIIAQPARELKTIQRSISKLVLEKLPVHASAAAYRPKIGIFHNAAVHAGTSPILKLDFERFFNSITAEAWRRFVASQEELRLSRSEMALVTRALFWGEGSKNPSCLSIGAPTSPLISNAIMFQFDVEMSNFAEERGLRYTRYADDIVASAKDFKVLHHFERHVRQYIKKNKTPSLTINESKRAIYSPGDRRLVTGLILTPDGKISLGRHRKREISSLIHFFRLGQLDHERLGYLQGLLSFSLSVEHDFVSRMSSKYGNDVVSAILNYRVPRRDGSPR

SEQ ID NO: 4545 - protein, 319 aa, unidentified
  source 1..319: note = Related to NZ_LMEM01000009.1; note = Devosia sp.
MSLLEELQTYSGLGYGELGAVLRTAPRRYKAYLIPKRSGGHRMIAQPARELKNLQYFLIDRTLSKLPVHSAAAAYRENVGIRSNAAAHARNEVILKLDFSDFFPSIKPRDWMLFCGSLDPEVAEASGLATGADVMLATRLLFWGRGTFEPKCLSIGAPSSPVLSNVLMFAFDTAVAAHAIQNDVVYTRYADDITLSSDRSKQILLVEAAIRRYIKRYRSPALTINEEKRGLYTSGQKKMVTGLVVTPEKRVSLGRDRKRMISSLVHRFTLTQLELPKIAYLQGMLAFARDVEPSFYASLERKYGQPTMRALLAFRLPKS

SEQ ID NO: 4546 - protein, 311 aa, unidentified
  source 1..311: note = Related to JAFKLT010000057.1; note = Sphingomonadales bacterium
MSVEPKHSLIRTCALATGLTINEVVRIAGIGPKRYKIYQIPKRSGGQRTICHPSRELKALQYVFLRDILAQLPVHSAATAYKSGSSIKQNASRHLASRIILKLDFENFFHSIKVADWMAYAKATFPHWTAHDIEFSLFVMFWGAGGYKPVCLSIGAPTSPLVSNALMYQFDGVLSNFAAANGLVYTRYADDITISAEGRLDKDAIMAEIHSALDLIEYPRLKLNTAKTKLASKATSRRVTGLVLANDGSLSLGRERKRLISAMVHRAVRGLAEPDAIAHLRGLLAFANDVEPSFVAMLRKKYGSFVLDILH

SEQ ID NO: 4547 - protein, 300 aa, unidentified
  source 1..300: note = Related to AWFC01000023.1; note = Hyphomonas sp.
MSSLIEKISAETRISIPDVKLTVRTASRRYKVYSIPKRDGTARIIAHPARELKAIQRALISESPASLRVHSAASAYEDGSSIAKNANIHVKNSWLAKFDLENFFNSITVSAWQMYLSKLEVDDEYVELSSKVFFWKPERRKSDLCLSVGAPSSPFASNRYMFSFDQYVSDYCTKNNLAYSRYADDIAISSQSEIELIHLQEVIEEGLKESRLKLNSRKTLLLGPGQRRVVTGVILKNDKKISLGRGRKRIIESMVHNYAKGKPSSSLEVIRGHLALLKMIDPDGYNRIRKRYENCTSLFK

SEQ ID NO: 4548 - protein, 317 aa, unidentified
  source 1..317: note = Related to DOSK01000382.1; note = Brevundimonas sp.
MSRVLTDIAEHLGVGTEDVRKFIFAAPARYKVFSIPKRRGGQRTIAQPSAPLKEIQRFVAANQLATFPVHDAAAAYITGKSIADNAARHRKGKYLLKLDFENFFNSITVKDWRRLVALTPNHGITPQDLPHLDRILFWGGGTFSPIMLSVGAPSSPTISNMIMFRFDTAVSQKAAEVGAVYTRYADDISISAPTAKTCLEVERFAVSALRALKYPGLRFKTDKRGLYGPGQRRLVTGLVVTPDNRVSLGRERKRNISSLVHKASLGKLDAPEMLELKGLLGFVHSAEPRFLQTLKTKYGAELVQRIAAFEVKKLGDG

SEQ ID NO: 4549 - protein, 314 aa, unidentified
  source 1..314: note = Related to FOOA01000003.1; note = Aureimonas phyllosphaerae
MSLRDEICIATGIGLSEFARIENSAPVRYKSFSIAKKSGDYRIIAQPSRELKIIQRWICENYLASFPVHNAAYAYRLGRGISHNARVHAGSRYILKIDFKDFFHSITPNDLFVRIKLANKDLSKADKRTLSQCLFWGKGVNMPLCLSIGAPSSPMLSNIVMFDFDERIARICKDKGVKYTRYADDITVSSEGIDELLFVERGIRETVKNSKNPKIEINEDKSRRFGPGQRKLVTGLNLTSEGGVSIGRGRKRKIHSMMNSAKYGILPDHDIGMLKGLIAFSISCDDDLVTLLRKKYGSDVVDRILSFKVPSRRR

SEQ ID NO: 4550 - protein, 334 aa, unidentified
  source 1..334: note = Rhodospirillaceae bacterium; note = Related to DOJP01000165.1
MGTFFDPENSKLCLRLARETRMPYSALYRLVLTAPYRYKTYKIQKVGRPGQVRIIHHPARELKTIQRWLVKNVLYSMPVHSAACAYEKNTGIKLNASKHVNNNYILKMDFKDFFPSIVPRDIFLRMPADTPWNSNDFYFLSRVLFCKKDTGTKLSLSIGAPSSPKISNIVMYEFDQKVSEYCNQKNITYTRYADDMTFSTNRREILQECEDFINGLVREMDSPHLEINASKTLHTSKKHHRRITGLVLSSQGFVSLGRERKRLIRAMLHNYKYNQNSDADKTQKLKGLLAFACDCEPIFIDNLKAKYEAEIDCLLSMKPEKPYIRRLLGSRSKS

SEQ ID NO: 4551 - protein, 337 aa, Vibrio sp.
  source 1..337: note = Related to CP023054.1; note = Vibrio anguillarum
MKSLYDISEFTEKSVEEIIANYLTAPRKYKEFKIKKRNGGLRTISQPSKDVKFYQYAIIEKILKNLSIHDSATAYRDSKSIYHNALPHKGSSWILKLDFKDFFHSIRPEHLKSFLLDAYEDISSIEVDILNHYLFWLDRTDRKLKLSIGAPSSPIISNIVMYNFDESVCDICSKYSVIYTRYADDITLSASSRECLLEAEEELKVLIEETQTPLLVLNDKKRVLIGRNRSKRVTGVVITHENKLSVGRYKRKKVRAMLHLYSNDKLNEQDIPILHGTLSYIKSIEDNFYRSLRDKYGDAVFTKLAKESFKISKLKYYGKEESEEEKTQSKDDNDIVF

SEQ ID NO: 4552 - protein, 328 aa, unidentified
  source 1..328: note = Related to CH724143.1; note = Photobacterium sp.
MLWGLIFDMKSLLEISKFTGKDVTEIISNYLTAPRKYKEFKIKKRSGGFRTISQPSKDVKIYQYAIIENVLNNLSIHDSATAYRKGKSIYHNAFPHKDSMWILKLDFKDFFHSIRPEHLKSYLLDEIKGISSIEVDILNHYLFWMDKTDRKLKLSIGAPSSPIVSNIIMYKFDENVSNICSKFNVIYTRYADDLTLSANSRECLLETEKELKALVEETQIPLLVLNDKKRVLIGEHKSKRITGVVITHESKLSVGRYKRKKVKAMLHLYANGKLNEEDIPILHGTLAYIKSIEDNYYRSLRDKYSDAFFTKLYQESFSISERKYLGKE

SEQ ID NO: 4553 - protein, 324 aa, Vibrio sp.
  source 1..324: note = Related to JAKKCQ010000002.1
MKILSDISECLGKGIGEIISNYLTAPRKYKEFKIKKRNGGFRQISQPSKEIKNYQYAIISKVLNELPIHDAATAYRNKKSIYHNALPHKDSAWILKLDFKNFFHSIRPEHLKSYLTEAYEEISSIEIDILNHYLFWMDKTDRKLKLSIGAPSSPIISNIIMLKFDNAVSDICSKHDVNYTRYADDLTLSAQSKESLEKAEEELNALVEETQTPFLILNDKKRVLIGNNQSKRVTGVVITHENKLSVGRHKRKKVRAMLHLYVNEKLEKKDIPVLNGLLSYIKSIELEYYLSLKDKYGDVVFSKLSLESFSISGMLKKPEKKMKA

SEQ ID NO: 4554 - protein, 326 aa, Proteus sp.
  source 1..326: note = Related to JADRZV010000010.1; note = Proteus mirabilis
MKYLLDILEHSKKTIDDLIFNYLTAPRKYKEFEIKKRSGGFRKISQPSFDVKLYQYLIMENILAKLPIHDAATAYRYHKSIYHNALPHKNSDWILKLDFKDFFHSIRPKHLKSILTDVYKDISSIEIDILNHYLFWMDRGDQKLKLSIGAPSSPIVSNIVMYKFDETVFNMCSENNVIYTRYADDITLSSDSRNILLKVESELKKIIADTQEPLLILNNNKRVLLGKQKSKRITGVVITHEKKLSVGRYKRKKTKAMLHLYVNNKLKKGDIPILHGTLSYINSIESEYYQLLELKYGKATFRKLTKDAFYISKMKYKNINKNDMDN

SEQ ID NO: 4555 - protein, 334 aa, unidentified
  source 1..334: note = Related to NZ_LTZD01000015.1; note = Aliivibrio fischeri
MKILKDLSEKLDIDVDDIISSYLTAPRKYKEFKIPKKRGGFRDIAQPSNEIKIFQYGLIDTFLKNFPIHDCATAYMENKSIYDNALPHKDSKYLLKLDFKDFFHSIRPEHLKFYINKYNEGISNIEIDIINNFLFWMDKEDNKLKLCIGAPSSPMISNIVMYDFDLELESLCNTNNVIYTRYADDLTLSSNSNSSLMEVEGFLNKIVERTQIPLLELNDSKRVCIGDKKSKRVTGIVITHNNQLSVGRYKRKRIRAMLHLYNCNKLNENDIPRLHGLLSFVKSIEPDYYDLLKLKYNENLLKQLAKESYIISRKWYVSFNNDSLNVGDEDDIVF

SEQ ID NO: 4556 - protein, 326 aa, unidentified
  source 1..326: note = Related to PYNJ01000059.1; note = Photobacterium kishitanii
MNILKTLIEVLGVSYSSIFKDSLTASRKYKEFTIPKKKGGRRKISQPSEDVKIVQSAISSVLLNSLPVSDYAYAYIRNRSIYDNAFIHKESSFLLKLDFKDFFHCIRPEHLKYYIKKNISDISDMEVDIVNNFLFWFDNDDNKLKLCIGAPTSPLISNIVMYEFDEKISKICEDFDVIYSRYADDITLSSNNRDDIDTVEIKINNLIKETNIPLLKLNKKKRVFVSQHMSKRITGIIITHDNKLSVGRYKRKKIKALLHLYNNRKLKDKDIPYLHGFLSFIKNIEPEYFNKLKSKYNEKLFHQLAKESYILSKKEKEKEMITHEKL

SEQ ID NO: 4557 - protein, 335 aa, unidentified
  source 1..335: note = Related to CP045427.1; note = Shewanella sp.
MNKLNILNEISNDIDVNIGEFFNFSSMAPTAYSTFQIRKKSGGTREISQPAQWLKSVQYAIIQKLLEQLPIHYTATAYQKGKGIKQNAEAHINKTFILKTDFENFFPSILQSDLELILKRNNIEINSFEYSVISRFLFKKKNDSNKLELCIGAPSSPMISNVVMFEIDSLLSEKCNELDISYTRYADDMTFSSDKYENVEFILEFLKQTILKVESPQLILNNKKTKIISKGRSQRVTGVILSNDGRVSIGRNKRRRARTLLHLLELDKVDDKSLVELYSIVSFMRNIEPEFYEILKEKYGYNLFKKLYKKFSLLVEKHTDQSTGMKLKFKGFNVD

SEQ ID NO: 4558 - protein, 345 aa, Vibrio sp.
  source 1..345: note = Related to NZ_CP042449.1; note = Vibrio alginolyticus
MNIVKVISDLINQDITYMFLLSATAPEAYSTFYINKKSGGIREISQPSKEVKEVQYVIIKEILSKLPVHECAKAYKKGVGIKQNAVEHLNKEFILKTDFSNFFPSIKPADLEYYFKKNNIEINNLEFDIISKILFKKKENSNKLELCIGAPSSPIISNIVMYEIDELLYSHCKERNISYTRYADDMTFSSNSIEDLKEILSTLKKVIIKNKNPELILNQKKTRLISSGRSRRVTGVILSNEGKLSVGRTKRRRTRTLLHLLSKSSIDDKSIIELYSNISFIRNIEPEFYQKLLSTHGQSTFNKLNKSFQSLIEKNTDNNGFTWRFGINGDSLVKKVIYEDDDIQF

SEQ ID NO: 4559 - protein, 321 aa, Salmonella sp.
  source 1..321: note = Related to AAIODZ010000022.1; note = Salmonella enterica
MSYIDNLSRVLNCSVMSLISGYIKAPKKYKVFYIKKKNGKGLREIAQPAPDIKEVQRAIVSTLLAKLPVHECAKAYIKETSILNNAEPHKENKYILKVDFENFFYSIKPQDLYFYLLRGEIKLTQFEYEILSHYLFRRKKGEKKLRLCIGAPSSPIISNIVMYDFDCILSDYCHLNNIAYTRYADDITLSSESYGKIKDAYSFIARVVSDLKKPELKINSDKTKIIGKGRSRRITGVIISNTGELGVGRFLRKKIRALTHLYSNHKLSERDIPYLLGMLAHIKNIEPSYYEALVSIHGDNLFKKLGKDSYRILENKRGNDN

SEQ ID NO: 4560 - protein, 317 aa, unidentified
  source 1..317: note = Related to NZ_CP025085.1; note = Serratia sp.
MSYIDELSKTLNCTPKTIISGYIKAPKKYKVFFIKKKNGKGLREIAQPSPDVKKVQRAIVNSLLSLLPVHECATAYIEEKSIFDNAEPHKKNEYILKMDFENFFYSIKPQDLNYFISKNDIKLNHFEYEVISHYLFRRKKGEKKLRLCIGAPSSPIISNIVMYDFDEKLFNHCKENDVIYTRYADDLTFSSDSFDKLNDVKNFVIDLVSLQKKPELIINTSKTKFIGKGRSRRITGVVISNTGDLGVGRFLRKKIRALFYLYSNNKINHKDIPYLLGMLSHIKNIEPDYYYSLIKINGEDKLKQLGKDSFAVLQKKQ

SEQ ID NO: 4561 - protein, 322 aa, unidentified
  source 1..322: note = Related to DAEHES010000012.1; note = Serratia fonticola
MGYLNDLAGSLDSSVASLISGYLQAPRKYKVFYIKKKGSDKLREVAQPSPDVKNVQRAIASTLLNQLPIHSCAKAYIKDLSIYDNAKEHKTNTYILKMDFRDFFPSIRPNDLLLCLEKNSIKLNDFEYTILKHYLFWRKRGDNGLRLCIGAPSSPIISNIVMYDIDCKIDSICQALNIPYTRYADDLTFSSNSIDTLNIVFDKVKNIISSQESPRLIINHNKTKFIGKGRSRRITGVIITNDGQVGVGRYLRKRVRALLHLYSNNRIKVNDIPYLQGMLSHVKNIEPKYHEELLKKYNESLIKRLNLDASRIIKENRRNGVI

SEQ ID NO: 4562 - protein, 319 aa, unidentified
  source 1..319: note = Related to JAFJZU010000009.1; note = Pectobacterium brasiliense
MSYLEHLALSLNSSVASLISGYLKAPQKYKVFKIRKKNNKSFREIAQPSPDIKNIQRAITSTLLKNIPIHPCAKAYIEGLSIYNNAYEHRENNYLLKMDFKNFFPSITPNDLLLCFKRNNIELNNFEYNILKHYLFWRKRGERSLRLCIGAPSSPTISNIVMYEFDCKIHEYCITHNIPYTRYADDLTFSSNEIEKLHAIYDYVTSVILENKSPNITINDSKTRYIGKGRSRRVTGVIITNEGKLGVGRYLRKKVKALLYIYNNKDLRKEDIPYLQGMLAHIKNIEPSYYEKLLQKYEPSLLSRLGKEAATIIKERSLN

SEQ ID NO: 4563 - protein, 323 aa, unidentified
  source 1..323: note = Related to NZ_CP009769.1; note = Pectobacterium brasiliense
MSYLDELANYLEKSVPYLIRNYISAPRKYKVFYIDKKNGSKKREVAQPSKEIKEIQRAIVKTLLENIPIHSCAKAYMKNSSIYDNALPHKDNVFLLKMDFRDFFPSIKPSDLLYFLERNGLKFDAFEGTIVTNYLFWRRKGERKLSLCIGAPSSPIISNIIMHDIDSEINTYCEKEDIIYTRYADDLTFSTDNIVKLQKIHDFISNLTNRTEHPKLLINKEKTRYIGKGRSKRVTGVVITHEGELGAGRYLRKKIRAMIYLYSQKKLKKEDIPYLHGMLSHINNIEHDYYIKLKKQYGAAMFSALYQESFCISKKEKEADKVI

SEQ ID NO: 4564 - protein, 324 aa, unidentified
  source 1..324: note = Related to NZ_CP034015.1; note = Shewanella livingstonensis
MELISKVAEHLGLPMHELISNMRSAPSMYKAFSIKKRNGGDRIIRQPSPFVKNIQRAIVDIVFSGIDRSEFSMAYEKGRSIKDNALIHTGADFLLKMDFKDFFPSIKPSDLFRTLGDLGYDFNDLDRMFLSRYLFVEVGSLLELSIGAPSSPMLSNLVMKHFDIAIGDFCHKNSIRYSRYADDLTFSGCCYKDLKKVEAHVVHIISLDNKSNLLVNDKKTRLIGKGRSQRVTGVILTHDGNISVGRNLRKKIRGLVHLYSNKKLNNSDIPYLHGIISHMRNIEPEYYEKLIVLHGDVLFKRLAKQSYAIGKHLRCAHLKTGLVK

SEQ ID NO: 4565 - protein, 319 aa, unidentified
  source 1..319: note = Related to JAHKRD010000001.1; note = Shewanella sp.
MEIISDLAEELNVSIIELINQMQQAPKKYKVYSIKKRSGGSRIIAQPTAFVKMVQKGLCTSFLSQFKYSNSAMAYVKERSPISNANVHVGAKLILKLDFENFFPSIKAAHFIEFLERNKVTLESLEIDFLIRYLFRKVKGSYELSIGAPSSPLISNVMMYDFDLEIEEALKDSLINYTRYADDLTFSANSFEELNEAKLFVEAVILSKRYSFLKINEDKSKIIGRGRSQRVTGITLTHDSKISIGKSLRKRIRGMLHLYNQKKLKKNDIPYLHGIISHMRSVEPDYFKKLIDVYGAELFSRLARQSFMISKETKMKLME

SEQ ID NO: 4566 - protein, 318 aa, Aeromonas sp.
  source 1..318: note = Related to NZ_CDBP01000069.1; note = Aeromonas dhakensis
MSNESITDIICKSLSLLAHELLIKAMKAPLSYRVYTIPKRSGGKRTIAQPTAEIKKIQRCIVKTVLDPLPTSDISTAYKKDISIKDNAERHLGKKFILKMDFKDFFPSIRPEDLINSLERNNVRLSSADRKILILFLFRRNNYGRFELSVGAPSSPIVSNIIMYEFDIAVKEYCEKNNIVFTRYADDLTFSSNSIEDIKKTPAIIKSNLMLMDSPKLSINEKKTHIVSKGRSQRVTGVTLTHDNKLSIGRNLRKKIRAMLHLYKNNKLEHNDIPYLHGIISHMRNIEPEYFNKLLESYDDVLFKDLAKVSFNVSKVYK

SEQ ID NO: 4567 - protein, 321 aa, Vibrio sp.
  source 1..321: note = Related to CP001805.1
MENLLKEICSSSDLSIQDVIKGLSTAPLAYKVYTIPKRTKGERVIAQPSPFVKEVQRTLISVFLTKYKPSEVSTAYVEGKSIIDNAEAHKDNDWILKLDFKNFFPSLKPNDLFTFLEREGVVIGEFDKKILSSYLFRRNNRKLELSIGAPSSPLVSNLIMKSIDNKIEGYCNDNSIVYTRYADDLTFSTMDLDKIDALKQYIAAVLSETKSPKLSINDSKTKVIGRGRSRRVTGIVLTHENKLSVGRYSRKKIRAMVHHYSNRTIKKSDIPYLHGVISHMRSVEPDYYQKLEIKYGSDFFSKLAMDSYKISKAVKLKKLVK

SEQ ID NO: 4568 - protein, 321 aa, Vibrio parahaemolyticus
  source 1..321: note = Related to CP006004.1
MTNLLKEICENSEIQLTDIIKNLNTASISYKVYDIPKRTKGVRTIAQPSSFVKDVQKVITKVFLSEFTPSDASFAYIEGKSIVDNAAIHKDNKWILKIDFKDFFPSIKPEDLFNFLEKEEIKLSEFDKKIISSYLFRLNNSKLELSIGAPSSPVISNLVMKELDQEIIHFCEEKSIAYSRYADDLTFSTNNIAYFSDLLPYIYELLSYTQSPKLSINDKKTKIIGKGRSQRITGVVITHEGKLSVGRYFRKKIRAMLYSYNSNKIKKSDIPYLHGLVSHMRNVEYSYYEKLEENYGKEFFRKLAMDSYKIGKAIKLNSIKS

SEQ ID NO: 4569 - protein, 303 aa, unidentified
  source 1..303: note = Related to NZ_SRZX01000002.1; note = Marinobacter orientalis
MSTAIEKVCKDLGFTEEKFIEFCSLAPHRYKKFFIPKKNGAGLRLVAQPARPLKKVQRWLVSEYLSKLPIHEAAAAYVSEKSILDNAKKHAGNKVLVKYDFKDFFPSIKPSDFLKLISKNDVGISAYEAEIFSRLIFWSPGNRPGLELCIGAPSSPVISNAVMFDFDNAVSEFCSSESLIYTRYADDICISGYDNSIFEHVDRFIKKQVFEIESPNLLLNPNKTQFINENTVKKVTGLFITQNEEITVGRKLKRKVRAMVHNFHKGNLSAKDKERLKGYLCYLSDVDPSYLRKVAPDFQSWDL

SEQ ID NO: 4570 - protein, 646 aa, unidentified
  source 1..646: note = Related to DACSHB010000002.1; note = Legionella pneumophila
MDTIIEYFSKIDFTKVRTNQPPELIFLCGGNSDQKANNFRPKLQNELIKKQRNVVLAENAMNWQGGQVFAKDLLELEKYYAALVSIIPLICESYGAAAEFGAFVTDEFIRKKLFIIIKEQFYSGENSSSFIRYGPIKKYEDSENRETYCINNENPEEDLEDLCETLLACKPKTSKCNFDEGYFRILLLIDIINVLSISTHKEIKSIFEKVLSIIGFDQLSIDTYCVDLNEMLFVLEKLRLIKLRQKGQRSFYLSVSQEFYLEYRFIKDSNDTKLSTIRKNVLDYIYAQETRIQKTKVSILKEELKKGEIKWLQTNISLDDINIDELLKTAPLQYKVYEIPKKSGGKRTIAQPTAKLKILQREKILELENTFPVHNCAKAYKKNNNGIFENAKAHQDNSYFYKFDFEDFFESIKARDFNQYLLQFGYSLNERIDLIMLFFRFNKQSDKRKTNKIYKLLYNSDFNKSNNMSLLNVMVNEFSNEFQLSVGAPSSPFISNAILYEFDDMTQKWASEIGITYTRYADDITLSSRSKFEIADLEKEILNISSKMNFPKLKLNKRKEKYCSFKNRVSITGLNITPDHKISIGRKKKREISSMIHHFKLGKLSKDKMNRLRGWLSYCKAVENSFLDKMKIKYSEDTILEILKKN

SEQ ID NO: 4571 - protein, 646 aa, unidentified
  source 1..646: note = Related to DACVYU010000020.1; note = Legionella pneumophila
MQIITDYFKKVDFSKVRTNHPPELIFLCGGNNDEEANNFRPKLQDKLVKKQHNVILAESAMNWRGGQKFAKDLLELEIYFAALVSIIPLICESYGSAAELGAFVADQFIRKKLFIIIKEQFYSGENSSSFIRNGPIKKYEDSEGRKTYCINDKHPEQDLDDLYEALLSCRPKTSKCYFDKGYFRILLLIDIINVLSISTLKEIKISFQEVLSIIGIDQHEIESYCDDIDEMLFVLEQLNLIKYRNKGQQGFYLAVSQEFYLEYRYVKDSDDTKLSTIRKNILDTIYSQDSRINKTKVSILKEERKKGEIAWLQTNISLDDINVHELLKTAPLQYKVYEIPKKSGGKRTIAQPTAELKALQRKKISELEDKLPIHNCAKAYRKNKNGILDNAKAHKDNSYFYKFDFQDFFESIKACDFNQFLEQHGYSFSERVDLIKLFFRFNKQSSKQKTKRVYRYLTDNSFNRNNNPALLNLMIQDFANEFQLSVGAPSSPFISNAILFEFDDMMQNWANENDITYTRYADDITLSSKSKIDISSMEKEILNICSKISFPTLKLNKKKEKFCSFKQRVSITGLNITPDHKISIGRNMKREISAMIHHFKSGKLTVDKLNKLRGWLSYCKVVESEFIIKMENKYSKNTISAILRKK

SEQ ID NO: 4572 - protein, 504 aa, unidentified
  source 1..504: note = Related to DAECXU010000022.1; note = Legionella pneumophila
YIIFSDINPHDELDEICTIINNYKPETINSNFSHNYFKILLVLDLINVLAISSIDEIKIHAEAVLKKFDKNYEINRKTVKEMLFVLKKLDLVVEINKINQSFYLSKYDDLFLDYNPHQYKLFNIKKDIINSFYQSDESNTSNYRKYQIFSKYYRYYKDQENNSTKKDIEKEVKWINKTLDYEHIDTDQVIQIGPMLYKKFKIKKKNKGYRTICQPTAELKQIQRNELKKLYKQFLIHDAAKAYKKNINGILENASEHLGNNFFYKYDFTDFFSSIKADNFIGFLKRNSFEDNKILRLIKLFFVFDKNNKSEIKKAYEILKSNRSDINAFPRWFKDNLSLSIGAPSSPFISNIIMLEFDSIVFDWAKKNQLVYTRYADDLTFSSKHSFESKLIQKLINDTIKNIDYLNLRLNISKIRHFNIKEHVSITGLSITPDNKVSIGKKRKKEINALIHQYKNNDNYSLSRQQILRIKGLLAFCKNVETDFFLNLQKKYGNKVIKDILSEK

SEQ ID NO: 4573 - protein, 346 aa, unidentified
  source 1..346: note = Related to NZ_MDTU01000002.1; note = Piscirickettsia sp.
MSYLIKVPSYVEFLKKVYSLISKISNDLLISEEKIKNVIDRSSLLYHEFTIVKNNKSRVIHNPAKELKAIQIYLTNMFIKQAPIHDCAFAYREGISIKNCVEKHIDSNYFFLTDFKDFFHSIMFDDILRFLKLTNISQYLSRDEDCSDFAKVMCRYKRLTIGSPSSPSLSNALCFRLDEVINRFCCNNNLIYSRYADDICISSENKINCNLVRKSILSSIQEANVIRRLRVNPSKTRTLNRAKRVKILGLNITSDRKISIGRSKKREIKSMVNMWKYNRINNIERSYLSGYISYCLAVEEDFVMGLYQKYGSTLINRIREYNASYAREKNLLLENSLMDINHSDYN

SEQ ID NO: 4574 - protein, 307 aa, unidentified
  source 1..307: note = Related to REDP01000333.1; note = Planctomycetes bacterium
MISPFNLILKDCMITNVKIMNIAQRAKHMYKTYAIPKKNGGRRIIDHPAKPLKAIQRSIVSAVLRDLPVHQSCTAYEPGRSALLNAQTHQDSRYFYQLDFKDFFHSIKHRNVSAFLESSTRLDTEESEIISMICCKGDHLVIGAPSSPILSNRIMFRFDSEATIISQSLGCIYTRYSDDITISTKNDTTAINECIRALIDFIGSPDNNWLRINEAKTRHSSLKRRVAVTGYNITNDHRPVVPRSYKRTVRALIHKAIICNNDEIELDKVLGMVAYIEGSEPGFIESLKGKYGPEVINRLRKHNTTGH

SEQ ID NO: 4575 - protein, 305 aa, unidentified
  source 1..305: note = Related to RDXE01000040.1; note = Alphaproteobacteria bacterium
MTEIIKEIMRHTGFWPSDIVRISRDAPRSYKVFSIPKQNGSSRTIAQPTKELKAIQRAIVECLRKILPAEHTTATAYVKGKSIIDNAKPHRNSRIFLKTDFQNFFPSIMPSHFDQLLIQNEIHWEPEICNLIKRLLFFGNRTSTPQCLAIGAPSSPYISNAIMYQFDLRFSQYCASNELIYTRYADDVTVSGNGKMNQSAVLNEIDRNLASVGLSALKINPSKTRVFSHKHGVKITGIRVTSDGEIKVDRELRREIRARLHKIRIQSASTEMIAETHGLLSFVHMIDEELEENLLSQYKLDSYDW

SEQ ID NO: 4576 - protein, 317 aa, Pseudomonas sp.
  source 1..317: note = Related to JACYWS010000002.1; note = Pseudomonas syringae
MSEYNFREHLSDEFLISEHDVTRLLLRAPYAYKRYTIPKMNGGIRQIAQPAKETKIFQHFMMREWFSKMPIHECAAAYKHGASIKDNAERHAGSTYLSKFDFVNFFGSITERNIKVLLSTVFKGELSEKSIVDMARMSCIRDRATGRLVLSIGAPSSPVLSNAVMFNFDSVVHKWCVEQGIIYSRYADDLTFSCNEKGKTFLVEEFLQVTLKQLPEPLLTLNADKTIHASKKNQRRVTGLVLSNEGSVTIGRDRKRLISAMVHRFAIGALDNKSIAHLQGLIGFAQDIEPLFVAKLREKYTSKVITELMRVRGKKRN

SEQ ID NO: 4577 - protein, 317 aa, Pseudomonas sp.
  source 1..317: note = Related to NZ_JACOPX010000017.1; note = Pseudomonas neuropathica
MSEYNFREHLSAEFMISEHEVVRLLVRAPYAYKRYTIPKKNGGIRPIAQPAKETKIIQNFMMNFWFCKLPVHECAAAYKQGASIKDNAERHVGSSYISKFDFVNFFGSITEFNIQTLLSRAFQGQLSERSIADMARMSCIRDKVTGRLALSIGAPSSPMLSNAVMFNFDSVVSQWCFERDITYSRYADDLTFSSNEKGKTFLVEEFLRGALKELPEPGLLLNANKTLHASKKNQRRVTGLVLSNDGNVTIGRDRKRLISAMIHHFIQGQLDRKSIAHLQGLIGFAQDIEPLFVAKLRGKYTSKVITELMRSRCEKRN

SEQ ID NO: 4578 - protein, 317 aa, Pseudomonas sp.
  source 1..317: note = Related to CP089062.2; note = Pseudomonas aeruginosa
MSEYNFREHLSDEFLIAQHDVVRLLLRAPYTYKRYTIPKKNGGVRHIAQPAKETKIIQRFMMGEWFSKLPVHECAAAYKDGASIKDNAERHSGSIYISKFDFVNFFGSITEGDIKRILSRTFGGQLSEISIADMARMSCIRDRATGQLVLSIGAPSSPVLSNAVMFNFDSVVNQWCSERDITYSRYADDLTFSSNKKGNTFCVEEFIKGALKELSEPSLSLNSDKTIHASKKNQRRITGLVLSNDGKVTIGRDRKRLISAMVHRFAHGELDDKCVAHLQGLLGFAQGVEPLFISRLRSKYTSKVITDLMRFRSKKLD

SEQ ID NO: 4579 - protein, 317 aa, Pseudomonas sp.
  source 1..317: note = Related to NZ_CP077094.1; note = Pseudomonas promysalinigenes
MSEYNFREHLSDEFVISEHDVSRLLLRAPYAYKRYTIPKKNGGVRHIAQPAKETKIIQHFMMSEWFSKLPVHECAAAYKSGASIKDNAQRHSDCAYISKFDFVNFFGSITEVDIRNLLVEVFGSQLSEKSIADMARMSCIRDRVTGRLVLSIGAPSSPVLSNAVMFNFDSVVNQWCREHDIVYSRYADDLTFSSNRKGVTFLVEDFLQGTLKELPEPSLSLNTEKTVHASKKNQRRVTGLVLSNDGNVTIGRDRKRLISAMVHRYALGELDNRSIANLQGLLGFALDVEPLFVAKLRGKYTSKVITELMRVRAKKDD

SEQ ID NO: 4580 - protein, 315 aa, Pseudomonas sp.
  source 1..315: note = Related to JACGDE010000010.1; note = Pseudomonas mosselii
MSHYNFRKQISEEFMISEHDVSRLILRAPYAYKRYTIPKKGGGVRHIAQPAKETKIIQHHMIHEWFSKLPIHHCAAAYKTGASIKKNAELHSNSTYISKFDFVNFFGSITALNIKNLLQNEFNNIISEASIEDMSRMSCIRDKATGRLVLSIGAPSSPILSNAVMLNFDTVVHQWCSERGIIYSRYADDLTFSSNERGATLKIQDFIQGTLKELPNLNLILNTDKTIHASKKNQRRVTGLILSNDNKVTIGRDKKRLISAMIHRFSHNELNSKEIMHLQGLVSFAQHIEPLFVAKLRGKYSTKLITELLRSRGDK

SEQ ID NO: 4581 - protein, 315 aa, Pseudomonas sp.
  source 1..315: note = Related to NZ_CP035088.1; note = Pseudomonas viciae
MSLYDFRKHMSEMLSLSEHDVARLIVRAPYAYKRYFIPKKSGGMRPIAQPAKETKVIQNLLVNSWFSQLPVHECAAAYRQGSSIKANAERHKQNSYIAKFDFSNFFGSITESDLVNHLSYVLCGKLSVQSIKDIARVSCIRDRATARLALSIGAPSSPILSNSIMYYFDLAVESWSLERNIVYSRYADDLTFSTNDKGATSEIEKFILETLESIPYPRLHINSEKTVYASKKKQRRITGLIISNDNEVSLGRDRKRLISAMIHRYAHHELDEKSILHLQGLMGFAQDIEPLFVAKMRGKYTGRLISDLLRQRGKK

SEQ ID NO: 4582 - protein, 317 aa, Pseudomonas sp.
  source 1..317: note = Related to NZ_CP014205.2; note = Pseudomonas glycinae
MILYDFRKHISEVLSLSEHDVARLIVRAPYAYKRYFIPKKSGGMRPIAQPAKETKVIQGILIESLFAQLPVHECAAAYKQGSSIKDNAERHRQNSYIAKFDFSNFFGSITELDLIKHLSYVLCGKLTAQSIKDIARVSCVRERSTSRLALSIGAPSSPILSNSIMYYFDLAMEGWCRDRSIVYSRYADDLTFSTNDKGVMFDVEAFILEVLENIPYPRLKINSEKTVYASKKRQRRITGLIITNDNNVSLGRDKKRLISSMIHHYVQNKLDEESILHLQGLMGFAQDIEPLFVAKMRGKYTGKIISDLLRQRGKRIK

SEQ ID NO: 4583 - protein, 317 aa, Pseudomonas sp.
  source 1..317: note = Related to NZ_CP031641.1; note = Pseudomonas parafulva
MSLYEFRKQISVALSLSAQDVARLIVRAPYAYKRYTIPKKGGGVRPIAQPAKETKIIQSILISDWYCRLPVHENAAAYKSGASIKANAERHKNNTFVAKFDFKNFFGSITYSDLVNHLSYVFVNEVTKQSILDMARVSCVRDRSSGDLTLSIGAPSSPVLSNSIMYNFDLAVVEWCAERDVEYSRYADDLTFSAKDRGVLFSVKDFLLSTLEEIPYPKLSLNEEKTIYASKKNQRRVTGLIISNENKVSLGRERKRLISAMVHKYSHQDLDEKAVTQLQGLLAFAHDIEPLFIAKLRGKYSSKVIMDLMRKRGKKIK

SEQ ID NO: 4584 - protein, 316 aa, Pseudomonas sp.
  source 1..316: note = Related to JAGPVQ010000174.1
DVYDFRKYVSDTLAIPIHDVLRLLVRAPYTYKRYEIPKKSGGSRSIAQPAKETKIIQRLLMDAIFSQLPVHECAVAYKHGASIKTNAQQHRYNQYLSKFDFSNFFGSITSEDIAAHLGQCLGDELSEQSVADIARISCIRNKINSGLCLSIGAPSSPVLSNSILYNFDVSVSAWCLEKGIVYTRYADDLSFSSNQKGLSGSIEPFLRQTLKDISYPSLVLNERKTIHVSKKHQRRVTGLVISNDGSVSLGRERKRLISAMIHRCINDKLEEADIYILQGLLGFAQDAEPIFVARMRAKYGSLVIREILRKRVKLPR

SEQ ID NO: 4585 - protein, 315 aa, Pseudomonas sp.
  source 1..315: note = Related to NZ_CP019428.1
MDIYDFRKHVSETLAIPSHDVARLIARAPHTYKKYEIKKKDGGSRSIAQPAKETKVIQRLLMEALFCDLPVHECAVAYKLGSSIKKNAQLHRQNQFISKFDFSNFFGSITEKDVAAHLRHVFIGKISEQSILDIARTCCIRNSLTGILCLSIGAPSSPILSNSILYYFDIAIQTWCNERDIIYTRYADDMTFSSNERGVTSLVEKFLTHTLKNIKYPHLILNEKKTIHLSKKHQRRITGLVVSNDGLVSLGREKKRLISVMIHHYLLKKLDHKDIPILQGLLGFAQDAEPLFVARMRGKYGSPAISEIMRGRIKK

SEQ ID NO: 4586 - protein, 325 aa, Pseudomonas fluorescens
  source 1..325: note = Related to NZ_CABVJA010000003.1
MSIFDFRKHLSESLAIPTHDVVRLIVRAPHTYKKYEIPKKSGGVRLIAQPAKETKLIQRLMIQEIFTELPVHECAAAYKEGASIKANAEQHKNNQFISKFDFVDFFGSIKEADVASHLAYALPGKVSEQSIKDIARISCIKNKTLGGLQLSIGAPSSPILSNSIMYYFDVAVAAWCADKGVIYTRYADDLTFSSNVKGLPAQIEPFLTEILKEIPYPTLSLNKKKTVHVSKKHQRRITGLIINNDGAISLGRERKRLISAMIHRFILGTLEVEAILNLQGLLGFAQDAEPLFVVRMRDKYGHQVITELLRHRGVSKDKPKAYLKN

SEQ ID NO: 4587 - protein, 318 aa, Pseudomonas sp.
  source 1..318: note = Related to NZ_JAAQXL010000002.1; note = Pseudomonas proteolytica
MSVYDFRGNISNALVVSSNDVSRLIIRAPHTYKTYEIDKKNGGKRSIAQPAKETKYIQRLLMTQLFSRLPVHSCAVAYKDGASIKKNAELHKNNQYISKFDFTNFFGSIKEPDISAHLASVFGDELSDETIKDISRISCIKHKDLPGLCLSIGAPSSPVLSNTIMYLFDQIVHEWSVERGITFTRYADDLTFSSNTKGLFSEIEPFLSQVLKKLPYPVLSLNSKKTIHVSKKNQRRITGLVLDNDGRVSLGRDRKRLISTMIHHYSCGRLSDEETMRLQGLLGFAEDAEPLFVSRMRGKYGILVISELFQKRGKKLEK

SEQ ID NO: 4588 - protein, 320 aa, Pseudomonas sp.
  source 1..320: note = Related to BPLZ01000028.1
MSSYEFRQDVVEFFSVSEHDVFRLLQRAPHTYKRYEIDKKSGGKRLVAQPAKETKILQRYLMRVVFNDLPIHECATAYSSGSSVRKNAELHVVNPYISKFDFVDFFGSIKESDLILHFSRFLGGKVSEQSIKDIARVCCIQHKGRADHCLSIGAPSSPVLSNSIMYDFDEQVEAWCKERGITYSRYADDLTFSTSGKGVSAEIEPMIRGLLNDLPYPRLSLNDKKTLHLSKKVQRRVTGVILNNEGKLSLGRERKRKISSMIHRFSLGQLDEKDVFQLQGLLGFAEDVEPLFVSRMRGKYGIGVISALFQKRSEGRINKL

SEQ ID NO: 4589 - protein, 321 aa, Pseudomonas sp.
  source 1..321: note = Related to CP041771.1; note = Pseudomonas aeruginosa
MSKFELRLRLCRELLLTDKEVARLISRAPYTYKVYSIPKKNGGRRVVAQPARETKILQNFLIENVFKELPVHECATAYKAGSSIAINASAHVGNSYISKFDFSNFFPSITMLDLVRHIKSFFDGRLDDLEIIDIARVCCIKDRVTDRFHLSIGAPSSPILSNSIMYFFDVAVHKWSSERGVSYTRYADDMTFSTNEKSMSREIELFLVRQVEAMKSPRLSINHEKTIHLSKRNQRKVTGLVLSSEGKVSLGRNRKREISSLIHRFALGQLDPTDVFRLQGLLGFANDAEPDFVVRMRKKYGDLVIAALFEKRKAPSVISDG

SEQ ID NO: 4590 - protein, 316 aa, unidentified
  source 1..316: note = Related to LASC01000001.1; note = Burkholderia contaminans
MTINLRESLQESLGLSEAQLNRLIVRSPHTYKVYTIPKRTGGKRTIAQPAKETKFIQNWLIENIFNSLPVHSCASAYQPGSSIKRNADAHKAQRYLTKFDFKNFFTSIKSDDLIEHMRVHLGEVLDLDAIHDIARVSCIQLKAGEKLCLSIGAPSSPLLSNSIMFEFDSLVNEWCSRERVVYTRYADDMTFSTNERNKSAVIEKFIRGVVRDVGYPSLRFNNKKTISLSTKHSRRVTGIVINNQGQLSLGRDRKREVSALVHKFMLSELPQAEVYRLQGLLGFACDVEPDFLARMKRKYSDELIRTILEIRKKSDA

SEQ ID NO: 4591 - protein, 316 aa, unidentified
  source 1..316: note = Related to NZ_CADEWJ010000002.1; note = Burkholderia gladioli
MTIHLRGALRDSLGLSDAQLNRLIVRSPHTYKVYTIPKRTGGKRTIAQPAKETKFIQHWLIRNVFCHLPVHACASAYQDGASIKKNADAHRLQRYLAKFDFKNFFTSIKSDDLIIHMRRHLGSILEESAIDDVARISCIKLKAGGKLCLSIGAPSSPLLSNSIMFDFDSLVNGWCKKEGVIYTRYADDMTFSTNERDKSREIEEFIRSAARDVEYPALRFNTKKTVFLSTKHSRRVTGIVINNQGELSLGRDRKREVSALVHKFSFEELPEKEVYRLQGLLGFAKDVEPDFLERLKRKYSDELIRQILAIRKERDV

SEQ ID NO: 4592 - protein, 313 aa, unidentified
  source 1..313: note = Related to NZ_FSRV01000001.1; note = Burkholderia sp.
MTIALRKELQESLGLSEAQLNRLILRAPHTYKVYTIPKRTGGVRVIAQPAQETKFIQNWLIKRVFGELPVHSCATAYQAGSSIKKNAAAHKDHQYLAKFDFKDFFTSIKADDLVAHMSRHLAGLLSRSEILDAARISSIQQRQSESLCLSIGAPSSPLLSNSVMFEFDSLVSNWCVDRGIIYTRYADDMTFSTNRKGRSGEIEEFIRNIARGLDYPRLRFNSKKTVFLSKKHQRRITGIILNNDGELSLGRDRKREIKALVHKFTCDELPGEEVYRLQGLLGFALDVEPTFLQALNVKYSDQVIETILSIRKE

SEQ ID NO: 4593 - protein, 314 aa, unidentified
  source 1..314: note = Related to NZ_CP017757.2; note = Cupriavidus necator
MKIALRKALHDSLGLPEDQLNRLILRSPYSYKVYTIPKRSGGLRVIAQPAKETKFLQHWLMANVFRNLPVHECATAYQAGSSIKKNAELHKNNSYLVKLDFKNFFPSISARDLISHMRRHLDGSLDEEAQRDIARISCIRLPDAPGLCLSIGAPSSPMLSNSVMFEFDTAVHGWCNERGVRYSRYADDLSFSTNERGASGDIKEYVLSVVERLEYPRLSLNDKKSVFLSKKHQRRITGLIINNENQISLGRDRKREISALIHKFSVGALPDSEIFRLQGLLGFARDVEPRFFVSMSKKYTSDTISNILSTRKKP

SEQ ID NO: 4594 - protein, 317 aa, unidentified
  source 1..317: note = Related to QFXG01000005.1; note = Candidatus Nitrotoga sp. SPKER
MTDHLRHGLQESLGLSDCLLNRLIQRAPHSYKIYTIAKRTGGQRTIAQPAKETKFIQRWLIQNIFNKLPVHECASAYKDGASIKKNANAHKNHSYVIKLDFKDFFPSITFSDLVKHIAKHLGHILRTQDIQDIARISCIRLHGKSDLCLSVGAPSSPVLSNTIMYNFDSEVSAWCTQQCITYTRYADDLTFSTNFKGGSSEIEAFVRSITQKLTYPSLRLNNNKTTHLSKKHQRRITGIIINNEGNLSLGRNRKREICALIHKFSLDLLPESEIFRLQGLIGFAKDVEPLFVARMRGKYSSKLIEEVLQKRKPGRLC

SEQ ID NO: 4595 - protein, 312 aa, unidentified
  source 1..312: note = Related to JABFOH010000005.1; note = Acidithiobacillus ferrooxidans
MTDHLRHDLEESLGLSDYLINRLIDRAPYSYKVYTIPKRSGGQRTIAQPAKEIKFIQRWLIQNIFDKLPVHECASAYKDGASIKKNANSHKSHSYIIKLDFKDFFPSITSSDLVMHISKHLGRTFGAQDIQDIARVSCIRLHGKGDLCLSVGAPSSPVLSNTIMFSFDSEVSAWCAQNGITYTRYADDLTFSTSTKGICSEIESFVKGVTQELDYPNLTLNFNKTTHLSKKHQRRITGVIINNFGALSLGRNRKREISALIHKFSLDMLPESEILRLQGLLGFAKDIEPLFVARMRRKYSSRLIEEVLKKRK

SEQ ID NO: 4596 - protein, 321 aa, unidentified
  source 1..321: note = Related to NZ_RJUK01000001.1; note = Marinimicrobium koreense
MMIGLDISEQISKDLYVSAFQVDRLINRAPHAYKIFFIPKKTGGQRKIAQPAREVKYIQRWLVDNIFNQLPVHEAVKSYREGLGIKDNATWHKKNKYLVKLDFKDFFTSIKEAGLFDFLLRKLSDSYSDESLRKIARASCIKYKHREDLCLSVGAPSSPAISNAILYAFDEAVNNWCFENSISYTRYADDLTFSTSVPNVSSLIEPKVRQISSDFPYVNLRFNNAKRTHLSKKYQRRVTGIVLTNQGELSVGRLRKREVKALIHKFKTGLLPMNEVHRLQGLLGFVSDVEPMFLERMRVKYSSATIDDILKSVKQDKLVNS

SEQ ID NO: 4597 - protein, 314 aa, unidentified
  source 1..314: note = Related to MVDH01000001.1; note = Cellvibrio sp.
MNKSLLQEISESFFMSEIQIERIFVRAPYAYKLYTIPKRSGGLRNIAQPAKETKYVQSWLIHNVFSSLPVHDCAMAYKSGSSIKENALAHVEKPYLVKFDFKDFFTSIKEANLIAHFQLYLGGRFSSEEIKYLARISCIKYKHATEKCLSVGAPSSPILSNSILFEFDKSVHEWCVSKNIVYTRYADDLTFSLREKGMASTIEAEVRNFAKTKCVVNLRFNQKKTTHLSKKCQRRITGLVITNEDKISLGRDRKREIKALIHQHLLGMLNADQVSNLQGLLGFAKNIEPSFLFSLYKKYTFEVVNGIIRSRKTK

SEQ ID NO: 4598 - protein, 314 aa, Pseudomonas sp.
  source 1..314: note = Related to NZ_BQIK01000019.1
MTNSPLVNICADTLHISTSQVMRLILRAPHTYKVYSIPKKSGGRRIIAQPAKETKYLQDVIIKRYLNLLPIHEAASAYKIGSSIKNNANAHKHNKYFVKLDFKRFFESITLDDLVTHFEKYLPTPLSKEDTVYLARICCRSSDGRAALTIGSPASPVLSNTVMYDFDKIIESWSSQNGFTYTRYADDLTLSTSTPGASAQVIPAVLNALEKIEYPKLLLNNEKTVFLSRKNNRRITGIVINNDGRLSLGREKKRLISAMIYHYQQGRLSEENQFKLQGLIGFALDIEPIFVSRLNSKYGRDVISKILQRRQPKQ

SEQ ID NO: 4599 - protein, 310 aa, Pseudomonas sp.
  source 1..310: note = Related to JAFFZW010000005.1; note = Pseudomonas alliivorans
MIAHKTLEKMLADLSLSSEQLVRVVSRAPYSYKTYSIPKKNGGLRIISQPARETKYVQHWLIHNVFHLLPIHEAASAYVKGASIKKNAEAHRTNEYMVKLDFKDFFPSIKIDDLIAHFQKSLPFLDLLEIRYIARLSCINRGNGGALSIGSPASPILSNSIMYEFDSVVADWASQNKFVYTRYADDLTFSTSLPYASESVVPVIKDLLSSLKYPRLSLNVDKTIHLSKRGSRRITGLVITNDDKVSLGRDRKREISALVHKYGLGLLEQKDVFRLQGLLGFAADVEPLFLSRLGKKYGMKTILNLLRKRQ

SEQ ID NO: 4600 - protein, 316 aa, Pseudomonas sp.
  source 1..316: note = Related to MSXW01000061.1
MSNNPLIDALLSDLALSKEQFLRIASRAPRTYKIYPILKKNGGIRVIAQPARETKYIQSWLANNVFGLLPVHDSATAYRKGSSIKVNAQMHAANPYIVKLDFTNFFPSIKSSDVFAHLKQFLIGATDSELKIFTLLSCFNNNGELCLSIGSPLSPGLSNSIMYEFDSIISDWAAGNNFIYTRYADDLTFSTPIKGASEAVVDKVREVIGKIAYPRLSLNEKKTIHLSRKGCRRVTGLVLSNSGSVSIGRDKKREISAMVHRFSIGKISHDDLRRLQGLLGFVQDVEPLFIARLRAKYSSAVVVDLLRRRVKKESDK

SEQ ID NO: 4601 - protein, 318 aa, Pseudomonas sp.
  source 1..318: note = Related to POUU01000009.1; note = Pseudomonas stutzeri
MSNQSTLSRLLDELALEPHQFRRIALRAPYTYKTYTIPKKNGGARVISQPARETKYIQSWLIENIFKKLPVHSAAAAYVKGASIKKNANAHKDNPFLVKMDFENFFPSIKSLDLHLHFRKHLSFLSEEEILLVARLCSVRGMVHDGLSIGSPASPILSNSVMYEFDSLVAEWSQRNGFVYTRYADDLTFSTSTKEASAAVEPMIRDVIGAIGYPSLTINNRKTLHLSKKTNRTITGVIINNQGQLSLGRTKKREISSLVHRYTLEQLDVSRVHKLQGLLGYAYDLEPKFINALSKKYSLGVINEILRRRPPRQEANTD

SEQ ID NO: 4602 - protein, 323 aa, unidentified
  source 1..323: note = Alphaproteobacteria bacterium; note = Related to SDYH01000002.1
MTIALIEEIQASLGLSSEQMVRLIVRSPYTYKTYTIPKKSGGFRVIAQPAKETKLIQRWLISNLFNKLPIHDCATAYKEGSSIKLNANKHRENEFLSKFDFIDFFQSIKEEDIKAHLMECLGGFLSEKEVAWVARLSCIKTQTSKNLCLSVGAPSSPLLSNSAMFQFDSKLNNWCQENGIIYTRYADDLTFSSSIKGASAEIEGAIQNVLTEMARPKLLLNNKKTIHVSKKHQRRITGIIINNEDELSLGRERKRMISALIHKFTLNQLASFEIFRLQGLLGFSKDVEPAFLIRMRDKYGSGVIEMILKIRKDNNGKNGDFNS

SEQ ID NO: 4603 - protein, 313 aa, unidentified
  source 1..313: note = Related to JACVPK010000010.1; note = Polynucleobacter wuianus
MNSNDLIGRLISHLGLNEKDVLGLIRRAPFTYKVYTIPKKTGGNRVIAQPARETKYIQNWLIDHIFLALPVHERSMAYKKKIGLINNVLPHKNNKYLAKFDFKDFFHSIKFLDLVNHFNKHLHHLLSEAEIQYVARVACIKQRDSGSLCLSVGAPSSPLLSNSFMFEFDSAMDEWCQENEIIYTRYADDLTFSTNISGATNKIQQTIVGILSLKYPNLFLNHDKSIQLSNKNRRRVTGLIITNQQRISVGRDRKRMVTSMIHKFSIGELRAEDVFYLQGMLGFIKSVEPTFLVSMNRKYGHDLLTKIISIRKE

SEQ ID NO: 4604 - protein, 317 aa, unidentified
  source 1..317: note = Related to JACYMM010000001.1; note = Janthinobacterium sp.
MIDNLSGLIHLSLGISTTQLDRIIQRSPFTYKIYTIKKRSGGYRTIAQPAKETKFIQNWLIENIFSTFPVHECASAYKNGASILKNAELHKKGEFLSKYDFKDFFSSIKVKDLVLFFTHQLAHRFSKLDILRMAQISCVRHTELSGLCLSIGAPSSPILSNAIMYDFDAKIYEWCNKNNISYSRYADDLTFSTNELGRSDEITSLVNAAILENKIVKLQINKKKTVHLSKKYQRRITGLIITNSNIVSIGRSRKREISTLIHKFSLNMLSDDEKYRLQGLLGFSKNIEPLFIERMNVKYGKDLINQIFKIRKSTDTA

SEQ ID NO: 4605 - protein, 315 aa, unidentified
  source 1..315: note = Related to NZ_CP033019.1; note = Janthinobacterium agaricidamnosum
MKYSLPQLLQENIGLHPSQFERLIRRAPDTYKHYTIKKRTGGDRWIAQPAKETKYIQHWLIDNIFLKFPVHRCAMAYKAGTSIAINAAAHSKNSYLAKFDFSNFFNSIKYHNVNDFLSLLLEDSFSPDDIDNMARVSCVREPDFGLCLSVGAPSSPLLSNAILYEFDSRIEYWCQERSITYTRYADDLTFSTNEKGACSEIHKFLVDSLIDFDCPVLRLNDKKTIHSSKRFQRRVTGLIINNDGMVSLGRGRKREISAMIHKFRCKDLAESESYRLQGLLGFARDAEPSFVESMNKKYGNEILSSIYSLRKPKES

SEQ ID NO: 4606 - protein, 318 aa, unidentified
  source 1..318: note = Related to NZ_WNKY01000042.1; note = Duganella radicis
MNSKLLTQIRAELGLPVAQIERLIERAPYTYKVYTIPKRSGGDRTIAQPARETKLIQKWLIEHIFCTLPIHDAAAAYRPGASIKKNAERHANSKYMVKLDFKEFFPSIKYQDLVNHFCVHLSDAYEDDDIKRMALISCLHIGGRDFALSIGSPASPCLSNSIVYELDKKIKSWCKENKVAYTRYADDLTFSTNRPDISSEVEKMVSLTLKEIEYPQLKLNKKKSIHLSKRHKRVVTGVIINSENNLSLGRDRKREISSLIHKYSIGLLSKGDTYRTQGLLGFARDIEPDFVARLNTKYGNKLLEEIFTLRKAEEEDDL

SEQ ID NO: 4607 - protein, 315 aa, unidentified
  source 1..315: note = Related to LRON01000007.1; note = Duganella sp.
MSSKLLTQIRAGTGLPITQIERLIVRAPYTYKIYTIPKRSGGERIIAQPARETKLIQNWLVENAFGSLPIHKAATAYRSGASIKHNAEMHAKSRYMVKLDFKNFFPSITYNDLVAHFSRHLSEQYEIEDIKRMAIISCLNIGRLDLALSVGSPASPCLSNTVMYELDNIIQNWCDDKHITYTRYADDLTFSTNQKDISTEVEIMIASSIATVQNPRLSINSEKTVHLSKKFKRMVTGVVINSQNNISLGRDRKREISALIHKFSIGILSPDEAFRTQGLLGFAKDIEPDFVVRMDKKYGNQLLEQIFKLRKVTEI

SEQ ID NO: 4608 - protein, 321 aa, unidentified
  source 1..321: note = Related to NZ_CP016442.1; note = Burkholderia stabilis
MKIDLSQRLQESLGVSSDQLARLVARAPYAYKVYEIKKRSGGMRTIAQPARETKFIQIWLIENIFKELPVHESATAYGKGSSILKNAVAHKDNRFIAKFDFRNFFPSIKYEDLVEHFTRHLSGVVSDADVKMMARIACMRSKTNGRMQLSIGAPSSPILSNSIMFEFDSQISAWCVEQGIVYTRYADDLAFSTDVIGATAKIEPIIRQALRGINYPALQINNKKTVQISKKFQRRVTGLVINNEGDISLGRDRKREISSLVHKFTLGGLADDDIFRLQGLLGFAKDVEPQFIVRLSAKYTAEIINVILKLRKPPKLKSDFN

SEQ ID NO: 4609 - protein, 316 aa, unidentified
  source 1..316: note = Related to NZ_CADEZN010000001.1; note = Burkholderia gladioli
MNLSLKMQEELGITGEQFTRLVARAPYAYKIYEIDKRSGGTRTIAQPARETKFVQSWLIEHVFGALPIHECATAYGKGASILKNVDAHKENSFLAKFDFRNFFPSIKYDDLLLHFSIHLSNIASVEDVKMMARIACMRSKASGQLQLSIGAPSSPIISNSVMFEFDCRVAAWCAEQRIVYTRYADDLAFSTNVKGATVKIEPIIRKVLREIPYPLLQLNNKKTIHVSKKYQRRITGLVINNADEVSLGRERKREIGALVHKSTLGLLNDDDVFRLQGLLGFAKDVEPQFVIRLRAKYTCEVIDAILQLRKPSKAKS

SEQ ID NO: 4610 - protein, 326 aa, unidentified
  source 1..326: note = Related to JAGMZN010000009.1; note = Acidovorax sp.
MSILEGLAMASSIFSRMQEAYALSDEQLNLLVKRSPHSYKVYSIPKKSGGNRQIAQPAKETKYLQYWLIENVFSLLPVHECASAYHKGASVKSNAAAHSKNQYLSKFDFRNFFPSIVFSDLVRHFEKHLNDHVQAADILLIARLACIRPKGTSNLCLSIGAPSSPILSNSIMYEFDERISGWCKDHGIVYTRYADDLAFSTNIKSISYAVEKELREVLAGLQYPKLVLHAEKTIHVSKKYQRKITGVVINNQNALSIGREKKRIVSSLIHRFALNGLSDADISRAQGLLGFAHDVEPLFVVRMRQKYGFRVIDQLLSFRVQSEEKK

SEQ ID NO: 4611 - protein, 313 aa, unidentified
  source 1..313: note = Related to NZ_KI911557.1; note = Methylomonas sp.
MSTNLRREITGSLGISDLQINRIITRSPYAYKTYSINKKSGGKRIISQPAKETKFIQRWLVENVFSKLPIHQSVTAYRAGSSIKKNASIHKNNKYFAKFDFKDFFTSIRSDDLIAHLNKYLSDKYSYEEIMDIARISCKKNKRSGKLFLTIGAPSSPIISNTVLFDFDTLLYSWCCQNNITYTRYADDLTFSTNEKESTKNIEKNIRSIIRAIEYPRLIINSKKTVHLSKKSQIRITGLIIDNNKNVSIGRKRKREISSLIHSFSLGALPNDEVYRLQGLLGFANDSEPQFLERMRSKYSSEKIDNILKIRKQ

SEQ ID NO: 4612 - protein, 314 aa, unidentified
  source 1..314: note = Related to NZ_BMXS01000014.1; note = Halomonas qijiaojingensis
MDESRFRQLLKDELSISFSESARLIARAPHAYKVYRIKKVGGGYREISQPAKETKFVMHWLVGRFFEKLPVHECATAYSSGSSIKKNAIIHAEKSYIAKFDFKDFFPSITKFDVEKHLGCFNREELDGKSLSEIARLCTVAKGGSDNLCLSIGSPASPVLSNSIMYAFDRRIYEWCCDNSVVYSRYADDLTFSTNVKGLSFELPELVRTVLDGIEYPSISLNNEKTVFASKKGHRRVTGLVLSNPGKVSLGRKRKREISALIHKFSVGALSKEDLLRLQGLLGFVKDVEPLFVEKMISKYGYRVIVKILSFRKD

SEQ ID NO: 4613 - protein, 312 aa, unidentified
  source 1..312: note = Related to NZ_BJOC01000041.1; note = Halomonas halmophila
MDESKFRRLLKEELSISYSESARLIARAPHAYKKYRIKKADGGFREISQPAKETKFVMHWVIDRFLKPLPVHESAAAYRKGASVKKNAAMHSSNSYLAKFDFKNFFPSIKISDIERHLALHGDRGLDERSVSEIARLCTIAHMEGKCLSIGSPASPFLSNSIMYDFDEKVSRWCAENALTYTRYADDLTFSTNVKNLSFEVQGFLIEVIQSLEYPAIELNENKTVYASKKGHRRVTGVVLSNAGNVSLGRERKREISSLLHKFRIGELSREEVYRLQGLLGFANDVEPVFVERMRKKYGHDLLWRIMSLSRE

SEQ ID NO: 4614 - protein, 315 aa, unidentified
  source 1..315: note = Related to JABJWH010000040.1; note = Alcanivorax profundimaris
MDETVFQSLLQKELAISTSESGRLIARAPYAYKTYSIKKANGGRRTISQPAKETKFVMRWLVDRIFSKLPIHECASAYQKGSSIKRNAITHSNNGYIAKFDFKDFFPSIKREDIETHLYQYLPKDLELDRKSISQIARLCTISTGGGRLALSVGSPASPALSNSIMFDFDTIIANWCFSNSIFYTRYADDLTFSTNRKGLSFLILEQIHNTLSEVNYPQLSINDRKTVYSSKKGHRRVTGVVINNNGKLSLGRERKRKISSMVHKSCLGVLSDDETRHLQGLLGFAKDVEPLFIIRLKNKYGKRAIQEIFNSQII

SEQ ID NO: 4615 - protein, 319 aa, Pseudomonas sp.
  source 1..319: note = Related to VOJF01000050.1; note = Pseudomonas aeruginosa
MTLQEFLLKISSALAISNSELLHLIAKAPYSYKSYKIKKKSGGDRVISQPAKEIKYLQNIIMEAFLNKLPIHECATAYKKGGSIKKNAAAHTSNTYISKFDLKDFFGSIKANDVSQHLEKHLNGDLPPASYQLIARICCIKHKGLEELCLSIGAPSSPLLSNSIMYEIDQKISQWCRENQVTYTRYADDLTFSSNIKGISFEIEGLLSDILSTSQSPRLKINEKKTIHVSKKGTRRVTGIIITNDNKMSLGRERKRLISAMIHRNLVQRLEEKDIERLQGLLGLAKDIEPIFCARMRKKYGAAAISEILQYRREELKED

SEQ ID NO: 4616 - protein, 319 aa, Pseudomonas sp.
  source 1..319: note = Related to NZ_UATW01000001.1; note = Pseudomonas aeruginosa
MTFQEFLLNISSALAISDSELLHLVAKAPYSYKSYKIKKKTGGDRVISQPAKEIKYIQHVLIEFFLNKLPIHESATAYKKGGSIKSNAAAHRENTYISKFDFKDFFSSIKAADISLHLEKHLGDDLPPESYQLISRTCCIRHKGAEELCLSIGAPSSPLLSNTIMYELDQKISEWCQENQVIYTRYADDLTFSSNIKGKSFEIENVLRSILSATPSPKLSINNKKTIHVSKKGTRRVTGLIITNDDKISLGREKKRLISSMIHRNLTQGLKSKDIEKLQGLLGLAKDIEPIFCSRMRKKYGAATISEILQYRREEPEED

SEQ ID NO: 4617 - protein, 316 aa, Pseudomonas sp.
  source 1..316: note = Related to NZ_CP015992.1
MSHHDFLHDIASTLTLSLQELVYLIAKAPHSYKVYRIEKKTGGKRIIAQPARQIKYLQRALIHSVFKELPIHSCATAYAHGSSIKKNAEPHKNNKFISKFDISDFFGSIKEHDLIKHFNRHLAENINPDYFRYIARSCCINYKGTQELVLSVGAPSSPILSNSIMHEFDCIIHDWCTSKNITYTRYADDLTFSSNTKGVSFEIEKAITEALNSLDYPTLKLNTKKTFHASKKSQRRITGLIISNEGKISLGRDRKRTISAMIHKFSNGALPEEDIPKLQGMLGFAEDVEPVFSSRMRAKYGVKAISEIFQYRKQKK

SEQ ID NO: 4618 - protein, 314 aa, unidentified
  source 1..314: note = Oceanospirillaceae bacterium; note = Related to PBYC01000020.1
MKQESPIIAALCSELGFSSNQLMRLIARAPHTYKTYKIPKKTSGFRTIAQPARETKILQNWLIHNVFKDLPVSESASAYKKGASIKKNASHHKDSSYLLKMDFKNFFESIDIEMIKNHLISCLDVSRLDASAIARICSIDTQSSPNHHLSIGAPSSPILSNSFLFNFDLEAEQWCKENNCIYTRYADDIFVSTNAKSKTKEAEQLIEKLVNELLPGLKLNHKKTKHLSKKFNRTITGLVISNDNEVTLGRDRKREVRKSVFLYTKGLLEHEQVEKLQGTLSFAKHIDPVFLSSLQEKFGSDIIGEIFNARRKTK

SEQ ID NO: 4619 - protein, 311 aa, unidentified
  source 1..311: note = Related to JALE01000028.1; note = Thalassolituus oleivorans
MTTTPSFLSKLAKAYKLTETDIKRLVARAPHTYKTYEIPKKSGGKRTIAQPAKETKIIQNWLIKTEFKGLPVSNSASAYKPGSSIKINALKHRKNRYLLKMDFKNFFESIDETMVKEHLFKYLQIPESDAATISRVCCFQKKHSKKLSLSIGAPSSPILSNSIMYEFDAEIENWCRLNAAIYTRYADDLFISTNQSGRTADAEQFILTLTKELLPKLDINKNKTKHLSKKCNRTITGLVITNEGGVSLGRDKKRNIRKSLFLHQKGLLDKKQLSTLQGELGFAKHIDPDFITTLNDKFGNQFIHAIFTHRE

SEQ ID NO: 4620 - protein, 314 aa, unidentified
  source 1..314: note = Related to DNYL01000221.1; note = Halomonas sp.
MKSKLREIIKKKFALSDAEVAILISRAPVSYKSYKIKKKNGGHRKIHQPAREIKALQRWILDAVFSKLKVHPSSTAYEPGSSIKENAKRHLDNSYFIKLDFKDFFHSIKSEDIIQFLTDKGIKLNNRDLSDLVRILCIKDGESLCLSIGAPSSPKVSNVILYDFDEAVTNWCSENEVTYTRYADDLTFSTKRKGIGHLIEKQVLEIISEIQYPKIELNLSKRVSVSKKDWVSITGLTITTQNSISVGRKRKRFVKSLIYKHLSDGLQEKKLGELNGLISFIENIEPGFKDKMLEKYGDVPGLNLKKAKDEVSDL

SEQ ID NO: 4621 - protein, 314 aa, unidentified
  source 1..314: note = Related to NZ_SOCZ01000001.1; note = Halomonas alkaliantarctica
MENKLREIIKKQFALSDTEVAILISRAPVSYKGYRIKKKNGGHRKIHQPAREIKALQRWALDAVFSKLKVHPSSTAYEPGSSIKENANRHVNNDYFIKLDFKDFFHSIKSEDIVQFLSDKGIKLNSKDLTDLVRILCIKHEDSLCLSIGAPSSPKVSNVILYDFDEKVTSWCNENNVTYTRYADDLTFSTKQKNMGHLIEERILKIIYDMNYPKLELNISKRVSVSKKDWVSITGVTITCQKTLSVGRRRKRFVKSMIYKHMSEGLKQHNLSELNGLIAFIEHIEPGFKRKMIEKYGNVAGLNLKKESDEDPEI

SEQ ID NO: 4622 - protein, 309 aa, unidentified
  source 1..309: note = Related to NZ_ONZI01000001.1; note = Kushneria phyllosphaerae
MSESKLRQLISSSLFIPEKDLSLFIARAPVAYKSFFIAKKDGGFRKINQPAKETKKLQRWVIEKVFSHLDIHDCAMAYRAKVSIKDNALVHSNNKYFLKLDFENFFGSIKSEDIQNFLHDKKIKLDDDDVRDLARILCIKDEGKLCLSVGAPSSPAVSNAILYAFDEEISFWCLERKIAYTRYADDLTFSTKEQEACYSIKEKVKSILESMAYPRLKLNESKTLSLSKKNNIKVTGITVTSDNKISIGRKRKRFIRSQVYKYKKGELKPSSVPRLRGLIAFFEHIEPGAISKLEMKFGKELMVRVVKGS

SEQ ID NO: 4623 - protein, 326 aa, unidentified
  source 1..326: note = Related to NZ_NGUT01000002.1; note = Paraburkholderia caledonica
MHILERISHDLLVPQSLLEDALRRAHVRFRKIKIPKRSGGERVLLQPAAELKLILSWADSYVLRKAPVSNVATAFEPGTSIVRNAQIHSKSDYSVRVDLSNFFPSIRSHDLLRALSKARQHFPEWVFERDFEDMLRKACFDRADSLPVGYMTSPRIANIVMLDVDTTLQTTISSNPERFGRAYITRYADDFVFSTNRKGACNEFVEELRTLLASRPSPKLAINEAKTRFMSRKGGTTLITGLRVNNDGDVGVHANYRDHIRLLLKLFATGRLEQAENESLRGHLAFIEHADPSLFTRLSYRYHAEIAKLRGHAGLTALPAPQKLSS

SEQ ID NO: 4624 - protein, 318 aa, unidentified
  source 1..318: note = Related to NZ_SMRP01000003.1; note = Paraburkholderia silviterrae
MNIVERMSNELSVPQSLLESALLLAHVRFRKIKVPKRSGGERVMIQPASELKLVLSWLDSRVLSNAPVSPIATAFEPGTSIVKNARTHSKSLYSVRIDLSNFFPSIRSRDLLLALSRSRELLPEWASGGDFETLVRNACFDRADRLPVGYMTSPRIANIVMLELDTALATAVSRDTVRFGQAVLTRYADDFVFSTDKKGACNEFLSEMRSLLASTPSPKLSINEAKTRFMSRKGGTTLITGLRVNNDGDVGIHANYRDHIRMLLKLFSTGRLKPAENEKLRGHLAFIEHADPDLFTRLSFRYHAEIAKLRGHPSLNPA

SEQ ID NO: 4625 - protein, 306 aa, unidentified
  source 1..306: note = Related to MTZU01000087.1; note = Burkholderia ubonensis
MLDDAIQAAYFRFKKFTIKKRSGEDRHLIQPAAELKLVIAWLDAVVLSKLPVSDLATAFQPGTSIVMNAEAHRKSAYSVRLDVSGFFPSIRSKDLIRAINDAKPRFEEWVFTPAFEQLVRKACFDRSDRLPVGYPSSPRIANAVMYELDMRLNQLIAAAPERFGQAVLTRYADDFVFSTDKQGACRTFADELQTILARCASPKLSINVAKTRYMSRKGGSTLITGLRVNMDGKVGVHANYRDHIRLLLKLFSVGKLDFEEHEKLRGHLAFIEHADPRLFTKLSFKYYKEIASLRMKKAVPEQESPQ

SEQ ID NO: 4626 - protein, 317 aa, unidentified
  source 1..317: note = Related to NZ_JAALCQ010000007.1; note = Rubrivivax sp.
MTDFPALIGEKTNVPTEIIKSAVDLAHIRFRKIKVKKRSGGERIIIQPAAELKLVLAWLNNEVISKLPISPIATAFRKDASILKNASEHKASLYSIRVDIKEFFPSIRSSDLVLAIKSSPIELPPFTAEAGFFDFIQRCCFDRDGRLPIGYPTSPAIANAVMRNIDVALLNKINIDPTKFGQARLTRYADDFVFSSDKPGACRSFLDTLQETLIRTTSPRLAINSKKTRFMSRRGGSTLVTGLRINQDGLVRVHPKYRDHVRLLLKHFANGSISADDVPRLVGHLAFVQHADPRLFTRLSFRYFEEIARLRGKQENT

SEQ ID NO: 4627 - protein, 313 aa, unidentified
  source 1..313: note = Related to NZ_QXJC01000004.1; note = Simplicispira sp.
MTNFPVLIADQMKVPVVLVEDALKLAFIRYRKIRVPKRSGGYRTIIQPAAELKLVQAWLNEKIFKHLPLSSVATAFRPGASITNNAAIHRNSLYSVRVDIKDFFPSIRSVDLIRIVRSNRSALPPFVMETGFTNLVRQACFDREGRLPIGYPTSPSIANAVMHQTDKMLINEITSDVSIFGNTQLTRYADDFVFSTDKSGACHEFVRKLERLLSTLESPRLKLNTSKTKFMSRRGGSTLVTGLRINQEGLVRVHANYRDHVRLLLKHFAAGSLQSDDVIRLVGHLAFVEHADPRLFTRLSFRYFEEIARLRGK

SEQ ID NO: 4628 - protein, 316 aa, unidentified
  source 1..316: note = Related to JABMJG010000023.1; note = Variovorax sp.
MDSIVSKISGDLKIPIATLEIAIRLAKTRCRKFSILKKNGDTRQIIQPSVKVKPILSWLSLNVLNSLPVHDAATAFRRGKSILDNTSKHKEADYSVRLDLKDFFPSIKPEDLWRVMLDSRHLIPEWSIKEDAFWLISNVCFDQNNQLPIGYSTSPAIANAVMHRIDTTLANAVMDDSRFGAATVTRYADDFVFSTNKRGACKNFSDLLHDVIKTTNSPSLQINENKTRYMSRAGGSTIITGLRVNNLGAVVVHGNYRDHVRLLLKLFDSGRLALDQVPQLAGHLAYIEHVDPALFTKLSFKHYKRIEEIRSLRLVE

SEQ ID NO: 4629 - protein, 311 aa, unidentified
  source 1..311: note = Related to JAJTEM010000008.1; note = Burkholderiales bacterium
MLAKISDDLNIPRPLLENALALAATRFRKITFKRRSGPPRVAYQPAVELKPILEWLDITLISKLPVSRIATAFCAGSSIVQNAQVHRDSLFSIRVDISNFFPSITSSDLVTAIEATSHLPEWSNAPTTLRVLKQACFDINDRLPIGYSTSPRIANAVMFSLDNLLIQAISDERRFGNSLLTRYADDYLFSTNQRGACAEFLKEIRKILNSVQFPKLQINNEKTRFMSRAGGSTLITGLRIKQTGEIGVHAHYRDHVRLLIKLYAANRLRAEEFDSLRGHLAFVEYADPKLFTHLSFHFSDEITRIRSTDSL

SEQ ID NO: 4630 - protein, 312 aa, Achromobacter sp.
  source 1..312: note = Related to NZ_CP054569.1; note = Achromobacter denitrificans
MSNIIDLIADDLQLPKTLVKSAVDFARSNNRKIIFPKKTGGKRTALQPSVESKPIMHWLRLKLIELLPIHMIATGFRANHSILTNADRHRQSAYSVRIDIENFFESISFNDFKKTLESNKATLPSWALEEATLSLVEKICFDRDGRLPIGYPTSPGIANATMFEIDSALESLILDTTTFGQAIVSRYADDFTFSTDLRGSCRAFLEKLELLLASQTSPTLRINAKKTRFMSRGGGSTLVTGLRINNCGVVVVHPEYRDHIRLLLKLYSRNTLKQEDIPRLLGHLAHIQNVDPGFFTKLSYRYHEEISRIRKK

SEQ ID NO: 4631 - protein, 312 aa, Alcaligenes faecalis
  source 1..312: note = Related to NZ_LQAS01000005.1
MDDILELMAADLSLSKTTLKSTIFSTKRKYRKFSIEKASGGQRVIHQPSIELKPILYWIQINILDKLPVHKISTAFKKGSSILNNASLHQESLYSIRVDIDNFFNSIQPQDLISAIRENQANLPEWTKDGYVDELVTLSCFISRSYLPIGYLTSPQIANSVMFKIDSLLDEEFSNEGKYGVAKISRYADDFIFSTDKKGACKDALEKLKSIIEESKHPNLAINKKKTTYMSRPGGSARVTGLRINNQGKIIVHACYRDHVRLLLKLYKENRLNEEGGKEKLVGHLAHIQNVDPGLFTKLCLKYSSEIHELRK

SEQ ID NO: 4632 - protein, 312 aa, unidentified
  source 1..312: note = Related to CP009585.1; note = Burkholderia pseudomallei
MSSLATLAAAECCVPESWVNDVVRQGPSRVKTLRIEKSTPGKFRIISRPSAELEILQRWLVLRFFEKMEVHDSAMAFRRGRSILTNAQAHAKSRFFVRVDFSNFFPSIRYADFSFALGKSKNLGYFFSEYADAGNFIQRICFDSNLRLPIGYISSPTISNAVMFEFDVRMEGMVAANGGDLGNAKVTRYADDIVFSTDKKGGCAKFVELLRELVKTWASPLLSINENKTIFSSSSGGSAIVTGLRVCSDSHITITREYKDKIRLMLSLHAKKCLRPEDLPKLKGHLNYIRYVAPAFFSTLCAKYTSVIDKLI

SEQ ID NO: 4633 - protein, 312 aa, unidentified
  source 1..312: note = Related to CAJNBA010000001.1; note = Paraburkholderia aspalathi
MPSIVTLAAAECCVQESWVNDVVRQGPSRVKTLRIKKSTPGKFRVISRPSAELEILQRWLVLRFFEKMEIHESAMAFRRGRSILTNAEVHAQSRFFVRVDFSNFFPSIRYADFAFALGKSTELAYLFKEYSDIGNFIQRICFDSNLKLPIGYISSPVISNAVMFEFDARLENIVAANGEDLGSARVTRYADDIVFSTDKKGGCTKFVEILRSLVKSWASPSLSINEDKTNFSSSSGGSAIVTGLRICSDNHITVTREYKDEIRLMLSLLVKNSLRPEDLSKLKGHLNYVRHVAPAFFSTLCAKYTSVIAELI

SEQ ID NO: 4634 - protein, 312 aa, unidentified
  source 1..312: note = Related to NBSN01000004.1; note = Paraburkholderia fungorum
MSSLVKLAATECCVQERWVNDVIRQGPSRVKTLKIKKPKSAKFRIISRPSAELEILQRWLTIRFFEKMEIHDSAMAFRTGRSILTNAQFHAKSLYFIRVDFLNFFPSIRYADLNFAIGKSKIIRNIFTDYADAGSFIERVCFDSNLRLPIGYISSPIISNAVMFEFDVQLQKLVTANTNELGDGRITRYADDIVFSTDKKGGCAKFLELIRSFVKTWASPSLSVNENKTTFSSRNGGSAIVTGLRVCNDSHVTITREYKDKVRLMLSLRGKQVLRPEDVRVLKGHLDYIRHIAPAFFSTLCAKYTGVISEFI

SEQ ID NO: 4635 - protein, 312 aa, unidentified
  source 1..312: note = Related to NZ_PVFX01000143.1; note = Burkholderia gladioli
MPNFASLAATECHVPEDWVANVVRQGPRRAKILRIKKKNSDKFRSIARPSAELEMLQRWLLLKFFNQLELHDSAMAFRDGHSILTNAVRHKGSAYFIRIDFKDFFSSIKLQDFIMAMSQTKFFGFHLTEYSDYMEFIGKICFDSRGRLPIGYVTSPIISNAVMYRFDVALSNAISARTKEFGVSVLTRYADDIVFSTDLKGGCAAFLKFFQEFVSAWASPSLVINTEKTIFSSKAGGSAMVTGLRICNDNHITVTREYKDKIRLMLSLYQKSKLNEDELPALRGHLSYVKHVSPAFFSAICSKYLTAIEKLI

SEQ ID NO: 4636 - protein, 312 aa, unidentified
  source 1..312: note = Related to NZ_CP046674.1; note = Ralstonia pseudosolanacearum
MPSLITLAATECFVPEIWVRDVIRLGPSRVKRLRIRKKSSASYRVIKRPSAELEILQRWLTLKFFENLEMHDAAMAFRRGRSILTNAQHHVDSKYFLRIDFTNFFPSIKYDDLKKSVDKSSKNKGTFDAYHDADLFIKRVCFDENERLPIGYISSPAISNAVMLEFDEKVHRLIESNEEKLGAGKFTRYADDVVFSTDKKGGCTEFLKIFSSLVDGTTSPKLSINEKKTIFSSKLGGSAIVTGLRVCRDSHITVNREYKDQIRLMLSLYEKGKLDKEEHKNLKGHLSYVRSVAPAFFSRLCAKYFKSIEEFM

SEQ ID NO: 4637 - protein, 323 aa, Pseudomonas sp.
  source 1..323: note = Related to JAHYXH010000009.1
MSNLVKLAAKDCYVSEEWIKSVIDSGPNNVKIIHIKKKGDPNKTRIIHRPSAELETLQRWLTLTIFNQLANHEIAMAFLRGKSILSNAERHRKSKYFIRVDFKDFFKSIKADDLFKTIKFYNKSNSLISLSESDQFFIKRVCFDKLGRLPIGYISSPAISNAVMYDFDTRLLSLVNDNKAKLGAGIITRYADDIVFSTDTKGGCLEFLNLFKIMVNKNLSPRIFINEKKTIFSSRAGGSAIVTGLRVCQDSHITITRDYKDKIRLMLSLFEKGKLMQEDTATLRGHLSYIEHVAPAFFSKICAKYLYGISKILDPTPSPQQNN

SEQ ID NO: 4638 - protein, 316 aa, Escherichia coli
  source 1..316: note = Related to JAKLOK010000001.1
MEIYSIIDFETLMRSGFTSEVMRSPEPPKKWDIPKKNGGVRTIYHPASKVKLIQYWLINSVLINLPIHEAAYAFIKNRSIKKNALRHASARNKYYVKIDLKDFFPSIHYDDFEYAFKKYRDHIDYPEKLDSELLPLIKGVCFISDLTLPIGFPTSPFIANFVAREFDEKLTKNLNSIDRLNATYTRYADDIIISTNKKGASKQIINSVKSTLRNIKPDFKINPKKIKICSASGGSIIVTGLKVCDDFHITLHKKTKDNVRLLLSLLSKGNLKKDDYNKLSGYILYTKSIDPHFYTKLNRRFFKEIKFLENYHNKKN

SEQ ID NO: 4639 - protein, 316 aa, unidentified
  source 1..316: note = Related to SISW01000095.1; note = Hafnia paralvei
MEIYNIIDVETLMRKGFTGEVMRSPEPPKKWDIPKKNGGVRTIYHPSSKMKLIQYWLINRVLTNLPVHDAAYAFIKDRSIKHNALRHATTKNKYYVKIDLKDFFPSIKYNDFEHAFKTYRDRIDFPNNLDTEVLFLIKGACFIPDLSLPIGFPTSPIIANFVAREFDEKLTVKLNSIDRLNATYTRYADDIIISTGKKGCSKQIINAVKSTLKDIKPNFKINLKKVKICSASGGSIIVTGLKVCNDFHITLHKKTKDKVRLLLSLLAKDKLKIEDYNKLSGYIAYTKSIDPHFYTKLNRRYFKEIKMLENHHNKSE

SEQ ID NO: 4640 - protein, 316 aa, unidentified
  source 1..316: note = Related to CP026050.1; note = Serratia marcescens
MEIYKLIDSETLMRKGFTSEVMRSPELPKKWHIPKRNGGVRTIYHPSSKVKLIQYWLISNIFSNLPIHNSAYAFVNGRSIKSNALLHATAKNKYYVKVDLKDFFPSIKYSNFEYAFKLYRDRIEFSDVYDAELLQLIKSICFISDESLPIGFPTSPIIANFVAREFDEKLTLKLNSIDRLNAVYTRYADDIIISTNLKGASVKILNAIKSTIKRIEPNFKINNDKIHICSASGGSIIATGLKICHDFHVTLHRSMKDKIRLYISLLSKGRLKQEDYNKLSGYIAYAKSIDPHFYTKLNRKYFQEIRGIENSHNKVI

SEQ ID NO: 4641 - protein, 316 aa, Escherichia coli
  source 1..316: note = Related to CP010200.1
MRIYSLIDSQTLMTKGFASEVMRSPEPPKKWDIAKKKGGMRTIYHPSSKVKLIQYWLMNNVFSKLPMHNAAYAFVKNRSIKSNALLHAESKNKYYVKIDLKDFFPSIKFTDFEYAFTRYRDRIEFTTEYDKELLQLIKTICFISDSTLPIGFPTSPLIANFVARELDEKLTQKLNAIDKLNATYTRYADDIIVSTNMKGASKLILDCFKRTMKEIGPDFKINIKKFKICSASGGSIVVTGLKVCHDFHITLHRSMKDKIRLHLSLLSKGILKDEDHNKLSGYIAYAKDIDPHFYTKLNRKYFQEIKWIQNLHNKVE

SEQ ID NO: 4642 - protein, 316 aa, unidentified
  source 1..316: note = Related to OCMY01000001.1; note = Enterobacteriaceae bacterium JKS000234
MSLYTLIDKEVMMRDGFTQSVIDSSEPPKKWSIPKKNGGYRSIHHPSSKNKLLQYWLLTKVFDKLPQHDASYAFVKNRSIKDNALRHAKEKNNYYVKLDIKDFFPSIEFSDFEKCFLRYRELISIPTTWDESLLFLIKETCFLKPQKNLPVGFPSSPAIANFVARELDELILGELASYEKYNPIYTRYADDLVISVAEKGLSKEIIKAVKKAIKNCTCNFSLNEQKIKICSASGGSIIATGLKICNDHHLTLHKKMKDSIRLKLSLYSKGKLNIDELNKLSGYIAFAKSIDEHFYTKLNRKFFKELSSLENVHLKE

SEQ ID NO: 4643 - protein, 315 aa, unidentified
  source 1..315: note = Related to CP034474.1; note = Pantoea agglomerans
MILYKIIDTDIMMRDGFTESVIKSSEPPKKWTIPKKSGGVRSIHHPSTKNKLLQYWLLTKVFNNLPQHPASYAFIKGRSIKDNALRHAESKNNYYVKLDIEDFFPSITYDDFERCFVKYRDLITTPTKWDKDLLPLIQDVCFLKPQKILPIGFPTSPAIANFVARELDDIINAEMASFEKHNPVYTRYADDLIFSVADKGLSKKIITAVRKSLRKCSSNFKLNANKIKVCSASGGSVVVTGLKICNDHHLTLHKKMKDSIRLMLSLHSRGKLKEEDFNKLSGYIAFAKSIDEHFYTRLSRKHFKELRTLENRHLL

SEQ ID NO: 4644 - protein, 325 aa, unidentified
  source 1..325: note = Related to NZ_CP059959.1; note = Pectobacterium brasiliense
MMLYDLIENDLKMKTGFVSDILSSPEEPRRWTIPKRNGGIRFIYHPSAKRKVLQYWLLQRVFCLIPLNDAAFAFIKNRSIKDNALRHSKSKNKYFVKADIKDFFPSINFDDFLYSFNRYRADINFPKEYDNDLLRMIREVCFIGPKKTLPIGFPTSPFIANFIARELDEIIHLELKNINDANPIYTRYADDLVISSCKKRMHSELISIIRKSINKCNASFSLNEKKLKICSSSGGSAIITGLRICHDGHLTVHKKMKDKIRLYLSHINKKGLEESEINILSGYLAYVKNADANFYTKISRKHFKEIKEIENHYTYADLKPHDEVS

SEQ ID NO: 4645 - protein, 313 aa, unidentified
  source 1..313: note = Related to NSKB01000007.1; note = Halomonas sp.
MSIISEVSRELDMVEDSFREQIRLARGKIKHIKIKKKNGKGFRRIVIPPWEFKIVQYWTILNYLRNVKIHRSATAFHEGASIRTNALCHRKGNYFVKMDLSDFFPSVGVDDFKNALYKYHPEFIWLEKELSDSEFLESMFHKGVCAIGFPASPYIANICMIEIDELIESKLKNNVERFGRFSYTRYADDLTISIERKGFKREVEGVVYEAVREASLKNIKVNKEKTKYGSKSGGSAFVTGMRICKDGHITLHRKYKDHVRLLLSLYSKGKLKPEDKGKLLGHLNYCKSSDPEFYNKLVLKYFQSIEKLKNSNG

SEQ ID NO: 4646 - protein, 311 aa, unidentified
  source 1..311: note = Related to NZ_FNES01000010.1; note = Halomonas gudaonensis
MGIIKSIAKELGMPEPVFREQLNTAAGKIKHIRIPKKSQKGYRKLVIPPWEFKIVQYWLIYNHLKGFPIHPSSTAYKPGASIRKNALKHAEGKYFVKMDLSDFFPSIGAEEFRNIIEEYYPKHNWLIKELEDSDFVSSIFYDKKCAIGYPASPYISNIIMFGVDQHIDRALQDKQQTFGNYSYTRYADDITISIENKGHKKEVVRLVHDSIKKSGIKNLKVNQNKTKYGSKKGGSAFITGMRICPDGHITLHRKYKDNVRLLLSLYNRGKLDVAERSKLAGHLNYCKDADPLFYNKLALKYFSSIKKLQES

SEQ ID NO: 4647 - protein, 310 aa, unidentified
  source 1..310: note = Related to JAJNRC010000001.1; note = Halorhodospira halophila
MSEESVRNQIHEGRRQIKIKKIPKKDGNFRKITIPPRIFKLVQYWTIKNILHSLPVHEAATAFKPGSSIRENAFRHRDGQYFVKMDVTNFFPSIKSDDFFSVLSRMQHAEADPLLDSKDDEDFLDAMFRNRACEIGYPASPHIANIVMFEKDTRIDNALRDRKQEFGNSTYTRYADDITVSIDQKGYKDEITRLVSGVVEDDSEPTLKINPNKTRFGTRRGGGAFVTGLRVLPEGRLTLHKSYKDDVRFLLKLYEQDRLERWQISALQGHLNYCSFADPDFYTRLMIKHLDSIEEIKGEGLRSTDGTTEN

SEQ ID NO: 4648 - protein, 314 aa, unidentified
  source 1..314: note = Related to CP043420.1; note = Kushneria phosphatilytica
MKLIRDFCHEMGLPEEEFTVYVDDARERVKKAKIKKKDKTTREIIIPSWELKIIQYWVILNYLRKLPASESATAYYKGASIIKNAQAHRKGSYFVKVDIESFFPSLTLDIFITSLKKDLESNPENEVIRYLLEATNDASFNQSIFYNGTCVIGYPASPYIANYILKAFDENVVAELNEISGKLGIFNFTRYADDIVVSCENKGNKTEVLKILHNCLEQKFDGALKLKATKTKSTTRSGGSTIITGVLICSDGRTTLPRKYKDKVRLLFSLYAKEILEKEEIPALTGHLNYIRSVDPVFYNKLYSKYYTQIKKLS

SEQ ID NO: 4649 - protein, 317 aa, unidentified
  source 1..317: note = Related to NYUH01000011.1; note = Marinobacter sp.
MEKEMSIIDEIAKELRINKKIIESQLFASRKQVKKIRVPKKNGAHRSIYVAPKSYKIFQYYILNNYIKHVKKSHAASAFWKGSSILKNAKKHRERTYLVRIDISNFFPSIHINDFISVLDDSENNIIDLFSNPENAEVIMETCLSDEGYLRVGYPISPFIADIAMREIDQEIAKYLEEKFQEGTFSYSRYADDLVIGFDEKCGKEIEIAISEIIEKRDHPKLSINHSKTRYFNRNVGNAIVTGVRICQDGRLTLPKQFKDDLRFRLSLLNKGNLANEELSSLEGCLNHCRDIDPSFYTKLQTRYFKSIAELKNRNKN

SEQ ID NO: 4650 - protein, 313 aa, unidentified
  source 1..313: note = Related to NZ_CP031416.1; note = Gallaecimonas sp.
MHIKKAIANDLSIPDGLIDEAISVARAHVKIFHIQKRSGGSREICHPSKKLKTLQYWLIHSVFSQMQVHDASMAYRDGVSILHNAEKHRSNRFFLKMDLENFFHSISFEDFIPILRSWHRKSNPKWILDAECEDMIRRICFYKNDRLAIGYPSSPIISNIVMNEFDSKVSTLISDRKYGKVIYTRYADDLVLSTDKKGACSEIIKEIINLIQGTSSPNISVNHSKTKLGSSTGGSASVTGLKICSGGHITIHRKQKDHIRLLLSLYRKGKLEQEEENSLLGHLSYCHYVAPDFYTKLSKKYFKEIYDLRSKDL

SEQ ID NO: 4651 - protein, 313 aa, Vibrio sp.
  source 1..313: note = Related to MCXN01000048.1; note = Vibrio breoganii
MHIKRTIANELSIPDNLIDEAIRVARSHVKIFHIEKKSGGSREIFHPSKKLKTIQYWLIHSVFSQIPVHDASMAYRNDISILDNARKHRSNRFFLKMDLKDFFPSISFNDFIPILRDWHAKAKPNWVLDEEAEHLIKKVCFYKNDCLAIGYPSSPTISNIVMRDFDSKVSTLISAEKYGKVVYTRYADDLVFSTEKKGVCSEIKKELQTLIQATTSPNIKVNNLKTKLGSSTGGTASVTGLKICSDGHITIHRKQKDHIRLLLSLYRKGKLRPEDEKSLLGHLSYCHYVAPDFYTKISKKFFKEIHELRTNDL

SEQ ID NO: 4652 - protein, 313 aa, unidentified
  source 1..313: note = Related to NZ_JAAORA010000005.1; note = Candidatus Chlorobium masyuteum
MHIRDAIAIDLSVPVSIVDEALKESRIYVKKFTLPKKSGGSREIFHPSKKLKTVQYWLIFNILSKLPIHSSAVAYRDGISILNNAKKHCHNRFFLKLDLKEFFHSIVFSDLLPLIEDWYQNISVDWVFGPEEKDLIRKSCFYKEDRLAIGYPSSPVISNVVMYQFDLNVESLVSSGRFGDVCYTRYADDLIFSTDKKGGCKVLLREISDLIGRHKSPDITLNSAKTRLGSSTGGTASVTGLKVCNNGYITVHRKQKDHIRLLLSLYAKGELKPDEYRSLLGHLAYCHYVAPSFYSRLAQKYFKEIHELRASVF

SEQ ID NO: 4653 - protein, 313 aa, unidentified
  source 1..313: note = Related to NZ_LASA01000253.1; note = Endozoicomonas arenosclerae
MNIKSIISNDLGIPEKLIEEALSSSRTYVKVFKIKKRNGGFREIHHPSKKLKTLQYWLIHNIFKNLSIHKSSVAYQDGVSILDNAKMHSSNRFFLKIDLENFFPSIKYTDLEPIVDKWHSENKISWELDQEAKELIRKSCFYKEDLLPIGYPSSPIISNAVMHDFDTAINQIILDNRFGETVYTRYADDLVFSTNKHGACSKLKDVIRTFIGGYNTPNIKINTSKTKMGSSTGGSASVTGLKVCENGHITIHRKQKDHIRLLLSLYAKGKLPESEKSSLAGHLAYVQHVAPSFYSSISNKYFKEIFELRATNV

SEQ ID NO: 4654 - protein, 313 aa, unidentified
  source 1..313: note = Related to NZ_LT670847.1; note = Halomonas subglaciescola
MRIEEVISRDLKVPESLINEAISGARVRVKKFQIPKRSGGSREIFHPSKKLKVIQYWLMHSVFCNMPLSDAAMAYREGISILHNARVHSLNRYFLRMDFKDFFPSIRFEDVESHIKAWHRNFKPEWDLNDKSLEFINQSCFYKDARLAVGYPSSPAISNIVMRDFDSKILNEIGSEKYGDVVYTRYADDMVFSTNQKGACKEIIKAVKEIVSVCKSPVLEINESKTRLGSSTGGSASVTGLKICSDGRITINRKHKDHIRLMLSLFSKGKLDPKEVPSLAGHLAYCHYVAPDFHSGLSSKFFKEIHQIRTMDL

SEQ ID NO: 4655 - protein, 314 aa, unidentified
  source 1..314: note = Related to RJLR01000016.1; note = Dickeya undicola
MNIKQLISESIDVPLSMVDNAIILARSHVKKFELKKKNDKFRIIHQPSKKLKVIQYWLIYNIFKEMPIHAAAVAYRNELSILDNAERHKRNKYFLKIDFKDFFPSLTFNDLLPFLESWKSSRTDLFINNELKEIIRKSCFYTNDKLVIGYPSSPIISNIIMFDLDENIQSIISDNKYGNVIYTRYADDIIISTDKAGACKEIYKEISTLIKSTITPSLSINVEKTKFSSSSGGSATVTGLRVCHDQHITIHKKQKDHIRLLLSLYAKGILNEKDEKSLIGHLAYCHHVDPAFYSKLSKKYFKEIATIRSSHMKN

SEQ ID NO: 4656 - protein, 322 aa, unidentified
  source 1..322: note = Related to NZ_JACHTE010000007.1; note = Lysobacter penaei
MRDLVEVCSADLGISRQETLHLAKSAPYRMKRFELSKRGGGRRTIWRAAIETKGLQYSLIKNYLEHLPVHAASQAFSPGSSIKKNASIHVGNHYFLRVDLKDFFPSLTFENLRKATLSSNAKFDFSLEGSDSFALIQGACFDRDGKLPIGYSTSPFIANVVMFEFDESLEVTLQSEFGAGNFNYTRYADDMVFSTSTRGVCRKAYRKIKNFVADFDGASLSVNDRKTHFGSTGKGTAFVTGVHMLPNGKLAATRQLRERVKFLLYLLTKKRIPEKEYSQLIGLLAHLRSVDPAYHTKLSTDFYSVFPRLGKDRTATTSSERT

SEQ ID NO: 4657 - protein, 311 aa, unidentified
  source 1..311: note = Related to NZ_LMUE01000002.1; note = Dyella sp.
MLDLLDICSSALGTTRENALVIARTAPYRLKRIEIPKQDGSKRITWQAAIETKGLHYPLIQYYLRQLPAHPASQAFSPGSSIIKNAGIHLGNKYFLRIDFSDFFPSIKFNSFKKIINQTKSIFENFNTATPESMLLLEKACFAKDSSLPIGYATSPYIANCTMFEFDREIIDLLRAKFASANVTYTRYADDLVFSTNIKNACRDIYDVIVQFVKKYRAIDLTINHKKTHFGSVPKGTAYVTGVHMLESNRTAATKTLRSEARFLLSLRKKNKLDDDEQKRLFGLLAHIRQIDPAFYTKLASDFHVAFPHTK

SEQ ID NO: 4658 - protein, 313 aa, unidentified
  source 1..313: note = Proposed Pararheinheimera soli; note = Related to NZ_JAJOYU010000020.1
MDLKSRICKDLQIPETLFDSSVSNARRAVYQFKIPKKNGDERTIYQAAAKTKTIQYWLLKNIFEKVKSHPSSMAFSQGCSILKNAECHRNNRFFLKIDLLNFFPSVTFEDVKGALIKNWEQIDSLPPDKDLFELIRTVCFFKGDILPIGYPTSPILSNIAMLNFDEMVMSTLESSFGGDVTYTRYADDMVFSTNVPGRTHEVFKLIRQLITTNTSPKISINPDKTTSGSSSGGSAIVTGIKICPNHLTITKKQKDEIRLLLSLYSKGRLRSSDYERTIGLISFARNVDPSFFTRVSERFFREIRAIKKELSDT

SEQ ID NO: 4659 - protein, 313 aa, unidentified
  source 1..313: note = Deltaproteobacteria bacterium; note = Related to JAHLLK010000006.1
MKFWEQIETSFGLGKPEINRIINDSRRCVKHIKIPKHNGGFRLVVQPTRKVKLIQYWLIDNVFSKMEVHSSAMSYRPNISIRRNAEVHKNMRYFLKLDFIDFFWSLNYSDFVVVFDSFLGRKKILWSDNKFDRNLMRCCCFYKDDALPIGYPSSPIISNIIMYNLDVAIKNKLEVLEEKIGGKIVYTRYADDLVFSTNIPGACEEIKNSIISLVSGCNSPKLKFNYNKLKMTSSSGGSAVVTGLRICHDGHITLRREYKDQVRFFLNLMAKDGLKKEDIFVLRGHLAYVQDVDPVFYTKLQEKYFKQIEGVEK

SEQ ID NO: 4660 - protein, 306 aa, unidentified
  source 1..306: note = Proteobacteria bacterium; note = Related to JAHJTB010000019.1
MSEELNIPVDSLSDTIEQSRSFVKRIKINKKSGGERIVYQPARKIKVIQYWLMRTIFSKITIHSASMAYRKEGSIKENALKHSNGGYFLKLDFKDFFPSIKFSDLNKSIIAFRKNNNAIFKYTKADQELIRRVCFYKNDKLPIGYPSSPIISNIVMYKFDIRVTDEMPKFRKYGNVVYTRYADDMIFSTDRKGGCEKIFSFLSVLINSWSTPSLLLNEAKTRFVSSSGGTAIVTGLRICYDGHITLHRHYKDIVRLLLSLYKKGNLKEEDVYVLKGHLSYIQNVDSVFYTKICKKYFDIIDEIKTK

SEQ ID NO: 4661 - protein, 317 aa, unidentified
  source 1..317: note = Related to NZ_KB906230.1; note = Thioalkalivibrio sp.
MNIRERIAADLHVSHELIDRAVWESHSKVKKFRIKKRNGGTRPIFHPSKKTKLIQQWIIHNILNHLPVHDAAMAYRKGLSTVDNARKHRQNRYFLRIDLTNFFPSITYNDLEPLIREWHSHAETDWTLDPTSELLLKHTCFSQDETLRIGDPSSPSISNAVMASLDETISNTVRALSKNPIAYTRYADDLIFSTNERGLCKPIHEHTVAVIEESTSPLLSVNRRKTRFLSRSGGSAIVTGIKINPDGSLTLPKSYRNEIRFKLDLYRKGKLGDSDVRELRGHLAYCKHAAAGYYSRLCGKHYREIEEITTSLQDHSC

SEQ ID NO: 4662 - protein, 321 aa, unidentified
  source 1..321: note = Related to NC_016620.1; note = Halobacteriovorax marinus
MIYREISKFYNIPQEEVQDFISSNKTKYFRFEIPKRNGKFRTITHPRHELKIVQYWLVEKVFSRMNYVSCSSYAYIKERDILKNARKHQRNSHFLSVDFSNFFESITFKLLEPFLEKFYHSTEVEYSLEELKNVVKRSCFDSYGRLPVGFVTSSIISNIVMFDFDLRINVLLMSRKMLGRVVYTRYADDVTISTNKEGAIREIYELFCKGLISEFNSEITLNASKTKVRHKRCGNVLVTGLRITKDSRITIHKNYKERVKKLIHDNYKSEDLSVVSRIIGHLNFIKYVDANYSHKLNIKYFSEINELKLRYQALFSAKSYI

SEQ ID NO: 4663 - protein, 323 aa, unidentified
  source 1..323: note = Phycisphaerae bacterium; note = Related to JADHXY010000004.1
MAKSLIDMVATYLGHTREQVLHLSYRAPMTYRRYTIPKKKGGRRLINHPAKQTKSLQYALMNIFLSQLPIHSCAAAYKKKTASEHIPSPLLKNAILHAPYSYSVRIDFTDFFHSISSLDLFNRISNNDINLSISDKEFIENCLFVRVPEGQKGLAIGAPSSPIISNIVMYSLDEQINAIANGISDRVAYSRYADDIIFSTNLRGGCNYFYRAMSELVTRTSSPKLVINRSKTMFSSRASRRVVTGLFIRPDGGTSLGRQNKRYIRKLLFDLKRDNIEPRKLTYLSGYLAFALDVEPDFYNRLAHKYGAELLAVAIGKTHHDVS

SEQ ID NO: 4664 - protein, 323 aa, unidentified
  source 1..323: note = Related to MSYB01000011.1; note = bacterium B17
MSRIINLKNDVAKYVGITLERVESLAAVAPKSYRRDEGSKRSGRGSRVIFHPSKKTKALQYGLIKILLDDLPVHASAYAYRKGLKAPLLKNSMLHQKYSFSIRIDFKDFFPSIVPEDLFKVIDESGLFPAALDSADKRFLENVLFIRHHGLMHLAIGAPSSPSISNAIMHSLDVLFSAFARDKDSVYSRYVDDIIFSTNRKGMCDEFLRFLSTTLSGTPSPILQVNATKTLVMSRGTRRCVTGMFITPEGGVSIGRTRKRKLRTLLYRYSKHLKGEDVLSKEDLNYLKGNLAFVLDVEPDYYNRLVQKYTATMVNSALHASVS

SEQ ID NO: 4665 - protein, 313 aa, unidentified
  source 1..313: note = Deferribacteres bacterium; note = Related to JACKDE010000001.1
MDLIEKIALYLGFSKEQIVKHSKRCSKTYRLYKIPKKGKLTGFRTIYHPAKETKAIQYALMEILLGDFKVSESAIAYKRGLSSPLRENALLHAPYKYSVRIDFENFFLSLQPRDLARMAKSKFDLNDKEIDFLIKSLFVDLGSGRSGLGVGAPSSPMVSNIIMYELDEEIQKIALKIDPKSVYSRYADDIIFSTDQKGACKQFYDQLASVIKSSKSPRLKINDLKTIFSSRGSRRMITGLIVTPNGDVSIGRRNKRYIKKLLFDFSKSKISDKNKSYLKGYLSYIEDVEPDFLNSLSLKYGAALLEKIRMDQF

SEQ ID NO: 4666 - protein, 305 aa, unidentified
  source 1..305: note = Related to PAAX01000026.1; note = Ignavibacteriae bacterium
MSLIENVSRYLSFNESELLSFAQKAPTTYRTYQIPKKNGRLRTIHHPAKETKSLQYALINLIFKNYPIHSSAVAYRKGVKSPLKLNAESHSKYLYTIKMDFKDFFHSIVFEDLKNILDSPYTQQELEFLKNVLFLNYQGIYCLAIGAPSSPILSNIVMHGYDESILKIVTKIDPDATYTRYADDITFSSNKKSHCLNFAKELNKLTKDKLTPSLKLNSKKTILLSKANHRMVTGLVITPQGNVSVGRHNKKYIKKLLNDLKYDKISPIAFKYLKGYFAFVRDVEPKFVNSLTNKYGAALINKIII

SEQ ID NO: 4667 - protein, 304 aa, unidentified
  source 1..304: note = Related to NZ_CP021235.1; note = Pontibacter actiniarum
MKIIEKISNIYGLSFNETKNLINTAQNNYRIYKIPKKTTGTRTIYHPSKQVKAVQYILIDLILKKLQVHNAAVGYIKGVKAPIKRNAEQHAKFPYSIRIDFKNFFSSISFSDLKKVLENSSLELSLDDYKVLELVLFKNGLPIGAPSSPLISNIVMFELDELLAREALKVDSNSLYTRYADDIVFSTSKKNGCKDFLKKLKSVLINYNHPKLTINSSKTKFMSRKSKRMVTGLIITPQGKVSIGRENKEFIKMLLYQYNKKLLNPEQVSYLTGYLSFIIDVEPAFFNTLVIKYGAVVSNLLKKI

SEQ ID NO: 4668 - protein, 313 aa, unidentified
  source 1..313: note = Related to NZ_FNGA01000002.1; note = Maridesulfovibrio ferrireducens
MPDKLNLVGKLSFFLGASEEDIKTSANSMSRKYKQYKIPKKNGGSRTILHPCRPLKALQYAIHEVLLNKLEVHPIAHAYVPNQKSPLKQSAKAHTNYKYTIRIDFENFFPSIRPEDLELQINKNFILSKTDKYLLRTVLFYQKNRGSRPILPIGAPTSPTISNIVMFNLDELLLKTSKEHDRDSALTRYADDIYFSTNIKGCCKLFYDEIFQLLKRIDSPRLKINTNKTLFLSKGTKRVVNGLFVTPNGKVSIGRKRKTQIKSLIYKHSQTALMGKELLQTRGLLAFIQDCEPEFYNTLALKYGVHFYSIKES

SEQ ID NO: 4669 - protein, 309 aa, unidentified
  source 1..309: note = Spirochaetales bacterium; note = Related to JAFGSW010000031.1
MSRIIDIISKYTGLDPHKILKITYDSPTNYKLYYIKKKNGDSRAIFHPSKETKMLQYALMEKFLKKIPVHEFAMAYKKGIKSPLKKNALYHLNTQYTLHIDFTNFFPSIIPEDFWRAVSVAFPGKEFETSDIELINNILFIKVKGKCFLSIGAPTSPIISNIVMKEMDAQFLKLCKTLDEYSVYTRYADDINISTNIKGFSQKIYYSIKQHLSETESPKLTINEKKTYFLSKKGNRLITGLCITNMNSVVIPRNKKRIIRSLIHTELTSNKKDKTRLSKIKGYLAFIKDIEPDFFNKLVIKFGDGINDL

SEQ ID NO: 4670 - protein, 316 aa, unidentified
  source 1..316: note = Related to NZ_JAALLS010000018.1; note = Aliifodinibius halophilus
MSILKGLLSKYTSLSIDNISNIIKKAPASYKTYRIEKANGGYREINHPAKETKTLQYALMEIIFKKNDVHPIAMAYKRGVESPTFENARLHKDYEYSLRLDFKNFFPSIKPDDIISIVKDSSKYEFDDTDYSDLKRICFRKNHIKGYQYGLAVGAPTSPIISNIVMYDFDEAMEKISKELDKSSTVTRYADDIVFSTNEKGICAKFYSSVRDHLNDQDLSLEFNEEKTAFMSRGTKKVITGLVISNKGNVSIGYDKKEKVKRKVYKYSKGDLEDSDILSLKGYLAYIQDVDPDFFDKLNIKYGADILDDIMSFENE

SEQ ID NO: 4671 - protein, 313 aa, unidentified
  source 1..313: note = Related to NZ_RCTY01000045.1; note = Lysobacter enzymogenes
MHKLFDAMYHGKYRFDEFLALSPEENYSPVHWKARTIYKPSRTLRDFHTFLSGFVLEQLPINTSVSFAYRKGTTLAQAVAPHAKSRAFFQTDLERFFDSITTPLIRRILIENQTPVLDLQAHLDHILKLLTIDDKLPIGYSTSPLVSNACMHSFDQRLAQISHDRGWIYTRYADDIMLSTQDRADLSDASTVITGCLATELGYGFNLNPGKSKLTTIGRKVKLLGLVILPSGDIAIDRDVRNRIESWIYFYLRDRARLSKIFEETYKDGLEEGLERLSGLISYAHAADPGYLEKLRSKFGTTVIDSLLHRSAQ

SEQ ID NO: 4672 - protein, 318 aa, unidentified
  source 1..318: note = Related to LDJG01000003.1; note = Stenotrophomonas nitritireducens
MTPQPLHKLFDAMYHGKYRFDEFLALSPRENYSPVSWKSRTIYKPSRMLRDFHTFLNGFVLEHLPVNTSVSFAYRKGATLIQAVEPHAKSRAFFQADLERFFDSITTPLIRRVLLESETPVADLHDHLDHILGLLTIDGKLPIGYSTSPIVSNACLLSFDHRLAQVSQDRGWIYTRYADDIMLSTEDRANLSNAGAVIETCLASELGDEFKLNPAKSKLTTVGRKVKLLGLVILPTGDIAIDRDVRNRIEAWIHFYLRDRARLLKIFEETYSQGMEEGLERLSGMISYTHAADPAYLEKLRRKFGTTVIDSLLHRSAQ

SEQ ID NO: 4673 - protein, 318 aa, unidentified
  source 1..318: note = Related to NZ_LNSU01000266.1; note = Xanthomonas translucens
MTPQPLHKLFDAMFHGKYRFEEFLALTPEENCSQVRWKSRTIYKPSSTLKDFHVFLSRVALDHLLVDTSVSFAYRKGATLIQAVAPHAKSRAFFQTDLERFFDSITTPLIRRVLVENETPVTDLLDHLDHILRLLTIDGKLPIGYSTSPIVSNACLLSFDQRLAKISDDRGWIYTRYADDIMLSTQDRADLSDAGAVVEDCLASELGDGFNLNQAKSKLTTIGRKVKLLGLVILPSGDIAIDRDVRNRIESWIHFYLRDRAKLLKIFEETPNQGMEEGLERLSGLVSYAHAADPAYLDKLRSKFGTTVIDSLLHRSAQ

SEQ ID NO: 4674 - protein, 318 aa, unidentified
  source 1..318: note = Related to AM920689.1; note = Xanthomonas campestris
MTPQPLHKLFDAMFHGKYGFEDFLAISAEENHSLVRWKSRTIYKPSSTLKDFHVFLSRVVLDHLPVDASVSFAYRRGASLIQAVEPHAKSRAFFQADLERFFDSITTPLIRKVLVESQTPVTDLHDHLEHILKLLTVEGKLPIGFSTSPILSNACLLSFDQRLAQISHDRGWIYTRYADDIMLSTLDRSKLSDAGTVIEDCLSAEIGDEFKLNPAKSKLTTIGRKVKHLGLVILPSGDVAIDRDVRNRIESWIHFYLRDRAKLLRIFEETPNQGMEEGLERLSGLVSYAHTADPTYLDKLRSKFGTTVIDSLLHRSAK

SEQ ID NO: 4675 - protein, 318 aa, unidentified
  source 1..318: note = Related to LOKH01000144.1; note = Xanthomonas campestris
MTPQPLQKLFDAMFHGKYRFDEFLTLSPEDNYVPVRWKTRTIYKASRTLKDFHTFLSSFVLEHLPSDTSVSFAYRKGAALMQAVEPHAKSRAFFQADLERFFDSITAPLIRKVLTENQTPAADLQEHLEHVLNLLTIDGKLPIGYSTSPLLSNACLLPFDRRLAQVSLERGWIYTRYADDIMLSTQHRTDLSEAKTVIEECLATELGAGFNLNPAKSKLTTIGRKVKLLGLVILPTGHITIDRAVRSRIESGIHFYLSDRARLGRIFERENDEGMEEGLERLSGLISYANAADPAYLEKLRRKFGTTVIDSFLHRSAQ

SEQ ID NO: 4676 - protein, 318 aa, unidentified
  source 1..318: note = Related to FPCI01000001.1; note = Pseudoxanthomonas sp.
MTPQPLRKLFDAMYHGKYRFEEFLALSPEENYSPVHWKNRTIYKPSRALKDFHLFLNGFVLEHLPVNTSVSFAYRKGTTLLQAVEPHAKSRAFFQTDLERFFDSITTPLVQKALAENETPVADLSDHLDHILKLLTIDGQLPIGYSTSPILSNACLLSFDQRLAQISAERGWVYTRYADDIMLSTQDRAELLDARTVIEDCLTTELGDGFNLNPAKSKLTTTGRKIKLLGLVILPTGKIAIDRDVRNRIESWIYFYLRDRSRLSRIFEETYDEGMEEGLERLGGLVSYAYASDHAYLEKLRRKFGTTVIDSFLRRSAQ

SEQ ID NO: 4677 - protein, 318 aa, unidentified
  source 1..318: note = Related to CP076254.1; note = Xanthomonas translucens
MTPRPLQQLFDAMYHGKYRFEEFLALKPQEHYSLIRWKTRTIYKPSKTLKDFHFFLNGFVLEHLPVDTSVSFAYRKGSTLMQAVEPHSRSRAFFQTDLERFFDSITTPLIQGVLQRNQSPVADLADHLHHVLGLLTIDGKLPIGYSTSPLLSNACLLGFDQRLAAISQTREWIYTRYADDIIVSANDRATIADASAVIEECLASELGDGFNLNKGKSKLTTIGRKIKLLGLVILPTGAIVIDRDVRNRIESWIHFYIRDRSRLAKIFEEERGEGMEEGLGRLSGLISYAYAADPGYFEKLRSKFGTTVIDSLLHRSAQ

SEQ ID NO: 4678 - protein, 306 aa, Achromobacter sp.
  source 1..306: note = Related to NZ_FNYM01000002.1
MYHDKYRFEEFLTLYAGDHYSQVLWKNRTIYKPSAKLKDFHHFIGGFLLEHLPVDQSVSFAYRKGATLLQAVQPHSRSRAFYQTDLERFFDSITNNLIRSVLEQAATPVSDLSDHLDHILSLLTIDGRLPIGYSTSPILSNACLYGFDKRLAAISHERGWIYTRYADDIIVSAADRLAIEDAPQVIEDCLGTELGDGFKLNSSKSKLTTIGRKIKLLGLVILPTGAIVIDREVRHRIEAWLHFYVSDRPRLAKIFQEERKEGLEEGLQRLSGLIGYAHAADPLYLEKLRAKFGNTVIDSFLRRSAQ

SEQ ID NO: 4679 - protein, 306 aa, Alcaligenes sp.
  source 1..306: note = Related to NZ_CP032153.1; note = Alcaligenes aquatilis
MYHEKYRFEQFLELKPEEHYSSVLWKNRTIYKPSSILREFHYFLNGFLLEHLPVDTVVSFAYRKGATLLQAVEPHANSRAFYQTDLERFFDSITSDLIRSVLSRYETPVSDLSDYIDHIIGLLTINGSLPIGYSTSPILSNACLLGFDKRLAAISDERKWVYTRYADDIIISADDRLSIKDADQVIKECLKLEFGDGFSLNESKSKLTTIGRKIKILGFNILPTGAISIERGVRNRIESFLYFYVKDRPKLARIFEEEQGDSMEDGLLRLSGLISYVYAADPAYLKKLRVKFGNTVIDGFLHRSIK

SEQ ID NO: 4680 - protein, 318 aa, unidentified
  source 1..318: note = Related to NZ_PKQQ01000003.1; note = Stenotrophomonas sp.
MTPQPLEQLFDSMFHGKYRFIEFMELKPEQHRVRVSWKGRTIYKPTGVLKAFHRFLNHYVLDHLQVDETVSFAYRRGTTLLQAVEPHAHSRAFFQTDLERFFDSITTDHIRTALETSDIPVEDLGQHLGHILELLTIDGKLPIGYSTSPILSNACLLGFDSRLKSQSRDRGWVYTRYADDIILSAADRESLADAVAVVEDCLSSELGDGFALNPTKSKLTTIGRKVKLLGRVIVPTGVIVIDREVRNRIESYLHFYITDQSKLARIFREDREEEWEDGLQSLSGLISYVHVADVAYLDKLRAKFGATVIDSFLHRSAK

SEQ ID NO: 4681 - protein, 318 aa, unidentified
  source 1..318: note = Related to NZ_PKQP01000016.1; note = Stenotrophomonas bentonitica
MTPRPLHQLFDAMFHGKYQFDEFLALKPEEHRTRVSWKGRTIHKPSGILKNFHRFLHSFVLEHLLVDEKVSFAYRKGTTLLQAVEPHAQSRAFFQTDLERFFDSITSDLVRNVLKQAEVAVGDLDDHLEHILALLTIDGKLPIGYSTSPILSNACLSGFDARLSSISIDRDWIYTRYADDIIISADDRTALIDAAAVIEECLASELGEGFTLNLAKSKLTTVGRKVKVLGRVILPTGTIVIDREVRNRIESWLHFYTSDRPRLAKIFREERNEEWEEGLERLSGLVSYVHVADPSYLEKLRAKFGTTVIDSVLHRSAK

SEQ ID NO: 4682 - protein, 318 aa, unidentified
  source 1..318: note = Related to NZ_VLLB01000004.1; note = Massilia lurida
MNPQPLHQLFDAMYHDKYRFDEFLALKPEEHYSPIPWKSRTIYKPSPTLKDFHKFITGFLLDYLPVNDSVSFAYRKGASLLQAVTPHAYSRAFFQTDLERFFESITSSLIRRVLDQASTPVADLAEHVEHIVRLLTIEGALPIGYSTSPILSNACLLGFDARLAATSCARNWIYTRYADDIIISAGSRAAINDVGQVVEECLRAELGDSFRLNQDKTKLTTIGRKVKLLGFVVLPTGGIVVDRNVRDRVETLLYFYVTDRSRLAKIFAEENDEVMEAGLERLSGLISYVHSVDEAYLEKMRIKFGSTVIDSFLHKTAR

SEQ ID NO: 4683 - protein, 318 aa, unidentified
  source 1..318: note = Related to SZUV01000002.1; note = Acidithiobacillus thiooxidans
MTPRPLRQLFDAMYHGKYRFEEFLELRPQEHYNIVRWNSRTIYKPSKKLKAFHYFLNGFLLEYLPVNQSVSFAYRKGATLQQAVAPHARSRAFYQTDLQRFFDSITSDLIRSTLEGASTPASDLPEHIDHILDLLTINGKLPIGYSTSPILSNACLLRFDERLAAISKDRQWIYTRYADDIIISADDRKTIGDAKELIESCLAAELGGNFALNPSKSKLTTIGRKVKLLGLVILPNGAVAIDRDIRNRIETLLHFYISDRSRLAKIFEEERSEGMEEGLQRLSGLVSYTYAADPLYLEKLRAKFGATVIDSLLHRSAE

SEQ ID NO: 4684 - protein, 318 aa, unidentified
  source 1..318: note = Related to NZ_CP028901.1; note = Orrella marina
MTPRPLHQLFDAMYHGKYRFEEFSELNPREHYTSVQWNNRTIYKPSKKLKDFHSFLNGFLLEFLPVNQSVSFAYRKGATLLQAVMPHSRSRAFYRTDLERFFDSITSGLVRSALERAVTPISDLAEHIDHLLDLLTINGKLPIGYSTSPILSNACLLGFDERLASISRERQWIYTRYADDIIISADDRSAIEAASDVIKSCLSTELGDEFALNSSKSKFTTIGRKVKLLGLVILPNGTIAIDRDVRNRVESWLHFYVSDRSRLAKIFEEERSEGMEEGLQRLSGLISYVYATDPRYLEKLRAKFGTTVIDSFLHRSAQ

SEQ ID NO: 4685 - protein, 318 aa, Pseudomonas sp.
  source 1..318: note = Related to CP053705.1; note = Pseudomonas aeruginosa
MNPRPLHQLFDAMYHGKYRFEEFLALNPEEHYTPVPWNRRTIYKPSPTLKEFHRFLSDFLLDYLPVDQSVSFAYRKGATLLQAVTPHAHSRAFFQTDLERFFDSITLNLIRPVLNRAAHPVSDLPKHIEHILRLLTINGKLPIGYSTSPILSNACLFGFDKRLTVISNERHWIYTRYADDIIISAGDRLAIEDASSVIENCLSAELGKGFVLNQSKSKLTTIGRKVKLLGLVILPTGAITIDRDVRNKMESWLYFYVTDRSRLAKIFQEERNESMEVGLQRLSGFISYAYTADPAYLEKLRTKFGNTIIDSFLHRSAQ

SEQ ID NO: 4686 - protein, 318 aa, unidentified
  source 1..318: note = Related to JADMJL010000080.1; note = Methyloversatilis discipulorum
MTPRPLHQLFDAMYHEKYRFEEFLALKPQEHYSPVSWNRRTIYKPSPKLKEFHHFLSGFLLEFLPVDRSVSFAYRKGATLLQAVAPHAQSRAFFQTDLERFFDSITSDLIRSVLDQAETPVSDLGDHVEHILDLLTIDGTLPIGYSTSPVLSNACLFGFDKKLAAICHSRQWIYTRYADDIIISADDRLSIEDADQVIENCLVAELGGGFKLNQKKSKLTTVGRKVKLLGLVILPTGVIVIDREIRNRIETWLYFYIKDRSRLSKIFQEDRGEGIEEGLQRLSGLISYASAADPIYLDKLRAKFGNTVIDSFLHRSAQ

SEQ ID NO: 4687 - protein, 318 aa, unidentified
  source 1..318: note = Related to PNKA01001725.1; note = Cyanobacteria bacterium PR.023
MTPRPLRQLFDAMYHEKYRFEEFLALKPAEHYSPVHWNRRTIYKPSSKLKEFHRFLNGFLLDYLQVNESVSFAYRKRTSLLQAVAPHAHSRAFFQTDLERFFDSITSNLIRSVLERADTPIADLADYIDHILDLLTIDGKLPIGYSTSPILSNACLLGFDKQLAALSAERQWIYTRYADDVIISANDRASIEDASQVIENCLAIELGDGFKLNQKKSRLTSIGRKVKLLGLVILPTGAIVLDRDVKNRIETWLHFYVTDRARLAKIFQEEKNEGIDEGLQRLSGLISYAFSADPAYLEKLRAKCGSTVIDSFLHRSAK

SEQ ID NO: 4688 - protein, 318 aa, unidentified
  source 1..318: note = Related to CP086344.1; note = Halomonas sp.
MTPRPLHQFFDAMYHGKYQFEDFLELEPKEHYTPVPLSGRTIYKPSKVLKEFHTFLNGFVLVHLPVNTTVSFAYRKGVSLLEAVTPHADSRAFYQTDIQHFFESINVKLIKSALIKADTPVTDLNDFFDHILDLITVDGSLPIGYSTSPILSNACLHGFDERLAYISYKNEWIYTRYADDIIISGADRKSVQNAQSEIKNCLLEELGEGFKLNLNKSKLTTVGRKVKILGLVILPNGDISIDRSVRDKIEARLFFYINDRKKLAKIFVEEKNDGMEDGLQRLSGLIGYVHTIDPLYLEKLRMKFGTTVIDSFLHRSAQ

SEQ ID NO: 4689 - protein, 341 aa, unidentified
  source 1..341: note = Related to NZ_JAKPBV010000013.1; note = Lysobacter sp.
MPDLKASCRVGHFVCAPISTMTDPSVSVKARSLEYLFEMMHHGRHSFDDFLRLPVDKHFQRVDWRTRTIYKPSKTLRAFHSFLNVFVLGYLPVNERVCFAYRKGATLTDAVAVHAESRAFFQTDLAKFFDSITSQMVHDALARASTPAEDLPQFIDRIVELTTIDERLAIGFSTSPLLSNSCLIAFDNMLEDVCRDRQLIYSRYADDIVVSGQSPDKLDGIERLIAQLLDKALGPTFQINTAKSRMLRVGRKVKILGLNILPSGRITVDREIRDKVETQLHFYLTDRARLMRIIDAEPDEALQKLSGYIGHIHSADPLYLEKLRRKFGATVIDSFLHRSAQ

SEQ ID NO: 4690 - protein, 328 aa, unidentified
  source 1..328: note = Related to LPEM01000032.1; note = Burkholderia cepacia
MTKKPLQILFDAMYHNKQNFEDFANGDIASHFSRKPVTDDSGKTRVVSVPDKVLRKYHSFLNLFVFNQLPVNEEVVFSYRKGTNVAAAVQKHAASKHFYQADFSNFFESITSDIVRHSILRGEDKIPVADIHQYLDRIVDLVTFEGRLPQGFSTSPVISNTALLPFDKDLATYCQNKHLVYTRYSDDITISSNDKEPLFELDHVIAEILSSCGYSEMKLNENKTKISSKGRKIKILGMVILPNGQVSLDAKIKNRIETLLHLYVNNQQGLSDITESDLEDGLAKLSGLLNYANTVDQGYLDKLRRKYGVTVVDILIHQPKKTDAKKAD

SEQ ID NO: 4691 - protein, 328 aa, unidentified
  source 1..328: note = Related to NZ_UWYX01000002.1; note = Burkholderia gladioli
MTKKSLQTLFNAMYHNKQNFEDFATGEIKQHFSKMPVTDASDKARLVFIPDKVLRKYHSFLNLFVFNRLPVYNDAVFSYRKGTNAAAAVRKHSASKHFYQADFSNFFGSITSDIVRRSILHGAEQLPVADLHQYLDRIIDMVTVEGRLPLGFSTSPVISNTALLPFDEDLAIYCRRRQLVYTRYSDDITISSNERESLLELDDAISDILSSRGYSEIKLNEKKTKISSKGRKVKILGMVILPNGQVSLDAKIKNRIETLLHLYVNNQPGLSDVTKSDLGDSFEKLSGLLNYANTVDQTYLDKLRRKYGVTVVDILIHQNKKTDSKKAS

SEQ ID NO: 4692 - protein, 328 aa, unidentified
  source 1..328: note = Related to NZ_BBJH01000023.1; note = Paraburkholderia heleia
MTKKPLRVLFDAMYHNKQNFDDFATGEIDRHFTKKTIKDDAGKERLVFITDRTLRKYHSFLNLFIFNRLPVNEGVVFSYRKGTNAAAAVRMHAGSKHFYQADFSNFFGSITSDIVRQIIINGEDVLPIADTNQYLDRIVDLVTVDGRLPMGYSTSPVISNAALLLFDKELARYCQSKQLVYTRYSDDIIISSDEKEPLMDMSQVIADTLSDCDYYDLRLNEEKTKISSKGRKVKILGMVILPNGQVSLDAKMKNRIETLLHLYVNNQDRLSDATKIDFEDSVVQLSGLLNYANTIDQDYLDKLRRKYGVTVVDILIHQPKKTDSKKAE

SEQ ID NO: 4693 - protein, 328 aa, unidentified
  source 1..328: note = Related to VZQP01000011.1; note = Paraburkholderia sp.
MTKKPLHVLFDAMYHNKQNFEDFAAGQISHRLSSKTVTNESGKTRLICIPDKVLRKYHSFLNLFVFNRLPINEEVVFSYRKGTNVAAAVRKHSAGKHFYQADISNFFGSITSDIVRRSILRGEEQLPVADMHRYLDRIVDLVTVEGRLPQGFSTSPVISNTAMFPFDKELVTYCLKRQLVYTRYSDDITISSQEKEPLLDLDRVIADILCDCAYPEMKLNENKTKISSKGRKVKILGMVILPNGQVSLDSKIKNRIETLLYLYVNNQPGLSDITKSDLGDSFEKLSGLLNYANTVDGNYLDKLRRKYGVTVVDVLIHQPKKTGAKKAN

SEQ ID NO: 4694 - protein, 327 aa, unidentified
  source 1..327: note = Related to NZ_JAAVUQ010000005.1; note = Caballeronia sp.
MTKKPLQILFDAMYHNKQDFADFATGDIIRRVSSKTVTNDSTKERLVFVPDKVLKKYHSFLNLFVFNYLPINEDVVFSYRKGTNVTAAVRKHRNSKHFYQTDISNFFDSITVDIVRRCILRGEEQTPVSDMGEFIDRIVELVTMEGKLPLGFATSPAISNTALLPFDDSLAAYCSHKNLVYTRYSDDITISSSEKEPLFALDDALRDILSAHGFPNMQFNEHKTKISSTGRKIKILGMVILPNGQVTLDSKIKNRIETLLHLYVNNQSALFDLTKSDLDGSYETLSGFLNYANTVDQSYLDKLRRKYGVTVIDTLIHQPKKSESRKG

SEQ ID NO: 4695 - protein, 328 aa, unidentified
  source 1..328: note = Related to NZ_CYGX02000017.1; note = Paraburkholderia ribeironis
MTKKPLQFLFDAMYHNKQSFADFATGDIGRHLSARQITDDAGKKRDVFVPDKVLRKYHSFLNLFVFNYLSVNTAVVFSYRKGTNAADAVRSHASSRHFYQADISSFFPSITADIVRRSILRDEAQTPVEDLGDYLDRIIDLVTIDGTLPIGFSTSPVISNTALLPFDDAFAAHCLRNGLIYTRYSDDITVSSQEKAPLLALDAVIQDLLCRCNLPEMRLNERKTKISSTGRKIKILGMVVLPNGVVTLDAKVKNRIETLLHLYVRNQLALQEVMKADLVESAETLSGLLNYANTVDQGYLDKLRRKYGVTVVDTLVHQPKRTDSKKDK

SEQ ID NO: 4696 - protein, 328 aa, unidentified
  source 1..328: note = Related to NZ_CP045094.1; note = Burkholderia sp.
MNKKPLETLFNAMYHGKQSFQDFATCDVAQRVTRKTISDNSAKERIVYAADKVLAKYHSFLNLFIFNHLPIREDIVFSYRKGTNAADAVKKHVNSRHFYQADIANFFPSISADSIKKAILRGIHQVPVSDVAEYLDRIIDLVTVESALPLGFATSPSISNAALLLFDDALSNVCLEKGLVYTRYSDDITISAQEKESLLGMDATITRLLAECDYPQMHLNDRKTKLTSIGRKIKILGMVILPNGQLTVDSKIRNRVETMLHFYVRNNDALVDLTNTDLDESVDVLGGLVNYINTIDQRYLDKLRRRYGVTVIDTLIHRQKNTDSKRNK

SEQ ID NO: 4697 - protein, 313 aa, unidentified
  source 1..313: note = Related to JAHYBY010000004.1; note = Janthinobacterium sp.
MEQLRNLFDEMFGGELSFDDFLHGDISNRVIKKIDGTRVVYSADQTLRSYHRFLQRHVISYLYLNSDVVYSYRKSFNVADAVRQHAQSKYFFQTDLSNFFNSITSKLIHSTLFKSSERMKFLNSTEYFDRIVILLTANDRLPPGFITSPSISNACLSELDDVFQKFCIHKNLIFTRYCDDVIVSGQSQDDLRIAAQELSNLVEICYKGEFSFNVRKSKFTKIGRKIKLLGMVILPNGLVTIDSSLKKKIEVLLHYYITDSFTFLRMVDNDLGKGTRSLCGYISFVNAVDPTYFLKLCSKYSSAAIENLLRMPK

SEQ ID NO: 4698 - protein, 322 aa, unidentified
  source 1..322: note = Related to NZ_QUBS01000013.1; note = Trinickia diaoshuihuensis
MTKKPLAELFRAMYHGKYDYRDFIGEALSSRYKPLNVGGAQVSKERLVYAPDKTLKIYHSFLNLFLFEYLDVNEEVVFSYRKGVNVVGAVRKHAHNKHFFQADLQDFFLNINSTMVRAVIENVAARTPISDVLDHVDRIIELVTIDGTLPIGFPASPLISNAVLRSFDDRFEDYCALRGMVYTRYSDDLIVSSQNRDELTNLAAVIEEMLQSVGLAQFKLNPEKTKITSVGRKIKLLGLVILPNGVVSVDIKLKQQIETMLHFYITDNAKFRDFSEKDLTKATEQLSGYVNYVNTVDPAYLDKLRKKYGVTVIDTLMHQGSK

SEQ ID NO: 4699 - protein, 322 aa, unidentified
  source 1..322: note = Related to JAJUBG010000007.1; note = Caballeronia sp.
MTKKPLAELFRAMYHGKYEYRDFICEALDARYKPINVGRTQTSKERLVYAPDKTMKIYHSFLKLFLFEYLDVNERVVFSYRKGVNVVEAVKKHAHNKHFFQADIQDFFPSIDSMMVRLVIESAATRTPIADLMDHVDRIIELVTIDGALPIGFPSSPLISNAVLHRFDDSFEEYCVNRGMVYTRYSDDIIVSSQNRDGLNNLATAIENTLKSVDLGHLTLNPEKTKITSIGRKIKLLGLVILPNGTVSVDIKLKQQIETMLHFYITDRAKLRDFLETDLSKATEQLSGYVNYVNTVDPGYLDKLKKKYGVTVIDTLIHQGSR

SEQ ID NO: 4700 - protein, 317 aa, Pseudomonas sp.
  source 1..317: note = Related to JAEKFF010000008.1
MVNRDFKSAFEAMYHGKYDFEDFKSGDISEKFRKLDLNKKNVYEADQTLKIYHKFLNLFVFQWLEFNENCVYSYRKGMNVADAVKKHAHSKHFYQTDLNNFFGSIRSDFVKGSIIASIDRMPITDVLLYVDRIIEICTVSNKLPVGFSTSPLISNACLLHFDNEVERYCEESGLIYTRYSDDIIISGGDKKLYGTGEIIAEVLYRQFEGHLSINSSKTKYSSAGNKLKILGMMILPNGTITIDSKLKADIEVLLHFFTKDKQKFLDKIEADSATALAKVSGYLNYINTTDKVYLNKLRKKYGASVVDMFVRGSVKSL

SEQ ID NO: 4701 - protein, 317 aa, Pseudomonas sp.
  source 1..317: note = Related to NZ_UUGY01000017.1; note = Pseudomonas viridiflava
MANRDFKSAFEAMYHGKYDFEDFKVGDIADKYRKLNLNKKNVYEADQVLKTYHKFLNLFVFQWLSFNEDCVFSYRKGINVADAVKKHSQSKHFYQADLNNFFGSIRSDIVRSCIGASIDKVPISDISLYVDRIVEMCTVADRLAVGFSTSPLISNACLFRFDNEIEHHCHANGLIYTRYSDDIIISGVENKLYGMGDVVESILFQHFNGVLSINLPKTKYSSAGNKVKMLGMMILPNGTVTIDSKLKADIEVLLYFFIKDKQKFLDKIDTDSATALTKLSGYLNYINTTDKIYLDKLRKKYGSSVIDMFVRGSVKSL

SEQ ID NO: 4702 - protein, 306 aa, Pseudomonas sp.
  source 1..306: note = Related to NZ_JABWRD020000002.1; note = Pseudomonas shirazensis
MYHGKHDFEDFKSGEILSKYRALVFKKKKVYEAGADLKVYHKFLSLFVFQWLEFNERCVYSYRKGMNVVDAVKKHANSKHFFQTDLNDFFGSIQGDLVKLCIRGSLDRIPISDASSYIDRVVDLVTVENKLPVGFSTSPLISNACLLPFDNALEAYCNHSGLVYTRYSDDVIISGGDSKLYGIEKVVEYTLAQCYGGDFTINSAKTKFSSAGNKVKILGMMILPNGTITIDTKLKSDIEVMLHFFIKDKQRFMDKVDAEGTAAALAKVSGYLNYINTTDPAYLNKLRKKYGASVVDMFIRGSVKSL

SEQ ID NO: 4703 - protein, 318 aa, Pseudomonas sp.
  source 1..318: note = Related to CP047592.1; note = Pseudomonas aeruginosa
MASRDFKSAFEAMYHGKHDFEDFKSGDVSSKYRTFVFNKKDVYEAGAELKVYHKFLSLFIFQWLEFNERCVYSYRKGMNVVDAVKKHAGSKHFFQTDLNNFFGSISGKLVRECILRSLDRVPISDAGLYIDRIVELVTVEDKLPMGFSTSPSISNACLLPFDNAVEKYCEEQGLVYTRYSDDVIISGGDNKLYGTEKIIESILEELFQREITLNASKTKFSSVGNKLKVLGMMILPNGSITIDTKLKSDIEVMLYFFIKDKHRFIDKVDAEGTAAALAKVSGYLNYINTTDQVYLNKLRKKYGASVVDMFIRGSVKSL

SEQ ID NO: 4704 - protein, 303 aa, Pseudomonas sp.
  source 1..303: note = Related to NZ_JACYNP010000006.1; note = Pseudomonas lutea
MYHGKFDFKHFISWPAAELFKPIQIKDRVVYDADKNLKAYHKFLNLFVFEFLEINTDVVFSYRKGVNVIDAVKKHATSRHFFQTDLKNFFGSISSGMIRRCLEENIANFPVSDIGEHLDRILDLVSVENILPPGFSTSPLISNACLYHFDNKLELLCDSRGLIYTRYSDDILISGSEKKLYGLDVEISAMLETSFGGRFQINRGKSRYNSVGGKVKMLGVVILPNGEITIDTKLKSKIEVLLHFFTSDRAKFNSMLEAEDVNGLLKVSGYLNYINTTDPLYLNKLRSKYGATVIDMFMRGSVK

SEQ ID NO: 4705 - protein, 315 aa, Pseudomonas fluorescens
  source 1..315: note = Related to NZ_CABVHI010000016.1
MAKQKLESVFEAMYHGKFDFKDFISGPTSELYKTIKFKNRTVYNADKKLKAYHKFLNLFLFEFLELNTRVVYSYRKGVNVIDAVKKHATSRHFFQTDLKNFFGSIDLDMIRAAIQENTENFPVSDVNENIERILELVSVSGVLPPGFATSPLISNACLYHFDNLVENFCLNSGLIYTRYSDDIIISGSTNKLYGLDTHIESMLKKTFGEKVLINGSKSKYMSIGGKIKILGVVILPGGGITIDTKLKSKIEVLLHYFTSDRQKFNVMLDDKDVNGLLKVSGYLNYINTTDPAYLNKLRTKYGATVVDMFMRGSVK

SEQ ID NO: 4706 - protein, 315 aa, Pseudomonas sp.
  source 1..315: note = Related to FNTC01000002.1; note = Pseudomonas jessenii
MAKQTLESLFEAMYHGKYDFNDFIEAPLSMLCKKIPLKNRIFYKADEKLRAYHKFINLFISDFLKINTNVVYSYRKGINVVDAVRQHAHSRHFCQVDLKNFFGSIDAALIESCILQNIVNLPASDIATHIGRIVSLVSLDGTLPPGFSTSPPLSNACLFEFDNQVENYCHKKNLIYTRYSDDIIISGSSERLYGLDSIIEEFIKEYFNEKLEINPAKTKYTTVGGKIKLLGLVILPNGEITIDTKLKSKVEVMLHYYLTDRPQFNKILEKDSTKGISTLSGYLNYINTTDPSYLDKLRLKYGATIVDMFIRGSVK

SEQ ID NO: 4707 - protein, 323 aa, Pseudomonas sp.
  source 1..323: note = Related to NZ_CP052862.1
MAKKELSSIFDAMYHGKHDFQDFLAGDITTRYKVTTLKGMELYKTDEKLKAYHKFLNLFVFEFLKVNENVVYSYRKGVNVASAVQKHAGSRHFFQTDLKSFFNSIDSALVRETVKNNFDSIPVSDIDRYLDRIIEMSTVNDMLPIGFSTSPIISNACLQKFDSILEDYCIAQNLIYTRYSDDIILSSSGDTRLYGIDTTVGEMLKECFGEKLNLNFSKTKFSSVGNKIKILGMVILPNGAVTIDSKLKNTIEVLLHFYASDKTKFNDRLESESSKLKGDNSVGLLQISGYLNYVNTTDPHYLNKLRKKYGTSVVDAFIRGTVK

SEQ ID NO: 4708 - protein, 323 aa, Pseudomonas sp.
  source 1..323: note = Related to NZ_LT629777.1; note = Pseudomonas asplenii
MVKKELGSIFEAMYHGKHNFQDFLTGNIEPHYKITTLKGMKIYRPDEKLKAYHKFLNLFVFDFLKINKDVVYSYRKGVNVVSAVKKHANNKHFFQTDLKNFFNSIDKELVRNTIHSNLEHIPISNLDKHLDRILELSTVEDKLPIGFSTSPIISNACLQKFDSVLEDYCASEDLIYTRYSDDIILSSGGNTRLYGIEAKVSEILRECFGGKLNLNPSKTKFSSVGNKIKILGMVILPNGTVTIDSKLKNTIEVLLHFYASDKEKFKDRLASESSKLKGENSIGLLQISGYLNYVNTTDPNYLNKLRKKYGSVVVDAFIRGTVK

SEQ ID NO: 4709 - protein, 322 aa, Pseudomonas sp.
  source 1..322: note = Related to NZ_LT607553.1
MAKKSLSLLFDAMYHGKHDFLDFIEGDVADKYKVAIVKGMEVCKPDDKLKVYHKFLILFVFEFLRVNQDVVFSYRKGVNVASAVQKHAGSRHFFQTDLRSFFRSISRSLVKQTLLNNLDSIPVADLQENLERILDLVTVNGGVPIGFSTSPIISNACLYDFDNQLELYCKAHDLVYTRYSDDIIISGVENKLYGVDGVVGEVLGKCFGEMLSVNVSKTKFSSVGNKIKILGMVILPNGVITIDSKLKNTIEVLLHFYSSDKVKFNDRLETESAKLKGDNSLGLLQISGYLNYVNTTDPAYLNKLRKKYGAAVVDSFIRGSVK

SEQ ID NO: 4710 - protein, 316 aa, unidentified
  source 1..316: note = Related to NZ_CP089507.1; note = Luteimonas sp.
MNKQPLRDLFDAMYHGKHQFADFMSCDVTARATAFQLNERTMYSPDKRLRAYHSFLTLFLFDYFPVESEVAFGYRKGSSAYDAVSPHARSRHFFQADITSFFGSLDSGVVANVIDEHKERSPIEDVEKYTARVRSLVLLNGSLPMGFSTSPVLSNACLYKFDRALRERCQTAGLHFTRYADDLIISSGDLELTRSAKAIVEEVLLHEFDGKLQLNAEKTKLTSIGRKVKILGMVILPNGRITVDQRTKDRIEVLIHFYRVDQERFLALVKNDRAGGLEHLAGLVSYVNTVDQEYLGKLRRKFGVTIVDSLLHKTIL

SEQ ID NO: 4711 - protein, 318 aa, Pseudomonas sp.
  source 1..318: note = Related to NZ_QPDS01000008.1; note = Pseudomonas cichorii
MNRRPLEQLFFATFRGKQELNELLELDVRAAYSEKDFDGRVVYSPDKKLKLYLGFLSRVLFDRLPVEADVVFSYRKGVNVVNAVEKHSEGKYFFQSDIKNFFGSIDREMIRRSVLAALELCPISDIEHWLDRVLDLVTVDGVLPPGFPTSPVISNACLYEFDKKFLSWCKQNSLTYTRYADDLIVSGGVEEKMHLLIPCITQLLDTEFGGRIKLNTQKTKFIRPGEKVRMLGVAILPNGKVSVDGRLKKHSETAMHCLLKDKQIFTSFLKEKDFEKALKKFSGQLNYINTVDPSFLDKLRRKYGATAVDKIVHISVGS

SEQ ID NO: 4712 - protein, 318 aa, Pseudomonas sp.
  source 1..318: note = Related to NZ_JACVHC010000006.1; note = Pseudomonas anatoliensis
MNKRPLEQLFFAMFRDKQRFADFLEIDVNSAYTKKDYDGRVVYSPDKLLKQYLGFLSRVLFDRLPVESDVVFSYRKGVNVVNAVEKHSANRYFLQSDIENFFGSISRSTIRKSILSALDTCPISDIEQWLERILDMVTVNDVLPPGYPTSPSISNACLYSFDKRFLDWCKKNNFIYSRYADDLIISGGGEDEMHLIAPKIIELLNCEFEGQIKLNTGKTKFLRPGEKIRILGVAILPNGKVSVDGRLKKHSETAMYCLLNDKDKFISFLKESDFDKALKKFSGQLNYINTVDPSFLDKLRRKYGATAVDRVIHVSVGS

SEQ ID NO: 4713 - protein, 318 aa, Pseudomonas sp.
  source 1..318: note = Related to NZ_CP023969.1
MNRRPLEQLFFATFRGKQDFADFSNLVVNEAYSKKEFDGRTVYSPGKALKLYLGFLSRVLFDRLPIEKDVVFSYRKGVNVVDAVEKHSGNKYFFQSDIANFFGSITNKMIARSVLAAVDQCPISDIEAWLDRVLELVTVDGVLPPGYPTSPAISNACLYKFDRVFLAWCHDNSLTYTRYADDLIVSGESEDLMHQACKKVIEFLYAEFGGDLKLNPKKTRFIKPGDKVRILGVSILPNGKVSVDGKLKKDSETAMHFLIKDKKMFTSFLKEPDLERALKKFSGQLNYINTVDPSFLDKMRKKYGAAAVDKMIHVSVAS

SEQ ID NO: 4714 - protein, 318 aa, Pseudomonas sp.
  source 1..318: note = Related to RHQR01000004.1
MNKRPLDQLFFATFRGSLDFSEFASLNVSQAYSRIEFEGRAVFSPGKTLKNYLSFLSRVLFDRLPVEKDVVYSYRKGVNVVNAVEKHANNKFFFQSDIENFFGNITKEIIKKTILSAIDQCPITDIETWIERILDLVTVEGALPPGYPTSPAISNACLLSFDKRLLAWCNEHSLTYTRYADDIIVSGTNDIWMNSLSYKVTELLNEEFNNFIKLNPQKTKIIRPGEKIKILGIAILPNGKVSVDGKLKKRTETAMHLLLKDKKMFQSFFKEADLDKALKKFSGQLNYINTVDPSFLDKLRKKYGTATVDKIIHISVAS

SEQ ID NO: 4715 - protein, 318 aa, Pseudomonas sp.
  source 1..318: note = Related to JAEKED010000001.1
MNRRPLEQLFYATFRGKQEFADFSKVNVNTAYSKKDFDGRSIYIPDKTLKLYLGFLSRVLFDRLPVAKEVVFSYRKGVNVVDAVEKHSENKYFFQSDIENFFGSINRELISNTILAAVELCPIADIEDWLDRIMELVTVDGVLPPGYPTSPAISNACLYAFDKKFIGWCDSNSLTYTRYADDIIVSGKSEEQMHLLIPKITELLDAEFGKGMKLNSNKTKFIRPGEKVRILGVAILPNGKVSVDGRLKKHSETAMHLLLKDKKMFASFLKEEDVEKSLKKFSGQLNYINTVDPSFLDKLRKKYGAAAVDKIIHISVAS

SEQ ID NO: 4716 - protein, 318 aa, Pseudomonas sp.
  source 1..318: note = Related to LIHT01000076.1; note = Pseudomonas syringae
MIKRPLEQLFFATFRGKQDFQDFIKLDLAASSIKKNFEGRSVYAPEPKLKLYLGFLSRVLFDRLPLAEQVVYSYRKGVNVVNAVEKHSSSKYFFQTDIESFFGSINREMIRRSILWSLDFCPISDIDIWIDRILDIVTVDGLLPPGFPTSPAISNCCLVKFDEEFLSWCDSQGFIYTRYADDLIVSSKVDPGVDLLISKITEILNKMFDGDFKLNLNKTRVVRPGSKVKLLGVVILPNGKVSIDGNLKKNAETAMYHLLKNKEKFVSFLKEQELDRALQKFSGQLNYINTVDPDFLDKLRRKYGATAVDKIIHVSVAV

SEQ ID NO: 4717 - protein, 317 aa, Pseudomonas sp.
  source 1..317: note = Related to PGRY01000001.1
MIKRPLEQLFFATFRGKQDFAHFSSLDLSEMYEAKKFDGRTVYSPNRTLKSYLTFLSRILFGRLPVAEDIVYSYRKGVNVVNAVEKHAHNKYFVQTDIKNFFQSINRQQIKQTIEDSEHTCPISDLNESLERILDIVTIDGVLPPGYPTSPAISNACLYKFDQELASVCKEEKIIYSRYADDLIFSANAISVTESIIPKATKILDEVFMGHLKINESKTKVTLPGQKIRILGVSILPNGKVTIDGKLKKNIETCIYYFLRDKSVFIKLMKEADNEKSTKKISGQLNYINTVDPSFLDKLRKKYGIATIDQLLHYSAE

SEQ ID NO: 4718 - protein, 324 aa, Pseudomonas sp.
  source 1..324: note = Related to NZ_LDSV01000038.1; note = Pseudomonas psychrotolerans
MIKRPLDVLFSAMYRGKLSFDNMKAASADQMFESFTVSGREVVRPNPELKSYLGFLGRVLFNKLPVDVESVFSYRKGVNLLNAVEKHAASKFFLQVDIADFFGSIDSSLIEQTVLRSMDACPISDVEEHLEMIVKLVTVNSSLPAGYPTSPAISNACLYEFDRKFKDICGNRNLIYTRYSDDLIVSGTTSESINGVYGLLQNKLADEFGGKLQVNQSKTKFTRPGQKVKLLGINILPHGAVSVDKKFKKDAEVKLFYYLKDRSIFIKMSGSTNLDKAVKNLSGTINYINTVDSVFLDKLRKKYGSTLVDMFLHRSAKLVDENKI

SEQ ID NO: 4719 - protein, 318 aa, Pseudomonas sp.
  source 1..318: note = Related to CP017149.1; note = Pseudomonas aeruginosa
MKKRPLEDLFFAMYRGKQSFEHFANCSVEGLYEPVMVNGRLVYKTDKDLRAYHRFLNKFLFERLPVVDDVVFSYRKGVNAVDAVEKHAGSKFYFQTDLRDFFSSLTKSDVRRTLEWAKDVCVISDLDVWVERILKLVTIGDSLPMGFSTSPAISNACLYSLDGILKTHCLSNGVIYTRYADDLIFSSSNKQALDPLFGVVCRTLQSEFSGRMGINSQKTKYLRKGGKIKLLGLNVLPNGRVTVDMRHKKEIEVRLFYYVKDRARFLKIMGEVDDEKAIKKFSGLINYVNTVDPAYLDKLRKKYGLTIVDMFIHKSPKL

SEQ ID NO: 4720 - protein, 317 aa, unidentified
  source 1..317: note = Related to JAHTGR010000011.1; note = Duganella sp.
MNAKPLKILFEAMYHGKYDFQDFLQGDICSDFDMFTVGERTIYRPNKKLKTYHSFINLFVLEKFPVNAEVVFSYRKGVNVYDAVSKHAFSKHFFQTDISKFFPSIGVDLVRDTFLQNKNCTPVSDFDTCIERIVELVMVDGFLPVGFSTSPLISNVCLFGFDNLVQKYCSENGIIYTRYSDDLIFSSLEKSKLIGIFEFLQRTMLDLFGGLISLNISKTKFTHAGSKIKLLGMVILPNGKVSVDKKFKDNIEVLLHFYVKNRTKFFNLVESDLKGGMEKISGYLSYVNTVDKDYLNKLRKKYGMTVVDMFLHYTPKK

SEQ ID NO: 4721 - protein, 317 aa, Pseudomonas sp.
  source 1..317: note = Related to LIRD01000002.1
MNKRPLKELLAAMHQGKFEFPELDTGDVSDLYEKKIYNDREIYIPNKRLKTFHSFLSLFLLEYLHTNNEVVFSYRKGVNAVDAVSKHTSSKYFFQTDITNFFNSIDADLVTSTILNSIETCPISDIQSHITNIVKILTINNSVPVGFSTSPLLSNACLFNFDNELQKYCIENKLILSRYSDDIIISSLEKAPILEAEIYVERLLSKHTNNKLSINTKKSKHTQTGNKIKLLGMVILPNGKVSVDIKFKKDTEVKLHFYLTNKEKFNEISGPDLDSAIEKMSGQLNYYNTIDPSYLDKLRKKYGATIVDMFLHKSDKL

SEQ ID NO: 4722 - protein, 317 aa, Pseudomonas sp.
  source 1..317: note = Related to NZ_MUNM01000090.1
MKKRSLKDLLDAMYQGKFEFPELDTGDISTLYETKNYNDRELHIPNKKLKTFHSFLNLFLLEYLQTNKEIVFSYRKGVNAVDAVSKHAHSKYFFQTDITNFFNSIDADLVTSTIINSADRCPISDIDNHITNIVKTLTVNGSVPVGFSTSPPLSNACLFNFDNKLQKYCLDNSLTFSRYSDDIIISSLDKTPLLEAEKYVAQCLSKHTDNKLSINTTKSKHTQTGNKIKLLGMVILPNGKVSIDIKFKKDTEVKLHYYLTNKEKFTAITGPDFDNAIEKISGQLNYFNTVDQDYLDKLRKKYGATIVDMFLHKSDKL

SEQ ID NO: 4723 - protein, 317 aa, Pseudomonas sp.
  source 1..317: note = Related to AKJS01000163.1
MKKRPLKELLSAMYQGKFDFPELDTGDISALYETKNYNGRKIHIPNKKLKIFHSFLNLFLLEYLQTNNDIVFSYRKGVNAVDAVSKHAHSKYFFQTDINNFFNSIDIEMVTSTIFNNIGLFPISDIERYIPNIVKILTVNDSVPVGFSTSPLISNACLLSFDNKLQKYCLANSLIYSRYSDDIIISSSEKASLLEAEQRVTTYLAENTNNKLSINLTKSKHTQTGNKIKLLGMVILPNGKVSVDIRFKKEAEVKFHYYLTNKDKFTEVTGSDFDSAIEKFSGQLNYINTVDPSYLDKLRKKYGATIVDMFLHKSDKL

SEQ ID NO: 4724 - protein, 317 aa, Pseudomonas sp.
  source 1..317: note = Related to NZ_FYEA01000001.1
MNKRPLIDLLTAMHQGKFNFPELGTGNINDLYETKIYNNREIHIPNKKLKTFHSFLKLFLLEHLSTNEEVVFSYRKGVNAVDAVSKHSNSKYFFQTDINDFFNSIDEELVKTTIIRDIEKCPISDINLHIDNIIKTLTIKNSVPVGFSTSPLLSNSCLFIFDNSLKEYCDKNSLTLSRYSDDIIVSGKKKEPILEAERYIAQLLSDTTKNKLSLNIKKSKHTQTGNKIKLLGMVILPNGKVTIDIKFKKDTEVKLHYYLTNKEKFIEIVDSDIETAIEKLSGHLNYYNTVDPSYLDKLRKKYGATTVDMFLHKSDRL

SEQ ID NO: 4725 - protein, 317 aa, Pseudomonas sp.
  source 1..317: note = Related to NZ_CP062253.1; note = Pseudomonas gozinkensis
MNKRPLKELLVAMHQGKFEFPELDTGDITSLYETKKYNDREVHVPNKKLRTFHSFIKLILLDHLDTNEDVVFSYRKGVNAVDAVSKHSRSKYFFQTDIKNFFNSIDEDMVKETILKNIEQCPISDIQDHIEKIVKTLTVNNSVPVGFSTSPTLSNACLFTFDNTLQEYCKSNSLVFSRYSDDIIISSMEKNSIFEAEKYISQKLSEITKNKLSINDAKSKHTQTGNKIKLLGMVILPNGKVSIDIKFKQDTEIKLHYYLTNKETFKKIVGSDFDGAIEKISGHLNYYNTVDPSYLDKLRKKYGTTTVDMFLHKSDKL

SEQ ID NO: 4726 - protein, 317 aa, Pseudomonas sp.
  source 1..317: note = Related to NZ_CP077087.1; note = Pseudomonas monsensis
MNKRPLKDLLNAMYQGKFEFPELETGEISSLYETKKINDREIHIPNKRLKTFHSFLRFFLLEHLKTNNDVVFSYRKGVNTVDAVSKHAHSKYFFQTDIRNFFNSIDTELVISTIENNLTNTPIEDIQLYIEKITKTLTVNNFVPVGFSTSPPLSNACLFDFDNKLQKYCLEQKLIYSRYSDDIIISSREKQAILDIDEYISQTLQTTTKGKLTINTSKNKHTQTGNKIKLLGMVILPNGKVSIDRKFKKDTEVKLHYYLSDKKKFYELTGPDTNNAITKISGQLNYYNTIDPSYLDKLRKKYGATIVDMFLHKSDKL

SEQ ID NO: 4727 - protein, 318 aa, unidentified
  source 1..318: note = Related to NZ_MPIO01000005.1; note = Atopomonas hussainii
MKTKPCALLFEAMYHGKYDFQDFIQSDISNYFDVIYVKDRKIQKPNRKLKAYHSFLNLFLFEYLRTNERVVFSYRKGVNAYDAVSAHANNKHFYQTDISDFFSSIDSQLIKETIIASAELSPIEDLNEHLERVLSLVTVDGRLPMGFSTSPLISNACLYKFDAALEEYSISRHLTYTRYADDLIISSKNREDLEGIQEKISELLLKTFNGRLSLNHSKSKLTHTGRKVKILGMVILPTGKVSVDIKFKNKVEVLLHFYMKDREKFLDKVDGDMRGGMEKISGYLNYINTVDKSYLDKLRKKFGGTIVDMFLHLPTKKP

SEQ ID NO: 4728 - protein, 317 aa, Pseudomonas sp.
  source 1..317: note = Related to NZ_JAHSTU010000002.1; note = Pseudomonas azerbaijanoccidens
MIKKPLKTLFDAMYHGKYEFVDFAQCDVSLCYERVKFKKREVIRPNKRLKVYHSFLILFLLEYLKVDDEVVYSYRKGVNTYDAVSKHAASSYFFQTDLSNFFKSIDVEMVRAVINEGISRAPILDGEDYIDRIIELVTVDGSLPVGFPSSPVISNSCLYAFDEKLKSYCRQRGLIYTRYSDDIIVSGKDKDELLGVKESITAFLNDCFQGKLSINHGKSKFTHTGNKIKLLGMVILPNQKVTVDIKFKKDLEVMLHFYINDREKFLDKVGGGYREGVEKITGYMNYVNTVDKDYLNKLRKKYGATVVDTLIHHPTKK

SEQ ID NO: 4729 - protein, 317 aa, Pseudomonas sp.
  source 1..317: note = Related to SCFF01000003.1
MTKKPLKDLFDAMYHGKLDFTDFAECDVSLCYERTRIKNREVVRPNKKLKTYHSFLNLFLFEYLKIDEEVVFSYRKGVNAYDAVAKHSGSSCFFQTDLTDFFKSIDARLVKDVIGDSLHLAPILDADNYIDRIVELVVVDGALPVGFPSSPLISNSCLYGFDKKLKSYCDKRNLIYTRYSDDIIISGGSRDALLGIKESVAGLLDECFQGKLSVNCDKSKFTHSGNKIKLLGMVILPNQKVTVDIKFKKELEVMLHFYINDRERFVDKVGGDFRVGVEKITGYMNYVNTIDKDYLNKLRKKYGSTVVDTLIHHPSKK

SEQ ID NO: 4730 - protein, 318 aa, Pseudomonas sp.
  source 1..318: note = Related to NZ_CP039631.3; note = Pseudomonas veronii
MTRKPLKILFDAMYHGKFEFEDFAEGNVSRNYERIKLKNREIFRPNKKLKTYHSFLNLFLFEYLEIASDVVFSYRKGVNAYDAVSKHSANSYFFQTDISGFFTSIDSTLVKKTIAESMHLSPILDIEEYLERIVDLVTVNGILPIGFPSSXPLISNACLYGFDKELSSYCKSKDLIFTRYSDDIIISSLSRDSLSNIKDDVAGILHDCFEGKLSINESKSKFTHTGNKVKLLGMVILPNKKVTVDIKFKKELEVMLHFYATDREKFLDKVGGSYSEGIEKITGYMNYVNTVDKDYLDKLRKKYGATVVDILIHHPARK

SEQ ID NO: 4731 - protein, 329 aa, unidentified
  source 1..329: note = Related to JADMKF010000239.1; note = Aquabacterium sp.
MSTTQTHSLPRRQPVEVLFNAMYHGKWRFADFAGASVEANISSKTFTQAGKTRNLLVPSEKLKSFHDFLRLFLLDFLPLNNNVVFSYRKGLSAYDAVAQHAASKSFFVCDIADFFPSIRRPRVKSTLLTAKDLCPIQDLDTWLDRIVDLVCVGNSLPVGFSTSPAISNAVLMAFDNALQTYCTSKELVLTRYSDDIIVSAQDSASLKGIQEQVAASLQDAMKGEFSLHPGKSRFLHSGSKIKLLGMVLLPNGAVSVDASVKSEIEVLIHFYLRDRDKFADRVEGDQRKAEARLSGLLNYVNTIDKAYLDKLRKKFGVTVVDYFLHRSFS

SEQ ID NO: 4732 - protein, 330 aa, unidentified
  source 1..330: note = Related to NZ_FOKN01000013.1; note = Delftia tsuruhatensis
MSTQPTPQFSIKKQRIDVLFEAMFHGKWSFGDFVSASVQTNTISKSFTHGGRTRNLLVPSEKLKSFHEFLRLFLLDFLPFNEDVVFSYRKGMSAYDAVIKHAASKSFFVCDIANFFPSIKRDRIRTALLRAKECCPIEDLESVIERILDLVCTDSGLPQGFSTSPVISNSVLLDFDNAFHAYALGEGLEFTRYSDDIIISSRNSEAIQGIEAIVSHCLHDTMGGDFSLHYGKSRLLHSGVKIKLLGMVLLPNGKVSVDANVKDEIEVLIHFYLHDRSKFADKVDGDTRKAEARLSGLINYVNTIDQSYLDKLRRKFGVTVVDYFLHRSFS

SEQ ID NO: 4733 - protein, 330 aa, unidentified
  source 1..330: note = Related to NZ_SZVI01000009.1; note = Rhodoferax sp.
MSTPISPLPASPKQPIEALFNAMYHGKKSFSDFANLSIDENFTRKSINRSGKTRELLKPSDKLKGCHEFLRLFLLDFLPLNDEIVFSYRKGSNAYDAVARHAKSKSFFVCDIEHFFPSLKRTRVKSTIATARDSCPIEDIDTWLERIVDLVCVDDALPMGFSTSPNISNAALLPFDNALQSYCESRNLILTRYSDDLIISGENFASLDGIEAQVATHLQETMNGELNLHPKKSKFLHGGVKIKLLGMVLLPNGTISVDAGVKEEIEILIHFYLRDKSKFADRVEGGLQKAEARLSGLLNYVNTVDQAYLDKLRKKFGTTVVDFFLHRSFS

SEQ ID NO: 4734 - protein, 328 aa, unidentified
  source 1..328: note = Related to NZ_BADL01000521.1; note = Ideonella sp.
MSIAASPTTAKRPMADLFRAVYHDKRDFRDLIEMDVLLNCKREQYTKAGQVRAILVPNDVLAGCLEFVRLFVVDYLPINEDVVYSYRRGMSAFDAVARHRDGKHFLVCDISHFFPSLNRGRVRLTIDQGNDRTPIADFGHWLDRFVDLVCPESSLPVGFSTSPGISNAALKPFDDAMSIVCESRGLTLTRYSDDIIVSGQSKDALDGIEQIVAGTLQQVLPGEFTLNRAKTKRMHRGTKVKLLGMVLLPDGGVSVDAAVKDEIEVLLHFHSRNRSRFLERVGNDLAKGERRLSGLINYVNTIDKAYLDKLRRKFGAASVDYFLHRSFS

SEQ ID NO: 4735 - protein, 327 aa, unidentified
  source 1..327: note = Related to JACUZW010000001.1; note = Comamonas sp.
MSTPLKTVAKRPLEDLFNAVYHDKYRFQDLAQLDVLLNCKREQYTKAGHTRAILAPNEILAACLDFTRLFVVDFLPINEDVVYSYRKGMSALDAVVCHKDSKYFFVCDISHFFPSITWERVGLTLAQAKDRTPISDFDLWLDRFVHLVCPETGLPVGFSTSPGISNSALKPFDDAMKRNCDDRSLRITRYSDDIIVSAKTKEPLHEIEKLIEGTLQETFSNDFTLNQSKSKHLHRGTKVKLLGMVLLPDGSVSVDASIKDEIEVLLHFHATNRSRFVEYVGHSLTKGERRLSGLINYVNTIDKAYLDKLRRKFGVATVDYFLHRSFS

SEQ ID NO: 4736 - protein, 329 aa, unidentified
  source 1..329: note = Related to JAEQNE010000002.1; note = Ramlibacter monticola
MGAKTALLPSGPRSLEELFTAMYRGKRKVSEFASLNVAASCTRKSFTHKGRTRGIVIPSDKLRGCHEFIRLFLLDFLPVEIDLVFSYRKGVGAFDAVKQHASSRHFFVTDIADFFPSIKRDRVLSIIQTGRGISPISDLDAWMERIVELVCLDGELPVGFSTSPAISNAALRPFDQAMRKECGALGLVYTRYSDDLVISGGDAGVVERAQAFCECHLREAMHGEFQLRPEKSKFLHVGRKIKLLGMVLLPNGRISIDGATKSEIEVLLHFYLRDRAKFAAMGEGDERKVEARLAGLLNYANTVDQSYLDKLRHKFGAAPIDLFIHRSFG

SEQ ID NO: 4737 - protein, 308 aa, unidentified
  source 1..308: note = Related to CP039287.1; note = Cupriavidus necator
MYHSKRSFDDFARGPVAQKYVRHRFCKQGKTREVLSPDDKLRAYHEFLRLFLLDFLPQNEEVVFSYRKGVSAYDAVSRHAQSKFFFVCDIADFFPSLKRHRIRQTILSGKDSSPVADLDQWLERILDLVSVDDCLPMGFSTSPTISNAALLPFDNAVQWYCASRGLIYTRYSDDMVVSAKEFASLDGIEETLGAFFVEYMDGDLALHPGKSKLLRTGSKIRLLGMVLLPNGTISVDASIKSEIEVLIHFYIKDRAKFADRADGDAQKVEARLAGLLNYANTVDQSYLQKLRKKFGAAVVDLFLHRSFG

SEQ ID NO: 4738 - protein, 322 aa, unidentified
  source 1..322: note = Related to CP035708.1; note = Sphaerotilus natans
MPIVKKPLKTLFEAMFHGKRSFADFMREASEDDLGRTHIRQGAKRRELVSPSERLRAYHSFLRLFLVDFLPVHEKSVFSYRKGVSARAAVEQHAPSRHFFVTDIESFFPSLTRGIVRETITNAMAEIPIADLSDHLEHVLDLLCVDDAVPIGFSTSPGLSNAALYPFDAAFHARCQQLGVIYTRYADDIVLSSGERSAVQEGEVALNELLDRMFRGELRLHRGKSKYLHVGGKIKLLGMVLLPNRTISVDTSVKDEIETMLHLYLRDRERFNKMLEVGSAKTEARLAGLLNYVNTVDQSYLEKLRRKYGAAVVDMFLHRSFG

SEQ ID NO: 4739 - protein, 313 aa, unidentified
  source 1..313: note = Related to NZ_JPOQ01000093.1; note = Proposed Ferrovum myxofaciens
MLFEAMFHGKRDFTDFMRKVSEDDFGRAHLRQGTKQRVLINPSERLRAYHNFLRLFLVDFLPVHEEAVFSYRKGVSARAAVEQHALSRYFFVTDIESFFPSITRDIVRKTITSAMAEIPIADLSDHLEHVLDLLCVDDALPIGFSTSPSLSNAVLYPFDIVFHARCQELGAIYTRYADDIILSSGERATVESGEGSLNDHLDRMFEGGLRLHRGKSKYLHRGEKIKLLGMALLPNGTISVDTSIKDKIETMLHLYLRDREKFNTMLDAGTAKTEARLAGLLNYVNTVDQLYLEKLRRKYGAAVVDMFLHRSFG

SEQ ID NO: 4740 - protein, 311 aa, unidentified
  source 1..311: note = Related to JACORU010000006.1; note = Ramlibacter sp.
MFHGKQKFADFIGADVTSLYTTTTPRIGSKRRTLHMPSDKLRAYHEFLNLFVFEFLPVNTGVAFAYRKGVSAADAVRIHKHGRHFLVSDLADFFPSIDVSLVRATLVGGAMASPVEGLESNLDRILQLVCIDDALPLGFSTSPVLSNAVLFAFDTALQKECESRSLVYSRYSDDLIISGSDRDEVHGAGQIVEGLLREHFGEKLRLNPFKSKSLHVGSKVRLLGVVLLPNGKVTVDAKLRANIEVLLHFYLKDRAKFADFAKKVTGEPDKAEARLSGWINYINAVDQEYLDKLRMKYGSALVDRFVHRSFG

SEQ ID NO: 4741 - protein, 348 aa, unidentified
  source 1..348: note = Related to VSWE01000008.1; note = Herbaspirillum sp.
MQYSPVLYERQHILTMTKQPLQKLFDAMYHGKYSFEDFLQSPVEKNYEVIAPTEPGGRRLFKPKENLKTYHRFLNLFLFEFLPVNDRVVFSYRKGFSALHAVQKHAKSKFFYQTDIQAFFDSIDRALTEKAILSGQANCPISDLDIHLDRIVDLVCIDNSLPVGLPASAPLSNAVLLDFDNELERSCLERELCYSRYADDIIISGHRQVDVQEIGQSVQEKLHQFSSKNFSIHEGKTRYFHVGGKIKILGMTILPNGKISIDSKKKKDLEVLLFFYLNDKERFRKIVNQAKNRTETSRELSDDDYVAYLSGTINHVDSIDPDYTDKLRRKFGTATIDALKHSGFSKEK

SEQ ID NO: 4742 - protein, 333 aa, unidentified
  source 1..333: note = Related to NZ_KV880769.1; note = Herbaspirillum camelliae
MTKQPLQKLFDAMYHGKHSFEDFLQSPVEKNYEVIGTSDFGGRKLFKPKENLKLYHRFLNLFLFELLPINERVVFSYRKGFSAVNAVQRHTQSKYFFQTDIQSFFDSIDQALTKRTILAGEPYCPIADLTAHLDRIVDLVCIDDSIPVGLPASAPLSNAVLLNFDNEMERLCQERDLSYSRYADDIIISGQNQGAVQEAGNAVQEKLHQFSSEKFFIHQGKTRFFQVGGKIKILGMLILPNGRISIDTKKKNELEVLLFFYLNDREKFKNIVNQAKQRTDAKRDLVEDDYIAYLSGNINYVDSIDPDYTDKLRRKFGAATIDALKYSGFSKEK

SEQ ID NO: 4743 - protein, 333 aa, unidentified
  source 1..333: note = Related to NZ_SDQC01000001.1; note = Pusillimonas soli
MTKQPLQKLFDAMYHGKFSFHDFLHSPVEQNYEIVGGSTSGSRTLFKPKENLKTYHRFLNLFLFELLPINERVVFSYRKGFSAVNAVQKHTQSKYFFQTDIKAFFGSIDRLLTQKTILAGHEYCPIEDLHEHIDRIVDLVCVGDSIPVGLPASAPLSNAVLVNFDNEIERICKQQGLIYSRYADDIIISGQKHESLLGLKMLVQEKLHQFSSEKFFIHHGKTRFFQVGGKVKILGIMILPTGIISVDTKKKNDLEVLIHFYLNDRGRFKDMVNKTKKRSGADEELSEDDYIAYLSGNINYVDSIDPAYTDKLRRKFGSTTIDILKYSGFAKEK

SEQ ID NO: 4744 - protein, 335 aa, Chromobacterium sp.
  source 1..335: note = Related to JAGKRE010000004.1; note = Chromobacterium violaceum
MNKEPLQKLFDAMYHGKIRFEDFLYSPMEQNYEQGLPNHNGRRRILKPRENLKTFHKFLNLFLFELLPINERVVYSYRKGFSAVNAVEKHRDGKFFFQTDISAFFESIDVSLAKRVILSGAEFTPISDVDSYIDRIIDLVFVNDSLPVGFPVSAPLSNAVLFDFDNVMESYCLNKGLVYTRYSDDIVISGNEREWYNGVDDFVQRSLHESASDRFYINRKKTRFFQVGNRLSILGVMILPNGKVSPDTRKRREIEVLLHFYLTDKDKFKKMIAEKRVKSGKISKIDDGVSDDECLDVLSGNLNYIDSIDPDYTNKLRRKFGVATIDMLKHRGFSK

SEQ ID NO: 4745 - protein, 332 aa, unidentified
  source 1..332: note = Related to NZ_JAGSPN010000010.1; note = Undibacterium luofuense
MMEKQPLRALFNAMYHEKFNFDDFLTYSVSDSYEISSKEKLFERKFKKPKDMVKNYHRFLNLFVFDYLETNPRVVFSYKKGLSALNAVERHSLSKFFFQTDISSFFESIDKKLIRETIVAGCSACPVSDIDLYIDRIVDIVCIDNALPVGLPCSAPISNAVLLLFDNEIEKICAQRNLIYTRYSDDIIISGMERSSLDGIDKQVRGSLEVIYNNKFSINIAKTKFFKVGNKISILGVNILPNGKVTPDKSKKEELEILLHFYLTDRDKFISRASEMKRGNKNTLSEEDCLNLLGGNLNYVDSIDKDYTDKLRRKFGVVTIDKLIHRGFPVKK

SEQ ID NO: 4746 - protein, 323 aa, Vibrio parahaemolyticus
  source 1..323: note = Related to NNGJ01000068.1
MKKHTLERLFDMITHGKYDFSDFLHCNLDDEVKIFEISSKKLSSQSRIVYSASAKLKDFHSFLNMVVFEQLSSNEDVVYSYRKGVNALDAVIDHRNSKYFFQTDIRKFFPSIDRELIAKTINRNKERIPVSDFDNYFDRVLDMVCYGGSLTTGFSTSPLISNSVLIEFDDYFYKYCKSNHLVYTRYSDDLIVSSSKPFEIDIESTIIEKLDKLYRGNFGINKNKSRYSHIGQKVKLLGMVILPNGDITIDRKQKKEIEVLLHYYKEDKKRFDELIDGDYLKGMARISGILNYIKMIDEEYLNKLMKKYGVTLIDTLIRKAASK

SEQ ID NO: 4747 - protein, 323 aa, unidentified
  source 1..323: note = Related to MAJX01000042.1; note = Aliivibrio fischeri
MKKHTLERLFDIIMHGKYNFSDFLFCKLDDEVQVFEIGSKKLSSQSRIVYSSSTKLKDFHNFLNMVVFEQLPSNNNVVYSYRKGVNILDAVIDHRNSKYFFQTDIRKFFPSIDKKLVSETIKKNKEKIPVSDFDKYSDRVLDMVCHGDHLTTGFATSPLISNSVLIEFDDYFYNYCKNNHLVYTRYSDDLIISSNNPFKEDIELLITKSLDEIYQGSFSINKSKSRYSHIGQKVKLLGMVILPNGDITIDRKQKKEIEVLLHYYKEDKNRFNELINDDYQKGMARISGILNYIKMIDEEYLNKLMKKYGVTLIDTLIRKAASK

SEQ ID NO: 4748 - protein, 315 aa, Vibrio sp.
  source 1..315: note = Related to NZ_LNQW01000024.1; note = Vibrio jasicida
MKKSSLEQLFTLILHGKYSFSEFLECDLESELTEMTVRSRTLYSPSNKLKSFHYFINMVIGEQLNINGKVVFSYRKGKNALAAVQVHRKSKYFFQTDIRAFFSSINKQLIKEALLRSRDNIPVLDLDIYLDRIVDMVSVGNSLATGFSTSPLISNSVLVEFDDALVNYCTTNNLIYTRYSDDLIISSQNTIDHSIENVIESFLSQYYSDTFSLNDRKSRYSHIGQRVKILGMVILPNGDITIDRKQKKEIEVLLHFYREDKNKFRELLNDDMDKGFARISGILNYIKVVDEGYLHKLMRKYGVTVIDTLMRKASL

SEQ ID NO: 4749 - protein, 315 aa, Vibrio sp.
  source 1..315: note = Related to CAOA01000134.1; note = Vibrio nigripulchritudo
MKKFPLESLFDIILHGKYKFSEFENCQLNEEVTRIQVRSRTVYSPSSKLKSFHYFLNMVLCEQLALNEFAVFSYRKGISTLDALKFHVSNKYFFQTDITSFYSSITRSIIDRVIEVNKPNLPISDIDKFHKRILDFISYDGILPTGFSTSPLISNSVLIDFDNLFAQYCMNKGLVYTRYSDDIIVSSKNEFDIDVEKVISGFLKELYGDTFNLNSSKSRYSHIGQRIKVLGMVVLPNGDITIDKKQKKEIEVLLHFYREDYSRFRDIIGDDLDKGMARISGILNYIKNIDESYYHKLMSKYGVTTVDILTKKAGN

SEQ ID NO: 4750 - protein, 327 aa, unidentified
  source 1..327: note = Related to NC_018012.1; note = Thiocystis violascens
MTNAVTSGPKMPLESLFRAMYHDKFDFQDFVNGEISRNYERTQYLDREKTREILKPNQKLKTFHTFLNLFLFEHLPVNRDVVFSYRKGVSTYDAVIPHAKSRHFFQADISSFFTNINREMVNKTISFGYDSVPISDIDFYKERILDLVCVGDTLPTGFPTSPTITNAVLRPFDDQLQAYCNSNSAIYTRYSDDIIISALDRELPSDIKDYVTQTLSVITAGRLQLNERKCRHFHIGGKVKILGMLILPNGQISVDSKIRRETETLLYFYVRDKDKFLNKTGLDFDKGMKRVSGFLNYINTIDQRYLEKLRRKYGATVIDMFLHRSFD

SEQ ID NO: 4751 - protein, 316 aa, unidentified
  source 1..316: note = Related to NZ_CP014222.1; note = Janthinobacterium sp.
MKKQSFEHMYNAMFHGKYSFSDFLNCDIDSEYTTINLRDRVIYSSSKKLKDFHKFLNLFIFDFLHISIDSVFSYRKGYNVVDAVQMHKNGKYFFQSDIVDFFPSIHENLVKSTLKHSLESTPILDLDKYLDLIIKLTMINNNLPIGFSTSPLISNAVLLDFDEEILSYCRKKNIQYSRYSDDIIFSAENIEEIIEVPIVVEKCLISHYNNTFKINKSKSKIKHIGGKVKILGMVIMPNGSLTIDSKLKNIIETLLHLYRTDKQKLKEISENDLENGIKKITNYLNYINAVDANYLLKLKKKYGPAIIDYFIHKKRN

SEQ ID NO: 4752 - protein, 316 aa, unidentified
  source 1..316: note = Related to NZ_CP081150.1; note = Deefgea sp.
MKKPDLESAFNSMFHGKYKFSEFINLNTIDEYTIIQHNNRIVYSTTKKLKDFHKFLNLFVFEYLRINEEVVFSYRKGHNVVDAVKIHAKGKYFYQSDIIDFFSCINEQHIDHSLKISLSSIPVSDIEKYAMQVKNLILIDGKLPIGFSTSPPISNSVLFDFDKIIKQHCTLNDIKYSRYSDDIIFSANSLNLLDDIEKITEETLLKTSGNAFHINTKKSKIKSIGEQVKILGMVIMPNGELTVDSKIKNKTEILLHHYRTDKEKFKKISENELEKSILNLGSLLNYINAVDKPYLYKLKKKYGATTIDFFIHKTRG

SEQ ID NO: 4753 - protein, 333 aa, unidentified
  source 1..333: note = Related to JACJDS010000010.1; note = Pseudoalteromonas sp.
MFDENQKRSLREIFISTFHEKMSFQDFIQLDVGSEFQKFNLKRRTLYAPSSKLKRIHRFLNNTIFEFADYNTDVVFSYRKGVNIRDAVEKHAGNNFFFQTDLSNFYSNIHESDVRRALSNQLTNTPVLDIEKYIDKIIELVVFDNHIPAGFSTSPILSNICLFEFDNQLNKYCNEHHLTYTRYSDDLIISSKTDHFSEDIESVVSNLLSEYINAGITINKLKTKLHKKGHNFKMLGFNVLPNGVVTIPSVDKKEIETLLYFYLTDSNKFENYFQSTFCNTEAELGEKSLRELAIGTLSGKLIAFNSMDKQYVSKLRRKYGNTMIDMFIRKSVK

SEQ ID NO: 4754 - protein, 311 aa, unidentified
  source 1..311: note = Related to LAZL01000002.1; note = Catenovulum maritimum
MFKDFMQIDVNGEFQKINLKKRTVYAPTPKLKLLHRFINNTVLEFADYNADVVFSYRKGVSIRNAVEKHSHNNFFFQTDLSNFYGNIHQSEVQTALMNQLKNTPVLDVEKYIQRIVELVIVDDHIPAGFSTSPLLSNICLFSFDNELLKYCQAHDLTYTRYSDDLIISGQTNEFAGDIEPVINNLLAEYVNTGISINKSKTKLHKKGHKFKLLGFSILPNGVVTIPSADKKEIESLLYFYLTDNNKFENHFKNTQNPKDIESYDKSLREHALGTLSGKLIAFNSMDKQYVSKLRRKYGNTVIDMFIRKSVK

SEQ ID NO: 4755 - protein, 333 aa, unidentified
  source 1..333: note = Related to LKDV01000028.1; note = Pseudoalteromonas sp.
MNENNINRNLKDIFNSTFHGKMSFEDFLSLDVQSEYGTIALKKRLVYVPSPKLRLVHRFINKTILEFADCNKNVVYSYRKGVSTRDAVEKHSGHTYIFQTDLTDFFNNIRKSNVVNSLKKQLSSVPIKDINTFIDVIADLVVIDDHIPAGFSTSPLLSNICLFDFDNELEKYCLSNNLKYTRYSDDLIISGSSIDFTTTIEAIIETFLKKNVNNALSINEAKTKIHKIGHNFKILGFNILPNGIVTIPSADKKQVESLLYFFLTDEKKFEDFFLGFTNKIKQGSDDKTVREKAISMLSGKLIAFNAMDKKYIAKLRRKYGNTVIEMFIRKSVT

SEQ ID NO: 4756 - protein, 333 aa, unidentified
  source 1..333: note = Related to NZ_QNQN01000070.1; note = Pseudoalteromonas sp.
MNNESTKRSLKDIFSSTFHDKMSFDDFLRLDVNREFKTINLRKRLVYAPSAKLKQVHRFINKTILEFADCNTNVVFSYRKGVSTRDAVERHSHSNYIFQTDLSKFFNNIHRDDVMTALKSQLSNAPVSDIDLFIEKIVDLVVIDDHIPAGFSTSPLLSNICLFRFDNALEAYCEANELKYTRYSDDLIVSGSLNDFTESIETVIDNLLIEHVNNSLCINKAKTKTHKVGHSFKILGFNILPNGVVTIPSPDKKEVESLLYFFLTDDQKFEDFFKKCADSKTPETDDKTIRERAIGMLSGKLIAFNAMDKQYVAKLRRKYGNTVIDMFIRKSVT

SEQ ID NO: 4757 - protein, 333 aa, Vibrio sp.
  source 1..333: note = Related to JAATOR010000004.1; note = Vibrio diazotrophicus
MDNNDKNRSLEEIFVSTFHDKMSFKEFLSLDINNEYHTIDLRKRVIYAPTPKLKQIHRFINKTILEFADYSKDVVYSYRKGVSVRDAVEKHSNNTIFFQTDFSDFYSSIHAENVKTSLYKQLSNTYISDIEKYIDRILELTVIDNHIPAGFSTSPLLSNICLFDFDQELLKCCNDIGLTYTRYSDDIIISGSDKTFTDDILSIIKDLLGKHVNSEISINDSKTKINKKGHDFKLLGFSILPNGIVTIPSEYKKEVELLLYFYLTDNEKFEDYFKKLNENKKLELEDKTLREHAINSLSGKMIAFNSMDKKYISKLRRKYGNTVIDMFIRKSVK

SEQ ID NO: 4758 - protein, 312 aa, unidentified
  source 1..312: note = Related to SAAR01000301.1; note = Erysipelotrichia bacterium
MSFEEFLRLDVKNEFHRIDLKKRIIYAPSLKLKQIHRFINKTVLEFADYNSDVVFSYRKGVSIRDAVEKHSSNNIFFQTDFSNFYRSIHLSNVESSLNNQLSDTLISDIGFYINRIIELTVVDNHIPAGFATSPLLSNICLFDFDKELLKYCNDNNLTYTRYSDDIIISGVNDVFVESIKDLIKNLLAKYVNKDIHLNDSKTRINKKGHSFKLLGFSILPNGMVTIPSRDKKEVELLLYFYLTDNSKFENYFSTIADNKKLGSGDKSLREYAINSLSGKLIAFNSMDKCYISKLRRKYGNTVIDMFIRKSVK

SEQ ID NO: 4759 - protein, 333 aa, unidentified
  source 1..333: note = Related to NZ_RSEJ01000003.1; note = Photobacterium alginatilyticum
MEANQKRPLIDIFISTFHDKMSFNEFLTLNVSNEFKRIQLNKREVYAPSPKLKTIHRFINKTILEYADYNTEVVFSYRKGISTREAIEKHSASNYFFQTDISNFYNNVRLENIYTSLRKQLNNTPVLDIENYIDNIVNLVVVDEQLPTGFSTSPLLSNICLLDFDNALLKYCKDNFLIYTRYSDDIIISGSDDGFAVEIESIVSNYLNNFVNEKIKINSAKTKFHKRGHDFKLLGFSILPNGIVTIPSSDKKEVESLIYFYLTDNEKFEDLFKKISVNKKLENTEGKPIRDLAISSLSGKLISFNSMDKDYISKLRKKYGNTIIDMFIRKAVK

SEQ ID NO: 4760 - protein, 328 aa, unidentified
  source 1..328: note = Related to JADWMP020000001.1; note = Shewanella sp.
MEKRSLDKVFLSIFHDKFSFNDFIVFDLSSNYKKLMVNNREVFSASKELKYIHKFINSSILAYAKYNKDVVYSYTKGVSIRDAIEKHSGSKFFLQTDISNFYGSLNRDNIEISLRYQIDNFPISDIEDYIDLIVYLTVVEDKLPAGFSTSPLLSNLCLLDFDTALLKYANENKLVYTRYSDDLIISSVNDRLDNDIVLKIESLLCEHVNDSISLNQSKTKFNHIGNSFKLLGLNILPNGTVTIPSSEKKKLETLIYLYFTDKDKFIDFTNNNIKYNKESKERTVVEVGTRYITNKLVAFNSMDPEYVNKLRRKYGNTVIEMFLRQSVN

SEQ ID NO: 4761 - protein, 345 aa, unidentified
  source 1..345: note = Related to CP027188.1; note = Idiomarina sp.
MKHYEEKPQEFVLTSIQKKRSLQEVFLSTFHSQLTFDDFLNLNVAHEYKKVEIQKRVIYIPSYKLKRIHKFLNNTVFNHARFNTDVVFSYRKGISVRDAVTPHAKNKFFFQTDIVSFYQSIKTNDVERALKNQLSDVPISDIDRYIDHIVNLVVVDDHIPAGFATSPVLSNICLVNFDDALLEYCKTQHLTYTRYSDDIIISGEYELEHKVIEIFVTELLKANLGRAAELNIQKTKRYKRGHDFKLLGLNILPNGVVTIPRESKNEIEVMLYLYLTDAKGFDDYVKHTFFSSETDIDSSTLRERGIAKLSGKIISAKSMDNNYISKLRRKYGNTIMEMFIRKSVK

SEQ ID NO: 4762 - protein, 330 aa, unidentified
  source 1..330: note = Related to NZ_JAJEWQ010000006.1; note = Planctobacterium marinum
MPEKRQFIEVFRSTFHEKISQEELITLETENEYKIFQHKSRKTYAPTPKLKNIHRFLNNTVFEYADYNKEVVFSYRKGKSVREAVELHAGSKIFFQTDISNFYGSITRENVEHSLREQLNNVPISDIKEYIPLILKLVVVDNHIPAGFSTSPVLSNICLYEFDNALQVHCENNGLIYSRYSDDIIISGESSEFVDRVTKTTEDLLHKYINTNVSLNPDKTKVHKKGRYFRLLGFTILPDGKITIPSQDKKEIETSLYFYLTDSSKFVDLFTKTNQVALNEVDSVSIRERAIASLSGKLIGVNSMDKNYISKLRGKYGNTVIDMFIRKAAK

SEQ ID NO: 4763 - protein, 333 aa, unidentified
  source 1..333: note = Related to BMQW01000002.1; note = Shewanella ulleungensis
MELSKERRSLEEVFISTFHEKVNFDDFVNFSINKEYKTFEVNRRKIYAPSKKLKQFQRFINSSILEYADYNRDVVYSYRKGVSIRDAVEKHASSNFFYQTDISDFFGSITGDDIMKVINTSLLNVPVSDVLEYKQLLFELMVVDNNLPAGFATSPLLSNITLVDFDNALKKYCDRSNIIYTRYSDDLIISSVNEGFVDNINEVIKSFLHEHMGERFNLNYNKTKVRRKGQKVKILGFTILPNGIITISKSYKEEVESLLYFYLNDTDKFSDYVKNKINPRDNQIGDRTFEEFGISSLSGKLIAISSMDSLYISKLRKKYGNTIIEMFLRKTVN

SEQ ID NO: 4764 - protein, 326 aa, unidentified
  source 1..326: note = Related to CP031769.1; note = Salinimonas sediminis
MKRSFEEIFISTFHNKVSFDEFLTLDIESEFKKIPLQKRTVYAPSSKLKQIHRFLNHAVFEYAEFNKDVVFSYRKGESTRTAVEKHANNRVFYQADIKDFFGSLKKENILHTIEAQLENTPVLDIVDYRDRLLDLTVVDDHIPAGFATSPILSNLCLFEFDNALDNICKKEELTYTRYADDIIISSQTDAFLPEIEEKIQKLLSKKVNPEIFLNLAKRKVQLQGQRIKILGFNILPNGIVTIPNKDKKSVETMLHFFINDEEKFKDYVSKNIKSNSDGEPSLRDIGISSLSGKLISLNSMDKNYISKLKKKYGNTVIDMFIRKSVK

SEQ ID NO: 4765 - protein, 356 aa, Vibrio sp.
  source 1..356: note = Related to DACQGG010000011.1; note = Vibrio vulnificus
MSSTGYAFKIVIHFNLSINIGLALLIKIQKQRTLKEVFKSTFHDKISFKEFINLNLDEEYTISTFKKKKIYSPSDKLKKIHRFINSSILEHADFNREVVYSYLKGSSVRDAVELHSQSQYFFKTDIHNFFGIITTRNIKKSLEEQFSNVPISDIDMYKEFLFKLMVIDDVLPVGFSTSPLLSNICLFEFDNHLQAYCSSNNFKYTRYSDDIVISSNKSFDIEEMSENIQALLSKHVNEGAKLNKSKTKVHSKGERINILGYNILPNDEITISSKDKKETEILLHFYLNDLDKFDDYVTKNIINRFRNSDKKSIRDIGLSSLSGRIIGINTMDKKYLIKLRKKYGNTLIDMLLRKTV

SEQ ID NO: 4766 - protein, 332 aa, unidentified
  source 1..332: note = Vibrionaceae bacterium; note = Related to JAAEYZ010000024.1
MSYIKNQRTLEEVFKSTFHDKITFEDFINIDLNSEYKITIFKNKEIYSPSDKLKKMQRFINGSILEYADFNKDVVYSYLKGNSVRDAVELHSKSQYYFQTDIHNFFGTITGYNVKKSLEEQFSNVPISDLDNYKDFLFNLMVVDGKLPVGFSTSPLLSNICLYNFDNALYKYCESNGFLYTRYSDDIVVSSDSHISIDEISEKIQSLLLIHVNESAKLNKRKTKAHSKGEKINILGYNILPNDEITISSKDKKETEILLHFYLNDLDRFDNYVRNNISPRFRNVDDKSSREIGISSLSGRIIGINAMDRKYLTKLRKKYGNTLIDMFLRKTV

SEQ ID NO: 4767 - protein, 335 aa, Vibrio parahaemolyticus
  source 1..335: note = Related to JWSV02000003.1
MLLLSYIKHRRTLEEVFKSTFHSKLAFEDFIGINICDEYSVSTYKKREIFSPSDKLKKIHRFINGSVLEYADFNRDVVYSYLKGRSVRDAVEVHSKSQFYYQTDIYNFFGSISPSNVKKSIENQFSNVPISDIKDYQGFLFSLFVVDGKLPIGFSTSPLLSNICLRDFDNALNQYCIENSYRYTRYSDDIIISSDNQFCIDKLSKHIQNFLLQYVNENTKINKSKTKVHTKGDKFNILGYNILPNDEVTISSKDKKEAEILLHFYLNDLDKFDDYVRKSIYPRFKTSSDKSMREIGTSSLSGRLIGINAMDKKYLTKLRKKYGNTLIDMFLRKTV

SEQ ID NO: 4768 - protein, 334 aa, unidentified
  source 1..334: note = Related to NZ_LVDX01000004.1; note = Shewanella algae
MENNRNFRTFEEVFNSTFHNRVSFDDFVNGSINTEYSIVKFKNKSIYSPSLNLKKIQRFLNKSILEYALTNERVVFSYRKGASVRDAVEVHSKSKYFFQTDIKNFFGQIKKDVVENIIGTQLGCVPIIDIEEYHDVLLRYLIVDGHVPIGFSTSPIISNLSLFYFDNDLEEYCLKNDFKYTRYADDIIISSTDYEIDLHKTKSLIKSFLLRNNFVGELINDKKTRIQVRNGVIKLLGFNILLDGTVTIPSKDKKEVEIMLNFYLNDKSKFDDYVSKLKTRSGRLNEGKSLRENGISSLSGRIIGINAMDKKYIGKLKSKYGNAVIEMFLRKTVK

SEQ ID NO: 4769 - protein, 335 aa, Vibrio sp.
  source 1..335: note = Related to NZ_CP091185.1; note = Vibrio anguillarum
MENIEQKRSLEEVFNSTFHSKLPFSALTELTIDSEFKHKIFNNRDIYLPTDKLKKIHRFVNGSILEYAEINRNVVFSYRKGVSIRDAVEKHTCNKFFFQTDIKNFYGSISKKNISDIFDHRFDMVPISDLDNYRKKLLDLMVINDQLPAGFSTSPMLSNICLFDFDNELEQYCNESHLTYTRYSDDIIISSSEKENLTDLSEFIQSLLYKHVNKETLINDNKTKIVKHGSNVKILGFSILPNGELTISSKDKKEIEILLHFFLNDAEKFNNYIESKLSFKHDDSSDRNAYDSALSSLCGRIVALNSMDKKYLDKLRRKYGNTLIEMFLRKTVLKN

SEQ ID NO: 4770 - protein, 333 aa, Vibrio sp.
  source 1..333: note = Related to AAXNPA010000001.1; note = Vibrio cholerae
MNIANYNRTLEEVFKSIFHDKLKFEEFLKLDVKNEYQVFDIKGRKVYSPSKKLKKIHRFINGSIFEYADYNKNVVYSYLKGVSVRDAIEKHAKNNYFYRTDIKDFFGSITGENVIRSLENQLGNVPISDISNYVNHIFNLVVVNGRLPAGFSTSPILSNICLFSFDKELEVTCQRDDMVYTRYSDDMIISSINEIDEEKITGLIQSLLFRFVGDNVFLNDKKTKIHKKGTQGTLLGFNILPNGEVTIPSRDKKEIEILLHFYLSNSDSFVNYVSKNIQPRYANSDNKTLNEIGVSYLSGKLIGINAMDKKYLTKLRCKYGNTLIEMFLRKTVL

SEQ ID NO: 4771 - protein, 333 aa, unidentified
  source 1..333: note = Related to JABXGE010000012.1; note = Raoultella terrigena
MDRTNNNRTLEEVFTSIFHDKLKFKEFLELNITKEYEVFEVKGRRLYSPTKKLKQIHRFINGSIFEYAEYNKNVVFSYLKGVSIRDAIEKHALNQYFYQTDIRDFFGSINGENINHSLSSQLDNTPISDISDYINLIYNIVVIDQKLPVGFSTSPILSNICLFNFDNELEKICISNNMTYTRYSDDIIISSGNEINELETTSIIQSLLFNFVNNEFIVNDKKTKTYKKGSGNSLLGFNILPNGYVTIPSKDKKEVEILLHFYLTSPKSFEDYIIKNIVNRYKNQEGKSIDEIGKSFLSGKLIGINAMDKKYLTKLRGKYGNTLIEMFLRKTVL

SEQ ID NO: 4772 - protein, 328 aa, unidentified
  source 1..328: note = Related to NZ_CP034660.1; note = Colwellia sp.
MSEKRSLEDIFLSTFHNKYSFKEFIELDISKEYEIFNINDRTIYSPSAKLKAFHRFIISCILEYAEFNKDVVFSYRKGTTIRDAVERHSNNSFFFQTDIKSFFTSISTNDVKSTLLHQLVDIPVSDVNHFIDLLIKYCVVDNILPTGFSTSPILSNLCLFKFDNQLEKLAKEKHLHYSRYSDDLILSSKSLDTLNEIELTIQRYLTQYINSTIKLNQSKTKITKKGQRIKLLGLVILPNGIVTIDKKTKRQMETLFHLYLTDDEKFENYISTHFKNKKDQQTSLKEYGISILSGKLMAINSMDKGYLNKLRTKYGNTVIEMFLRKTVK

SEQ ID NO: 4773 - protein, 334 aa, unidentified
  source 1..334: note = Related to NZ_CP041170.1; note = Alteromonas mediterranea
MKTNTNESYRTFQEVFVSNFHNSLLFDDFLNLSVDNNIAVTQVKEREIVQPSKRLKRILHFLAKNVFDYGNIANEVVFSYRKGVNVRDAVLPHSKNRFFFQTDIANFFGSITKPLVSKSIRNGLGSVPIADIHEYADVILNIVSYKNCLPLGFPTSPAISNMCLLNFDKELLIQANELDVSYTRYADDIILSANNDEVLRMLAARVGGLLQEFLGAEIKINEAKTRYLQQGQKIKLLGLVVLPNGQVSIDRADKIEIETLLHHYLTNDDKFLGYGVVLKNKKAKNDKVLTRENVISMLSGRLIGANAMAPEYLLKLRQKYGNTIIEMFLHKSAK

SEQ ID NO: 4774 - protein, 322 aa, unidentified
  source 1..322: note = Related to CP033381.1; note = Methylomonas sp.
MPFGIVQMKKTSISLREAFDSTFHQKFNFDDFLSLNISQEYKQLSNEKVNPSLKLKKYLRFLNSFVFDYAKINENVVHSYRHEKSTYTAVVPHCHSKFFFQTDIKDFFHKISKQDVEKIVDTALDKAPIYDINRYKSELLNITTIDDVLPVGFPTSPNISNSFLSSFDDTLEGYCIKNNIIYTRYSDDVILSSEYKNSLINIQDVISNYLKEIYDGRIEINTYKTKHTHKGSKIKILGMVVLPSGKISVDIKFKQHLEILFHFYINDKNKFADYLKNHYQGDFSKISGQLNHINTIDKSYLDKLRKKYGNFIVDSFHHQSID

SEQ ID NO: 4775 - protein, 315 aa, unidentified
  source 1..315: note = Related to NZ_CP022129.1; note = Methylovulum psychrotolerans
MKKTSLSLQEAFDSTFHHKLNFDDFLNLNLPQEYQKISNAKVNPSPKLKKYLRFLNSFVFDYVKINTNVVHSYRHEKSTYTAVVPHCHSKFFFQTDIKDFFHKITKQDVEKILDTALDNVPIYDIHQYKSELLNITTIDDILPVGFPTSPNISNSFLSDFDDALEGYCIKNEIIYTRYSDDIFLSSNAKDSLMSIQNTISDYLNELYDRRVKINAYKTKHTHKGSKIKMLGMVILPSGKISVDIKLKQQIEVLFHFYINDKDKFADYLKNHYQGDFSKVSGQLNHINTIDKSYLDKLRKKYGNFIVDSFYHQSID

SEQ ID NO: 4776 - protein, 316 aa, unidentified
  source 1..316: note = Related to MGYX01000019.1; note = Gammaproteobacteria bacterium RIFCSPLOWO2_12_FULL_47_76
MKKLLLKEAFNSTFHKKLNFDDLLNLEIINEYTSFNIRNKQILNPSEKLKKYHRFLNSFIFDYAKINTSVVHSYRKEKTAYTAVSVHANSKYFFQSDINDFFNSITATDIKNVLNSNLDDSPISDIVNYKDQLINIVTVNNILPIGFSTSPNISNTCLYNFDNSLETYCNERDINFTRYADDIILSSNTKESMVGIEEIVSKILNEFFNDRFVLNQHKTKRLRKGNKVKLLGMVILPSGKVTVDMKLKKQLEILLHFYINDKDKFSDYLGKVYSGKLSTISGQLNYINTVDKNYLNKLRKKYGNYIVDLFFHSTVK

SEQ ID NO: 4777 - protein, 312 aa, unidentified
  source 1..312: note = Gammaproteobacteria bacterium; note = Related to JACUUH010000036.1
MPLQDVFTSTFHQKLDFNDFLNLDVKSEYEPLKNTQKLILKPSPKLKKYLRFLNSFIFEYAKINTNVVFSYRKDNSAYTAVRKHANSKYFFQTDLSSFFYSITAEDVKNVLENYMGNSPINDLREYQEIIINMVTVDGVLPVGFSTSPKISNSCLYEFDNELEQYCLDDGIIYTRYSDDIILSSKDNDLKTVEKVISGMLNKFFGARFQLNPNKTKHTHTGKKIKLLGMVILPSGKVSVDIKLKKQIEILFYFYINDKTKFTDYLVNKYQGDLGKISGQLNYINTIDKSYLNKLRKKYGNFIVDSFIHQTVS

SEQ ID NO: 4778 - protein, 329 aa, unidentified
  source 1..329: note = Related to PJBZ01000069.1; note = Psychromonas sp.
MNEITHTNFKKNTLQTIFESNFHDKFSFHDFLHFNQEKEYTKVNIGREKIGSKEILKASDKLQSYLRFLNNYIFQYADINKNVVYSYRKGANTYQAVKKHSDNNFFFQTDIKGFFKNVKSADIKFILENNLHNTPISDLKKYEERILSIVTVNDTLPVGFASSPILTNSLLKDFDNELENYCTQNDIVYTRYSDDLILSSKVKDSLIDIEKMISNILNKFFNDSFQLNKEKTKLTHKGNKIKILGMVILPTGKVTVDIKIKKQIESLLHFYINDKDIFIDLVGGNYDDGLAMVSGKINYINTIDPEYLIKLRKKYGNYVVDLFFHQSFK

SEQ ID NO: 4779 - protein, 326 aa, unidentified
  source 1..326: note = Related to NZ_WTKU01000003.1; note = Psychromonas sp.
MNDITHSEKKSLQSIFKSHYHEKYSFEDFLNFDQEKEFSTIEIDTKKGAKKEIFKPSDKLQDYLRFLNNYIFQYADTNTNVVYSYRKGTNPYQAVVKHSANNFFFQADIKGFFSSVKRQDIEYVLNNKLAQSPISDLNIYINRILNLIMVNDSLPIGFASSPILTNSLLNDFDNELEKYCLDQDVIYTRYSDDLILSAKTKTPLINLEDYISEMLVKFFNERLKLNEEKTKLTQKGNKIKILGMVILPTGKVTVDIKVKKNIEILFHYFINDKNKFVDISGGNYEAALDKLSGKINYINTIDPDYLIKLRKKYGNYIVDMFFHKSY

SEQ ID NO: 4780 - protein, 316 aa, unidentified
  source 1..316: note = Related to JACUUF010000373.1; note = Methyloprofundus sp.
MALTLKNAFEATFRSNYRFEDFLALKLEQTATRKKLGGREIVQPNAELKAYLRFLNRFIFSYADVVDEAVFSYKKDASPKQSLIKHCQSRCFYKTDIARFFESITFDDVLQVFTNKLSQAPITDWPDYQAHLQSLVLVDGRLPIGFPSSPVISNSVLYEFDQAALAWAQRHDIIYTRYSDDLIFSAQHDEVLKSLPQRIEKWLNDFYDGRFKPNPYKSFFTHTGEKVKLLGLVIQPNGHISVSRSLKNKIESLLHYFIEDQAVFDRLLAQHFSGNAVGLMSMLSWVQSIDQPYIEKLRKKYGNYTVDLFLHGAARL

SEQ ID NO: 4781 - protein, 329 aa, Escherichia coli
  source 1..329: note = Related to CP028745.1
MKPLSLEKAFNIAFFEKDSFQNFLSFEPFQQTKFITFDERLIAEPTSKLKEYHKFINEFVLSYLKVNKDVVFSYRKGSSTYDAVKLHACSKIFFNTDIKSFFPSITREYARSVLVDNLSNVPISDLNIHLDKILDYIIIDNSLPVGFPTSPAFSNACLYDFDVEMQQYCINHEYIFTRYSDDIIISSENDEGFENIHSVVSDLLGEFGKGHFKLNSAKTKLIKKGSKIKLLGMVILPSQIVSVDIKIKRKLEHLIHFYVTDKDKFIDSIIKDPKVKTSGLNDSEILEKGVNTVSGLLNHINTIDKSYLDKLKRKYGNTIVDMLFYKNVN

SEQ ID NO: 4782 - protein, 329 aa, Enterobacter sp.
  source 1..329: note = Related to NZ_CP006580.1; note = Enterobacter ludwigii
MKPLSLEKAFHIAFFDKDSFHNFLSFQPFQQTKFSTFEERLIAEPSSKLKEYHKFINEFVLSYLKVNKDVVFSYRKGSSTYDAVKLHAKSKVFFNTDIKSFFPSITREYARAVLFNNLSNIPISDLNVHLDKILDYIIIDDSLPVGFPTSPAFSNACLYDFDVALQQYCAEHDYIYTRYSDDIIISSENDEGFDNINSVVIELLGEFGKGHFSLNPTKTKLIRKGSKIKLLGMVILPSEIVSVDIKIKRKLEHLIHFYITDKDKFLDSISKDPKIKTTGLNDSEILEKGVNSVSGLLNHINTIDKKYLDKLKKKYGNTIVDMLFFKNVN

SEQ ID NO: 4783 - protein, 328 aa, unidentified
  source 1..328: note = Related to NC_014562.1; note = Pantoea vagans
MKALTLEKAFSIAFFEKDTFENFLTFEPLSQIKFSSKNERLITEPGSKLKEYHKFINEFIFSYLKVNKDVVFSYRKGASTYEAVKLHAKSRVFFNTDIKSFFPSVSREYARYVLDDNSSSVPITDFSSYIEKILDFIIIDDALPVGFSTSPSFSNACLYHFDLGMQSYCFEKGYLYTRYSDDIIISSEHELDDDIYAVVSGFLNKLSSANFELNPSKTKLIRKGSKIKLLGMVILPTGVVTVDIKVKRKLEHLIYFYLNDKEKFVDSVKKESGNKQKYLNEGEVLDKGISMVSGLLNHVNTVDKSYLDKLKKKYGNTIVDLFFHKNLN

SEQ ID NO: 4784 - protein, 353 aa, unidentified
  source 1..353: note = Related to NZ_CQDT01000017.1; note = Yersinia frederiksenii
MSDQFVNVDDNILPTNSSSPIKPKKSLPLEKVFNIAFFEKDTFENFLNFDVASGYECADFKGRTLLKPSPKLKDYHKFINDFIFPYLSVNETVVFSYRKGSRTYDAVSRHSESKVFFNTDIQNFFPSITRDFAKLVLLDNLKNIPISDINNFIPKILDFVVVDNVLPVGFSTSPSFSNASLYTFDCRMFDYCQEINAVYTRYSDDIIISTNNDSDLNDIYRIVAHFLSQVNDGKFLLNKRKTKIVRRGNKIKLLGMVILPSGKISVDIKTKNKIEHLIHFYLTNKESFKNAVLKYDKDGKIKNLPENEIIIKGVGMVSGILNHINTIDQEYLNKLRRKYGNVVIDMFFHQNAS

SEQ ID NO: 4785 - protein, 328 aa, unidentified
  source 1..328: note = Related to NZ_JXSK01000013.1; note = Photorhabdus luminescens
MNTPDNPIIPKSKKILKLETIFSIAFHEKTKLDDFLSFNIKSEYKKLEYNGRIIYHPSTKLKSYHKFINDFILFYLNINKEVVYSYRKGSSTYEAVKKHSDKKWFFNTDINNFFSSITKNFAREVLEDNTSAIPIIDIQEYYDKILDFIIVDDILPIGFSTSPAFSNACLYKFDNNIQYYSSENNLIYTRYSDDIIISSDNKEIIHSIYTTVSNFLSKENNGNFSLNKYKTKIVNKGNKVKLLGMVVLPSGKVTVDIKIKKKIEYLIYFYITDKDKFKDAIGKDIDKGIEMISGNLNHINTIDKSYLNKLRKKYGNVIIDMFFHKNVF

SEQ ID NO: 4786 - protein, 327 aa, Pseudomonas sp.
  source 1..327: note = Related to NZ_LR733826.1
MNKKKLEVLFEAMYHGKYSFKDFIESDISAEYASFKAKERTIYRTTKKLKTFHSFISLFILEYLNINPRVVYSYRKGFNSLDAVSKHAQSKYFFQTDIEHFFENLTTPLIRKTILNNSDNSPVLDIENHIDRIVELTTLNNSLPLGFSSSPVMSNACLYDFDNELEKLCIQNELIYTRYSDDIIISSQNQEKIEPIESTIEFILNKHHNGQLNLNKQKSKHTRKGNKVKLLGLAILPNGKVTIDIKIRNEIEVLLFHYVNDRDKFLDHEKIKQDMTKGVDLLFGYLNYVSTIDKNYLEKLRKKFGATVIDMFLHRTKKKEDRHANNF

SEQ ID NO: 4787 - protein, 323 aa, unidentified
  source 1..323: note = Related to NZ_JAJOYU010000011.1; note = Proposed Pararheinheimera soli
MKDNSLESVFNAYFNNKKNFSDFYTLRTEEEASLIPLSKSKVELYRCSEKLKVIHTFLSLFIFNEMPLRKDIVFSYRKDVNITDAVRPHCNSEFIFKTDISKFFNSISAECVYHSLSKYCENIRTVNSGEIRENIERIVYLCTINNHLPVGFSCSPSISNFCFYDYDNIIDAYCNENGYIYSRYADDLIISSQDEMNKDKITDDLTAILSSDAFLRLSINHKKTKLITKKFERQILGISILNDGKMTVSKATKTDIEVKLHLLKTNREKLVDYTGMEEKSSILSIAGVLSQINNIDSDYLFHLRKKYGNAIISKLLKGKELLK

SEQ ID NO: 4788 - protein, 323 aa, unidentified
  source 1..323: note = Related to CP048043.1; note = Serratia liquefaciens
MKDNSLENVFNSYFNNKKDFADFHTLRTEDEASLIPLSKSKVELYQCSARLKVIHTFLSRFVFSEMPVRKDIVFSYQKDVNIADAVRPHCNSEFIFRTDISKFFSSISAEAVSHMLSKYCENIRTVDAKEVRENIDRIVYLCTIDNCLPVGFSCSPSISNFCFYDYDNIIEAYCNEKGYIYSRYSDDLIISSQDEMDKDTITGDLTTILSSDVFLKLSINHKKTKVITKKYERKILGISILNDGKMTVSKVTKTDIEVKLHLLKTDRKKLMDYTKMDEMASILSIAGVLSQINNIDKDYLFHLRKKYGNAIISKLIRGKELLK

SEQ ID NO: 4789 - protein, 323 aa, unidentified
  source 1..323: note = Related to FWGN01000003.1; note = Klebsiella pneumoniae
MKNKSLENVFNAYFNNKKDFSDFHKIRTEEEAHLIPLKRNSAELYQCSDKLKAIHNFLARFVFSEMPVRKDIVFSYRKEVNITDAVRPHCESDYIYKTDISKFFPSISADAVSEKLKKYCAHISTVDAEDVRENIGRIVYLCTLNNQLPVGFASSPSISNFCFYDYDNLIESYCREKNYIYSRYADDLIISSQSEIHKESITADLSVILTSDALLRLSLNHKKTKVITKKYERKILGVSILNNGKMTVSKTTKKDIEVKLHLLRTDRVKLVDYTGMDEMSSILSIAGVLSQINNIDKDYLYHLRRKYGNAIISKLLRGKELLK

SEQ ID NO: 4790 - protein, 323 aa, Escherichia sp.
  source 1..323: note = Related to LR134270.1; note = Escherichia marmotae
MKDNSLESVFNSYFNNKKNFADFHTLRTEDEVRLIPLSRAKTELYQCSARLKLIHTFLSRFVFSEMPVRKDIVFSYRKEVNITDAVRPHCNSEFIFKTDISNFFPSISGDVVSDKLSKYCATIRTVDAEEVRDNIKRIVFLCTIGNRLPIGFSSSPSISNFCFYDYDNLIDSYCHNNNYIYSRYADDLIISSQHEISKDTITTDLKSILSSDPLLKLSINHKKTKVITKKYERKILGISILNDGKMTVSKATKTDIEVKLHLLKTDRNKLVNYTGADEMSSILSIAGVLSQINNIDQDYLFHLRKKYGNSIISKLLKGKDLLK

SEQ ID NO: 4791 - protein, 323 aa, unidentified
  source 1..323: note = Related to NITI01000005.1; note = Cronobacter sakazakii
MKNNSLESVFNSYFNHKKNFDDFHNIRTEEEVRLIPLSRTKADLYKCSDRLKLIHTFLSRFIFSEMPVREDIVFSYRKEVNISEAVKPHCNSEFIFKTDISNFFPSISSEAVSNKLSKYYDYLSTIDIEDVKKNIERIVYLCTFDNRLPIGFSSSPSISNFCFFDYDNIIESYCKDKKYIYTRYADDLIISSQHEILKKEITNDLIGILSSDPLLKLSINHKKTKVITKKYERKVLGISILNDGKMTVSKATKTDIEVKLHLLRTDRGKLMNYTGMDEMSSILSIAGVLSQINNIDQDYLFHLRKRYGNAIISKLLRGKELLK

SEQ ID NO: 4792 - protein, 335 aa, Escherichia coli
  source 1..335: note = Related to NZ_ADJG01000004.1
MDADIVLPIGGCNDRKKTLEALFNSYFNFKKEFSEFNSIQTINEVEKIALLKNNKIIYKCSDRLKSIQSFLNKFIFNEMPIRKDIVFSYRKDVNIADAVRPHSHSNFIYKTDISNFFPSIKPQIIKNRLLKHRDKIEFIEREEIEKYCDRIIDICTIDDHLPIGFPSSPSISNFCFYEYDSIISDFCIKNSLIYTRYADDLIISSTDELDKDNLSQTLEQILHSDDQLRLKINYKKTKLITKKYERHLLGISILENGKLTISKKMKRDIEIRLHLLKTNRDKLVDYTNSNEMDSILSIAGTLSQINNIDKDFLYQLRKKYGNAIISKLLKGKDLL

SEQ ID NO: 4793 - protein, 317 aa, Escherichia coli
  source 1..317: note = Related to ABBXOP010000094.1
MKIKDAFDFYYNGKFNFDLFSDLVFSDHVKEVILNKKLFFSASDDLKVIHNFLSKFIFDSLGVRDDIVFSYRKGVNVFNCIEPHKFSNFIYKTDIESFFPTITKPAIEEAIKKSVCNISYIDHEDIINNLDRILELTTVSERLPVGFSSSPSISNFIMYDFDCDIYKYTTDHGLVYTRYSDDILISSDKEIDKNEMTRIISDILSKKKGLNFKINNKKTKIITKKYERIIFGISISPVGTLSVSSKLKKEIEVKIYYLLNNREKLSMFSNMDEKNAILSLSGSLSYVLGIDPGYVTKLRGKYGNAIITKLLSNKEDL

SEQ ID NO: 4794 - protein, 317 aa, Proteus sp.
  source 1..317: note = Related to CP021694.1; note = Proteus mirabilis
MKLEEVFNFYFNGKESFEQFYTLSLNDHIKEFNFNNKKCYSISDELKTIQLFLSKFIFENIEFRKDLVYSYRKGVNVVDCISPHRFNNYIYKTDIENFFPSIGYDLIKNKIIEKVKDISFLDTNDVMVHLSRILELVTIDKKLPIGFSSSPAISNFVMYDIDCKIDCFAKNNDLIYTRYADDIILSGKNNLDKNSINQEINNILNYNQDNIFHLNDKKTKIITKKFERNILGISISPVGTLSISRQLKKEIEVKIFFLINNKDKFVKFSEMDEMSAIFSLAGKLSYALGVDPVYINKLRRKYGNSIINKLIKNKGDL

SEQ ID NO: 4795 - protein, 315 aa, unidentified
  source 1..315: note = Related to ALIV01000029.1; note = Pectobacterium atrosepticum
MNKNRFEDVFKAYFNGKLNFSDMLNLNIDENIEILSLGNREVIKCSEDLKKIHSFFNLFIFDYLEIQADSVFSYRKGVNVVDAIRPHAKNKFIFKTDIKRFFPSISHSLIHNCIFSQIENIPFLDFPTYLDRVCDLVTYNGKLPVGFSTSPNISNAIFNPLDIKIKEYCSYNKLTYTRYADDLMISSNNYLDKEDYIKIISNIIKLDDGHHFTINIEKTKLIKKSKNMDVMGVKIHPDGTLTIGKKLKNEIETKLYLFSKNQDDFVKFSKQEKESSKAKLTGQLNYINTIDPDYIVKLKTKYGNSLVELFFRKAI

SEQ ID NO: 4796 - protein, 315 aa, Enterobacter sp.
  source 1..315: note = Related to CP029126.1; note = Enterobacter hormaechei
MNKSKLDEIFNAYFNGKLDFSEMLTLNITNNINTISVGSRQVVKCSSNLKRIHSFLNLFIFDLLEIQTDCVFSYRKNVNVVDAIRPHSNNKFILKTDIKNFFPSITRMSIYECINRQIEALPFSDLCDYLDKICDLVTYNGHLPMGFSTSPQISNAVFNLIDIEIKSFCIKNNLTYTRYADDILISSNNYLDKEEYIDKLTKILSFDDHQCFTINTEKTKLIKKGKNTDIMGVKIQPDGTLTISKKLKNEVETKLYLFSKNQDDFVKFSKQDKNQSKAKLTGQLNYINTIDPDYIVKLKSKYGNSLVELFFRKAI

SEQ ID NO: 4797 - protein, 315 aa, unidentified
  source 1..315: note = Related to CP077366.1; note = Pantoea agglomerans
MDKYYLEHTFNAYCDGKIDFNDFLNIELKTNIEEIKVEKREVVKCSEKLKRIHSFFNQFIFDNLEIQEDCVFSYRKNVNVLDCIAPHSKNKFIFKTDIHSFFHSISKKTIHNCIFTQIDNQPLSDIESYLDRICNLVTYKDRLPQGFSTSPVLSNAVFNNFDIKIKKHCNRNNMIYSRYADDLLISSNNYLDKEECIHDIDNILNSCFEQKFKINTLKTKLIKKGKNMEVMGVQIHPDGSLSIGKRLKNEIETKLYLFLKNQNDFVSYSSLDKNHAIARLSGQLNYINTIDPKYIDKLKYKYGNSLVDLFFRKAI

SEQ ID NO: 4798 - protein, 316 aa, Escherichia sp.
  source 1..316: note = Related to NZ_CP042942.1; note = Escherichia fergusonii
MISENKFESIFNLYFDGKLNFSDMLSLNKEKELKHLTIENREVIKCSEKLKKIHHFLNLFIFDNLSIQSDVVFSYRKNVNVVDAIIPHAQNKFIFKTDLNNFFKSIKRSEIYNNLISQTDQIPIIDIVDYIDLICDLVTYHDELPLGFSTSPNISNAIFNQYDIKIKEYCLSKKIAYTRYADDILLSSDNYIDKNEYIELLNNILTIDGKRIFSLNSKKTKLIKKSKNMEIMGVKILPDGKITVSKKIKNQVETKLYLFIKNQSDFIKYTKSNKISSINKLSGQLNYINTIDPEYIEKLKSKYGNSLVELFFRKAI

SEQ ID NO: 4799 - protein, 322 aa, unidentified
  source 1..322: note = Related to nan
MAGNKSFEKIFDAYFHQKISFEEFNEIEIEKEIKRINIGSKIVYGCSSKLKKIHSFLSVFVFDRVSIREDVVFSYRKNNNVLNAIYPHAKRRAIYKTDIESFFPSIRMENVKEQLKEHCKESIFFDLEEHLDSIINVISVNDRIPIGFPTSPIISNFAFIRFDNEISSYCKKRRYIYTRYADDILISSDDFLDKEELTKDINEIFKKLHSDYKLNIPKTKILTKGRPRIIFGVSIFPDGKLSVSRKLKNEIEVKLYLYLKDKKEFLSYSKANTMEGAIVNLSGILNYVNTVDKTYLNKLKSKYGASVVGLFFRKTIENEYRN

SEQ ID NO: 4800 - protein, 316 aa, unidentified
  source 1..316: note = Related to CP096258.1; note = Providencia rettgeri
MSVQIKDIFDIYFNNSMEFNELIHLNKDDYLELKTYKGKEIIAYKKGFNKLKLLHRFLNEAVFNRIEIMNDVVFSYRKGVNVLNCVMPHRNSNFIFKTDINNFFPSFSSKFIEVKLINKFNNFIISDINQYLPEIVDIVTYNNTLPIGLSTSPSLSNILFSDIDFKIKLFSNENEYYYTRYADDIIISSNRDINKNTIFDDLQQILTSENDNFILNKSKTKLLRKGNLRKIMGVCIMPDGHITVDKKLKNNIETKLYYMSKLNNIHSKDSETTEIKRYLSGIINYVSTIDNSYINKLKRKYGSTIVEMFIRKSLIK

SEQ ID NO: 4801 - protein, 316 aa, unidentified
  source 1..316: note = Related to NC_012880.1; note = Musicola paradisiaca
MSIKIKEIFDIYFNNSMDFNDFFNLNKMEYLEKKIFRGREIVAYKKGFNKLRLLHRFLNEAIFNRVDIMDDVVFSYRKKVNVFDCVYPHRANPFIFKTDIKNFFPSFNRDFIESKLESVFKEFIISDINEYLFKIVELVSYNDFLPVGFSTSPSLSNILFSDADKKLKSFSISNGYIYTRYSDDIIISSESEIHKKDIFTTVQGIINSECDSFVLNFDKTKLLKKGGVRKIMGVSIMPDGYISVDKTIKNNIETKLHYISKLNNVNSQEPELIEIKRYLSGMINYISTIDDGYINKLKRKYGSTIVEMFLRKSLVK

SEQ ID NO: 4802 - protein, 318 aa, unidentified
  source 1..318: note = Related to LZDL01000007.1; note = Haemophilus haemolyticus
MKDRKPNLKFFFESYFNKKVSFDAFENISIEKNYHIQCINKREIYVPSNELKLILSFFSDFIFKLLPIEGDVAFAYRKGINVKDCLLPHVNSKFFYKTDIINFFPSISSYLIRENIYEDILKLSYLKKDDVDFYLDKILSLVTIDDKLPIGFPTSPFISNYVMRKYDLMLKYFCNMNGFVYTRYSDDIIISSNMNISKDFITRNIDGIFRKEKSPFYLNKSKTKIFTKKHKVKILGLTINNGEISIDREIKNNIEIGIYFFINNREKFINYFGLNELSAKKKLAGNLSYAINTEPDYLLKLVKKYGSSTIKEILRASV

SEQ ID NO: 4803 - protein, 318 aa, unidentified
  source 1..318: note = Related to NZ_CP015030.1; note = Mannheimia granulomatis
MKDRKHNLKFLFESYFNKKISFDIFENISIEESYDKLCKNKREIYIPNYELKLVLSFLSHFIFKSLPIEDDVAFAYRRGINVKDCLLPHANSKFFYKTDILNFFPSISSSLIKENIYQDIHKLSYLDQEDLALYLDKILSLVTVDDKLPVGFPTSPFISNYIMRKYDVSIKSFCSNNKFIYTRYSDDIIISSNTDIDKDYITNNIEKVFQQGENLFHLNNSKTKVFTKKNKIKMLGLIINNNQISVDRKVKDEIEVGIHFFIKDRLKFINFFNDSELSAKRKLAGNISYAINIEPDYLQKLAKKYGLLTIKEILKVNL

SEQ ID NO: 4804 - protein, 318 aa, unidentified
  source 1..318: note = Related to NZ_KV801828.1; note = Haemophilus sp.
MKDRKPNLKFLFESYFNKKVSFDIFENISIEKSYYKICKDQKDIYIPNDELKLILSFLSHFIFKSLPIENDVAFAYRKGINVKDCLLPHVNSNFFYKTDIINFFPSISTSLIKENLHQDISKLSYLDQENLMFYLDKILSLVTIDDKLPIGFPTSPFISNYIMRKYDINIKSFCNNNNFIYTRYSDDIIISSNDDIDKDYITSNIKSILQQEYSPFYLNNSKTKIFTKKNKIKILGLTINNQEISVDRKIKDEIEVGIYFFTKDRLKFIDYFSDNELSAKRKLAGNISYAINIEPDYLQKLARKYGLSTIKEILKVNL

SEQ ID NO: 4805 - protein, 331 aa, unidentified
  source 1..331: note = Related to NZ_CPWN01000004.1; note = Yersinia frederiksenii
MANLNPPIYRNNTHSSSRKFSELFDSYFYGKYSFDDFLSIDISKETKKIQLKDNKIIYSCSGKLKNIHRFINIFIINKLCIKEDIVFSYRAGKNVVDTILPHSENKFFLQTDIYNFFPSISINLIKETILRGISNLEITDIDDYVDYILKLITIDNSLPIGFSSSPPMSNSCLYDIDNKISIYCEQKRMKYTRYADDLIISSMNLFDVNHVKNSIAKILNEQKNASFILNERKTKFFSKSQKIKMLGVVILPTGRVTVDIKMKKKVESMIYFYLNDKDKLLDLSGLNYEDTLKNISGLLNHINTIDKKYLDKLRMKYGNTVVDMFFHKSVK

SEQ ID NO: 4806 - protein, 311 aa, unidentified
  source 1..311: note = Related to PYNG01000071.1; note = Photobacterium kishitanii
MKKKELKLIFNLMYHGKYDFNDLINCNIEKEYIKIKIKKRVIYKASNKLKNYHSFLNLIIFNYLDVDKDVVFSYRRGVNTVDAVRPHVNSCFFYQTDIKNFFPSLKKDLIKKTIINCKDSIPVIDIEKYIDRIVDLVTIDGVLSTGYSTSPIISNACLFNFDNEIKRKLANNNVIYSRYSDDIIISSNENIIVDDMNKIILLALKNNVSPDIEINKNKTKLSKKGCKIKILGMVITSDSVITVDNKYKREVEYLLYLYIRDKNRFKSIGKSISQVSGVLNYIQTIDPEYIKKLKKKYGSTIVDVFLHQSMK

SEQ ID NO: 4807 - protein, 327 aa, unidentified
  source 1..327: note = Related to NVXO02000002.1; note = Sulfurimonas sp.
MHKKELENIFNSYFHNQYNFQDFLNIIPKQNIHYKFNKYKNYKFISYIKENNSFSKDSMKMREYHTFIKNIFCNYMKVHAAVFSYRKHINIYDLAKIHNEHQNFFTTDIKSFFYSISTQMIHEVLIQNKVNFPFELDVKYYKNIVNITTVNNSLPVGYVTSPSISNAILYKFDELMDNYSQEHSISYSRYSDDLIFSSDDYNAIKSLPAVIESTLNSLYSSAFKLNISKTRFFDKTEKVSFLGISILPNGHITVEKWTKENISQLIYFYLNDKNKFTVLLQKRFKNNLSRAYGTLNYINDIDKQFILKLRKKYGNFIVDKFLHGVKH

SEQ ID NO: 4808 - protein, 317 aa, unidentified
  source 1..317: note = Related to QGLM01000007.1; note = Frischella perrara
MFQEKHSLEMLFNAMYHGKYSYQDFISSNIENYIQHINNKIVKTNKTFQVYHSFLNLFLFDYLPINENVVFSYRKGVNIYDLLIVHRNSKFFFQTDLKYFFPSITSEDIKKLIEKNIDMFPVVKKDIETHIDRIISLTTINNYLAVGYSTSPNLSNSILFDFDNSLSDFCQKLNIKYTRYSDDLIFSSLDKENLQKVEIEIRRLLKILFGGRIQLNTKKSKYNHQGNKVKILGAIILPNGQISVDKKIKTKIETAIYLYLNDRNKFDDFLEKNYRKGVNQISGTLNYIKTIDYDYLKKLKKKYGSTVINMFLNQSIG

SEQ ID NO: 4809 - protein, 324 aa, Aeromonas sp.
  source 1..324: note = Related to CP077210.1
MIQRTFKQAFNAVFHEKENFEEFLALDIENEVEKISVENKIKKQHRLFFRQSEKLKKYLRFVDRVILRNLAKDNDVVHSFTKDKSTLTAVSAHSNNDYFFQTDISSFYSSITKDDVLRILKRDINLIPIIDLSDYIDFLVSIMTYDGVLPVGFSTSPQISNAFLFEFDGELNEICRRRNIIYTRYADDIILSGMDLEHLKDMSSVIDSLILKLFSGQITLNKGKTKLTWKGNKVKILGLTILPNGVVTIDKKYKNTIETLLHLYTTDIDRFEKHLSVTDGFNKRSLFGLLHYANSIDPQYISKLQRKYGSLAVYKLMEDSQNDD

SEQ ID NO: 4810 - protein, 324 aa, Aeromonas sp.
  source 1..324: note = Related to JAEHHQ010000003.1; note = Aeromonas veronii
MTKRTFRQAFNAVFHDKEAFEDFLSIDIGNEIERVVILNKLKKQQRVIFKQSDRLRKYLRFVDRVILRSLARNDDVVHSFTKDKSTLTAVIAHAKNDFFFQTDISSFYSSITRNDVLMLLKRDVDLVPISDLSDYLEFLASVMTYDNTLPIGFSTSPQISNAFLFEFDRQLNDICREREIIYTRYADDIILSSMTLNVLEDMSHVIDSLLSELFLGNISLNRDKTKLIRKGNKIKILGLTILPNGVVTIDRKHKNTIETLLYLYTTDIERFHEHLSIMDGFNQRSLFGLLHYANSVDPHYISKLQRKYGALAVHKLMEDSQNDD

SEQ ID NO: 4811 - protein, 318 aa, Aeromonas sp.
  source 1..318: note = Related to NZ_MVPS01000007.1; note = Aeromonas veronii
MKKRTLEQAFNAVFHEKEQFQDFLKIDLELEVELINVKDRVVVRQSDKLKKYLRFVDRTILRSLAKDDEVVHSFIKEKSTLTAVQAHVESKYYFLADIKEFYQSIKRKDVVNILERNQAEIPIEDIVEYIDYLSYVTTYKDTLPIGLSTSPQLSNAFLFDFDREVKAYCIENSLIYTRYADDIIISGDNMDVIAMLSDRIQGMLQLYGSSCFTLKESKTRITWKGNKVKILGLVILPNGRITIDKKYKKIIEALLYFYSSDKSEYQSLLSKVMHGDEKSLFGLLHYANSVDPLYINKLQRKYGALSLHALMESDRDDN

SEQ ID NO: 4812 - protein, 328 aa, unidentified
  source 1..328: note = Related to SIHL01000004.1; note = Alteromonas sp.
MTHEADSNQTKKKTLEQAFNTIFHDKEDFSEFCSLDVISEVEPFTISDREVFKTSDRLKRYLRFIDRIILRHLSIDTDVVHSFSQEKNTYTAVKEHVGNDYFFLTDIESFFSKIKTEDVKKILYRNINNIPISDIENYIDFLSSVVSFNNQLPVGFSTSPRLSNSFLYDFDIALKTYCSRESLTYTRYADDVIISGASFEKLERLKTTIQDFLKIHASNELRLNKSKTRITHLGNKVKILGLMILPNRTITIDAKYKSRLELLLHFYSNNKEKYQSYLEENFNGSEKSVFGMLHYVQSIDPDYLDKLQRKYGIYAVRFFMEKKSNDNR

SEQ ID NO: 4813 - protein, 319 aa, unidentified
  source 1..319: note = Related to NZ_CP074570.1; note = Paraneptunicella aestuarii
MTKRTFEQAFNAIFHDSKAFVDFCGLDVASEVETFTVSGREIFKTSDKFKKYLRFIDRVILRHLAKDKNVVHSFTKDKNTFTAVRAHTDSNYFFLTDIRNFYSNIKITDVLRILERDKERIPISDIDSYINLLASLMTFNGSVPVGFSTSPQLSNGFLFEFDCAVREFCESNVLTYTRYADDIIISGKSFEELSDLKEIIQTFLNKYASSTLLLNEEKTRITHLGNKVKILGLSILPNRKVTIDTKYKKKLELLLHFYVTDESKYKSFLEEEFKGSEKSLFGMLHYVQSIDPDYLEKLQRKYGVFALRTLMEERWNESR

SEQ ID NO: 4814 - protein, 326 aa, unidentified
  source 1..326: note = Related to NMRX01000072.1; note = Methylococcaceae bacterium CS5
MTGKRRWQVGKRNFEQAFNAVFHDKQAFNDFCSLDVRSEIETFVINSRTIYRTSKKFKKYLRFIDKVILRHLDKNEQVVHSYLKEKSVLTAVKAHSSSKCFFLTDIKDFFTSVKTQNVLHLLTRDKLRIPITDFERYIETIVNLTTFAGSIPVGFPTSPSLSNSFLLEFDAVLEKYCCEHGFIYTRYSDDIIISGKSFEGFDNLENDVQSMLYKSASEDFFLNTKKTRLTQIGNKVKILGLVITLGGSVTIDSKYKKTLESLLHFYINDKEKYKDLLERTLHGKEHSLFGLVHYVKSIDQAYLEKLQRKYGAYALSALMEDRWSDK

SEQ ID NO: 4815 - protein, 323 aa, unidentified
  source 1..323: note = Related to QNFQ01000482.1; note = Gammaproteobacteria bacterium
MRWQVSKRTFEQAFNAVFHDKVAFEDFCTINVQEEVEEFFYDDRKIFRTSKKLKKYLRFIDRVILRHLANDDEVVHSFIKGKSTLTAVKAHTSSKYFFITDIKDFFSNVKTIDVLRILERDKYLVPIDDFENYIDTIVSMTTLGGSIPIGFPTSPQLSNAFLFEFDRKTKFFCADNSLIYTRYADDIIISGQEFNDVAGLKSQIQLLLSEHVSPNLSLNQDKTHITQIGNKVKLLGLVIMPNGRVTIDVKYKNRLETLLHFYVNDKDKFNDLLKKTMKGNVKSLFGLLHYAKSIDPEYLEKLQRKYGVYTIRLLMEDKLSDNR

SEQ ID NO: 4816 - protein, 317 aa, unidentified
  source 1..317: note = Related to NZ_JOKH01000004.1; note = Endozoicomonas numazuensis
MSKRTLEQAFNAVFHEKESFNDFCAMNHSQEVLSFSANSRDLFHPSPKLKKYLRFIDKVILRYLERDDVVVHSYIKGKSALTAVEAHAGSSHFFMTDIKAFFSNITDVDVREILTRNEGNVPISDIKEHISLLVEMMTWQGSLPVGFPTSPQLSNAFLLRFDQKLHRYCEGRGYTYTRYSDDIVISAKSFDGFEHLSETIQLLLNTAVSPLLRLSDDKTRYTHTGNKVKILGLVVTQGGKVTIDSKYKRQLETLLHFYVTDRERFGRVVDETLAGKEHSLFGLLHYARSIDPSYLEKLQRKYGAYALRSLMEDKWHG

SEQ ID NO: 4817 - protein, 338 aa, unidentified
  source 1..338: note = Related to LT841305.1; note = Acidithiobacillus ferrivorans
MWFVILTRQDYFYFSGNLKVDNRTLQQAFNAVFHNKESFSEFCSLEQRKHIVEFLYRGRKVYKTSAQYKHYLRFLEKVVLRHLATNANVVHSYIKGKSALTAVTTHSENSAFFLTDIKSFFPNITELNVKHVLNRDKNLVPISDFEHFIPYLAKIMTWDDSIPAGFPTSPQLSNGFLFDFDNALYDFCKTNELTYTRYSDDIIISGKYKDKLLCLKDTVQDLLHNYASKNFFINNEKTRITHAGNKVKILGLIITPKGRVTIDSKYKRTIESLLHFYTNDRSRYNDLLQNEFDGKEHSLFGLLHYAKATDPAYLEKLQRKYGLLALRQLMEDRWNGSR

SEQ ID NO: 4818 - protein, 335 aa, unidentified
  source 1..335: note = Alteromonadaceae bacterium; note = Related to NVXL01000289.1
MSINSLKSEGDEVSVTDRSLEQAFNAVFHDRESFNDFCTLPLAPEVSEIPLHLRKVYRPSDKLKTYLRFIDKVVLRHLKYNASVVHSYIKGSSALTAVQAHAKNQAFFLSDIKSFFPNIGDQDVRKVLMRDSHRIPILDFDQHIERVTKLMTLDGVLPVGFPTSPKLSNGFLHEFDNALAAYCDSTGLTYTRYSDDIIISGMDRAKLTVLREKVQMMLEEHASKSLRLNDEKTRVTHRGNKVKILGLVITPDGQVTIDVSRKHALEGLLHFYATDTEKYKNLLEKTFKGEDKERSLFGMLHYANSCDSEYLVKLQKKYGVLILRTLMEDRWSGNR

SEQ ID NO: 4819 - protein, 320 aa, unidentified
  source 1..320: note = Related to NZ_CP019628.1; note = Pseudoalteromonas aliena
MHLKSLEKAFNTMFHNPQLFEEFLCSDLSNEVEEFYIGKEKPRKVIRVSDKFKTFLRFIDKVILQHLKINEGVVHSYIKEKSAMSAVQSHVNGKYFLVSDIVSFFSNVSSEDVKKILVANVSNIPIEDIEDYIPRIVTLVCWNDCLPVGFVTSPKLSNAALFQFDSAMADYCKKQSLTYTRYSDDLIVSSQAREPLIELQTQLQSLISQNTNGQLEVNLDKTKIYTIGQPFTILGLVITQYQTLTISRKHKNHLEVALHYFVTDKLRFKDYLEEHFAGKEQSLFGLLHYAKSVEPRYINKLQRKYGAYAITDLLENKWND

SEQ ID NO: 4820 - protein, 321 aa, unidentified
  source 1..321: note = Related to JAFLKV010000025.1; note = Sulfuricurvum sp.
MTQTSLQNAFVSYFHTRYQFDDFLSILTNEHYTEIFYSKNTFSPSKKLKDFQKFLNLFLFELLPLNQDVVFSYRKGVNAQDAISPHKNSKYVLNTDIKSFFANINTSKLKKLILDNKNNFLILPSDIEKHIDTIMNIVTYNSILPVGAPTSPAISNGYLFDLDSALQSYCLRNEIIYTRYSDDFIFSSETKESLTKVLPIINDMFIHLGFETFTLNESKTRIQQRGSKIALLGLIITPQGYVTVDKNLKKEVEILLHFYLTDKEKFRDYFLKKFSSNIDKVSGLLSHINAVDSYYIAKLKKRYGSFIVNSFTHRDIHNVTF

SEQ ID NO: 4821 - protein, 319 aa, unidentified
  source 1..319: note = Related to JAJPEU010000001.1; note = Sulfurovum sp.
MNKTSLETAFNSYFHNKHSFQDFLNININNEYTQIFYSKNTFSPSKKLKQFQQFLNLFIFDHLNINKDVVFSYRKGVSTIDAIKPHKNKKFIYTTDIQSFFTHIETEKIKHIILENKNNYIIIEEDIEKYIDNILSLVTYKNVLPIGAPTSPKISNAYLLRLDNLVQEYCEKNEIIFTRYSDDFIFSSDSKEKLINLDDTLEDFLKQSEYLNLTINRKKTKLQRQGSNITLLGLTITPQGHITVNKKIKNDLEILLHFYLTDKSKFNDVFESNYSSKIEKVSGIISHINSIDKTYISKLRKKYGSYIVNSFIHRDISYE

SEQ ID NO: 4822 - protein, 319 aa, unidentified
  source 1..319: note = Related to FXLF01000023.1; note = Candidatus Thioglobus sp.
MINKKPFQEIFNLYFHGKYSFEDFINTDIKRCVTPHQFNQKTMLSVNKKLAEFHKFINVFIINKLAYNSFVCFSYIENTTIRNCLEPHKNNKYFLSTDISNFFGSIQSVDVMNTIQSNINEGSLNISDIEKYKDSIIKLITFNDSLPIGFSTSGRLSNSILFKFDQVVLDSCNAQNITYSRYADDLIFSSNDKNIKQTQLMVENALAALFNKRLKINIDKTKIYSKRAKIKILGMTITPNGSITIDKKIKSDIELAMHFYAKNTEKFCSIIENKFDGNIQKAFGTVAYINSVDKAYLNKLRKKYGNYTVESFLRKSAKQ

SEQ ID NO: 4823 - protein, 317 aa, unidentified
  source 1..317: note = Related to JACCHT010000001.1; note = Candidatus Thiodubiliella endoseptemdiera
MQKKSFQETFNLYFHGKYSFEDFINTPIKDNITQHQFDQRTVLSANKKLTEFHKFINVFIVNKLTYDDSICFSYAKNTTIRHCIEPHKNNKHFLSTDISNFFASIQSVDVINTIQHNIDEGNIGIADIDQYKDSIIKLITFEGALPIGFSTSGRLSNAILFEFDKVILTECQSKNITYSRYADDLIFSSNNKNIVQVKPIVETALSNIFDERLKINDKKTKTYSKKSKIKILGLIITPNGDITIDKKIKSDIQIAMHFYANDTNKFDSFLRKRFDGNIQKIFGIVGYINSVNKDFLNKLRKKYGNYIVDSFLRKSAK

SEQ ID NO: 4824 - protein, 320 aa, unidentified
  source 1..320: note = Related to VCHC01000138.1; note = Gammaproteobacteria bacterium
MTKTKIRPFQEIFNLYFHGKYCFEDFIATDVKKHTKKHDINNKIILSADKKLKEFHQFINVFIVNQLEFNDSVCFSYAKNTTTHTCLEPHKNNTYFLSMDIVNFFGSICNTDITRVIEHNIKQKKINISDIEKYTASIVKLITFEGVLPIGFTTSGRISNAILFEFDKKILDYCSPKNITYSRYADDLIFSGNDTNIGQVKSTVKNILTDLFDTRLNINNDKTKTYFKNTRIKILGMVITPNGKITIDKKIKSDIEIAMYFYVSDSVKFEAILEKKFNGNMHKIFGIIAYINSVDKDYLNKLRKKYGNYTVESFLRKSAK

SEQ ID NO: 4825 - protein, 552 aa, unidentified
  source 1..552: note = Bdellovibrionales bacterium; note = Related to JACOND010000012.1
MKKKLYNVVGHLPKIWFVCGAKFEGKNSIRKLFIKYIQKNHQEICTARNRNSNSLSFSPKKIILAEDVLEQSKTKDTKILDYEEHISEFSTNVIFFLESPSVFMEIGRFTKTITDPLKFLFCVDQKHKKKKNLINKLLSDPKYTVLHYTTNNDIIINSDDFFKKVLNCLNKTTPTISYYEDNIHSFYSFLISFLQKEASLEQIIRKVELERKKTGFFSNFLNKIKFHLKLLIKSGLILKQDCFYFSVIRGDILKGVKFQALTERQKELLFDVEMNYSYEHIKDLVYEPNSTLKNYQAFIKTRVFDPLEEEHKVIHKRCFSYKKKHSISNLVELHIGNNYLLNMDLKNFFNSIKREDFIKCMVTLGLFEERFRTKITDICFKTKSNEINGLPIGARTSPFISNLVMREFDNLVYNLCEKKEVVYTRYSDDLSFSCKKKGVLQDIEKEIYKVIKKLPYPQNLKINEKKTKHMSKKGRRKICGLYITPESHISIGRKNKNKVKNILKNFNKTEKIYHNKEMIKIIQESFLDSEEKGYLYYVNSVEKEFLKSQIYL

SEQ ID NO: 4826 - protein, 306 aa, unidentified
  source 1..306: note = Related to NZ_AP024849.1; note = Clostridium sp.
MKEKDFKVFYIPKKNGYRKIITYNDENRKLREFHQRVGDILYKRILPSKFAKAYIKKRSIIKNAKTHMYNDSFLLFDIKDFFQSINHNWLIEKLYYEINLNHKKKISKITCAKIVDSCSVSNRGLAVGLIPSPFLANIYLKDFDNILYGNLKKLGIKRIIYTRYADDLVISYNGIEPKNIDDIKKIVCENLKKFGLKLNDKKTRIIDFKQSNHVKITGINITKTEDDGRKLSVGRKRKDDLYVLAVELAKRKPDERKNNEILTLKGLQSFILSVEGVKYEECYSKNMISVINGLGYNALKDLIDSL

SEQ ID NO: 4827 - protein, 310 aa, unidentified
  source 1..310: note = Related to JAHHUY010000039.1; note = Clostridium tyrobutyricum
MRKIKGKIFFIPKKHGYRKIITYNQSDSDIELRKFHVKIASLLYKRVLPSKFAKAYIKNRSIIKNAKTHMYNDIFIMFDIKDFFQSINHNRLIKKLYYEINLNNRKKLSMVSCSDIIKSCSISNRGLAVGLIPSPFLANIYLKDFDNILYGNLKKLNLKNIMYTRYADDLTISYKSDTPLKIEKIEKIVCENLKKFGLKLNCRKTRSINLNKSNHVKVTGINIIKMFDNYRQLSVGRKRKDDLYNLAIKISKKNFKEHKENEINKIKVKGLQSFILSVEGEKYEQCYSENMMSVIHDLGYKSLKQLIDNI

SEQ ID NO: 4828 - protein, 307 aa, unidentified
  source 1..307: note = Related to SWQT01000003.1; note = Clostridium botulinum
MIKEADLKEFYIPKKNGYRKIVTYKDGDNKRREFHQRVARLLYKRILPSKFAKAYIKKRSIIINAKCHMYNDIFLTFDVKDFFQSINHNWMIEKLFYEINLNHKKKVNKVICSQIVKSCSVSRKGLAIGLIPSPVLANIYLKNFDNILYGNLRAMGMNHVIYTRYADDLVISYRGTDIKNIDKIKKIVCENLKKFGLKINDNKCRVIDLNKSNHVKITGINITKEIDNNRKLSVGRKRKDDLYRLAIELAQKSPEERSEYEIGKIRGLQSFVLSVEGKEYEKCYSKNMMTIVNKLGYSTLKDLIDSM

SEQ ID NO: 4829 - protein, 305 aa, unidentified
  source 1..305: note = Related to UFXA01000002.1; note = Clostridium perfringens
MDNNFKVFYIPKKKGFRKIVTYGKSNIKLRETHKNINILLYRRVLVSKFAKAYTKNRSIIKNAKTHMYNDIFIMFDIKDFFQSINHNWLIDKLYYEINLNHKKKVSKKNCEKIVKSCSISNKGLAVGFIPSPFLANIYMKDFDNILYGNLKQLELKNILYTRYADDIVISYKSNKTEKFLEIKSLIDKNLSKFGLKINNEKTTIINLNKSNHVRITGINVIKDTFNNRSISVGRKRKDDFYNLALKIAKEKKEEVNIYERKKIIGLYHFIVSVEGKGFEKCYSEKMNHAINNLGYKNFEELIKNI

SEQ ID NO: 4830 - protein, 310 aa, unidentified
  source 1..310: note = Related to CP014223.1; note = Anaerotignum propionicum
MNNDLSTFYIPKAKGYRKITTYKDRNGDLIKYHDKVNISLQKRLKQSIFAKAYIKKRSIVTNAKTHMYNDIFISMDIKDFFQSITHDRLINTLYYEINKNSVGHFTLEQCRDLVKSCSTGQRGIAIGLKPSPILANIYLKDFDGVLYGWLKKLDLDNVIYTRYADDMMVSYRSNSKDTVPINKEIISKVSELLKLSYLRLNASKTRIINLNISNHVRITGINIIKNDDNFRMLTVGRKQKDDLYYRSIGLFIKETKDDKWYLEAKKIQGMQSFILSVEGERYLNTYSKKMNIVINDLGFKNLKDLIDNLI

SEQ ID NO: 4831 - protein, 306 aa, unidentified
  source 1..306: note = Related to JAASHB010000001.1; note = Paeniclostridium sordellii
MYKEKFNIKYIPKNKGYRKIVTYKNSDCDLKKFHIKISRTIYNNTLPSKFAKAYIRKRSIITNAKAHKYNDIYIFFDIKDFFQNINHNKLIEKLYFEINIKRKKKISKLDCYRIVKSCSLSNKGLGVGLIPSPILSNIYLKELDNILYGRLKKFGLPNVIYTRYADDMVISFKKCDKYNLDEIELLVKNLLTRYGLKMNNNKTKVINLEKSNHVRITGINISKDSQNKRYLTVGRKRKNQLYHDVIKLLNIKKEDRDKKEINRVKGMQSFILSVEGISYEDSYSLGMIKIIEEFGFTNLKEAINSL

SEQ ID NO: 4832 - protein, 306 aa, unidentified
  source 1..306: note = Related to AAXVUS010000010.1; note = Clostridioides difficile
MKNNNFKIMYIPKSKGYRKIITYKDNDVEIRRYHIDISKFIYNNTLPSKFSKAYIKKRSIITNAKAHMYNDVFLYFDIKDFFQNINHNKLIDLLYHEINKGSKIKTSKIDCNNIVKSCAVSGKGLGVGLIPSPLLSNMYLKEFDNILYGKLKKMDLPNVIYTRYADDMVISFKYIESYDMSEVKNLIGILLRRYGLKLNDKKVKIINLNKSNHVRITGINLCKDENNNRRLTVGRKRKNELYYKAIETISKPAKDREDIQIKKIKGLQSFVLSIEGEMYENTYSQNMISIINNYGFKNLKSLIDNL

SEQ ID NO: 4833 - protein, 306 aa, unidentified
  source 1..306: note = Related to NZ_FMMP01000006.1; note = Cellulosilyticum sp.
MKDELLIKYIPKKKGYRKIVSYNVANQKLRQEHKHINKFICDETIPSKFAKAYIKNRSIILNAKMHMYNDIFIYMDIKKFFASINHTMMVNLLFKEINKRKPKIIITKDTCYKIVKSCAISSKGLAEGVIPSPTLSNIYLKEFDNILYGYLNKMHLENIRYTRYADDMIISFKDTENYNVVDIVNAVTTLLKRYKLELNKEKTKIISLNRSNHVRLTGIIISKDSDNNRSLTVGRKRKNELYNKAISLAKKNKDIRLQGEINKVKGMQSFILSVEGIKYEEIYSDKMISIVRELGYEKLKQLIDNL

SEQ ID NO: 4834 - protein, 304 aa, unidentified
  source 1..304: note = Related to NZ_JACOOV010000022.1; note = Blautia sp.
MIKEDLVVKYIPKHNGYRKIVTYKENSELKKFHTKAKNVLDKKIIPSKFAKAYIKKRSIISNANVHRYNDIFIALDIKDFFANIKHKKLIDLLQFELARNGRRVYKKDCIKIVKSCSNTDRGLLVGLKLSPILANIYLKEFDNILYGKLKKMNLPDVKYTRYADDLVISFKNCEANLHDIISLIQKLLKRYGLRINEKKTRIINFNVSNHVRITGINIVKDEKNFRTLSVGRQRKNELYYLAKEILDGQLNDPVKIRKVKGLQSFILSVEGVNYQKTYSYAMINEFTRRGYIDLKDFIDKLDYK

SEQ ID NO: 4835 - protein, 326 aa, unidentified
  source 1..326: note = Related to CP042243.1; note = Crassaminicella thermophila
MYRKEQIKRILFSRKVNAMDEKLFQIKYIPKKNAFRKIVTYREDNNIRVMHEKITSFIVKNTLPSKFSKAYIKNRSIVTNAKAHMYNDIFLMMDIQRFFSNINHNKLINVLYYELNKKENIISKVDCTKIVDYCSVGNKGLPIGFVTSPVLSNLYLKEFDNILYGKLKKYNLENVIYTRYADDLTISFKKNSSYANDIIVNIQNTIANLLKRYSLKINERKTKIIDLNKSNHVRITGINIIKDDNNFRRLSVGKKRKNELYWSAINYFLTDKDNRNDAELDKIKGMQSFILSVEKTGYENSFSKAMKSKINELGYNSLKELIDKLE

SEQ ID NO: 4836 - protein, 312 aa, unidentified
  source 1..312: note = Related to NZ_QUEQ01000010.1; note = Ruminococcus sp.
MNEQLTVKYIKTKNKVRKIVTYTENGELRKYHENVVKYLEKYATNSIFAKAYVPKSSIFKNAEAHMYNDIFIKMDVKNFFPNINHKYMAECLFFELNKNTQISRKECYSIVKKCSVGEKGLPLGLVSSPALANLYMKEFDGLLYGSLKTMDLNNPIYTRYADDLVISFKSGTNDIDKIDAIKQEVRRLLKKVHLNLNEKKTKSYILNKTNHVRITGVSITKDEKNYRHISVGRKLKNQIFWNAINMHDQEIKDYVQIEHLKGIFSFALSIEKKDFEACYSKNMKQLIKERGYDSLRDLIKDLGNDNKSMITN

SEQ ID NO: 4837 - protein, 317 aa, unidentified
  source 1..317: note = Related to FMEB01000016.1; note = Roseburia sp.
MKEQLVVKYIKTKNKVRKIVTYTENGELRRYHEEVVKYLEKYTTNSIFAKAYVPRSSIYKNAKAHMYNDIFVKMDIKNFFPNINHKYLAECLFFELNKNTQISRKECYDIVRKCSVGEKGLPLGLVSSPALANLYMKEFDGLLYGKLKKMELNNPIYTRYADDIVISFKTGKDDFEKIDNIKAEVQSLLKKVHLTLNEKKTKSYTLNKSNHVRITGISITKDENNYRHISVGKKLKNQIFWDAINMYDQKVKDYTKIEHLKGIFSFALSIEKKDIENFYSENMKHLIKIRGYDSLKELIKDLGSDVDKNDNKAVITN

SEQ ID NO: 4838 - protein, 318 aa, unidentified
  source 1..318: note = Related to JAGZZD010000009.1; note = Roseburia sp.
MDEELVVKYIKTKNKVRKIVTYKERGELRKYHEKVVEYLDKHVIVSKFAKAYAPKTSIYKNAYAHMYNDIFLKMDIKDFFPSINHNYLAECLYHEINKNTSISRRECYDIVKKCSVGKKGLPLGFVTSPALANLYLKEFDGLLYGKLKKMDIKRPIYTRYADDMVISFQSQEDYLEKIELIRSEIDNLLKRVHLSINHKKTKIINLEKTNHVRITGVSITKDKNNYRHLSVGRKLKNHIFWSAINQYDKEEKDYNEIAHIKGLYSFVLSIEKNGVENGYSDKMKSLLVERGYETLKQLLSSLGNDELNKNEIDDLGSH

SEQ ID NO: 4839 - protein, 303 aa, unidentified
  source 1..303: note = Related to JAFQBJ010000029.1; note = Agathobacter sp.
MDEQLVVKYIRTKKKVRKIVTYREHNDLRKYHEAVAKYLQKNTFNSIFAKAYVPKSSIFSNAKAHMYNDIFIKMDIRDFFPNINHEYMAKSLYHEINKIAQISNKECHDIVRKCSIGEKGLPLGLVSSPGLANLYLKEFDGLFYGQLKKMCLKNVIYTRYADDLVVSFKYCDDYEKYAEKIVAQAEHLLQRFCLKLNMEKLQIVNLKKSNHVRITGVSITRNSQNYRHISVGKKLKNEIFWKAIELYDNPEGHNMIEREQLKGLFSFVLSIEKRGVEESFSEGMINLLKIRGFNSLKELINTL

SEQ ID NO: 4840 - protein, 307 aa, unidentified
  source 1..307: note = Related to NZ_MJHW01000008.1; note = Roseburia sp.
MNKELFLEEKYIKTKKKYRKIVTYVDGENLLREKHERIVSLLKQECSDSIFAKAYIEHSSIVKNAKAHMYNDIFLFFDVKDFFPSINHNYLIQRLYKELNNNGNASINSCSKLVELCSVNDKGLPLGLVTSPILSNIYMKEFDNIIYGKLKKLSLDNIIYTRYADDIVISFKAEKIDPDINVNIKECVIRCLKQVHLKSNENKERVYDIRKGGHVRITGINVIVENDNYRKLTVGRKRKDRLYNDVMSYYMRRIKDREKALSIKGNESFILSVEGKEYEKCYSENMKKVIKEYGYDSLHDMIKAIKY

SEQ ID NO: 4841 - protein, 309 aa, unidentified
  source 1..309: note = Related to NZ_JADMQW010000015.1; note = Intestinimonas butyriciproducens
MNVQHPDIKIRYIRTKNKTRKLVTYSSDDCELRVRHKRINDFIEARFIPSIFSKGYVKNRSIYHNALAHLYNDYFIMLDIKDFFPHICHKQLADKLFYEMNLLSREQISMKECKNVIELCSVSSRGLPLGFITSPLLSNVYMKEFDGIFFGQLKKLGLENPIYTRYVDDITVSFKYSNRIPPIEVENQVVDLAQSLLSKYGLQLNNRKKRSYNLNISNHVRITGINITKQPDNKRLLTVGRATKNELYWGAIDCLKSRDPEKIAHIKGMQSFILSIEKNGYEKCYSKAMIQQIRNLGFFSLKELIDSLD

SEQ ID NO: 4842 - protein, 310 aa, unidentified
  source 1..310: note = Clostridiales bacterium; note = Related to RKGG01000020.1
MNVQNPDIKIRYIKTKNKTRRITTYVSDDCNLRLSHTRINVFLKENFIPSVFTKAYVSGCSIYHNALSHLYNDCFVMMDIKDFFPSISHRQLEKKLYFEINAKAPNQISMLECRELINLCSVGNVGLPLGFITSPVLSNIYLKEFDGIFYGKLKSLSLKNIIYTRYADDIVVSFKPEDVKNIDDAKSSIINIAKQILSRYNLHLNERKTRFYSLEISNHVRITGVNITKNDDGKRLVTVGRSLKNKLYWDTINYMESDNKDAETVNHIKGLQSFVLSIEKNGYEKCYSKQMIENVRKHGFRTLKDLIDSL

SEQ ID NO: 4843 - protein, 308 aa, unidentified
  source 1..308: note = Related to DNFS01000014.1; note = Ruminococcus sp.
MNINNPDIVVRHIKTKNKTRKIITYRSEDCELKTKHRRINTFLQERFIPSIFTKGYVKGRSIYDNALPHMYNDYFILLDIKDFFPHICHKQLAAKIFHEINLVKENQINKKECNYIVDCCSIGSRGLPLGFITSPILSNMYLKEFDCILYGYLKKMELNNVIYTRYADDIIISFKTDSFVEFKEIENDIVDTSKLLLSKYGLQINNRKTRAYNLDVSNHVRITGINITKSEDGYRHLTVGRKLKNELFWNAIECFETKNQENIQTIKGLQSFVLSIEKQGYESCFSEGMLKKVNDLGFESLKELIDSL

SEQ ID NO: 4844 - protein, 308 aa, unidentified
  source 1..308: note = Oscillospiraceae bacterium; note = Related to JAGAMN010000013.1
MNSTNPDVRISYIKTKNKLRKIVSYRSNDCELRTYHQQINDFLEQRFIPSIFSKGYVKGRSIYDNAQAHMYNDYFIMLDIKDFFHNICHKQLSSTLFYEINLAQANQISQKECNDIVSACSVSKRGIPLGFITSPLLSNIYLKEFDGIFYGKLKQMALSNIIYTRYADDLTISFKTDCTAKLPDVESLIASTADSILKRYGLHLNGHKTRSYSLYVSNHVRITGINVIKDQSGYRSLTIGRSVKKQLYWDALRCLESKDGELIRHVKGIQSFILSVEKQGYEDCYSSAMKRRLSDLGYKSLKDLIDAL

SEQ ID NO: 4845 - protein, 309 aa, unidentified
  source 1..309: note = Ruminococcaceae bacterium FB2012; note = Related to FMXS01000006.1
MNEQHPDITTYYIRTKNKTRKIVSYISDDCELRNTHLKINNFLERRFIPSIFSKGYIKNRSIYHNAQSHMYNDYFILMDIKDFFHSICHKQLAQKIFYEINLTKSNQINLLECYKLISLCSIDSRGLPLGFITSPILSNIYLKDFDNIFYGKLKELNLDNIIYTRYADDLTVSYKTKSTVKDVNMEAKIAETASNILKRYGLKLNNRKTRSINLNVSNHVRITGVNITKNNYNFRHLTVGRSIKNQLYWDALKCIDSDNDLLKNKVKGMLSFVLSIEKAGFETCYSDLMMAKVYSLGFSSLAELIMSIK

SEQ ID NO: 4846 - protein, 308 aa, unidentified
  source 1..308: note = Clostridia bacterium; note = Related to JAFZJT010000006.1
MTELHPDIIIRYIRTKNKTRKLATYRSVDCDLRKKHEQIEQFLTAWFVPSIFAKGYVKNRSIFHNAQSHMYNDHFVMLDIKDFFPHICHKQLSEKLYYELNRSGKNVVAKSECNDIVDICSIGSRGLPLGFVTSPTLSNLYLKEFDGIFYGKLKKLGLNNVIYTRYADDLTISFKTVTAPELSKIEESIVQIAQQLLKRYGLQLNMHKTRSYDLRVSNHVRITGVNVIVSEGNRRRLSAGRSLKNKLFWDAIECAETRDPVKTAHVKGMQSFILSVEKEGYETCFSKAMIQKVESLGFSSLKELIDSL

SEQ ID NO: 4847 - protein, 324 aa, unidentified
  source 1..324: note = Related to QPZU01000011.1; note = Clostridium botulinum
MKKSEDVIIKHIKTKNKIRKIATYVSEGCKLRKEHENILKYLNKNFINSKFAKAYVKNRSIYSNAKVHLYNDCFIMLDVKDFFNSINHKNLIEKLYYEINKPNKKIYYQIDESNRKLISKIECANIISKCSLYNKGIPLGFITSPILSNIYMKDFDGILYGQLKKFKDYNIIYSRYADDMTISFKDNQDKKEIENEIINITEDLLKRYGLKLNNKKTRSYDLTISNHVKITGINIVKEEDNYRRMTVGKKVKNKLFWDALKCYRDGNHDYKCIEGLKGMQSFILSIEKKGYEECYSENMKNIINELGFSSLKELIDSLFYIEKN

SEQ ID NO: 4848 - protein, 316 aa, Bacillus sp.
  source 1..316: note = Related to LJIT01000071.1; note = Bacillus cereus
MSEQNVFYQVKYIKTKNKLRKIVTYKDELPDIKLKHEEIAAFINKNFIPSIFSKAYVKNRSIYHNAITHMYNDVFIALDIKNYFNSIDHKLLLSALYYELNKRNKSTISKLECGKIISICSIFKKGLPLGLVTSPILTNVYMKEFDNILYGKLKKMKLKDVMYTRYADDLVISFKRDVYLDSNQIRKNTDVIVHQVSSLLSRFKLKLNPAKTKITSFEKSNHVKITGVNIIRDSSNHRKLSIGRKIKNNLFHDAIKCFEEKNKNKSDVMKIKGLESFVLSIEKRGYEEIYSRNMKKKIKDLGFDSLHDLINSLYYE

SEQ ID NO: 4849 - protein, 311 aa, Bacillus sp.
  source 1..311: note = Related to NVJL01000019.1; note = Bacillus toyonensis
MDVQTNYYQIKYIKTKKKTRKIVTYTENYPEIRVQHEKIADFINKQFIPSLFSKAYIKKTSIYHNVLPHMYNDIFILLDIKDFFNSINHKILIDLMYYELNKKKKNTINKLECAKIISRCSITKKGLPLGFITSPTLSNIYMKQFDNILYGKLKKLELTNVIYTRYADDLVISFKRDVLSSSNICVEKIINQVKSLLLRYKLQLNTSKTKVINFEETNHVKITGVNIIRDSSTNRKLSIGRKIKNDLFHKAIKCYENENTNKYDILRVKGLESFILSIEKKGYEETYSKNMRAKVKSLGFNSLHELINNLL

SEQ ID NO: 4850 - protein, 315 aa, unidentified
  source 1..315: note = Related to NZ_JAIVKS010000001.1; note = Priestia aryabhattai
MNEQNTSFRIKYIKTKKKLRKIVTYKSDNPELRIRHEKIAAFLNSNFTPSKFTKAYVKNKSIYHNARTHMYNDIFISLDIKDFFGNINHKLLINLLYYELNKKDKDTINKLECGKVVSHCSVSEKGIPLGFITSPILSNIYLKEFDNILYGKLKKLNLKNVMYTRYADDLVISFKNSFNGDSKLKSDNDENIISIVQKLLSRFNLKLNPSKTRRVSFEKSNHVKITGVNIIRDVYNQRRLSVGRKLKNDLFHMAIKCHEQEIKDMYEVMKIKGLESFIISIEKKGYEEIFSINMKDKIGELGFESLHDLIKNMRY

SEQ ID NO: 4851 - protein, 313 aa, unidentified
  source 1..313: note = Related to NZ_VEEP01000002.1; note = Cytobacillus oceanisediminis
MDYQETKKGYIVKYIKTKNKIRKIVTYGDNAQEIKKIHTEIAEFINENFMPSKFSKAYIRHKSIYQNALAHMYNDIFISLDIKDFFRNINHQKLINALFLELNKHSNNTINKLECSKIVSNCTVSKKGLPLGLITSPTLSNVYLKEFDNILYGKLKRMKVENIIYTRYADDLVISFKDIESKTKIIDDIIMLVKKLLSKYNLRLNSSKTRIISLDKSNHVKITGINIIKSPSNYRKLTVGRELKNDLFHTAVKYYEDGNTNKYELLKIKGLESFILSIEKNGYEEVYSKNMKLKIKDLGFKSLNELIKGLTSK

SEQ ID NO: 4852 - protein, 316 aa, Bacillus sp.
  source 1..316: note = Related to LR134328.1
MEKDDWYVEKFIKRKNKLRKIVTYNNSDIRNRHTIINNFLNGNLLFSKFSKAYIKGKSIYDNAYAHLYNDYFISLDIEKYFNNIDHNILIETLYYELNKTSEKKMVMNKIECTKLVNLCSTSKKGLPLGLITSPTLSNIYLKEFDNILYGKLKRLGLESIIYTRYADDITISFKYSEEDLNIVQNNIYDIVSSLLKRYKLKLNYSKSRFIDLGKSNHVRITGISIVKDENNYRKLSVGRKSKKELFYRAIDCYRTFLEDPSNVDYLEVLKIKGMESFFLSIEKRGYENFYSKGMQKELKELGFDNLNDLIRSLPHE

SEQ ID NO: 4853 - protein, 316 aa, Bacillus sp.
  source 1..316: note = Related to NUQK01000037.1; note = Bacillus wiedmannii
MKMQNEWYKEKYIKRKNKVRKIITYNDESVREKHSQINRILNEKLMFSKFSKAYIKGTSIFYNAKSHMYNDIFICIDIKKFFNNIDHKILLQTLYYELNKTEENVIKYGRVELKKLIEVCSISSKGLPLGLITSPALANIYLKEFDNILYGKLKKLQLNNVIYTRYADDLTISFKYIEDYLSIKDVIINEVSKLLKRYRLEMNDKKERIINLNKSNHVRITGVSIVKNVDNYRQISVGRKVKKELFYKAINAYLTFQENPSRMDFLEMKRIKGMESFILSIEKNGYESCYSVGMMRQLEELNFNNLHDLINSLPIK

SEQ ID NO: 4854 - protein, 318 aa, Bacillus sp.
  source 1..318: note = Related to NUNG01000033.1; note = Bacillus thuringiensis
MNTDYKVRYINTNGKKRKIVTYANEAKRKEHIEIKKFLEKKLIFSKFTKAYISKSSIYKNARAHMYNDIFVKYDIEKFFNNINHKILVEILHEQLNLNSEKNENSMLEVAELVSSCIVDKKGLPLGIITSPILANIYLKKFDNILYGKLKKLGLDNIIYTRYADDLTISFKNPDEWEIERFNDELTYIEEVITKQLKKFRLKLNLKKKSIINLKVSNHVRVTGISITKITDDKRRLSVGKKKINKLYDDALELYIKTQNKEYVLTDEDFYHISRIKGMESFILSVHKTGYNHFFSGMMQKKLEELGFSSLGELIKNLN

SEQ ID NO: 4855 - protein, 318 aa, Bacillus sp.
  source 1..318: note = Related to NZ_CP085511.1; note = Bacillus cereus
MNIDYKVRYIDTNGKKRKIVTYANEEKRKEHIEIKEFLERELIFSKFTKAYISKSSIYKNARAHMYNDIFIKYDIEKFFNNINHKILVEILHEQLNLKNEQDENSILEVAELVSSCIVGKKGLPLGLITSPILANIYLKKFDNILYGKLKKLGLENIIYTRYADDLTISFKNPNEWGVASFNEELTYIEEVITKQLKKYRLKLNLKKKSIINLKVSNHVRVTGISITKVTDDKRRLSVGKKRINKLYDDALQLYIKQQNKDYVLTDEDFYHINRIKGMESFILSVHKTGYNHFFSGMMQRKLEEFGFDSLGELIKDLN

SEQ ID NO: 4856 - protein, 322 aa, unidentified
  source 1..322: note = Related to QXJM01000039.1; note = Cohnella faecalis
MEKKINMADYMVRYIVTKGKRRRIVTYGNEEKRQEHNEIKLFLEEKLIFSKFTKAYIAYSSIYKNAKAHMYNDIFIKYDIEKYFDSINHKILVRILHEQLNLGQEKEIYTIFETSELVGNCIFGKKGLPLGLITSPVLSNIYLKTFDNILYGKLKKMKLENVIYTRYADDLTISFKNSSRKSLEDLDHVFSEIESLINLQLKNYKLKLNANKKSIISLDVSNHVRITGISITKLVTGKRRLSVGKKKVIKLFDDALQLYYKKIVDADELSNEDLYNIQRVKGMESFVLSIHKTGYNHMFSEKMQDKLLNLGFKSLHELIESL

SEQ ID NO: 4857 - protein, 318 aa, Bacillus sp.
  source 1..318: note = Related to NZ_AEHM01000023.1; note = Bacillus subtilis
MNKDYKIKYVEINGKLRKVVTYNNEAKRLEHIEIKRFLERNLIFSKFTKAYIPRSSIYNNARAHMYNDIFIKYDIEKFFNHINHKILVEILYEQLNLKSEKEIYSMLEVSELIGRCILGNKGLPFGLITSPILANIYLKEFDNIFYGKLKKMELNNIIYTRYADDLTISFKNPNNYGLVEFNEKLTVIENVITKLLKKYRLRLNSNKKSIINLKVSNHVRITGISITKISNDKRRLSVGKKKINRLFDDALQLYLKKQRTDYTLTDEDFYNIRRVKGMESFILSVHKTGYSHFFSEMMLEKLKKIGFNSLHDLIKTLD

SEQ ID NO: 4858 - protein, 324 aa, unidentified
  source 1..324: note = Related to JAFHKR010000035.1; note = Fictibacillus nanhaiensis
MNKVDATWYKIKFIRRKGKIRKIITYTDQSVIEKHTRIKEFLEERLIFSKFTKAYVKNSSIFNNAKAHMYNDIFIKLDIKDFFISINHKILLDLLFSQLNVNPDQTKVSKMEISRLISICSIEKKGLPLGLITSPILSNIYLKEFDNILYGKLKKMNFKNIIYTRYADDITISFKSEDTNEFIQGLKVEILNLVEVLLKRYKLKLNRDKISLINLNISNHVRITGVSVTKDSNNYRRISIGRKRINKLYHDALNLFIKIKVRNMSLDNHDFLKIRQIKGMESFIFSIEKNGYDTIYSEKMKLRINELGFESLSQLIKNLPEKNF

SEQ ID NO: 4859 - protein, 320 aa, Bacillus sp.
  source 1..320: note = Related to FMJM01000007.1; note = Bacillus cereus
MNEKKMWYEVKYIRKKGKIRKIITYKDESIRRLHVQIKEYLEERLIFSKFTKAYVSNSSIFYNAKAHMYNDIFLKIDIKDFFNSINHKILLEVLYSQLNLDSKQKETTKIEISKLIDVCSLDKRGIPLGLVTSPILSNIYLKEFDNILYGKLKRLGLENLIYTRYADDLTISFKSISNIPDTLLKVILELVSGLLKRYKLKINPNKVSLVDLNISNHVRITGVSVTKDANNYRKISIGRKRINNLYHDAINMYIKCRTGSLSDADYLRIKQIKGMESFVYSVEKHGYDRVYSLKMHEQIKNMGFDSLSELIKNLPENIRA

SEQ ID NO: 4860 - protein, 319 aa, unidentified
  source 1..319: note = Related to JAJJZD010000002.1; note = Thalassospira sp.
MNSDYKKIVIVKNGKKRFLVTYNNPEVRLKHEAIKRFLEDNIYYSIFTKAYRKKSSIYINAKAHMYNDIFLKYDIKNFFDSIDHKILVQLLHMELNKLNKNSFSLLDVATLVEECIIDKKGLPLGLITSPTLSNIYLKEFDNILYGKLKKMDLSNVIYTRYADDLTISFKGNLTSEELSEFNQQLIIELQKLLKKYKLTLNKNKISIINLNISNHVKVTGINIIKKNDNYRELSVGKKRVAILFDLALNIYSRIMNDDYTLNKDDYYEISKVKGLNSFILSIHKKGYENMLSQEMRNKIFEKGYSSLTDLISNLPNSNN

SEQ ID NO: 4861 - protein, 322 aa, unidentified
  source 1..322: note = Related to NZ_VEEI01000002.1; note = Lysinibacillus fusiformis
MNKSWYKIKYIRKKRKIRRIVTYSDNSTEIKNKHIGIKEFLEKNIYMSKFTKAYKKDSSIFKNAKAHMYNDVFIKLDIKDFFQNIDHKILLEILYFELNKSKSLSTIKYSKKQLLSLIELCSVSKRGLPLGLVTSPILANIYLKEFDNLLYGNLKKFGLNNIIYTRYADDLTISFKKTSQINIVNEKKNIELLVSSLLKKNRLKLNFSKSKMIDFEISNHVRITGLNIVKDTNNFRRITVGRKRINDLFHQSMNLHLKLKEYSLTDSDKLEILRIKGMESFIYSIEKKGYEYVFSNNMKESIYNEGFSNLTELIDALGARLE

SEQ ID NO: 4862 - protein, 308 aa, Streptococcus sp.
  source 1..308: note = Related to FR873482.1; note = Streptococcus salivarius
MVNNSGFAIFKLKKNKKIRKIVAYTSNSELKNIHKLINDHLKERVIYSKFTKGYREGVSIFDNAKAHLYNDIFIQFDIKNFFPSINHHKLINLLYKEVKHNGYNISKSQSYEIVKKASQGLKGLPLGFITSPLLSNIYLKKFDTILYHRLKKQGLDNVIYTRYADDITISFRCIPDKTDYSDIRSTIEKIISNLLKRYSLKLNNKKTRVTNLLKSGNVKVTGVYIVNKRDDYRHLTVGRKFKKELLWDAIQTLDNIERDESLVKQIKGRYSFVLSIEKEGIENMLSPCMRRILNEKNISSINELFSVL

SEQ ID NO: 4863 - protein, 308 aa, Streptococcus sp.
  source 1..308: note = Related to NZ_VMMH01000009.1
MRPNKEFKVFKLTKNKKVRKIVAYTTDSNLRREHVLINNYLRERVRYSKFTKGYRKGISIFDNVKAHMYNDIFIQFDIQRFFPSINHRKLTKLLYQEVKYNNYNLSKSQSYEIVKKSSQGLEGLPLGFVTSPLLSNIYLKRFDNILYGHLKKEELDNVIYTRYADDITISFRGIPDKLDYSDIKSRIEKIIFDLLKEYGLKLNNKKTRLTNLLESGNVKVTGVYIVNKQNSVRRLTVGRRFKKKLLWDAIQSLDNIESDDFLIKQIKGKYSFVLSIEKEGIENMLSPCMRRILKGKNISSIDELFSIL

SEQ ID NO: 4864 - protein, 675 aa, unidentified
  source 1..675: note = Related to QRWY01000002.1; note = Coprobacillus sp.
MKEVYMLFFKNNQEKFKPSFFIAFLCGVKYKSNSPEDKRNVLYDYLKQNRKIKPVILEKSFDIDSFDNINTLNYKDIGLNNLRDIEILTSLYSHLIFVIHESMSTASEIGMFSYDDHTAKKICVIYPDEFSINKNVIGDFFTYAFFSDRNPIINNKFPFYPRTKTVHHASNNVEAYTYFINNQITKDLENKINTYIENNSKRTYDLKLHKKFQRFQSYYLLKNKNKDKIDMNLTAEFFFYHMLALLNTNEVKEIFEENNHDFHKCVTKIGNLFLETLKMTILYNRKNITANKITCHVNNYPFKQALFYLFYVFHDIGVVEIKENKIVKIENKQYDGYISKLHKLLISYKEERTFEKINVGKNAYKQFYIKKKTGLYRKITTYNDNEEGYKLKEYHDRINDFLNENITFSQFTKAYLKDTSIVKNARCHLYNNTFIQIDIKDFFPSINHHKLLNRLYFEINRGNNMRYIISKKDCLDVLKTCYFSKKGIPIGLVLSPTLANIYMKSFDNELYGKLKKLNLNNIIYTRYADDMVISCKDKLDQEKILKIKELVSEQLSYLGLKINEKKFRNVSLYTSNHVKITGINICKVKMKGNNNYRYLTVGRSKRELLYKLAFELLELNKDSFIYQYKLKKLKGYYAYVYSVEKGKVDRLCPPKYVDKLRKYGYSSFSDLIREL

SEQ ID NO: 4865 - protein, 662 aa, unidentified
  source 1..662: note = Related to QUDZ01000002.1; note = Eubacterium sp.
MEYTLLENIKITRPILFLCGPYYNKNNKSDRRLILQEKIYEIHKNKFLPLVIDDFLTEKNIKDNTIDIQLMEEICAAVSAQTYIFLDTMSSAAELGIFANSAFFNKIKVYIPKKSDIYNKSNVGYFVRDVVLMKHSDKIECLEYRPAVERNAIATDYILEYYKFVNNQLPKNIEDDIRNDEIFNESDEHFIEYLDSNMMPDNPYQICYQIRNNKIDVNISIKILFYITISVISIEYKNDIKEKNFSVFDINKIIEQVKSIIINSLSEKTNKDLNTIDEININTVSKHKIEKIIQHIVKFAHIYYLYSQFHSVYLMEKPIGKIIRKIEVGNHPYTLLQLSDSQLDLLQDINNDKDKYYEKIVIEKNKKKREIIKYINNNDGDNAKKIHEYILKKIYSYYRFNDNSYAYQKGKSIKECVNKHIEGKSFIKYDIKKFFESIKEENLYKCLVDIFGIDKRFIGALKRIFNSCFYENTLPLGLTLSPVLSDMYLKKFDDTISRQLEEKGITYSRYADDIMISSKEIIDEKLYHEINKMVTDELVKVNLILNVKKSVFVTFNSKCNFIRYVGVNIVQGINGNYLSVGKKYIYSIAKEYLKYMDKVNVLNSELSSESDEELEELKKNVFYRRMAIIGKVSFLKQIEGDKGCKRLKKRLEKYVDIDLEKI

SEQ ID NO: 4866 - protein, 662 aa, unidentified
  source 1..662: note = Candidatus Acetatifactor stercoripullorum; note = Related to DXGH01000009.1
MEYTLLDKITITRPILFLCGPYYEKSNKSDRRVILQNMLYDTYKNKYLPLVIDDFLTEKNIRDDNISIQIMEEICAAVSYKTYIFLDTMSSATELGIFANSAYVNEISVFVPKVSDIYNRKNVGYFVHDVVLKKHEDRVKCLEYRPGLERKALATDYVVEHYKFVNDSLPSNLARHIKEDPIFGQEDSHPINLREDDVVIPQTPYQICCQRKGNNLTVSISLRLLFYVTVSIISHEYKTFLQSGDEDFSKFDIDDIVDKVNQCIKNFISGKTGKDLSACVIAKLNTVLQEEERTLVYHIAKFVHVYYLYSQFHRFYLVEKPLGNVVDKIAVGNHPYTLCGLKEKDITLLEKIQADQEKYFEQIIVRKNKKKREIIKYREDKNGDQARELHNRMLQGILEYYTANQASYAYRRGRGIKQCVQQHLDGVDFMKYDIRKFFNSIGLEKLTKCFGAALKIDERFFKELYRMLGSCFYHGTLPLGLVLSPILSDIYMNEFDRRAEGFFSSLGFTYTRYADDILVSAKEVMEEEAKEKAEEFVERELKRLSLSINREKVRKARLEKQGDQIRYVGLYIVRGEKENFITVGKSYAYETARECLDYFHKVRRLLVEELPAAEKEKLEKDTFFERRILLGKLGFMEQMEGQRGIDRVEARLKAHGLSILEI

SEQ ID NO: 4867 - protein, 666 aa, unidentified
  source 1..666: note = Related to NZ_VSLA01000025.1; note = Acetobacterium wieringae
MDYILADKLKITRPFVFLCGPNYERNKIADRRNILRENIHRIYKMQGQEVLPLIVDPFLAGKYIDFNKYSVQLLEEICAAVSCQTHILLDTMSVATELGIFANSTYSNELCVYIPKNSDVFNQGNVGTFVREVVLKNPAANIRYFEYRPRIIRRAYSSVFTAEHYAFNNDRIPKNIKEVLKEDAKGNKLICDLPIIYDDSTSIPSEVNHIAYTYKNSKLDINISIKLLFYIVTSIFQQEYPEITKGKIDDLTQAQLHNICTYTENAIINSVSFFLGIDRKSLTETHISTILKIDNKDAIQHIAKFILIYYTKSQFKFMELITSSEYTAIKMKIGEHPDVIFNLSKDQMQVVNFVVKNPELCYECVNLKLGKKVREIIKYAKSEEGDNAKKLHQSMNEMFREEYKHSIYSYAYHQGSSIRKCVDCHINSRSFVKMDIKNFFNCISKDILLKKIENDQNIDKRYEHLLNDIISSIYYNEKLPLGLVMSPIISDYYLFEFDGQVGKYCESKALIYTRYADDIMISSSSTIEEQLYMEIMDFVSNLLNRLNLKLNKDKCESVHFDKNQSFIRYIGINIVKGENGALNYLSVGKKYIYALAKDYLKYDNFCSALENITSEEKEKMQTNVFYMRTELIGKISFIRQIEGERGIERLKVRLCKYYPDIDLKAL

SEQ ID NO: 4868 - protein, 657 aa, unidentified
  source 1..657: note = Related to FPCD01000008.1; note = Butyrivibrio sp.
MKEYMLLDQISIERPIVFLCGPYYNKKDDGDRRKILKQTISNQYSNRILPLIIDDFLTEENIDDKTISIQLMEEICAAVSVKTYIFLDTLSSSAELGIFANSTFMNKIQVYIPKKNDIYNKSNVGYFVREISLKSRPDTIKVLEYRPGVKRNAIASDYIVEFYSFVGNKLPLNIHQSIINDEDLKESKGKTNIEIIESADMPQSHYQICYSITNQELQVNTSIKLMFYVTLAIVSCEYKELFDNKESDFSKISLEEVEQQVKDALYNLIESKTLINKNDLKKISVKTVLKQEQNDNLIRHIVKFLHVFNNNSDYGVLRLFKNPINKIIKQVIKGKTVFDVIKLTQEQIELLMKINSNPDLYYETIEIRTGNKVREIVKYRNDKNGDSARKIHEAINQSLKNEYMYSSNSYAYKKGENIKKCVINHLDGMGFLKYDIRKFFNSISIELLAKKMIIEFDIDPNYVYQLKSVLMACSYNNQIPLGFVTSPIFSDIFMKDVDNKICSVAEKNDCIYTRYADDILISSKQMIGDDMYKNIDLTVKATMLENGLVTNEKKNQFINFDSSHSFLRYIGVNIIHQQTGNIITVGKTYINDVAKDYIEYDQKKNNCQQQLNEELFYSRLRIIGKIAFIKQIEGDVGVERLKRRLYKYDPNIDFDAV

SEQ ID NO: 4869 - protein, 663 aa, unidentified
  source 1..663: note = Related to FR882517.1; note = Firmicutes bacterium CAG:65
MGYILRDEIIIRRPIVFLCGPYCQKTNKSDRRNILRKCFKDNFKDGVLPLIIDDFLTEENIKDPQINIQLMEEIFASISQKTYIFLDTLSAASELGLFMNHAFLNKVVAYIPKESDILNKKNVGYFVKDVILKMNSRQAKYIEYRPAITRSVIATDYAVEHYGFIDDIVPENIRRDLLDDIALKTKKVHLICLDEKETTPMDDYRICYRRKENRIFLNVSISLVFYIVASLMYEKYSAKLVTNPNASIKDFDVDDILRMTTDTFDNYLLRKGLPTNEDIEINTILKCSFRDLIYHIVTFCYIYHCFSTYMGLRLVDRHMDTILEPYADKKMGNPLEIFDISVQDYDFLIQCQKNPEEFYSKFYLLKNGKRREFIKYSETETGKKLRKIHERINDALRKNYVSSEKSYAYKKGSSIKKCVELHQNNNGFIKYDISSFFNSIDMDILLDAVMNIFSINFAYKKVMRNIISSFYYEGMLPLGLVISPVLSDIYMLKFDQQIIEYCEKKNYKYTRYADDILISKETEFETVEYDEIDDLVIKWLRQLKLKLNSKKKKRLFLQKDGQHIKYIGVNIVHFAKGNKLSVGRQYIYDVVKEYYNYREQARKLREYGIGDETHLFYEERRISGKIAFIKAIEGADGWEKVRKRIGDKEGLYIDEKLKFYHIS

SEQ ID NO: 4870 - protein, 668 aa, unidentified
  source 1..668: note = Related to MNRK01000283.1; note = Clostridiales bacterium Nov_37_41
MGYVLRDEVLIKRPIIFLCGPYFKKGNKSDRRYLLRKCFRKHYGDGVLPLIIDDFLTEDNIKDPNINIQLLEEIFAAISCKTYIFLDTLSAASELGLFMNHAFTNSVVAYVPKKSDILNKSNIGYFVKDVILKMNSEQAKYIEYRPAITRNVISSDYAVEHYGFIADIVPENIEKEIASDIIFKDKKEKLLYTEENEQYPDDDFHIFYKKRDGKMILHISIGMLFNVVMSLMYELNQSKLVTNKEATIADFNVDVIQRITKEVFLNYLIKKGIPCGKEIELYTKLSYSFDSIVYHMVTFCYIYHCYSTYRGLRLVDRHMDTVLDACEEISGNNPLQVFGISEEDYSLVECCAREQQKFYTSFTITKGGKKRELVKYVDTEMGDAMRKIHEKMASSLQGKYTSSELSFAYKKGGSIKKCVELHKNNDAYIKYDISKFFNSIEFEKLFEKIKKVFNIDSAYDVITKKIIASFYFQKKLPLGLVISPLMSDIYMLDFDEIIAEFCSMRNCIYTRYADDILISKKTMFIESEYQEINQKVELFLNDLKLKINSKKTKRVFLEKDGQHIKYIGINIVHFDTGNKLSVGRKYIYDVVNEYYQYLEDLEMLKVNDYEDERERLFYQERIIAGKLAFIQSIEGSDGWQRIRARFGKNAYLCENNRLSLNNLRDKVG

SEQ ID NO: 4871 - protein, 905 aa, unidentified
  source 1..905: note = Lachnospiraceae bacterium; note = Related to JAFVBO010000076.1
MSKTKIADIYAGLPDAKEAIQYEGIRDFMDAFVIPPEFPLDEGLARGNKMFITGNKGMGKTAALRYLNDYLSRMNKSTKSSFMLFEQDYNDRRKAEMLNQARSSLCLLGIEPDEKINQDDFSYIWRWHIFMTILRQNGENMREAIFLQDDTWKRFNKLLFSVIKPDFTPTLSGSLSVGLPFFGPIQPEITLNLPEIRLGKGKGTFEEIMEEATDCFKELIRFNSPYYLFIDELDVYRGQREEYLRDLRMVRDLIREVKFLNRLMQTAGWNNTKLFCTIRPEVIHAIDRELSGNIGRQITGFDCPLTWFRNTRETYTQPIMHLLMRRIELAEEKNGERIGSEEERYKRWFPQGETGEEPSDIFRRITWSRPRDIVRFLICAGNRCGGQKAFSETVFQAVKKDYSFGSLEEVKTELLALYTVEEVEAMFDCLRGLPACITLADVARRTESMKCKPVSVYGLQRVLGDLYRVGVIGQKKGNILRWQHEGDDGLFYSGDWEIVIHPGLCDALYIQEVETSAQEQAQLETQQHTSGTKSTNQELQVKDSATKPKDPVMSSELSHEMKAHQEEAREAPIFGLSEEQYQLLLDSRKTPSLYFQAFTLKTNGKTRELIRYKDNEYGEKIRQVHETAANDLQKQYRQHEASYAYRAGGSIEKCVSAHVGSTCFLKFDIHHFFNSIDAALLASEIRAQLHLTALSKESVEEFVQCFFIDGILPLGLVISPLLSDIYLHSLDENMETFCRQQRCIYSRYADDIMISGVGLQMDQMETVFSGRLSNLLKEKKLEINPLKTQKMFLKESGQYIRYVGINIVRAAEGNVLTVGRSYIHQLAKDFLDFARRKDDARTKNGEALSEADQQYLFYQGRRLAGKVQFVKQVEGDAGVEKILRRIQPHWIVEDEADLMRFCLGK

SEQ ID NO: 4872 - protein, 666 aa, unidentified
  source 1..666: note = Lachnospiraceae bacterium KM106-2; note = Related to AP018794.1
MCKIMILVLKKKIKIDRPIIFLCGPFYKASDKNDRRNILKDFLLTESDKKCIPLIIDDFVTEENIKDTTISIQLLEEIFAAIALKTYVFLDTMSAATELGLFTNNAFINKVQAYIPVENDIIYKNIGYFVKDVVLDNKSGRVAYMEYHPRIKRVPIATDYVVEHYEFINNILPLNIQEGVRKDLHSSLWNEKEVEINESAELPSDHYKINYKYDVEDNILRVNLSVQYLFYIVGGLIYSEYSDELVKNETIDFDDSCIEILEEKIKLMLRMFIQMNIFCGINQRTYVQVNTVIKDKMSNIIRHMVKFIFLYHQKSRLNGYFLVNKKSILKEVIVGKSPIDFFHFTENDISYIKDINSNKGKYYECLNLKLKGKKRELVTYSENDREGKANYAKYIHKKVVSIILENYQYSNSSYAYRKGYSIKDCVAMHKNSTFFLKFDISKFFNSIDLDILVMTIMEEFSIGKSFKMHVEEIVSTCFIDNEMQLGLILSPILSDIYMKKFDQVLERMGKECGFIYTRYADDILISSSNIIADQDIQIIKNAIQSELKLLKLKENSKKYKKIYLKSIGQHIKFLGLNIVRMMDENKITVGKEYKNYIAKEYLQFIDMKVNDEEDKKCKFYWGKRIIGYLSFVKMIEGEKGENEVYIRILKSTGGRIAFERERLQGE

SEQ ID NO: 4873 - protein, 681 aa, unidentified
  source 1..681: note = Related to SWPB01000023.1; note = Clostridium botulinum
MYVIDDKIRIDKPIVFLCGPYYDPKDKCDRRTILKKYLIDKGNFLPLIIDDFLIDDNIKDKNINIQLLEEIFSNISVKTLIFLDTFSTSAELGLFANNSFSNKITVFLPQKSDILGVDNIGFFVSDIILKQDPNRINYLSYRPKILRVPVASDYVKEFFGFINNEVPKNIKNELDKNLISKRENYYINIEFDDLNLRNNSSNINIEKISVNDNGRDITFYISIHMLFYLVVAIVYKNYYEKLDGDKKLSKGKNISNKKDNTKIKNNKNFTVNQVKNVERLVREYIFNTYCNHKGSYNKNTNVVIETKLERKLFEIIKHMMKFIYVYHAHAKYMSNNFISDPNNIIKDVSEENPVKMFNISKEDFGLINDIKNNPDRYYEKRIIITNKKKREIVKYRNNDFGMQIRKLHTKIANVLEKIYIFHESSYAYRKRKSIVDCINTHRINNYFLKYDIKSFFNSINKKILLAGVCHELKIDIKAYGKEIESIFSTCFYNNKLPLGLITSPILSDIYMKVFDVKLTNYLTEKYNTCVYTRYADDILISNGEMLEKEKEDEIDNYIINELKGISLKLNDKKIRKVKISETGDHFKFLGVNIVKGEEDNYLTVGRERINDVAKLYLKYRHIKDTYLNDKTNDKWIFYTQKRIVGQIAFINQVEGIIGYKKLENRILKCSKGNVILTNNIQ

SEQ ID NO: 4874 - protein, 659 aa, unidentified
  source 1..659: note = Firmicutes bacterium; note = Related to JAGZEQ010000023.1
MGENKMAYILKDEIKINKPIIFLCGPYYNDLDKSDRRKILQDFLLENFPKKCLPLIIDDFLTKENIGDNEISIQLFIKIFAGISFKTYIFLDTMSSAVELGLFTNSAYNNSLYIMLPYEKERNCGNIGVFTSNVVLEDNADRITVRYYHPKIERIAFSTDNVGEFYKFINDCLPEKIRKDILQDYAENINLEHEIQIAHKEDYPQNDYCVNYQYNNTENSLIVFISVKLLFYIICGIVYSEYTENLRKKEKLDFDSYNIYTTVAHLKSLIMAFLMKHTFVGINSKTKVDIQTVLTRNIEDIVKHIISFIFTYHKNSRLKGYFLVGKNEIIKELELQISPVDFFDLTVKDIEILNLFKNKPDDFFSTFEIKTGYKKRKITTYKNNIYGNAMRELHQKICLVLNKQYVFDIHSYAYQKNKSVKKCIECHKKSKSFLKFDIHKFFNSIDKRKLSQKLLYEFELDEIYEEQLLNVLDICFDEEKMPIGLITSPILSDIYMKKFDVEFSNELGENYIYTRYADDILVSSANNISLEEEIRITRLLVSKLKVLGLKMNNKKYMKRNLKAIGDYVKYLGINIVVAKNGNIITVGKTYKNYIAKTYLRYIEIDDENREEKFYLGKKIAGYLSFVNMIEGEDGLKKIYTRIEKSTKGEIKIEGKITDL

SEQ ID NO: 4875 - protein, 587 aa, unidentified
  source 1..587: note = Related to FMEJ01000011.1; note = Clostridium sp.
MVYALNDKIKIERPIVFLCGPYYKSGDVSDRRRILNKVLLDEYKCLPLIIDNFLTPDNIGDDTISIQLLEEIFAGISFKTYIFLDTMSSAVELGLFTNNVYNNSISVFVPHLEDRNCGTIGVFVNDNVLTNNKNVKKICYHPKIERVAFSTDYVGEYYKFVNNQLPTVIKNSIDQDFEEIGDREFKIKLKCFNDYPKDDFVINYRFNEKENTLIVFISVKLLFYIVGDIIYAEYSNNLASKKNLRITSDHIRLVMAQLNSLIRILFLKNSLVAINGKTNIVIQTVLKRNIDEVVKHIVSFIFTYHINRRVKGYYLTHHGDILKELNLKLSPQDIFKFNDIDIDLIRKIDKSFYKEFEIKSSRKKRKIVTYNDDENGKKLRELHKKMALNLQKKYKFSEYSYAYQKGKSVVNCIERHINSVHFLKFDIHKFFNSIDIHRLSKQISNLYQLDKFYEKQLLEILKTCFNDEKMPIGLITSPIISDVFMHDFDVEFASKLNKDYVYTRYADDILISCSHAISQDELDNIILILKIMLNRKGLSLNEKKTANVLLKDKGDYIKYLGLNIVKCEKSNRITVGKNIKMILLRII

SEQ ID NO: 4876 - protein, 328 aa, unidentified
  source 1..328: note = Clostridia bacterium; note = Related to JAFVYW010000089.1
MFGYLTLYFKDMERALSVANGYLADPDKYTKVHVVPMNGKVRKLRAYADNKEGKRLRELHEAVARFVWDAFQSSNMSYAYKKGRSIVDCVRAHINGKVFLKTDIHAFFDSTKLSTFLQMFLRSPKFMADKPKLTTILSACFYDGTLPLGFVSSPAISDFFLHEVDRRMQMLSGIVYTRYADDFLISSINVGAQFVLENALKVLKGEIQKLGLELNERKTFYRPLKNIGDSIHFLGLNLVRTSYPFNRVTVSNSYIRETSIDLAAALQKSDQKAYEAARGKISFVSMCSPESFEKLKKLVMIKFHLDLEEMLDSKTVQEAKLAIHLNRK

SEQ ID NO: 4877 - protein, 308 aa, unidentified
  source 1..308: note = Candidatus Borkfalkia faecipullorum; note = Related to DXFX01000070.1
MKMPEKCFSTAKEYQCNPAEFVREHVVTINGKKRTLRAYAYGSGGEELRALHTAVAQIISSGYMPSNASVAYKKGDNIVKCVSRHLSGCVFFKSDIVSFFESITLEKFMDRLKDSLLDKNSDLKKLLPACFYENMLPLGFCCSPILSDFYLSDIDKKYENGQGYVYTRYADDFIVSSRVESGEEILEELREKLWDDMESVGLDLNEKKTYIRRLDHDGDHFHALGLNIVRREKGKNIITVGDAYLRETCKQLTAIVGGETNNEEDICAVRGKIEFIRMASQDSYRKFERLVKVKTGSSLQAISERLSD

SEQ ID NO: 4878 - protein, 319 aa, unidentified
  source 1..319: note = Clostridia bacterium; note = Related to JAFSFB010000001.1
MKKIDKLIRVAEGYIANEDAYIRHFVVVINGKRRKLATYANSENGNALRELHTYMASFIRRLYQQSNASFAYAKGKNIIDCIKVHIRSDVFLKTDIHSYFNSITFEGAERVLNRHKTYQKNSDSMGILLKACFYNGRLPLGFVSSPVISDIFLVALDRKYSKRKDILYTRYADDFIISARGENSVSVLDEVRETLSDDLGKQGLFLNTKKTYIRTLKQAGDAIHLLGVNLVKTENEENRITVSDRYIRETSKGFSDLMNFNGDIEEKTELCNTVCGQISFIQMCSQDSLNKLQKMVRVKCGYSGSLQAKAICRACGLEK

SEQ ID NO: 4879 - protein, 331 aa, unidentified
  source 1..331: note = Related to JAFWGQ010000010.1; note = Mogibacterium sp.
MRGKYSKSWSIDTMYTDARSTVEQYNEDPEKYVRSFTVRINGKKRNIITYTPDRNGAALRNIHSRFAFTISHCYQSMPDSFAYKKGSGILTCLSQHLQSDTFFKTDIHDYFNSIKFETLLSMFQEDKTCKRRMKKIKALLSLCFYNDHMPIGFITSPVLSDLYLHKVDESFLGRYDVIYTRYADDFIISGKNNMSSLEKAKNELEESLSEYGLSLNAKKTYFRTLHRPGDAIHVLGVNLVNNDPDPNRITVSDRYIRETSKDICRFLSEYQDQTKEENEIALSSAIGKIEFIRFVSPSSYSKLEKMVRIKHGEAVDLSRAMLEGLIKKNNS

SEQ ID NO: 4880 - protein, 700 aa, unidentified
  source 1..700: note = Related to JAFUFH010000088.1; note = Bacilli bacterium
MALSFFLFMYITNFICSLDSRRPLVFLCGPAYSPNPQDRRWILSHYIQSKWSEKEKDKYVHAFPIVVDELFKPDEIKEKKLDIRLNILEEIVSKISYKTYIFLDTMSTSYEMGQFTNFAYNNDSVTIFVDKKYRGRKNNAIGEYIRLSIDKSFVEYTASYDNNGLIYFPEKDGKGKTRIPKEILKVLEDDNPVKKGCFLNKILFSTYINDLNKPGYIVYHRSKDLLSFNFCIRNLFYYISSVYKLLSKSSQALLNEIPQSPRDYRFKEFVKFFKQELLKTFVCVNNSSNISFLLTADFSIEVNVENLDCDELIYHMLYISYKLFNIKSSSSRYLIPEASDQSSFDSIYFVDGLEMFGLFDNETMCALDKNRYLPHKQCISFRTLKIKNKTRNILAYRNNFFGERLRGLHQTILDSFLSKLPTSKSSYAYKKGKNTLVCLKQHEGNYYFAKFDIHKYFESIRLKMLGNKIQNYFYKKINALLSNLSLSYSNKKRINSKLTSILKPLFYKYQLPIGFVSSPKISDFYLFECDERMNKQKGIIYTRYADDILISSKSKGELDEGIRLLKSLLREEELVLNEKKTRFAVLNHENDSFKFLGINIVRRKGDLFDYTISNTYLVQTCKMFFKVFEEWEWKKDINEVIKVNGRISYIKNISNNSFKRFLHLLKVKFKDGTTISDLYWRLIWMDCPLYLELPKDIIMS

SEQ ID NO: 4881 - protein, 610 aa, unidentified
  source 1..610: note = Tenericutes bacterium; note = Related to CP074575.1
MEEILAKVSASTFVFLDTLSTAAEYGMFTNAQANNFTYTLLPYEEDIINDAVGYYVKKSIRENRDIREIVDLVRYHPKVNRYAKSSDVVDEFFGFIKDELPISIEESVKKSLLRNKEKYEIDFSITNESSSDFFIKLTSDVLEPQRYNILCSTKLLFYIIEGFLKDEYGNKSEILINQFKYNLDDYVSSVIGNVNSLVINSLVTHNTITPLEAVNSKFDIDVDLSESIFDVVKHMIEFLILFRNGGNKYSKRRSLISNPNEIFTRFKSKISKNDSSFTNMITNDKQLINFTKIALQKPSYEYNKLAYSSFIVSSPKKKRRIVTYSKTEYGQNARVLHKNIVAFLNNHVLSDSNSYAYKTGRSTYDCVLPHLNSQYFFKADISSFFNSINSDILVSKIVNHIEDFNVQQSTIRDILHTQIENMVNNCYYLNKLPIGFVSSPKLSDIYLFEFDKEIGEYCKNRNRIYSRYADDIMISSENEIDIESIKKSVIDSLSKVKLTINSKKLENKKLLSIGDNVKFLGLNIVKKELGNTISVGKSYVSEATIEFCDIVLNKDINQRVKKVIGKLKYIIYQDPTKSKQIERIIKSKLLSSYNFTSSNDFMTLYKQLSE

SEQ ID NO: 4882 - protein, 690 aa, unidentified
  source 1..690: note = Related to JAIWZC010000001.1; note = Enterocloster clostridioformis
MLVPSFPISIALPVSQSSFIKWLFFVWEKMMNRTPEEVINLRPLVFLCGPLYDPSDKKDRRKILRQYLTRYKTTLSYNGKDYVIEPFALIIDKVFNTEDLENNQNIALIEEVIAACAYKNYIFIDTMSTALELGLFANSYSQNRTTALLPKDFRSFKPSIGYFVQQTIKKSDNIALCIYGNKRINKFIDGGRQVIENLVAFKSHQIPREIERDIKKDFSKGIESFILRIEFTTNIKDAEKILYQVNTEGIRMVIPPRILFYLVETFGSINNIKNALLDYFEYYECEKDKELVIMSILIRKGLCILELDSPFEYSIIDVIGSMSYFIEKLKTRVAFHQNYERLRYAPIKRWRSRKRFSACELLGLDIIEMRQMQSLFGYNKKKSVISKNLLINGKKRKIKMYSCTSEGFALRNFHLRLMKQLQKLFELQPYSYAYRKDRSILMCMNQHIDSKFFLKIDIRDFFNSISKGKMNKIIKCHLCYDPKQAYEDNVIWRKSRYLGEYVKEWLGIKEITDICFVNGRLALGMVTSPILSNIYMDFFDARFHDNYPELVYTRYSDDILISSGKWFDYKSILNFIAKELCYLGLEMNEHKVGFYKLKQAGDHIKFLGLNIVHGPAEENYITVGKQYIKDVCSNISQYEKKIGLFKKSQIIGQIEYIKFISTRDYLQLQKIYRIKNHKDLNVEELNRVGL

SEQ ID NO: 4883 - protein, 1740 aa, unidentified
  source 1..1740: note = Erysipelotrichaceae bacterium; note = Related to SVBB01000024.1
MAKFSYEQYKKVVGKATVKPEINVESVKGYLDNPNQYVFPFAINEKNGKTRTIITYNESSDGKNLRKVHELLAKDFEDNFAERNQYSYAYHKGIRCYNALEAHLKSNYFIKLDIHHFFESITLENFLDIYGEYFNKNWREILQYLFYFGSLSIGFVTSPLLSDFYMKKFDNAIEEYLKDYPELHFSRYSDDIMISSESKDNDTSLEALFIFIKEQLKQLRLETNESKTKKIKLNLEKHNSFSFLGLNLSKIDEENNKVTISKRYILFILFLIAKQKRYKNNCTPLDNEIKSRVAYLAYNSEISFERFQKKHINIYGEPYNFIPKVLEKREVGQTTDTIKDYSEYKDEFEFNIHSKADGANTSGYQIKNGITLTKYLGKKEEVIIPDFVDIIGDYVFMGHKIKKVILGNNVKIIGNDAFRNSTIEEIVMNDSLRHIGNGAFQNCKNIKKVVIPSYIKYVSNNTFAESGLEEITLPEGLIKIKMGAFAQSNIQNINFPTTLEAIEYNAFTECTKLSRVDLSKTNITSLGVGAFSNCVQLKEAILPEGLSTIENNLFSNCSLLKEINIPAKVGYINNSAFSNCYSLSSIKVSDGVAFLSRKDNASIVKKNHELLFTLKDKIDEDIQIIGRGLFAGVAIKNIVIPEGVKIIKEDAFKGCLWLKSITLPESLEEIGNNAFEKCISLEEIVIPSKVKALPNGLFANCSNLVKVVMGEEVTSIGDNCFANDKKLSIKLPKELMLIGEGAFKNCYNIKDLYIPYKVKEIKKNAFIGMSKHLNSIKVDNKNLVYSSGEDNNILFLQKKGSLILGTNHSTIPGGIKSIGNYAFAYNSELEEIDLPETVTTIGESAFKGCTNLRKVNLHYVSKIEKHAFENTPNLKDIFLPNSLTHIEECAFLNSGLTSITLPNSLVKLDKKAFRGCRNVKDIHIPASYTRSLSALLTTGSEEINYIEIDPDNSMYRCVDNKVIIIKAINNDPEKILFVCNGVKEIPNVPVIMDMAFKGVKGLKEIVIPNKVCVIGSNAFESCPDLEKVTFKYDDDIEIKDNAFKNCPNLKEVVLPKLLTIISANLFYNCPNLKKVKIPEGVKVIGDRAFSYTGLEKVTIRKDLVNIGNDAFASTNLKDVIIEEGVKKLSYGLFTETKISNITLPNSLEAVPGNLFAGCKELTSIVIPDKVASIGSSSFSNCTSLKEVKLPDNLEIIEESTFYKCVNLENINFPTKLKEIKSFAFYHCHKLNVPAFNEGLESIFSNSFNSVETLKDLALPSTLKYFNNSAFAYCPIESIKVSPGGMYQSNNNALTYHNKNAFNELILGCKNTTLDDSINFIAPYAFNNIDSLLEVVLPKNVTTISSNAFSDCHNIKRIILNDKLESVQSGAFDSNLCIDELKIPANTKYFGYLPKEVNKIAIDKNNILYSDFGIGVFATKDGKILMTTPTSSLPVEGITSINRDCYNNRKFTKVELPSTLISLGGFNNCEIDELFIPDSVKTISLFAINSIIKKITVSENNPYYIASEDGTMILTRSKKQIVYLGENTVIPEGITVATTNDLITSIHYPSTISDRALSLEPRGIKQIDIAKDHPTVAANNNTLYRKLDGGLIYAVNGEEIADEVTKITNLNLGKFDNVIIPKNVNLILPRALGGLIIDNIAAHKDNKMFDSRDNCNAIIHTSTNTVLFIARNGRVPDGCVVTPTTIDQRVKDVTSIEIENNYSGYETLSYNVIQRLNNNPQTTTKSSFSTIAFDSDDDLPF

SEQ ID NO: 4884 - protein, 332 aa, unidentified
  source 1..332: note = Related to JAFSUM010000023.1; note = Bacilli bacterium
MIEVVAYSLSFSPQFVAECAGSSPWSRSFYRRVSIPKKNKPNERRIIYLPSPEIKLMQHFLVERYISKLPVHGSATAYRRGSSVVKNAKAHTGNSHFLLMDIESFFDSIQRGRVKRMLLNNGVFVNPADAEMLISLCTYDGHFVQGCVSSPSVANAYLYEFDNKMDMLARGLPNGVYTRYSDDIVLSSSERIPGQIAAEVAAALAEFGLRINHKKTHFISNRQRIHITGIRLKDNKKLGLNTLFKKELKNDVYQFWKKCSLSGADLKDKNRLYGKLAYLKMADPSYYNTIITKYRFGCRTLLDFLHCLVLENDHLMLPPDKRFTDCSSNRIE

SEQ ID NO: 4885 - protein, 319 aa, unidentified
  source 1..319: note = Related to NC_022549.1; note = Paracholeplasma sp.
MGIVREDISDTFNMDMKRVSIYVNKSNQFYKKIAIPKRKGGTREVYLPSSDIKMLQHYISEKYFSKIQLSSNATAYIKSKSIIDNARPHIKNKHFLFTDISNFFDNIKRNLFSEILLKELPFLSPYDVEDILSICTYKNRFVQGAVTSPIISNIYLKSFDEFLQGVVKNIPNGVYTRYSDDITISSSEFLNENITKIIADELSKLGLFVNNTKTYFSSFVDEIEITGLKISGNRISLSNKKKREIKNMIYHKFNKKSNSSETAEQIIGHMFYLRQIEPQYYNTLNLKYKKKKKLLIDRLFLLKNEENIQKCTATSNIQT

SEQ ID NO: 4886 - protein, 322 aa, unidentified
  source 1..322: note = Related to NZ_NFJF01000003.1; note = Olsenella sp.
MIPVSTAIARGVGVSTDYVLGLPERVDSLYRSRIIAKDRSGQGKARVISVPDPSLQLVQEWIADFVRENTSELPPYVAAYETGRSIVQNALIHASHRHLLTLDIHHFFPSCTREMVVVKVFSGMSARDGETGQRHQLGADDVDLLASLSCYKGALAVGSPCSPFIANRIMLPVDGEIIAALPDGYAYSRYSDDISISSDSRINTGLITQIVEKILSDHGFSLNRSKTHCRGTGNARRVTGVFLTSDGSLSIGRDRKKELCRQLYALLKKQEGSPSRVLGMLFFCKQVEPEYFNTLVAKYATYGLANDYGGVIPALQALRRKM

SEQ ID NO: 4887 - protein, 313 aa, unidentified
  source 1..313: note = Related to VOWY01000007.1; note = Collinsella sp.
MSIVEEIASDLGFSKSYIKEIAEGAGGRYRKVLLNGRRIDVPSSDLKLVQGWIACLLQECMPCDAGYITAYEPGRSVISNALLHSENAHLITLDITGFFRSCTTEMVKSVFSQLRFVSHGSNNKTAVSKKDIELLTQLSCYRGSLPMGSPCSPGIANRIMVPVDQEIIRVLPPDCSYSRYSDDIAISSSQWLDIQGIVGLLEVVLAEYGFNVNHKKVHCYGKGDARKITGIYIHPDGTLGIGKSRKALLSRSLYLLLTRQTGSASELLGHLNFCKQVDPDLFVRLIAKYSSYGVAVEYGGVMPALVEMANREG

SEQ ID NO: 4888 - protein, 303 aa, unidentified
  source 1..303: note = Related to JABZGZ010000043.1; note = Atopobium sp.
MSIIKMISSDLSMGQNEILSIANSADSSHYHKFISGGRRIDAPDQMLKLLQFWVADFVCMETPELPDYVTAYEQGRSIKNNASMHAQNAHVINLDIHHFFQSCTKDMVKNLFASIEGYNLTSEDLKLLVSISTYKGHLTIGSPCSPFIANRIALPIDYDIKLKLPNDMEYSRYSDDISISSNNYIDYEVIVDIIGNVLSSHGFEINRKKTHCFGKGGRRHVTGIFINPDGTLSLGHRRKKQLESMLYKYLMRSKGNPNEILGFINFCNYVEPDFTRRTLLKYSKYGFARNYSSVVDYLRQIKG

SEQ ID NO: 4889 - protein, 312 aa, unidentified
  source 1..312: note = Related to NZ_QVPV01000001.1; note = Adlercreutzia equolifaciens
MTKTSISALIQSDLGLETGYIESLAERASALYSRIKLKGRRIDAPSPELKLVQCWSSDFLHSADGDLPSFVAAYEPSCSVIRNASMHADHAHIARLDISDFFHSCKHAMVETVFRGIRFQPLPDGEWLKLEEADVTLLARLSCYKGALSVGSPCSPALANRIMLPFDRDIEANIPSSCRYSRYSDDMVFSSNCWIDIAALESTVDEILSTSGFRLNRRKTRCSGKGDRRRVTGVFVTPEGELSIGSKRKHEIKRLLYDYLTKGQGDADVILGLIQFAIQVEPKWASVLLAKYAKYGEARQYGVIGALRNASE

SEQ ID NO: 4890 - protein, 318 aa, unidentified
  source 1..318: note = Related to QSBV01000001.1; note = Collinsella sp.
MEALPVSIADRICFDLGMTNRQLLGLVSSTADRYHCFSAGGRKIVAPRPDLKLVQCWISDYINTEFDIDLPYATAYKKGSSVCRNAGLHAKSSHFLLLDICHFFESCTQQMVRNLFSGGTYRPTNAEFRSRLTADDVDLLVALSCYRGSLATGSPCSPFIANRIMASFDHEIAARLGERFVYSRYSDDICISSTEWIDSAEISTFVGSRLRQKGFDLNSDKTRCFGRGHLRKITGIYLDCDGVLRLGPQRKAELKRSLYQVLMRECDRECALRVLGHLSFCKQVEPDFCNALLAKYASYGKAVSSGGVMPALVELAYG

SEQ ID NO: 4891 - protein, 302 aa, unidentified
  source 1..302: note = Actinomycetia bacterium; note = Related to JAAXUU010000117.1
MADDLLLDEEYVTKLVNSSARYYLTHLLEIKGKKRKVHKPLPDICLLQYWVIENILSQAPTPARCATAYEKGSCILANAAVHKDNSHIMQLDIKHFFDSITSDMVFDYYIGLDARLSDADARALQRISTYRGTLTVGSPISPFLANRIMIPVDIEIQECLPSGITYTRYSDDMCFSSPEFIEPQLIDAIQEVLSRYSLRLNTAKTHFSGRGDRQKVTGVVLIAGGKLSLGSMRKSALKKMLYEFVRYGKGNPSKILGHINFCKSIDPESVESILMKYSTRGPAVELLKAAIARSESERISEG

SEQ ID NO: 4892 - protein, 306 aa, unidentified
  source 1..306: note = Related to DMNP01000113.1; note = Eggerthellaceae bacterium
MSVLDLMAFDLLLDRDYLESILHNKRGQYRRIRLQNDRVVWQPSATLALMQYWLVDWISEMDKRELPFATAYEPGMGIVVNAKRHIGAKHALAMDIHKFFPSIGAHMLGGYFASTIEESGASAGIEDRDIGLLLDIALFNGGLVMGSPCAPYLANRVMAPVDERIWLEVANTRGLTYTRYSDDLFFSSPEWIEPSIVGEIAILLQECGLQVNSSKTRFMSEGTGINIAGVYVGQKRITLGQKRKRELKERLYQFCTNDNPTPDSARSLLGFLSFCKSVEPSYVGFMLTKYSTYGGDIMLRIKDACS

SEQ ID NO: 4893 - protein, 321 aa, unidentified
  source 1..321: note = Related to JABLXJ010000013.1; note = Firmicutes bacterium
MSLIERISRSLDIDENLIKTIARTSNKYYRVFSISKKFGGVRSIYHPSPILKVFQYWLVQNLISHLPVSEHATAYGLGCSIKRNAQLHAAAKHIVRMDVKNFFPSIRFQLLADRINAFRDTIPGGASLTEEDLQLINGICFVRGRLVIGSVCAPAISNAVMYPFDCEVSQQARALHLTYSRYADDIVFSSNEWIHPSIVEDIDGRLGKFGMKLNREKTIFMGGSDRKMVTGILLNTGRLSIGRARKESIKKMLYQKLRTGAGDNRKILGYLNYLRDIEPDTFNRMVVKYNSFFGRNIMRVLTEAPADTRKAQAEAAPTKKP

SEQ ID NO: 4894 - protein, 303 aa, unidentified
  source 1..303: note = Lachnospiraceae bacterium; note = Related to SVEQ01000005.1
MGIENRIANNLGLDPQYIINISKRNDLYRKFYIKKRNGKLREILHPSKELKIIQIWLVKNIFDEFPVSEYSYAYSKGNSIKNNAKEHCYSNYIFQADISNFFPSIDRAKLETYFDENKFIVDKLGLTDEDIDFILDVCLYKGEYLVVGSCASPCISNLIMYKFDNELNKKLLKEGKYIYTRYADDIAISSKNYISVTIRDIVESELKKMGFSINNQKTHFSNKKSRRRITGVVLDNNSCKMTIGNKKYKGFQRKLYNYLVKGEGDEGYIKGYLSFIKDLNIEQYKQLKKTYKRYDKKKKFFTD

SEQ ID NO: 4895 - protein, 307 aa, unidentified
  source 1..307: note = Related to QVFD01000002.1; note = Coprococcus catus
MRLSERIAKGIGIDESYVIIIASRNNLYAKYYIPKKNGRYRLILQPSKELKVLQHWLLRNIFAYFPVSEYSSAYSKGNSVRKNAAVHKEGRYLLHTDITNFFPTISRTMLKQYFQSNESLTRKLGMADEDIELILDICLYRGENLVVGSVASPQIANMLMYAFDLELKQMLDGFGSFRYTRYADDIVISSMSFIDEQVLKQTEQLMIKYGFKMNHEKTYYMGKNGKRQVTGIVLDNNRNALTIGNKKYKKFQRMLYDYLVKGHGDLGYIKGYLAYIQEVSRQQYDQLAEIYKRYDIENVLFHNANGR

SEQ ID NO: 4896 - protein, 300 aa, unidentified
  source 1..300: note = Related to JAFTQC010000025.1; note = Clostridia bacterium
MNLLEQMNRDLGIDKQYIRNCAKRNNLYARYYIKKKNGGRREILQPSKELKVLQYWLINNFFNQFPISPYSSAYQKGCSIRKNADCHKYGKYILHTDIVHFFESITSKSMNSFFLRNKDILGDMHLTFDETRLILNLVLYKGAYLVVGSVASPMISNCFMYEFDMKLGEIITKRNMKYTRYADDIVISSDNYIDNSILDEIDILLNEYGFKRNIDKTYFMCKRKKREVTGLVIDNNDNSLSIGHKKYNQLKRDIYNYLIKKQGNCNQIKGKLAHLKNVNIDKYIAIKKIYSKYDKSHEIF

SEQ ID NO: 4897 - protein, 307 aa, unidentified
  source 1..307: note = Related to JACSRA010000017.1; note = Clostridium sp.
MSLLQRMSSELRLDPDFIMSTVNSTKKYRIYKKGSKFIYNSSGELKTLQYWLNSKIFSILEYSKFTAAYQKGCSIKKNASIHSKSNYILHTDIENFFNNITEYHINILLEEINQLGKSDKELIKKIILYKGHLVIGSVSAPHISNCVMYKFDIELYDTIINNTNMKYTRYADDITISSKEYITHDVIKKVEALLVKYKFSINNNKTYFSSRATRRRVTGITIDNSTNELSLGHKKYKFIKKEIYNFLVKEQGCKDKILGNLAFIKDINSKKYDELKSVYLKYDKEGIVFSKEEKDIELKDEHEISSY

SEQ ID NO: 4898 - protein, 312 aa, unidentified
  source 1..312: note = Related to NZ_CP022106.1; note = Halobacillus halophilus
MSMLERISNDLNLKVSFIENVLKHPKKQYRIYYIRKRNGGQRKIYHPSPVLKTLQYWLVNNVFNEFNVSIYATGYIKGKSIKDNAEAHKDSNFILNMDIENFFESINKKHVNELVNANGEYSSLDIYHLNKICFYGDFLPVGSVCSPHISNCIMYKFDNEVVEKLPNNFRYTRYADDITVSSSSYINDNVQVILEELLEKYEFRVNHNKTRYMSKKQSQMITGLNVNDGKVTIGTDIKKQLKKDLYNNLTKGTGDSEVILGKLNFLKSIEPDYFNKLIIKYSKYANVLNKLKNDVKEQKNIPIEINKSIEHT

SEQ ID NO: 4899 - protein, 304 aa, unidentified
  source 1..304: note = Related to JAFRUO010000020.1; note = Clostridia bacterium
MNIIDIMADDLKLDSSYILKIANRSDFYYKDYTIKKKNGGFRHISQPSPELKTLQYWIVKNILCKLPISNIASAYNKGNSIKKHAQIHSGAKHILHTDINNFFPSIHFSHLSSILFKHKYIFENLSIDINDSLPYISKICFRGDGLSIGAVSSPIISNIIMNSFDERLYDYCKANNYLCSRYADDIYISSNSYINDSVVVFISNLLDDLDMSINSSKTRFYSTKYRMSVTGLIITNDSRITIGSKRRSEIEKMVYNKIVNGIGDKYSIMGYLAFLKDIEPNTYNNLIIKYSKYCDGDVINKILE

SEQ ID NO: 4900 - protein, 307 aa, unidentified
  source 1..307: note = Clostridia bacterium; note = Related to JAGBXM010000051.1
MTLIEKISLDLNLDKLYLARIISRSGFYYKDFIIPKKNGGFRRISQPSAELKTLQYWITKNILCKIPISKAACAYKKGDSIKKHALLHCKSRHILHTDIKDFFESVDSSKLIKILEKNHSVFEDINLDYNSSIDDIRKICFRKNKLCIGSVSSPIISNIVMYDFDNALTGYCKENGLIYSRYADDIYVSSDKFINHDILEFISNELNKCGLSINRSKTRFYSSKYKRSVTGIVITNDSHISVGTKRRTMIKNMIYNKLVNSEGDSNEILGYLSFLKDIEPDTYQRYLIKYSKFCTTDVLTALSDKNT

SEQ ID NO: 4901 - protein, 305 aa, unidentified
  source 1..305: note = Oscillospiraceae bacterium; note = Related to JAGAZX010000174.1
MNILEKISLDLKLDLTYISRIADRSSFYYRKYTIEKKSGGFREIYQPSAELKTLQYWVVHNVLCALPISEEACAYNKGNSIKKHAEKHQKSKFLFHTDIRNFFPSIHMSHLAPILRANKGIFDKLGLDLEQSIQNIGKICFKSDSLCIGTVSSPIISNIIMYAFDVQMAEYCKAKNYIYTRYADDIYISSNNFIPIDIVSFIASNLSQNGFTINSGKTKFYSTKYRRKITGLIITHDGKVSVGLQKRNEIKKMVYDKLIHNKGDSLKILGYLAFLNDVDPKAYNDIIIKYSQYCSGDIISALNKS

SEQ ID NO: 4902 - protein, 304 aa, unidentified
  source 1..304: note = Related to JAFRDB010000067.1; note = Clostridia bacterium
MNIIARMAQDFKIDHSYLSKIVYRSAFYYKDYYINKRDGKTRRISQASPQLKAMQYWIVENILAKIPVSKGAYAYKKGDSIKRHADIHRLSKHIFHTDIKDFFFNIHFEMLRCALSNHSHIFDEIGIDSSEAFSDIKKICFRNDELCIGTVSSPIISNIVMYNFDEKMIDYCNRNGWIYSRYADDIYISSNYYIPKEVKNFVSAELSDNGFKINTKKTSFISNKYCRKVTGVVLSNDGRVSVGTKQRNAIRKMVYDKIIHKKGSPETILGYIAFLKDIEPQTYNNIIIKYSKYCAGDVIDEISK

SEQ ID NO: 4903 - protein, 303 aa, unidentified
  source 1..303: note = Related to JAFTXX010000014.1; note = Clostridia bacterium
MKMVDKIAADLCLDPDYIASVIKRSRFYYRDYYIDKRDGGRRKISQPSPELKTLQYWVVNNILNKFPISNSAHAYQKGSSIKRHAQFHQNSKHIFHTDICKFFPSITYEHLQPILLSNPKLFEDLEIDLDSVETIRDICFRENSLCIGTVSSPIISNIIMYQFDVIMLGYCKKNHLKYSRYADDIYLSSNSYIDLAHVSFVSDTLRKFGFSINESKTYFSSPKYRRKVTGLVIGTDSSVTIGSEKRAFIKKLVYDKLVHNKGDGNSILGYLAFLKDIEPQTYNNIIAKYSQYCKEDIIEALKK

SEQ ID NO: 4904 - protein, 320 aa, unidentified
  source 1..320: note = Related to FMGM01000006.1; note = Clostridium sp.
MSSLITRISSNLQLKDDYISSIIRRSNYYYKDYYIPKRNGGRRKISQASPELKTLQYWVKTNILSLLPISKAAFAYNRGNSIKKHATFHKESYFIFHTDIKDFFPSITSEHLVAELAANRGIIEAANLWDDDILDVVSSICFRRNHLCIGTVSSPIICNIVMYAFDEHFTNYCNRRNWKYSRYADDIYISAQEYLPSSLQSEVNEKLHEIGFSSNAYKSWFCSKKCRREITGLILTETGKVSVGLEKRLAIKKMVYERIMHGRGDPDTILGNLAFLKDVEPNSYNSLLIKYAAYCDGDVIDAIKTGPKPHRVITLDLPDI

SEQ ID NO: 4905 - protein, 307 aa, unidentified
  source 1..307: note = Related to QUIJ01000008.1; note = Butyricicoccus sp.
MNSIIDRIARDLSLDRDYIASIIRRSSFYYKRFTIPKRNGDPRVIYQASPELKSLQYWVREKILKFLPVSNAAFAYQAGNSIKKHADFHKEARFIFHTDIKNYFPSIHEKMFTDILIAHQDKLQAQGMWFDDMCDVIAKICFYRGRLSIGTVSSPMISNIVAYRFDELIIAYCRERGYRYSRYADDIYISSNRYISQSTKKFVEVSLYECNFKMNISKTWFRSKKSRRKVTGLIITDTGRVSVGLETRKKIKNMIYNRLVNGNGSPESILGYLAYLKDVEPPTYNKYIIKYSTYCDGDVISAIRRGS

SEQ ID NO: 4906 - protein, 309 aa, unidentified
  source 1..309: note = Related to NZ_PDCG01000001.1; note = Bifidobacterium aemilianum
MSKSLVEEISASLRISTERTQEIIINADKLYKIYSIPKHSGGNRLIYQPSSQLKAIQYWTLDNIISLFPVSDRAFAYVKGRSIASNAKAHRQSKYLFHTDIHNFFPSITSSLFDKQCLNRFSSILEETGFSFGDTNSVLHKILFRKDKLTIGAVSSPAISNAVMHDFDQSLTNYCLISGYVYTRYADDIYISSKSLLPKQIKEDIFAEMHKFGFSPNYKKTSFWNGSSHLKVTGVNVLAGSGRLTIGTRNKKMIKGMLYEYLMHGKGDPTKILGYLAYVKEIEPSFYNTLIIKYSEYRNEHIIKYLKDS

SEQ ID NO: 4907 - protein, 310 aa, unidentified
  source 1..310: note = Related to JAKKPP010000007.1; note = Aliarcobacter butzleri
MNFLNYLQATGYHNNLLIEVINNLDRYVYKFKFKGKWQIAPKWELKILQKILKEYLTKYYGSIISENATAYIVGKNLSYNVSKHQGNSYFFVTDFKNFFPSIEFEKVKYILKSNLNKETEDSIDLILKIVFYDNKLQYGFPTSPIISNLILIDFDKKIEQYLLNYFKGNNIKYSRYSDDITISAKYKINKNDILSIIENLINSEYTYLKLNLQKTRFFEKYSHSPYITGLVPLNQRISIGKKKFNIIKLNTYLILNNKAIENDNFFRKENQLQSYLNYLYLVDKHNYIKLKNYFSKNYINSDIFNSLFRK

SEQ ID NO: 4908 - protein, 309 aa, unidentified
  source 1..309: note = Related to PDKF01000002.1; note = Arcobacter sp.
MSFLEYLEEKGYPNTLLRKIFDKHEDYVYHFRIKGKLQIAPKWELKILQKILKDYITDNYASYISNFATAYIKKENISYNVSKHFGRNYFYVTDFSNFFPSIKLTNIKDYLSSIFKDEDSSSLDIIFNIGFYSDSLQFGFPSSPIISNIVMTKFDNLLFEELKTKFPKNNIAYSRYCDDLTISSKYEISPKIINNIINSLLIKEYTYLSINKRKTRSFEKYSQYPYITGLIPLKDRTTIGKKRFNILKLNIYLSLKNKKIKNTDLFDTDIALSSYLSYVYLVDPHNYNRLKEYFSKRFKPLEIKNLFKK

SEQ ID NO: 4909 - protein, 304 aa, unidentified
  source 1..304: note = Related to NZ_SCFT01000021.1; note = Erysipelothrix sp.
MGNKSDIIELISIRTGISSKKIEETISSSKCEYSVVHAKIKKKKRIFYIPSPQLKIIQLHLIKIVLEGFEVSSHAHAYIKNKSIKTNVNCHIGNTFFFQTDIKSFFPSIKANHIKNVLSKDDSISKDDIGLILSAVVPFESLDLGSPTSPIISNIIMLEFDQKIESLIQENYKGAIYTRYSDDITISSKQPILGIDKIVDKTLEEFGFEINKSKTKYTQLIDKVKITGIFLHADKRMTVGTNFKRNLKQQLYLLSNGLDPQIDNIQIMGMLSYIRDIEPEYYLSLVQKYSSSTKSIIDIIKSGM

SEQ ID NO: 4910 - protein, 517 aa, unidentified
  source 1..517: note = Related to MW349128.1; note = Staphylococcus phage Machias
MYRFKEIQGKDNFERLELVNVMDIFYLQHKKPFFKDIVKFDFGYTLVFTDGVNDFVSIDHPSRLWGKNFIPIKNNEEISYIHNDKVKMSLDIFNNNENVIDNLNDLEEKIENYLCSNYYNKISYRTVYNKFTIKEFDNTFTVFKLLSETKSIRNTVKIQNLIKIDKDLINKKDLNLIVDIINNFTNQKTSDAEKNNSYLKNIIKLLLKSFELKYSNKNKFETFYIPKTDGTKREINSPIEEIRPILKSQSKKLNAILEYRISKYNIEDNIIAYRDGKSIKNNADYHKENDTIIKFDVSKFFDNCHFDYWKENLFFILNDNKNLMKRFEKEMEGFLFRKDNKGLYMGSPLSPAASNLIVVPVMRYIKNVISKFKSDIKVSIYSDDITFSSKEINDEFNPSRLKNLVNHAFEIYNLDFKIKEEKSLVMKNRKRKVTGLSINQHNQVTISQRRYRELRTILHLLSNGMEFKDIKGFDNEIELTSLINYYLDVDMTGKISRLINKYEKTFNELKSFESGEK

SEQ ID NO: 4911 - protein, 501 aa, unidentified
  source 1..501: note = Related to MW218148.1; note = Staphylococcus phage vB_StaM_SA1
MFKFNKVNNLKMIGENEIHNDLMLERMMFVMKPVFRRLEKNNKGKLVMLFSDGRKNYLLSTSDKRYYSSPLLSYEGDEYKELESASYIESNIDSLKLLKVKISDILSDNQNIRIRKNLMFTVYEDVDDIKLVQLLTRGDKKIQSAFNIENVISISKDKIKLDDFNLIKDLLNHYIIKGIKDVYISNTIKLLIEALELKYSGKKAFDTFYIPKSDGTKREINSPIEEIRPILKEQSKILNAILKFRIDKYKLDENIIAYREGKSIKDNASLHKENKVIIKFDISKFFDNCHIDYWKENLFFHFKEDEDLMDRLMKEFEGFLFRKDNKGLYMGSPLSPSASNLIMVPVMRYISNILKKFKTDIKVSIYADDLTFSSKVINDEFNAKRLKNMVNHAFKANGLDFKLKEEKSLVMVNNKRKITGLTVNHRDEVTISQKRYRQLRTVIHLLSNGVEFKNIKGFNTELELVSLINYYLDVDTTGKVRRLISRNERAFNELKRKSEVK

SEQ ID NO: 4912 - protein, 500 aa, unidentified
  source 1..500: note = Staphylococcus phage vB_SauM-UFV_DC4; note = Related to MZ779063.1
MFKFNNVERINLIGNRKMNYIELQESLYTLKPKFKKIVKNDKGDFVLIFSDGRKEYIGNTNAGSMFRPKMMVVNSIDDYNLFSGDGQPYRVEISSMSSLNKHLRRIIDQNYTFNIITKKFRIYEEDKIINLIKLKSTTENDKDIFKIEAILKIKKDLISIEELELIKDILNDCLTSQGKYEYILNSLELLIKSIDLKNRNVNTFYTFYIPKSDGTKREINSPIEEIRPILKKQASILNAILDLRIDKYNLDENIIAYRDGKSIKDNADYHKENKTIIKFDISKFFDNCHFDYWKENLFFSFKDEDYVMERFEEYMKDLLFREDNKGLYMGSSLSPAASNLIMVPVMRYINNILSKFKTDIKVTVYADDITFSSNEINDEFNSKRLKSMVNHAFKVNGLKFKLKEEKSLVMKNHKRKITGLSVNHNDEPTISQKRYRQLRTIIHLLSNGVEFKDIKGFETPLQLVSLINYYLDVDTTEKVKRLMDNNEKIFNELKKEAGVN

SEQ ID NO: 4913 - protein, 509 aa, unidentified
  source 1..509: note = Related to MZ422438.1; note = Listeria phage LPJP1
MLSLILIDNVLIDINGEIVSEIDIRMKKNIISDKKVLAKLVKYNIRNKLIQSIKDISYLEENNKFENNEEFNDIHLENIEKIIKTYDLLSNDEICINEGYPDLPVVTYDKTLITEFINNISIKLSYRNLNISHRYIEMNDGYLYIITNTNDIYNKYNIYKITDDKEMIKMIKYLLDISISPDQPNNKPLLLELLLTRILIQNNNEKLYQHFKINQGTKIRDIYAPHNDIKDISRKFNNIFNGMLETQLSNKGVEKHLFAYQKKKGILDNALVHKNNKYIIKMDIASFFDNCRYEDISKYFKLLVLGKENFKKKNNKDSVMDTLFKEIFINPETGGLYQGNPASGSLSNLLMSNVAKYLKNVLIDSGITFSIYADDITFSSNEKSEFFNRKYLKFILNKAFEVYNYSNLSIKDEKTIKMSNNKRRITGIRINHNDQCTLDRKMYRLLKTIFFKLSKNKNNINNISMTFNELKGRISYYRYIDNTNKMENLVNEYQNTLIKLKLINEPKVD

SEQ ID NO: 4914 - protein, 454 aa, unidentified
  source 1..454: note = Listeria phage LPJP1; note = Related to MZ422438.1
MNDLLIISKNPLRILTNKGIFYPYDKDIKIISRFDNSEKKLVQLNNILFKDSYDLLIKIMNYYKTSNSIDFNYSKKYLLENSIELREYSEFFSMYRSFSSTPLVSVSKGYILLYPNSKISNSKYLIYKLKSKYASDIKLLLKRRMSLEIIQLYCIIKDLEDNNIELFKKIKIEKNGKEREVIDPNIKIKNTLKEISKILDKRLDRKISNLKYPNIMAYRKNVSIKDNALMHLNNKYIIKVDISNYFPSIDWKLINSRFILLLFHGVTDKYMDTIKKGFVDENDKMFLGNPVSGVISNIIMVDIINHIQTIFHKYGIICSSYSDDITFSTNIDNNKLFNKKFIIKICNQAFKIYNDKFKINDSKTVYLKGNMRNITGITINHKNQLTLSSEKYDDMRNNLYSYMKTGSCYYDDYELLGKMSYYLHIDETGKFRKLYDKYINIFESIKRGDEKIEE

SEQ ID NO: 4915 - protein, 329 aa, unidentified
  source 1..329: note = Related to NZ_BCXJ01000007.1; note = Alkalihalobacillus clausii
MNRANQYNLPLIQDGQKFLSVADDQLIRRFKVKDKGKLRDVNDPIPELKNVLRAWNAVITDHYAKKLKDSDTSQVAHAYLPHKSIQTNARAHLHSPVIQFDFKGFYDSCKFEYFKKELRELDPRLDDQNEHIVKRLLIDPQTGGVTQGLPVSGALAGLSLIPFWVELGKNLPDNIRFTQYSDDLTFSYVGRMPPGFTIPSLTQKIYEALKKTGLDFKLNPDKTRRQKDQYRKVTGIRINHHNQTTPSRNDYRFLRHALYVLSKSDNLDKELTKWGFTSKSAFVGKVSYMRSIDSTNKINRLIMKYRMTCRKHDIFTTWIDQTYKRSAFA

SEQ ID NO: 4916 - protein, 329 aa, unidentified
  source 1..329: note = Related to NZ_MTIV01000022.1; note = Evansella clarkii
MNNNNPYSLPLLQDGRQLLHLADDRLIRRFKIKNKGKLRDVNDPVPELKTILKAWNGPLTDYYVRQLQLNGVSHVAHAYLPNRSIQTNAQAHLYSPIIQFDFKGFYDSCKFDYFRESLRDLDPTLDDQNEYVIKRLLIDPNTGGVTQGLPVSGALAGLSLIPFWVELAKSLPDNIRFTQYSDDLTFSYTGQTPPGFTVPALTQKIYEVLKKTDLSFKLNADKTRTQKEQYRKVTGIRINHHNQTTPSRDDYRFLRHALYILSKSDDLDKELAEWGFASKSAFVGKVSYMRSIDSTGKIDRLIMKYRTACRKHDIFTTWIDQAYKRSAFA

SEQ ID NO: 4917 - protein, 381 aa, unidentified
  source 1..381: note = Related to JAFUWL010000024.1; note = Prevotella sp.
MIYITVKQPPMYHQMTLEEFLFQTETRPAVINENLTNTRTYEMEYVSQRFMDKFRFNIPALIRKLDAFNDSTAELRVKPRHSLYREFHIPKKSGGLRKIDAPEPELMDALRRLKTIFEEDFHVLYHTSAFAYVKHRSTLDSVKRHQANESKWFAKYDLSNFFGNTTLDFVIKMFSMIFPISEVVKDEHGKEALVTALELAFLDGGLPQGTPISPLITNVMMIPVDHKLANSFRDFNRQRYIYTRYADDFLISSRYDFSFREVEQHIVDVLKSFDAPFTIKSEKTRYGSSSGSNWNLGVMLNKDNQITVGYKKKRQFQAMLASYVMDSKNGILWDKNDIQVMEGYRNYYRMVEGEAIDRIVEHVGEKYGVNIVKMIKSDLRT

SEQ ID NO: 4918 - protein, 366 aa, unidentified
  source 1..366: note = Related to JAFUJH010000080.1; note = Ruminococcus sp.
MTLEEFLFEVDTKPQAMINPNLTNTRTYEVERISEKFLERFDVAKLVTKLSQFNASTEELRAKPRHDLYRTFHIPKKSGGLRKIDAPEPELMDALRRLKTIFEEDFKALYHTSAFAYVKHRSTVDAVKRHQANESKWFGKYDLSDFFGSTTIDFAIKMLGMVFPFSEVIKSTVGERELRKAIELAFLDGGLPQGTPISPLITNIMMIPVDYKLANGFRDFNHQRFVYTRYADDFLVSSKYTFSFREVEKFIVDTLKSFGAPFTIKSEKTRYGSSAGSNWNLGVMLNKDNEITVGHKKKRQFQAMLASYIMDKKNGKDWDKSDVQTMEGYRNYYRMIEGDTIDKMVAHIGEKFGVDVVQLIKDDLRA

SEQ ID NO: 4919 - protein, 379 aa, unidentified
  source 1..379: note = Lachnospiraceae bacterium; note = Related to JAGCWK010000209.1
MVYITVKQPPMYRQMTLEEFLFATEAKQEIINPNMTNTRTYEVERVGNKFLEKLDVAELITKLSQFNASTDELRSKPRKSLYREFHIPKKSGGLRKIDAPEPELMDALRRLKTIFEEDFHALYHTSAFAYVKKRSTIDAVKRHQANESKWFGKYDLSNFFGSTTLDFVMKMFSMIYPFSEVVRYDTGREELRKALELSFLDGGLPQGTPISPLITNVMMIPVDYKLANGLREFNHQRFVYTRYADDFLVSSKYTFSFKEIENYIVDTLKSFDAPFTIKPQKTRYGSSAGSNWNLGVMLNKDNEITIGHKKKRQFQAMLASYVMDKQHGTEWDKSDIQTMEGYRNYYRMVEGEAIDKLVEHVGNKFNVNIVQLIKADLRT

SEQ ID NO: 4920 - protein, 379 aa, unidentified
  source 1..379: note = Related to QTXN01000002.1; note = Ruminococcus sp.
MYYITVKQPPSYHQMTLEEFLFGGNTQTRLINENLTNTRTYEVENISERFLQLVNVDKLIEKLIWFNERTDYLREKPRRDWYYEFHIPKKSGGLRKIDAPEPELKEALSTLKTIFEVDFQALYHTSAFAYIHKRCIIDLLKRHQANESKWFEKLDLSNFFGSTTMEWVLQMFSMVFPFSEVLKDERGRAEFAKAIELGFLDGGLPQGTPLSPIITNIMMIPVDFEIARTLREYNHQRFVYTRYADDFQISSKYSFSFTEIQNVIVSILKNFKAPFTINSTKTRYGSSAGQNWNLGLMLNKDNEITVGHKKKRQFQAMLSSYVMDRKNGIAWDKSDIQTMEGYRNYYRMVEREKIDGIVKHLSDKFGVDIVKAIKEDLAA

SEQ ID NO: 4921 - protein, 392 aa, unidentified
  source 1..392: note = Oscillospiraceae bacterium; note = Related to JAJPXI010000169.1
MVYQTVERGGFVYYITAKQSPRYHQMTLEEFLFGERESSKHYSLEFDPTGTKTYEVEHISDRFLSTVNVDWLISKLSMFNEQTKDLRQKPRRSLYSEFYIPKKSGGLRRIDAPEPELMTALSVLKTIFEQDFRALYHTSAFAYVKGRGTVDCMKKHQKNDSRWYGKYDLSNFFGSTTPEFVLHMFSMIFPFSEVLKNERGREEFKKAIDLAFLNGGLPQGTPISPLITNVMMIPVDFELTRRLRNFNDQAFVYTRYADDFQVSSKYTFSFRQVENLIAEVLRGFGAPFQIKSSKTRYGSSAGSNWNLGVMINKDNELTVGYKKKKQFRAMLSSYIMDHRNGVLWDRHDIQVMEGHRSYYKMVEGEAIDRIVDHINQKFGVNVVSMIKQDLAM

SEQ ID NO: 4922 - protein, 380 aa, unidentified
  source 1..380: note = Related to JAGHVH010000015.1; note = Oscillospiraceae bacterium
MYYVTVRQSPMYKQMSLEDFLFNTTASTATINANTANTRTYAVQSISGKFLKTVDVDVLVTKLAWFNSITKELHSKDRQDLYHSFCIPKKSGGLRQIDEPNEELMSALRMLKDIFENDFGALYHTSAFAYVRDRCTIDAVKKHQDNESKWFGKYDLSNFFGSTTKEFVMHQLEMIFPFCEVLKREDGRRELETAIDLAFLNGGLPQGTPLSPTLTNIIMIPVDYKLYNTLRNYNNQTFVYTRYADDFIISSRYSFSFKEIENLIKSTLEEFGAGFSINSKKTRYGSSAGSNWNLGVMLNKDNEITIGHKKKKQFQAMVASYIMDSKNGKSWDINDVQRLEGLRNYYHSVEPERIDEIIEHANEKFGVNFRKLIADNLKVA

SEQ ID NO: 4923 - protein, 382 aa, unidentified
  source 1..382: note = Bacteroidales bacterium; note = Related to JAFZDJ010000019.1
MTTYITVKQLPQYRQMTIEELLFGTEPADTCVNDGIGNTRTFVTENYATVDEYMKFIDPAHLIEVLRNFNDKVDCLRQVPRSSLYHSFSIPKRTGGLRRIDAPNEQLMEALRELKTILETEFHALYHTSAFAYVKERSTISAVKRHQMNESKWFAKYDLTNFFGSITLPFTMQILAKIFPFSVILRSRDGKIELEKALELGFLNGGLPQGTPLSPMLTNLIMIPIDHTLANALRDYNGQRFVYTRYADDFQISSRFTFQFREIESLIVRVLHDFNAPFRLKPEKTRYGSANGANWNLGVMLNKDNEITVGHRNKKIFQAMLHNYIHDRANGIFWELNDVQTLEGYRNYYSMVEKDTINKIIEHTDRKFNVNVRRMIAEDLRR

SEQ ID NO: 4924 - protein, 388 aa, unidentified
  source 1..388: note = Related to HF991826.1; note = Clostridium sp.
MYEQISIEEFLFNDNITNKVITQNSSNTHTYKLKYINEKLQDLCRVEDLILELDKFNSDYKSLRGISRENLYNTFFIPKHSGGLRRIDAPNAELMNALRRLKAIFEEDFHALYHTSAFAYVKKRSTIDAVKRHQQNGSNWYGKFDLSNFFGSTTIEFVMNMLSMIFPFSEVVKTKHGKDALEHALDLAFLNGGLPQGTPISPLITNVMMIPIDFKLSNTLRSFPCSQPNNLGETENYQRFIYTRYADDFLISSKYEFDIKEIEKFIVDTLSEFDAPFTLNSKKSRYGSRAGRNWNLGIMVNKDNNLTVGYKKKKQFQNMLASYIMDKHNGKEWDKNDVQVMEGYRNYYRMIEGEVIDRMVEHIAKKFGEEIIHRCNGSNLKLVLEDLR

SEQ ID NO: 4925 - protein, 378 aa, unidentified
  source 1..378: note = Siphoviridae sp.; note = Related to BK025872.1
MVYITVRQSPIYHQMTLEEYLFQSYQTPPVVNANIANTRTYEVENVSEHFSSKIGVEALIGKLVRFNNDTAELRAKERSELYETFYIPKKSGGLRRIDAPKAELMDALRRLKTIFEDDFHALYHTAAFAYVKKRSTVDAVKRHQKNSSKWFAKLDLHDFFGSTTLDYAISMFSMVFPFSEIVKEPQGEAALRTAMSLAFLNGGLPQGTPISPLITNVMMIPVDFKLSNTLRNFEKQSFIYTRYADDFIISSKYDFDVRSVEELVVSTLNSFGAPFTINASKTRYGSSAGRNWNLGVMLNKDNEITVGHKKKKQFQSMLYNYITDKNNGVAWERNDVQVMYGLHSYYRMVEKETIDAIVAYINKKMNVDVIRMMKDDLR

SEQ ID NO: 4926 - protein, 378 aa, unidentified
  source 1..378: note = Siphoviridae sp.; note = Related to BK047352.1
MVYITVMQSPIYHQMTLEEFLFQNFQAPTILNTNVSNTRTYAYETVSEHFTSRIDTDALICKLVRFNEQTEALRAQERSTLYETFHIPKKSGGLRRIDAPKPELMNALRNLKTIFEEDFHALYHTSAFAYVKNRCTVDAVKRHQKNNSKWFGKLDLHDFFGSTTLDYVIKMLSMVFPFSEIVKFPNGEAELRKALDLAFLNGGLPQGTPLSPLITNVMMIPVDYKLANAFRDFDKQRFIYTRYADDFIISSKVDFDVHRVEKLVVDTLHEFGAPFTINESKTRYGSSAGRNWNLGVMLNKDNEITVGHKKKRQFQSMLYNYITDKRKGISWPREDVQTMQGLHSYYRMVEPETIDAIVKHTNEKMETDVLRLIKDDLR

SEQ ID NO: 4927 - protein, 405 aa, unidentified
  source 1..405: note = Siphoviridae sp.; note = Related to BK027304.1
MESSHQWALTSIIYVGYNSRLRKGGFTLVYITVKQSPIYHQMTLEEFLFQTFQGPAVINENMTNTRTYEFESASAHFTKSIDVDALAWTLARFNQSTEELREKERISLYNTFYIPKKSGGLRKINAPNPELMNALRRLKTIFEEDFKALYHTSAFAYVKKRCTVNAVERHQQNNSKWFGKLDLHDFFGSTTLDFVMDMFSMIFPFSEVVKTVNGKTELRKALELAFLDGGLPQGTPISPTITNIMMIPVDFKLSNALRNFDNQRYVYTRYADDFIISSRYEFDVHKVEELVVFTLQNFHAPFSINASKTRYGSSAGRNWNLGLMLNKDNEITVGHKKKRQFQSMLYNYITDKKRGIEWSREDVQTMQGLYSYYRMVEEKPIDAIIKHIDDRMGVDVIRMIKKDLR

SEQ ID NO: 4928 - protein, 378 aa, unidentified
  source 1..378: note = Related to NZ_JADPFI010000030.1; note = Flavonifractor plautii
MVYITVKQSPMYHQMTLEEFLFKTFENDKLISKNTGNTRTYEFERISDRFMSRIDVNELVGYLAHFNESTAQLREKNRQDLYSTFYIPKKSGGLRRIDAPKPELMDALRRLKTIFEEHFHVLYHTAAFAYVPGRSTIDAVKRHQKNESKWFGKYDLSNFFGSTTLDFVMQQFSMIFPFSEIVKYELGKNELERALELAFLNGGLPQGTPISPLITNVMMIPIDYKLANKFRDFERQSYVYTRYADDFIVSSKYGFNVRTVERVMIETLAEFNAPFTINEAKTRYGSSAGRNWNLGLMLNKDNEITVGKRNKRQFMGMLHNYVMDRKKGIAWDKHDVQTMDGYYNYYRMVEKETIDRIVEYINKETNANVLQYIREDLR

SEQ ID NO: 4929 - protein, 373 aa, unidentified
  source 1..373: note = Related to BK039125.1; note = Siphoviridae sp.
MQSPMYHQMTLEEFLFNTYDAKSPVINQNAGNTRTYEFERVSNRFLSRIDVNELVGHLVRFNESTEELRNVNRQDLYTTFYIPKKSGGLRRIDAPKPELMDALRRLKTIFEEKFHALYHTSAFAYIKERSTLKAIQRHQNNESKWFGKFDLSNFFGSTTIDFVMQQLSMIFPFSEVVKYELGKNELRTALELAFLNGGLPQGTPFSPLITNVMMIPIDYRLANKFRDFGRQSFVYTRYADDFIVSSKYSFDVRMVERAMIDVLTEFNAPFTLNEEKTRYGSSAGRNWNLGIMLNKDNEMTVGHRAKKQFKNMLHSYALDRKKGVMWDRHDIQVMNGYYNYYRMVEKDTIDKIVEYINKETDCDVLRDIHEDLK

SEQ ID NO: 4930 - protein, 388 aa, unidentified
  source 1..388: note = Paludibacteraceae bacterium; note = Related to JAFVFT010000122.1
MVYITVKQGHHERQMSLEELFYEEYNPRRFSPRNTSDTRTDIRSAPSAEMMRYVDVIGLIHKLSEFNTQTKELRECNRQELYNTWFIPKKSGGRRRIDAPKPKLMLALRNLKSILEEDFGALYHTSAFAYIKNRSTLDAIKRHQQNESRWFLKLDLHDFFGSTTPEFVMKMFSMIFPFSEVVKSAYGKTQLETALGLAFLNGGLPQGTPISPTITNIMMIPIDHRLSNSLRGFSTERVNPKTLEPFKEHLLYTRYADDFLISDAYSFDWKKVQEYILNVLKEFDAPFTVNTKKTRYGSNSGRNWNLGVMLNANNEITVGYKRKKEFQRLAYQYITESRGGNKWPLEEVQHLQGLYSYYHMVEPETFDRIVKFMNEKYNADILTMIKRI

SEQ ID NO: 4931 - protein, 381 aa, unidentified
  source 1..381: note = Related to JAFUKZ010000113.1; note = Muribaculaceae bacterium
KEHDMPYITLQQSPIYYQLSLDDILDGAVDVSKMVVPNATNTRTRYKEILSEKFLNKFDFDAMIRVLEQFNEQHENLFNVERKTLYETFYIPKRTCGLREINAPVPELMDALRQLKTIFEVNMFALYHTSAFAYVKGRSTIDSIKRHQHNESKWFGKFDFSNFFGNTTEEFVFSMFSMIFPFSEVVKSQREANALRRALSLCFLNGGLPQGTPISPIITNVMMIPIDHQLCNELRAMDEHYVYTRYADDILISSKVNFDITKVQEFILSVLRKFNAPFSLKKEKTRYGSSAGRNWNLGVMLNKDNEITIGHQKKKTFKAMCCNYVEDKRKGITWDLHDVQVFAGLISYYRMVEREYIDYVIEHCNTKFNTNIELLIKQDLS

SEQ ID NO: 4932 - protein, 377 aa, unidentified
  source 1..377: note = Clostridia bacterium; note = Related to JAFSCV010000034.1
MPYITIQQSPIYYQMSFDDILDGTVDLSRMVVPNVTNTRTHFREFLKPSFLERFDFDLMIAVLEKFNEQHANLFNVERKSLYETFYIPKKSKGLREINAPVPELMDALRQLKTIFETNMFALYHTSAFAYVKGRCTIDCIKRHQQNESKWFAKLDFSDFFGSTTEEFVISMFSQIFPFSEIVKRKDGLEALKKALSLCFLNGGLPQGTPISPTITNIMMIPIDHQLCNELRKMDEHYVYTRYADDILVSSKVGFDCNKLQDYILGVLKKFNAPFCLKKEKTRYGSSAGRNWNLGVMLNKDNEITIGHQKKKTFKAMCCNYICDKKKGVAWDLHDVQVFAGLISYYRMIEKDYINYVIDQNNKKFGVNLEALIKEDLS

SEQ ID NO: 4933 - protein, 379 aa, unidentified
  source 1..379: note = Clostridia bacterium; note = Related to JAFXMP010000165.1
MPYITVRQPPPHQQITFDDLFFSTSVQDHFQPVRRDMSGTITRFVKEPKKELLQRTDINSMISCLEMFNQRHADLLAAERRSLYHTFFIPKHSGGLRKIDEPNENLMNALRELCSIFVNKMGVLYHTSAFAYVPGRSTIDAIKRHQANESRWFLKTDFSNFFGSTTEDFLYRAFSVMFPFSEIVKTKRGSEALKKALSLCFLDGGLPQGTPISPMLTNAMMIPIDHRLFNGLTKQGFVYTRYADDIQISSKYSFDYKEMVAHINGVVKDFGAPFVIKDQKTRYGSSSGRNWNLGLMLNKDNNITVGYQRKKQVKAMTNNFIVDHLNHIPWPKEDVRHFDGILSYCKMVEKEYFEHMIKAFEEKYKVNFKIMMKAALEQP

SEQ ID NO: 4934 - protein, 377 aa, unidentified
  source 1..377: note = Related to JAFTFD010000232.1; note = Lachnospiraceae bacterium
MPYITVRQRTEFRQITFEELILGIAPAPTRKHTSKGGTITRYVRNVDPSIRATVNMNALISSLERFNNLHQNLFDAKRESLYRTFYIPKKTGGLRRIDAPNDELMDALRELKTIFTDQFGALHHTSAFAYVENRSPVDAIKRHQVNGSRWFLKTDFSNFFGSTTEDFLYTMVSMIFPFSEVIKSRVGKEELKKALSLCFLNGGLPQGTPISPMLTNLMMIPFDHKFCNELSKKGFVYTRYADDIQISNEFDFNYHEIVQYISDTLKSQHAPFVIKPQKTRYGSSSGRNWNLGVMLNKEGDITVGHEKKKVFKAMVNNFIVDTLRCVPWSIEDVRHMDGLLSYYKMVEPDYFDHIIKSFNEKYKVDYHTMVRAVLKGK

SEQ ID NO: 4935 - protein, 379 aa, unidentified
  source 1..379: note = Related to NZ_JADNGR010000005.1; note = Intestinimonas butyriciproducens
MPYITLMQSPAFHQITFDEIISGVVDIPTMILPNESNTRTYFATRVNQKFLERFDFSEMISDLDKYCERHAGLYDKKRKSLYTTFYLPKKSGGLREINAPVPELMDALRELKTLFETKFFALYHTSAFAYVPHRCAVDAVKKHQSNQSHWFLKTDFSNFFGSTTHDFLMRMLSMIFPFSEIIANEHGKAVLEKALDLCFLDGGLPQGTPISPMLTNLMMIPIDHRLFNCLRDFKGHSYVYTRYADDILISARHHFDYAEIVDFINSTLKEFCAPFKIKDEKTRYGSRAGSNWNLGVMLNKDNEITIGTKNKQRFRAMLCNYTLDRKNGKPWELHDIQVLNGIMNYYKMIEKDYIEGVIKAMNEKFKTDIVSNMREDLGQ

SEQ ID NO: 4936 - protein, 373 aa, unidentified
  source 1..373: note = Related to JAFXEH010000357.1; note = Alistipes sp.
MQSPIFHQITFDEIISGNVNLANMVNPNETNTRTYFSKVLNPKFLERFDIDAMVVTLEEFCKQNAKLYEAKRSDLYDKFYIPKKSGGLREINAPQPALMNALRNLKTIFETQMFALYHTSAFAYVPGRSTIDAVKRHQKNESHWFLKTDFSDFFGSTTPKFLMSMLSKVFPFSEIVKSQRGFDALEKALDLCFLNGGLPQGTPISPMLTNLMMIPIDHRINNCLRDFNGNHYVYTRYADDSLFSSRKGFDKDEIIGFINSTLAEFGAPFKIKDEKTRYGSRAGSNWNLGVMLNKDNEITIGYKNKQRLRAMICNYILDRQNGRRWDLHDVQVLRGLVNYYSMVEKEYVDSVIKYNNEKFHTDVMKSMSEDLNQ

SEQ ID NO: 4937 - protein, 381 aa, unidentified
  source 1..381: note = Paludibacteraceae bacterium; note = Related to JAGCXD010000256.1
MYYITTMQHRKPRQLSWEDVIMDKLVMNDYVNDKSNSTATITRKYENIPDEVIKKINVELMVRWLHNFNEESKELFERKRESLYSTFRIPKQSGGFRRIDAPCEELQNQLRKLVTFISDDCGVLYHTSAFAYIKGRSIVDCVRKHQKNESNWFLKTDFSGFFPNTTLDFTMKMLSMIFPLSEICKRKDGYSELEKAISLGFLNGGLPQGTVLSPMLTNMFMIPIDHKLFNELAGRKLVYTRYADDIHISGQEHFPFKEIVTLIENTLAEFNAPWVIKKEKTHYGSRKGKNWNLGLMLNKDNDITIGWKKKQYFKAALCSFILDTKNKKYWDLGDVQHLRGQLSYYMMVEKEYFEKIIIQQNKKWNVNVKEMFKEYLNGTFA

SEQ ID NO: 4938 - protein, 375 aa, unidentified
  source 1..375: note = Related to JAFUNX010000245.1; note = Clostridia bacterium
MPYITVMQSPRFHQITLDEILSGEVQVSDIAPRSVTGTVTHFSERLNDRLTRLAQVDELVAVLETFIQKNESLYEQKRSKLYNTFYIAKRSGGLRKINAPLEELMSALRELKEILETKFSALYHTSAFAYVKCRSTVDAVKKHQTNNSRWFLKTDFSDFFGSTTPEFLMKMLSQIYPFSEVVKLERGRVVLSKALDLCFLDGGLPQGTPISPMLTNLMMIPIDHRIANELRRNNFVYTRYADDIIISHKFDFSFTEKCDFINQVLAEFEAPFKIKPSKTRYGSSSGNNWNLGVMLNKDNKITIGYQKKKTFKAMCYGYITSKQNNQPWDRHDLEVFNGLISYYKMVERDYIAYTIDHYNQKYGVNMMAMIREDLR

SEQ ID NO: 4939 - protein, 382 aa, unidentified
  source 1..382: note = Siphoviridae sp.; note = Related to BK054953.1
MPYVTTFMTRAKKQLTLEDVLFGVKNLSPYINGVDFGTSTRTYEYKKLPQELKEMARVPYLIGKLKSFNRTYQPKFDANNMREHYNSFKIPKKSGGWRQIDAPDDELKQALYSLKAIFENDFKVLYHTAAFAYIKGRSTTDALKVHQRNNSNWYLKTDLSNFFGSTTLEFTMRMLSVIYPFCEVVKYEDGEKALRDAISLCFLDGGLPQGTPISPLLTNVIMIPIDHEISRRLRASETNDFVYTRYADDATVSSKKGFLFMGVIEMMNDVFKKFDAPYTIKKEKTHYGSRAGRNWCLGLMINKDNKITVGHENKKVFKAMLNNYIVARKDGKGWPPEEVMTLRGKLSYYSNVEPEYFDYVISWYNKKYHCDVIKMMADDVAA

SEQ ID NO: 4940 - protein, 390 aa, unidentified
  source 1..390: note = Siphoviridae sp.; note = Related to BK046396.1
MIYVTVRITEPYKQIALEDIMLALFQGENVRERTPRSPYTRTFTYERLPERILAGFDVEKKIGLLRTFNKKHHNLMESDIREHYHKFFIPKKSGGMREINAPDDELMNCLRELKLLLESEFYASSHAAAYAYVKNRSSVDAAKVHQWNKSKWYLKTDISGFFPNTTPEFVWNALSMIYPFCLIMECKSGREELRKALSLCFLDGGLPMGTPISPMLTNLIMIPFDFEFSKFLRSLQNPENNPDKKGRRFAYTRYADDMNISCGIEFDKSFIIRKIENLFRLFGASYIIKDEKTHYGPSYHKNWVLGVMINKDNQITIGYKKKRNFEAMLFNYAKDRESGTYWPLEQLQYALGLMSYYRMVNKESIDGVIIRYSQKFGFDIEAAMKKDLKN

SEQ ID NO: 4941 - protein, 376 aa, unidentified
  source 1..376: note = Related to JAGZNC010000011.1; note = Firmicutes bacterium
MPYVTTPLSPVTRQLTFEEIIMGEVDVSRPVYSNATNTRTVFVKSISNEVAQKARVASLTKQLQEFAENFRGLYEVDRRSLYDTFYIPKKSGGLRRIDAPNDALMAALRVLKTILEGAMPADHHTAAFAYVKGRSAVDAVKRHQRNDSHWFLKIDFSNFFGSTTKEFVVKTMMEIFPFCLLGEDGRTALETALELCFLDGGLPQGTPISPLLTNIVMIPVDHQINKRLAKDEGNSWVYTRYADDMLISAHKSFDPKRVMDLISAALQHVEAPYIFKREKTRYGSRAGSNWNLGVMLNKDNEITIGHKKKERFRAMIHNYMTDRQNGTAWDPHDIQVLCGHIAYYRSIEPSWVCDLLERYSQKFGRNVEDTMKEDIR

SEQ ID NO: 4942 - protein, 464 aa, unidentified
  source 1..464: note = Related to JAFVSI010000063.1; note = Clostridia bacterium
MPYITIPVRQKEYQISFDDILNGINESFFAMMMDDTCDTRTVYRDHTPPRLLEKINIGAMVGMLEKFNNRHREYFDVPKENLYETFYLMKKNKGFSVVVREIFKTHNANSGISYSGKDVYADVFAILKGLLTNHPCAEHNRIEQETLAKCVQYLTPLGFEVNEEKIKSFIKAGFRRIDAPRAEFKSVLTDLKITFENKLFGSYHTSAFAYVKGRSTIDALKRHQRNNSRWFLKLDFSNFFGSTTHEFVLRQLSSIFPYSEIVKSERGREALSKALSLCFLNGVLPQGTPFSPTITNIMMIPIDHAIAKMCREHSPHLCYTRYADDILISSDLSFTWEVDKEGSVQNEILDILRRFNVPFSLNTEKTRYGSSAGRNWNLGLMLNKDNEITIGHEKRKAFKAAVYSFLNDYTHHRVWDVEEVQVLGGQIAYYRNVEKENIDAIILAYNQRFGVDMMQIIKDIISNR

SEQ ID NO: 4943 - protein, 369 aa, unidentified
  source 1..369: note = Related to JAFTOK010000250.1; note = Clostridia bacterium
MRQITIDDILNGIDESKLALQKDTRDTTTWKVDAISRELIEKTDFYAMQVALMEFVEKYKDLIAVEDKSTLYRSFKIPKRSGGLRQIDAPNDELKKALYELKFIFEKKFYMSYHTSAFAYVHGRSTIDSVKRHQQNNSRWFLKTDMRHFFPSTTPEFLMKMLCMTFPFCEFIRYDFGCKELLEKALSLCFLNGGLPQGTPTSPMLTNALMIPVDHAINKMCHEYAPHLCYTRYADDILISSQYNFKWSDVQGRLISILETFGAPFTLHPEKTRYGSSAGRNWNLGVMLNAENKITIGHEKKKVFKAMVFQFMTDDAKGNHWSLDDVQHFLGLISYYRMVEKDCINEILQTYSQKFNKDVEATAKALLKP

SEQ ID NO: 4944 - protein, 410 aa, unidentified
  source 1..410: note = Related to BK028778.1; note = Siphoviridae sp.
MYITYWNPPKTRQITFDEIIAGVQNVEALHYGGSTTSTITVCRNDLTPRLQKITNIPDMIAKLTEFNQKYAGLEACDLAAHYEHFEIPKKSGGWRPIDAPDKELSDALVELREMLRTFMIADYHTNAFAYIPNRSFIDAVRKHQAGHVKTKKNEETGVQTTVTFENHWAVKFDLHGFFPSTTPDFLLGMLSIIYPFALIMKDERGHEQLANALKLCFLHGGLPQGTPISPWLTNVMMIPFDHLITRKLCYGYKAKDGIEREFTYTRYADDMMFSCYHSFDPMEIQQIVIDGLNFIHAPFTLNEAKTHYGNRHSSKNWCLGLMWNKDNQITVGWRNLKMFRSAMKNYIDAKKRGETWELEDLQKFMGKLNYYHMVEPEVIDDLVHRYNEKFGVDVMAMLKDDLRLKDGEAA

SEQ ID NO: 4945 - protein, 410 aa, unidentified
  source 1..410: note = Related to NMTT01000002.1; note = Faecalibacterium prausnitzii
MYITYLNPPKTRQITFDEILAGVQNVEALHYGGSNTSTMTVCRNDLTSKLRAITNVPEMIEKLVDYNVKYTALESSDIPSHYSHFEIPKKSGGWRPIDAPDETLSDALIELRELLKSFMIADYHTNAFAYIPNRSFIDAVRKHQAGHNKTVVDEATGMKKVVNYQNHWAVKFDFHGFFPSTTPDFLLGMMSVIYPFALIMRDARGRDELAKAVNLCFLRNGLPQGTPISPWLTNVMMIPFDHCITRKLCYGYKAKDGIDREFTFTRYADDILISCYHHFDPMEIQQIIIDALNFFHAPFTLNETKTHYGNRHSSKNWCLGLMWNKDNQITVGWRNLKMFRSAMTNYINAKQHGRTWELEDLQKFNGKLNYYHMVEPEVIDELIRRYNAKFGTDIIAMLKEDLRPKEGVVA

SEQ ID NO: 4946 - protein, 410 aa, unidentified
  source 1..410: note = Related to BK028800.1; note = Siphoviridae sp.
MYITYWNPPKTRQISFEEILAGVTDISNLSRGGDNTSTMTICRDNLTPRLEQITNIDSMINQLAAFNRKYAELESSNLPSHYYHFEIPKKTGGWRPIDAPDKELSDALSELQRLLKSFMIADYHTNAFAYIPNRSFIDAVRKHQAGHVKTKTDPETGEKKTVCYENNWSVKFDLHGFFPSTTPDFLKGMFSIIYPFALIMKYPRGQAELDKALNLCFLNGGLPQGTPISPWLTNVMMIPFDHLITRKLCYGYKMKDDIEREFTYTRYADDMMFSCYCSFDPMEIQEIVVNALEFIHAQFTLNAEKTHYGSRHSSKNWCLGLMWNKDNQITVGWRNLKNFRCALTNYVEAKSHGRTWELEDLQKFMGKINYYYMVEPDVIEDLIQRYNKRFNVDIIAMLKDDLRPKEGVVA

SEQ ID NO: 4947 - protein, 410 aa, unidentified
  source 1..410: note = Bacteriophage sp.; note = Related to BK021062.1
MYITYWLPQKTRQISFDEIMAGILNVNQLKNIGDKTATVTVCRNDLSDRLFRITNTPEMIAQLYAFNEKYVALEQCDLKTHYRHFSIPKKSGGWRPIDAPDKELSDAQTELRELLNGFMIASYHTAAHAYIQNRSILTAVRKHQAGHIKKKFNPELGYSETIVYENNFAASFDFHGFFPSTNPEFLLHMFSQIYPFALIMRSQNGDEQLRKALSLVFLNGGLPQGTPISPWLTNVMMIPFDHLMSRKLTRGYTMKDGVEREFTYTRYADDIDISCPLSFDPLEIQQIIIDALHFINAPFTLNEKKTHYGNRHSCKNWMLGLMWNQNNEITVGWRNMKYFKAALANYIDAKKHGRSWELEDVQTLNGKISYYKMVEKNVVDYIIATYNEKFKVDIEEMIRADLRPVDGYAA

SEQ ID NO: 4948 - protein, 411 aa, unidentified
  source 1..411: note = Related to BK018054.1; note = Siphoviridae sp.
MYVTYWNPPRTRQITFDEILSGVVDVNQLKYAGDETSTQTVQREGLNDRLVAITNVTSMITQLTEFNQKYARLEAVRDLSTYYYHFEIPKKTGGVRPIDAPTNELSDALVELRTLLKSFMIADYHTAAHAYINGRGTLSAIKKHQAGHRYTVKDRETGKEKIVTYENNWAVKFDFHGFFPSSTPEFIYSMFSKIYPFSLIMKDRNGYNQLTKAMRLCFLNGGLPQGTPISPWITNVMMIPFDYMLNKKLSYKYTMKDGISRTFTYTRYADDITISCYLSFDPMEMQDIIKETLDAINAPFTLNEEKTHYGNRHSSENWMLGLMWNANNDITVGWRNFKDFKKMASNYIVCKKEGKTWDLEDLQQFNGRLNYYRMVEKESVDTVISRYNKKYRVDMMAMLKADLKPKEGVVF

SEQ ID NO: 4949 - protein, 410 aa, unidentified
  source 1..410: note = Siphoviridae sp.; note = Related to BK018962.1
MYITYKAAPKTRQITIDEILAGIIESEKLKYREDVTSTVTACRDELTPRLRAMTDINRMIRELEAFNKKYEQLESEPDMSVHYTHYEIPKKTGGMRPIDAPDKILSDALNELQTLLKSFMLADYHTAAHAYVPHRSTLTAVKKHQEGHVRTKTNPTTGKKEQVIYENNWSVKFDFHGFFPSSNPEFVMGMLSVIYPFALIMQDPFGGHEALSDALKIAFLRNGLPQGSPLSPWLTNVMMIPFDHLLSRKIRHGFKMKDGIARDFTYTRYADDITISCYLSFDYMEMQDVIKNILAYIHAPFTLNEEKTHYGNRHSSKNWVLGLMWNQDNEITVGWRNIKTFKIMMSNYIRCKKENATWTIEDVQELNGLISYYKMVEKDKIEALISKANNKYHVDVMAMIKDDLRPKDAA

SEQ ID NO: 4950 - protein, 444 aa, unidentified
  source 1..444: note = Related to BK018504.1; note = Siphoviridae sp.
MLAQKLIKTSPEAHQSNERPIGNRRLELLRQPTSLSEHKHNPHIRSTHMVYITYNCPERFREMTFEELLRGDFNLANLSTGGHGATRTVICNKVPPRIMRITKVEQMIFQLQAFNQQYESLRLTTPRSSLYNHFSIPKASGGLRWIDAPNPDLMKALKELKTLFQSWMFADHHTCAFAYVEDRSVLSAAKRHQKFNAWWFAHFDFHGFFPSTTPEFVLSQFELIYPFNLILASPIGHAELFKALDLCFLNGALPQGTPISPLITNIMMIPFDHAFAKAVNHFESGKHNPDGTPITDRLCYTRYADDIEVSCKVIFNYHAVERLIVQLLSQMNAPFTLNETKTQFHSRAGRNWILGVMLNKDNQITVGYRKNKIFKATIDTYFRDKQKGKKWPDEDLQSFQGNITWFKDVQPDTTKYIIQKYNAKYGLDLESCIKADLAPPSVTA

SEQ ID NO: 4951 - protein, 396 aa, unidentified
  source 1..396: note = Siphoviridae sp.; note = Related to BK037618.1
MVYITYNTPETVRQITFEELMLGVDIPLDSLRSGGHGSTRTVVCSKVPERIMKITYLDAMISQLKMFNTCYKDLIDYPNKWELYDHFEIPKKTGGKMRPIDAPHPELKKALAQLKDMMSGWMFADHHTCAFAYVNGRSTKDAVIKHQRFRSWYFCHFDFHGFFPSTTLHFVLKQMEEIYPFNLILADPIGRRELRRALSLAFLNNGLPQGTPFSPFITNVMMIPFDHKFARLLNQFQSGKCNPDGTPITDRICYTRYADDIHISCRVFFNYRKVERELIAMLHELGAPFTLNTEKTHFGTRAGRNWMLGLMLNKDGDITVGYRNHKILKSTIETYFKDRRNGKKWDEEDLQKFRGNISYYLSVEPATIAGVIQKYNAKYGADLLTCISNDLKPKAA

SEQ ID NO: 4952 - protein, 384 aa, unidentified
  source 1..384: note = Siphoviridae sp.; note = Related to BK023886.1
MPYIVVKAPPRYRQVSVDEFLFEDEARTSYVALCETETITRFRDHIPGNVRDAYNIPLAIRALQSFNETHSELFEPDRTALYHTFYIPKRSGGGVRRIDQPLPELMNALYELRRIFESMFHADMLYHTTAHAYIHKRSTVTLVRKHQQNASKWFAHYDFHNFFGSVTPEFLSKMFSMIYPFSAVMQSAGGKAALEKALSLCFLNGGLPQGTPISPMLTNILMIPFDHKFSNHLEAFGERNYVYTRYADDISISSRSPFDYKKVEAEIAASLKTMEASLELNRKKTSYGNNTGSNWMFGMMLNSKNNITVGWKNVKAFRSTLNTYLYERSQGRFWPLEQVRSLSGTISYYKMIDEQWLNSILDIYNQKYKTSVRYCLKQDQKRKQ

SEQ ID NO: 4953 - protein, 381 aa, unidentified
  source 1..381: note = Siphoviridae sp.; note = Related to BK050993.1
MCYYVCLPKTESKPNIWSWLEGDIHSPQWLWGTKSAAATVTRRVDFISASVKDKYNVNFIIGTLDAFNKKWSYLGQEIEKHYSHFYIPKKKLDEYGRVKWREICAPDDELSEALKDLKEIFEAAGVSLHHTNAYAYVRHRTASDAVSKHQYNHSRWWITTDFQNFFGNTTKDFLMSMMAQIFPFSAVIERDFGKECLSRALDLCFLNGGLPQGTPISPMLTNIMMIPFDYIMTKKCREKDYIYTRYSDDIQVSHRRKFNPDEVLRFIHETLTQIHAPFTIEKEKTKFKSGNQFVLGVMYNQNCDITVGHKNKKEFKATLFNYMCDRLSGKVWALPQLQQMMGKYAYYSMIEKEYFENVMKEYSRKFKQDVMKCIKADLRRC

SEQ ID NO: 4954 - protein, 398 aa, unidentified
  source 1..398: note = Related to BK019042.1; note = Siphoviridae sp.
MPYVTLQMNPVYTQLSLEDILDGDLDPKRFMPVRNAPSSTRTVYRTQLRQDFINRFNVPGMIRILKEFTTKYAALYDRNRKDLYYHFEIPKNTIDPATGRYGMRPIDAPEPELKLAQYELKSILENQCGASYHTNAFAYIHNRCAVDAIRRHQANHSKWFLKTDFHNFFGSTTPEFLKYMLSMIFPFSEIYQDPEGEAALDKALDLCFLNGGLPQGTPISPMLTNLFMIPIDHRLANVLRDHDGVHYIYTRYADDMQISSKVKFNYGNIVQYINQTLAEFHAPFRLKDSKTRFGSANGHNFNLGVILNENNDITIGYKRKMAFRSQLYDYIQHHLRHDPIPMHDLQVMAGLLSYYTSIEPDYWRQTIERINSKNHVDLNKIILADLGTAARGGEDVPF

SEQ ID NO: 4955 - protein, 410 aa, unidentified
  source 1..410: note = Related to RAYA01000099.1; note = Butyricicoccus sp.
MQFTSLARPSLQWTAHIKVTEKKGFVMYITYKVPPRYRQMTFEEMLSNETNLSEFKYSSNSMTRTIVRKVLPSKLVDFTDIPRLIKQFEDFCEKHKALYEVPRASLYDTWRTPKKKKGPHGETKYRTICRPNSQELRDAHTELQRILEDSMIASYHTRAYAYIKNRRTKDAIQVHQKWKSKWFSDFDFTDFFGSTTLEFLSQMIFMSYPFCLIPEEHRETVRKALDLCFLNGGLPQGTTISPMLTNLMMIPFDHMVSNELHKHDGDRFVYTRYADDIRISCRVQFDVKQMESYLIKKLRQFDAPFTINPEKTGYGSINGKNFCLGYMLNKDNQITIGHERKKRCKAMVNNYILDRMSGQPWSLHEVQVLNGQLNYWRYDNEDGTYAVMINFYKRKYGCDVEKWIKADLSA

SEQ ID NO: 4956 - protein, 444 aa, unidentified
  source 1..444: note = Related to BK053663.1; note = Siphoviridae sp.
MVIRVLAIYDLSQPNKAFIPVISPSHRIQNPTQITETTHRKEYMMIYITYSQPARYHQLTFEEMMAGITVNDIAELRTGTVSGTRTVCLKRVPKKFRDAANIPELRARLQMFTDTYNTMISNPNRQSYYYKFFIPKKSGGLREINAPLPDLRAALVQLHTILSGAMLADHHTAAFAYVTGRSTLDAVKQHQKWESMWFVKFDLHDFFGSTTLDFLMSTFSKIYPFCILCEDKSGEDLLRKALSLCMLNGGLPQGTPISPFLTNVMMIPFDHRMFNTMRNFRLSENRTDRFVYTRYADDMCISCRAGFRYKTVEDYIVSTLKWMNAPFELNREKTHYGSRCGRNWILGVMLNKNNEISVGEREKKYFESMLTSYYMSHGRGTYRGHFDKALTKPWPMEDVRRLHGLYSYYKMVEPARIAEIIEEYNKKFGMNFEALLKMDEQLIA

SEQ ID NO: 4957 - protein, 389 aa, unidentified
  source 1..389: note = Related to BK018887.1; note = Siphoviridae sp.
MENKIMITIPQPERFRAPTFDDYLRGLNSFDQLKTYDATGCVTRMVNVEAVRGKFDLSAFKLVLNNFLTATEKLRADDIHTHYHSFKIPKKSGGLRQINAPDDELKFALQMLVNILSNVMPRTYHTNAYAYVTGRCTYDAVAKHQRWESNWFGHFDFRKFFDSTTKEFLMSQMAKQYPFALIKEDVETWTKLSQALDLCFLDGGLPQGTPASPLLTNIMMIPFDYEVTQDIKSMPNRKCPNGTDRFIYTRYADDIHISCRVEFDIKEQERYLIKKLREQNAPFTINAEKTHYGNRSGQNWMLGYVLNASNAISIGHQNKKHIKAMIHTYAMDKRNQIMWDKDDLMTMLGKIQYWRFSEKELVDYTLERLSQKYGFDVLEEIKTDMGNAA

SEQ ID NO: 4958 - protein, 384 aa, unidentified
  source 1..384: note = Related to NFKQ01000002.1; note = Anaerotruncus colihominis
MPYITLRALPNYHQVSFEELLTNSIDLKQFFYNKTPSNTRTHYVQNVNKKLITSINFDDMKKSLYHFIDLNQQFFNGTISSLSTMYDTFYIPKSSGGLRRIDAPNDELMRTLKDLKRLFEDKLLAIHHTCAYAYIPGRCPLDAIKRHQSNESKWFGKFDFNNFFGSTTQEFLESQLKQIFPFSELLNDAQISGLFHQVLSLCFLNNCLPQGTPMSPMLTNIMMIPIDFHISKWLRSLDKHTFVYTRYADDMQISSRSPFNIGKVQNLILDVLNSFHAPFRLNDEKTRYGSTSGSNWNLGLMLNSQNEITIGYKRKKQLKIMLNNFLYDYSNGKFWDASEVRHLQGQLQYYLSIEPDYISYLVDRYSQIHNVKIYDTFSKILKSN

SEQ ID NO: 4959 - protein, 388 aa, unidentified
  source 1..388: note = Related to JAGOJH010000182.1; note = Thermoclostridium sp.
MLFTFYKKEAETNVNFTDLLDQFYKGTMPLYHPEEIKSYKKTITVTLPAPITDEAANEKYHVDKMVEALKEFEVAIDLLNNIPRKDLYRFFTIPKRSGGLRQIATPCPELMATLRDLKNVFEYKIKCLPHNAAFAYIKERNCKHALEVHQRNKSRWFLKLDIHDFFGSVTVHNMMTEFGKIFPLQTIMERVPELFVKILDICTLPNEQGQCVLPQGTPMSPLLTNLYMIGFDHTIQNTLRDYNHQQFVYTRYADDLLISSQYDFDYKELTAYIASVLQLYHLQLNPDKTRYGSNAGRNWNLGMMLNKDNQITIGHQQKERLKAMLHNFLRDFTLGKPWSIIDTQVLVGQVSYYRNIEPTYVRELIKKYDEKLNTDFKQCVKKILRPKT

SEQ ID NO: 4960 - protein, 397 aa, unidentified
  source 1..397: note = Bacteroidia bacterium; note = Related to RZYM01000024.1
MLYTYKIKYVEERHNVENLLDVLYGDAPAQTETVRSKTNKVYNDFSYDRFKTTETTPERFILTSPHVNSDEQTLRQIYNLTAEIESFLNNNPSPATMYHNFKIPKRTGGFREINAPNETLMKFMRDIQPWFTYKLNALPHDSAYAYVYKRDCNKAIQRHQAIKSNWFLKLDIKKFFDNCDPAFLRQQLKMIYPFGIMRDQDYHRFMDALILLITLNNGLPQGTPLSPVITNLIMVPIDRDINKKLGTYFKDKQQSFMYTRYADDMLISSNKEMNVQEVVGIIDTILHTYTNKLQINPDKTRYGSKAGSNWNLGIMYNKDNKLTVGYRRKKKIKTMLFQFYSCYNEGTRDKEYAQAILGELAYLHNIEPEYTRELVRFMDDKYSTDFYTILHKTVKEN

SEQ ID NO: 4961 - protein, 354 aa, Bacillus sp.
  source 1..354: note = Related to NZ_JAEHBI010000004.1; note = Bacillus cereus
MYYTHNTKNQNDSKYQRFSTTKLKSEEITIEQYREFEAINKQILGLTKKIKDWLTNNQSAIKYSIFNLPKMTGGFRTIKAPEEKLKSFMREIKFDLESIGIVPHDSAYAYIPNRDCLKAIQCHQRNKSNWFLKMDLEKFFNNCSEQVIAIQLKKLYPFSLMTETDYTSFISSLCGLACHENELPQGTPLSPILTNWLMISIDTQINNALAERSEESFIYTRYADDLLVSSKQPFRHEEIVELVKGVLEQEGTPFTIKDTKTRYGSRSGKNWNLGIMYNKDHNLTVGHKRKRRIKTMLFQFYRGQRDRGYALELNGELAYLKNIEPDYHDYLIGFMNSKYRFNFKKAINIAIKQN

SEQ ID NO: 4962 - protein, 382 aa, unidentified
  source 1..382: note = Related to JAFPMR010000005.1; note = Bacilli bacterium
MYITSIKKNTGPGNSKAQLNLIDSLFGEYQEPDIIIDAGRFIRTRTTSASTNALMDLNNYDNNVRYLYRKISNFLYGHEIPSMYYEFKIPKKSGGLRTIDAPNDELKTFMSEITHEFGNKFKLLTHDSAFAYVKNRCVVDAVKEHNNNGSRWFLKIDLHNFFGSCTKDFIVQQLKQIYPFAKHEAETPTKDLLNALADLATLNNGLPQGTPLSPMLTNWIMIPYDYRINLLLNTLVKQEKLLKQRYIYTRYADDIIISAKEKFDKDIIVKEIKKLFEHSPLEINETKTRFGSNAGRNWNLGVMLNKDNNITVGHKRKRYIKDNIYYFIKFKETWDKEQCRWLLGNLSWLQNVEPEYCIGLLNYYKNKYSFDVLRELHLVLKR

SEQ ID NO: 4963 - protein, 365 aa, unidentified
  source 1..365: note = Related to JAGCTX010000238.1; note = Pseudobutyrivibrio sp.
MYLTFYTNAAPKQLTWADILNNPYITRQTSDITKKKVTKEIPDDYAEILWAKRRVMYNPNLIPTDVTAIDTSEHYRHFQIPKKSNPTKMRQIDAPDDFLGNIQTMYKNQIENELQVLSHKAAHAYVAKCSTVTAMQTHQRNDSKWYLQIDLKDFFNSITGEWLKTQLLQVFPFPLIEERELDKIIHVSLLNGTLPQGSHLSPLLTNLAMVPIDYVLTEKLHNLNGHHYVYTRYADDITISCKEKFNEHMILGLIKHIFREFNVPFRVNNDKTKFGSIAGRNYHLGIIVNKDNQLSVGHEKNQKFRAMIFNFCTIGDEWELHDVQKMLGLISYYKAIEPDFVNKVINKYNEKFNIDIMSKAKAMLT

SEQ ID NO: 4964 - protein, 394 aa, unidentified
  source 1..394: note = Siphoviridae sp.; note = Related to BK022447.1
MRHLNSSDLQRLPVITVMEETKMYYTIHREKINYPEVTLRKILLNKPIPEKTKLREYTTVEIPDTTNFTLTEDAIRFRDYILNSWESLSKSSIQLYSSFKIPKKSGGLREIDAPVQGLKTIQSTLAYWLQDELRILPHDAAYAYVKGRSHIESLKKHQNMQAKWFLKIDFSNFFPAHNKEYILNMLEQVYPIGALIKNDRAVISKMLDICLLNDKLPQGTPVSPALTNICMVPIDYAITNLCVTLGKKYNTFFTYTRYADDIIISAGKSFKWTGVIKEIENILNNFNAPFKINNKKTRYGSNTGRNWNVGLMLNKDNRITLGHKNNKILNAKINRFCYENIVEKKTWTVPEIQELQGNIAYAKAVDPDYTNYILHKYTVKYKTNVEQCMKNMLY

SEQ ID NO: 4965 - protein, 384 aa, unidentified
  source 1..384: note = Related to JAFQSJ010000047.1; note = Clostridia bacterium
MYISYINKKNNQIETRDTSGPTEKNIQELGKRLQCFYYLYEEALKILQNGDVSSRYRTEDRLKKNKTRRRIDVPDEELMKYQKKVVDIFNNHLALVFPQSVYGYVKGRSPKAMAEVHRNQYQVIKMDIKDFFPNCTLDFIMKSMSTVYPFCLLDSELIETIIKPCMIFYDGQYRLPQGAPTSPILSNIAMIPVDYELESGALNGRGYNYTYTRFADDIIISHGEFDFSSSISAEERILSLIFGIEYEEPPKSLEEKYSEIKKITCNVINTIKDCLHNQNPNFKINSEKTKVLNTECGNVWMLGVTVGQDVKIGNQRKQGLKATLWTFLNDCKNGKPWSQKDTRHMLGILGYAKYIEPNFVNELIAKYEQKTGTSFRKEVKKILC

SEQ ID NO: 4966 - protein, 376 aa, unidentified
  source 1..376: note = Related to JAFQSS010000025.1; note = Clostridia bacterium
MYITYIDQDKMQKVTCSTNIITERNIAYAERENGSLISLAEEARELLKKGVNSKYTTYYKKKSNGQKRQINVPDDELKAFMRKVVKTFTAMSGFMWPDNMYAYIEGRGIKQHAELHKNAAVIIRMDIKSFFDNCTFKFVTESMKEVYPFCLMDWNLLEPIVKACMLKGRLAQGAPTSAILSNIAMIPFVTHANNWTKAKTITLGLAPRGKYFKMTKGTRRKATSIVAKRIIFSMYADDIIISTNIKAPFGENAWKTIRIIQKLLNWYTPLQVNPRKTKYVDIRRKGGAWVTGLMVNKEHNVTVGREKKEKLKATIFSFLADCKNGKPWDEHRVRQMMGTVSYIRHIEPEFVDMIIQKYNQKLNIDYHEQIKNIIYS

SEQ ID NO: 4967 - protein, 386 aa, Desulfovibrio sp.
  source 1..386: note = Related to NZ_JABAFY010000049.1; note = Desulfovibrio piger
MRENVVEITRTHITGGAANPVSHIENWYDLAAVLGLKTGTLSYALRERDKLQTKIRLGDRTVYKSGRALKVIQSRLTTLVEPLFDALPGNECALAYRTGVSATDRIREIPHARMLVTFDIRKYYDNVTLRHIEECLRGCGFRTLGARLVGRYCVVRREGRCTLQQGSPVSPAISNIVGHFYFDTPIRAWLGSEFPDVRATYVRYCDNIALFLHDGVPEGFTDKFKSFVRETFRSGGFRTHKWNCITDSNPVKNQKFLGVVLNAEARVELVVVDRLRAILFNWCLFGGQCTADRFMSEEGIQLRDFMFDGMKVGKLRQIMRGHINYVKRINSKHGLWLDKLLGAALYLDEKGMPACANEEMFRRVKKYKDCNESYDDFMAGITSITG

SEQ ID NO: 4968 - protein, 382 aa, unidentified
  source 1..382: note = Siphoviridae sp.; note = Related to BK057640.1
MQILRTYVEDQRTNSVRHIRDWYGLAAVLGLKTNILAYALKERDKLQTRIKLGDRTVYKSGRALKVIQSRLTTLVEPLFDALPGNECALAYRKGVSATKYIRESIPHARLLVTFDIKKYYDNVTLKHIEECLTKCGFQVLGARLVGRYCVVRKGNRSTLQQGSPVSPAISNIVGYFHFDVPIRSWLTSEYPDIEATYVRYCDNIALFVHSDVPDGFTEKFKSFVKRALGDGGFRTHKWNCITDSNPVKNQKFLGIVLNSQARMELCIVDRLRAILFNWCRFGGFAAAERFMAEEGIQLREFCIDGMKLAKFRQVMRGHINYVKSINEKHGLWLDKLFEAATYLDARDLCACNNAELFRSIKKYKNGNEPLDEFMRGVEASAG

SEQ ID NO: 4969 - protein, 430 aa, unidentified
  source 1..430: note = Candidatus Cloacimonetes bacterium; note = Related to JAJBAW010000005.1
MKCQKYTEEVFDSPLSLVHGWDELGALLKIKTKYLSWVGGKDKNGSLRRNHMQHLVKVKGRDTYKSDTTLARIQTALNIPFDQIQDSFPHEHLLAYRKGVNYKKELQKYLGRKYMVHCDIKGYFDNISMRKIVKTLCALGAMSEAGAKLIARYCIVRRRQSDRWVHTLQQGSPCSALLSNLVGYALYDRDILAWVARKQKEYPRASLEYVRYCDNLVLFVDGDAPLELIKEYRQYVHVVMSRRGFQTHKWSVTPKNHPFRNQRFLGVVLNVKARVDLERFQRIRAALFNACRTSVTEAANTYFSLYPFRAAEFPTENVGEDRAVFAITQHARDEQFLSIMRGHVAYIDSVSKEQGSLLKKLFQACVFLRENPQGVSQRLAEPVFLALKTYNRKVESVEVFLERLSSACSRTRNSSESLTQENTGHWESVL

SEQ ID NO: 4970 - protein, 384 aa, Desulfovibrio sp.
  source 1..384: note = Related to NFJC01000017.1
MKLRSTEASQMMKLIDNFSELGSLLHIKNNHMAYARKFRDDLRRKIKVGKRTVYASKSPLSVIQRRLGMVFNIMMDDLPYNEVAIAYRPGVNVAEKLAVCQGSAIMIKTDIRHYYDNISYAHIEKALMDCGMIARGARLIASYCTIWNGRFSSLQQGSACSPALANIVGNRYFDRPIVRWLRDHCPVEHTYYRYSDNLVLFCKEEPGNDFINEYKEFVKTTAARGEFRTHSWSSIRNNHPTRHQEFLGIVLNEVANISRVKRDRIRAILWNAVVGNTAEEAKKYFADTGELPRGIADEEEVYTTKFMMAMQGYVAYARMIQDKFANRIAKLLIAVRIKDGYFNEDGMIFKYGLDNKHIECAKLYKDDSVGIEEFRRRFLDCLSS

SEQ ID NO: 4971 - protein, 325 aa, unidentified
  source 1..325: note = Candidatus Saccharibacteria bacterium; note = Related to JABCOO020000008.1
MMLYDLIGVSKNDFDNFIENINSVVIKEGTHWKHVNPSSHNSVSIKFDKYFEDQFKNVISASSPKQGAFCGKSIIQLLAPHSSKKYVLTLDIKNFFGSINFHKVQECTKDHSSLQLYSDIIHIFYFGGDDQLRRGLKGSAAIAEVVGLKIDHLIRKIIYSNKEYSNKDLVYSRYYDDIIISGDSFGALRSVASVLAKSIYKELGLLLNPKKTRLRILHGSKILGLRFHDRDITVPQSLKHKLRAIMYEYSSANYDESDYESVRDAKRHVGQIIGTLRYIINFTSANVSRYEDWLADFYEELDRLEEIRKDLAQYYDDEKGIYFDM

SEQ ID NO: 4972 - protein, 357 aa, unidentified
  source 1..357: note = Related to JAGOTC010000067.1; note = Candidatus Gracilibacteria bacterium
MLDKRRLAVNTKDFSILKGILPGVIDTLIHYPEGAYKRIEIPKKSGGMRIIHAPLGEAIMQMNADNTSTSLLGWIQKRINHVLGFILLPSSVCAFRPGIDPYSFLRTTLDGISNCRSSQVGGIYKIDIQDFFNSVSEDQVKMVWEKSLPKLSGNFYSKDIINILTLLSCYEGKLNQGPPSSPIIANIVGYLCIDSNLRGLQQTRNIGSNRTPKSLWIRYLRYADDIMILSFDGAIPSDIPDTINETIKNSGFHIAKKKTLLLNDSHSYPLLGISLLRDTSPVGFQFQIGTARDRDLASELLGYQGEGIKSIAGKLGFNKRISLLGRSGVEVEHFPGRYSKRVAHALSMKSDLLLCSQ

SEQ ID NO: 4973 - protein, 322 aa, unidentified
  source 1..322: note = Ignavibacteriales bacterium; note = Related to JADJEI010000006.1
MPSKVLQHIPLKLNLHEIKYLTTPLKTTESRLLKIISIKSKIVKEKKIPKKNSDEFRILNYPVGEFKLILKRLHKFLMSRSKFPKSVCGGIVDKNLYDMVKSHCGREGIYQIDLKDFFPNINSDRVYSFFKNSGRSERISQILTDLVIYDKRLPQGFPTSPIVANLIAWKMDYDLQSICNNHKLNYSRWIDDVLISGRISELNKAIYKIDKSILKNGFYINNKKKRLLKRKNSKEIVSVGLDLKRHKPDVPIKVYEKLEYILQVLITEGVEFARDFFEEEFKLKDIQKSLIGKIRFIEEYNKAKGNFLSNLYIQINWGKGIG

SEQ ID NO: 4974 - protein, 418 aa, unidentified
  source 1..418: note = Related to QPGD01000013.1; note = Brevibacterium aurantiacum
MQFLKKLKLALDRLILGRSTPGRMLEHVFDRNLSILDKVLESILLKDGLEHSEFRGRLTRWRKSYIGKSWGLWTDFSDSANICEFLGDSSIAESDIVSIFADPDMHYRRFWLPSRRSDNTRSKGRVRKRRLIHAPDDSLLSIHRLLLREVLDSFDLVISDAAHSYRPRRSPRTCMFPHKSSGWMICMDFRNFFGTITEDKVLRALVDRLGCPSSTAACYSRLFTVNCEDKGIRVLPQGAPTSGFISNVCLIGFDQRLRAMLSSVDSNIVYTRYADDIVISGPGMLSKSVKSRVIALVSQAANGKGFVINNSKTRVYSGASVMRALGIDIRGGELFPRKSIIDYIEKQVRLIKTRSLTEVSNGWGGLVDGQDNTLKYLDHLWGLIIYASGINRRYAQGVIAELENVETPLSGRLGLIDS

SEQ ID NO: 4975 - protein, 376 aa, Corynebacterium sp.
  source 1..376: note = Related to NZ_KV797734.1
TPLRTPKPEEPNKGVLPIYGVAHLSWMLDVSPSSLSTLLGSERAVRSDLRRRGSRPRAIYIPDSEYLAILRKINQLVFLPADERLDLAAFGFRPGCSPSDCMDKHKHGKWMLKLDIHEFFSSISFFDVKRTFIRVGHSETVSETLAEICTINENGRRVLPTGFPTSPYISNWVLASFDKRMRAWCAENKIYYTRYVDDLFFSGTEAAPNNIIGSIQGLVDYRLGLHGLTLNLKKTRFYRGDSVFKGLGVELHPSRDELVGAGRYMLPSRRMRAHIENQTRCIKKFGVETASRHWCERSGIDRGLGIPEYRYVQHLAGALSYIKNINKAYGNDLENELQIALGESVSSYLLGHQSIFPNSVYSSSYDVPSARKFGSN

SEQ ID NO: 4976 - protein, 325 aa, unidentified
  source 1..325: note = Related to JAFWLI010000028.1; note = Eggerthellaceae bacterium
MFKFDGVPPISYQEYHIPKKSKGVRIIEEPNAQLKAVQKRILPYLYDCTRVGLLPVSHLAHGFIPYRGCMTAVPKHSLNSPVLIGADVHDFFFNFPAEPVENNLWFAMDSSRVDYIMTCALWKGNYPKEHFPQGSPISPYLTNIGMVDVDRMIAAFCKKNGLFFTRYADDMLFSIIDGAEDSPQVRKMMREDEPFSSLFHGVEVILQDHLGLELSAKKSHVMWRHSTCKTQALGITFRQDNKGYNANKRKRRNTRAQLYNLFRKVQAQGGHFQDEDWQEWRSVNGSMNYCNLVRSLSKFPEVAGIDPVFQLSYYNEIERWANAAV

SEQ ID NO: 4977 - protein, 529 aa, unidentified
  source 1..529: note = Related to JAFXGU010000070.1; note = Lachnospiraceae bacterium
MTDNFDYKNPHNITTGRLLYSDELPFFDMISFCMFLGTTPTQLQRILGNIDSMYSRFYIDKDTGRVTSKHAGLRLREINAPLEPLKTWQLRLLDVLNLFPKHEANTAFMEGCSVINAAKTATKGDVLVHVDIKDFFPSHTALYIKRKLSALVFKTFRMYLPEEVLVAITKLICYRMQLPQGSPCSPMATIVLNYDLDTRIDAVAKKYNLEFKRYADDMWFTGVQSDDVIQEFLYELQDAIHPFSLNYKKTNIMRTRAYPKFNGVRIKFTKSYVPSTQAAKIINMVVAALGFTKHKANISKNQVLIEGYPTPQLALDDVRSLMDSVAATIMAKYPNLVFTCKPNWYYIQSTKKCLGLNIVGENVVYPRKRYNDLRLEAMLMGRQRALFALYFAIVAKHKANPRLLPPIKTAPFVFASKGSVGHENFRNLLTNPFNRRVFMGKVAYLRSINPEKADKIMAIEKASYQKCIDGYLLWYPTVNVDYYPDVQWLSSLRDIPNSEACVDIFIGSSISNEELSSILGEAGIGCWAL

SEQ ID NO: 4978 - protein, 567 aa, unidentified
  source 1..567: note = Related to BK016974.1; note = Siphoviridae sp.
MIELMKNYSFKTTLKNLVKGFVAAETAAPKLFTKSLDDWPFFDIATLCAYLGITPLELQALCNCQPTLLYHRFYIDKATNRIVPFNKTANLRMIEAPRPELKEYLMKLIPFFEKFPIHKCNYAFIRGKKIKDAVESVKEGEVLIHTDLKDFFTEHTPLYIKSKLEMLMLQNVPEMYDPEFCKVLTRLITVYTHLPQGSPCSPILTAIVNYDMDSTIQSLADEYNLTYMRYADDICFSGAIANDDIRVFLDKLVDAVHPFRLNRKKVAIMRDAAYPVFSGLKLYIENDRQYIPSSLLGKLIKLLRHEFEPMEFTSVHTVATQGKIHFKLGKIVETPVGSLKEKCDRFSCHLNSKYSASGFKFKLKPTYFYIKSLKQVLGMHITDGKICYPRKMYNQLRLEAMLVGRQMAFQFTQKYIAKNTIDPITSKQHVYLDLQNFVDNISDKDDPMYSRFFTVRYTNVPVGNARNALYTISSRSYKLVSYAEILGITPTYLRGKKRTSKGYRNMLDKPVSLKVFYGKVNWVNTVDPEKATKLKEIVKKYKLKTLAALVKAFQESASREYVKFSAV

SEQ ID NO: 4979 - protein, 485 aa, unidentified
  source 1..485: note = Related to BK028934.1; note = Siphoviridae sp.
MDINRFPKLVREYYNTLTGRHTPLESICGNRVLTLSELPFIDYNSFSSYMGVTPEILTSITDVTAKACYSRFYIDKNTKKIVPYSFGIKLREINAPTEALKELQLKLMEFFNQFPKHPCNYAFMQGKNIVDAAKTVANDGVLVHVDLKDFFPAHTSLYVQKGLEHLIAKNFNTNLPLDVLSRIVKLVCLDGVLPQGAPTSPILTIILNYDFDCRVAELAEKFGFTYTRYADDLCFSGNKSDAECQDFISELSEVVHPFRMNYKKVGIMRDKAYPIVTGFRIKTKVTYLPSTQSAKIIGIITNYLQMPDLRGTISAKVIEFTFSKDTKIPLDELPETLTRITDLVHTKYPNLEFIVKPMYKYVQSVKTVLGLHISNSEVKYPRSKYNDLRVEAMLIGKQLGIREVMYNIHPARIALVKKYAAHNKFFKSSFRNLMVKPLSKRVFNGKLAFLSIVDPDKTLKLKTIMDKHRQKTVEDMIDIFKREGF

SEQ ID NO: 4980 - protein, 394 aa, Aeromonas sp.
  source 1..394: note = Related to NZ_JAACNB010000003.1; note = Aeromonas veronii
MKKYTVNTSMLSLLEGCSFFVKGKGAEPLPYSHAEEGKLGNKFFYKISGSESKQINTIHELLISSLFERLPVNQSATAYLKGKSYLDFLEPHRNNYYFLRTDLKNFFHFIDKEMVVEALRHHVSEEPVTTEYSQSSLELVSRLVTLTLPKNSKNLEFAGQSILPIGFKTSPVVSNVVFRKFDILIEKFCAQHDILYTRYADDMLFSASDIRTSKYKEKDIFSVLRNPKVKEKKPFLHSRRFLEQISFIVNLGGFKINNKKTHMSKGYFTINGYTISGTNYPYTSGTIRVSNKKTKIICKLLHECKINVDDGDILKTVFNYRETKARLPYKSSKKFMNTYHATQLNNKLMGYRSYLISLLKFNETYRCMDSTFINKCTSLVCELDSIINRRINKQ

SEQ ID NO: 4981 - protein, 392 aa, Aeromonas sp.
  source 1..392: note = Related to JADPIC010000001.1; note = Aeromonas dhakensis
MKKYTINASILSTLEGCSFFFKGKGAEPLPFSHVKEGKLGNKFIYKVSGSEARQINLIHESLISTLFEKLPVNQSATAYLKGKSYLDFLEPHRNNHYFLRVDLRNFFHFIDKEMVLEALHHHVSEDKITDECNQSSLELVSRLVTLKLPNESANSDFTGKSILPIGFKTSPVVSNVVFRKFDILIEKFCAQHDILYTRYADDMLFSASDIRTSQYKERDLIFDLVNPRVKKKKPFLHSHRFIEQISFIVNLGGFKLNAKKTKMGEGNFTINGYTISGTNYSYKSGAIRVSNKKTKIISKLLHECNTKDDDGSILNAVFNYRVAKIKLPYKPSMKFLKVYYTSQLNNKLIGYKSYLISLLKFNEHYRCMDPAFITKCEKLVSGLNEMIIRRMK

SEQ ID NO: 4982 - protein, 311 aa, Aeromonas hydrophila
  source 1..311: note = Related to NZ_AP023398.1
MKSYTINSTVIATLETCSFYSKGKGVESFPYSQVKECKLNNKFIYKLSGADTRQINEIHDILIKTLFDKLPINNAATAYLKNKSYLDFLEPHRNSNYFLRIDLKNFFHFINKKIVKEVLFHHVSSDPISEKTTQSSLDLITNLLTITLPNNVKNLEFSGKSILPIGFKTSPAVSNIIFRKFDILIEKFCSRHDVLYTRYADDMLFSSSDTRTEQYIEKSLFDILLPPPNTKPFLHSSKFTEQIAFILNLGGFKINTKKTSIAKGNFTVNGYTISGSNYPYKSGTIRISNKKTKTISKLIHECKKTSPMRTY

SEQ ID NO: 4983 - protein, 389 aa, Vibrio sp.
  source 1..389: note = Related to SZQJ01000005.1
MKNYTVSSSILSLVKECMFFNEGSGVKSLPLSCVHETKVKNKFIYSITGSEGDKINHIHEALNRSLFSRIPVNQSATAYVKNKTYLNFLEPHRNHYHYLRVDLKNFFHFISDKIVRESLKEHVSTSNISETCSQSHLDLVTSLVTYTLPKSAKNTDFVGRSILPIGFKTSPLISNIVFRKLDILIEKFCSEHNITYTRYADDMLFSSSTMRDGKYREKTPFDGVLGIKDKKPFVHSQRFIEQLSFIINIDGYKINRRKTIKKSGYISINGYFIEGSNYPYIIGELRVSNKKTKVVSKLIYECSTDKSDREILKAVFNVDVEKLKFRFNPKDSFKDEYSKSQINNKLIGYRSYLISLIKFNDCTQSMNKDFINKCSKLISDIELIINRRM

SEQ ID NO: 4984 - protein, 391 aa, unidentified
  source 1..391: note = Related to MUEZ01000005.1; note = Salinivibrio sp.
MKSYTVNSSVLSVLEECTLFDKGSGLKPLPPTQFKETKIGNKFIYIPSGSERKTINYIHESLNKNLFSRIPINQSATAYSKGKSYLNFLEPHRNNYYFLRLDLKNFFHFINGDTIKNAISEHVSSSAIMDGCIQSNLDFIVKALTITLPKESKNKEFSEKTILPIGFKSSPIVSNIVFRKLDIIIEKFCSENNITYTRYADDMLFSSSTTRDENYRERTLVASLFEKKDKVPFLHSDKFIEKISFIVNIDGFKINRRKTVKSKKYLSLNGYIISGSDYPYLSGSIRVSNKKTKIISKMIHECNKSNDDILIYKSIFGSDPSKIKFQYKPKESFLIKYCRSQVLNKLVGYRSYLISILKFNTDYLCIDRGFIKKCEHLIRELEPLIESRIDK

SEQ ID NO: 4985 - protein, 391 aa, Vibrio sp.
  source 1..391: note = Related to NZ_LAUM01000014.1
MKNYTVNSSVLSVLKECTFFDEGSGLKSLPSTHFKETKVGKKFVYVPSGSERNHINAIHESLNKSLFSRIPINQAATAYSKNKSYLNFLEPHRNSYYFLRLDLKNFFHFINRTVVRNSISEHVSSSEVIEGCSQSNLDFIVNILTITLPDTSKNEEFSGKTILPIGFKSSPVVSNIVFRKLDILIERFCAKNNVTYTRYADDMLFSSSTVRDDKYREKSVFDDLFKKKEKVPFLHSDKFIEEISFIVNIDGFKLNRKKTVKSKKHLSLNGYLISGSDYPYLSGSIRISNKKTKIISKMIHECNKDQDDISLYKSVFGVNPSKINFRYKPNEAFLIKYCRSQVLNKLVGYRSYLISILKFNENYSCIDGKFINKCESLTRCLETIIESRMDK

SEQ ID NO: 4986 - protein, 393 aa, unidentified
  source 1..393: note = Related to MSCJ01000001.1; note = Photobacterium angustum
MKNYTANSFTLSLLKQCTFFNEESGLISLPSSHVIETRVGNKYIYKLVGSESELINKLHENLNETLFCRIPVNQAATAYTKNKSYLDFLEPHRNNFYFLRVDLKNFFHFINREIIKDSLKDHVSSKPIISGCRQSNLDFIVNVLTIKLPETSKNTDFIGKSILPIGFKSSPVVSNIIFRKLDILIERFCFEHNIIYTRYADDMLFSSSDLRNDKYQEKSVFDDLFKKKEKNNFLHSDRFLEQISFIVNIDGFRINSKKTVRSKKHLGLNGYLISGSNYPYIDGKIRISNKKTKKISKLIYECNTDKSDLDIFKVVFSIDPFRIKFRRKPKVEFLNNYCCAQINNKIIGYRSYLISLLKYNDKYSCLEDDFIFKVKGLIKESEKIINNRMKKEI

SEQ ID NO: 4987 - protein, 391 aa, Vibrio sp.
  source 1..391: note = Related to ABBKDM010000016.1; note = Vibrio vulnificus
MKKYSLSSVVLDLLKEYSYYKEDKGVLPLSSSHVREFKIGKKFAYSTAPAINRIHSHLSKVIFSQYVSKIPVNQSAKAYLAGTSYYDFIEPHRNNYFFLRLDLKNFFHSISKDVIQKNFLEYFSDEKISETCEQTHAQAICNLIMYKLDVNNSNVAFKGKYILPMGFPLSPSISNVVFRKTDLLIEKFCNEKGITYTRYADDMLFSSRGTIVPPPIFRLIGKNKDKVKAYESPFLHSKRFYDEISYLVGLDGYRINKIKVIKAVNTISLNGYTIAGTNYSDLKGDIRLSNAKTKIIYKLLHELKVQKSDDVLVFKKCFSSEMPVPKYKKNVGKFILNFCTNQINNKLVGYKSYIISILKYDTEKDCLSVESKSKYLNLLGKLDVVIKKRMK

SEQ ID NO: 4988 - protein, 390 aa, Vibrio sp.
  source 1..390: note = Related to AIDA02000097.1; note = Vibrio cyclitrophicus
MKKYSLSPVILDLLKEYPNYEEDKGVIPLTSSHVREFKIGKKFAYSTNTAINKTHSHLSKVIFSQYISKIPVNQSATAYLEGKSYYDFIEPHRHNYFFLRLDLKSFFHSIRSNIVSENFLEYFSDKKISENCEQTHSEAIFNLIMYKIDNKSKNNTFKGELILPMGFPLSPSISNIIFRKTDLLIEKLCDENSITYTRYADDMLFSSRGQIIPPSIFPLIDKNKKKETTYKNPFVHSKRFFDEISYLVKLDGFKINKKKTKKSVHTISLNGYTITGSNFPDIKGEIRISNLKTKIISKLIHELNNKTDDVIAFNKCFKKENPIPKYKKGSENFISEFCKNQINNKLVGYNSYIISIIKYDKEKNCLSRDSREKYANLVKDLNKLISKRLK

SEQ ID NO: 4989 - protein, 390 aa, Vibrio sp.
  source 1..390: note = Related to CP071059.1; note = Vibrio alginolyticus
MKKYSLSPIIIDLLKEYAYYKEDKGVLPLSSSHVREFKIGKKFAYSTSSAINSVHSQVSKLIFNQYISKIPVNQSATAYLSGKSYYDFIEPHRNNYFFLRLDLKNFFHSISKDIIERNFLEYFSNDPISDKCEQTHAQAIYNLIMYKLDSKSDNSTFKGCEILPMGFPLSPSISNLVFRKIDLLIEKFCDEKGIVYTRYADDMLFSSRGKIVPPPIFAFFGKDTKKRKSYDPPFLHSKAFYEEISYLLQLDGYKINKNKVKKSVHTISINGYTITGSNYSDIKGDIRISNIKTKTITKLIHELKVNKDDILVFKKCFKKEFPTPKYKKGANDFISDFCTNQINNKLVGYKSYIISIVKFDGDKDCLSTASRSKYTKLLEQLDNSITKRLK

SEQ ID NO: 4990 - protein, 393 aa, Pseudomonas sp.
  source 1..393: note = Related to NZ_JABUYN010000001.1
MKKILLHPSVVELLKNFSNYTDSKGILPLLSSHVKEFKIGKRFVYTLSEKISPSYKHIIRAIHTQNLAKIPVNQSATAYLKGKSYFDFIEPHRNNYFFIKLDLKNFFHSISEDVIKSNFLEYFSDEIIFPNSTQTHAEAIYNLIKIDLSEKSSNKRFIKKSILPVGFPLSPIISNIVFRKIDLLIEKFCDEKNIVYTRYADDMLFSSKGKIEYNPFSTKNNKYLNPYLHSKNFYDEISFILSINNYKINKNKIKKSVHTMSLSGYTITGSNYSDIKGFISISNKKTKIISKLIHELKIENTDEDRDRDRDILKKCFSMIPPKPKYRKKTDEFIKKFCENMINNKLLGYRSFLISILKYDKNHDCINIENNEKYNKLLNEINIIIRKRLSLNDF

SEQ ID NO: 4991 - protein, 398 aa, unidentified
  source 1..398: note = Related to NZ_CP012737.1; note = Pseudoalteromonas sp.
MEEIEMKKITLSKTVFDILDDYSFFDKAKGLTPLSFENVNEFKIGKKFTYTPESNLKPLHQKLSRFILNNYLSHIPLNQSSVAYQTKKSYFDFIEPHRNNYFFIRIDLKNFFHSISPAIIKSNFLNHFSDDPISESCPQSHAKLVYNLITLKLDENSKNKTFMNEEILPMGFPLSPVVSNIIFRKIDILIEKFCDIHHIKYTRYADDMLFSSKGSLLPKPIFEPIVMGLKAVTKSYKPHFIHSERFLEEISILLNLDGFKLNRKKTTKAVNTLSLNGYTISGSNFPDINGTIRISNKKTKLISQLIHELNSEEPKTDVEIFKLCFRHEFPKPKYKKNAGQFIETFCINQINNKLIGYVSYLKSIIYYHDDHNCLSNESINKYSKIINELSTIISKRVK

SEQ ID NO: 4992 - protein, 383 aa, unidentified
  source 1..383: note = Related to NZ_CP046329.1; note = Shewanella putrefaciens
MKKYSLTPAMLEVCKEYNFFSDVSGFMPLTSENIKEIKIGKKFAYSHQDNNKPTHQKLSKIIFENFLSNIPLNQSAIAYVKKKSYFDFIEPHRNNYFFLRIDLKDFFHSISEDLLKRTLSDYFSSESLSETIKQSNIDAIFTFLTVNLKSDSSNVKFLDKKILPIGFPLSPNLANIVFRKTDLLLEKLCDMHGVTYTRYADDMLFSSRGIMEKNLLFRKNNNYKKPYIHSDNFLSEIKYLVSIDGFFINHNKTIKSVNTLSLNGYTISGTNFPDIEGKIRLSNKKTKIIEKVIHEININPDDKVTFEKCFKKEFPKPKYEKNRDNFINNLCTIKINQKLLGYRSYLISIIKFNNKFNCISESSEDKYNTLLSKIENVIKKRIK

SEQ ID NO: 4993 - protein, 310 aa, unidentified
  source 1..310: note = Related to NZ_PKFV01000007.1; note = Lelliottia sp.
MSAVAYIEGKSYLNFIEPHRNNFFFLRLDIKNFFPSITEALVKECFRDYFSEEPINDVIKQSHLDAFVNFVTLNITNSSVNDTFKNSSILPMGFPLSPIISNIIFRKIDIIIERLCVQSYITYTRYADDLLFSSRGKVDMSLASFMKINSTYTAFIHTERFCDSIRKILAVDGYKINKTKTIQAKSIVSLNGYTIIGSNYSDVRGEIRVSNKKTKKIEKLLHELKKKISDQAVYLKCYSNQIPVPKYSSKKEVFLNAFYKNQIDNKLSGYRAYLISMIKFDGEYDCFDSHALQKYKNLISQLDLALSKRK

SEQ ID NO: 4994 - protein, 393 aa, unidentified
  source 1..393: note = Related to MAJY01000007.1; note = Aliivibrio fischeri
MNKNKFNNDFLKRIVVDYKNYNESHKVPSIEPDMVVEFKLGKKYVYKLNEAHSDYEGISKCQNKLITEFLSNIPISTVAKAYVSGKSYLDFLEPHRNNYYFVRMDLKNFFHSISSELIRNSFDLYFENEFTNEDKKQTLMDAFINIATYKLDQESKNVAFSGKRILPMGFKSSPIISNIIFRKIDILIEDFCSNHNITYTRYADDLLFSSKTNSDPYGSVFLKRFNSKPRTGFIHSNRFLDEISYLVRIDGFKINASKTIKAINTLSLNGYTIEGSNYSDLQGTIRISNKKTQIISKLIFEVKKGSSNFNVMKKIFDFKVSNKYFNYIPPKEEHIERYCRDQIINKVSGYRSYLISILKYESEYKCIDEKSINKYNKLIKELEWILTKPEFAS

SEQ ID NO: 4995 - protein, 367 aa, unidentified
  source 1..367: note = Related to JAKGAW010000004.1; note = Pseudoalteromonas sp.
MDKIDKDTFFSELLVGDYSTLINQGVPQTDFGDVTEIQSGKKFFYKLKEDSDLNKCLKVLTTRFLNKIPINNSAKAFRSNQSYLNFIEPHRKNYHFIRIDIKNFFHSISEDILKDCFSSYFEKQIVNTKSRSLLVDSFINLVTLRLSENSKNEVFSNKIILPIGYKTSPIISNIIFRKFDILIQSLCSMHNIEYTRYADDLLFSSPKHSNTIHSTFFYNEISFILSLGRFKINQKKLLSAKKILSIKGYTIDGTEDEKRLGTIRISNKKIKIIEKLLYEFDKGSSNIKILRKVFKINVEKKKFKYKPKPEFIDKYAKDQVHNKTLGYRSYLISLIKFNQDYKCIDDKSILKYLKLVKRLEKLALEIK

SEQ ID NO: 4996 - protein, 410 aa, unidentified
  source 1..410: note = Related to BPFA01000013.1; note = Shewanella sp.
MKIIEKKDFVNQVLQGYDGYSNEMGVKTLTPNEIVEFKIGSKFGYRCSNNDLAKSLENTQLRALSRVVNTLEISKCATAFVTGSSYLDFLEPHRYSYHFIRLDIKDFFHSISSSVISESFSKHFKDTNITSGETKQTLLKSFLNLVTYTIPPDSTNKKFAGKTILPIGFRTSPAISNIVFRRLDCLIEDFCYRNNVTYTRYADDMLFSSKINTKFKSILQKKDVLPPIPITHKEHKTRLAKIKREEALKHGCFLHSDKFTNEISSIIRIINLKLNIKKTIKSNQTISLNGYTIDGVDSYLSAGTIRVSNKKLNVISKIIHSLNKNMSAIEIMERYFKMNKAHECFKYPPKYDYYNTFCIQKLFNKITGYRSYLVSLIKYDEEYNCITPSSLKKYKSLIAELDKTFTKIKL

SEQ ID NO: 4997 - protein, 380 aa, unidentified
  source 1..380: note = Related to NZ_AP024610.1; note = Shewanella algae
MVSEKKIGNKFAYSLKVNGDEGQNILAIHNKLNQLFLNNIEINRCAKAFIKGRSYLDFIEPHRENFHFIRLDIKKFFHSIGIDLLTEAFENYFKKDYLINNENKQSLLNAFIKLVTYTIPDDSPNIELRGVTVLPIGFKLSPVISNIVFRKFDLLIEDYCYHNNITYSRYADDMIFSMKISNKFKNFKRIKFPSLLINAEDDRERKLEILSFIHSDKFIDDISDILSIGQHKFHLNPKKTIRSHHTISLNGYVIEGCEDHFSTGSIRLSNKKTHFISKVIHAITKKKLSPESIFKTILKESIDKSNIPYTPATPAFKKQYYRSQLINKLAGYRSYIISFLVYDSKHHCIEDKYIRKYLEMINAIEKSINKLEKQRLQQPK

SEQ ID NO: 4998 - protein, 372 aa, unidentified
  source 1..372: note = Related to NZ_AKXJ01000001.1; note = Pseudoalteromonas sp.
MKYKKLTVKSFVSMLSDEASDQLELLKQPIEPYKFSDVKQRKLGKKTIFKLTPAKSQYLDRLNNKLFSHIRINNSAIAYVEKKSYLDMFEPHRKNINFLRLDIKSFFHSINRKTLEETLSPYVTDENFFEVGSVKQSLIDALLNLVSLRVSVEYNDESLHNKDILPIGFKSSPVISNIVFRKFDIIIQELCAKNDIIYTRYADDMLFSSPVHSKYIHSDKFLNEISYILSFGGFRLNQSKTIKDKRMISINGYVVEAGENGDSGTIRISEKKTRKIYKLIYMMENNIPPKTIMNRIFKVRDRDIVYRYKKGKAKFKETFYKTQTLNRLTGYRAYIISLLKYNNKYNCIKERQVNEYQKMIIKLEKQIYRLNL

SEQ ID NO: 4999 - protein, 381 aa, Vibrio sp.
  source 1..381: note = Related to BA000037.2; note = Vibrio vulnificus
MCRGRSRDIMKYKKLTTKAFISILSDETSDQLELLKKPIEPHGISDVKQGKLGTKSIFKLTPAKSQYLGRLNNKFFCHIQVNNSAVAYVEKKSYLDMFEPHRKNTNFLRIDIKSFFHSINREILAEALSPYVTNEIFFESGKVKQSLLDALLNLVSLRVSTEYNDQSLHNKDILPIGFKSSPVISNIVFRRFDIIIQELCARSDIIYTRYADDMLFSSPEHSKYLHTNKFLSEISYTLSLSGFKLNQAKTIKDKNMISVNGYVIESGENGNSGSIRISEKKTKKIYKLIYMMENNIPPRTIINRIFKIRDRDIIYSYDKGKRKFKDKFYKTQTLNKLTGYRAYIISLLIYNEKYHCIKEEYINEYKTLIGKLEVQIYKLVK

SEQ ID NO: 5000 - protein, 376 aa, Vibrio sp.
  source 1..376: note = Related to JAKEUX010000001.1; note = Vibrio brasiliensis
MKYKKLTTKTFISILSDEANDQLELLKNPIKPYKFSDVKQGKLGNKSIFKLPPAKSQYLDRLNVSFFSHIQINNSAVAYVGKKSYLDMFEPHRKNTNFLRVDIKSFFHSINRKTLKKALSPYVSDENFFEKDKVKQSLLDALLNLVSLRISKEYNEKSLHNKDILPIGFKSSPVISNIVFRRLDILIQEFCAKNDISYTRYADDMLFSSPTHSKYIHTNKFLTEISYILSLSGFKINQSKTIKDKNMISVNGYVIESGKNGNSGSIRISEKKTKKIYKLLYMMENNIPHRTIMNRIFNLRDRDIIYNHEKGKGKFKDKFYKTQTLNRLTGYRAYIISLLKYNEKYHCIKDEHIEEYKDIIKGLENQIYKITYQPTK

SEQ ID NO: 5001 - protein, 371 aa, Vibrio parahaemolyticus
  source 1..371: note = Related to JABCDA010000001.1
MKYKKLTTKAFLSFLSDDPNDRLELLKTPIAPYNFSDVKQGKLGNKSIFKLSPAKSHYLERLNRNFLSKIKINNAAIAYVEQKSYLDMFEPHRENTNFLRLDIKSFFHSISRETLAKTFESYISDEVFFEVGKTRQSLLDAFLNIICLKVTTDFNDLSLHDKEILPIGFKSSPVISNIVFRRFDIMIQEFCARHDINYTRYADDMLFSSPNKSQYLHTKKFFSEISYILSLGGFNINQAKTIKDKNMISINGYVIENYSDGVPGSIRVSEKKTKKIYKLLYMIENNVSYKIIMNRIFNVRDRDIVYNYEKGKRKFKDKYYKTQTLNRLAGYRAYMISILKYNDRYNCLPKSKSDEYFKIINRLEKQILIIK

SEQ ID NO: 5002 - protein, 380 aa, Vibrio sp.
  source 1..380: note = Related to NZ_PIFZ01000001.1; note = Vibrio splendidus
MCRGRNRYIMKYRKLTTKTFLSILSDEIIDQLELSRNPIQPYTVKDVKHGKIGTKSIFKLAPAKSQYLERLNQKFFSNIEVNNSAVAYVGKKSYLDMFEPHRNNANFLRLDIKSFFHSINREALKKTFSAYISDEVFCEDGKSKQPLIDAFLNLISLNVTKDYNDPQLVNKSILPIGFKSSPVISNIIFRRFDILIQELCSRSGISYTRYADDMLFSSPSEHTYLHTNKFFNEISYILSLGEFKINTSKTIKDKNMISINGYVIESKGDGRNGTIRISEKKTKKIYKLIYMMEKGVPHKVIMNRVFRVQDRDIVYNFKKGKEEFKKKFYKTQTRNRLTGYRAYIISILKFNDKYQCIEAKYVSEYQTIVESLEKQIYKVI

SEQ ID NO: 5003 - protein, 372 aa, Vibrio sp.
  source 1..372: note = Related to CP087877.1; note = Vibrio alginolyticus
MKNRKLTTNTFLSILCDDPLEINELLKKPIPAYTKQDISETKVGTKTIFKLTPAKAHYQKRLNDRFFSRIPLNQSSVAYTKRKSYLDMFEPHRKSYRFLRLDIKSFFHSISRDLLKDTLSSHVSEDLFFSSNYAKQTLIDALLNILTINLGDTYKDKDLTNRDILPIGFPSSPVVSNIVFRKFDFLIQKLCSENNIIYTRYADDMLFSSTADSKFIHSEHFIREVSYILSLGGFKLNGDKTIKEKNMISINGYVIESNGKDKNSGHIRLSNKKTAMICKLIDKLDKNVAHKDILKKITGLKENHIKVSFDKGRNEFLAQYYKSQIINLLAGYRAYLISIIKFNKLYGCVEDKYLDKYQNIIDDIQKHLFRLV

SEQ ID NO: 5004 - protein, 362 aa, unidentified
  source 1..362: note = Related to CABDVD010000002.1; note = Raoultella terrigena
MIKRKKLTTNTFLSLLSDDHKDRFELSTQPIGDITSKNVIEFKIGSKTCFKFKNAGVLEQYQERINRLFLSEIEVSHSAFAYVKNKSYLEMFESHRNGYYFLRVDIKSFFHNISRQLIADSLSGYISDEDFIKNKQKLMDAFINIITLNVTKEQSSFVGRQILPIGFKTSPAVSNIIFRRFDNLIQSLCSKNNIVYTRYADDMLFSSPLGFKFLHTERFMNELSYILSLGGFSINNKKTLKDKHMITLNGYVIESSLTSGKIASIRISNKKTDIISKLINKLEYNVDSKLIMRKLFGLTNEKVKPQFSSKKNKFIDQYYESQLLNAIAGYRAYLISIVKFNLKYNCVEQKYILKYQGMIDKT

SEQ ID NO: 5005 - protein, 373 aa, Vibrio sp.
  source 1..373: note = Related to JAHUCN010000002.1; note = Vibrio fluvialis
MKRKKITVRAFLSILSDDPHDRAELSLQPIKSIEADRVTECKIGSKTVFKLKDAKLLEQYQDRVNQRFLSNIEVSNSAIAYVKNKSYLDLFEPHIYGYHFLRVDIKSYFHSISRELIKTSFSTYINDEDFIKGQQKLIDAFTNILTLNVGDKPKNNALAGKEILPIGFKTSPAVSNIIFRRFDNLIQSLCSKNHITYTRYADDMLFSSPLKFKFIHTRKFMDELSYILSLGGFLINDKKTVKEKHMISLNGYVIESNGVTGQPAKIRISNRKTNIIAKLINKLDHNVDCKLIMSKLFNLSEKSIKVKYKKGRDDFIDQYYRTQLINVISGYRAYLISIIKFNCKYNCIDKNHLSKYQLMINKLEKHLLRLSNW

SEQ ID NO: 5006 - protein, 373 aa, unidentified
  source 1..373: note = Related to NZ_CP057313.1; note = Klebsiella pneumoniae
MKNKRILIDKVFYERFLSVDSFKENLISQIPIPKITNKEVRLISSGAKTFYAINNTSPHSHVQYRLNRYFFSHIPINSAAKAFVKGGSYLKYLEPHIYGSSFCRLDISSFFNNISFNDVEMCLSPYIKDEYLIGNEQKLLSAILNSIGYEIPIHKKHTLIVPMGFKTSPIISNIVFRKMDLLIQNFCAKKGIIYSRYADDMLFSNPKESKLLISDYFFDEISSLLSIMGFKINESKYIAREKEISINGYVIENKGGYGAVGTIRLSKSKLKTILKVIHGLNENMPHKSICNKYIDIRLSESDFKYENKKAEFEKKYYRDQLINYLSGYRAYILSLIKFNIEYRCVNNHFLSQISAMLDDIQKHIIKEKNKRLR

SEQ ID NO: 5007 - protein, 377 aa, unidentified
  source 1..377: note = Related to DAFBNF010000007.1; note = Providencia rettgeri
MKKQAILIDKSFYEKFLSVESFKENITLQTAIPKITSKEVRLISSGAKTFYAINKASPHSHVQHRINQYFLSHIPLNSSAKAFIKGGSYLKYLEPHIYGSSFCRLDISSFFNNISFYDVEECLSPYIKDEYLIGSEQKLIDAILNSIGYNSPIQNKIIVPMGFKTSPIISNIVFRKMDILIQNFCAKKGILYSRYADDMLFSNPKESKILLSDYFFDEIASLLSIMGFKINESKYISRKNEISINGYVIENKGGYGKIGSIRLSKSKINTILKVIHALKQDIPNKIICNKYIQIRLKETDFKYENKKLEFEQKYYRDQLINYLSGYRAYLISLMKFNLIFNCINHDFLTQANMILSDIQLYLHKIKNKRSPRHINNI

SEQ ID NO: 5008 - protein, 374 aa, Citrobacter sp.
  source 1..374: note = Related to CP018810.1; note = Citrobacter freundii
MKTKKMILVDKVFYEKILSVESFKENIITQSAIPKISNKEVRLISSGSKIFYAINNTSPHSHVQLRLNRFFLSHIPLNSAAKAFVRGGSYLKYLEPHIYGSSYCRLDISSFFNNISFDDVKQSLSPYIKDEYLIGTEQKLIDAILNSVGYESPIRKDKGMIIPMGFRTSPAISNIVFRKMDLLIQDFCAKKGVIYSRYADDMLFSNPRESKLLMSDYFIDEISSLLSIMGFNINQSKYISREKEISINGYVIENKGGNGSIGTIRLSKSKLNTVLKVTHALAQNIPYKNICNKYIKVRLKEKNIKYESKKDEFEKKYYRDQLINYLGGYRSYLISLVKFHSEYKCVNSDFIIQINGILNDIQNHIQKIKNNRRL

SEQ ID NO: 5009 - protein, 370 aa, unidentified
  source 1..370: note = Related to NZ_CP033622.1; note = Dickeya zeae
MKRNTFVIDKEYYEKYLSAESFKENFISITPIPKITKKEVRLIKSGFKTFYSLQSTSPHSHIQNRLNNYFFSKIPLNSAAKAYVKGESYLSYLEPHIYGSSFCRLDIKSFFNNISFTDVKKSLSPYVKDEFLIGKEQTVLEAILNSVGYDDEKYDRTLIPMGFKTSPVISNIIFRKMDILIQDFCIKKGLIYSRYADDMLFSNLRDGNLLLSNYFFDEISSLISIMGFKLNESKYIAKKRMISVNGYVLENKGGRGVVGNIRLSSEKLSTINKVIHALNSKIPYKTICKRYLDIKLKDGDYKYESKREDFERKYYRDQLINFMNGYRAYLISIIKFNSDYNCMSIKFIESVNLTLNEIQVRIREIIKKRI

SEQ ID NO: 5010 - protein, 371 aa, unidentified
  source 1..371: note = Related to JACYMS010000012.1; note = Pantoea agglomerans
MKNNNILIDKAFYQKFLTSESFKENLISGIPIPVISNKEVTCFFSGYKKIHVIRDTSPHSHVQYRLNKYFFPHIPLNSAAKAFVKGGSYLKFLEPHINGSSFCRLDICSFFNSISFEYVEESLSPYIKDEFIIDNKQKLVEAVLNSIGFKDEKINKEEMIIPMGFRTSPAISNIIFRKMDILIQSFCSKKNIIFSRYADDMLFSTPKESKILSSDYFFNEIASLLSIMNFKINDKKYISREKEISLNGYVIENKGGYGASGSIRLSNKKMMVITKVMYALNNNIPAKTICLKYLDIKLKEKNIKFENKKSEFEKRFYRDQLLNYLGGYRSYLISILKFNSSYGCIRDNFTHHIIFILNDIQLHMVKIKKKI

SEQ ID NO: 5011 - protein, 377 aa, unidentified
  source 1..377: note = Related to NZ_JACSXJ010000009.1; note = Pantoea eucalypti
MKEKISKIDKNFYIDIFIKSSFQKEFETGDIIPLIANKEVSIINDKNKTFYSLAHSSPHYSIQTKIEKFLLKNIPLNASSFAYRKDLSYLHYLEPHIQNVKYCHLDIVSFFNSIDINLVRDTFSVYFSDEFLVKDKQSLLDAFIASVTFSTKVGDVEKTIIPMGFKSSPSISNIIFRKMDILIQKFCDKNNITYSRYADDLLFSTKKENNILSSNFFINEIGSILSINSFKLNKSKYLYKEETISLGGYVIENTLNDGSKGNIRLSSSKLNILHKALHEINKGSSAKHICNKVFNLKIKEFTYKKNKTAFEKKFYSSQLVNKLLGYRSYLLSFVKFQNKYKCINPVFLEKCFRLINEIENIINKNSHAQGMNAPMSN

SEQ ID NO: 5012 - protein, 366 aa, unidentified
  source 1..366: note = Related to PDLA01000006.1; note = Klebsiella pneumoniae
MKEKISKIDKNFYTDIFIKTSFQNEFEAGGVIPPIAKNQVSTISNKNKTFYSLAHSSPHYSIQTRIEKFLLKNIPLSASSFAFRKERSYLHYLEPHTQNVKYCHLDIVSFFHSIDVNIVRDTFSVYFSDEFLVKEKQSLLDAFMASVTLTAELDGVEKTFIPMGFKSSPSISNIIFRKIDILIQKFCDKNKITYTRYADDLLFSTKKENNILSSTFFINEISSILSINKFKLNKSKYLYKEGTISLGGYVIENILKDNSSGNIRLSSSKLNPLYKALYEIKKGSSSKHICIKVFNLKLKRFIYKKNKEKFEDKFYSSQLKNKLLGYRSYLLSFVIFHKKYKCINPIFLEKCVFLISEIESIMNRKF

SEQ ID NO: 5013 - protein, 370 aa, unidentified
  source 1..370: note = Related to CP064054.1; note = Morganella morganii
MKHKITKISSDFYKNFYLRETFSDDVIMHCGVPNITSNDYKSISFNNRMFFSIKNNSPHKKIQERLIKNFLQKIPLSSPAIAYRKKLSYLHFLEPHVHGESFCRIDLCNFFHNINYDFAKECFQSYFEDEFLLDKKIKVIDAFLNSLSIEMEISSGKKKIFPMGFATSPFISNIIFRKLDILIKNFCDKKSIIYTRYADDMLFSGSGTDKLLGSEHFDKEIASIISIAGLSLNMNKKIYKRGIISLNGYVIENNNGGGERGSLRISNGKTYLIRKALKKYKNGDSKEIICKKVFLVKKPSIKYKKNIDLFVNKFYDSQFSNKLAGYRSYFISLIKFNDKYRCFKDDEIAKYSAIIEEISSVLLKSQHKIK

SEQ ID NO: 5014 - protein, 365 aa, Escherichia coli
  source 1..365: note = Related to CP057173.1
MKHKINKINNDFYKNFYLRETFSDDIIMTHGVPEISNDDYKSISLKNRLCFTIRKSSPHKKIQERLIKNFLVKVPLSSPAIAYRKKLNYLNFLEPHIHGENFCRIDLCNFFHNINYNFARECFKSYFEDEYLVNKKIKVIDAFLNSLSIEIVVNNKKKKIFPMGFATSPFISNIIFRKLDILIKSLCDKRSIIYTRYADDMLFSSSGKDKLLGSEHFDNEISTIVNTAGLSLNKHKKIFKKGIISLNGYVIENKNGGGERGSIRISNGKMYLIRKALDKFKKGYSKEHICKKVFSVKSPTVKYNNNADQFVTDFYNSQFSNKLAGYRSYLISLVKFNDKFRCFHENEITKYSVIIDEISNALLKP

SEQ ID NO: 5015 - protein, 365 aa, unidentified
  source 1..365: note = Related to NZ_MJAO01000006.1; note = Serratia marcescens
MKHKITKINSDFYKNFYLRETFTDDIIMTHGVPNITNSEYQNISFNNRVFFSIKQSSPHKKIQERIIRNFLQKVPLSSPAIAYRKKLSYLHFLEPHIYGENFCRIDLCNFFHNINYDYARECFKSYFEDEYLVNKKIKVVDAFLNSLSVEVELNDKKKRIFPMGFSTSPFISNIVFRKLDVLIKNLCDKRSIMYTRYADDMLFSSSGKDNLLGSEHFDKEISSIVNIAGLNLNVHKKIFKRGIVSLNGYVIENKDGGGERGSLRISNGKTYLIRKALDKYKKGYSKKHICQKVLSVKPPSVKYKSNADQFVMEFYNSQFHNKLAGYRSYLISLVKFNEKFGCFHEKEITKYSAIIDEISSVLLKS

SEQ ID NO: 5016 - protein, 365 aa, unidentified
  source 1..365: note = Related to JACGFP010000002.1; note = Pectobacterium brasiliense
MKHSITKINSDFYKNFYLRETFGDDIIITRGVPNITNDDYQKISSNNRTFFSIKNSSPHKKIQERLIRNFLQKVPLSSPAIAYRKKLSYLHFLEPHIYGENFCRIDLCNFFHNINYNFTRDCFKSYFEDEYLVNNKIKLIDAFLNSLSIEIDFNDKKKRIFPMGFPTSPFISNIIFRKLDIVIKNLCDKRGITYTRYADDMLFSSSGKDKLLGSEYFDNEISSIVNMAGLSLNTHKKIFKKGIVSLNGYVIENKDGGGERGNLRISNWKTYLIRKALDKYKKGYSKEHICKKVFSVKKPSVRYKKNAAAFVQSFYSSQFSNKLAGYRSYLISLIKFNDKFECFSNEEIAKYSAIIEEISEVLLKS

SEQ ID NO: 5017 - protein, 365 aa, unidentified
  source 1..365: note = Related to nan
MRHQITKINSDFYKNFYLRETFSDDIIMTDGVPNINKDDYQHILFKNRIFFSIKINSPHRKIQERLVRNFLQKVPLSSPAIAYRKKLSYLHFLEPHIYGEKFCRIDLCKFFHNINYDFAKECFKSYFEDEYLVDKKIKVVDAFLNSVSIEIDLNGKKKKIFPMGFSTSPFISNIIFRKLDILIKTFCDKRGIIYTRYADDMLFSSLGKDKLLGSEYFDKEISYIVNMAGLSLNTHKKIFKNSIISLNGYVIENKDGSGERGRLRLSNRKTYLIRKALDKYKKGESKENICKKVFLIRTPSIKYKSNASLFVSNYFKSQFNNKLSGYRSYLISLIKFNDKFNCFEDDEIIKYSNIIEDISKVLLKP

SEQ ID NO: 5018 - protein, 365 aa, Proteus sp.
  source 1..365: note = Related to SCIO01000007.1; note = Proteus mirabilis
MKHKITKINSDFYKNFYLRETFSDEIVSSRGVPNITNDDYQSISLNNRVFFSIKKNSPHKKIQDRLIKNFLLKVPLNSSAIAYRKKLSYLHFLEPHIYGENFCRIDLCNFFHNINYDFTRECFKSYFEDEYLISKKIKLIDAFLNSLSIEVELNNKKKRIFPMGFSTSPFISNIIFRRLDILIKTFCDKRSISYTRYADDMLFSSSGKDKILGSEYFDKEISSIVSIAGLSLNTRKKIFKKSIISLNGYVIENKNGGGERGNLRISNRKTYLIRKALDKYKKGYSKEYICKKVFSVKPPVIKYRNNATLFKKEFYNSQFSNKFAGYRSYLISLIKFNNKFGCFQDKEITKYSVLIEEISQVLLKS

SEQ ID NO: 5019 - protein, 376 aa, unidentified
  source 1..376: note = Related to NZ_QGOK01000008.1; note = Marinomonas shanghaiensis
MFKKLNSKDLLNILSSDSQSRLVVLTQSWPMLNVDDVKTLKFNNKTFFSLVSRVERDGYLKKLNLSFLSKIKINSASVAYKNGKSYLDFFSPHVENYNFLRLDLKSFFHSISYEIIKETFESYFLDEYFVDNGKEKGKEKIIDVFLNLVMLNVPSSYGDSFISGRRILPMGFSTSPLISNIVFRRFDIVIHEFCEKHNIKYSRYADDMLFSSNISDKTLFSNRFHEEIKYILNRGGFKLNNAKTIQSKGVLSVNGYVIDSYLERKGLRLSSSKLKNINKIIHALKKGWSYEIILKKYAKKDFDKTNYYNKGISKYRSEYEKSQILNLLVGYRSYLISFHEFDRKDRSIDNDFLVVSGKIIKSIEKAINKIYKDRKL

SEQ ID NO: 5020 - protein, 374 aa, unidentified
  source 1..374: note = bacterium (Candidatus Blackallbacteria) CG18_big_fil_WC_8_21_14_2_50_49_26; note = Related to PCUK01000088.1
MKRLSRPEFINLIDNDTFIEFTAGKIFNIPSSGVVEFQLSNKFFYKLRTDIKLWSFLRVIHSNLNKNFLKKISLNSSAIAFRSGLSYINFFSPHIENYFFLRLDIKSFFHSISKNLINNVFSSYFRDEFIDKNSQISLLEYFIFLTTLYIDETYKNNQFKYQYILPMGFSTSPLISNIVFRSIDIQISNICLEYGVTYTRYADDMLFSMPKNANPHIQTDVFYVSIKSILSKYGFFINKHKVISKKNTISINGYTLQNTPNMCEFRVSNKKIKIIQKIIYEYNKNTEISAILKKCFKYNIIKRFTTPEKVPNNLVEKYNKHQLINKIAGYRAFLLSFILFNHRSKLMSIETSNKYLNLINELEKIMRNIYLTLD

SEQ ID NO: 5021 - protein, 365 aa, unidentified
  source 1..365: note = Related to NZ_LR136958.1; note = Alteromonas sp.
MKKLDKKLFFDILNIEEQVLNPFVEDQVSSFKIGRKFVYALGDRSREKLYQQELNQRFLYKIPLNNAAKAFRKHTSYFDFLEPHRYNYNFLRLDIKSFFPSITKPSIVETFSHYIEDELVVDDTGEKLLLNCFVDLVTFTIPSHSANRKFAGESVLPMGFVTSPAISNIIYRKLDIIIQKHCSIHGIEYSRYADDMLFSSLASSSYIHSRSFLDFISQLLLKHGFELNKRKSIYKKHVLSLNGYVIEGARSDFPSGDIRLSHKKLKLLDKLIYELGNGKSNSEVLKSVFSLEIDKVNFPIPNTEQEFKDAYCKDQLLNKIGGYRSYLIAFIKFLMLNNISSSVSMERYSELLIKLEKEYSKLHKS

SEQ ID NO: 5022 - protein, 368 aa, unidentified
  source 1..368: note = Related to JACHBV010000002.1; note = Rahnella inusitata
MHIIDKKFFKTAIASKDLFENDIFPPIPSKYVFEKKLKKRYVYSLKKDSAIFNAQQNIIDLFLRKIDVNNCAVGFRKDKSYLNFLEPHSGNYYFLRLDIRNFFHSIDEKLLKDCFSPYFKDEFIDAENKQKLISSFLNLVTFHVGKSYGNIDFVGKKIVPVGFPSSPFISNIYFRNIDVILQKLCALHDITYTRYADDLLFSSSRDNKFVHSDSFEKEVKVILSSRKLKVNEKKIVKAKHRISLNGYVIQSTALVNNKNDNNVSGIFISNKKTSILKKVLHEFESKPVNYTKIMERIFKEKIRQEDFFYPITLDFKKKYYKTQARNKICGFRAYLISFIKFNAIYGCIPECRIQAYKKLICQIDTFLV

SEQ ID NO: 5023 - protein, 368 aa, unidentified
  source 1..368: note = Related to NZ_RHDS01000003.1; note = Curtobacterium plantarum
MHIIDKNLFKTEIAPKDLLEDDVIPSIPYSSVLEKKIKKRYIYSLKNKSPALLAQRNLIEVLLRRIDLNDSAVGFRKGACYLNFLEPHSNNYHFLRFDIKNFFHSIDEKLLRDCFSSYLKDECIDPGNKQKLISSFLNLILFHVGSSFGNDDDKGKRILPVGFPASPFVSNIFLRKIDIIIQRTCALHNVTYTRYADDMLFSSSRADKYIHSDSFENEIKVILSSHKLKINEKKIVKAKHRISLNGYVIQSSSLTNRKNVNDISGVFISNKKIIKLKKIIHEFNKKPVDYTKIMEGIFREKIKPSNFTFPITGTFKQKFYKTQVRNKLCGYRAYLISFVNFNLRYDCIPDGKIELYSKLINEIDVIIK

SEQ ID NO: 5024 - protein, 368 aa, unidentified
  source 1..368: note = Related to NZ_CP059956.1; note = Pectobacterium brasiliense
MHIIDRNHLKISILPKDIFVDGIVNPIPSSAVTEKNVKGRCVYILEKNSDYAIAQRNLVEQFLSKIEVNNSAKGFRKNLSYLNFLEPHASNYYFLRLDVKNFFHSIDERLLKKCFFIYFKDEFIDSNNKQKLLDAFMNLITFYVPSSSKNINCKEKRIIPVGFSSSPLISNIFFRSIDILLQKLCIAFNITYTRYADDLLFSAVRGCEYIHSDSFEKEVRIILGTMSLKINNNKIIRAKHRISLNGYVIQARSLSKKKSANDYNGVFISNKKTETIGKVLYELSLNSVDYKKIMEKIIGNKIKISDFNYPLTYGFIIKYYKTQTRNYLSGYRSYLISFLKFNEIYRCVPDIKINVYKDLLDKIDKFLV

SEQ ID NO: 5025 - protein, 374 aa, unidentified
  source 1..374: note = Related to UHIX01000001.1; note = Yersinia enterocolitica
MLNKIDKNYFVNNILNRKIDIIKDGEIKSITSDNVIEFTVKDKLLYSLGNGNLYSFPQKRINDFLFKFIPFNNASTAFKKDFCYFDFFKPHIGNSLFLRLDIKSFFHSINIDKLKDVLNKYVEDDFIDEKKNQKIIDSVINIISLDITLNSKNKYYINKKIIPIGFSSSPLISDLYFRRIDILIQKICLKNSITYTRYADDLLFSAAHENNYVRKNWIGFTEEIRKLLYYFNFNLNDKKTIQKKGLLSLNGYVIETRLSTGNNKLIFSELRFSNEKLSKLIRAIYHLEVLGTSPTVIMISIFKEKIKDLKFKYHITPAFAARHYRYSLLNKLRGYRSFIISILKYNIKHNILNKKTKEKYKLLTEKLEREILKL

SEQ ID NO: 5026 - protein, 372 aa, unidentified
  source 1..372: note = Related to FCGU01000001.1; note = Serratia marcescens
MLKKIDRNYFNDIILNGKKDIISDGEVKTIPSDSIKEFSVKNKFFYQLSDKSIYKKPQQIIAEFLSKHATSNNSSIAFKAGLCYFDFLKPHLNNSRFLRLDIKSFFHSIDIEMLKKTLSHYIEDDYIDDMKKQKIIDALINIVTIENSEDLNIKIKKGSKFLPIGFTSSPLLSDVFFRKIDIIIQKLCVKHSIQYTRYADDLLFSVSHKNTFINKNWEGFTNEIEKIVNYFRLNINRKKTTIRKGLISLNGYTIETKMLNGAILNSEVRLSNDKLSKLTRTIYHLDTLGSSPKKIINIVFKEKIENIEFKYKATQSFIERHYKFVLMNKLCGYRSFIISILKYNSGKKILNEKSKQKYENIVSTLERLILVL

SEQ ID NO: 5027 - protein, 385 aa, Proteus sp.
  source 1..385: note = Related to NZ_CP043925.1; note = Proteus columbae
MIKLNREFFTSDIIVLKNSESGLSEFINSNTIPWDNVTEIKLKGKYYYSFSKRIVHNIDYVKSQRNIYDYFSNVIPLNNNSFAYKKETCYLDYLRPHIGNYFFLKIDIASFFHSIKESYVRKLFYNYINDEFLDNDKKCSLIDALIKLTSIDIPSESKNISYVNKRVFPIGFSSSPIISEIYFRPIDVLLMKLCSDFELTYTRYADDILISGGINNKYIANNWDFIYNRIFEIFSYYKLKINTRKTINKKKCLSINGYVLESMYYDNRLLFSELRISNFKLKKINKALFYLEENTYIKNETIKYVMEKVFNSKFKKDKFKYTITQSFIDRHYVFSLTNKMRGFRAYLLSFIIYDRKYMILQKETKDKYLKIIGRIELIIDRLLKK

SEQ ID NO: 5028 - protein, 382 aa, unidentified
  source 1..382: note = Related to NZ_CP063241.1; note = Pectobacterium brasiliense
MNKITKKILIEKILLLSKDEIDEFYQAEIPDSNVVEKKHKNKFMYSLSYSSTFRKIQSNINSALNPLLDLNNSAIAYRTGLSYFDFLEPHAKNYHFLRMDISLFFHSLNIDDVKEAISQYIDDDIINTKHNQKLIDVIIKCISYKIPKKFKNTNLHDKTILPMGFSTSPIISNITFRKIDILIQKLCAKLDITYTRYADDMLFSTPRDKKIIHSEFFLKEIKILVSLLGLKINAKKTIVKSHTISLNGYIIQNQIRLTGFAGLFSPISPAEIRLSNKKTAIIDKLLHHILVKKSDSDVILNKLFKEDVRDLMHHGNKEKYVKEYSLDQILNKLTGYRSFLLSIISHNKKFNSTSVGTIKKYSSKITKIEKCINILDKKKIYT

SEQ ID NO: 5029 - protein, 382 aa, unidentified
  source 1..382: note = Related to JACHAN010000001.1; note = Pectobacterium brasiliense
MNKITKKILIEKILLLSKDEIDEFYQAEIPDSNVVEKKHKNKFMYSLSYSSTFRKIQSNINSALNPLLDLNNSAIAYRTGLSYFDFLEPHAKNYHFLRMDISLFFHSLNIDDVKEAISQYIDDDIINTKHNQKLIDVIIKCISYKIPKKFKNTNLHDKTILPMGFSTSPIISNITFRKIDILIQKLCAKLDITYTRYADDMLFSTPRDKKIIHSEFFLKEIKILVSLLGLKINAKKTIVKSHTISLNGYIIQNQIRLTGFAGLFSPISPAEIRLSNKKTAIIDKLLHHILVKKSDSDVILNKLFKEDVRDLMHHGNKEKYVKEYSLDQILNKLTGYRSFLLSIISHNKKFNSTSVGTIKKYSSKITKIEKCINIIDKKKIYT

SEQ ID NO: 5030 - protein, 382 aa, Citrobacter sp.
  source 1..382: note = Related to CP056181.1; note = Citrobacter freundii
MNKITKKILIEKILVLNKDEIDEYFQAEILDSDVIEKKHKNKFMYSLSYGNKFRKIQSNINSELNQILELNNSAIAYRTGLSYFDFLEPHSKNYHFLRMDISSFFHSLNPEDVKSSLSQYIDNDVVNEKHNQNLIDVILKCITYKIPTKCQNKKIHEAIILPMGFSTSPLISNIVFRKIDILIQKLCTKLDVTYTRYADDMLFSTPRDKKIIHTDFFLKEISILVSLLGLKLNTRKTIIKSHTISLNGYIIQNQVRLIGFAGLFSPISPAEIRLSNKKTAVIDTLLHQILVKKNSNNQILKHLFKEDVRKLMRHGNKEKYVEEYSQDQILNKLTGYRSFLLSIISHNNKFNSTSLDTINKYKSKITKIEKCINILDKKKIYT

SEQ ID NO: 5031 - protein, 382 aa, unidentified
  source 1..382: note = Related to NZ_WHOZ01000001.1; note = Pantoea agglomerans
MKKITKKILLEKILLLNKDEFDTFIQVEIPDSEVIEKKHKNKFMYSLSYASKFRKIQSNINSILNSTIQLNNAATAYRAGLSYFDFLEPHVGNYHFTRLDISSFFHSLKVEDIKTALEQYVENDTLNEEHNQKLIDVILKCVTYKVTKESNNNRIHDKVIIPMGFSTSPVISNLVFRKIDIIIQKLCTKLDITYTRYADDMLFSAAKNKKAIHSDYFIKEIKILVSLLGLKLNERKTIKKSHTISLNGYIIQNQVKLSGFKGLFSPISPAEIRLSNKKTVIIDKLLHHIMVKKNNHNDILKKLFKEDVRHIMRYSNKAPYIDKYAKDQIMNKLTGYRSFLLSIISHNKKCSSSSNETIEKYKAKVVKIEKCIKTLDTNKIHT

SEQ ID NO: 5032 - protein, 381 aa, Proteus sp.
  source 1..381: note = Related to JADSTY010000052.1; note = Proteus mirabilis
MKKITKKILLEQILDVKKEDIDAFLQNNINDSDVSEKKIKSKYTYTINDNKLKKIQSNINEFLTQIIDLNNAAIAYRKGLSYFDFIEPHAKNYHFIRMDISSFFHSLDVKDIQEALYQYVDNDVVNDTHNQKLIDVIMNCITYTIPITANNEKYHNITVLPMGFSTSPLISNLIFRKIDILIQKLCTKLGVIYTRYADDMLFSAPFDKKIVHSEFFIKEIKILISLIKLKLNKNKTIIKSHTISLNGYIIQNKIKVNGIRGLFIEPTPSEIRLSNKKTIIIDKLLHYIEVKKSKNNIILKKLFNEDVRDLMVFSNKKKYIDDYSLDQILNKLTGYRSFLLSIIKYNEKTNITSNTTIQKYQNKIKRIEKCINSLDKNNKYT

SEQ ID NO: 5033 - protein, 390 aa, unidentified
  source 1..390: note = Related to NVWN01000005.1; note = Arcobacter sp.
MYKINKKYFLTYLQPIIEKGIVTTIKKEKVKEYKLGKHYFYEITDEKIRYIHEWLNKSFQKNIDLNNSSIAYRKGYSYLNLFEPHRHNYYFLRLDIKSFFHSIQMSDIIAVFEPYFDNEHIDEKKKQKLIDGFINLVTFKIPVSFKNKEFKSSRILPIGFITSPVISNIIFRKIDLLIQKFCSEKNIIYTRYSDDMLFSSSNNSKYLHSEDFYKEISIFLNIMNFKLNQNKTLYATHTLSLNGYTLQYSNQPNSKNEQLINEFRLSNKKLLIIKKMIYLINKQEKSPKFILNKLFNFGINKLSTKYPIESKNVKEKYYYDQLLNKLTGYRSYVLSIVVFDKKHDCCQDKTIDKYTDIVEDLNKIIKRYIKKIETISKKIEDEIKESESAK

SEQ ID NO: 5034 - protein, 358 aa, unidentified
  source 1..358: note = Related to JAIZPA010000057.1; note = Sulfurovum sp.
MGKISKDGFKKFLQTTTQTNINEFKIGKSYFYELKDNDNLLAFHRVLNREFQKVIPLNNAAVAFRKNKSYLDLFEPHRKNYYFLRLDIKAFFHSIQIDDIKKTFSTYFEDEYIDNDKTQTLIDAFINLVTYKVPDNSSNKDFRGKQILPMGFVTSPVISNIIFRKIDIQIQKFCSKRDITYTRYADDMLFSSDKNSNYVHSDGFINEISIFVAQLKFKLNHHKTLKATHTLSLNGYTIQYSNIKKDILGARDEEVISEFRLSNKKINIIKKMIHLIEVEHQTPQYVLKKLFNYRLPNDVPAEKKEEYYKHQITNKLTGYRSYILSFITFDKKYHCMQKNTVEKYIKLIKLINQNPYLQ

SEQ ID NO: 5035 - protein, 369 aa, unidentified
  source 1..369: note = Related to MICC01000016.1; note = Sulfurimonas sp.
MKKIIHKSFFKNYIIEGEVPSTKIPSVNEFQLGKNFFYEVVNNKKLLSLHKQLNDVLLNKIDLNNAAVAFRKDYSYLHLFEPHRTNYYFLRLDIRSFFHSIRVDDIKEIFKAYISEDEYIDDKKKQSILEGFINLVTYTIPADSKNDKFKEKQVLPMGFTTSPVISNIIFRKLDIQIQKFCSKNNIIYTRYADDMLFSSSLASSFVHSESFIKEIRITISQMKFQLNENKTIRTKHTISLNGYTIQYSYFENFLKLHKQEYKINEVRLSNKKTNIIKEMIYLIEVKKMSSQKILWKLFHYKLRFKFVITESDVRKKYYDDQLLNKVSGYRSYLLSIIKFNKKYSCTRDTTIKKYSELINNLDKIIDYKY

SEQ ID NO: 5036 - protein, 458 aa, unidentified
  source 1..458: note = Related to WTAE01000162.1; note = Sulfurovum sp.
MNKLITIDYFKRIILKNKVPNISKDNIREFTVGKNYFYELTDKQQLLVQFQIFNKLSNNIELNNAAIAFRKDLSYLHLFEPHRKNYNFIRLDIRSFFHSIQIDDIREVLKVYIPKDEYIDKKEKQSVLDAFINLVTYKIPSTSKNEKFKGKRVLPMGFQTSPIISNIVFRQLDILIQKLCSSHEIVYTRYADDMLFSSSKNRTYVHTDDFIKEIRIILSTMDFKLNEHKTLKARHTLSLNGYTIQYSDISTMKSKKKIIIHNESELHELRLSHKKTDIVKKIIHMIVTEKKEPEVILKKLFQYKINLKFIPSETLKNKYSHEQLLNKILGYRSYLISIIQFNKLYYCTQDKTIDKYIKIINDLEKIATQYRMKIEKLERKIDKEKKRIKSILMQPIDKLQFTIWEKDALSEVGYTTLNSLKGVTEKHLYGNIKGIGEVKAKNIVSIVNKELSKTKSRI

SEQ ID NO: 5037 - protein, 356 aa, unidentified
  source 1..356: note = Related to NZ_PDKB01000007.1; note = Aliarcobacter vitoriensis
MKINKKQLFQQIKLLLNSNNRINNLEVEEFKIGKNFFYKIDNIEIIKFHDWLNNYLLDKIEINNSSKAFITDKSYLDFFEPHIKNYNFIRLDIKSFFHSINIKDIANAAKAYFDKDTIELDKKYPLLSFFLFFTTYKIPDISENKKFINKRVLPMGFKTSPKISNIVFRSLDIQIQKLCIKNGITYTRYVDDMLFSSKKDLTYIHTDSFIEQISFILNQMNFQLNSKKTIKAKHTISLNGYTIDSSKKEFRISNKKLLKIKKLIYMKNIQKKSAKDILKKLFPKDFRKYKLRYCSSQLENKIKGYRSYLLSFIVFDNKYKCLSENTKNSYIDLINKLEKLILLDTKVYNDEIDEDF

SEQ ID NO: 5038 - protein, 317 aa, unidentified
  source 1..317: note = Related to NZ_VWUH01000001.1; note = Pantoea sp.
MLSQIEINNSAFAFVPKRSYLDFFTIHIGNYNFVRLDIKNFFHSIDLKKLEKMLSVYFENEFIDTDKDQLIIKSFMNLVTYKIPLASKNTTEKGNTILPIGFPTSPIISNIYMRDFDIKIQEFCARHNIQYSRYADDMLFSSKKDSDFVFSETFMKEVAILLSLKGLHLNTKKTIKRKHTISLNGYTLSNSNPTIKETSPHFEFRISNKKISTLKKFIFLTKNVNISSREIMEKVFSFNIKKQKFRYPPKKKFIESYCKTLLVNKIIGYRSYIIAILKHSEKHQACNDSTIEKYKLLLSELDFYLDKNPPEDFSKTL

SEQ ID NO: 5039 - protein, 380 aa, unidentified
  source 1..380: note = Related to JAENMR010000003.1; note = Lelliottia amnigena
MLKIHAGQFKQLLTGQSIFKNGTIPTIEDKFIREIQLKGKFFYAIQNSPELSSTQANLINELFIQIEINNSAYAFVSKKSYLDFFTNHIGNYNFVRFDIKNFFHSIDVIKLEKMLSAYFENDYIDNEKQQPTIKSLMNLITYKVPLSSKNIAKRGNTILPIGFTTSPIISNIYMRDFDIKIQEHCIRHNINYSRYADDMLFSSDKSSEYIFSDSFMKEVSILLGLKGLQLNAKKTVKRKHTISLNGYTISNNHISQILEKPAFEFRLSNKKLCILKKFIHLSKKDGVTSRLIMEKLFSFNIKRQKFRYRPKKEFIESYCNTLLTNKITGYRSYLISIIKHALKYNISSDCSLENYNKILKELELYLDKNPVPDHSKSDKI

SEQ ID NO: 5040 - protein, 380 aa, unidentified
  source 1..380: note = Related to NZ_CP011303.1; note = Serratia liquefaciens
MLRIDATTLKKMIISENLLIEGIIPPIESKFVTEFRVKNKFYYSVQNNPELLLAQNKIISDILSKVELNNSAFAFIKNKSYLDFFEPHMGNYNFVRIDIQNFFHSIHTPQLKEILSHYFKDEFIDPNKKQKIISSFMNLITLNIPLSSKNQNSKNNNILPIGFTTSPIISNIYMRDFDIKMQDFCIRHNITYSRYADDMLFSSTEQSSFVLSDAFMKEVSILLNLKKLKINTSKTIKKKHTISLNGYTISSSLIVDGKVISPAEFRISNKKTAIIRKFILLSKKEKITSRYIMEKLFHFDKNKVHFLFPPKDKFIESYCNTLLVNKIKGYRSYIISLIKNAKKYNNTNENTIKKYQEIILELNIYLDKNPLKNFSENKKT

SEQ ID NO: 5041 - protein, 366 aa, unidentified
  source 1..366: note = Related to NZ_JACYTP010000002.1; note = Photobacterium arenosum
MIKNKISDDFFKKAILKGNEGLLNDFSPSVREFKVGCDNFFEISRDSEHKRINDRITKFVLDKSPINSSACGFVQGKSYYDFLRPHIQGYYFLRLDIKKFFHSIPSHEVKSLLAQHFNNEKNGKKYSALDIAYMSITHRVSDNYIDKDFRGKEILPIGFSSSPVISNIIFRRVDILIQKLCEDKGIIYSRYADDMLFSCDNSKYLHSEQFEKDISIFVSTLSLKLKKRKRRATENTISLNGYVVQNRKRKKGFLHVYKEKPVGNIRLSDKKLKPLKKLSALLKKQKDPIYIMENIFYLNPKNFIRRYGGNFAFYSKYADDQLQNKLKGYRSYLVSLIKYNDKYGCVNIDCMKKVKGLVEVFESNIK

SEQ ID NO: 5042 - protein, 366 aa, Vibrio sp.
  source 1..366: note = Related to BBMT01000003.1; note = Vibrio maritimus
MIKNKISDDFFRKAILKGNEDLLNNFSPAVREFQIGCDNLFEITRETEHKQINDRITKFVLEKTPINSSACGFVQGKSYYDFLRPHISGYYFLRLDIKKFFHSIPSYEVKALLSQFFNNEKNGNKYSALDIAYMSVIHKVSDTHIDKDFRSKEILPMGFSSSPVISNIIFRKVDILIQKLCEDKGIVYSRYADDMLFSCDNSNYLHCDQFERDISIFISTLSLRLKKRKRRATENTISLNGYVVQNKKREKGFLHVYKEKPVGSIRLSDKKLKPLKKLASLLQKQKSPVVIMESLFSLERRKFINRYGNNWNFYCKYADEQLQNKLKGYRSYLVSLIKYNDKYGCVNVECMEKLRALVGVFELNIK

SEQ ID NO: 5043 - protein, 309 aa, unidentified
  source 1..309: note = Related to JAJRLY010000005.1; note = Klebsiella pneumoniae
MMKNNISDDFFKKAILKGNEDLLNDFSPAVREFKVGCDNFFEISKDSEHKRINDRITKFVLAKIPINSSACGFVQGKSYYDFLRPHIQGYYFLRLDIKNFFHSISAHKVKNLLAQHFNNEKGGNKYSALDIAYMAVTHKVSDTYLDKDFRGKEVLPIGFSSSPVISNIIFRKVDILIQKLCEDKGIIYSRYADDMFFSSGNSKYLHSEQFEKDISIFVSTLSLKLKKSKRKATENTISLNGYVVQNRKRKKDFFHVYKEKPVGNIRLSDKKLKPLKKNFRIAQKTKISNIYNGERLPFKPKKVCPKIRE

SEQ ID NO: 5044 - protein, 368 aa, Vibrio sp.
  source 1..368: note = Related to LWEH01000044.1
MIKNKKKISDDFFKKAILNGNKALLSDFSPSVSEFKVGGDRFFEISRGSEHKSINNRITKIVLDKIPINSSACGFVQCKSYYDFLRPHVHGYYFLRLDIKEFFHSIPSIEVKKLLSQYFNNEKNGAKYSALDIAYMSVTHRVSDTYIEEDFRGKDILPIGFSSSPVISNIIFRRIDILIQKMCEEKGIVYTRYADDMLFSCESSKYLHSEQFERDISIFVSTLSLKLNRKKRKAAENTISLNGYVVQNTKINKGFFHEYIEKPVGNIRLSDKKLKPLKKLSVLLKKEKDPIYIMDKVFNLNPSKFIRKYGKNYEFYSKYADDQLQNKIKGYRSYLLSLMSYNDKYGCVNAKCMQKVKGLVEVFESNIK

SEQ ID NO: 5045 - protein, 373 aa, unidentified
  source 1..373: note = Related to NZ_PNDJ01000020.1; note = Pseudoalteromonas sp.
MYQVEASMINTKISDEFFKKAILKGQSEIFNEFSPSVRESKVGPDSFFEIAQNSLHKDINDRITKFVLNKNPINSSACGFVAGKSYYDFLRPHITGYFFLRLDIKKFFHSIPVSEVRELLSQHFNDTKNGAKYSALDIAYMSVTHKVSNDHVDQDLKAREILPIGFSSSPIISNIIFRRVDILIQKLCEEKGITYTRYADDMLFSSYKSRYLHSEQFERDISIFISTLSLKLKKRKRKEAENTISLNGYVIQNKKIEKSLFNVLKEKPVGKIRLSNKKLKTLKKLAALLRKKQSPTYIMENQFKLNPNKFKAKFGKNLNFYNKFADDQLQNKIKGYRSYLVALLKYNELHGCVNIDCVKTVEKLIKVFELNVK

SEQ ID NO: 5046 - protein, 366 aa, Vibrio sp.
  source 1..366: note = Related to UHIJ01000001.1; note = Vibrio alginolyticus
MNKKVSDEFFNNAILKGNVALLDDFSTSVIERKSGADIFFEILKDSDHKIVNDRITRFVLSKIPVNSSACGFVPGKSYYDFLRPHISGYYFLRLDIKKFFHSISVLEVKNLLSQYFSDDKKGAKYSALDIAYMSITHKVNNNFDDDDIKKKEILPIGFSSSPVVSNIIFRRIDILIQKLCEDKGIVYSRYADDMLFSSSKSRYLHSEQFERDISIFVSTLSLKLKKRKRKAVENTISLNGYVIQNTKLKKNLFFNVYKQDPIGSIRLSDKKLKHLKKLSALLRKNRDSVYIMESIFQLNYNKFKRTYGENINFYIQYSDDQLQNKIKGYRSYLVSLIKYNEKYGCVANNCIVKVKELVRVFESNIK

SEQ ID NO: 5047 - protein, 367 aa, unidentified
  source 1..367: note = Related to NZ_MNAN01000032.1; note = Pseudoalteromonas byunsanensis
MNNKIIKNDFFEQAVLKGKTQLLNKFTPSAVERTVGNDIFFEIPKDSDHFLINRRIEQLILSSIPVNSSCCGFVKGKSYLDFLKPHIKGYYFLRLDIKDFFHSIQLSDIKALLGDYFEDDKKSFKYSPLDIALMSLTHSVSSTHPAKDMRGKTILPIGFPSSPVISNILFRKVDITIQKFCEDKKITYSRYADDLLFSSTSSRFLHSEQFEKEISIFISMLTLRLKRKKRIAGENTISLNGYTIQNKKKSNVSFLRDYQQDPIGSIRLSNKKLKTLKKLAASLIKKHSAVSIMENLFGLSFQKFKRNHFPDKNFYRKYARDQLQNKLKGYRSYLISWVIFDDKHSCVASDFLLTARCLIDIYEKNIE

SEQ ID NO: 5048 - protein, 367 aa, Escherichia coli
  source 1..367: note = Related to CP088131.1
MNKNKVSDDFFKNAILKGNLGLFDKFDLSVIERNIGNNAFFEISKDSEQYKINERITKFVLSRQPINSAAYGFIKGKSYYDFLKPHITGYYFLRLDIKNFFHSIPVREVNSLLEGLFNSSKEGKLYSALDLAKMTLLHTVSKDFSDSSLRGDYVLPIGFPSSPAISNIIFRRVDILIQKYCDDKNIIYSRYADDLLFSSANSNFIHSEQFEKEISIFISTLALTLKKSKRKACENTISLNGYVIQNTRPKKTLFSNIFRENSTGAIRLSNKKLQTLKKVLRSLFKGKSAIYIMETFFGLNYSKFKNKFNSDYRFYNKYATDQLQNKLRGYRSYLVSLIKYNESYDCVDQNCLKTVKSLAKDLEKYIV

SEQ ID NO: 5049 - protein, 367 aa, unidentified
  source 1..367: note = Related to CP034276.1; note = Pectobacterium versatile
MNKNRVSDDFFKNAILKGNTDLFDSFDVSVIEKKIGNDCFFEIPRDSEQNKINERITKFILSRQPVNSAACGFIKGKSYFDFLKPHTTGYYFLRLDIKNFFHSIPVREVNNLLESLFSSSKNGKSYSALDLAKSTVLHTVSKDFPDLSLRGEYILPIGFPSSPAISNIIFRKVDILVQKYCDDKNIIYSRYADDLLFSSINSNFIHSEQFEKEISIFISTLSLNLKKSKRKACKNTISLNGYVIQNTKPKKIIFSMFYSDNPVGTIRLSNKKLQILKKVVAALFKKKSAIYIMENIFDLSPSKFKKSFNSSYYFYNKYAEDQLQNKLRGYRSYIVSLIKYNEKHECVDKNCLITVKSLAKALEEFIL

SEQ ID NO: 5050 - protein, 364 aa, Vibrio sp.
  source 1..364: note = Related to CP017889.1; note = Vibrio alginolyticus
MINNKIHDDFFKNAILKGDTSLYDDFSQSVIEKQVGPDVFFEIKKDSDHYRINERITKIVLSQVPINSSACGFVPNKSYYDFLKPHIKGYYFLRLDIKNFFHSIPKKYVEELFKQYFSDKKNEQKYSSLELALMAVLYKTNIFDDEKDKIVLPIGFPSSPVISNILFRKIDILIQKFCEEKNIIYSRYADDMLFSSSKSNYLHSEYFEREISFFLSTLALKLKRRKRKATENTISLNGYVIQNEKPKKRFLFNVYKEERVGTIRLSNKKIKIIKKLSAHLIKGSSPVVIMENLFNLNPYKFKKKYNSNIQFYNKYSRDQLQNKIKGYRSYLVSLIRFNEKHGCIDKKCLETAIKLVSILEDNIT

SEQ ID NO: 5051 - protein, 367 aa, Salmonella sp.
  source 1..367: note = Related to CP079839.1; note = Salmonella enterica
MKNKILSDDFFKNAILKGNSALFNEFTPSVTEREVGPDVFFEIEKNSEHRKINERITKFILSQIPINSSACGFVQGKSYFDFLNPHIKGYFFLRLDIKKFFHSIPASEVKSLFKVYFSNTKKEEKYSALDIALMAVLHKTSKSLSDSELRDKEILPIGFSSSPVISNIIFRKVDILIQKYCEDKNIEYSRYADDLLFSSAKSNFIHGEQFEREISIFISTLSLRLKKSKRTASENTISLNGYVIQNTKQKKLFNMFFYKDAPIGTIRVSNKKTKIIKKMTALLRQGKSPIYIMENVFNLNRKSFKPKYTNNYTFYNRYATDQLQNKIKGYRSYLVSIIKFNEKYKSIDEKFLKSAKKLVKELEDSIP

SEQ ID NO: 5052 - protein, 365 aa, Vibrio sp.
  source 1..365: note = Related to NZ_JACVEG010000002.1
MKKINNEFFKGAILKNNEALFDEFKPSISEFRIGGDNFFKISPNTPHHDISERITKIVFSQVEINSSACGFVQGKSYFDFLKPHIHGYYFLRLDIKKFFHSIKISDVSALLEDCFSNEKGKFKYSPYDIALMSVTHKVSSNFSDIKLREKDILPIGLPSSPVISNIIFRRVDILIQKYCENKKITYSRYADDLLFSSLNSNFIHSENFEREISFFLSCLSLRLNHKKRKACENTISLNGYVIKNSKPKKLDFFNIHKEDPVGKISLSNKKLKIIKKIIHHLKKGSSAITIMEELFYLNFNKNRSKFYNYYGFYQKYAEDQLQNKLKGYRSYLLSLVIFHQKNKCVDELCLRTVKKMIKDINKKIV

SEQ ID NO: 5053 - protein, 365 aa, unidentified
  source 1..365: note = Related to NZ_WTLC01000042.1; note = Pseudoalteromonas sp.
MKKISNEFFQSAILKGNSAILDDFSPSVVEQNVANNTFFTIRSDTAHKSINERITKIVFSKIPINTSACGFVSGKSYYDFLSPHVYSYYYLRLDIKQFFHSIPISEVKKLLEDNFTKDKGTFKYSPYEIAFMALTHRVSKNSSNKELINKDLLPIGFSSSPVISNILFRKIDILIQKYCENKKIKYTRYADDLLFSTLNSKFVHSEQFEKEISILVSTLGLKLNNKKRKACENTISLNGYVIQNTKPKEMTFFSVRKDDPVGTIRLSNKKLKIIKKLIAAIGKNIPSVTIMEDLFGMNFDKFRGKHFNNLMFFNKYVEDQLQNKLKGYRSYLISLIQYDKRVGHVDVDCLESVIELINKINKYIK

SEQ ID NO: 5054 - protein, 367 aa, Aeromonas sp.
  source 1..367: note = Related to NZ_RJCW01000006.1; note = Aeromonas dhakensis
MNEMNKDFFINAILNKDETLLNTFKPSVVEHQVGDDFFFEIQDRTPHKNINKRITNIILSQIPLNSSACGFIRSKSYYDFLQPHVTGYYFLRLDIKNFFHTIDSDLIDDLLLSLFSDEKKGSDTLSPFDIASLVVTHKVSESCSCELINGKRILPIGFPSSPVISNIIFRKIDLIIQKFCDDKRIKYTRYADDLLFSSPDNKFIHSEQFEKEISIFVAILNLKLNKKKKIACENTISLNGYVIQNEKGKKTRHLHVYKEEPIGTIRLSIKKTKIIQKMVYLLDKKIAPVTIVSKLFKINYHTHKFKYRRNLEFFKKYADDQLQNKLKGYRSYLLSIINYNKIKPCVSTEHIDKYLYLVDKINSYIKE

SEQ ID NO: 5055 - protein, 366 aa, unidentified
  source 1..366: note = Related to CP069319.1; note = Kosakonia cowanii
MKLITNEVFSKTILKGKSELFDTFTPLSTERQIGKEVCCIIPDSTDHKVINNSLTKIVFSRIPLNNSAYGFVPNRSYLDFLTPHVKNYYFLRLDIKKFFYSIDISLIKKLVQSLFSQDKEGKKHSPYDVVMEAITHKTSSDFPIAEIRNRQVLPIGYPSSPVISNILFRPIDILIQKYCEGKKITYTRYADDMLFSGNTKRILHGENFETEISILLATIGLKINNKKTIACENTISLNGYVIQNIKPTVNEFLSQYYETSIGHIHISNKKTQLICKVIHSLRKKESPENIMATHFGKTYNKHKFKYTKDYSFYIKYADMQLQNKLKGYRSFLISLIKHNKKNNCISDKNIEKYSNLAREIERHIKN

SEQ ID NO: 5056 - protein, 365 aa, unidentified
  source 1..365: note = Related to FMAY01000002.1; note = Kosakonia oryzendophytica
MKLINNEIFIRTILKGNTDLFNTFVPTSAECQIGKEFCCVISDSTNHKAINHALTKIIFSRIPLNSSACGFVKNKSYLDFLTPHIKNYYFLRLDIKKFFYSIDVSLVENLAKSLFSQDKEGNKFSPYNIVMDAITHKASASFPITELRNKQVLPIGYPSSPVISNIIFRPIDILIQKYCEGKNIIYTRYADDMLFSANTKRVLHDRSFQTEIAILLSTINLKINKTKTIACENTISLNGYVIQNERPIFRKSPHQNYEQPTGHIRISNKKTEIIHKILHSLREKESPSTIMKKHFGKSYDNHKFIYKKDYAFFIKYIETQLQNKLKGYRSFLISLIQHDKKNFCIADEHIEKYSKLTKEIERYII

SEQ ID NO: 5057 - protein, 349 aa, unidentified
  source 1..349: note = Related to NZ_CP030062.1; note = Mannheimia varigena
MFDDSIFNRIILQNHLSLRKDFHPKVIGIKINKNLYFSINSDIHRDINKRIVNYILSDIPVNSSACAYIKGKSYLDFLSPHCKNCYFLRLDIKNFFHSFPERILDEFLLSLFNNEKPKGSDELSSYELARLVLLYKCDDEYSDDSIKGRSILPIGFPSSPIISNILFRKIDILIEKYCYTRGITYTRYADDMLFSSKSSGFLLKSEFEREMSFLISLLGFRLNNNKTIRSSNELSLNGYVIYNYMENNRSGIRLSNKKLSIIRKVIYYKKNKMSNDFIMRRLFNIHINNFKFKYGKHESFFEKYCEDQIQHKIRGFRSFLLSFSNYSKENYGVCEEYIELVNELEKYII

SEQ ID NO: 5058 - protein, 364 aa, Vibrio sp.
  source 1..364: note = Related to NZ_CP090019.1; note = Vibrio kanaloae
MKKISRDDFVKDILGLSVSTSLDSPTLSVKYHKIKSQDTYSIVEQTLHYYANKAINDNILSKISVNSSAKGFVKGKSYLDFLSEHKDGYYFLRLDIKKFFPSISQTDIRNVLSQYLSYKINKKDKISTLDYAMNVITHRVDPKSAPFLPVGFSSSPTLSNIIFRKIDILIEKLCLDKNVKYTRYADDLLFSSSNNPEILDDKFINEISKLVSILSLKLNVKKTKRKKGLISLNGYVICNKSPDQPWLFSKKKRYFTGNLWVSNKKTKNFSKLIYLMEKGYSSDYIANKVLKITPNNNHVFYGVNVDFYTKYCNDQVLNKARGYRSFLLSLIIYDTKNKCVEENYINKYSKLVNRLDLVIDKYTS

SEQ ID NO: 5059 - protein, 375 aa, unidentified
  source 1..375: note = Related to WMDK01000003.1; note = Photobacterium carnosum
MSMCSMCHTVNFCFCIKDKAYYMSKYIERKIGPSLTSKLLSNIDRNVVSELKVGKDYTYSMLTDSHLEVINKELVENLFSHIPLNNSCVGFVKKKSYLDLLEPHRYSKKFTRLDISSFFHSISISDVKASLTPYVNPLFLDKEKKISTLEKIIECITYDVPLTSSNTIFRGKKILPMGFSSSPVISNVVFRKIDIQIQKYCIENKIIYTRYADDMLFSSNKELVSQVEFINKIQSLVSQLSLRINERKTITTSGHISLNGYVIDGSSGTIRLSNKKLSRINKITHQLLVRSKSPSSVAKKLYGYSISQYNFKYSYSKEFFEQFCKDQLHNKIAGNRAYLISVLKFNDRYECICPDYLKKSKVMLDRLNEILDNWR

SEQ ID NO: 5060 - protein, 353 aa, Vibrio sp.
  source 1..353: note = Related to MCSX01000068.1; note = Vibrio cyclitrophicus
MSKYNERKIGPSLISKLLADVDHNVISEAKVGKDFTYSMLTNSDLEVLNKELVSDFFSKIPLSNSCVGFVKNKSYLDLLEPHRFSNHFTRLDISSFFHSISIDDVKSSLSPYVKPEFLDEDKSISSIEKVIDCITYSVPTTSENVKSRGKKILPMGFSSSPVVSNIVFRRIDIQIQKYCIENNIIYTRYADDMLFSSTNELVIKVEFVNKIKSLVAQLSLKINEMKTITTSGHVSLNGYVIDGVNGTIRLSNNKLSRINKITHQLLVRRKPPEYVAKKLYGYSISKFKFRYGFSKDFFDQYCKDQLHNKIAGNRSYLISLIKYNERHQCMCPIYFSKSKLMLDRLNNILDNWK

SEQ ID NO: 5061 - protein, 353 aa, Vibrio sp.
  source 1..353: note = Related to ACZN01000014.1; note = Vibrio coralliilyticus
MSKYSDIKISPSLNSKLLANVDRNVVSEIKVGKDYTYSIMAGSNLDVLNRELASDFFSKIPLNNSCVGFVKNKSYLDLLEPHRFSTKFTRLDISSFFHSISIEDVKLSIEPYVKPKFLDNDKTLLSIDKIIEYITYDVPQKSKNVKFRGKTILPMGFSSSPIISNIVFRKIDIQIHKYCNDNNIIYTRYADDMLFSSNNEIVGQRIFINKIRSLVSQISLKINERKTITTSDHISLNGYVIDGASGTIRLSNKKLNKINKITHQLLVRDRSPAVVAKKLYGYSISKYDFKFGYSQEFFEQYCKDQLHNKIAGNRSYLISVLKFNEQHDCICPEYVVKSKIMLDRLNKILDNWR

SEQ ID NO: 5062 - protein, 356 aa, Aeromonas hydrophila
  source 1..356: note = Related to JAEHJS010000001.1
MNKTKVITLQSEHKVLLCEDANPDDISSIFYLGKLAFKIKANCFREQIAIYISNSIQDVIPINSAATGFIKRKSYLDFLSPHRRSSFFIRLDVKDFFHSIKEEDIKKSLSNYIVPSHIMIEDKKTPTIDQLIKYIMHEIPDDFPDKNLKGKKILPIGFPSSPSISNLVFRKIDILISKYCQHENIMYTRYADDLLFSSKKKLPPELENKISEYLSILSLKQNNKKTLCTKSHISINGYVIDGETNSIRLSNHKLQRINKLTHAIINRKDSPKEIMKVMYGKTFSQYPFNYPKGKRNFYIKYCIDQINNKLKGYRSYLLSIIKYNKSEIIITSTYKEKLMTVITRIEKCIDIYNKLK

SEQ ID NO: 5063 - protein, 380 aa, Vibrio parahaemolyticus
  source 1..380: note = Related to AVPX01000003.1
MLTASKLPSHITRVSCGLQVTCESLFCIGSDMKTNKIKLPASLGAFLNENSDTAVKERKIKGNYFYSVDDSVLDKHQTLAKILSEAIPKNSASKGFSADCSYLDFLKPHTPSRFFLRMDISSFFHSIPVEQIANKLKPYFDNNADNESHAVSVDSILKKVTYKVPETSSNKKILGETILPMGFPCSPTLSNLFFRPLDIVIQSYCLEHDVIYTRYADDMLFSSKYNQTIGSGDVETFIKRLMNKNSLLINTKKTLYTEGHISLNGYVIDSNGGCIRLSNSKLLTINKLTKMLIVQKVSLRHVAESLFGMNIRNLPYENANTNAFFEKKCRKIVLDKVRGFRSHIIGVKKHGIATSSISAESVKKYEKIIERLEKIILQHG

SEQ ID NO: 5064 - protein, 351 aa, Citrobacter sp.
  source 1..351: note = Related to CP057863.1; note = Citrobacter freundii
MKITKIALSDDLRAFLTNDDVQLVREMKIKKDFFYHLESEETARYHKKIEILISKYIPVSRSSYGFVKGKSYFDFLSPHLDSKYFSRLDIKKFFHSISADDLSKKLKPYFVDKLDKDSNVRLIDLILKKLTYEVPANSKNQYFIGKKILPIGFPCSPIISNLVLRPIDIQIEKICKEHNVIYTRYADDMLFSSKYMLSLFNGEIKNSVNRIISHIGLTLNESKTVITSGHISLNGYVIDGTTNTLRVSNEKTMKLKKTIRLIILKKERFSAIACKYYGLNIKNLRYHNANTDKYFETYCKNIVLNKLSGYRAYFISILKFDSEHNVLDEKSIIKYNLIISDLDKILNEYRN

SEQ ID NO: 5065 - protein, 344 aa, unidentified
  source 1..344: note = Related to PNCI01000020.1; note = Pseudoalteromonas rubra
MKLSQKEVLNALKVQSIDDIKKISNEFSFKDGFYIPESMEYKILSKNLSVIFSKLPLSSAAKAYRKKHSYYDFFRPHLEGEHFLRLDIKAFFNSITSEHLEGFLISHLKGKNAYEIKMLARAISFFLTVKVDKKQILPIGFPASPSIANLIFRPLDITIEKLCHNKKIIYSRYSDDLLFSSASGSVIHSSWFESQISYIISKLDMRLNTSKRIATSKEISLNGYVLYGEENNKKIRFSNQRLRILKKLIHYKKVRNLPDRVIAKKLFQDEVRILDSSLRFNKKSEFLDTFCRDQVINKLRGYRSYLISLLKYDNLYSCVDREYKIYICDLIGELNSIIFSYDRG

SEQ ID NO: 5066 - protein, 342 aa, unidentified
  source 1..342: note = Related to NZ_AHBZ03000021.1; note = Pseudoalteromonas citrea
MKLSQKEIFKALEVKSIEDIKKISSDFAFKNGFYIPRSPEYKTSSENLNVLFSKLPLSSVAKAYRKKHSYFDFFRPHLDGEHFLRLDVKAFFNSIKREQIEIFLISHLRGKNAYEVKVLAKAISFFLTVEVDKQRVLPIGFPASPAIANLVFRPLDIAIEKLCHEKKIIYSRYSDDFLFSSASNSIIHSNWFESQISYIISKLDMRLNNGKRITTSGAISLNGYVISGEENNKKLSFSNLRLKTLKKLIHFKKIRKLSDKMIAKKLFQDNLKNLNLKYSDEKSFIDKFCRDQVINKLRGYRSYLISLLNYDNLYSCVDSAHRRHICILIEDLNSIILSYDRG

SEQ ID NO: 5067 - protein, 344 aa, unidentified
  source 1..344: note = Related to NZ_CP045418.1; note = Pseudoalteromonas sp.
MKLSQKEIFKALQVESIDDIKNISSDFSFKGGFYIPNDLKYKTSSQNLSKLFSKLPLSSAAKAYRKNHSYFDFFRPHLGGKYFLRLDIKAFFNSIKREQIEDFLISHLKGKNAYEIKFLAKRISFFLTVEADKDQILPIGFPASPAIANLVFRPLDIAIEKLCQEKKIIYSRYSDDLMFSSENSSTIHSNWFESQISYIISKLDMRLNTRKRIATTDTISLNGYVISGESPNKKISFSNQRLRILKKLIHYKKVRKLPDKVIAKKLFQDNLKSLDSSLKFAKKESFLDTFCRDQVINKLRGFRSYLISLLNYDDLYSCVQSEHREHISSLTEELNTIILSYDRG

SEQ ID NO: 5068 - protein, 341 aa, unidentified
  source 1..341: note = Related to NZ_CP055159.1; note = Shewanella algae
MKKISVAEILTSLGVKSIAEIDQIPKDHRLVSSYHVAGSSAYLAASKSIGQLISRLPLNSSSVAYRKGLSYFDFFRPHLKGKYFLRLDIKSFFHSITIDSIIRTFDSHIKGSKRREKSELTRKLTDFLTIEFEGKKILPIGFPASPQVANLVFRPLDIQIEKLCLEKGVSYTRYADDLLFSSQSEKVIHSTWFESTISSIISQQELKLNNSKKIKTKGKISLNGYLISGSDYKKISFSNKRLTVVRKLLYFKNKKNYDDLSIMRRLFPTDLKNLHLVHPNKNEFLKVFAQSQILQKLKGFRSYLLSIVNYGEKYNCIEQSHRIVLLELISNLNDVILKYEN

SEQ ID NO: 5069 - protein, 342 aa, unidentified
  source 1..342: note = Related to JADYXO010000004.1; note = Pseudoalteromonas sp.
MSKISILEVLSSLNVESIQDIDKIPKNSKLKSGYHIPDNGAYSEASSALGELLSKLPLNNSSVAYRKGYSYFDFFRPHIKSNYFLRLDIKSFFHSISKSVIEQTIESHLRSSKELDKSLLARKVSEFLTIKYDKVDILPIGFPASPRVANLIFRPLDIQIEKICLESGIIYSRYSDDLLFSSINDKTIKSNWFESQISYVISQLNMKLNNKKTIKTKNQISLNGYVISGSENNKYMSFSNERLKLIRKLIYLKKVKKISDFSIMRKLFFTEISNLKLIYHNKAEFTQVYAKSQVENKLKGFRSYLLSLVNYGDRYDCVQLEHKKMLINLIEELNLLIFQYNN

SEQ ID NO: 5070 - protein, 356 aa, unidentified
  source 1..356: note = Related to JADYXL010000003.1; note = Pseudoalteromonas sp.
MKTITKKYFMENILNSNPPGDIPDNSIQEVRIGKDFAYSIDKKFESYSINKRLTSLVFNKVPLNDSAVAFRQGMSYYDFMFPHKNNYKFLRLDVKSYFHSLRIRAIRNCLKHYFMGSRLTNNTTMVDQALKYCTYTIPTDSKNVKFSEKVVLPIGFPSSPVISNIIFRQLDIEIQKICYKHEIIYTRYADDMLFSAKKSNIYIHNALFEEEISRLLQRLSLKLNNKKTLKKNHTLSLNGNVIAFGKAGGSLRLSNKKVKLINKVTYLALVKEESAVFIMNKLFNVNINNYNFQFQQDEIFFKKVCMDQLFNKAVGYRSYLLSIIQFDKKNNCLETRYRKKYSKIITRLDKLIDIYS

SEQ ID NO: 5071 - protein, 342 aa, unidentified
  source 1..342: note = Related to JAFLWB010000009.1; note = Enterococcus sp.
MRINSKLYDDLENYFSMSVNELTITTSLEAKDRVEIFSIEKKNKEKREIHSVDTKTTMWKVQNFLNNKYFYQNNFPEYVFGFLKGKSYFGFLQYHVSKKNTNNFLKLDIKNFFGSIDTEVLIEDIVNDFEEDTYKKEELKMLFKVVLTYKDQLPQGFQTSPYLSNYYFLRADLRIKKYCDKLDFKYSRYADDIIISTLSKGEKLFSKGTVSMIDRIIADFDLKLNRSKTRVAKRELVLNGFVISSEVRLSQSKLKELRRVLFIIEHNQCKNSDQLLDLINSDKKINSKNKKRYYSTEYLLKYLSGIRAFLISSLKNISTKSDWYKTASKLIVRVEAVILKMY

SEQ ID NO: 5072 - protein, 334 aa, unidentified
  source 1..334: note = Related to NZ_CP049886.1; note = Vagococcus coleopterorum
MYNLSDHIEHVYKKNISELIDQLELDKKNNVEEFNINKNNGTKRNITMVVGDCILGRLQSFLSDNYFNKVEFPINSFGFRENCSYFDFLDIHCSSEEKDFLKLDLKDFFSSIDAKLVCENLAKDFERNVKKRVKLEELFFTVITFKGKIPQGFKTSPFISNYFFVRADLRFQKYCDKLNYQYSRYADDIIISSNTGKDFFVGNTIAIAKKILADFNLKLNSSKTKYAKNELVLNGYVISNETRLSQSKLREIRRVLFIMESSVNLDVATDRLNSKKYFSSKISNRIFDLEYLFNYLSGYRSFLISSIQKKETGKWKDTASKLIKRIEAQLLRQE

SEQ ID NO: 5073 - protein, 342 aa, unidentified
  source 1..342: note = Related to VTIG01000006.1; note = Listeria monocytogenes
MLSIHEHIKDRLEISIEDLVKVIKSEKLNNVCTYNLSKKGKERQVVEVDKDTTLYYVQTILLKFFSSINHFPEYVFGFQKHKSYYKFLDMHTTGNDETYFLKLDIQNFFTSLDAEKLLTNLVAQFEQVTANQPIVKELLYAALTYNNKIPQGFKTSPFLSNYYFFIADLRIKKYCDKLNIKYSRYADDMIFSSHFKKNIYSNRTIKAFEIILFDFNLKLNKSKTKLSKKELCLNGYVVSNEVKLSMNKLKELKRILFIIEQNKQKQTKDLLISINNHTYLHSSRKKNTRYFSEEYLKNYLSGYRSFLLSFIKENTHQKKWREISKKIILRIEKALLILYDLQ

SEQ ID NO: 5074 - protein, 329 aa, unidentified
  source 1..329: note = Related to JAAAJO010000006.1; note = Enterococcus hirae
MDIFSKKQFEHLLNIDIENDTQKIIEEKNNIKNIEIVVNNKTRNILRLPTSSLIRSTQKKIQHTILSDEYYPDCVCGYVKKKSYFDFLKPHCDKKYFLRIDIKDFFDSISSEKLTILLAEKIRINDPKERKEIMDFLLNILFVNKKLPQGFSTSPALSNLFFKRADLRIEKYCMTQKITYTRYVDDLLFSSNQNNLIGTKILTTIKYICKDFGLEINYKKIKRGIDTFSLNGFVIDNSEIRLSRKKLAYLKEVLFFLDHNCHKDNLDILISKEFGSKFYYTENILSFLSGYRAFLISSLSSNPSTWNDKCRLLINRIEKLTIILSKKIL

SEQ ID NO: 5075 - protein, 334 aa, unidentified
  source 1..334: note = Related to NZ_NUOQ01000048.1; note = Priestia megaterium
MQIFIYKEEYFYDKILSSSKALIEETIKDKDKFYREKKIPKKNGDRTLFCLKKDCPLSKVQQNIRMNFLNKISIPDYVYGFVPNHSYKDFLLPHTNKKYYIRLDIKNFFDSINSEILSEIFSYYFQVKDVVNDVLLRQFIELVTLNDRVPQGAITSPIISNIIFRQLDLRIRKYCAKFNITYTRYADDLLFSSDNPYLHKDFFIKKIKYIVSTKGFQLNKGKVRYDKDFISLNGFVVEKNIRLSRKKLKNISNTLFILERYKNKFNLNIVLAEINKMQLKKEISSISELINYLAGYRSFLIQLLDKENLENFENEKFLKYINRIQTAIIFLDSQ

SEQ ID NO: 5076 - protein, 334 aa, Bacillus sp.
  source 1..334: note = Related to JADILK010000060.1
MQIFLYREDFFYNKVLSSSKKAVDEIIKNKDKFYQEKIIPKKNGYRTLSCLKKDSSLSKIQQSIRSNFLNKISIPDYVYGFVPKHSYKDFLSPHTKRKYYIRLDIENFFQSIDPDTLKEVFAYYFQINHVTNEELLKQFIELVTLDNKVPQGAITSPIVSNIVFRQLDLRIRNYCKKFNITYTRYADDLLFSSDNPYIHKDFFIKKIKYIISTKGFKLNKNKIRYDKEFISLNGFVVENNIRLSRKKLKNLSSSLFILDRYKNKFNLNEVLMEINKIPFKKEINSIGSLINYLSGYRAFLIQLLNRENLEGDENKKFLRYIERIQNAIIFLDSQ

SEQ ID NO: 5077 - protein, 333 aa, Bacillus sp.
  source 1..333: note = Related to NZ_CP072062.1; note = Bacillus mycoides
MQIFLYKEDFFYKKILLDSKESIQEIIKDKNNFYRKKKIPKKKGYRTLCCLERDSSLYKVQQSIRKNFLNKISIPDYVYGFVPKSSYKDFLVPHTGKKYYLRLDIQNFFQSIDTKVLKEVFLYYFRLKDNNEETLNNFVELVTLEDKVPQGAVTSPVISNVIFRKLDLRIYNYCKKFNVTYTRYADDLLFSSDNIYIHQEFFIKKIKYIVSTMGFEINKSKSRYDKDFISLNGFVIDEDIRLSRKKMKNLSSILFVVEKHRNRFNLGDVLTEIQSLIHNKQIDSKHSLIHYLAGYRAFLIQFISKEQKTDLGNKKIFRYIERIENTILFLYSL

SEQ ID NO: 5078 - protein, 334 aa, Bacillus sp.
  source 1..334: note = Related to NZ_NIST01000001.1
MQIYIYKEDFFYNKILSTSKTQVEEILNDKNRYYTKRKIPKKNGFRTINCLEKNSALSKIQQSIRLNFLNKVSIPNYVYGFVSGQSYSDYLKPHVRQKYFLRLDIKNFFENITSQTIESVFSYYFRLNTNTNNDEELQFFIDLVTLNGKLPQGAITSPTISNIVFRQLDIRINKYCKKFNINYSRYADDLLFSSDNDFLHKEFFIKKIKYILSSRGFEINKHKIRYEQDSISLNGFVIEENIRLSRSKLKGLSKVLFIIDKHKNNLDTTKVISEINDGGFNKEIKNKYSLLNYLAGYRAFLLQFLDRENLEDYNNKKINRYVIRIQNAIELLYQ

SEQ ID NO: 5079 - protein, 333 aa, unidentified
  source 1..333: note = Related to NZ_CP007161.1; note = Virgibacillus sp.
MQIYIYREDFFYNKILATSKSLVEEILKDKSKYYTKRKIPKKNGFRTINCLEKNSALSKIQQSIRINFLNTISIPNYVYGFVSGQSYSDYLKPHVRRKYYLRLDIKNFFENITNDTLESVFSYYFRLNDNKNNEELLLLIDLITLDGKLPQGAITSPTISNIVFRQLDIRINKYCKKFNINYSRYADDLLFSTDNKFLHNDFFIKKIKYILSTRGFELNKHKIRYDQDSISLNGFVIEDNIRISRSKLKGLSSTLFIIDKHRSNFDITKLLSDINNSGLNREIKNKYSLLNYLAGYRAFLLQFLDRENPEEYYNKKVSNYVIRIQNSIELLRG

SEQ ID NO: 5080 - protein, 338 aa, unidentified
  source 1..338: note = Related to CAKKMH010000024.1; note = Priestia megaterium
MLGYIYTEDFFYKKLLSSEKKIVKNTLLIKESFYKERDLSKKGGTRTLSCIEKNSSLYNLQNNLRSNFLNNIPIPDNVKGFVPGHSYRDFVIPHLNNKYYLRLDIKNFFDNITFETVKEVFGEYFKLDNASNNNKLLETFAEIITLRGSLPQGAVTSPTVSNIIFRRIDIRIARYCKKFNINYTRYADDLLFSSNQSNLHKGFFIKKIAFILRDLNLKINSSKIKKTKNYISLNGFVVDKDISLSRKRKSDLTKILFIIDKNKAVCSTDALLFILNTESYIHKSYFFKDKWSLVNYLSGYRALLIDWLPINKETMNYEKSKKLITRIEKVIDFLLGEN

SEQ ID NO: 5081 - protein, 331 aa, Bacillus sp.
  source 1..331: note = Related to NZ_CP031072.1; note = Bacillus mycoides
MIIIFIYKEDFFYDYVLRNSLEEINKQIIDKQNYYYTVKIPKKGGIRVLNCIKQKTPLFELQNLLKVNFLDKIPIAENVFGFVKEQSYKDFLVPHTWENSRERYYLRVDIKDFFGSITNDTILEVFDYYFKTNEKSSKEMNELLMQIISLNGCLPQGAVTSPVVSNVVFRQLDIRIQKYCEKFDVTYSRYADDLLFSSEKLKLHDKFFIKKINSILMSSNFKVNDKKIIKTESEISLNGFVVGKNVRISRSKKRDLNRILFIYEDKKPKNIKDFLDLLNSNKFKNRVKVNNKYFNDKNNLLNYLNGYRSFLINWLNNNSSSIEYKKQKKVY

SEQ ID NO: 5082 - protein, 355 aa, Bacillus sp.
  source 1..355: note = Related to NUYK01000018.1; note = Bacillus cereus
MRKYSFNFEVIIIYIYKEDFFYEYVLRNPLEEVSKQIKNKQDCYYTVKIPKKGGVRVLNCIKQDTSLFELQTSLKVNFLDKIPIAENVYGFVKEQSYKEFLFPHVWDNGKKRYYLRVDIKDFFGSITSETLIKTFKYYFKTSDKVSKELNELLMQIISLNGVLPQGAVTSPVVSNIVFRQLDIRIKKYCDKFDIIYSRYADDLLFSSSSMRLHDKFFIKKINHMLKSLNFNINTKKIKKTESEISLNGFVVGKNVRISRSKKRDLNRVLFIYKDQKPKNINDFLNLLNNNKFKSRIKNNNNKYFEDKINLLNYLNGYRSFLIGWLHNNTLSVDYEHQKQYIERLEEFILNVNRMN

SEQ ID NO: 5083 - protein, 355 aa, Bacillus sp.
  source 1..355: note = Related to NUPV01000049.1; note = Bacillus cereus
MRKYSFKVEVVIIFIYKEDFFYNYVLRNNSLEEINNQIKNKQDSYYTVKIPKKGGIRELNCIRQHTPLIELQRSIKENFLDKIPIAENVYGFVKGQSYKDFLTPHIWENGKKRYYLRVDIKNFFDSISEDTLIKTFSYYFKATVKASNTMNKILMQIISLNGNLPQGAVTSPVVSNIVFRKLDIRIQKYCDKFNFTYTRYADDLLFSSTSTRLHDDFFLKKIKYILKSSDFKVNNKKIKKTENEISLNGFVVGENVRISRSKKRDLNRVLFIYETYKPKRMEDFLVLLNSSKFSSRVEFNDKYFNNKINLLNYLNGYRSFLISWLHNSTSSKGNNKQVEYIERLENLILELNRMS

SEQ ID NO: 5084 - protein, 345 aa, unidentified
  source 1..345: note = Related to NZ_AUMR01000034.1; note = Ectobacillus panaciterrae
MIIIFIYKEDFFYDYILQDSLEEIKKVIENKENNYYIIKIPKKDGLRKLNCIKKETKLYQYQTLIKNKFLNRIPIAENVYGFVKGQSYKDFLVPHTWENNKKRFYLRIDIKDFFGSINTDTLRQVFRYYFKTDENASNEMIDLLLDIVSLDGFLPQGAVTSPVISNIVFRQLDLRIQKYCNKLNFTYTRYADDLLFSSINKRIYDPFFIKMISTILKSRNFKINHSKVKTSDEEISLNGFVVGKNIRLSRSKKRDLNRILFIFQDQKPKNITDFLSLLNSKKFKSRINVNNEYFSNKTNLLNYLSGYRSFLISWLPENKSSPDFKSSKIYIKRIEELILNINNMN

SEQ ID NO: 5085 - protein, 323 aa, Bacillus sp.
  source 1..323: note = Related to NZ_CP095476.1; note = Bacillus glycinifermentans
MKEKIKDKQQNYYLKDIPKKGGRRYLNCIEKETPLYVYQTSLKNKFLNNIPISENAYGFVKGRSYYDFLVPHTRGNNENGRYFLRIDIKDFFDSITTDILEETFKYYFKTDEKSSNEMVGLIIDIISLNDVLPQGAVTSPVVSNIVFRQLDIRIQKYCNKLKVVYTRYADDLLFSSVNNRTHEPFFIKMISNILKTLNFNINFSKIKKSEEEISLNGFVVGQNIRISRKKKRDINRVIFIYKDKKPKTTSEFLTLLNSQIFTTRTRKNNEYFSSEISLLNYLSGYRSFLISLLPRSKQSIYYKNMKRYINNLEELILNIINLE

SEQ ID NO: 5086 - protein, 345 aa, unidentified
  source 1..345: note = Related to MWZC01000789.1; note = Chryseobacterium sp.
MRIDSLNKFEKKVLRGSITEYNESLTDDSINQAYHTKIIKKNDNSERTLQCIDSNHDIYKIQKKLKNNFFDFIPLSNHAYGYVKGKSYYDYLTPHIKKKFYLRLDIKDFFNSIKEKKLREVIEYDIDNIKINEDTTLVDFLIKTVTFNGSLPQGAVTSPVLSNMVFRVLDIRISRYCRKFGIEYSRYVDDLLFSSNDLLIHKKVFTNGITKILKSQGFYLNHNKLRKSKDEISLNGFVVGSEIRLSRKKTALLSALIFCYQNTQKKTFDNLSTEFKKHFGIDNEKIINADRLHNYLAGYRSFLLGLLPFDSVGVLPDNMTKINQKYLIKINEIEKLLKLTSKEMN

SEQ ID NO: 5087 - protein, 340 aa, unidentified
  source 1..340: note = Related to CP049783.1; note = Paenibacillus polymyxa
MRIESLSKFEKKVLRDSVSHYVDLLTEEQLLTAYYTKIIKKKDKSDRVIHCIDNEHLIYKIQKQLKNNFLDFIPLSNCAYGYVKGKSYYDYLKPHVKHGYYMKLDIKDFFHSIKEKELREVLKYYVDDVSINESLTILDFITKVVTVNEFLPQGAVTSPVLSNIYFRFLDIRISRYCRKFGINYTRYVDDLLFSSDNLFIHKRVFINGITKILKSQGFQLNPKKVRKTKSEISLNGFVVGENIRLSRKKTAIISSLIYYYQCSPNKTLEELLTEVEKNLEIKIKISNLHNFLAGYRSFLLGLLPFDSVGVLPEVITRTDKKILYKINEIEKILDLTAANI

SEQ ID NO: 5088 - protein, 342 aa, unidentified
  source 1..342: note = Related to NZ_CP071709.1; note = Cytobacillus gottheilii
MHIEDLNTFETKILRESTKTCVEILKVEKISKAYYTKTISKKNGMKRTLHCINNEHILYKLQGNLKRNFFDYIPLSSHAYGYVKGKSYYNYLEPHVGNDIFLKLDIKDFFGSIKENKLREVLGYYVDDINVSDNFTLIDFIVKVVTVDGKLPQGAVTSPVLSNILFRHLDIRISRYCKKFGITYTRYVDDILLSSASFYLHKKVFVNGIKKILKSYDLYLNTNKIIKTKNEISLNGFVIGKEIRLSRKKTAFISAIIYCYQQTNKKNVDNFIKEIKEHFKLTDSTEINLLWLHNYLAGYRSFLLGLLPFDSVGVLPEHLSKSNRKLLYKINEIEKILDLLIL

SEQ ID NO: 5089 - protein, 339 aa, unidentified
  source 1..339: note = Related to LT608335.1; note = Sporomusa sp.
MKIFSLDYFENRVLKEKIETLIIDPVEKDSCYTQIAVKKRAGGIRTLSCIHLYSRVYHSQKRLKENYFDKIPTSDFCYGYKKGLSYKDFLAPHVDSKYFLRIDLKDFFGSITCNLLSEVLTSYISCLPVNNTTLLDLIIDIVTLDGKLPQGAITSPTLSNIAFRQLDIRIYKYCEKYQVIYSRYADDLLFSSNNMVIHKLFFLKRISNILNSKGFSINRDKIVKATEQISLNGFIVGSELRISRKKRRLLSVILYCFDKYKPRTYNILLNHVNAELGAKPIKTTEYLNNFLSGYRSFLIGWLPYDSLGCLPSEAFLSEFDKKNLRLINQIEYILKKFNP

SEQ ID NO: 5090 - protein, 348 aa, Bacillus sp.
  source 1..348: note = Related to JACYOH010000011.1; note = Bacillus thuringiensis
MKIYKVDYFERQIMNNEYSTEDLLDVFLKKEEHYNLYVIPKKKNRGTRKLYCLSKNKELYRCQQLLKVNFFDRIPVSDYCYGYRTGKCYKNYLEPHIGKKYFLRLDIKDFFDCIGKDIIRDFLLTYVSEDIENTILGKEISFGLLDLITELVTINGHLPQGAITSPVISNLIFRSLDIRIYRYCCRYGITYSRYADDLLFSSENSVLHKNFFTNKIQHILKSGQYNFDINYRKVKKCRGEISLNGFVVGENVRLSRTKIKKMNTIIHVFKKEKDLDKYNILIELKKNYNLVFENVVDLNNFLSGYRSFLIGILPFNSLGELPNNINRYDTKNLRIISEIEGILEKVNK

SEQ ID NO: 5091 - protein, 325 aa, Bacillus sp.
  source 1..325: note = Related to NZ_CP023179.1; note = Bacillus cereus
MKKNAEISKITNRKIQCYFRVSIPKKGGERIIYCINPSCNLRTLQQNLQRNFLNRIPIPNNVFGFKKGYSYKDFLEPHVNKNYYLRVDIKDFFNSISKELIYDVLTNYLKMDEADNKEVLDTVFDIVSLHGKIPQGAITSPSIANVIFRQIDMRIKKYCKVFNVEYTRYADDMLFSSDNEYLLKPYFIKKIAKILFSKGFRINSSKIKKSNNGQIVLNGFVISDSLSISRKRLSDIQRVLFLYQKGGAPVSISIFLDRINSEQYLYRKKMNGKYFPTRGSLIDYLSGYRAFLIQWLPEDKNSNVYEKLTTLINRIQYLLINIEEI

SEQ ID NO: 5092 - protein, 338 aa, unidentified
  source 1..338: note = Related to WMEQ01000013.1; note = Pontibacillus yanchengensis
MFIYNEDFFYGKILNCRKDALEDILSNKSDEYQERIISKKGGKRYLSCLSDTSSIATLQRGLSNKFLDHIPVPDYVYGFIKGKSYKDYLVPHKNREFYLRVDIKDFFSSINKDLVKEVLDYYIRTDNDTLNKNLIDIIYDIVSLNDSIPQGAITSPSISNIVFRSLDIRINKYCRRFGITYTRYADDLLFSSNNSFLHNKYFLKKISHILQSKRFNINSNKVIKSNKIISLNGFVVGEKIWLSRKRLHDINKVLYLYKTNTFSNINSLLYVLNSSDYIYRKTNNNSFTSKMEIVNYLAGYRSFLLQWYEFQNGDNKNFKLLNKIDEIERILIEIEQLK

SEQ ID NO: 5093 - protein, 379 aa, unidentified
  source 1..379: note = Related to NZ_LZZM01000127.1; note = Clostridium puniceum
MKWIIIMAIRTIYDEEFFYKNILREEKENVIEIINKKKEYYYNKTINKKNGVRNLKCIIEDSPLYFLQKNLVNYFLNNIPLPLYVYGFRKGVSYKKYLEVHLREEVDNNYLESNSRKDVSKDCLQPHLRNYIGKKTCYIRIDIKSFFDSINLDLIKKIFSNYFTPKDSFLKDELLEIFSQIVTLDNLLPQGAVTSPTISNIIFIREDIRIYNYCNKLNIKYSRYADDMLFSSKHNKVFKTYFINMITKILDENGFKINYSKTKKGLDEISLNGFVISNCISLSRGRKHDISKILYIFDTLKPFSTSTYLNMLNDKDNNFKYIKYKADCYFSSRGKLINYLCGYRSFLINWLPRENEELTYNKVKRLIDRIQEVILKIQE

SEQ ID NO: 5094 - protein, 344 aa, unidentified
  source 1..344: note = Related to VDEM01000162.1; note = Cytobacillus firmus
MIVIYIYKKHFFINKVLGTKTKNIYDLVEEKDKHYFNKTIQKKNGVRELKCLKEGDFKHIQQNLKKNFLDELPIPDYVYGFVKYSSYKDFLLPHIGKMYYVRLDIKDFFPSVKKDLLFQAFKSYFKLDGSDNDDVLNLFVDIVTLNEELPQGAVTSPVISNIVFRSLDIRIKYYCDKLGITYTRYADDLLFSSTNEQLHSRYFIKKVSKILGDKKFKLNTDKILKYTDEISLNGFVVGEKVRLSRKRKSDIAQVIRLCRNVKKPVDFDTLLSQLNQLDLRYRKKTVSDNGEEVYFSSKETLANYLLGFRSFFIDWLNTNLISDKREIKFFIDQIETFIDKHYAI

SEQ ID NO: 5095 - protein, 768 aa, unidentified
  source 1..768: note = Halanaerobiaceae bacterium Z-7014; note = Related to JADPIE010000003.1
MVFIKIYSKDFFYKYIIEDKEQDELAEIISNKMYSYLRFEYEKKNGYRFIYSMKKDTGLYEVQTKLKDNFLNEIPIADHVYGFVSGYSYKDFLVRHCYEDKNKTTYFLRLDIQDFFESIKTKMIKETLEYYIKIKDEDNPTVLDLINDLVTINDFLPQGAITSPVLSNIVFRQLDIRFQKYCRKINIKYSRYADDLLFSSKESYLHKRNFTNKIRHILKDKGFKLNFTKTIKSQNEISLNGFVVGNNIRLSRKRNHDISMILYLYDNQSVDEFINILNKENFIYRNKKYDMKTNDEKYFINQDDLINYLAGYRSFLIDWIPIKDGKHKEKHIKLIKNLEVLLEDLSDINNEYNYKGDKMSQKENIPLSVPNLSKDILPNIEETIESGWVSTGGKFIDQFEEKLADYVGVDQAVSCQSGTAGLHLAMRVLGIGPGDEVIAPTVTFIAAVNPIRYMGAEPVFIDCDSDDGPAGPSAEPTNAFTNEGSVNMDLDKLEEFLENECELTDGRVINKSSGREIKAINIVHVFGNPVNMERLIDIAREYGLKVIEDATEALGSYYTEGRYAGRYCGTIGDIGVYSFNANKIITTGGGGMIVARESDLLEEAKFLSTQAKSDRLYYRHDEVGYNYRMTNIQAAFGTDQIDRLEGFIATKIENYRRYKEAIAEIDGLELMAFNEGCRPNHWFYSVLVDPDLYGIDRDELLQELNAVGIQTRPLWGLIHQQKPYLDCQAYRIEQAPYYQQNLINLPCSSNLTAEQVKTVVRYLREFKS

SEQ ID NO: 5096 - protein, 333 aa, unidentified
  source 1..333: note = Related to QBKJ01000001.1; note = Halanaerobium congolense
MEGIDKENLLEIIANKENHYGKNEISKSNGKRIIYSIDNNSQLYKMQKHLVNNFLSQIPIADHVYGFVKDYSYKDFLLRHIHDKNNKTYYYLRLDIKDFFGSINSNLIEETLDYYIKVNEAENGNSIIEIINGIVTLENFLPQGAVTSPVVSNIVFRQLDIRLQRYCRKLDIKYSRYADDLLFSSTNSNLHKNNFFKKVSYILKDKDFRLNYSKTIKDENEISLNGFVVGNNIRLSRKRKKDISKVLFLYNNKPDNQSFVSYLNEHEFLYRDKIGSSYFLNKDDLINYLAGYRSFLIDWIPVKEGRHKEKHINLIENIEDLLENISDVNNEYN

SEQ ID NO: 5097 - protein, 339 aa, unidentified
  source 1..339: note = Related to NZ_FTNC01000003.1; note = Halanaerobium kushneri
MYIKIYNLNYFLKKILEISEEKLKKTLTNKKNAYSKYKIPKKNGYRKIHSLKSGDLSHLQSNLKKNFLDNIPIADNVYGFVEGYGYKDFLIPHTYKKYYLRLDIKNFFESIKTNKLEIIFDYYITASNDEEKDKILDYLISIISLNDYLPQGAITSPATSNIFFRELDIRIQKYCKKLGFDYSRYADDILISSNNDKLPKDFVIKAVNKIVSDRKLKLNYKKIIREKNEISLNGFVVGKGIRLSRNRRYDISKINFLFKSNKSVSQYKFVELLNNANGGFKYRYKNNNGKFFSDIDDLINYLAGYRSFLINWIPDEDNKYYNKHINLLNDIEEILLWLN

SEQ ID NO: 5098 - protein, 323 aa, unidentified
  source 1..323: note = Related to NZ_JAHLOO010000081.1; note = Caldibacillus hisashii
MSKTLEKKENFYEVIEIPKKNGIRVIHCISKNSPLYYLQDQLRKNFLEKIPCSTSACGFIKGSSYKDFLIPHQNMEYYLRIDIKDFFNSIKKDKIKEVLRQYLKLNNEKSNEILNYISELVTIDSYVPQGAVTSPQLSNIIFRKLDVRLQKYCQNLNINYTRYADDLLFSSKFGKVHLPFFLNTIRKILLSENFLINKSKIIKTRKEISLSGFTVGRNIRLSRSRKGDLTKVLFLFNQGGKPKSINQLLERLNSETYRYRMVREERNNNYIYFTSKESILNYLAGYRALLIDWGNHNKYKSLKDESKLILRIEKIIKDISQLS

SEQ ID NO: 5099 - protein, 343 aa, unidentified
  source 1..343: note = Related to NZ_SIRE01000011.1; note = Paenibacillus thalictri
MNHIKIYDESFFYRAILEIEHESMISKVVENKINSYKEITISKHSGSRTIHCINNNDQLYGIQRNLVDNLFSKVALPDNICGFVKKRSYRDFLVPHLWNNNEKRYYLRLDISDFFGSINSAKIHDALDGLIDLDEEKKVKMLKLISEICTLNDILPQGAVTSPAISNIVFKRLDVRIRNYCRKLNVTYTRYADDLLFSTTKEKTLGGYFVKKIVGILKSSGFILNRKKVKRGKFEISLNGFIVGENIRISRKKKRDIAAFFFLYIRGGKPKNIVEILERLNDYDFRFRQKLFTSKNDIINYLAGYRSFIIDWLPQETESNVHKDLKKIIDKIQETLEEIEELE

SEQ ID NO: 5100 - protein, 343 aa, unidentified
  source 1..343: note = Related to NZ_BNJP01000020.1; note = Paenibacillus glycanilyticus
MTKIKIFDENFFYRSVLGIEDEHIFNNLVITKFTSYKEIAVPKNGGIRTIQCIDKENQLYKIQRNLVDNFLSKIHLPDNICGFVKRKSYRDFLIPHAWENNNKRFYLRLDISDFFGSINSAKIHNSLNDLIDIEEDKKNKILNMISEICTLNDVLPQGAVTSPVLSNIVFKRLDIRIRNYCRKLDVIYTRYADDLLFSTTKERSLGGFFVKKIIGILKTSGFILNRKKVKRGISEISLNGFIVGQNVRISRKKKSDITAFFYLFIYGGRPKTIKDLIERLNSYKFQYRRSLFVSKNDMINYLAGYRSFLIDWLPEDTETKVYKELVKIINKIQNTLEEIEALE

SEQ ID NO: 5101 - protein, 347 aa, unidentified
  source 1..347: note = Related to NZ_MBFH01000016.1; note = Brevibacillus laterosporus
MFVGDIILIYKKNFYYQTVLGVDDSSMVKEVIENKEKHYKPIVIYNRGKKREINCIEEKRELYNFQSNLAKNFLNKLPLPDNVCGFVKNRSYRDFLVPHINSHNSDRFYLRLDIKDFFNSISESHLREVLQEYVTIIDKEDNEEVILSMVNLVTLNGSLPQGGVTSPVLSNLVFRSIDIRIRNYCRKLDVTYTRYADDMLFSCDKEKVINGFFIKMIISILKSKKFVLNRRKVKKGASQISLNGFVVSHNIRISRKKRQDINRFIFLWEKGGTPKTIDELILRLNSFDFSYRIKDFNSKYSVLNYLAGYRSMLINWLPNEFDDEWYQQSERLIRKINMIIMKIEQLE

SEQ ID NO: 5102 - protein, 329 aa, Bacillus sp.
  source 1..329: note = Related to CM000757.1; note = Bacillus thuringiensis
MLGIEKDENFKIIIEKKANNYKNLLISRKGKQREIKCINKESQLYRIQANLVQNFLNEIPLPDNVCGFVKKRSYRDFLVPHINNSPTDRYYLRLDIKDFFDSITEEKIEKSLQEYVTINDGAENKEVLKDIIDIVTLNGCLPQGGVTSPVISNIIFRRLDIRIRKYCSKLNITYSRYADDMLFSSQHNRLFDGFFVKMIAKILKDSNFVLNRKKIKKGVSFISLNGFVVGKNIRISRKKRQDINRFIFLFEKGGNPKDVNELLSRLNKEKFYYRSRNFESKSSVIDYLAGYRSMLISWIPEDSDEAWKENVKNLLDKIQKIIMKIEYLK

SEQ ID NO: 5103 - protein, 349 aa, Bacillus sp.
  source 1..349: note = Related to NZ_CP018173.1; note = Bacillus subtilis
MAFYIYHTEQFFQNIIRDSSANIQASLEEKEGSYEKFSISKNSGTRTIYSIKSESKLKKYQKNLLSNFFEYINISDQSYGFVKERSYKDYLQPHINNNLYKDRYYLRLDIKEFFESIKRETIKEELSFYFRLKDSKQTEEILKLVTDIVTLNDSIPQGAVTSPTLSNIIFRELDVKINAYCNQLGVVYTRYADDMLFSSFREHDKFAQPLIKVIYKILKTKGFKLNYKKTIKGKNQISLNGFIVGDNIRLSRKRKKDINNIIFHYYKSGKNIEQFLNSLSEVDLIYRHKNINSLGSLVNYLNGYRAFLIDWIPVNVSNDKISKHSKNIDTIEQIVERLENFKNSIRKLK

SEQ ID NO: 5104 - protein, 351 aa, unidentified
  source 1..351: note = Related to NFKO01000003.1; note = Pseudoflavonifractor sp.
MRYLLFLFAWEDSMYTIESFCNAIWETSYSKVSQGVTKEEYGEFEIPKKGGSRVINYLGRDTSMWNLQHKLLKNFLEKQDLPVCVKGFRQGESYHSFLAEHIGSKFFLRIDISSFFPSITEKQIKNELSRLLACNSNEEKEKLLKLICDITTLNDCLPQGACTSPAISNLVMARIDQRITKYCQVFDIRYTRYADDLLFSSEGFNFKSKNWFLKKIKYILSSQNLKLNYSKIKYGENELVLNGYIISNKGICLSRSRLSDIRHVVSFAKKNRNLIEEFGSERFLQEINKLPLRHRDLTEYPFNTVFQFIQYMCGYRAFLISLVDRSYEETSFQKQLQHLIRKLETQITHYT

SEQ ID NO: 5105 - protein, 338 aa, unidentified
  source 1..338: note = Related to DWWA01000023.1; note = Candidatus Ruthenibacterium merdavium
MFTIESFCNAIWETSYAKVSLNILKDDYSEFEIPKKDGKRKISYLDKDSGLWSLQHKLLINFLNKQDLPVCVKGFKKGENYRSFLAEHIGAKFFLRIDISSFFPSITEKQIKSELARLIICNSDEDKEKLLGLLCDITTLNGSLPQGACTSPAISNLVMARIDQRITKYCQVFDVRYTRYADDMLFSSHVFDFDKKKWFLKKIKYILSSQDLKLNYSKIKFSQDQLVLNGYVISGDGIRLSRNRLSDIRHVVSFASKNYMLIQNSESQKFLQEVNKLPLQYRNLVDYPFKTVFQFVQYMCGYRAFLISLVDQNYAETSFQKQVQRLIRKLEIQIVHCT

SEQ ID NO: 5106 - protein, 390 aa, unidentified
  source 1..390: note = Related to NZ_CABVEO010000001.1; note = Faecalibacterium prausnitzii
MAMPAAGVRRDHSSMCCVKHALRDLLGKYLYTALCFFLLEKNAMFTTESFCNLVWGTSYLKVLRKISKEDYNEFEIPKKGGTRTINYVDRQSSLWKLQRELLNKYLVKQDLPICVKGFKKGENYKSFLSEHIGAEFFLRIDIANFFPSIKISSVKRELALIIRCDNDAEEEKLLDLIGEIVTLDGRLPQGASTSPVISNLVMARIDQRITKYCQVFNVQYTRYADDLLFSSNTFDFENKKWFLKKIKYILKSQELSLNYSKIRYGHKEIILNGYVISNNEIRLSRNRLFDIRQIVKFTKENVPLIRSIGLDEFLSKANKLPLKHRNLKEYPFKSIFQFSQYLCGYRAYLISMVDTNCLQTSFQKELQRLIRKIEAQILLLEQALPIRNSN

SEQ ID NO: 5107 - protein, 329 aa, unidentified
  source 1..329: note = Clostridia bacterium; note = Related to JAGARU010000066.1
MIWNYSYSTVQSKIAQKKYKTISIPKRNGFRELSFLDPKTDLHMLQSGLVNFLKKIELPVCAKGFVKGESYLSYLEHHIGSIHFLRLDIKDFFPSITRKLIEREISCFMSFDSEEEKKKIVKLVSDLVTYHNCLPQGAVSSPVISNIVMIRIDQRILKYCQVLGIKYTRYADDLLFSSEEFDFNDKKWFLRKIKHIVSDGNFKINYGKLKSSTREISLNGYVISQEGLRLSRQRLNDIKKVVSFASSNRQMLQSDPNSYVQALNQLNLEHRGLSVYPFKSVYQFYQFLCGYRSYLISFLKYDIESQFRKKLCKLLDKLEKIIKQIASVL

SEQ ID NO: 5108 - protein, 334 aa, unidentified
  source 1..334: note = Related to JAHLPV010000019.1; note = Acetivibrio sp.
MTIESFCKVAWNLSYNQVRSSITKKDYIQFDIPKKNGVRTITLLPEGSSLYVLQRNFNKYYLNKQGLPICVKGFVRGESYISYLESHIGAKYFVRMDIKDFFPSITSEIIKDTFSHLLSFDTDEEKEKILELISEICTYEGVLPQGVPTSPVISNIVMTRIDQRITKYCQILGITYTRYADDMLFSSNMFDFKTKKWFIKKIKFILASMHFKINYSKLKFSENEISLNGYVVSDTGIRLSRSRLMDIKKAITFSKNNHTLLKTDPTGFLRLVNETSLEYRNLKVYPFNSVFQFTQFLIGYRSYLISFLRYDIDSTFRKKAEKLIRNIEGELEFY

SEQ ID NO: 5109 - protein, 338 aa, unidentified
  source 1..338: note = Related to DWZO01000095.1; note = Candidatus Massiliomicrobiota merdigallinarum
MFDLEQFCQNIFGKGFDEIKEKINKEDYSSFVIPKKRGMRQIIALPKNSELRRMQKLLLDKFFANYSLPIPAKGFAKHESYKNYLMPHMGANYFLRIDISNFFNSIKFEHVEELLKDLFVFMDKDEKSKVIDLIWDIVSYNDSIPQGGVTSPIISNLIFRKLDQRILKYCQLFDIEYTRYADDLLFSSYEFNFMDKKWFLKKIKYILGSRKFRINYRKIKYGYKEISLNGFIVSNRDIRLSRSRLFDIRHIVSYIRNNEDAKRKDKCLLGINNLRFKHYDIEKYPFKSYYRVIQFLCGYRSFIISWIDDCIPNIANQKKLRKLVNEIEKAINILSEYI

SEQ ID NO: 5110 - protein, 343 aa, unidentified
  source 1..343: note = Related to QRWY01000002.1; note = Coprobacillus sp.
MNAKEIFCLKIIGDSNFEILTVLSNKKNEYEKIEIPKKKGYRKIYCLKSNSKIKRYQQNLINNFFSHYPIPVVAKGFVEGENYFSYMKEHVGSNYFLRIDIKDFFESIKYEHFENFMYEMETFKDKNNEGIIKIIWNIISYNDYLVQGAVSSPMISNLIFRRTDQRILKYCQELGIKYTRYADDLLFSSSNFEFKKKKWFLKKINYILRQNKFQMNCSKLKCCDYQISLNGFVISYDNIRLSRKKYHDISQVVWYVNKSDIYEKNFFDELHKLGFYNNKLRTINTYYSLLQYLCGYRSFLIGSYKECEMGDDTKRKIEYIIKKIDMSIIKVISNKYPTYWVTK

SEQ ID NO: 5111 - protein, 348 aa, unidentified
  source 1..348: note = Related to NZ_ACXX02000002.1; note = Ruminiclostridium papyrosolvens
MRIYKEEYFYNSILQCNKQKVLNGLEAKSEAYFKYEIPKANNKKRTISALDKDSLIYELQSNLYKNFFSFQPIPVCVKGFVKGNSYLDFLNAHIYDNYSTYFVRLDIRDFFDSISKETMISTLQEFINIEDVINVIYDICTLEDKLPQGAVTSPLLSNLVLRRIDQRVTLYCQSLGVAYTRYADDLLFSSNEIDFSQQKWFVKKIKYILGSIDLKINYNKIKYGKDLISINGYVVNSNVNLSRKKLYNLTSVLYFFNKNKGKYKKVYKVDNKIFMNTNWLHDLNTYLKNSTSTNLEFVSVHKLQNFLIGYRAYLISCISYSSENKVNQYSSKIKHIESIINKLLELNQ

SEQ ID NO: 5112 - protein, 347 aa, unidentified
  source 1..347: note = Related to NC_016791.1; note = Clostridium sp.
MKIYKEEYFYNSILKHSKETVLKGLGAKSEAYFKFDMPKANNEKRTISALDKDNLIHELQSNLNNNFFSLQPLPICVKGFVKGNSYLDYLNAHIYDNSSTYFVRLDIKDFFDSISKEVLISTLREFVGIEDVINVIYDICTLEEKLPQGAVTSPLLSNLVLRRIDQRITLYCQSLGVTYTRYADDLLFSSNEIDFRLKKWFVKKIKYILCSIDLKINYKKVKYGKGLISINGYVVDNNVNLSRKKLYNLTSVLYFFNKNKGKYKKIYKVDNNIFLNRTWLEDLNTFLTNSTSSKLIFGSIQKLQNFLIGYRAYLISCIGYSSEKKIDQYSSKINHIESILNKLLQLN

SEQ ID NO: 5113 - protein, 346 aa, unidentified
  source 1..346: note = Related to JACQZP010000009.1; note = Acetobacterium woodii
MFIFDENYFYNIVIKCDRNQLLNIIKEKNLQYESFEIPKNDGMRVISAIKKNSQLVRLQKNLNSNLFSKIPLPVCVRGFVSGESYNSYLVEHIGKKFFLRADISAFFDSIKKDTIISMLNEFISVINVIEQISEVVTLDDKLPQGAITSPSVSNLIFRRIDQRITKYCQELNVTYTRYADDMLFSSDKLNFNESTFFYAMIKKILKENGFACNNKKKKIEIDEISLGGFVISNDVHLSRKKLENINKLIYFFRKDKTFEKQKYLVDSLVFQDKHWLNEVNNLKLKENISFKCFSSNNQLIDYLCGYRAFIISIVQANDNNTENIKQLRKKINNIEMIIEAIIKHST

SEQ ID NO: 5114 - protein, 364 aa, unidentified
  source 1..364: note = Related to QXWO01000034.1; note = Lachnospiraceae bacterium
MISVNRYLKLYSKKYFLTRILECSEEELAQAKGEKGIVCIEDRIPKKGGFRSIVSVKPGSSLAKLQKKLYKNYLSQIPVSTAAKGFVKGCSYVNFLEEHVGHSYFLRVDIRDFFDSITKEKLAECLEPFAEKEIADEIMELCTWNGKVPQGFSTSPALSNLVFRRIDQRVRKYCRSYHKEMDRRIFYTRYADDMLFSSAGTLEFDFCKNKNFKRMIAHILHQNGFSCNESKTIYAKGEISLSGYVVSNDVHLSRQKLCNINEVIYQFDQRKSYGSISYSLDKATVNIKNIMCNLNKRKMKKADGTVIQFDSLSDLVYYAAGCRSYLMQIASTEHGDTGYDKQIAKKIRKLEMILDYLSEELGEV

SEQ ID NO: 5115 - protein, 335 aa, unidentified
  source 1..335: note = Related to BLME01000752.1; note = Lachnospiraceae bacterium
MVLYSYEYFLDKILESTQEEVEKAKREKIFVCSEMKLPKQSGFRNIVSVEKDSIMKKLQKNLQKNFLDKLPVCPSAKGFVKGNSYMDFLEEHIGHEYFLRMDIHNFFDSIAEGLLDENLKNFVRDEEEMSPDLEELESGAKGSRIREDIIELCTWQGRVPQGFLTSPSISNLVFRRLDQRIRKYCRAYQKEQKREIFYTRYADDLLFSSQGFDFKRNKNFKRMICHILEDYGFSCNENKTIYQNGQISLTGYVIRKDVHLSRKKLRNINEVLYQFREIIECDERVRSEKIKANLQMILQNLNQKKMKKSNGDPIYFADGNRLIHYVAGYRSFFTL

SEQ ID NO: 5116 - protein, 365 aa, unidentified
  source 1..365: note = Related to CP085988.1; note = Clostridium sp.
MKKIYGWDYYCERILRKSQLFIENSLAEKENSYIVFDIRDRGKERTICQVDKTSGLYQLQNNLNRNLLAKIPLSKAAAGFVRGLSYQDYLRSHCGKKFHMRLDIHHFFDHVTEEQVIKSLEEFVQDEKIRENIGEITTFNGKLPQGAVTSPAVSNIVFRRIDQRILKYCQSVRKVREGKKFYQEDLIYTRYADDMMFSSDYLDFRRDLFVYRMIKHILKENGFSLNVKKTYMAEGEISLSGFVVGGEENGCSVRPSRKRLREINRILAYFDARRELDGCPYEADIKKLRDPRVIDNVNLMFPDGSVARFSNKKSLINYLCGYRAFLITFLKGENGQGSSQRALQGKIRNLEKLIDQCQRWWFHIE

SEQ ID NO: 5117 - protein, 365 aa, unidentified
  source 1..365: note = Related to JAJCIC010000020.1; note = Lacrimispora sp.
MKKIYGWDYYCEKILWKNDAFIASSLAEKEESYSTFTIGDRGKSRVIQQVDQTSGLYQLQNNLNKNLLSRIPLSKAAAGFVKGKSYQDYLRPHCGKRFHLRLDIRHFFDHVTEEQVVESLKDFVQDERIRINIGQITTLNGCLPQGAITSPAMSNIVFRQIDQRILKYCQAVRKVKEGKQVLYEDIVYTRYADDMMFSSEYLDFRKELSFYKMIKHILMDKGFRLNHDKTYMTEGEISMSGFVVGGEAHGCMVRLSRKRMREINRILNYFDKRAKIDGSPYEVDEEKVKDFRVVDKVNALFPIGKIARFSNKKALMNYLCGYRAFLITFLKGENGQALHQRALERKIKNLEQLIDQCQSRWFGMT

SEQ ID NO: 5118 - protein, 372 aa, unidentified
  source 1..372: note = Related to JAHLDN010000040.1; note = Clostridium estertheticum
MKRLYGFEYYAKNILKIDLLNQDEKTKFFNKLETNISESYVKFQIPKKDGMRDICAIDKSSILYTIQKNLNKNFLSKIPLSSVAIGFVKGKSYNDFLAHHIGKKYYMRMDIKDFFGFISEKHIKESLKEFVQESEIIESIVNICMREGELPQGAVTSPTISNIIFRRIDQRIIKYCQSIQNIRIAKKNYNEDIIYTRYADDMLFSSNILDFKENKYFKKMIKNILSNNEFKVNYNKMYYSSDSISLSGFVIEKDVHLSRKKMKNINSILYFFDKRIEYDKTKYNINIDKIEDTQLIKQLNDLNLNTLNGRKINFENIAQFINYLCGYRSFLISFLKMDIRKTDSINLIEKKVKKIEELINKINEINDFRTQN

SEQ ID NO: 5119 - protein, 374 aa, unidentified
  source 1..374: note = Clostridia bacterium UC5.1-1D4; note = Related to CP094680.1
MKIYTEEFLRDGILEIQEQPFEKLLVEKNKWYKCFEISKKDGKREICALSDEESGQKVKRLQKNLLHRFLRKIPIAVCAKGFVKEESYQSFLEPHIGSKYFMRLDIRNFFSSFSEDLIWKGLHEFVENAEALDMICELCTWENTLPQGAVTSPALSNILFRRADQRILKYCQTITERCSKNRYRPEAAGNENTLYYTRYADDMLFSSDFFDFSKEEYFMKMISRILKDYGFELNRDKTVISEDQIVLNGYVVGNAVWLSRRKMRDLKRILYFFRNKNHELYRIDKLKVKKTIESLKELNCFMEKNNSERNNFANSLELINYLAGCRSWLIAILQMRTEDNRTRRNLGKTKVRIEMLLSELSRCEEEKQRWAERG

SEQ ID NO: 5120 - protein, 400 aa, unidentified
  source 1..400: note = Related to SRYA01000068.1; note = Lachnospiraceae bacterium
MYRVRFFHSLSSPGITPIRKFSESACSFPKNIMKIYTLEFLFKILELQPEEFSQILLKKETAYNTFEIPKKNGRRLIHGLDAKDGKPLKKLQQNLYRKVLCKQPTAIPAKGFLKGESYLSFLEPHAGNQFFLRLDIHDFFGSFSEKMIRDNLNSFIEDKEALELVFELCTVSKKLPQGAVTSPALSNIMFARLDQRILKYCQALEQNKREQLHREKESWCNASISYTRYADDMLFSSDFFDFRENLAFLHMISRILGEYGFHLNRQKTMMAEKELSMNGYVVGENIRLSKKKTSELRRILYCLKDQEAETYQLNQELMDDPQKILKKIKQFSSETQKGSRTFSDIHKLIWYLGGCRSWIISVLQTEAKFGKEEKNMVKLIRRIECVLDALQAMTEDPNRR

SEQ ID NO: 5121 - protein, 364 aa, unidentified
  source 1..364: note = Related to QRVX01000041.1; note = Coprococcus sp.
MQIYNYKFLLEKILKTSDEKLHAVLEGIEYAYEETEIPKKNGIRVIHMLRKTPEGRNLTNFQRNLVRRFLQKIPIAIPAKGFVTGESYQNFLMPHAGNHYFLRIDIKDFFDSFSEKLMKSNLKEFIQDREALETVFELCTLNAKLPQGAVTSPILSNIFFRRIDQRILKYCQSIEERYRKENTRSEKQGIRRISYTRYADDMLFSSDFFDFGEHIYFLRMLSKILKENGFEINRSKTMMCKGEIGLNGYVVGDGLRLSRRKLQSVKETLYFFRKQDQELYEVDMRKAEDLKESLKKLNEMRRENNKEAREFRSRQDFIHYLAGCRAWMISVLQTEQLLKKDSKRLEKTIQRLEELLKAVEKEEG

SEQ ID NO: 5122 - protein, 360 aa, unidentified
  source 1..360: note = Clostridia bacterium; note = Related to JAFTWW010000008.1
MFINEYDYFINGVLKTSETTLKNVQKDIKANYTTHKIPKKNGERIIHAIKKDSDLYNLQKNLCLHFLDTIPLPKPVIGFVKDENYVRFLSQHIGKRYFLRLDINSFFDTVNRKMLQKTFKEFFPGSDNTSLSTFIDLCTIDGKLPQGAVTSPVISNIVFRRIDQRILKYCQNFDDVYISKRSNKESITYTRYADDLLFSSDIIDFSKNAFFMGMIISILKDNGFTVNKTKTRCSTNEISFSGFVLGRDVHLSRKKLHELNKVIYFFNKADEHSYKKYRLNKAVFTSGDWLAKINSLELEGPFGQKKSFKTPEELLNYLCGFRSFLLLILRENPNGSPHMEQLDKKIHKLEEIIDLILCHT

SEQ ID NO: 5123 - protein, 372 aa, unidentified
  source 1..372: note = Related to NZ_JACSJW010000001.1; note = Exiguobacterium sp.
MLIDVYAAFALRTRLIFSEGTYSILTIYSGGNNINIYEESYFYKKILGYESISLPLSLTNKLDAYNSFELSINNKVRNINAINSKSDLFAFQKNLLNNFLIYIPLPNCVCGFVKGKNYLDFLKEHLKKDFYLRLDIKDFFPSLKSENIKDVLDEYIIISDINEKTHVLDTIIDIVTLNGSLPQGAVTSPQVSNVVFRRLDIRIRNYCRKFNISYTRYADDMLFSSNDSRLHKDFFVKMISKILKDNCLELNRSKIKKTKEQIVLNGYVVSNRISLSRNKLKKVNTLIYAYENLDGKKKKPKNFNEYLNRITTLEDFFPSLPSNIEGRRNVIVNYLAGYRSYLLSFDKDTYRDICVTYPNKIKKIEFILKELM

SEQ ID NO: 5124 - protein, 342 aa, unidentified
  source 1..342: note = Related to NZ_JACSMD010000001.1; note = Exiguobacterium sp.
MNIYEESFFYKKILEYGLTPPTDITSNKADAYNTFELIINGKKREINAISPKSDLYNIQKSLLDNFLTHIPLPNCVCGFIKGKSYLDFLEAHLKKEYYLRIDIKNFFPSLKAERVKETLSEYIKISNYTKKQEVLDNIVDIVTLNGSLPQGAVTSPQLSNILFRRLDIRIRNYCRKFNVDFTRYADDMLFSSNDDRLHKDFFVKMISKILKDNQLVINRKKLRRGQKKIVLNGYVISNHISLSRNKLKKVNSILYSFENIKGKKLEPKNFLEFYSRLSSNRSIFPDSSLTIEKKYDILFNYLAGYRSYLLSFSKEKHKDTCVDYSGKIKKLEYVLSKLNKWA

SEQ ID NO: 5125 - protein, 320 aa, unidentified
  source 1..320: note = Related to JAEMBY010000004.1; note = Rummeliibacillus suwonensis
MLAIIDKNLAYKSFEMTTNGKVRNIDAIDSKSSLYKLQRNFLDRFLIDIPLPDCVCGFVKGKCYLDFLIPHCGKKYYLRLDIKDFFNSLKVDKIRSVLGEYIQVSDLNKKNLILDDIGVMVTLNDSLPQGAITSPQISNILFRRIDIRIRNYCRKFDVEYTRYADDLLFSSNKSKLHDKFFTKMIFKIIKDFDLVVNRKKIKKSEERLVLNGYVIDKNISLSRAKLKNINTLLYCVEYNSGTKAYPRTIIEFFDRLKNVKTCLRLTSDIKKNKSIVINYFAGYRAFLINFSKVGYKDYCKDYTTKIDRIEKALEIIQEIK

SEQ ID NO: 5126 - protein, 442 aa, unidentified
  source 1..442: note = Related to NZ_VNKI01000001.1; note = Peribacillus simplex
MKIYSEDFFYKGLLGFDSRTVMKNSLIATNSYQSFELEVNGKKRKIDAIKPNTKLYYIQKRLLKNFLVNIPLPNCVCGFVEGKNYLDFLKPHCNKKYYTRLDIKSFFNSIKSENINGILEEYIQINDEEKKQQILNDFCEIVTLNGSLPQGAVTSPQLSNIFFRRIDIRIRNYCRKFNVEYTRYADDMLFSSNEETMHKDFFIKRISKILKDYKLKLNNKKIIQSENSIVLNGYVVSNKISLSRKKLKKINTFINAFNNSDGKKKKFIGTEDYTYRLTKSKNLSFTMTDDLYINKLKIINYLAGFRSYLMTFSKPNNEDYCEDYFDKINNIEKMLEKLTKEGLPYNDKKSNIAIIIDHVKFGRVNGFNIEVRKINKSSHSNRMLYKHLKMNLNDRTLFVKFYPFPLKLDELINDIDKKALKNRILQNNINEIRYALKINEKG

SEQ ID NO: 5127 - protein, 327 aa, Bacillus sp.
  source 1..327: note = Related to NZ_KK366017.1
MDILDEVPTIEDINEYYDTFNIQVNKKQRTINAVKQGSLLRKLQEKLLVNFLENIPLSDCVCGFVKGKNYLDFLIPHCEKKYFLRIDIKDFFNSLKVNLVRDTLSEYIDIKIPDEKENVIDEIITITTLNGSLPQGAVTSPQLSNILMRRIDIRIRKYCEKFKVEYSRYADDMLFSSETSEIHKSFFIGKLKEILKDINLRINSKKVIKTNEKIILNGYVVSNNISLTRKKLKKLNTLLYTFEYNGSIKKYPQTFTEYIRRLQSVNPILIDLSKGDDWSKVQIINYLAGYRAFLLSFNALSIKDYTCDFSNRIKRTEKMLERLSDIK

SEQ ID NO: 5128 - protein, 306 aa, unidentified
  source 1..306: note = Related to NZ_CP073315.1; note = Psychrobacillus sp.
MVNKKVRKINAIKTNSVLHNLQKKISNNFLDNIPLADCVCGFVKGKNYLDFLLPHCGSKFYLKVDIKDFFNSLKESLVRDTLSEYVDIKNREEKDRVLKELIYITTLNGSVPLGAITSPQLSNLLLRRIDLRIKKYCEKFNVIYTRYADDMLFSSNNQEVAKPFFLGRLKDILIDFELKINSKKTIIAENKIILNGYVISSRVTLTRNKMKKLNTLLYTFEYKSGVKRYPRTFNEFLQRLKTVNEELFDLSKSIPETRIQIINYLAGYRAFLLSFNKSSIKDYTCDFSKKIKRTEKMLDILSDIRY

SEQ ID NO: 5129 - protein, 327 aa, unidentified
  source 1..327: note = Related to NZ_CP091777.1; note = Lysinibacillus sp.
MNIYSGKSFFKEVFEMKYEDVKKVTDSNIEENYNIVKIPKTKGHREIYCIDDSSELYILQKNILMNFLDDIPISENAFGFVKGRSYIDFLYTHVYKNYKNIYYLKLDLKDFFSSIKSFHIERTLEKHVHTNSSKISKEIIDNIVKLTTVDNKLPQGAVTSPSLSNIVFRFTDIRIARYCEKFGIRYSRYADDMIFSSDRKVIHAPFFIKTIKKILNESNFYVNNRKTKFSIGSLNLNGFRITDKINLTRKKRAKLNTCLYICNNTKKKHVLTKLNLSGFNFSDFEDLANYLNGTRSFLIMIARSSNNNIVINELIKEIEVNINKFLQ

SEQ ID NO: 5130 - protein, 337 aa, Bacillus sp.
  source 1..337: note = Related to PVQU01000010.1; note = Bacillus pumilus
MIIYSKEFFDNNILKISNEIDYINAIQTKESSYTHKSILKKNRLRNIEVIDRDSLLAKMQINLKDNFLNIIPIPHFVYGFVKGKSYKDYLIPHINNMSKNKYYIRLDIGNFFDSVTVELIKNALSEYLSLNDLQEKDQIILNIADLVTLDGKLPQGAITSPVISNIVFRRLDLRIKKYCDQLNITYTRYADDMLFSSYDNILLKNNLINLVRAVLNDYGFELNFDKTIRTKNFISLNGFVVSDNLSLSRKKLIEIKRILFILEKNKKNKNSLKILEEINSFGKYKKRNKFTSEEALHDYLAGYRSFLISLLPDNDDLWKEKCISTINRIEKAISVSF

SEQ ID NO: 5131 - protein, 347 aa, unidentified
  source 1..347: note = Related to JAARWS010000006.1; note = Listeria booriae
MQIFDKGFFYEKLIAKSNLHDLNNVRDVYYRKFNIVINNKKRSIATVLEGTALYKLQFRLKNNYLDKLPLPDCVIGYRKGKSYRDFLVPHVKLDKNDRFFVRLDIKSFFDSINEDVIKEALQDYVKIAGEEDRNRVISDIIDICTLEGKLPQGALTSPALSNICFKRLDLRIRSYCRKLGYTYTRYVDDLLFSSTDLSLIQPKFIQMIKLILSDYGMKLNHRKIIQTKNLISLNGFVISDEIRISKSKMNHLLSLLFCIEQNLKSRNLAELLEKLNQIRQHDGKRDFLTVDDVMEFLSGSRAYLIAWNSSDSSAWKVKCTKFILRIERQLVSLDKKHGQELREVNFY

SEQ ID NO: 5132 - protein, 322 aa, unidentified
  source 1..322: note = Related to JAAVIG010000001.1; note = Oscillospiraceae bacterium
MDSFKILNKETWLQTLNISEEELMKVAELKSLFYKKYRKEKPSGYRTIYIINKDSVLYSLQSKIQKKIFRNIFLPECVYGFRENCSYIDFLTPHISSKNKFYLRLDIKDFFESISVEYIKDFFQYYIDDKISNEEKTFIVNSIIDVTTLNGKFIQGAVTSPSISNFAFREIDIRILSYCRKLNVRYTRYADDMLFSSENNYLNSKHFIIAIQAIINDLGYTLNHAKTLKYKNEISLNGYVIGADIRLSRRKLHKINELIFQLSKSDFYGFENNIEKYHIKNQLAGYRSFLIQVNRHVVDLPYRRHLEERILTIEKLIIKHFT

SEQ ID NO: 5133 - protein, 300 aa, unidentified
  source 1..300: note = Oscillospiraceae bacterium; note = Related to JAFXES010000214.1
CLSQKTDCYRVYSKQKKDGTRTIHAIKSDSGLYVLQHRMQQKFLNNIYLPDTVYGFREHCSYIDFLIPHISEEKDRCFLRLDIKDFFGSIRIDDLKEALKYYVSDEIENADQEKILDKMIEIVTVDQKVVQGAVTSPMLSNLVFRQLDIRIERYCSRFNLKYTRYADDMLFSGRTSYIHSRKFMAAIAAIIESKGFSLNYSKTLRAEQEISLNGFVIGSELRVSRKKLHKLNEIMHRLNSREFDKFSSDYELYHVRNQLAGYRSFLLQVLHTDESEARKYKIQIKIDRIEALMRKYCKID

SEQ ID NO: 5134 - protein, 325 aa, unidentified
  source 1..325: note = Related to JAFQWA010000012.1; note = Clostridia bacterium
MKSWQIHNYDSLISDILETSPEALEEAFKNVDKYYERLNLLKSDKKSYRTIYRLKESPVSIMQKNLLNRFFSNIYFPSNVFGFRKGCSYFDYLNYHQMIGDGTYYLRLDINSFFDNITIENFEDSITYYISDDCSDEEKQKIIKTLLKITTYKNHFVQGSITAPVISNIVFRELDIRIEKYCFTMGIKYSRYADDLLFSSPSSFLHSDRFIRMIINILNDKGFSINHQKTLKQVGQLVINGYVVDSAVHLSRNKLRTINKILHTIEKKKSKVLLTSWGAPNYRVLNYLSGYRSYLINVMKYCDEEKKNKLGKTLARIEDIINRYY

SEQ ID NO: 5135 - protein, 329 aa, unidentified
  source 1..329: note = Related to JAFQYD010000077.1; note = Methanobrevibacter sp.
MNNITIKDKTAFLDLIMENPEDQDKFDREKATTYRLFKIKKHNGDRHIYAIKPTSIICKYQQNLYKNFLTKLLFPECVCGFRKDRSYFDFLVPHISKQNKRYYLRLDISDFFESIQLSDVKDCFQHYLNDDMDEEVKDDICNYFIKIVSYKGKIVQGAVTSPAISNLVFRSLDIRITKYCQPFGITYTRYADDLLFSCNHKKIFSYSFQKCIQAILSDKGFTLNIDKTLKFKDEISLNGYVIGESIRLSRKKVTRLNKILFELSQSNFDELKSERERYILINTLAGYRAFFINSMRYMIDPVQTKKMERKIQQTEKAIDKIRALPIQQI

SEQ ID NO: 5136 - protein, 324 aa, unidentified
  source 1..324: note = Firmicutes bacterium; note = Related to JAFYGI010000008.1
MIGFRITSKSQFFDEIVEISEEKMALALNNKKSAYHCYKKAKKEGFRIIYAIKKNNLIYELQNKLKNSFFMNLLFPECVCGFRKRKSYYDFLIPHISSNEPRYYLRLDISDFFGSIDVDDIEESLNYYIDDSISSEEKQLIINNIIGITTIDDKIIQGALTSPILSNLVFRSLDIRIEKYCKMLNITYTRYADDMLFSSDSSYIHNYRFQNMIKTIISEKGFNLNTKKTLKYKNEISLNGYVVGNSIRLSRKKLSQLNNIIYEMGKKQFKGFKSNKEKYTIKNKLAGYRAFLIQSIPYINRNNLVQISKKITKIENLITKYCAD

SEQ ID NO: 5137 - protein, 326 aa, unidentified
  source 1..326: note = Related to NZ_WQNQ01000008.1; note = Ruminococcus bromii
MNSFRIETKEEFFKILDCDEDTFTSAIKDKEKAYFKYKLQKKIGSRYIYGLVKDNLIYTLQKKINREIFKNILFPDCVYGFCKRRSYFDFLVSHISNNQRKHYLRLDISDFFDSIEIDDIYQCLSYYISNDISGDDRDYILQLIVDITTLNNHAIQGAITSPAISNIIFRSLDIRIEKYCEKIGVHYTRYADDMLFSSESSYIHSYKFTNAIQAIISDKGFYLNRKKTLKCENEISLNGYVVGTNIRLSRKKYKSINKIIYTLTTSSFTGFKNNYHQYITRNKLAGYRSFLIQYSRYIQDENQNKKIQKKIETIQNLILKYCVSSI

SEQ ID NO: 5138 - protein, 349 aa, unidentified
  source 1..349: note = Related to FRCT01000004.1; note = Ruminococcus flavefaciens
MDSFKIANKEEFIELIDVSEDELKEILKNKQNSYHKCFVNKKKRDSIRIIFALDQKSNLFKIQRALQRKFFCNFYFPSNVYGFIKQRNYIDYLEPHCSRNGTRNFLRLDIKDFFGTIDINHIKECLKYYIADTCDENEKKYIIDSIAEIVTYENKLIQGAITSPVISNLVFRKLDIRIERFCEKNNVIYTRYADDMLFSGIDFDVHKRTFINMIATIIKDYGFSLNYKKTIKMHEELSINGYVLGRDIKISRKKYESVNCLLYYINSKINKIPISRSFKYQLINILAGYRSLFIQVLRYVHDSHNKEVIQKKIAEIEKGINKISQFKENNIGANKDYEDKILEEICSKK

SEQ ID NO: 5139 - protein, 364 aa, unidentified
  source 1..364: note = Related to NVVX01000015.1; note = Alkaliphilus sp.
MLHRASKQGDDTLKVWRVDNYNDYFSNIVKVPEKEFKSKIADNEKKLFYSEYINKTKKNGLRKIYCVTENSDLYKIQKNIKNNFLDNIMLSDSSYGFRKGRSYYDFLASHKSFYSGKYFLRLDIRDFFGSIEYSLIEDVVSYYFVVGENLTSSQKKELLQNTLSSMTYENKVPQGAITSPTLSNIVFRQLDLRIEKFCQNVDAIYTRYADDLLFSSYNRNLHSAKFINFIRSILISKGFHINHSKTIRTKNLISLNGFVISENDIHLSRKKLASLSRILFCLETPKWINSKASFVNLNMKLKTEGDKHLFEGKYALLNFLAGFRAFIIPIVRSMDDSKLRKKQQKYIVRIEKTIEKIEKLPPKK

SEQ ID NO: 5140 - protein, 349 aa, unidentified
  source 1..349: note = Related to CP013683.1; note = Clostridium botulinum
MKVWKIENYDDYFNFIVKVSEDNINELLSQDEKKKYYSGYIEIKKKIGKRKIYCVDKDSKLFKLQKNIKSNFLDNIMLSDACYGFRKGYSYYDFLSPHKDFYSKKYFLRIDIKEFFNCIDYSIIEDVIKHYFVVGDNLTKSQKKKLIQYTLKAVTYRKKVIQGAITSPVLSNIIFRQLDLRIEKYCKYIDVIYTRYADDLLFSSYNRFLHSRAFINIISRILNSKGFDINYSKIIRARNSDKNSVSINGYVINDEIHLSRTKLKSLNRVLFYLENTKWKNCKNDFESLNKKMKAENDIHNFSGKYELVNFLTGYRAFIISIVKGTDDIILKQKYQKYIERIELLVKKLV

SEQ ID NO: 5141 - protein, 346 aa, unidentified
  source 1..346: note = Related to MNRT01000036.1; note = Clostridium sp.
MKRWRIDNYRDFFNKILKVEEDELIALLENKNNVYSSYKIKKKKGHRTIYYLKDNLDLAKIQGNLIKNFLSNIMLSESCYGFRCNLNYIDFLERHTTLSNDRYFLRLDISNFFESISMELLIDVLSYYIEDSEYVTSDESNKIVYYIKEIVTFDDKLVQGIATSPIISNIVFRQLDIRIEKYCRKLGVEYSRYADDLLFSSEIKSKIHGDFFIGKIAKILSSKSFNLNHKKTIKADKELCINGYVVGKNIRISRKKMQTISRVLFFLNSVNIKKNLNFLDELNHKLKNEMKDNRIYFLNKIQLINYLSGNRAYLISILRYSDEYFGKRIIKKINNIEKLILELDES

SEQ ID NO: 5142 - protein, 347 aa, unidentified
  source 1..347: note = Lachnospiraceae bacterium; note = Related to JAFZQH010000027.1
MKIAKINNREQLYKGVLEYEKRIIDTALTDSAKKQYYGKRINIPKKGGSRGIYCVDSNTFLYEVQKSFAKNFLNNIPNSDAAHGFVKGKNYYSFLNAHVYPYSRISFLRLDIKDFFESITSEMVRNSLDYYVSNDDPRMHDEVLNIMTDIVCYEGRLIQGSPTSPAISNIVFRPVDIRIERYCMSQGVVYSRYADDLLFSSISGTQLSERFISGIKAILKDNHFRLNLQKTIRSVDYISLKGFVIEGQIRLSRKKTKSIRQVLYFLEKNRYENTNAWMSSFKEEMEGLGNDSAMDINNSYSLKNYLAGMRAFIISSIKESGDIYYKKRAAGIISRIEKQIDEIENKG

SEQ ID NO: 5143 - protein, 351 aa, unidentified
  source 1..351: note = Related to NZ_VTVE01000001.1; note = Pseudobutyrivibrio xylanivorans
MGDNNGMNGWNIQDKEDFYNRIGVKTDLELKSYVSFLAKNKYYKQSVEIPKKNGTRLIYNIDKTSELYRIHNNLKKQYLDRIYISDAAYGFVKKRSYYDYLVPHLNKYKNRHYMRIDISSFFDSIKSEHIENAFGFILKECKDRDYIIERLKEIFLYNGTLAQGTPIAPAVSNIVFRELDIRIEKYCNKRKVVYTRYADDLLFSSDDNTVMRKDFYRGIRKILGSRGFNINEDKTINMSDSIVMNGIVVGKSIHLSRKKLKPIRTMLFALKLVEKEKDIEKCLKCINNTFQKAKIDKTFNSAIDVRFYLCGYRSYLIQILKYCEDINIENRLKKIINSIESYLNGPKKSFL

SEQ ID NO: 5144 - protein, 335 aa, unidentified
  source 1..335: note = Related to NZ_KE383885.1; note = Hugenholtzia roseola
MWGKKTFFEPNPFFKRRLQWLYRQLLPLYEPPACAFAYIKGRNYAQYRAVHQKNHYIYAIDLKSFFNSITTPQVNNALQSFCSPAVAGYLADALTAEGVLPIGFPTSPLISNIVFKNLDEKIVEFANKEGLSYSRYADDILISSNKKITTQNLNAFVYLIEKNGFKINFKKFKKVDKNTNLSTLSLKERRFLNLLLHQWQKKGYMDTNLWFLAAHRKSYAKPQDALSNFLRAKIFPFKDDFPKLWAQFERISKQYPYQTQNQMEENSIPATEKTQIMKEQPKSPTQYAQAPEPVVVSATTNATKLTFSASRQELEQYRRTPVSGSIDNFFKNHCQ

SEQ ID NO: 5145 - protein, 502 aa, unidentified
  source 1..502: note = Epsilonproteobacteria bacterium; note = Related to QNFV01000088.1
MKKLNSYKVKKLIDRYMTSSEELGSMLLRASNLSRHILNTIDMNNTDKATHKFLSNYKEEIDDIQEHNSYSLSKFSSSKLGLSNRGILSTSMSLAGSYSKWDARHWVSYREDDNRKTQLYKEGSEILSPSPSGIEFDFNNDVFMGEVIGNINQLMGVIGKMSNSVIFRHRFVDGRRISMINPKLEKSLRDIIEAEFKGYAKNFYKMYNSFHLNIGSNREHVTGFIKGKSYIDHARAHLGCRSAVSIDISKFYDNISLLNIINNNLFYNSLLSFFKQETGLPFEASSFKEGYHYDLLSKLFGLMNVQFVGLMTFLTHNGLLPTGAHYSPNISNLILSNVDLHMVDEIKNINSNLKYTRYADDICISSDKDKDENGEYYLNMDFIKRLETIINDHGFHLNYDKTMIMGASDRKKIAGIILDHTANPPRLSIGSRKKLELQERFNGKDWKELTTSDIGTINWVKTINVNQYNFVCSGITGERLMPIPRGCERDPITSLVVDAVPF

SEQ ID NO: 5146 - protein, 431 aa, unidentified
  source 1..431: note = Candidatus Woesebacteria bacterium; note = Related to JAGNEA010000001.1
MKRLALKRTRYKKLRKQLCISRLPKNNNDLSAVSFLALYIDFLKLYRSTLILCCSIVYSDSIAIEISKKKKNKDFFNQHDIALFDSLYLSIISDYDLYKKDLNEKNRAVVVARIDRNSKLLMPVFNSLFELFGSVSNTFIFRNVVINNRQLSIISDSIDAGLTYHIKKNNKAISLFFSRYYSIFVNHYSLNDNVYGFIKNKSCVDNANYHLDNSPASLINIDINKFFNNCTVVKCLKNNVFTDTIDLFDASVDTKIAFSFGIISLLGYCTHNSVFPTGASFTPVLSNIMLIPVDVAIKSYLSETFGNNVCNIRYSRYVDDISISSDRAKINKSYVLTIDTIKCIESILNNYGFYVKYSKTSIAGPGDKKSVNNIILDNNNHKLSIGTDKKLKYKTIFSKLFADEEHDYVVANLPYIKDINKDQYDYITEQK

SEQ ID NO: 5147 - protein, 325 aa, unidentified
  source 1..325: note = Cytophagales bacterium TFI 002; note = Related to LT907983.1
MDYNTVITLLGHDNESWQNLIANGIRYSVFQLPKANKKLRLIEAPQGELKRTQKYLNNILYAEYHPQSPDCVHGFIRMKAAPRNILSNARTHLGKKYLINIDLKDFYHQITTERTTDLLWKRFPNLLPNEVDELNKIVVKDDRLPMGAPTSSVLSNMAFQECDMALMTYCDQHKIVYTRYVDDLSFSSNKQINSAILEGIYTIIKLNGFSENPKKVKHYGESDVKIITGIAMQGLHWHVSDDMKSRLEKNMSEYRKLRKLINNLKFLGVEAKAKTKLKTLKRAIAGQLEFVKQIEGIDSDFYRSMKKIWKQSDADTVNVDLSVYI

SEQ ID NO: 5148 - protein, 330 aa, unidentified
  source 1..330: note = Related to NC_015512.1; note = Haliscomenobacter hydrossis
MHALFKNEPDQLAQSLNWPDDYQDVIKKQNYHQFSMPKKDGTLRAITAPGNKLKFLQKTLSHAFQLTYLNKIPDCVHGYVPGDIHPEVGTRHILSNAQVHFGAKYLLNLDIDDFFPNLDSLRILDALRYWYPEMPQATQELLVGICCYNNQLPMGAPSSPVLSNMCVHQMDLALLTLCAQHQVTYSRYVDDMSFSSSSDNLLALEPALIEALQSFGFTINQAKRMHFGPEGPKIVTGLIMDETDITVNDTFLDNLNECIKEYSQLRWLSRQLEMDKKWLQSKVRFAAQSIEGQLAFLSQIQGADDAVYQKYHRKFDKAQSMRPPNYDFYF

SEQ ID NO: 5149 - protein, 338 aa, unidentified
  source 1..338: note = Saprospiraceae bacterium; note = Related to JADJTC010000010.1
MNILNLQNASNRVQFCKVLAISEDALKSALANHKYYTFKVTKKNGKLRKIEDPNDERQYVQQRLSFELYPLYKTVLPPYVHGYIPTAISQNGSRSILSNAEAHLNCNFMVNLDLLDFFHQITISKIRGCLSKVYKIRSLNIIDLIVKIACYEGRLPMGSPCSPVLSNMIVIDLDGALFDYCQAQNITYTRYVDDLSFSSKLEITGVQIETLKKIILNEGFLLNEEKFRIFHQNDPKKVTGLVVHQGKLDVSDDYLNSLSRNIKKLKRIKRTYQHMRMLHPELKTNLQSRYRLIKSSVAGQLSFVQRILQPEDERCLALAEEFDDARTSSEVVDLHLYF

SEQ ID NO: 5150 - protein, 563 aa, unidentified
  source 1..563: note = Related to JAIUNV010000007.1; note = Bacteroidetes bacterium
MYSKKVKTPSDFLLLSNELENIRDFSGLAVLLGVNQDYLLMNILPSYTCFEIKKKSTLRKVYYPEYYVSEIQRTLNLYLTASYLTNYYLPTQLPVHSYIPRITLTEQSDSDICRNNKSNAEVHFGSERILKLDLANFFPSIKSIHVRDGLRRLLPRLPQYCIEWLVHLTTFEGFLPAGAPTSPTISNIILYDFDKFANSINGIKYSRYGDDLTFSAIDGRINLKQVERDVKIELEKWQFQIQEAKTFFLRKGQRLRITGVVLNEKLNISREYLKWLRAVVYSCESIGIEKAATKYGDRYFEKMLNSTRKKYRYIGVYVDKGLIKKCITNKELVSFLKASLLGHISYVSSVRGKDDVYVQNLRNRFINCLREEGLEKKEIEFEAKSFKENENLVYITNATSQSVVYYAYVFLKSAKLSDDDINRLRKHFSYKDSSNIDFKKIKENFINQSIYFLELYNYMFYRDRFKLFYESLSDDEWNQLFNRDQNFANKRTYPRWIYHLDFNCSNIRNNYNEEGVFHPNSGVFFEEEKANQVYNAYLLEKNFLDQLGMRTCLICQSNISEFT

SEQ ID NO: 5151 - protein, 326 aa, unidentified
  source 1..326: note = Saprospiraceae bacterium; note = Related to JAGOCA010000016.1
MKNKSAFYHFAKSFNLEQEDLYLVYSAPTYHTFEIPKRNGDLRTIYAPAPNLKKIQRKIAEKLSKYYSESLPASVMGFVKTAAWKKKRDIVSNARKHIKSKHLINIDIENFFPSIKTDHVARVLNEIIKLDNEGVQIIRQVLMKDDSLPPGSPASPILSNLVFKPIDLAIEHFCKGQKIIYTRYVDDLTFSSKKEITKTQICTIADILTKYNFRVNEDKTVIYKKNDIKEITGIAIVDKKLTLCESTIEEIKNNILYYKEWKQQILQQYGPNESVRKKISHMQRSIKGQLNFAKRIDGEKGEKYNELKELYEHSLDEKEFAFKVYI

SEQ ID NO: 5152 - protein, 399 aa, unidentified
  source 1..399: note = Opitutaceae bacterium; note = Related to JAJTGA010000020.1
MTNAPDSAPLTTPSGKKPPGLSVTLTVERHRLLHVILDPAAWRMFREALQTRGAWSRRGRILKATLVAEDFRGWSPRPYLPPDSPDWSETVMELHPPTEPAAFERLIATAMEHFRILEQEDAAAFDRSLRNTWEKVRRAAMAAHALAPSQLPRPFPVYAARLAAIPKKRPGEFRVIAVPDRAQLAAGRSLLPYLHSRLDPALPIHGFVPGRNPVTNAQPHRGFGWSLTMDLADFFDHVTADKLVDAGLPRSIARLITDRDGVARQGYATSPAASNLAFQTVDHRILALLAAECPGAVYTRYADDLTISANDREALIRVQRNLEALIASAGFKVSARKTHVLAARAGRRVVTGVAVGETDLRATRSARRRLRAAEHADNRMQARGLREWSLLKAPRDKLP

SEQ ID NO: 5153 - protein, 381 aa, unidentified
  source 1..381: note = Related to JAJTGA010000020.1; note = Opitutaceae bacterium
MNDYITLDLKGRSENGRSRQVHLTGEGLREFGEKLEKNGLQTEAPLIVRALFLRGEAGNLDSRPCFNGNGWDGNMLEIHLAPGIGSKVAEAGVEAYLDVTFDRKADGLFDRKWRAEMAKVRGNFPGFPGGGVAPFPAFDAPLVRIPKRRPGAFRLIATPTADQKRAARWLLPTLDKWIDYRLPIHGFVHGRNPVTNAKVHIGFRFSLGFDLEDFFDHVTVKKLVAAGLPRSLAVAVTDGAGIARQGYPTSPTAANIAFQEVDRALLRTVAQLDQGVAYSRYADDLTFSADSWSVLRRLRGLVEELVPRYGFRISHRKTTSWSAFAGRRMITGVAVGKDGVCAPREIRRRLRAARHQGRAPQASGLAEWNRVREPHVFRRSD

SEQ ID NO: 5154 - protein, 313 aa, unidentified
  source 1..313: note = Related to SSEH01000250.1; note = Hyphomicrobiaceae bacterium
MAARFARGPQGLQSDPSHLKTTGSHTSNRAAICGLVDVFIVEFGMQVLRIPKGNGKVRVVYAPSEEEKAELRSLLPALVKIAKRRCNLEVVHGFMPGRSPLTNALPHVGYQYTVNMDLQDFFDTVLITHVMHLIPPQILAKVMRYGAARQGLPTSPLVANIAAAQLDWDLITALPEDVVYTRYADDLSFSFDDQKLTKELPLLVKKMVEDHGFAVNTAKTKVQWAGAGRRIITGIAVDHSRVFATREVRRKLRAAHHQNNKGSKAGLTEWCRLKLPALYLAEQTRRGKKSKSHHRAEEPVVEKSNKERRSLRL

SEQ ID NO: 5155 - protein, 430 aa, unidentified
  source 1..430: note = Related to AP009389.1; note = Pelotomaculum thermopropionicum
MKILKIPKKNGKYRTIYAPDAEEKRALRGIVGILNQKCQHVCDPAAVHGFMPLKSPVTNALAHVGRKYTVSFDLEDFFDTVTPEKASKCLTKEQKELVFVDGAARQGLPTSPAVANLAATDMDRAILKWIEKSGKSVVYTRYADDLAFSFDDPELIPVIQKKVPEIIRRSGFRVNTDKTTVQAAVAGRRIICGVAVDDEGVHPTREVKRRLRAAKHQGNELEAAGLEEWCKLKVPSGKRQKARETTEGLDELRKHWKLRKIDMAKAVSRKVIPEKDLGDNCYITNDPAYFMGMSTFTTGWKSCMRMDGGEYRKGVMAWLALPGTSVAVFLSDRTMNIAGVERRRMRARCLVHKLENGQLVYDRLYGNPDDTPVLVKKLEEAGIRPIREFAGKGIYVEGDVPASMAMPYCDNLWEEKINIKSGKRVVRFYV

SEQ ID NO: 5156 - protein, 431 aa, unidentified
  source 1..431: note = Related to FNBS01000081.1; note = Thermoanaerobacter thermohydrosulfuricus
MKIVQIPKRNGEYRTIYVPDKKEKQKFKNLLGELNRKAKNILSNAVHGFVPGRSPVTNALAHVGYEYTISFDLEDFFDTVTPEKVSKYLTKEEKETVFVDGAARQGLPTSPVVANLAAADMDKAILKWIKKTQKNIVYTRYADDLTLSFNEPELIPVIKDKIPEIVKRNGFKINEKKTRVQAAIAGRRIICGIAVDKNGIYPTREVKRRLRAALHQGKIRQAKGLEEWMKLKLPNSEKKEEKIKRIEEAKVLIELWGIKKIDVEKALREKAIPEMDLGDNCYITNDPAYIFGMSYFTTGWRSCMAPDGGYGKGVVTWMMLSGTSVAVFLSDRKKATGSVERRVMRARCLVHRLRTGELVYDRLYGNPQDIEFLKKKLEEHGIKSAREMPKDSKLYVVGNVSRSLPQPYYDTLRKEKVVLKESQKKAYRFFI

SEQ ID NO: 5157 - protein, 305 aa, unidentified
  source 1..305: note = Related to RFGF01000109.1; note = Nitrospirae bacterium
MRRILIPKSHRTWRTIYVPGPAEKARLRGLVPVLHRLERSAAERHGTIHVAHGFVPHRSPVTCALAHLNCAWTLTADLADWFDHIHESQIAHGIELGGGDPNVAAQLCVDGAPQQGLPTSPIAANLAAIPMDRWILDRLPPDAVYTRYADDLQLSLRTAPHDPQAIVGILEEAASHMGWQIAPHKTRIYDARRGHRIIVGIAVGSRSIAIPRTTRRRLRAARHQRPQHPHTQGLEEWCRLLLPRALRPRRRLRFEQATDTPPAGLSSLSTPSSRISHAGTIERSQQHKPGLRRVFRFSVRNQSSP

SEQ ID NO: 5158 - protein, 323 aa, Vibrio sp.
  source 1..323: note = Related to CP033144.1; note = Vibrio owensii
MNNDYSNTQGGSVNDNQWKEDLDGIWSITLTPKLSNIYNVLAYGEWLSDPNKIEALSVKKIHVDTGGKKRLIYSPNMDSKGFYQAILPKLNETFEKMEERAVAYGFVPKRSCVDQALQHVNYAYTISLDIKDFFDHVKIKHVKGLIDEELIPYLFIDGAARQGLPTSPMVSNIAFNAIDLEIITFLEERMGFTTSKPKAERDMFFWDLDLDFDQEQKRYYAYTRYADDLSVSLDQYEDIARVINGVQRILLRHGFELNARKTKILDSNNGRRVICGVGVDEETVYPTRKTLKKLRAAKHQKNLSSMFGHRAWIYSIDKKKPVR

SEQ ID NO: 5159 - protein, 316 aa, Vibrio parahaemolyticus
  source 1..316: note = Related to DADYEG010000002.1
MNNDYSNNEGSSVNENQWEDNSNGVWSITLTPKLSKIYADVVWGEWLSEPGMIEVLNVRKIHVDTGGKKRQVYSPDMNSKVFYQALLPNLNETFEKMEERAVAFGFVPKRSCVDQALQHRNYAYTISLDIKDFFDHVKPKHVKGLIDEELIPYLFIDGAARQGLPTSPMVSNIAFNAIDREIIAFLEDKITLIADKPKYGGSSWGGEEKKRYYTYTRYADDLSVSLDSYDDIARVINGVQRILLRHGFDLNARKTKILDAKNGRRVICGVGVDVETVYPTRKTLKKLRAARHQKNLSSVFGHRAWIYSIDKKKPVR

SEQ ID NO: 5160 - protein, 316 aa, Vibrio sp.
  source 1..316: note = Related to NZ_CP045071.1; note = Vibrio harveyi
MNNVYSNYEGCGVNNNQWKEDQNGVYSITLAPKLSEIYADAVKDEWFFEPSKSDTLSVKKINVDTGGKIRKIYSPDMQSKVFYQALLPSLNEAFDKIEERTVSFGFVPKRGCVDQALLHLNYAYTISLDIKDFFEHVKIKHVKGLIDEELIPYLFIDGAARQGLPTSPMVSNIAFNAIDRQIVTFLEDKIGRVASRPKDEFFFDLEDDLKCYCSYTRYADDLSISLSLYEDVARVINGVQRILLRHGFELNARKTKILDAKNGHRVICGVGVDEETVYPTRKTLKKLRAARHQKNLSSIFGHRAWIYSIDKKKPVR

SEQ ID NO: 5161 - protein, 304 aa, Vibrio sp.
  source 1..304: note = Related to ABDZOA010000009.1; note = Vibrio vulnificus
MNDNQWKEEINGVWSITLTPKLSKIYADAVWGEWLSGDGKSEALTIKKICVDTGGKKRQIYSPDTHSKLFYQALLPNLNETFEKMEERAVAFGFVPKRSCVDQALQHMNYAYTISLDIKDFFDHVKPKHVKGLIDEELIPYLFIDGAARQGLPTSPMVSNIAFNTIDREIVKYIEGKIGLSNTIKQTDDFFIWGDENDWKYAYTRYADDLSISLNDFNEIPQVINGVQRILLRHGFELNARKTKILDAKNGRRVICGVGVDVETVYPTRKTLKKLRAARHQKNLSSVFGHRAWIYSIDKKKPVR

SEQ ID NO: 5162 - protein, 644 aa, Vibrio parahaemolyticus
  source 1..644: note = Related to DAETXO010000001.1
MHELRINKGNGKFRSVVAVGKEERYFYRELLENQLEQTLTGHLKENGLFNVVHGRKYSNTVANAIPHQRYQYTLSVDLKSCFDSMTRDVAAKNGFPDLPEDCFVAISTSSEPVAAQGLPTSTVICNLLLVKTDIKILHLLHKTFKGEFAYTRYIDDLTISFNSFNEKKYTTLLSNLVYLVSQSGFEVNMSKVELQRALDGRRRVCGLAVDEGGVYLPRKLKRTIRALEHKESMNLFPSKQTRTLRGLLAYGELKLPNKLGAQQEDTESLIKSIVVSGEWGKKWLCYLIELSSKQSKNPGQEIFCFRVPHTLDDGSIRQLVEAYTIQESSIENDRKTLDINQVSSTEQPDIRTLSSYDIIATHHEVEVLGCTDAQSSKLKQAYFEKRVNFTSQDRKILGFLERREPIPRSLREVITIPPNTKKLDALVCAITGLFDSETILNICKREIWLSGALENVLNDEDRLLFLSQHPYAYRYMLHFVNERDLVKVLESNFYSAKHIFPHIKTAQMKRALGNTRELYRKLVSTNSYGAMYLVPPEWFKKERFISLCSEYFNLTSVMLYEVYSRSVAFYYLRERLYDSNFECASLDDVIRQCKAHTFRVVESEFPAAKNLDQNEICTVELRVNKLVTEIQSRWPWKFVIKNMG

SEQ ID NO: 5163 - protein, 387 aa, unidentified
  source 1..387: note = Related to NZ_LEKN01000013.1; note = Ursidibacter maritimus
MKDRIEKIITISKNNGKFRKVFVPTPSYAEQLNKNLKYLNEILLERDKCKVNHAFLTGRNSVTNAMQHIGYRYCLQLDIEDFFDSITSESVKGLINDEVINLVFIDGFLKQGLPTSPMISNIAFIPVDQAILNFVKNLDENIVYTRYADDLTFSFNDIRCKGVIHKRIIKILDEFGFKINNKKTKFQKAVNGNFIITGISVNEKGVFSTRKTKKKLRALEHQYQKNIKFIINIIEDISFMEKDILKLVNVLKLLNTYYKNKDNILNWNLKFLDGFLNEACNIFVSFSGNIYISDVKEIGRYHKYLKYNSEYNHIINNHTDFKWIKYRKYKIKLEDIIKKCDECRYNFHSVIGFRGWASCALPKKEKKDAKVNQSSSNIFFDDDNIPF

SEQ ID NO: 5164 - protein, 387 aa, unidentified
  source 1..387: note = Related to WIUM01000095.1; note = Glaesserella parasuis
MENRIAKVITISKHNGKFRKVFVPKSSYTEQLNKKRKYLNKILLERDECKVNHAFLAERNSVTNAMQHIGYRYCLQLDIEDFFDSITSESVKDIIDDKVCDLVFIDGILRQGLPTSPIVSNIAFIPVDQAILKFVKKLDENIVYTRYADDLTFSFNDIKFKDVIYKRVIKILDAFGFKINNKKTKFQKSVNGNIIITGVAVNGKGVFPTRKTKKKLRAIEHQYQANIKFLIKIIEEISVRENDESKLVNIFKLLNTYYKNKDDILSWDWEKLNFLLNDIEAIFKIFSSDIYISDTKELTKYQMHYIHNSIYYSNDSECFNRNNYTDFKWLKYRKYKIKSEDIINKCNECRYNFHSLIGFRGWANCPLPKKREKGNKNSSNFDNDIPY

SEQ ID NO: 5165 - protein, 316 aa, unidentified
  source 1..316: note = Gammaproteobacteria bacterium; note = Related to DMMV01000106.1
MDDFTEYHFEGSSWITPWYFPCWNSEWEWEYDDKIYRTIHEWNAAGRIIKKGEKKKCYLPCRKRLVFTIDQTARFDLFYISKKNGKFRRIFSLYRKQKDQLRKLIPYLEKILLKHDDDKVNYAFIRNRNCVEHAIQHIGYKYTVSMDLESFFESVNREHVSKYLTTNVMDQCFISGAPQQGLPTSPLIANLAFLDCDKAILNSLEKYNISSVYTRYADDLVVSFDDKKDIGKIIFLITNIVNKAGFKVNKSKTKIQSIKNGRIIITGVAIDNKGVRPTRKTLKKIRAAKHSGNDKSLSGLIEWSKCSLPKTHPQKI

SEQ ID NO: 5166 - protein, 318 aa, unidentified
  source 1..318: note = Hahellaceae bacterium; note = Related to JADJWY010000016.1
MEIEEYKISKIPKGKNSFRLLYIPTPTLKKKLQSHLSYLQYKNLELDEHRTCHAFLKGRNCVTNALQHVGYNYCVSMDIKDFFDSVRPHHVENKVSREVIQDCFIDGAPRQGLPTSPLLSNLALLDADAKIIEFLNQFRVVHRYTRYADDISISFDDERATGRIIFIVNSVLESYGFSVNQKKTKIQSKENGRIIITGIAIDKNGLFPTRKTKRKIRAAYHQKNISSVRGLEEWAKCKLPNNTPKNPKRFIRIVGKTLVSCMHCNQSNLIWAEQYPGRTFLVNSESGSRHKCKFLNAILSQRDLMTQLKKWGTRTSFL

SEQ ID NO: 5167 - protein, 487 aa, unidentified
  source 1..487: note = Related to NZ_MJIC01000014.1; note = Alteromonas lipolytica
MQTEFTIKKIPKGKSFRTLYIPSSAYKKHLKSKLPLLLERYILFEGDNGFCHSFLPGRNCVTNAIPHIGFAYNISLDIQDFFDAITPDHVTSKISRELIQDCFIDGAPRQGLPTSPLIANIAMIDIDNEIVASISKLTSEFVYTRYADDICVSFNQKQYLYQAKYLITNLLNRHGFRVNNKKTTFQSLKNGRLIITGIAVDKAGVHPTRKTRRKMRAAEHQGSESSYRGLHEWALCKLPGQGISHSQELHQISPKSISCQFCGEQDLVWLRIGKSKLRLYSKTTKMIHDCGQHKRLDVFEHLTALGFTKFETSRKPWFTGFYILQQESLLLLFRKRGIDIYRIDFLEYFHDCTSPAEVIEDVNSTLVDHEMYETTTENNGSDELYLEDHVREELLQDNQIDEFQRGFTPSELCRDIFRPESKYLSLMERVNYKKFPLKVHKFILSLTTPINFREEFYSAYNNAISQQAKNGTLDFDDLDLIDWDIPF

SEQ ID NO: 5168 - protein, 1017 aa, unidentified
  source 1..1017: note = Phycisphaerales bacterium; note = Related to SIAK01000078.1
MWLQSSEAREIFDTDLTKTIGIDAAEIEKFRRELAAVPSATLVKFWFGAQRTSEPTTLEKHLREKLRTRAALFSWVHGPGTSIARDLLYVKLPSSEKRRLVNLLLASLRSRMPWIESRLIHAMAFRPAELNRVAEKTVGKTKGFQQWGPLYRGVKIGKRRGYRQLWIPNTPLKATQGALLRLIAPGLARVLQPFVFGASSGRRGPTFENAAAHLGKAYVATFDLRDFFPSTRVGDVIRGIQWAADHGHLLVDETRVPSYLEENPQVRSLRWTDDAMVLVARLATYRARLPQGSPLSPLLANVAFARFDERILDALGREFGKREFAYTRYFDDLTISLSGAAARDLGLKQTSTVRDRIEQKLQEVLEGSSFALNASKSRCTALTVERRPAAGKTIANSLGHHVTGVILRRESVELTRDLKRELRTTIHRLKHRDFVEDARVWHQSKNFLPPAFKSLSKGHRWEGNTIISRRCSAERLSVLMLRHFHPELRVRAILREWYPWQERFIGGEQVRRGKQAWPLIEWLLAALWEGTVTARRHGDNTIRFSQGGVAVCDVEAESALQFFLLAKESAIAVTEYWHHLQGLKGYLGACPIRPEFSDIIEWRDRLVEAMSALEIRGYEIEATEPIVENTSDGDPEPLTVSDRVKERSDRFIVVYREFARRMSIAGDTFLGTCEDAARVVATNSADFDRWISAIRGLFVTRLPRLPAVVEHRDSFDRRRLFDAVRVWDDGTKRLVADDYQFVADLRVALKIDRLDSEDTYQFARAQLRLFDWLLASFERSTETRRCGIGEVSALDRGCDLPVNLWSGTLKERLAEAFEELVSAHEVLRSSDGETKLFIQRSGEELHRERETIRCTEQWNNDRAWEHLCQVARVLFITTQESVEPSLWRDPVEDDQPVSAQNELRRKKTWKGVCDRVDSELRHRARLLAKLRNRDAHKANDDRRAEWCSIQADVARILGRSWESTSGRKHPQFHAKDDLELFGHEVTVVKLELIRSLTALFNRAAELQVWRPEHGMDR

SEQ ID NO: 5169 - protein, 842 aa, unidentified
  source 1..842: note = Related to JADLBO010000003.1; note = Phycisphaerales bacterium
MTSRLIHALAFRPSYFTRHPSSRWGALYHRREISRGTNKPRVLYIPNKPLRSIQRALLFLFLNRASHELGQSVFGARPGQRCPLINNAKRHLGQMYIVSFDLADFFPSITLGHIVSALAHIRTPLGHCALQDNEANLDRPRRDFPWTHDAAVLVARLCTYRGRLPQGASTSPLLANIAFSRFDDLIAERLGTGLVYSRYFDDITISVSKSAARRLHLNNAKALADYAQTCIETELIPAGFRLNAKKTRFGTAAAGFTVTGLRINKNTIDIPRKTRRQIRALLHTISTSGLLAAARKTWGAELEARIRWDSARQSHHSAGRRLPQEKLCALMLKRLLPDLVIRVFDRDETEAPRTTEITGRQATRVLEKLLTYAWTHRVSFRVHDDYVAVKAAGEREIARLFSKVSIEFFGLAPNELIRCTELFHKLAGWSAFLEDAENHGEARRVADLGRELRRVLAGVQAGTRSETTAYETGALRVDPAGLPLTAEQENRQLAREVFELIRQFMLFVSPGPISHDLPELERNFKAVANSEETFSRWLETTMRLYQIRAEVVPPESARREFRGHDIHETIRLLSDRLAGRRAPTYEIERDFYKKVSKDDVPDSPRAYLRHQFRVLGRLKSAFDCSLALRNQRGPTAWIQTLNENTWSRSIAARLHTAVQVLRERLVEMASQPGVMRVFQNAVLADLNAGMSELMTTVSSTTSELRWKSLFATGSVLSKLILEQVEASRLETETTEKRSHTEIAIASLTAGTGESHADLLRLIHLLRCRDAHPATDEQMNDWIKLQRLCGSRLRRVTTNIRMPDNAGAMFGNGHLELTELEANDLKLSIIEGVDRFLRQVSVV

SEQ ID NO: 5170 - protein, 306 aa, unidentified
  source 1..306: note = Gemmataceae bacterium; note = Related to LR594584.1
MAFREDRFQRLFAPAHGELYRRKRVPKGKCCYRTLFVPCAPLARAQRLLLSRCLNQMLGHSHPGVYGGRPQTSVYGNAQRHLGQKFVVTLDLRDFFPSVTVNHVVATLLRLPPVSLVRHVWLDQPTQGGRARVPQMHRYAWTQRAAVLVARLTTFRGRLPQGAPTSPAISNLVFARYDDRIATALPGFVYTRYVDDLTLSVSETAARDLGIRTAKQAQAVVVERVERALRRSGFMLHPDKTRVTAIEREHRITGLRVGADRVDVPRRVKRKAASLARDLRKLGLVDTARRRIGAEIHAATQARPWV

SEQ ID NO: 5171 - protein, 955 aa, unidentified
  source 1..955: note = Related to DTTU01000469.1; note = Phycisphaerales bacterium
MSDHIVEKIKALDAQFVQLEKLPHHVIYSEFTTPQQLLLDRKIQYREGAYQLLDWYPPIREARELLKHLPPFEMLKLVGGKPCSSLSLFTFIKRHLARKGTKSIFRWSDRKRFVYWVYRNKLLSSVLPYVRPASESKHLVLRYLLKPLKKQQGYYSSKVVHAWAFRPDFFKAKVDYEPLYITRKIAKSQRGYRTLDIPFAGLAKLQRAILKMLLNPACQRVLTDSVFGFTPGNDRTIFSAAEAHLGAKFLVGFDIADFFHTVKFNDITSTLMKLPPDILRASNSAISKNKSPLKWEWDLVLLLAKLMAYKGRLPQGAPTSPALANLVFHEYDVLIRQQLCDSFEYTRYADDLTFSISATKAKRLGIRSELDARQYLEKRLIQLFESSSFTLNSKKSRAVNLRQGGRVLGLYLNNEGVGVPRSTRRDLRTTLHKMRNHGLLCTARNHPALPDCSEFVHRDTKRGVRHFFKSGRVSMERLCSLTAHRICRNLTISDLRNEGSTRELIGNRLRDTLERVISNAWLGKLVLAKQDSKSLLVSFNSGDPALLLRAETGIDFLLLGRIDCVKCALLHQSLSGYLSFLEGAPNRATFAAIHDLAKQLGDVLGSLDIGQFQPAASRQAGTTDGERPSLTIDEDVTRKARAFLAKLGVSDFEHPDWSVLCRAVYSREQLDSWLTATDKLIKEKRVFAEGSRRNPVKFIDIRAGKIFGRRTGTYDEENQYLVRRLSEDGLSRPDLALQLQEELIEDLIEYAEQAGEQGETAYPEQSVRLERVCADLKKLRNQLTTTNESMLLFARRCSPENDTNIRKRLEKLEQPISGDSSGAVWYSLFEFGFCFVQSFQESLEHDDEGKPVATSRAWKDIKRYNVLSLLRNRHAHGWVKTAANLANLDEIQRTIAKRLGKIWKPKKNQVGDTLESLITLELTSFEANEFTLDILNQLRDSLIAVRQELQTPPSP

SEQ ID NO: 5172 - protein, 314 aa, unidentified
  source 1..314: note = Related to JAFRHR010000024.1; note = unidentified bacterium
MERTEITPWFYYDIYKTEKRTIHKPSHALKKVQRFIMRKFLKPHFKQMTTNEAASVHCGKKWIMKLDIKDFFNSITEKQIKDVIKKYVSYDNYDSSITYEHTWEVFSEEQIFSVCTLKGKLPTGASTSPYIANLVLRDFDIEIENFCLRYGVRYTRYMDDLFFSTNREQYFLSLVELEVLRLFKELGFEINVPKIKYISSNKCQQILGLGVNNKKPVLTKDTKREYRAYFYNLLAPIQFNNTEEYKKHEKELFGHLAYIMSVDKKFYYKMVAYIFNIIKRLNIWRKPCLKNLIKKIGNNFETEIEMFRFCSYLK

SEQ ID NO: 5173 - protein, 415 aa, unidentified
  source 1..415: note = Related to VXLT01000305.1; note = Gemmatimonadetes bacterium
MPPAEPTPSLGQAMRRLRLAAGLSQRELAGRLAVDPTYLSHLESDRRDPSVRFVKRFAALVDVPVTSLLVVAMWDEMAPSEQDMFQPVVSSLMHLTEAVVRMPASSPGPLRRLSVQKLVAVCRLSEQQFARLLESREKEYHEVSWEKEPGKTRTLHIPSERLKAVQRLILRYMIDRVPPHPCSACVKGRGNHWAYRRHARHPSMLRLDISDFFPSVGEDAVREAFIRLGAREPVADALVRLVTLPERLPQGAPTSVAVADMVLFPLDVRLAGMAEKHGFTYSRYVDDITLSGGNRLARFEQTVRRIVTDLGWELNEKGGLVGSDQRHSLLGGIVNAKPNVASEYYGRVRSYLRLVAKGREQPDEDDFRKLRSKVEWIVSVNPERKAALHALVDEALTTLKQQEASIRRREKIVPQ

SEQ ID NO: 5174 - protein, 320 aa, unidentified
  source 1..320: note = Related to JAGGSE010000064.1; note = unidentified bacterium
MFSLDELLSIFNDVEEVEMSPSFAFVYSQLVEKGTSAFWLGVRKHALRDWYEQYHNVLSEDVKVEYTPVRIPKRSGGFRTLYIPSDQLKERQRAWLKLTYILVPKVTHAYAFEKRRSLRDALEKHVGNYLFLRLDIKDAYPSIRKKVLDSVLVKHDVPLSVRQMLIRDCYFKGLPQGAPTSGRLFNIVLSQTDLVIAEVIARLHGVYTRYADDILVSFPKDAKISISKTSQVINRYLNKISLELHPSKLRVGRGKLRVLGCVVHSDKVTISRKVRRLYRAMLHNNKTGKISLSKHKINGIKGWLNMVYRSETVPAIGPIS

SEQ ID NO: 5175 - protein, 469 aa, unidentified
  source 1..469: note = Alteromonadaceae bacterium; note = Related to WKFN01000002.1
MIFIKLLLLPFYLIFGVLRNILSEGGHPFDGAYNDMVARQNEEHRKNLKERSDKIKKAINEIEKKSKEEPLWKLSKLTKISIEELKHTTGTYRKVNVKKKTGGYRELQIPNDQLKQVQKKLAKFINSQFKNDISPFCHSYRNNRGIISNSLPHLNCKVLVKLDVKDYFQNITFEQVMRELDLGFESIQFHPQSNFIRHNVSEPDSRISSYLASEEAQEILKKLVYSEQGLPQGAPTSPVISNLVLSDFDKEVYALVTSLNGAYTRYSDDITISFKEDSSQKIAQVIKFVEAKLAENGFKLNKKKGKINVLRPHQAQRICGVTINSGKPTISRKQRRLIRAAEHNAKQGKPTTFTEDQIKGHESFQKYIKEHGELLAGNERIQYLKTKVISARGCKVDKNFVILKGSQFDISKFDEAKEEFQTLFNQLKQEGVIVLKQNVARFKRNHQFKSKTLATSLLHLRNVRSSKWV

SEQ ID NO: 5176 - protein, 332 aa, unidentified
  source 1..332: note = Related to DNYA01000036.1; note = Cryomorphaceae bacterium
MEFAVDSISYELGTVLALLVVLVGLVLLTKSLARDYVSKYGGGARKHAQRKNSRTLLDTIDVREDVFFGVATDYALVKIPKRTGGSRQLQIPNAELKRLQRKLLVYLTAKLGHRVNRSVHSYKKYRSIKTNATVHLGAAVVIKLDIVNFFPKVTLKQCRQVLKLLNLTKPVEDRLVALLTTPGGLPQGAPTSPLLSNLVLRALDKSVWYYCWSRGHRYSRYADDITISLPIDDRQAVHRAISFVNHALKRAGFKLNRRRGKFHILRRHQAQRICGVTINSGKTTISRQKRRELRAIRYRLENNMEASISEIQLEGYEAYVRMVSGVSVKAFS

SEQ ID NO: 5177 - protein, 365 aa, unidentified
  source 1..365: note = Related to CP036278.1; note = Aeoliella mucimassa
MLPHQIRPEHLAEAMGLSVNMLWSFARNMDACFKPRRMQWDGKKHRPIDPLYKPPKRLLKKLHRFLQNHHLCHPAAHGGVRRRSTFTSAQIHVGSRNVWTRDVTDCYPSISQAAMFSQLRKLKFQHDTALVLSMLFTYRDGVPQGSPISGDALNIFFWPLDQLLASMAGSLKLRYGRNADDFVWSGSNRENGDKLAARLESEIELLGLKINEKKKRANGLQTSSDERLVHGISVSKPSGTAISRLQSKKALALGEKYVAACRSVTADSLEAVAVKRAQLAGWMYYCRQAHIGPARTIRQLLEAGDRHVLKKLRAIGLSSQKNKWWIIDYRPRRNKPSRNEPKRLANAWRTRLARMSHKNVVATGL

SEQ ID NO: 5178 - protein, 359 aa, unidentified
  source 1..359: note = Related to NZ_CP036349.1; note = Botrimarina mediterranea
MKPSEIRVEHLAEAMGLSINAFWFFARNIDNAYKPRRMRWDGKKHRPIDPLKPMAKKVLRRLHRFLQRNRLCHPAAHGGIKGRSCFTSARVHLGARNVWTRDAKDCYPSIAPEAMQKELQALSFRNDTSKALVLLFTYRGAVPQGSPISGDALNIFFWRLDQLLASMAGSLKLGYSRSADDFVFSGDDRDAGDQITACLENELLNRGMKINRKKKEESGHQTASDERLVHSIAVSRRRGTGVCRLHAREALELCRIFVAASRSVSANSIQSVASKRATIQGWLNYCRQADFGPAKTVRQQLEAGDRHVLRKLQSMDLSAKGNKWWYVNSTQGRDEPRRLSATWRAKQAKKSADLAGSNA

SEQ ID NO: 5179 - protein, 348 aa, unidentified
  source 1..348: note = Related to PAJV01000050.1; note = Gimesia sp.
MNPKSITPAEIAAAMKMTERQLWTFTRNFEKLFKPTREIMIGSKKRAIDAPRDSAKKKLKLLHKWFFEKKLFHPSAHGGVRHRSCFTSAQQHLGKKFVWTRDASDCYPSITPEMFFYELKRIGFRQDTATLLTRLCTVRGSIPQGSPVSNDAINLYFWRIDQFLKSLSGANDLSYSRVADDFVLSGYKKYLGDNILLRLEGMLQQFGIQINDKKRRKSGFQNRSNPQLVHSIRVDLRRGTKISQEHRTKIIDLANSYEAACKRVQPSSLEPIAHKRQQLIGYLHYSRQADLSPIKHLKSKIQNGDRRVSRILKNLHISAFKGKWWLVSSKRNEPRRLKSIWMKRLEAN

SEQ ID NO: 5180 - protein, 384 aa, unidentified
  source 1..384: note = Planctomycetes bacterium TBK1r; note = Related to CP036432.1
MLSKNWLKWKHGSMRYSPAVKTRLSPPDLTVKRLAAVAQVDPSELMRYAGNTAVMYRSARKQWDGKKHRVIRPMNKKFKKMSKRLHKFFQRQPWWHGAAHGSICHRSCFTSAARHVGQRHVFTRDVENCFPSITTDALYRQLLLLRFKPDVADLLAKLMTCDGTIPQGCPTSTDAVNLFFAGLDQRLASTAAAMGAQYSRVVDDVVVSAKDKDAGQIVINRVEHEFERLGLKTNLKKKQTDGYRGPHQKRHVHGLDISSKRGVQISRQCKEKALAVAQSYLDSCKSATPLSLESIAAKRERAMGYMQHLRQGTGSTFRQLDQKVKAGDRAVQAKLRRVGVTCRKNRWWIIRGPQDRITKAARNIVREVARQWHATKYSTPSSSP

SEQ ID NO: 5181 - protein, 352 aa, unidentified
  source 1..352: note = Planctomycetes bacterium; note = Related to JACQXM010000014.1
MKPSDITPAMIAEACKVDEGRLWRIAERTESQYHSPRPKLIKGRHREIDPPNHDFKKVLRRLHRYLQRSLTFPRCVHGGLRGRSCVTAAGNHVGRKYIVTRDVKDCYPSIPTEALRRRLIDEGFRSDTALLLSRLMTNRGVIPHGAPVSGDALNLFLADSDRRLDHCVRRRGGSYTRSADDMVVSVGARESVTPLARVIEDEIEGHGLRVSEHKRRQKGVQHSNTRGGPRVHNLLVNNRRGVGAVPEHRAKGLRLAESYVCGARSVRPETLEGLASRRAELVGMINYFRQLRFSPARHLARLLRQGDRLVRSRLSTVGVSLTAKWWVNSRKRNRPREIGDRWRLKSDNSPAA

SEQ ID NO: 5182 - protein, 340 aa, unidentified
  source 1..340: note = Chloroflexi bacterium; note = Related to JADBLS010000178.1
MASLDGMASNMASWYKPARKVLIKGKLREIDPPTPVLRYRLRKLHRFIAANFRPHRGVHGGAKGRSCFSSARVHKGRRYIIKRDVKDCYPSIKTAALLDRLVAYGFCEETARILSLLMTLNGRLPHGSPVSADALNLFLFEADEVIVAKCTVLGGKYSRTYDDMVVSTNSGAASRELGEVLESQIAAHGLEVNSRKRAKEGFQPPHKRQLVHNIDVRSAGGVRIVREHEQKALAVATRYVRAARCVSPESLEPVALLRSQAAGYMHYCGQADFGPAKQLRRLLKQGDRHVRKRLTNECVTRCRKWWIISLRRNKAKQIAQRWRALQDEESRSSAPSTSIA

SEQ ID NO: 5183 - protein, 368 aa, unidentified
  source 1..368: note = Phycisphaerae bacterium; note = Related to JADHYA010000008.1
MKEKYRMQCKHKDVKKPLKGMTVEWLAEECGTTGDFLWILAKDSTFMYKPPRKQLKRSGNGYREIDPPKHQYKRILRKITKVLSSNMRHHPAAHGGVPYRSSFTSAKPHCGAKFIVTRDIRECYPSISSQNLFRSFRLLGASLSFAKFLSAIMTVHNHIPQGGPPSSLALNLYFRRMDDHFYRRAQSQGGNYRRFADDFVISNNSRKKAVALESELDHSISHRGLEVNEKKREKKGFLSGDQLKEIHSLVVNCRRGLKPKREHIAKGLQLAEHYARCCTCAKPADLPSLAKLRQRATGMMYYFRQADFSPARHIRNMLEHADKKVLRMLQSRGLQPHKNKWWLVHATRNEPQRLLCLWEPSAQVCSVA

SEQ ID NO: 5184 - protein, 366 aa, unidentified
  source 1..366: note = Related to JAAYDY010000091.1; note = Phycisphaerae bacterium
MNSETASRTADAGTLLRGITVEAIAQACETSPDELWRLARNSKLLFKLPRQQRKKGGGFRVIYPPTKTHKPLLKRMARFLSRQIPVHSAAHGGVKGRSSFTSAAKHLGATVLVVRDIEECYPSIGPQALANALKRLGASPSLAKFLSSIMTVDGQIPQGGPLSSLALNLFFYRQDEHLHRKARRVRGAYTRLADDLVASVGDTETGAAMGREFDSAISSRHLRVNASKRAKKGLLGGDKLKEIHSLIVNSRRGLRPKDEHVQKALRFLQNYCRRCRSATPADLESLAYLRRVVCGWMYYMRQAARSPARHMRKQIHLADARVTQMLKKHAIQAKKNKWWVLSSKRNEPRRLAAQWVWREVNAARAG

SEQ ID NO: 5185 - protein, 326 aa, unidentified
  source 1..326: note = Related to NZ_JACHXU010000003.1; note = Rhodopirellula rubra
MSEHTFLDWVARGDERFLPTRIDSSSGKFRELDVPKPSDMRIFRMLNKSLGFDRLFHRVAHGGVKRRSSVTSAKSHIKAPFVWVIDVTNCFPSVKFDRFASELGHLGVTPAMQKIIAETLFCRGQIPQGCPTSNLALNLFFMALDYQMAEYCWKRLISFTRMADDIVVGAKERSRGEHAVDKLVAGLAKLDLTVNEKKRAKVGFQPNTGQQLVHSLEISSGSLLLCDEHRNRARQVAEKTVGACRSVQPQSLERAADYRRQLNGWFHYSSQSQDLLTSDLAKAIRVSDNAVKSRLQRAQLDCKRWRWWEIKTATELAARWGSHISV

SEQ ID NO: 5186 - protein, 405 aa, unidentified
  source 1..405: note = Deltaproteobacteria bacterium; note = Related to JADJBV010000001.1
MGDLIHTRRWDLPDIDELLRERGLPELSDGGNRVPISSLPIQRIAVRRRPRRPSEGNELDVLMRICTALGCNADWTTVVQVARASHWERHRRYKKSGAIRWLDVPEERLKTALGEIHRLLLSSMPRDGTSTAFHAGASPALHARVHSGAVAAAAADIRNFFGSVRPRHLLPWFGLTDYPKASLLPGWSELGRKAVCQLLFRYRDGKPAYLAQGAPSSPLAANLAGLWLDRAIVSAAARQFAPGKFAYSRYADDLVLSAVDCEEPTRFAEEAAQILARSVAGQGWTIQSSKSRQWTTADSVALHVCGLRVPTRPGEPLTLGRETWRRARSALHRLRHRSDFGLHAAGSPAVAHGLLAYSYSATGDLRWLAYTSARLAYLARRLGGPIFSESLLAGWSDESSLADVP

SEQ ID NO: 5187 - protein, 354 aa, unidentified
  source 1..354: note = Related to JAGQAG010000001.1; note = Ruegeria pomeroyi
MPFSIKKREKTKLRDRFPVLWQVLGDLLANETCYCASDYNSFTFKARRSRKSRTIDAPCPHLKALQRQALNILLAPVVVHEAAMAFAPGKSIAMNARCHLGATHLYSTDIRSFFTSVSRVHVKEMLATRVKYLSVEAREEILDLVTWNERLPQGAPTSPHIANLVMFSFDELCTDMATRVGATYTRYADDISISSTSADVLLQMQKVVNMGLGALGMEPHPEKTRHLGPNQTKLVTGLDIGGSHIRPTRAFRKKTTALVRMSVKYPAEMEKHQEVIFGYLAFWYDVDPGDPQLANLLWQMGQPREASRAKATRQKQIGMMSKPSPTTPPPKEQQAVPLNAERKPSKPPVTKPDV

SEQ ID NO: 5188 - protein, 314 aa, unidentified
  source 1..314: note = Related to NZ_FNEB01000020.1; note = Lutimaribacter saemankumensis
MEDVFYDRANSYHSFTIKARRSAKIRTIDAPNPPLKLLQRATLDKLLAPVVAHDASMAFAPGKSIAMNARRHLGASYLFSTDIRSFFPSVTSQHVREMLEARFQHFSPEAREEVQDLVTFNGRLPQGAPTSPHIGNLVMFSFDEICCAKAAEMGAVYTRYADDISVSSNSSEPPQRMQEVITGYLSAMGMELHPDKTRQLGPKQTRIVTGLDIGRSRLRPTKAYRKKAAALVRMSSKYPTKMARQHYKILGYLAYWNDIDPSDPQLAALLDQMKRPSWAAKVRASAARQKPRGQAMFHRFPEELLKDLGPGLRK

SEQ ID NO: 5189 - protein, 351 aa, unidentified
  source 1..351: note = Related to NZ_CP014327.1; note = Falsihalocynthiibacter arcticus
MIFGSDDRKVNILEEYPTLCQVLEVSQEEGNCDCEVSYNSFIIKSRRSKKYRTIDAPCPHLKSIQRALLDRLLASVPPHDAAAAFVRGKSIAMNAQRHHGASHLFTTDIRSFFPSVKDSHVREMLRIHFPHFSQVFCEEIISLVTNGGQLPQGAPSSPHIANLVMSKFDERCQEASDNLKTVYTRYADDISISSNDAASLRRMERVVRIGLDALDMEIHSEKTRHLGPQQTKLVTGLDIGGSRIRPTRAFRRKTSALVRMSVKYPGKMNRHRDTIRGYLAFWYDIDPIDPQLPSLLNQMALHRWEVRLRAAQETNQRLLPIQPNPLQGRTQTNGYTKVRSNIVSLFKKLRD

SEQ ID NO: 5190 - protein, 323 aa, unidentified
  source 1..323: note = Related to RCIZ01000009.1; note = Mesorhizobium sp.
MSSEQSVLSSVLGLDSTAIKPVMGWYGPMFYHSFDVKPKRRGRKARQILAPIDELKTIQRAILEKLLSHVSPHPAATAFFAGRSIVSNARQHHGCRYLYKTDISDFFPSVTTGMVRVVLERHFPHLSQSAIDEIIRLTTHEGTLPQGAPTSPHLANLALYDFDDSLSRLCNEIGARYTRYADDVTVSAQDEYALSIAAGAIRSGFAELGLAQHPAKTRCFGPNCRKIVTGLDVSGEVIRPPRSFRKKAAALVRMSETYPKRMERHSPRVMGYLAHWQGTTPDDPELYNLKHRMRQLQRREAIADHTVNAVSSWAIEDDLKISF

SEQ ID NO: 5191 - protein, 453 aa, unidentified
  source 1..453: note = Related to nan
MTAQTPERLVFEGREHPMFSEPLSDFLRSGSGRPEFQMQSTACWRGYIGTWEVIGRRLYLVKLEGRLKSGEKANLAAVFPSSEERVFARWFSGIIQLPQGDEIEYLHIGFASIYERDLLLRFEDGELVDRRLRVNGETGSDAPGDCALLPRREDAKLAAGPGHQLWEQIERAAEELSTQPKTFAALALREFYYTEGSVRIARKIRALACPSEQLKKLQRSILTSILDVAAPHKQATAFFRGCSIIQNARQHHNKHYMFKTDIRSFFGSITTEDITTTLRRFIPNLSQKNLEALTKVLSCDGTLPQGAPTSPHVSNLHMRDFDELVSSQAKKHKCSYTRYADDIAVSSDNKFAVHQMSEIVGDALGNARFTQNTRKTHLLGKFDRKIVTGLDVSGDHIRPTKKFRKTTKAMVRVFIVHDRKAMLPNIQSRLAFWRSIRPDDPEMLQLRKSIASA

SEQ ID NO: 5192 - protein, 304 aa, unidentified
  source 1..304: note = Related to NZ_JADMNM010000013.1; note = Qipengyuania sp.
MLTEAPRHHLWKEIERAAEELSTHHPIIKLNAFNGYSGREFFYTEGSIRVARKRRALACPSEQLKELQRIILTSILDVAAPHKQATAFFRGCSIVQNARQHHRKDYMFKTDIKSFFDHIKSADIMRAVQRFIPNLSQANLDALTKVLSCDGALPQGAPTSPHVSNLHMRDFDELISAEARKRGCSYTRYADDIAISSDDKFAVHQMSEVVGEALEKAGFTQNKRKTHLLGKFDRKIVTGLDVSGVYIRPTKKFRKTTKAMTRVFIVYGRKAMLPSIESRLAFWRSIRPDDPELFQLRKSIDNER

SEQ ID NO: 5193 - protein, 494 aa, unidentified
  source 1..494: note = Related to NZ_MTSX01000001.1; note = Kiloniella majae
MGKSKNNEFSRRQLLIAFASTSIIGIMPSITSASSHIYEKENALIWLIGTLQPISLNELENTSFFPDRSWLIETINNFEEQLLINKHKRISEFYFSLTHEGHEKLPWIHAHSKDITRLSILRSSIFRSKNKVKFDRWIASAGVSPPKRTNVPVSLGAHNFARIEDEMVSSDRLFSDKNQLISFNSAQDLADSIPQNLSQSEVPLYKFAIDLGISVEFFQKFFEHRYEMYKFKKTRKQNGTLREIEIPLENLKTLQSVMAWKLSFQLKPHKTVHSFIRGRSSITNAKEHIRGDFIGKSDIRNFFPNISSSKIYTSLISSGYNRFEAKFIALFCTIQKNKRSKLPHGSPTSPILSNFVLYDADETIYQYCKARDITYTRYADDFTFSGKNYSKIQQAIKYQISALENHDFQPNHSKVKISNARDFPRVTGINISGDIFPPRNLKKRARAVFHLIETGNSSPKVRSQAAGYLGYLSQFTSFTRTATYKKWQTILERR

SEQ ID NO: 5194 - protein, 334 aa, unidentified
  source 1..334: note = Candidatus Peribacter sp.; note = Related to JABHVZ010000016.1
GYYTFTIPKGSGGTRLITAPDDELKAKQRKLLKKMQKKHWISRKAHGFRKRHNCLTNAQVHAGKKYILNIDVKNFFPSITSIAYRNYATRERNLMETKYKDEDRGFPNLFFYAATPVFHSGSLPQGAPTSPFISNIYMRRFDTQIEKLLRQYISDDILYTRYVDDLTFSSNSRAVERVIPIVRGKLKSLRLEINDDKTKFMSPSQRQEITGINVNSGRPTIGKAYRRKVRAIVHRAEQGWVITSAQKERLLGMISHIALCHPSEAAKYRDALLPVSISPNSARMFSGVNRVKLPVKKTRSKKKQSNSNAGVTGANRTVKRKIAIDKKGEVHDID

SEQ ID NO: 5195 - protein, 356 aa, unidentified
  source 1..356: note = Related to JAFDVW010000003.1; note = Acidobacteria bacterium
MLMGPQQMQPVAAAAAWNVPRIESPDALADWLRLTPGELRWFADLNHLNDRSRIQKLSHYHYQISTKPAGGWRLIESPKPRLKHIQQQVLHHILERIPPHRAVHGFLKGRSIQTFAAPHVGRRVVLRMDLQDFFPTFRGARIRAFFRTLGYPETVADLLGGLCTNAVSHNAWPTRMHHEDSAHRSRVQAFYSRVHLPQGAPTSPLLANLCAYRMDCRLAGLAESAGARYTRYADDLAFSGEKDFERGIERFSTHVAAILLEEGFQVHFRKTRVMRQGVRQHLTGIVVNRRLNVMRPDFDRLKAILTNCVRLGPESQNREGHANFRSHLEGRIGFMEMIHPQKGARLRRIYREIRWP

SEQ ID NO: 5196 - protein, 442 aa, unidentified
  source 1..442: note = Acidobacteria bacterium; note = Related to JAFAPG010000514.1
MQKLFLVKVIAGAFLSGEPTIPEIVARLSRTLGKRWDWIHPLAQRYIKTIAGRTRPRRRDVVKFLLQDSGFKKAWSNHAHQLSIKQWLTEPQRMQPVSAAENWGIPVIESIGALAQWLELTPSELLWFSDLRGLGCRSDERRLRHYHYRILDKQYGNIRLIELPKPRLKQLQLQILAQILERIPPHPSVHGFVKRRSIKTFVAPHVGRPIVLRMDLREFFPSFRAARIQTLFRTIGYPEPVADLLGGICTNAVSRDVWKKPSPDVHPCRWSEARILYSKPHLPQGAPTSPALANLCGYRMDCRLAGLAKSVGAQYTRYADDLAFSGDKALEMRIERFATHVAAILIEEGFMVHYRKTRVMRQGVRQHLVGLVINHHVNTIRPDFDRLKATLTNCVRLGPESQNRNAHPHLRLHLEGRLGFVEMINPSKGKRLRAIFNQINWQ

SEQ ID NO: 5197 - protein, 442 aa, unidentified
  source 1..442: note = Related to QHZV01000271.1; note = Acidobacteria bacterium
MPFSSLLRTVAASFVAGETTTEEIIARLSSTLGRRWRWLGPLAQRYVKFVSARTRPRHSEVVQFLRHDAGFRRAWSRHKNEISIEQWLSGPAQMQPVTAAAGWDLPAIESIGELAAWFGLTVSELLWFADLKGLGYRQKSEKLHHYHYRILPKPSGEIRLIEAPKPRLRELQRHILSGILSRIPPHPAGHGFIKGRSIKTFVLPHVGQHVILRMDLRHFFPSFRAARIQTIFRTTGYPEPVADLLGGICANCTPRDVWNKYGSESDYDCRWQARVLYCRPHLPQGAPTSPALANLCTYRADCRLSGLARSAGARFTRSADDLAFSGGADFGRHVERFSTHVAAILLEEGFDVHYRKTRVMRQGVRQHLAGVVLNQHVNVMRADFDRLKATLTNCVRLGPKSQNRESHSSFRSHLEGRMAFVEMINPAKGKRLRAIFDQIHWE

SEQ ID NO: 5198 - protein, 451 aa, unidentified
  source 1..451: note = Related to JAIQGJ010000043.1; note = Acidobacteriia bacterium
MRNHSLLTSLARSFLAGEPDTDQVFTRASRLLGRRWRWLRPLARRYVMAFADKARPRQRDVVRFLLHDPDFKHAREKYFKELSVRQWLIGPQQMLPVAAAETWGVPAIGSIGALADWLQLTPGELQWFADLKALGYKRKDCPQLQHYHYKVFSKRSGSIRFIESPKPRLKELQRQILARILDRTPAHPAVHGFCRGRSIKTFAASHTGRRVVLRMDLQDFFPSITGARVQALFRTAGYPESVADLLGGICTNVVPRDVWKEPAHEIDLRQLWEARVLFSRPHLPQGAPTSPALANLCTYRIDCRLAGLAKSANAEYTRYADDLAFSGGHEFERSVERFSTQVAAILSEEGFAINHRKTRIMRQGVRQHLAGLVINQRVNVTRSGFDCLKATLTNCVRLGPESQNRENHPSFQAHLEGRIGFVEMINPAKAIRLRRIFERIQWTGMESQRER

SEQ ID NO: 5199 - protein, 442 aa, unidentified
  source 1..442: note = Acidobacteria bacterium; note = Related to QHYC01000242.1
MSRSSLLRVLATSILAGEPTVDHIVVRVSRTLGRTWRWLPPLSQRYVKAFAGRTRPRRRDVVQFLRHDPGFLCAWSKHFHELWVEQWLTEQQRMQPVAAAETWAVPVIESPGALADWLGLRTVELQWFADLKGLGYKSSRPKLRHYHYRILAKQSGNIRLIEAPKPRLKELQRQILAQILERIPPHPAVHGFVKGRSIKTFVAPHVGQRVVLRMDLRDFFPSFSAARIQAIFRTLGYPESVADLLGGICTNATPRDVWSRPAFDIDLSQVQEARALYSRPHLPQGAPTSPALANLCAYRVDCRLSGLAKSVGVEYTRYADDLAFSGNEAFERCVDRFSTHVAAILLEEGFAVHFRKTRVMRQGVRQHLAGLVVNQHMNVMRPDFDLLKATLTNCIRLGPESQNRDAHPRFRSHLEGRVGFVEMINPVRGRRLRTIFEQIQWR

SEQ ID NO: 5200 - protein, 445 aa, unidentified
  source 1..445: note = Related to QIAA01000032.1; note = Acidobacteria bacterium
MSKSSLQRALANSFLAGEPYLEQLVSRASRTLGRDWRWLRSLAHRYLKRFAGQTRPRHRDVVRFLNDDSGFRRAWLQNHSELTVAHWVTEPPRMQPVAAAESWKIPSISSAGDLAAWLGLSIGELQWFEDVRRLVYKEGSSKLRHYHYRVVAKQFGAVRLIEAPKPRLKTLQRQILSQILEQIPAHPAAHGFIKGRSIKTFVSPHVGRRVILRMDLQDFFPSFAAARIQALFRTFGYPESVANLLAGICTTTTPQSVWEGTGFDVSLKQLQEARILYSNAHLPQGAPTSPALANLCTYRVDCRLRGLASAAGAAYTRYADDLAFSGDTQFEQGIERFSNHAAAIILEEGFAVHFRKTRIMRRGVRQHLAGIVTNHHINIMRPDFDRLKAILTNCVRLGPQSQNRDAHSHFRLHLEGRVGFVEMINPAKGYRLRRILDQIQWPTET

SEQ ID NO: 5201 - protein, 444 aa, unidentified
  source 1..444: note = Acidobacteria bacterium; note = Related to JAFDVQ010000015.1
MGGPGFYAALANSMVAGEATEDAIAARLAQTLGHRWRWIRPLARRYVARFGGAMRPRRRTIAQFLITDEGLSRALRLHRKDIRIANWVAPAGDMQPHRAAKNWPVPAIETVGALAEWLQVTPSELEWFADLKRMISRREDGFEGPLSHYHYRILAKPGGDVRLIEAPKERLKKMQRQILADVLEKIPVHPAVHGFRRGRSIKTFAAPHVGQRVVIRMDLRDFFPSISAPRVQALFRTAGYPERVADLLGGICSNATPRTLWTKKGSGIDPLRMAEARQHYAWPHLPQGAPSSPALANICAYRVDCRLTCLAEASGAVYTRYADDLAFSGGMDFERCAERFAIRAAAILLEEGFAVHHRKTRIMRQGVRQYLAGIVVNEHVNVIRRDYDALKATLTNCVRHGWESQNREGHVNFREHLAGRVSFVEMVNAKRGAKLRALFERIRW

SEQ ID NO: 5202 - protein, 401 aa, unidentified
  source 1..401: note = Related to JACQZR010000185.1; note = Acidobacteria bacterium
MTLGRPWRWLRPLGQRYLARFSQGTRPRTAGVVDFLLQDPGFRRAAQRHARSLDVANWLCEPRQMQPVGKAAGWDIPTIETVTDLASWLEIPLDALNSAAVPFATSHHYHYRLLSKQSGMLRLIEAPKPRLKALQRRIAAGILDCIPLHPAVHGFRHGHSIKTFAAPHAGQRVVLRMDLRDFFPTITRARVQAFFRTAGYPEAVADMLGILCTNSTPGSIWKPADPKLVPEMRALHRTPHLPQGAPTSPALANLCAYRFDCRLSGLALASGAFYTRYADDLAFSGDTDFERSVDRFTTHAAAILMDEGFSVHHRKTRVMRRGVRQHLAGLVTNDIPNIYRGDYDRLKAILTNCLRHGPASQNRNGHPDFRAHLDGRISFVEMINPSKARKLRALFHQINWA

SEQ ID NO: 5203 - protein, 442 aa, unidentified
  source 1..442: note = Related to JAFAQG010000033.1; note = Acidobacteriaceae bacterium
MANPSLPNLLARSFLAGEPSLDQIVSRCTQVLGRRWLWLRPLAQRYLETTTSKTRPRQREVADFILRDPVFSRIWSERAHTLAIEQWLPAPSRMAPVPAARAWDIPLIDSPAALADFLWLDYAELDWFADLKKLTYKTAHPRLRHYYYRVLTKQSGGVRLIEAPKRRLKRLQREILAGILEKIPPHPAVHGFFKGRSIRTFVAPHVGRRVVLRMDLRDFFVSFGAARIQAFFRTLGYPESVADLLGGICTNAVPRHVWHDAGSDIDPAEFERVRSLYSRPHLPQGAPTSPALANLCAYRLDCRLAGLAKSAGVTYTRYADDLAFSGGSEFEKHVERFSTHVAAIALEEGFSVHHRKTRIMRRGVRQHLAGVVTNERINILRADFDRLKATLTNCVRHGPASQNRTAHPSFRAHLDGRVAFVETINPERGKRLRTLFEQIDWR

SEQ ID NO: 5204 - protein, 447 aa, unidentified
  source 1..447: note = Acidobacteria bacterium; note = Related to QIAH01000498.1
MKGSVFYSVLASSLLAGEPTVDLTSERLTRTLGRRWRWIRPLVERYIKRFSGHTRPHRREVFEFLRHDQHFQEARAKYRKEIRIEHWLMESELMRPVPAAADWNLPRIESVGALAEWLALDLMDLLWLADLKGLASKYNRPPLQHYHYRILPKASGRLRLIEIPKPRLKDVQRQILFHVLNKVPPHPAAHGFVKSRSILSFVRPHVGRPIVLRMDLQDFFPTFPAARIAAFFRTAGYPESVADLLGGLCTTTAPRSLWLKSDSDYAFENIYQARDMYSRPHLPQGAPTSPALANVCAYRMDCRLAGLARSVGAEYTRYADDLAFSGDESFARHVDRFSIHVAAILLEEGFSVNHRKTRIMRRGVRQHLAGIVANEXXXDFDRLKAILTNCIRHGPGTQNRKLHPQFRSHLLGRVAFFESINPAKGQRLRAIFEQIQWPERTGNEMKQ

SEQ ID NO: 5205 - protein, 435 aa, unidentified
  source 1..435: note = Acidobacteria bacterium; note = Related to JAFKEE010000018.1
MANPALVAHLARCFASGETTADRIAERAAEVLGRTWFWLLPLARRYLKEHKGSTRPKQHDVIRFLLDDGEFRRRANKLSVARWLMAPQRMQPVPAAATWSLPELVTAGDLAAWLGVSPGELDWFADRKGLNARTKRAPLDHYHYRILAKPRGGLRLIEAPKPRLKEMQRRILTEILNRIPAHPAAHGFCPGRSIRTFAEPHVGRSIVLRMDLQDFFPSLPAARIQAVFRTLGYPESVADLLAGACTHRTLSSVWRAAEPSISGAELFLARQLHQSPHLPQGAPTSPALANLCAYHADCRLTGLARHFGAVYTRYADDLAFSFDEPGDVSRFTSYAAAILLEEGFAVNNRKTRIMTRGRQQRLAGLVTNARLNIPRSDFDQLKATLTNCVRFGPAEQNRAGVADFRAHLLGRIGFVESIHPGKGRRLRILFDNICW

SEQ ID NO: 5206 - protein, 435 aa, unidentified
  source 1..435: note = Related to NZ_CP063849.1; note = Paludibaculum fermentans
MANPALLSILARCFASGEPTADGIAARTAQALGRPWFWLLPLARRYLKAHGALTRPKRQEVIRFLLDDTGFRHRAHKLSVAKWLTEPQRMQPVQAAAEWNLPELVTEGDLASWLSVRPEELDWFADPKGLNARTSRPPLEHYHYRVLAKRRGGIRLIEAPKPRLKEMQRQILGEILDLVPAHPAAHGFCPGRSIRTFAEPHVGRPVVLRMDLQDFFPSLPAARIQAVFRTLGYPELVADLLAGVCTNRTHSSVLRTPRPAIPQVELIEARRLYHWPHLPQGAPTSPALANLCAYRADCRLTGLARNFGAIYTRYADDLAFSFGQPSDVRRFSTYAAAILLEEGFAVNHRKTRIMTRGMQQRLAGLVTNDHLNIPRSDFDTLKAILTNCVRLGPATQNRAGVPDFRAHLNGRVGFVESIHTGKGSRLRAIFDNISW

SEQ ID NO: 5207 - protein, 440 aa, unidentified
  source 1..440: note = Bryobacterales bacterium; note = Related to JACJWB010000023.1
MDRRTLATALARALCAGEADAASAAERLEQTLGRKWRFVAPLARRYAAAFEAVVRPRLADVERFLSRDGGFCRAARRHGPQLAVAQWIQEPAPAMRPAAAAREWGLPAVATPGDLAAMLGLEAADLDWFADLRGWGAGGVDAKLEHYRYRVVPKRSGRLRLIEAPKQRLKQVQRRLLAEILRSVPPHPAVHGFVAGRSVATFAEPHTAKRMVLKMDLRDFFPSVRAARIEAFFRTAGYPEPVARALTGLVTNAAPRRVFAKEGELGLVHGARSLYCRPHLPQGAPTSPALANICFRRADQRLEALARSAGADYTRYADDLAFSGGDDFARHARRFSLHVAAIATEEGFAVEHRKTRLAPESGRQRLAGVVVNHRPSLPRAEIETLEAILTNCARDSPETQNRDGHPRFREHLAGRIAYLAMLNPSKAAKLRAIFDRIAWT

SEQ ID NO: 5208 - protein, 441 aa, unidentified
  source 1..441: note = Related to JACMLA010000763.1; note = Bryobacteraceae bacterium
MQRSLVIKKLAEVFLASGINSPFLTSRCAVVLGRNWRWLRPLADRYVVTFSNRIRPSYREVLSFLETDTGLKEAFTRNSGQFEIKQWIEETPHMRPVPAAQAWPVPPIETTGALAEWLWLDAGHLEWYADLKAFAETSISEKLSHYSYHVLRKRTGSVRLIEAPKRQIKKLQTQILEWILNPVPPHPAVHGFIAKRSITTFVAPHTGQRVVLKMDLRNFFPSLRAARIQAFFRTAGYPDEVAQLLTGVCTNITPRRFWRAPELNLTLQEIQDMRDLYGRPHLPQGAPTSPALANLCAWRLDCRLQALAASAGAQYTRYADDLVFSGDEHFDRSVSRFSAHIGAVVLEEGFAIHHAKTRIMRQGQQQRVAGLVVNQHANVARPDYDRLKAILTNCIRHGPESQNQNAHTSFRQHLEGHISFVHMVNPAKALRLRALFDQIAW

SEQ ID NO: 5209 - protein, 377 aa, unidentified
  source 1..377: note = Related to PSQY01000227.1; note = Proteobacteria bacterium
RDRGLLRAYENYGHRINVITSFPEVQEMCPVPAARTWGVPPIRTEGELATWLGIELNELYWFSDVAGFGARLGAPPKTRHYSYWILTKRSGNIRLIEAPKSRLKALHRKILSEILERVPIHDAAHGFVKARSITTFAAPHIGRRVVLKMDLQDFFPSFHAARIQTLFRTIGYPERVADLFSGLCCASTPRELWKQMPIEVNPQQWRESRDLYFRTHLPQGAPTSPALANICCYRLDCRLASLANSAGAAYTRYADDLAFSGVGQFVRGIERFANHVAAVLLDEGFSVNFRKTRIMRHGVRQRLTGLVINQHPNVPRDEFDRLKAILTNCVRLGPDTQNREGLSHWRQHLEGRIGFVEMVNPKRGAKLRRIFDVIAWN

SEQ ID NO: 5210 - protein, 443 aa, unidentified
  source 1..443: note = Related to JAFAUE010000361.1; note = Acidobacteria bacterium
MRPNVCLFEALASAFVAGDPTVDGIVARSARMLGRDWRWLRPLAQRYVETFAGRVRPRRSDAVDFLRGDKRFRRICQRIPSHIGIAHWLTQSQRMLPMAAAKGWRVPSIESVSALADWLGTDENYVEWFADLKALSCKSDHNKLRHYHYRVLLKDSGDVRLIEAPKQSLKRLQQRILTGILNGIPAHPATHGFVTGRSIKTFAAPHAGKRIVLRIDLRNFFPSFRAARIEAFFRTMGYPETVAAMLAGICTNATPRDIWHNVKPGGGPVQFWETRSLYARPHLPQGAPTSPAIANLCCYRLDCRLAGLARSAGAVYTRYADDLAFSGSKSFEKSVERFSIHVAAIALEEGFSVNHHKTRIMRQGVRQRLAGVVVNQHPNVLRHTFDRLKATLTNCVRYGPSSQNRERHINFRAHLEGRISFVEMLNRNKGSRLRKLFGQIRWE

SEQ ID NO: 5211 - protein, 445 aa, unidentified
  source 1..445: note = Related to JAEUQG010000434.1; note = Bryobacterales bacterium
MTGRIAAAMNAAFLAALARSLMAGEQTVEAARARAMRTLGRRWRWAGPFAARYIAAFRHGPRPRLKDVIAFIRADEGFDLAALTYGSKLSIAHWLAAPQRMLPYGPAADWDLPSIHTEGDLARWLALHATELDWLADRKNLCRKQANPKLRHYRYVIEPKRRGGIRLIESPKRLLKELQRRILAEILDRIPPHPAAHGFVKGRSIVTFATPHTNQPLVMRLDLENFFPSFPAARVQALYRTLGYPDAVADVLTGLCTTSTLHDIVRAQTFEDRRLYEQRHLPQGAPTSPALANAMAYRLDCRLSGLARTAGAVYTRYADDLAFSGGDEFRRNAHRFQHHAAAIALEEGFAVNFRKTRIMRQGVRQSLAGLVVNGGLSIRRRDLETLEAILTNCLRHGPTSQNRANHGDFRAHLEGRISYVEMVHPEKGRRLRSLFDRIDSWANTL

SEQ ID NO: 5212 - protein, 432 aa, unidentified
  source 1..432: note = Related to JAFDVS010000120.1; note = Acidobacteria bacterium
MKISFPAAVVSAVARSLMAGEPTVEGAHVRMMRTLGRPYRWLLPLAGRYVRAFAGRTRPRLREVVQFLLNDRGFRRVRQRQLAVEHWLTEPQRMLPCGPAAEWGLPVVECEADLAGWLGLHLSELEWFSDRKGLCRKHGSEKLQHYHYRMEEKRSGGIRLVECPKRELKELQRWILGSLLDRIPAHAAAHGFVKGRSIVSFAAPHAGKAVLLRMDMENFFPSFPAARVAALFRTLGYPEVVAEHLMGLCTNAVPRGVWGTRVEGRMLYSRRHLPQGAPTSPALANAMAYRLDCRLTGLARTAGAVYTRYADDLAFSGGEEFRRVVDRFGIHVAAVALEEGFAVNHRKTRVMGQGMRQALAGVVVNQGVSIRRDELEKLEAILTNCVRTGLAAQNREGVADFRAHLEGRIGFVEMVHREKGRRLRAIFEKIRG

SEQ ID NO: 5213 - protein, 344 aa, unidentified
  source 1..344: note = Related to NZ_CAJCHS010000439.1; note = Nevskia soli
LVAEWLPEAPRMRPVAAAEEWKLPAIETVGDLADWLSLYPAELEWFADLKHLNNRRPKLQHYHYRVLVKRSGGVRLIETPKATLKALQRRVLSGILDHVPVHPDVHGFVRGRSIVTYAQPHVRQDVLLRLDLENFFPAFPAARIQALFRTLGYPETVSDRLGGLCSNSAPADACGALYARPHLPQGAPTSPSLANLMAYRLDCRLSALARTAGGRYTRYADDLAFSGGVPFRRGVDRFASHAAAIALEEGFGVNHHKTRIMRPSTRQQLAGIVVNHHVIISRRELELLEAILTNSVRRGPASQNRDGTPDFRGCLQGQVSFVEMVNRAKGQPLRTLFEAIDWER

SEQ ID NO: 5214 - protein, 452 aa, unidentified
  source 1..452: note = Acidobacteria bacterium; note = Related to JAFDVZ010000005.1
MSRAAILSVLARSLLAGEPAYPAARSRAERTLGRRWRWLGPLARRFAGRFGDAVRPRHRDVVRFLARDAGFSEALHAYGGRIRIAEWLAEPQRMLPVEAALAWDLPVIETAGALAEWLGVTVDELDWFADRKDLCGRANASEQLRHYRLRLLAKRTGGARLTEAPKPRLKAVQRRILEGILDRVPPHPAAHGFVQGRSIVTFAEPHARRRMLLRLDLADFFPASPAARVEALFRTLGYPEAAAGLLAGLCTTATPRAFWRDCPAWLGAEEWSAARTLYARPHLPQGAPTSPALANAMAYRLDCRLAGLARSAGAVYTRYADDLAFSGDLEFARGVHRFAAHAAAVALEEGFAVNHRKTRIRGQGARQRLAGLVVNDRPNLPRRDLERLEAILVNCARRGPQGQNRAGEADFRAHLEGRVGYVEMVNPAKGERLRRILETIAWPERQGRTLDS

SEQ ID NO: 5215 - protein, 334 aa, unidentified
  source 1..334: note = Related to JAIEMJ010000003.1; note = Bryobacteraceae bacterium
MPEAWGLPKIASAEALAEWLGLDPPDLAWFADLRGMTRQAPTEALRHYRYHVIVKRHGNLRLIEAPKPRLKAIQRQILTEMLDRVPPHEAAHGFVHGRSIASFAAPHTGQSAVLRLDLDHFFPRLQRARVRAFFETLGYRKPVATLLGGLCTNRAPRFLPWPDFATMQVHTAPHLPQGAPSSPSIANSCAYRADCRLAGLAAAAGVRYTRYADDLAFSGGDEFSRGALTFATHVAFILGEEGFAVNHRKTRLMRQGVQQYLTGLVVNQHLNVDREDFDRLKATLTNCVRRGLASENREGLTDFRAHLEGRVGFVEWINPRRGERLRGLILQIKD

SEQ ID NO: 5216 - protein, 329 aa, unidentified
  source 1..329: note = Related to AP025252.1; note = Bryobacterales bacterium F-183
MHARFALSHPLPPLPTEVALADWLCLSPSELDWFANRRNLATSAARSHYRYHLLTKPSGGVRLLEAPKFRLKCLQKRIQTGILDLLPPHPAVHGFVKGRSVKSFAIGHVGQPGVLRIDLENFFASVRSARITGLFRTLGYPPPVAKLLSELCTNSVPKTVLADHPERFLYFNRHLPQGAPTSPLLANLCAYRADCRLAALAKADGSLYTRYADDIAFSGFVNNDLAAQASAILAEEGFTVNHHKTRLMSEGVRQHLAGLVVNAKPSTPRDEYDRLKATLTNCARYGLDSQNRDKHPNFRQHLEGRVAWVEYIHPERGAKLRTILAKLEP

SEQ ID NO: 5217 - protein, 432 aa, unidentified
  source 1..432: note = Related to JAEUQE010000020.1; note = Bryobacterales bacterium
MARILNGAPFDVPGMIASADEMLGRRFRWVRLLAKRYASAMAGKTRPRLRTTRQFLIQDGAVSEAWRKHKIRVEQWVTHGPRMQPAPAASEWDLPRIETSGDLADWFWIEPGELEWFADLKRLGNKLGVAKLQHYRYLILKKPNGRLRLIEMPKRRLKSFQRQILEFILDRIPVHPAAHGFVKGRSIHTFVAPHIGQEVVLRIDIADFFPAISQERIQALFRTMGYPEAVSDLLGGICTNAVPYEVWGQTPEGVDARVRYEARNLYRWAHLPQGAPTSPSLANLCAYRLDCRLAGLANAAGVRYSRYADDLAFSGGGAFVKNVRRFAVSVGSILQEEGFAANHRKTRVMRRGVQQRLTGLVVNERPNVSREEYDRLKAILTNCARHGAGSQNREGHAFFRSHLEGRVGFVEAVNPERGHRLRKILERIDWEE

SEQ ID NO: 5218 - protein, 454 aa, unidentified
  source 1..454: note = Bryobacterales bacterium; note = Related to JAEUQF010000393.1
MPLALEIEICAALAQAFTNAASLPDMVASADHLLGSRWRWVRLLVKRFAAANPSATRPRYRDAYQFLAKDGAVRRALYRHPGEIHLAHTIPSPPRMRPVPAAQPWNLPTLETLGDLAQWFWLSPEQLDWFAGLNRFSKNGSEELQHYRYRLEPKSHGGLRLIEIPKPRLRKLQRQILHYILDLIPAHPAAHGFVKGRGILSFAQPHAAKPIVLRLDLQDFFPSIYGPRVQTLFRTFGYPENVADSLGGICTNIVPSHIWNTTPEGTTLDAKVAAKALYRSSHLPQGAPTSPALANLCAYRLDCRLTGLAKAAGAVYTRYADDLAFSGDASFARGVDRFATHVAAIAAEEGFSVNHRKTRIMRLGVRQHLAGLTVNEKPNIRRDTFDELKAILTNCLRHGPATQNRENHPDFRAHLEGRVSFVASIHPAKGLKLQSLLRQIQWADTPRPAAPSPP

SEQ ID NO: 5219 - protein, 458 aa, unidentified
  source 1..458: note = Gemmatimonadaceae bacterium; note = Related to JADLFK010000145.1
MKPHDFATVLAIALLAGDQSDDAAVARLRLVARGRQRDLLRLVGYYRALAPNGVAPRRREVARQLRALFDAQRERGAAPWVRARTQVDVPLPSPVMRPSAMRTSAVRAAPAHAWDPAPRDRPDIATVGALASWLELPVEELLWFADCRDLNRRHSAPSLRHYHVSTRPKRHGGVRVIEAPQTRLKAIQRKILSEILETIPLYYSAAHGFVKGRSVRSFAAEHVGKPLLLRIDLADFFPTVSGARVQALFRTLGYPEAVADLLGGLCTATTSRHVFGAVRAQVDRRMLQHAMELYTRPHLPQGAPTSPALANACAFRLDARLTGLADWAGAVYSRYADDLAFSGGDEFARRIDRFCAEVGAIARDEGWRVQDHKTRIMRRGARQQLAGVVVNERLSTPRVAYEQLKATLTNCVRFGPASQNRAAVVDFRAHLLGRMAWVASLHAARGRKLHAIFDRISW

SEQ ID NO: 5220 - protein, 447 aa, unidentified
  source 1..447: note = Related to JACMJE010000135.1; note = Phycisphaerae bacterium
MPHQSLTIALARALTGGSQDEPSIALRLAVTLGRPPARWIARFAHRYVRAFSGNTRPREIEVAQFIVADRSWSARLAPTPTRPRQLVARWPLETPGMVPVPAAADWPVKRIESVGDLAEWLGIDSSMLDWFVDAKNIAHKQPHTKLHHYHYRVLQKRSGGIRIIEAPQERLKIIQRKILKDILEQVPQYYSAAHGFVKGRSVRTFAAPHVQQQAILRIDLQDFFPTIGRARVQALFRTLGYPETVADALGALCTNTTPRRFFAMTPRTAGDVALQVKARHLYGRPHVPQGAPTSPLIANLCAYRLDCRLTGLADWAGAVYTRYADDVAISGSGNFARNVERYAAEVSGIALREGWSVQHHKTRIMRRGVRQHLAGIVVNERLNVSRTDTDRLKAILTNCVRHGPTSQNREHHPDFQSHLRGRVGWVTFVNPLKGQRLATLFEQINWE

SEQ ID NO: 5221 - protein, 396 aa, unidentified
  source 1..396: note = Bryobacterales bacterium; note = Related to JAEUQC010000130.1
MHTLARAFLAGELNAQSAAARAAALFATPPRWLPALAARFVAAFAGKTRPRFLHAVAFLQAQPPRAAKLINWLTEPAVMQPVEAAKGWALPSLTSTGELATWLGLSIPELEWLADLRGTARPGHYHYQPVAKQSGAARLLEAPKPRLKAAQRQILRQILDLVPGHAAVHGFRRHRSIRTFAAPHAARPVVLRMDLRDFFPSISRTRVDAVFRTLGYPGPVAALLAGLCTTAAPTGGPLYRQPHLPQGAPTSPALANICFHRSDCRLAGLAAATGLQYTRYADDLAFSGEFISENLQARIGAIVLEEGFTLQYRKTRLMRQSVRQHLAGLTVNAGCNVRRVDFDRLKATLHRCVQLGPRDETRDALTGHVAFVESVNAARGRKLRALLERIQWTSHG

SEQ ID NO: 5222 - protein, 448 aa, unidentified
  source 1..448: note = Related to NZ_SDMK01000004.1; note = Acidipila dinghuensis
MERPLQPLSHSSNEFLSLAHALLSAEQAVEPHLQILRTAFRAEPPPGRLRPLAVRTVGWASTRPRPRIRRFIEQLRAEPRLVRLIERHGLRQLPLVSVPLRMLPIPGTAPVVLETAGSLAAWLEVEAGQLLWFADLRDWNRKAGGDRLKHYTCRVLAKPYGAIRLLEVPGPRLKSMQRRILREILAPVPPHPAAHGFRRGRSIVSFAAPHAGREVVLRMDLRDFFPSISGPRVQALFRTLGYPEPVADLLGGLCTATTPRGVWRNTGCELSAADLQDARIFYARPHLPQGAPTSPAIANLCALRLDRRIGGLAEKAGVTYTRYADDLAFSGDALFARGAERFALRVAAIAAEEGFAVHPRKTRLMRRGVRQHLAGLTVNAQPQLPRRELERLEAILTNCVRHGPEGQNRDGHADFRRHLEGKVAFATMVNPARAGHLRELLERIAWGD

SEQ ID NO: 5223 - protein, 598 aa, unidentified
  source 1..598: note = Acidobacteria bacterium AB60; note = Related to VANK01000001.1
MGYHEPTPAISVPARPRVPHVSRVGDMGYHEPTPAISVPARPREPHISRLLETWDTTNLTRPSALSHERRCDLALASRPLAAQRPAAILLMRRSAPSWQGKKPSGLALTSLGLPQGNVAIRALVAGASLRSHADQLPPGQTRWSTPLAPRLSKSVLIRALATAFLHGEPTTEELIQRAAHTLGRNWRWLRPVARRFVERFAGKVRPTRRSVLAFLREDENVNRTWHSRRHQLTVASWVVEPDGPAAMQPMAAAADWPIPAIATVGDLARWLGLTMGDLEWFSDPRRLTAKTRTPTLQHYHYRVFPKSSGGFRLIEAPKFRLKKVQRQILHEILDRVPTHAAVHGFVPGRSIKTFASLHAGKQVVLRIDLREFFPSIGRPRVQALFRTMGYPDSVAGLLSGLCTNATPRRVWREGTAQPSRSVDPAASFEAAQFYARPHLPQGAPASPALANLCAFRLDSRLQGLANAAGATYARYADDLAFSGDAAFARSAERFAARVAAIAEEEGWTVNHRKTRIMRQGVRQHLVGLVTNTHANVRRADFDRLKAILTNCGLHDPATQNRENHPAFRAHLEGRVSFVESINPGKGRRLRALFDRIVW

SEQ ID NO: 5224 - protein, 483 aa, unidentified
  source 1..483: note = Related to NZ_SIHJ01000001.1; note = Posidoniimonas corsicana
MRAYASYLTPDQTRWWGSAAAPTMLPSRTQVTPPVECTRNNLARALASAMAAGPVETDALMERASRLLGDQEQHKRLSWLRPLTRRVEAEFGAGPRPRAAALAEYLLCDEGFERAFQKHAPWPVGLVSAAPAMAPIPDAADWRVAPLTTVGQAASWLGLSVGELRWFADCRAWERRRPAGPLRHYQYRGLTKRFGQTRLIEAPKPRLKALQRQVLERVLDRVPPHDAAHGFRRGRSVGTFAAPHAGQRVVLKIDLQDFFPSIAGARVAALFRSVGYPEPVADVLTGLCTNSAPPDVWAEGPTSRAAAQQRRLYSAPHLPQGAPTSPALANLIAYRLDCRLAALAKSAGGVYTRYADDLAFSGGQEFLRSVHRFRTHACATAMEQGFSVNHHKTRVMPSSQQQRIAGLVVNERPAVSRVERGRLKAILSNCIRHGPESQNRDGHADFRACLQGRVAWVEMACPPQGAKLRSLLDLVDWTATRKR

SEQ ID NO: 5225 - protein, 440 aa, unidentified
  source 1..440: note = Related to NZ_SJPO01000016.1; note = Posidoniimonas polymericola
METDIQSVARALAAAFAAGPLTADRLVGCGERTLGRRYRWLRPLAWRVEAEFAYGPRPRADHIADFLLLDERFRVYAARHDAAAVSRVHDPVEFCPFPAAQAWPVARLRTPGQLAGWLDTPPQQLAWLADVRGWERRRRRGPLRHYHYRALAKRFGATRLIEAPKPRLKAVQRRLLAEILHHVPPHDAAHGFRPGRSIRTFAAPHSGQRVVLKLDLEDFFPSTPAAQVNALFRSLGYPEAVADLLTGLCTNTAPAAVFSPDSARDWRAALQRARYAQPHLPQGAPTSPALANLCAYRLDCRLAGLAAAAGGVYTRYADDLAFSGGAEFARSVHRFRTHAAAIALEEGYRVNHHKTRVMPTAQQQRIAGLVVNAQPAVSRAERDRLKAVLTNCVRHGPASQNHTGHTDFRAHLGGRIAFVEMACARQAAKLRRVFEQIEWG

SEQ ID NO: 5226 - protein, 445 aa, unidentified
  source 1..445: note = Related to CP036291.1; note = Pirellulimonas nuda
MRPGHSTAVALATAFVAGPLEVDPLVDRGAHVLGGRPRWLRPLARRVAARFGDQTRPRVTAVARFLLADRALLRAALTCQIQPGAGLGLTPEMAPLGPAARWRTPSLCNTRELAGWLGLPVGELEWFADLRSLESRQREGPLRHYHYRPLTKRFGQTRLIEAPKPRLKAIQRVILAELLDHVPPHPSAHGFCRGGSVRTFAAPHAGRPVVLKIDLEDFFPSIAAARVRALLRAIGYPERVADLLAGLCTNAVPPDVWKEAGAPATGHADRQLRRYAQPHLPQGAPTSPALANLCAYRLDCRLAGLAEAAGGVYTRYADDLAFSGGDAFARCVGRFQTHVCATAMEEGFAVNHYKTRVMRRGQRQQIAGLVVNHRPGVARDQRDRLRATLTNCVRHGPASQNREAHADFRAHLNGRVAFVEMVSPEQGQRLRRLFEEIRWEAGCGV

SEQ ID NO: 5227 - protein, 440 aa, unidentified
  source 1..440: note = Related to PNKX01000009.1; note = Pirellula sp.
MPTPRITADALAAAFLAGEIEKDQLIARASRMLGRRPRWLAPLAKRVATAYGTRTKPRRAALATFLLGDPGFRAALAKGPLRIVDWTTDEPAMRPTTPAAAWVLPLIGNISELAAWLGVSLHELAWFADMRSWEAKRSSGALRHYHYRIESKRFGQVRLIEAPKSRLKTIQRRILAELLEPIPLHEATHGFRRGRSIKSFAVPHVGQAAVLKIDLQDFFPSIAAARVQALFRTVGYPEPVADALAGLCCNATPADVWNRSEADGDAAQRRQTRWLYEKPHLPQGAPTSPAIANLCAYRLDCRLSALAASARAAYTRYADDLAFSGGADFARSAGRFETQVCATVMEEGWAVRHRKTRLMRQGVRQSLAGINVNKRLNLCRRDVDQLKATLTNCVRMGATSQNHADHADFRSHLEGRVSFVEFINPERGAKLRRLFERIEW

SEQ ID NO: 5228 - protein, 440 aa, unidentified
  source 1..440: note = Related to RECD01000177.1; note = Planctomycetaceae bacterium
MASETIVRLLAAACLAGNLEVDEVVDRWGRAMGKRWRWLRPLARRVLAEFAGDARARESAVARFIASDRGFRRAALTHDLRVAEVLHASGPGMSPVRAAEVWQLPPLRTAGELAQWLGIDTRQLDWFADRRSFGSKRHQGPLRHYHYRTVAKRFGQVRLIESPKPRLKQIQRRILAGILDLIPTHPAVHGFRRGRSIMTFAQPHVGQRIVVRIDLQDFFPTVGRAWVQALFRTVGYPEVVADVLAGVCTHATPADAWESVDSEHFGRQPDRIHRLYSRPHLPQGAPTSPALANLCAYRLDCRLAGLARSAGASYTRYADDLAFSGQADFVRVAPRFCLHVGATAMEEGFSVHHRKTRRMRQGVRQHLAGLVVNERLNVRRKDFDLLKATLTNCIRSGPQSQNRGNQSNFRAHLAGRLSFVELVNPEKGRRLRELFDRIPW

SEQ ID NO: 5229 - protein, 440 aa, unidentified
  source 1..440: note = Related to JAGQPE010001238.1; note = Planctomycetales bacterium
MSDITVAQALTTAFLTGEPDLDQIVDRWSVTLGRRWRWLRPLAVRLLANLDEADQRREVAVAWFLFLDRGFQRACDSHDLDVAQWIHITRPPMRPIAAARDWQVPSICTPGELADWLDVEPNRLEWYADLRSLESYWPQNKLRHYHYRLLEKRFGQVRVIESPKPRLKQIQRQILTGILDHIPPHPAAHGFRRGCSISSFARPHVGKRIVVRIDLQDFFPSISHLRIRALFLSLGYPQQVAKRLAGLCTNVVPLDTWLGDCGNRSTFGPSGVQRLYSTPHLPQGAPTSPALANLCAFRLDCRLAALANSAGATYTRYADDLAFSGERDFERVAHRFHLHVCAAVMEEGFRVHHHKTRRMRRGVRQHLAGLVVNERLNVCRQDFDRLKAILTNCIRHGPQSQNRMAHPDFRGHLAGRIGFFESVNAAKARRLRALFDQIAW

SEQ ID NO: 5230 - protein, 440 aa, unidentified
  source 1..440: note = Related to NYXM01000103.1; note = Planctomycetaceae bacterium
MDSYATIADALATAFLAGDIETDELVDRGSLLFNRRWRWIRPLARRVVETFAAGVRPRQTSVVEFILADRGFFRACQKHDLRLANRLVAPPMMRPVIAAASWRVASIRTPRELADWLGVSFGELSWFADLRGLEHKRNHGRLRHYHYRPLAKRFGQVRLIESPKPRLRQIQRRVLTDILDHIPLHDAVHGFRRGRSIKTFAAPHVGRRVVLKIDLQDFFPSISAARIQAIFRTIGYPEEVADLLAGLCMNSAPTDEWDHEFSGSSGRQVRQFRWLYSQPHLPQGAPTSPALANLSAYHLDCRLTGLSRSAAATYTRYADDLAFSGARDFERVAMRFHNHVCATVMEERFTVHHRKTRIMRQGVRQRLAGLVVNERVNVPRVDFDRLKATLTNCIRQGPQSQNRQGHLDYRGHLQGRISFVEMVNPSKGHRLRALFDQIDW

SEQ ID NO: 5231 - protein, 444 aa, unidentified
  source 1..444: note = Related to JAAYAY010000047.1; note = Planctomycetaceae bacterium
MNFCNVTARALSAAFLAGDFDVDGLVVRGSRVLGKRRRWLRPLARRAVETFAGRPRPRRVTLAEFILGDPGFLQASRRHGLRPATLPTAPSIMCPVGAAESWQIPSIRSAGELADWLGVTIGELEWFADRRSLEYKWNHGRLRHYHYRPLTKRSGQVRMVEAPKPRLKAIQRRILAGILDHIPLHDAAHGFRRGRSINTFASPHAGKRVVLKIDLHDFFPSIRLARIQALFRTIGYPEEVADLLAGLCTNATPPDVWEADTIRLAGGQLQEACWLYSQPHLPQGAPTSPALANLCAYRLDCRLHGLAQSAHAVYTRYADDLAFSGDRDFERAAKRFHLHVCATVMEEGFSVHHRKTRIMRQGVRQRLTGLVVNERLNVSRRQFDCLKATLTNCIRFGPQSQNRSGHGEYRAHLDGRISFVETINPARGHRLRELFDRIEWPERD

SEQ ID NO: 5232 - protein, 440 aa, unidentified
  source 1..440: note = Related to SJPS01000003.1; note = Bythopirellula polymerisocia
MSTRNHTANALARIFLAGKFESDEMVERASHLLAKRWRWLRPLARRVVAAYDGKPLPRSIALTKFILSDLGFSRALEKHEVHVVHPLINVPTMNPIAVANTWRLPSICTIKELADLLSITVSELNWFADLKLFEYKRNRGALRHYRYRPVTKRFGRIRLIEAPKPRLKVIQTLILSTILNNVPPHTAAHGFRRGRSIKTFAEPHTDKMAVLKIDLSDFFPSISIARVQSLFRALGYPELVADTLAGLCSNATPLDVWDSPKVDSPAKNIRQVRWLYANPHLPQGAPTSPTLANLCAYRLDCRLSALAESVGAVYTRYADDLAFSGDDSFARVAKRFQIHVCATAMEEGFRVHHRKTRIMRRGVRQRIAGLVVNKHLNLARNDIDRLKAILTNCIRFGAHTQNRSEQDDFRAHLYGRVAFVESINPRKGSKLRQLLEQVEW

SEQ ID NO: 5233 - protein, 459 aa, unidentified
  source 1..459: note = Related to CP036278.1; note = Aeoliella mucimassa
MSLRARLESLGYSAACLIAMSSPKRIAEPLAAAFLAGPLEVEGMVARGSQLLGKRWRWLSPLAKRMHRYFGGTTRPRQARLINVMLCDEGFYRACTKYELQLVDLQACQPAMAPSLAALSWNVPALCTTKQLADWLGLAVSELEWFADMRRWETKPASMQTQHYRYRVLSKRNGRLRLIEAPKSRLNMLQRQILTHLLDRFPVHSAVHGFRQGRSIRTFAVPHIHRPVVLKLDLRDFFPTIRIAQLSALFRTAGYPERVADLLAGICTNTTPTEVWDDEGLAASPSEIRRMRMLYEQPHLPQGAPTSPTLANLCAYRLDCRLAGLAEASGGVYTRYADDLAFSGDERFARTAERFAIHVMATVMEEGFEVHPRKTRLMRPGVCQRLTGLVVNQHLNIARSDRDRLKAILTNCVRHGPATQNHEGHRDFRCHLRGRVAFVESINPTWGKKLRGLFDQIVW

SEQ ID NO: 5234 - protein, 437 aa, unidentified
  source 1..437: note = Related to JAGQOY010000114.1; note = Planctomycetales bacterium
MCSYVSIARNLAASFVAGQFESDAIVERGAQLLGRRWRWLRPLAIRVIEKFSKGPRPSHASVVQFILRDHGFIRAYEKHNLQLIDLIGEATEMSPIKKAQPWTVPIINNIAELADWLGITMGHLEWFADLNSLEYKCNRGRLRHYHYRPLAKRFGSVRLIEAPKARLKEIQRKILSGLLDQIPAHEAAHGFQRKRSVKTFAACHVGKSVVLRMDLHDFFPSITLSRVRAVFRSTGYHESVSDLLAGLCTNCAPLDVWENLVPSGPGRQSIMLYSQPHLPQGAPTSPALANLIAYRLDCRLSALAHSAGAVYTRYADDCAFSGGPEFFRIVKRFACHVGAVVMDEGFSVNFRKTRIMREGVRQKLAGLVVNEKTNFPRADYDRLKATLVNSIKHGPESQNRTQHRDFRAHLLGRISFIEMLNPNRGRKLRQLFQGIAW

SEQ ID NO: 5235 - protein, 377 aa, unidentified
  source 1..377: note = Planctomycetales bacterium; note = Related to JAGQOX010000111.1
MARFILSDRGFLRAYERHNLQLVELLTTAPVMLPLPTAEGWEVPQLPEVNDLADWLGVSLATLHWLADTRCLESKWNRGKLRNYYYRPLAKKQGTIRLIEVPKPRLKGCQRQILTGILDHIPPHDAAHGFCRGRSIKSFADKHVGKQVVLRLDLQDFFPSVHGGRVQAVFRSLGFPASVADLLAGICTNSTPRDIWESLQFPQPQLRLTQWQYDNVHLPQGAPTSPALANLCAYRLDCRLSALARTVGADYTRYADDLAFSGGQDFSRAVRRFHVHASAIAMDEGFHVHFRKTRIMRRSARQRLAGLVVNQHANISRAEYDRLKATLHNCVRSGPSDQNRTGHTDFRAYLNGRISFIEMVNPARGAHLRRLFDRIPW

SEQ ID NO: 5236 - protein, 454 aa, unidentified
  source 1..454: note = Planctomycetales bacterium; note = Related to JAGQPK010000195.1
MTHARPDSLGVLDRFPMTHSDQTIARFLAAAFVAGPLVADEMATRGARMLGRRWRWLTRLALRVSEEFQHGPRPRRATVEEFLLGDSVFHKACERHELEIANYSITAQMCPVDAARNWPVPPLCTFADTADWLNVRSRELEWFADLRGLAARASHQKLRHYHYRTLSKRFGQVRLIEAPKLRLKEIQRQILREILDAIPAHNAAHGFCAGRSIKTFAAGHVATSVVLRMDLRDFFPSISRAQVEAVFRSVGYAESVANVLAGLCTNCAPDDIWDGVEVPVQQLRSVIARYARPHLPQGAPTSPALANLCAYRIDCRLAGLAESAGATYTRYADDLAFSGGDEFRRSAKRFSQHASAIVMDEGFDVNHRKTRIMQSGARQRLAGIVVNAHTNVPRKDYDRLKAILVNCLRSGPQSQNRDQHADFRAHLNGRVAYVELINPPRGKKLRELFRRIDW

SEQ ID NO: 5237 - protein, 440 aa, unidentified
  source 1..440: note = Related to JAGQQK010000642.1; note = Planctomycetaceae bacterium
MNEAAIAKALATAFLADTMTITAMEARGSHVLGQSCDWIRPLAARIMAAFPGGVRPRRQRVVEIIRQSRAFLLACEEHDFHALNPTLLPTKMHPAQSIRTWNVPSITSTDALARWLGISPAQLDWFSGRFRRSASVRIGSLGHYRYRLLQKSSGQVRLIEIPKWRLAELQRQILTRILNHIPPHAAAHGFRQQHSIHTFVAPHTGQAMVARIDLQDFFPSITLPRVAAVFRTVGYPEAVADALAGLCCHQVPDHVWHSEAGNLGTSSRNQLRLLYRQPHLPQGTPTSPAIANLCAYRLDCRLTGLAQSARATYTRYADDLAFSGDDEFRRSAKSFVLHACACVMEEGFTVHFRKTRIMPAAARQRLAGLVVNGKTNVPREDFDRLKAILTNCIRSGPDSQNREQHVNFQAVLSGRISFVEHINPSRGRKLRTLFEQIVWA

SEQ ID NO: 5238 - protein, 459 aa, unidentified
  source 1..459: note = Planctomycetaceae bacterium; note = Related to DNWZ01000023.1
MQSNRVLIRTIAITLLRGDWQVEAMAIRTAKLLGKRYRWISPLIKRLDQQFGSSRRPKQSELIDFLRLDRGLCRALEKHEPEIFDWLQEADVMQPIPSAEAWQIPSITTEGELAEFLGAATSDLIWLADEKSLHSKNTKKYSGHYHHHLVNKKNSVLHFCNPHDLDAIANRLRIPSESIRLIEAPKRRLKSIQRNVLNGILDRVPPHRSCCGFRQGESIVDYSRPHVGKSIVLKMDLRNFYPTITLNRIISIYTSLGFPETVSRLLAHLSTTVTPPEIWRNHKGASQLRYLESLYTCRHLPQGAPSSPALANLVAFRLDCRLEGLAKHVGADYTRYADDLAFSGGDEFRRIAKRFSTSVSAIVMEEGFGVNFRKTRIMPAASRQRLVGLVVNHGLNVQRQEYDRLKAILTNCIRHGPESQNRDNHPSFRRYLEGKIAFVSMINIEKGNKLLGLFRAISW

SEQ ID NO: 5239 - protein, 376 aa, unidentified
  source 1..376: note = Related to JAGQPD010000106.1; note = Planctomycetales bacterium
MANQSGPQDRDRVKPRVVSWRPRGTEMRPVSAASQWHVPEIRTPRELAAWLNVSFKQLDWLADIRSLEYTPGRGRSRHYCYRVLSKRFGAVRLIEAPKSRLKAIQRQISSEILSQIPVHESVHGFRRGKSINTFAAPHVGRACVTKIDLEDFFPTVTRSWVRGIFQSAGYPDAVSVLLAGLCTNSAPHDVWQDMREQLPRQRLRYIEALYATPHLPQGAPSSPTLANLAAFRLDCRLSGLARKMELTYTRYADDLAFSSDSPATRDIHRRLPYIYAIVMEEGFRIHFRKTRVMPSAGRQFLTGLVVNDRLNITRTDYDVLKAILTNCVRHGPDGQNRDRRNDFRAHLSGRIAFVESVHPERGNKLRQLFERIQWPT

SEQ ID NO: 5240 - protein, 443 aa, unidentified
  source 1..443: note = Related to CP036289.1; note = Bremerella volcania
MHTIQFYAINLAGVFVDGPFDVDALVERGSQILSKRGRWLRPLAKRLAKTFGDRIRPRKSDVVSFLLADQGFRNAYQNGRFKFSSLLRPAPEMVAPAVTTTWQAPLNLRTPQDLSHWLDLKPGELAWFSDRRQLEAKQNKPKLQHYRYRLLPKRPGEFRLIEAPKPRLKTIQRRILKDILNHLPPHDASHGFRCGRSISSFARPHIGREVVLKMDLQDFFPSIRAAQVQAIFRSLGYPDCVADLLTGLCTNSAPTEIWNALDHAPPAKIQYKIRRYARPHLPQGAPTSPVLANLCAFRMDSRLAGLARKMNASFTRYADDLAFSGDCEFARICRRFSVHVAAIAMEEGYTVHYRKTKIMRKGVRQRIAGIVVNKRPNILRKDYDRLKAILSNCVRTGPASQNREGHDDFQSHLAGRVSFVEMIHPDRGRKLRAILEQIDWTVS

SEQ ID NO: 5241 - protein, 442 aa, unidentified
  source 1..442: note = Related to QPEW01000030.1; note = Blastopirellula cremea
MHSVTHSANILATAFAAGRFDPEELVQRGSQVVASRGRWLRPLAVRLAEAFAGKIHPRKSTIVAFLVADAGFCRAYHNDRVQIANLLGPIPEMIPTATAANWQGCLALPTPHDVSRWLNLAPGELDWFADRRRMAHAQSNPKLQHYRYRLLQKRPGEYRLIEAPKPRLKAIQRRILSDILNHVPPHEAAHGFRRGRSITSFAAPHVGKQVVLKMDLQDFFPSTRAAQIQSIFRFLGYPDTVADLLTGLCTTSAPQDIWPTAAPRPAQPTQRQMRRYAEPHLPQGAPTSPVLANLCAYRMDLRFSGLASTVNASYTRYADDMAFSGNQDFARVCQRFSTQAAAIAIDEGYTVHFRKTRIMKQGACQRVAGMVINRRLNISRKDYDRLKAVLTNCARHGPDSQNHDAHNDFRSHLEGRVSFVEQINPERGRRLRALLERIDWSK

SEQ ID NO: 5242 - protein, 465 aa, unidentified
  source 1..465: note = Related to NZ_QPEV01000005.1; note = Blastopirellula cremea
MIPHAERDSLVIPPSTFFLMRTSKKTLAAALATAFVAGSFEVDDLVERGYGVIGKKPRWMQPLAERLHAAFPWDMRPRRASVERFLLFDYGFHRAYRRSKLTVASRIGSSPVMNQGVVASGWKAIRPLTTPAELADWLDVPLRQLDWFAGVGPYKRVPTEMKLQHYRYRVLKKVDGNVRLLEAPKARLKRMQQKILTEILNHVPPHATCHGFRRGRSITTFAKPHQGQAVVVKLDLRDFFPSIRAAQIHALFLYLGYPEPVAHLLTGLCTTSAPETVWREIGASPRNNLTQEQIRRYARPHLPQGAPTSPALANLCAYRLDYRLSGLALAAGATYTRYADDLAFSGDAVFRRAAQRFVVHATAIVLEEGYQVHHRKTRVMRQSVRQKIAGLVVNQQANVPRKDFDRLKATLTNCVRHGPESQNRADHANFRLHLRGRIAFVESINQKRGEQLRSIFAQITWPQSA

SEQ ID NO: 5243 - protein, 437 aa, unidentified
  source 1..437: note = Related to NZ_CP083740.1; note = Bremerella volcania
MHSRKLLAATLASAFVGGPVETDALVEHVRVLLLDKRKQRWLKPLVKRFVQASSVGPRPRQPQVEAFLLADYGFLKAYHKNHIRLSGALAPSPVMSSTIESITSSDRISLITPAELARWLDLPIRELDWFADRRGWEAKHANAKLQHYRYLTFAKPSGETRLVEAPKSRLKGIQRRINTDILNHVRPHEAAHGFRAGHSVRSFAEPHVGKRVVLKLDLRNFFPSIRAAQIHAIFRSIGYPDAVASLLTGLCTNTTPSEIWEERLPLALDFPMYERPHLPQGAPTSPALANLAAYRLDARLGGLAKSAGANYTRYADDLAFSGNTPFERVVRRFADHVAATVMEEGFFVHHRKTRIMPQGVRQRIAGVIVNEHLNVDRRTYDRLKAVLTNCIRLGPDSQNVDAHEHYRHHLEGQVSWVESINPQRGQRLRELSNRIMW

SEQ ID NO: 5244 - protein, 446 aa, unidentified
  source 1..446: note = Related to JADLDX010000443.1; note = Pirellulaceae bacterium
MLNDPESPTKRWQMLADILLHCRWTSADHLALGMGAIKRQPNAVRNMIAAIHQAFPWVPSRTQLVTFLASRSDLLKGLRWKRLPDIQCQRRLYPTTMQPTRFAQQTWEPPPLPTLGSVADDLLRLPASLVEWLSNPRVQHYVVSVIAKRGSAGSAGTGAATGRILEQPKRLLKAAQRDILREILRDVPAHPAAHGFVPHRSVVTFAKPHTGRPVVVRMDLANFFTSIPAARVNAVFRSLGYPLPVAHQLTNLCTTACKLDAVEGLADYSAAERVRLENLYGRPHLPQGAPTSPALANLVAYRLDARLSGLARRVGCEYTRYADDLLFSGDRRLLRQAQSLVVQVSAIALDEGFQVQHRKTRIMTQAVLQAAAGVVLNQHTNIDRRDYDNLKATLTNCVRHGPATQNHLQHPNYREHLLGRIGWVHHLNPTRGSKLMRIFERIQWPN

SEQ ID NO: 5245 - protein, 444 aa, unidentified
  source 1..444: note = Planctomycetales bacterium; note = Related to JAGQOV010001318.1
MQTPHTVAETLAEAFLQGEFATESLVQRGAQALQGTPPRWLRRLASRAVQTYGLGPRPALPALSRFIAHDAAFQSAMRGRRPVVARAWLCVPEMFPIAAARSWEVPPLCTLGSLAEWLDVPVGRLDALSDVKSLERLHPRESLRNYRYRVLSKGGGRVRLIEAPKPLLRAIQRQILAEILRAAPVHDSAHGFCHGRSTKTFATPHVDQSVVISLDLKEFFPSISAARVDALFRSLGYPARVAAALTALCVNCTPSWVWKKLSGDALTRRRIELERLYGFAHLPQGAPTSPALANLCAYRLDCRLAGLAAVCGGNYTRYADDLAFSGGERLRRSAARFQVHASAIVMEEGFKVNHRKTRIMSQGACQKLAGVVVNRTTSLPRRDVDQLKAILTNCVRFGPTSQNREGHADYRGHLRGRVAYVQFLHPGRGAKLRAIFEQIDWNAS

SEQ ID NO: 5246 - protein, 463 aa, unidentified
  source 1..463: note = Related to JAGQPV010000013.1; note = Planctomycetaceae bacterium
MPDDLAAARRLALAFLTAEWNPQSMAEHGRRVLGLKGSPKWILRLAEQVCRQYPAAPPPTQLELSRLLATSGRLRQAIRRREQSNQPLDSGTLLLPPMPMRPVVGLPAGWELPNLTSAGQLAAWLDITPDELDWFADVRRLQRDRPPGPARHYQYRWIPKAGGRQRLLESPKPRLKQVQRSLLHGLLDRIPPHPAACAFRRGHSLASFLAPHAGRRILLHVDLRHFFPSISSARVHALFRTVGYPEAMARSLTGLCTTSTPRQELDRPQDREAEAALHRLYGSPHLPQGAPTSPALANLCARRLDVRLNGLARRTGADYTRYADDLLFSGGHELERMLSRFRVWVCAIAIDEGFTIRHRKTRELPRSGRQQVAGVVLNEKLNQPRAEYDRLRATLHNCIRHGAASQNRNGHPRFREHLGGRIAWVNMLNPNRGARLKQLFQQIDWPEESTGSPPADSQPAKPD

SEQ ID NO: 5247 - protein, 461 aa, unidentified
  source 1..461: note = Related to NZ_CP036276.1; note = Symmachiella dynata
MTDVRAVARGLATVFLSGEWTRAGITQRVQTALEQRVKSRAVDLLVGRILRACGEQPPPPTLHKLTKLILSDPVFHKYIAEEDGYPRRLNLAHLPPPVMAPAPAIPSDWQLPTILTPGALADWLGLSSPELEWFADCHGRERQRAREALRHYRYRWIPKRTGGRRLLEIPKQRLKDLQRTILQWILGRIEPHAAAHAFRRGRSIASFAQPHSAKRVVLRIDLRHFFPSVQPSRIKSLFRTVGYPEAVARLLCGLCTNSVPDDILGVAEQQFATNERQPVERLYAAAHLPQGAPTSPALANLAARRLDGRLSGLATAVGGDYTRYADDLVFSGGRALERCLPRFRTLLLAIVLDEGFSIRHRKTAVMPAGGRQQVAGIVVNEHPNLNRKEFDRLKAILYNCAHHGPRSQLTGCLPQPNEPPTEATLEQLRSHLTGKVAFVRMINPAKGERLSKLLREIDWVG

SEQ ID NO: 5248 - protein, 448 aa, unidentified
  source 1..448: note = Related to NZ_JH636435.1; note = Schlesneria paludicola
MDDSFRQFTANLAETLARGTWSLDELLKRADQSLTETSSRAWIIRLTERTMVAFPGRQSPQHCLLMQFLAHDRGLRRVWNNCERDERPFPEIDLTKLVPPVMQPASEVIAAWPVRPLVTIQDVSQWLGLTLGELDWFADRTRRKSRVPEGPLRHYRYRWIAKSSGGQRLLEIPKPRLKELQRKILAEILDAIPPHPAAHAFRRGRSVRGYVTPHVGQQVVLHIDLREFFPSIRASQIHALYRTVGYPERVAAMLTGLCTHITPRDAIPLNGEQQASNSNWKRLGSPHLPQGAPTSPALANLVAFRLDCRLAGLSQKVEAVYTRYADDLLFSGGKELARCASRFRLLVTAIAHHEGFEIRARKSRTMHSGTRQQVAGIVLNRQPNIPREEYDALRATLYNCQRHGPTTQNVNQHPHFRDHLLGKINYWSNICPERSRKLRLLFDQIVWP

SEQ ID NO: 5249 - protein, 442 aa, unidentified
  source 1..442: note = Planctomycetes bacterium Pan189; note = Related to CP036268.1
MHDFEDEFPTPDAESVARVFLAGAFSPESCTARLTVVFGRVHHRRIERLVRLVFAVFPPHSAVPTLRRLTLFLLRFESYFPDQFRISPPRDLTGHRTIPAEAITGSLPILNNIRELAEFLDLTPERMLWLADPHGFETKRPRERQRHYRYRWVERTGRTPRPLEIPKQRLKAIQKKILAEILNKLRPHPAACAFRKGQSVRDFAKPHVGRRVVIRFDIANFFPSILQPRVQATFRAVGYVEEVAFLLSALTTNRLPTDQLHAEATGSGARHLRQHLLSAHLPQGAPTSPALANLCAFHLDRRLTGLAARFSLSYTRYADDLLFSGNLSDAEIYRFRIRALAILIDEGFEARSSKSAVLRKGSRQQACGVILNTRLNIAREDYDALKATLHNCIRHGPELQNHEGVADFRSVLRGRIAWVHSLNVAKGEKLLAMFEQIHWNTS

SEQ ID NO: 5250 - protein, 425 aa, unidentified
  source 1..425: note = Related to JADZEF010000070.1; note = Planctomycetaceae bacterium
MSERIRMVMAARRQSRWHDQLAKRVHDEFAAVIPRPTRDRLAEFILFKGRIPRRVRAPEHRDGPLRNTSLLSLPAPAMIPADAIAARVALPAITTQGQLADWLSISPSELDWFADPAALLARWGVADRGTLRHYRTRLLPKPRGRWRLVESPKPRLKEIQRKILADLLDLVPVHPAAHAFVRGRSIVTGVTPHFGRDVVLSIDLREFFPSVHAGRIHAMFRTLGYPERVASLLTGLCTTRTPADRLAQGAFSTAQRQLYQSLHLPQGAPTSPALANLAAWRLDCRLEGLARRFGAAYTRYADDLIFSGDSTVHRALPRLRMWATAIVLDEGFAIQRRKTRVMPSGQRQTVGGLILNARANIPRREYEALKATIFNCLTYGPSSQNREQHPRFYEHLRGQIAWVAASSPPRAARLLEEFQRIDWSR

SEQ ID NO: 5251 - protein, 446 aa, unidentified
  source 1..446: note = Related to JABMPE010000532.1; note = Rhodopirellula sp.
MPSEFIRKLSWVLLAGRWERGELENRGRLALRRATCPMWMVQLANRLIVTFGDNVTVPQRRQLELFLSWDAPLQKRIRTWDRNGSFPKLVVPPQRMAPAADRFIESRLPELTTTSSLAAWLSISPSELDWFADQRRWERRQVNEAARHYRYLWIPKSGGMCRLLESPKPRLKAMQREILDCILAKVPVHDAAHGFCRGRSVRTYLEPHVGRDIVFSVDLRQFFPSVRVSQINAIFRTVGYPEEVARMLTGLCTNSTPENVLHSKRVPDAGVENSRMLRRYRDVHLPQGTPTSPMLANLAAFRLDRRLTGLASKFGASYTRYADDLTFSGDSDFRCALERFKILVYAIVIDQGFEIRHRKTRVMTQGQRQLVTGLVLNNRLNVPRNSFDVLKATLHNCVRFGPSSQNREAIDNFSEHLAGRISWVDSVSPARGAKLKALFNEIDWSR

SEQ ID NO: 5252 - protein, 418 aa, unidentified
  source 1..418: note = Planctomycetaceae bacterium; note = Related to JAGQQF010000113.1
MPSRRPSPSYIALCLAVAWEHKTGRNDELLEDAVAVLGLTDRPRWLRHLCRHLAGRWGDPLRRPSRGKVVRLLLASESFIAAVGAVPLQDNLAPAPYWTTILPAWSWNLPEFPSTGALANWLSVSPADLDWLADVRGLNPRSPDPQLWHYHYSVRPKSDGRSRLISAPKLRLKQLQRQILGQILQRIPVHPAAHAYVSGRSMATCLAPHVGRDVVLHLDLDSFFPSIQASQVRAVWTYVGYGASVAAMLTGLCTENVPDSVLSRLNASRQAVDRFRERHLPQGAPTSPALSNLCAYRLDCRLSGLAGHFGAAYTRYADDLIFSGDAHFRRRLFDFRTTVGAILLDSGFNLQGRKTRVLPASRSQRVGGLVVNRRLNIPRREYDDMRAILHNCARFGAESQNRERHPHYREHLLGRIAY

SEQ ID NO: 5253 - protein, 451 aa, unidentified
  source 1..451: note = Related to NZ_CP011270.1; note = Planctomyces sp.
MDEPEFRERVVLDALARTLLPLADDVSVAVRAARQLLGWKPERWFRTLVANVLAWPEMRAGQMTAGELAARLSGIPSLMEALDEGKGVVLDLSAIPRPRMRRSPVAGMGPIVRLETVGDCLDWLGLGLNELDWLTDPKGWLPAAGQSRLAHYHCQWIPKPAGGVRLIEAPKRRLKAIQRKIHEEILRHVPPHEAAHAYRPGRSMVTALTPHTGQETVWHLDLTSFFWSIGSGRVRRFFRRIGYPEGVAGVLTGLCTSRVAPGLLEPAPLSEREKQQLLARHLPQGAPTSPALSNLCAFRLDCRLSALSARYDVRYTRYADDLVFSCGPKLRRRLPGFRNTVLAILIDEGFQIRRRKTRVLRRGQRQQVGGLILNETLNVPRSEYDTLRAILHDCGRNGPVVANRDQHPSFREHLQGRVAWIAHVSPGRGRKLKEMFERIDWSGSEEPTGAG

SEQ ID NO: 5254 - protein, 438 aa, unidentified
  source 1..438: note = Related to JACKHO010000006.1; note = Planctomycetaceae bacterium
MTYRAFLRSLAFILDQGFWHEEAALEQVLDVLPTRQRQAKWPRRLIGRIFTTFSRYTRPSFGELSRFLQGDKELKADLRRLTAIPLIVWRPGDQTRPHPVLRVSGDLPILKSVRDFANFLRMPVNSLQALADVNSREARTLDARHRHYNYRWIQKRSGGQRLIEIPKERLKHAQSQLLECILRHVPVHEAARAYRRGLSLRDAVEQHVGQRILLRIDLQDFFPSIGVGKVRQVFRHLGYPSVVAMHMAGLCTNVVPQAVLETTSSNHRLSHVYQLPHLPQGAPTSAVLSNLASYRMDARLTGLAAYWSMQYTRYADDLLFSGDSLSAAQVSRLRTQILAVASDEGFRIRRYKTKVMRAGRQQSALGLTLNSQANTMRRDFDNLRALLNNAVRHGLESQNRDNHPKFLEHLAGRVAYHRSMNPKRGARLDRLLSRLTNE

SEQ ID NO: 5255 - protein, 435 aa, unidentified
  source 1..435: note = Related to NZ_CP036271.1; note = Caulifigura coniformis
MNGEILRAARIAEALLAGPWDLKSLTGRLKTTFHAVARSRWPRQTAVELVAEFPAPPRAIRLAFWITRNRHLAPRQKDVPLADLPRPRMRPHPAAASLLVPALCTPGDIAAWLRLDPGQVDGLAGAGVPERRRHARARNYAYRWLKKSDGRVRLIESPKWRLMAVQRQILSDLLDHVPPHPAAHAFVRGRSLQTFLSPHVRRNWVLRLDLADFFATIAANRVVEVFRFLGYPEASAQWLTRLCVNAAPSDVLCDGIGHAADAHVQRLRSRLSGLHLPQGAPTSPALANLCLFRFDQRLARLAESRGLQYTRYCDDLVFSGDRETRSDVVDLRRTLFMILADERLSVRHAKTRIMPAGRRQNVCGLNLNHGLNTPRAAFDQLRAILHRCGTKGLTAEEQQDSSRFRQHLQGRIAWVSSINPHRQAKLVKLFEAIAW

SEQ ID NO: 5256 - protein, 456 aa, unidentified
  source 1..456: note = Planctomycetaceae bacterium; note = Related to JAGQQQ010000113.1
MGQQSRRLAEAIAQTVLNGPFAFDAIVSRLKRITPGPCLRGWKQRVARSVLDRFGEGGGVPSLFTLRQYLIDSGLLIDVEADDFPEDWIDETETTIIRPDRVPHAVFCPRIAAFQNLGLPEWTTTRELADWFGLTDGQLLWLSGGRRSDGKSAFERYRLKCQRSSSGKVRCLEVPRSMLKSIQRELNRDLLTRIPIHSCAHGFVPGRSIHSYVEPHVGQDVIWKTDLANFFPSITRSRIEAQFRLFGYPDAVARTLSGLMTVRQDRTKIEELSQQFPRDQFRDLASLLTQSHLPQGAPTSPALANLAAYRLDCRLSGLATKFHANYTRYADDLTYSGGQRFQRSLDTFRVHALAIIVDEGFRNRLRKTRVMMSSRRQTVAGLVINQTQNVPREEYKTLKAILFNCRLHGPASQNRDGIPDFQAHLRGRIEFVRSANPERGEKLMAMFEEIEFHAET

SEQ ID NO: 5257 - protein, 446 aa, unidentified
  source 1..446: note = Related to NZ_FOQD01000001.1; note = Planctomicrobium piriforme
MNLFLDALATVVLSGPFDQKAICARIRKSLVVRSDAPLEVKLTTRWVTPLVKAFLSAVPARPRHRQVVSFLSTQQLSAQAEYFSIETSRCSPPLFLPLKPQFAEWGLPQWRTTGQLADFLGISPVRLDWLCGRYPVRDSQEIRQRYQIRWQRSRTGKLRMIEIPCPQLMRIQRQLLHDVLDRIPVHAAAHGFRAKHSTLTCVSPHVAQAVVWKLDLASFFLSIPRCRVTGLFRMLGYPEAVAEDLGWLTTNAVPSKVLQRMKAKIGTDQFQELERFAAAGHLPQGAPSSPALANLIAYRLDCRLNGLATAYGAHYSRYADDLLFSGDYRFKRYLAGFRIQVLAIILDEGFLIRRRKSKVMVHSRRQQALGIVINQHPNLPRQEYKLLHAILHNCVVQGPHSQNRDGHLDYHAHLAGRIANLRRLNPARAAKLQTMFEQINWQRFDS

SEQ ID NO: 5258 - protein, 423 aa, unidentified
  source 1..423: note = Verrucomicrobiaceae bacterium 5K15; note = Related to JAFBGL010000010.1
MSSDELATILLSGAFEQAAFEERLVMAVGAPKFSRKLAGRVIRHFGSGSRPSVRMLAEWLESDRRYQKKQRRGELQLSGQILPAEMAPDMRVAADWKIPSITTSGDLAHWLDLPVSQMEWFAGDYNSVPADTKLSHYTVQTVVKKSGGFRVLEKPKWQMKQVQRYILHGILDHLPPHPCSHGFQKNRSILSYVQPHIGRKMLIKMDLKDYFLSIERSRVRALFHLLGYPPLVSVQLAGCCTNRLRLADVPSGVAQRDRYTVSHLPQGAPTSPALADRLLYRLDLRLHGLAQKMHMDYTRYADDFAFSTNDSVRRPQVEAFLNLVDQIVREEGLQLHKTKTSVMHHSQRQRLAGLVLNEKHNVARGEYDRLRAILHRCGQNGLDAENKNDHPSFLQHLEGRVEFIRQTNPRRGKKLQGMLDKLV

SEQ ID NO: 5259 - protein, 445 aa, unidentified
  source 1..445: note = Related to NZ_NIDE01000017.1; note = Fimbriiglobus ruber
MKIDPVFLDMARVLLAHPWDRAAVLACGHKLLGRKPKWWAAAVEKFVAWFPTRPPTAARLARLLAAHPRLAALRDKDKLPQPRADLLREALQYQVDHLRYPDLPKLATPAQLADWLNVPEPVLRWLADIKCLNARQAPAVQNYRYHWVARRRGGHRLIEAPKEILKRLQRQILDRILDLVPPHDVAHGFRAGRSILTHAAPHTGQIVVIKFDLKDYFPSVAGKRVGSLFRWLGYPDEVAWLLTCLCTTITPAAVEATAPAGADDVSLTFQTLYRRRHLPQGAPTSPAVANLCTFRLDRRLSGLAAKLGARYTRYADDLLFSGDAVFARKRRSFIACVYRVILEEGFQPAFRKTRVMARSTRQLATGLILNETLNVPRPDFDELKAILHNAMKHGLASQNRAGHPHFVDSLRGRIAFVSQANPRRGAKLKLKFEAVLENEKRPAST

SEQ ID NO: 5260 - protein, 429 aa, unidentified
  source 1..429: note = Related to NZ_BMXI01000009.1; note = Roseibacillus persicicus
MTPTTLWLKNLSTLLLEEERQLDAWLALIRKVIPGKPRRNFLIITREVWKVAKTRTVLENRELQQIFRENRRFWNWQRKWYATRTPLPPALIVGPATPVLDTSAWHLPELATVGDLADFFALQPDDLGWLLSPKAQHYHEQWLPKRKGGRRLLESPKPLLKQVQRTLLRELLDKVPPHECATGFRAGHSIVDFAQPHANKSIALKMDLANFFPSLGRSRIKRLFMSLGYREGVALALAVLTTHRSASPDLTFTEKELYSRYHLPQGAPTSPALANLAAFRLDCRLAGLAKSAGASYTRYADDLLFSGTEELARGLHRFENRVIIITREEGLEINFRKTRRMAASQRQAAAGLVFNQKLNVPRREFDTLKAILHNCRKHGVSSQNHSHHPDFQAHLRGRIAWIASLHPVRGERLRAAFEELDWSKPNAQE

SEQ ID NO: 5261 - protein, 477 aa, unidentified
  source 1..477: note = Related to NZ_ANOH01000392.1; note = Rhodopirellula sp.
MSDYPTAVGFELTQHSDRLASARLELSPRNERIVHRASLSPVFTMAPRPVVKRSVSAAELTKLLAASLSARWLGDTESVSRRLRKLTGSRAKWVQELAVSLNQQFGKQGYASGAEIIRHLRNNPYLQSARKNNKLFRLPVAEAISAPESDSPSIETDTQLVDFLGLPSLRALEWLLLPHLRRQTNVDHYTRRTLHQTNGKTRLIEEPRPVLKRVQRLILTEILSHVPIHDVAHAYRPERSVFTCAAPHTDCRVVLRMDIRDFFGTITLRRVAAQFRRCGYPRPIAFTLARLCTAATPITSESTEREQHLTIPHLPQGAPSSPTLANAVAFQLDRRLAGLTRAVDANYTRYADDLLFSGGQCLASRVDRIATTVAVIAMEEGFQIAHRKTRTMFSGHQQRVLGLTVNQKLNCDRRQYELLRAILTNCLRHGWESQNRDSHPNFAEHLRGRIAQIVQANPNRGQRLLHLYEQVSWNDPG

SEQ ID NO: 5262 - protein, 464 aa, unidentified
  source 1..464: note = Related to NZ_JACHXU010000006.1; note = Rhodopirellula rubra
MAPPSVAKRTVTASQLADLIASELATRWLGDVDEVTRQISKLTGSRAKWVRTLATSVTQQFGKTGHATRIQLLRSLRNEPHLRNARKKKKSFNVPVLSTTQPTSSLFPTIETDDQLVDFLQLPSLTVLDWLLVPHFRRQTQVDHYTRRVLRRRDGTTRLIEEPRPLLKRIQRLIHSEVLVDVVIHDVAHAYRGERSIFTCAAPHVGHQAVLKMDLQNFFGTITLRRIAAQFRRCGFPRPIALTLGRLCTAPPVSVVSPQTGKGFVQVNLINSGSANSGGNLNAVRMPAHLPQGAPTSPTLANAIAFQLDRRLLGLANAVGANYTRYADDLFFSGDRGFASRIDRFATTVAVIAMEEGFTVAHRKTRKMFSGHRQQLLGLTANEKLNSHRQQYEQLKAILTNCVRHGWESQNRENHPNFADHLRGRIAQTLQCNPNRGQRLMRLFHEIAWNETQPSRPSPDKPDP

SEQ ID NO: 5263 - protein, 445 aa, unidentified
  source 1..445: note = Related to JAGQPR010000068.1; note = Planctomycetales bacterium
MAALSLVPLRMDEKAAVNRAAFIKVLAFELSRTWLGSRQRIRQVLRRMLGRMPAWCEELSSMVHEEFSAAAYANQLQLRRFLGRVAALRSVFRKGRNLRIRTTALGRATAYRWPVPQARNEAELQDLLCLRSTVALDWLIKPHVVRSTNVDHYRRKMICKHDGQIRLIEEPRPLMKRVQKTIHRHLLAAIPVHSAAHGFICGRSIFSAASPHCGKRLVLCMDLANFFGSIDRRRTSALFRLCGYPAPVAFLLGCICTAPESNSPDMPGGELVKVSRLPQGAPSSPSIANAVAFRFDQRLAGLAHSVGADYTRYADDLTFSGNEQFVNSASRLIPLVGAIAIEEGFAVNHRKTRRFYAGHRQTVLGLTVNVSPAAARQSYESLKALLTNCVRHGPESQNRDNVDNFRSHLRGRIAYVGAQHASRNKKLLELFGRIHWDQSTPRDLQ

SEQ ID NO: 5264 - protein, 426 aa, unidentified
  source 1..426: note = Planctomycetes bacterium Poly21; note = Related to SJPU01000001.1
MESSLTRSQLAMLISRDLSRRWLGNSSVIHRRLRRITGSRARWTDQLAEALHLQFGRAGHAQQVPLQVWLDGHPVMKAAFRNRQTLRVDVATANQINRPGYRWPVPAAANLLELTDLLCLRTPRAIDWLVRPHLRRSTSVDHYVRRRIPGRQGRGRWLHQPRPLLMRVQRCIAREILTEIPLHAAAHAYRRGLSVRDCAAPHVGHRVVLKIDLENFFGTISLRRVTALFRAAGYPDEVAVTLGRLCTVPARTPSGTEDCRIAGTCLPQGGPASPAISNAIAFQMDRRLAGLASSVGASYTRYADDLLFSGGPDLASRIDRVATTVCVIAMEEGFQVQHRKTRKMYSGDRQRLLGLNVNTQLSTDRSDFELLKAILTNCQRQGWRSQNRDQHPEFRLHLQGRIAHIGQTNPGRYQKLARLFDAIDWT

SEQ ID NO: 5265 - protein, 434 aa, unidentified
  source 1..434: note = Related to JADYZV010000153.1; note = Pirellulaceae bacterium
MAEKTLDPALVSRRQFCRQLAGCMSRCWLGNDAHVRERLEQVLDCQATWVAELAKSLSASFSEIGYANRFALESWLRKQPTIKLFFKGKKSRRLTDEVQRALASRNHRWPVPPLDSDDDLCRLLEIASLRELQWLVLPHVRRNTAVDHYKRTCLKKKLGGYRWIEEPRPKLKAVQRRMLESVLPGIPLHSAAHAYRTGCSVQSCAEPHVGQRVVLKLDLRDYFGTISIFRVKALFANAGYSWPIALRLAQLCTAPARMDDLRDEARSLTRTRLPQGAPTSPSIANAVAYRMDRRLAGLAASVGASYTRYADDLIFSGDDNFAARVDRFATSAAAIVIEEGFAIQFRKTRKLFHGAEQRILGVTVNEKLNLNRRAFEGLKAELHNCARRGWRTQNRTEHADYRAHLRGRIAYAQSLNPTRGAKLLQLFEQVKWNE

SEQ ID NO: 5266 - protein, 462 aa, unidentified
  source 1..462: note = Planctomycetes bacterium K23_9; note = Related to CP036526.1
MTARRETRIDIGRARLVRILIARLNHRWLETPAQVLRLTQGLFGSQHSLEKQLATQLSQAHRENRLSTQQPLSRWLLRNELLIRYFRKKQTISICKSIVDSIEKSEHAYRWRVPAVDDEVQLAKFLLLGSSQVLQWLTLPHRRRRTDVNHYRRRAIPKRDGTLRWIESPSPILKRTQRIIAADLLPHVPLHDAAMGFRRGHSIHDSAARHVGKASVLRLDLQDFFGSIHFGRVRSLFAYAGYSSKVASTLAMLCTAPSETAPLDTSPPCITPLSNSARTSTRSALPELPSRLPQGTPTSPAIANAIAFRMDRRLDGLATAAGANYTRYADDLVFSFDSPSVAFAKRFATSVAVIAMEEGFKMNFRKTRLMRRGNRQRVLGMTVNEKLNVSRQAYETLKAILHNCAKRGPRSQNRTEHPNFREHLRGRIAHVASIHTGRGNKLTAVFETIDWDDDAPDYRQPD

SEQ ID NO: 5267 - protein, 430 aa, unidentified
  source 1..430: note = Pirellulaceae bacterium; note = Related to JABDKS010000522.1
MSSHTVTIDVDLKRFAGLLHRRLQYRHLPAPASVRDAIQPLFGRDKKLCEDLVQQIVDAQRNPQPLRHPQMLTWLSKNPAVKKRFRHRKRIKIQQSLVIQIESDGVYRWPVPPIANEGQLADFLSLSTPRIIDWLTLPHRRRSTSVDHYTRVASTKRDGTIRWIEQPAPTLKRVQRLIAQQILSTIPLHDAASGFRAGHSVPDCARQHVRRSLIIRMDMRHFFGSIHVGRVRNLFLIAGYPPQVARTLAFLCTAPASIDPDADELLRRSRLPQGAPTSPAIANAVSFAMDRRISGLCKTLNVTYTRYADDLIFSCDHFGLSQAKRFATTVAVIAMEEGFQINFRKTAFMRHGNNQRVLGLTVNQKLNSARKEYETLRAILHNCRRDGPAGQNRHDHPKFRCHLRGRIAHIASVNPHRGAKLMEQFDQIYW

SEQ ID NO: 5268 - protein, 444 aa, unidentified
  source 1..444: note = Planctomycetales bacterium; note = Related to JAGQOZ010000019.1
MPPATYSLDQVAAAFAKAAVVGVWKRTAVLDQWRKLIEPLPNGLKSVAMQLIGQFAHVPSQQVVAEFLQSNRMFQQAYAKNLVMRRVGWCDHQIVDAALAPKSRHVRNWDLPELTSPTDLASLLDCPENLLWQLADHRRCYWLRQSHYRLRMSRKRSGGLRLIEAPKPKLKTVQRRIWKRIIRWIPAHQAAHGFQPRRSIRSNAALHTGQSVVIRMDLQNFFASVSGARIAAIFRTAGYPESVALLLARLCTSKVSRFVWQMLCDENQAADLHGLVDQVSVWHLPQGAPTSPALANLAAFRLDRRLTGLAASMSSRYSRYADDLIFSGPTDLAKRSQAFVAKVTEIMVEEGFLPNTRKTRIMRPSVRQSVCGLTVNQKVNSNRADFKQLQAILHNCVTLGPAGQNRANVADFRAHLAGRIQFQRFIHPQRAAKLEAMFVRIKWP

SEQ ID NO: 5269 - protein, 450 aa, unidentified
  source 1..450: note = Verrucomicrobiales bacterium; note = Related to JAEUHH010000058.1
MPPEPLPECMIAAAAEQLAGWLQLRLLPEAQSLEAALESGLPGSISDRKPLLRRLSGIKEIATMPEADLAKIIAADPWFQAHGARSARHWRHQTRVREMTPRWEGLPILATEGDLCLWLGGLRPAELHWLAQTERGDHDPAGKLAHYVHRWIPRRHGAPPRLLASPKPLLKSLQRKILRDLLDHLPLHEAAHGFRRGRSIRSFAHPHTATDCVLRLDLADFFPSIRFGRVAALFETAGYPSPVARLLAGLCCHSAPRAVVRSAGLPRALADRLLRPHLPQGAPTSPALSNAVAFRLDRRLAGLAAAAGAQYTRYADDLAFSGGRDLWRGATRFLDRATAIVLDEGFEVNFRKIRVMPACARQRIAGVVVNEKTNTVRETYDALKAALHRWETRGLPEDDALFPERLLGRISALAQLNPEKGAKLRQRYDRVREGSGFHEMGSPPTSGGLL

SEQ ID NO: 5270 - protein, 346 aa, unidentified
  source 1..346: note = Related to JAGROW010000047.1; note = Verrucomicrobiae bacterium
PHPAVMTARWEGLPLLPSLSDLADWLEIASLSELHWLAGIDRGREAPPSRAVHYTYRWILRKNGSPPRLLECPKPKLKAIQRKILRQILDKVPLHDAAHGFRLRRSIRTFAVPHTGRECVLRADLADFFPSIRFGRVAAFFETSGYPASVARLLAGLCCHAPSKRGIRAAKLSPFSAAKWLRPHLPQGAPTSPALSNAIAFRLDRRLSGLAQASGAHYTRYADDLAFSGGSDLSRGADRFLALVATIALEEGLELNYRKSRVMPACSRQRIAGVVVNETPNTTRAIFDELKACLHRWETKGFDACAADDPEFSDRLLGRIAALAHLNPRKGEKLRQRFERLRGARQ

SEQ ID NO: 5271 - protein, 384 aa, unidentified
  source 1..384: note = Related to VFZW01000070.1; note = Acidobacteria bacterium
MTTAIPRLLAQAFLNGKLQRAGMIKRGAELLGQKWKWLGPLATRFLKEFGGAKPRLGDAVRFLRHDEGLCVARAGLRIAKWTPSNGVAAMRWKLPEMESPAALAEWLGLTDAEVAWFADRKNINKGKSSHYTYCVFEKPGKPARLIEAPKTRMKELLRRLLTDVFEKIPVHAAAHGFVARHSIKTFAAPHAGQPCLLKMDLANFFPSISRARVESLLITAGYDERVAELLAGICTNRAPRDVAPDPIYTRPHLPQGAPTSPAIANLCMFRADRRLRGLAESAGAVYTRYADDLAFSGASVGDRSALRIVRRTHLRIVRRTQAAEPVKHESPRLRHSRAGRPVQCSSMRTDSHQIAIRIIRVFGCCGCAVWVFHDDRQPPQRIMG

SEQ ID NO: 5272 - protein, 440 aa, unidentified
  source 1..440: note = Related to JAGQPM010000203.1; note = Planctomycetales bacterium
MATHRHIAKVIAGTAAAGQLTEDEIVARVAGVLGKRWRWLRPLARRMEERFAGRTRPRESAVHRWIIADDGFHRACRQHAIVIVEELPHRPEMRPPTGIAMTWNVPTITTVYDLAHWADLPLDELEWLADRRGREPSAEAKYRRYRYRVLSKGQSRFRLIETPIYRLKLLQRHLLSGILDHLSPHDAAHGFRKGRSIHTFADNHLGRQVVLKMDLRDCFTTIDFGRVSHLFRLAGYPERVADTLAAITTNTVPDQVWEAASGAHVFCPSERLPSIYASPHLPQGAPTSPAIANLCLYKLDLRLTGLAKACGASYSRYADDLAFSGDADFARCVQRVRHHIAAIIQEEGFEVNHRKTRVMRASTRQRITGIVVNQHRNIPRREYDQLKAILHNCISRGLQSQNRDKHTDYRAHLAGRVAFVEAVSPSRGQRLRDMLNQIDP

SEQ ID NO: 5273 - protein, 448 aa, unidentified
  source 1..448: note = Related to JAGQPF010000096.1; note = Planctomycetales bacterium
MKRVAEWFAVLFSRAATIGEMKGAAARLIGGQPRWVAPMLRRAEADAQVRDPPSELVGLSFQSWMHWLLHDRGFLARVSDPFAAIHRGPAESMMLPAAAAMDWPVPQILTVGDLAHWLDISPAELHWLANLDASWKLTGREGRHYQRVAHQKRFGEVRIIEAPRYRLKVVQRRILHGLLNRIPAHDAAHGFVAGRSTRTFAEMHARSRMVLRIDLRNFFVTIRRFQIAGVFALAGYPADVAYVLSRLCSAQMSVQEFSDLVGSPLEFRRASGAPSLAQTRRLYTRPHLPQGAPTSPMLANLCVYRLDCRLSGLAAAVGGRYSRYADDLAFSADLDVRQSKRLCTQIAAIVIEEGFQVHDRKTKRMRRGTRQRIAGVVINEHPNVTRQQYDQLKAILHNCARYGPESQNRDQCADFRAHLEGRVAHVGMLNPTRGAKLKRLLQQIDWGR

SEQ ID NO: 5274 - protein, 338 aa, unidentified
  source 1..338: note = Related to CP042912.1; note = Mariniblastus fucicola
MKFPVPKIRTLLQLANLLEIEPEQLRWLANPCGRRSAPDSWSRHYRSHWIRKRSGGWRLIEAPRSRLRYVQRILLDTIFNAMPPHVLAFGFCRNRSVIDFVKPHVGKDVCWRFDLTDFFTSVTTGRVAGLLRNSGYPCDVANSIAMLTTVQTSPRILSVEHPRATFSVQSPKHLRRHLPQGAPTSPAIANLCAYRLDARLSGLARSVGGVCYSRYADDILFSGDSDLARQSGRLRAHVGAIAIEEGFEINYRKTRLARASQRQFAAGIVLNEKLNVPRENFDRLKAILHNCVRSGPTSQNRDNHPAFRQHLEGRVQWVEMLNRGRGEKLRKLLERIEW

SEQ ID NO: 5275 - protein, 445 aa, unidentified
  source 1..445: note = Related to JACRUV010000555.1; note = Planctomycetes bacterium
MATQRFVADYLASAFVCGRWECDDLVDRGADALGRRWRWLRPLAQRALHTLGHDRRPSRFQVLRFLRQDEGLRRACHKHDVRVGGLQRKPPEMAPTAGHPVNWDVPPLVTVGELADWLDLKLTELDWFADRRGLERKVPRGPLRHYRYYWLSKRIGGSARLIESPKQRLKAIQRCILHEILDRIPPHEAAHGFCRGRSIRSFVAPHAGQSIVLRADLRDFFPCIPRRRVAGVFRTAGYPEEVSQCLAALGTNEVPDDVWRSFPQYGNVADRWRHQRLYGQPHLPQGTATSPAIANLCSYRLDCRLAGLARSFRGRYTRYADDLLFSGGRVLARSIGKFHRVVYAIAMDEGFEINPRKTRIMRQGVRQCAAGLTVNRHPNIPRDEFDRLKAILYNCARRGPGNENHARLPEFRLHLDGHVSFVESVNPARGQKLRSLFERIQWPAT

SEQ ID NO: 5276 - protein, 445 aa, unidentified
  source 1..445: note = Planctomycetes bacterium; note = Related to VGYH01000867.1
MVNQDLVASALAAAFVGGRWQVDELVARGARALGRRWSWLRPLASRLLHVLGEDSLPSRSQIERFLLQDAGFQRACLEHAIRVGGPGRNYPMMSPAAGSPASWGVPPLVTVGELAKWLGLEGKQLDWFADRRSLERTTPAGPLRHYKYYWLSKRLGGSARLVEAPKWRLKMLQRRVLRGILDNIPPHAAAHGFWRGRSIRSFAAAHVGQAVVLRMDLKDFFPSIAKARIVAVFRTAGYPEDVCQLLAALCTNHVPDDVWQRFPQYGGAADRWRHEGLYARPHLPQGTPTSPALANLCAYRLDCRLTGLAHAVGGKYTRYADDLLFSGGEALARSLRRFEATACSVIIDEGFAVNFRKRRIMRQGVRQHATGLVLNRHVNVARDEYDRLKATLHNCVCQGPTGQNRGGVRDWRLHLQGRIAFVESINPDRGRRLRRLFDRIQWPRD

SEQ ID NO: 5277 - protein, 447 aa, unidentified
  source 1..447: note = Related to JAEUIH010000118.1; note = Planctomyces sp.
MSSRKSIARRLTVAVLAGRFGKDSILERTLPLIQGSPTWLKRFVDQLIRRFGNQRPKRSYVLAFLLSNREFIDASLNEDFDVQPYLLPSEFSPSPGNFEAIDVIRLRSSGEVAAWLKLNENELSWFADRHQLERLSTVGPLRHYRYFWKLKRHGRCRLIEAPKFRMREIQRRLLREILSRIPVHNAAHGFRRGRSANSHAAPHVGRSVVLKLDLEDFFPSVPPMRLTRLLMHTGYPEDVAEILTALCCNHVPSDVFDSFPHRDDWKLRRRAKQLYCRPHIPQGAPTSPVIANLCAYRLDTRLAGLAQSANATYTRYADDLLFSGDDQFSRGIDRFRILAAAIAMEEGFAVNHHKTRVMKRSIRQEAVGLVLNEKINTRRDEFDRLKATLHRCILKGPEAVNCGQHAHFRQHLIGRIQHIAQSSQSRHTKLMALFDQINWSDPQSPST

SEQ ID NO: 5278 - protein, 441 aa, unidentified
  source 1..441: note = Planctomycetaceae bacterium; note = Related to JAGQQS010000555.1
MNTPESAARRLAVAILAGKFEKEAILQRTLPIISGSITWMKRLVNQIIKRFGNQRPRRRDLVTFLLHSRGLSNASEQEDFQIRAYDQAADFLPSPGLFENVGVLPLRSVGEIGEWFGLGESELLWFADRRQLERVLPDGPLRHYRYHWKLKRHGKCRLIEAPKFRLREIQRKLLREILNQIPVHNAAHGFRKNRSAQSHAAAHVGKAIVLKMDLEDFFPSIAPAQLVRILMHVGYPEDVAEVLTALSCNHVPYEVFSSFPHMADGRQKRHAQQLYCRPHFPQGAPTSPAIANVCAFRMDRRLAGLARSANAVYTRYADDLLFSGDEKFARSINHFRISVAAIAIEEGFTINHHKTRVMKRSVRQEAVGLVLNEKLNTRRDEFDRLKAILHRCVLRGPAAVNEGRHADLRSHLRGRIQYVAQTNQGRHAKLSRLFEQIDWSD

SEQ ID NO: 5279 - protein, 479 aa, unidentified
  source 1..479: note = Related to JAEUHE010000137.1; note = Verrucomicrobiales bacterium
MSVARFIARATLRWRADPLTHNGTRWSTVPLSTLMEFANQVARQLAIAIQQGRIEEEALVQRIREHCLGRQRWLRSFARRFVAHFGEGRRWRRLRMERFILKDAGFRRAVAMSQLSLRSGINPAPGMCPAAGAPEHWKLPELATTGDLARWLNLEPGELAWFSDSRTQEQTLPEGPLRHYRYHWVLKRGGSARLLECPKQRLKLFQRHVLFQLLNRIPIHPAAHGFQAGRSVQSFAQPHVGREIVMRLDLQDFFPSVMKSRVLAIFLTAGYPEPVAAMLAGLCTNASPFAVLSSCPATVHPTQRCHLKDLYRRPHLPQGAPTSAALANLAAFRLDLRLHGLAKAAGAAYTRYADDLVFSGDSAFARMVERFYIQVCAIALEEGFAVQTRKTRMMRRSVSQRAVGLVLNDRLNTPRREFDCLKAILHNCVVQGVAAQNRADHPRFKEHLAGRIAYMESINPGRGIRLRRDFDRIIWPDPT

SEQ ID NO: 5280 - protein, 442 aa, unidentified
  source 1..442: note = Related to JACPRJ010000368.1; note = Verrucomicrobia bacterium
MRLAAKIAHALATAILNGTLTTEGVYKRGAAVLGCRWAWLRPLAKRIIAHFGEGTRPRVFRLERFILANGGFLKACEKHQLTLRPDAHFEPAMCPAAGPPRRWKVPRIRTPGELARWLGVEFNQLLWLADCRTQEQKLPPGPLRHYCYHWQPKRDSSARLIESPKPRLKTIQRQVLHEILDRIPPHAAAHGFRAGRSIRSFVKPHVKREVVLKLDLKDFFPRIARARVLAIFLTAGYPEAVAELLTGLCTNSVPSEVIKACPAATNPLRAREAKQLYQRPHLPQGAPTSPALANLAAYRLDCRLAGLAKAAGARYTRYADDLVFSGGKPFARMVDRFYIQACAIALEEGFEVHTRKTKIMRRSLSQRAAGIVLNEHPNVPRREFDRLKAVLHNCVVHGPASQNRDGVADFRAHLAGRVAHVEVINPARGRKLREGFERIEWE

SEQ ID NO: 5281 - protein, 386 aa, unidentified
  source 1..386: note = Planctomycetales bacterium; note = Related to JAIOQE010000901.1
SRTALTRFILGNAGFQAVCEEDPDLSLSGSRHFVPAMTPQNSRAASWPVPPLVALQQLADWLGITPGELAWFGDLNSLQRSVPNGPLCHYGYHWIRKRGGSFRLVESPKARLKQLQRKVLHELVDKIPPHDSTHGFRQGRSICSFVKPHVGKRVILKMDLQDFFPSITRWRVTGIFLYAGYPEEVARLLAGICTNEAPPQVLRSLPACERQRAWQLESLYQIPHLPQGAPTSPGLANLCAYKLDSRLAGLARAAGGTYTRYADDLLFSGDDAFARSVKRFYIHAAAIVLEEDFTINFHKTRIQGQSVRQRAAGLVINSHANIQRDSFDNLKATLHNAARFGPAGQNRGGVADFRAHLGGRIAFVEMVCPPRGEKLRRIFEQIAWEG

SEQ ID NO: 5282 - protein, 451 aa, unidentified
  source 1..451: note = Related to NZ_CP042997.1; note = Aquisphaera giovannonii
MERPPLSSSSFHRLRRYCLILARAFLAGPWERQGLVERGRATVQRKAKWLDSAAKRAMEAFPTCAALREARLADHLAGDPDVLKAATSGRVPLRPQALVDLRPEMRPPPGPSAAWSVPAIATPAELAAFCDVSPVQLEGLADCQGRERRTPREPLRNYRYRAFPKASGGFRIIEAPKPRLRRMQRLLLDEILAKIPAHEAAHGFRPGRSVMSFVERHVGRHVVLKMDLADFFPSITAARVLAIFMTAGYPEDVAKLLAGLCTNAVPMHLERLLGGTPVGDWRSRKLLAGPHLPQGAPTSPALANLAAYRLDLRLDALARSAGAHYTRYADDMVFSGDESFARSAGRFALSVSAIALEEGLAVRNRKTRVMRRGVRQRAAGIVLNERPKIPRDDYDKLKATLHNCLRHGPAGQNRDGHMDFRAHLLGRIAYVARIHPGRGERLMRSFDRITW

SEQ ID NO: 5283 - protein, 441 aa, unidentified
  source 1..441: note = Related to NZ_JAALJH010000014.1; note = Aquisphaera sp.
MSSSRHPHRRFALVLARAFLAGPWEHPELVGRGRTAIGRKGRWLDAVARRLLVAFPSPAALRARWIADHLLADPQFLKAIGKARVPLRAELSPVMRPAPGEPASWLVPAITTPAELAAFCGVTITQLEGLADCQGREKKARREPLRNYRYRVVAKPSGGSRLVESPKPRLKAIQRRLLDEIVARIPPHDAAHGFRPGRSVSSFVAGHAGRHIVLRMDLADFFPSITSARVEAIFMTAGYPEDVARLLAGLCTNVVPRHLEDGDGADRATGWHSRRLLAEPHLPQGAPSSPALANLAAHHLDVRLDALARAAGARYTRYADDLVFSGDDAFARSVRRFSIHVAAITLEEGFAVRHRKTRIMRRGVRQRAAGIMLNVRPNIPREDYDALKAILHNCARHGPEGQNRAGVSDFRAHLLGRIAYVSGIHPQRGARLKRTFDRIAW

SEQ ID NO: 5284 - protein, 449 aa, unidentified
  source 1..449: note = Related to CP003364.1; note = Singulisphaera acidiphila
MGRPPLLSTQNAEFIVRELANAFVEGVWDLDGLVARGEQTLGRRPRWLRHLARRLLAAFNDGRRPPAAQIARFIHNDRGFDRVRERYELTMEWSRRPPPVMSPGPGEPESWPVPAIVTPEDLAERLGLTRSELDWFADSQAREGRGSPEKLRHYHYRWQAKRSGSARLIEAPKPRLKAIQRRLLDEIVAMVPPHDAAHGFRLGRSVRTYVEPHIGRTIVLKMDLRDFFPSISAAWITALFLTAGYPEPVARLLSGFCTNSVPPDIWADPRCPIQGPEHWRLRRLHRQTHLPQGAPTSPAIANLCAYRLDCRLQALATSVEARYTRYADDLAFSGDQRLARAVERFQTQVGAIALEEGFVVQHRKTRAMRQAVRQRVAGVVLNVRPNVPRPDYDRLKATLTNCIKQSPQSQNRDGHADFQAHLRGRIAYVAALNPNRGQRLRALFEQIAW

SEQ ID NO: 5285 - protein, 445 aa, unidentified
  source 1..445: note = Related to JACKIC010000007.1; note = Planctomycetes bacterium
MVLSASSLPLRLARTLLSRPFTWQAVEEALVDARGGPDPGLTRLVTVLLLRLRALRTRARSRAALHELVDYLDNSRRVERLFGEVGPELAELPPPTMLPLPGAPKRWQVPAITTVAQLADWLRVQPDELLALACRWRQDREHRDDRLQHYHRRWLPRRGGPPRLLEAPKARLKAVQRRILTGILNAAPPHRAAHGFVRGRGVGTFAAAHVGAACVLRLDVADFFASVRGARVRGVFLAMGYPIDVAELLACLCTTRTPDRVCHRGLHDFGTVGAVLATRLRARHLPQGAPTSPALANLVAFHLDARLTGLARRFGARYSRYADDLLFSGVGAFVRGANRLAVYVAAVLLQEGFAAAHRKTRRMPQGVAQHAAGLVLNVHGAVPRRERERLEAVLVNCVRHGPASQNRVGRVDFEAHLRGRIAHVEHHHAPHAARLWRWFDRIVWE

SEQ ID NO: 5286 - protein, 439 aa, unidentified
  source 1..439: note = Planctomycetes bacterium; note = Related to JAGQRA010000173.1
MPLSVEQHARDVARTLVARPFTAPAIEAVLVVECGRPDPRLARLAKALALRFGGLRRPRAREVADYLVRRRRYAETAAACEMQLQDLPRRSMLPLPGAPATWKVPAIVTTTELAAFLRVGAEELAAWCRRWRRSPGRPDPRHEHYHCRWLPRHGAPPRLLEVPKTALKRVQRRILTGILQAIPPHPVAHGFVRGRGVATFTAQHTDRDCVLQLDIEDFFGSIQERRVRAVFVAAGYPVDVAAALARLCTTHTPPRVLAELVSNDRARRLATRLAMTHLPQGAPTSPALANLIAFRCDLRLAGLARRFGGGYTRYADDLLFSGGPEFAADARRCATHAAAILETEGFAVAHRKTRVMRRGVAQRAGGLVLNRHGAVPRASRERLEAILTNCVRHGPASQNRAGVVDFAAHLQGRVAHVAHHHPPHGVRLLRLLAQIDWCR

SEQ ID NO: 5287 - protein, 436 aa, unidentified
  source 1..436: note = Related to JAFEGM010000060.1; note = Verrucomicrobia bacterium
MNRPDLAAALVARRIVAGTIEPAAVTEALVETGGLRLRRARPLARQIVRQFGGVLRPRWRDVARLLAGNRMFRRQCRGSAAAGAAAPPTMRPAAGAPQQWPVPPLTTPGELAAWLRLSPEELLFLAARWRERLPSEPRVRHYHYAWHPRRHGPPRLLEVPKARLKWVQRRILRGILDHIPPHAAAHGFRRGCNILSYTSTHTGRACVLRMDVQDFFPSLRRGRIVRIFLTAGYPEPVATLLADLCTTATPAEVLRPLAAPISARAAQLRVALRSRHLPQGAPTSPALANLCAFGVDARLAGLARRFGATFTRYADDLLFSGDAGFARSARRCEVRVGAILLELGLTVAHRKTRVLPRSVCQRAAGLVLNERPGLPRRERDRLKAILTNCVRHGPASQNRANLPDFAAHLRGRVAHALATHPASAARLLALYERIVW

SEQ ID NO: 5288 - protein, 439 aa, unidentified
  source 1..439: note = Planctomycetaceae bacterium; note = Related to JAGQQE010000253.1
MSLLSRDVDSLVDAFVAGEWTEPSMLHRCGVIVDGKPKWLPFLIQRVLKRFPGVRPTRRALTDFLYEDRRLAAASERITTLTNHIRMNSEFDCQLTSLKSSVRPTWTTVRQLADWFDLPVEHLLWFADSSQIGRQHPHGPLCHYHYRWVEKRRSGRRLIESPKPGLRQMQRRLLNECLRHLPVHDAAHGFCKGRSVDTFVQSHTGRQVVLRMDLQNYFPSLRPFRLMRLLMLAGYPEVVARTLSNLCTNTTPSSVLRDYSSISLSNSDRHLTVLLRQPHFPQGAPTSPLIANLLSYRLDARLQGLAQSAGIHYSRYADDLLFSGDERFRRCVKQFRIHVAAIVIAEGLNVNHRKSRIMLQSRQQRATGLVLNQHPAVSRRDFDLLKAILHNCIRFGPQTQNHSGIDNFRMHLLGRIQHMARYHPSRAQKLMHSFEQITF

SEQ ID NO: 5289 - protein, 434 aa, unidentified
  source 1..434: note = Planctomycetaceae bacterium; note = Related to JAGQPY010000402.1
MKVSHLADAMLAGVWVQQEITERVLQVVKTPRRWVPSLVRRTILAFPDHRPLRSVLCQFLMTDDSLRSRACDDEFEVLAYSGNDEFDNHRFDDSARRPVRWQTFGQLAEFLDLEISELSWLADLRGLQRTAPDGPLNHYHRRWQLRRRAVPRLIESPKPRLKSVQRRILQCCLSRLPLHSAAHGFRKGRSVSTFLQHHAGQSCVVRLDLHDFFGFLSPIRLLRLLMMFGYSESVARTITAICSTTTPEHTIERMPQNFVDRRQATTLQRLRSRHFPQGAPTSPAIANLIAWKLDQRLTGLATTFGATYSRYADDLLFSGDEDFRRRAQWFTTCVAAVAMDEGFEVQHRKTRIMTRSVRQQACGLVLNHRPTVSRREYDVLKATLHNAVRFGPESQNRSRHSGFRQHLLGRINYVRQWNPARAVRLMALFDSIRW

SEQ ID NO: 5290 - protein, 431 aa, unidentified
  source 1..431: note = Related to NZ_JAENIJ010000042.1; note = Luteolibacter pohnpeiensis
MPSRIHHARRLATALAAGSMANHDELIHRAAPLMGDIRKARWLKALARNLSLEFAEAPRPTIRKITDRILHDPGFTRAWILGKARIGIGFTQPEMAPAPGIAVAWGVPAITTLAELADLLRLHPDDLGWLTARNSSEHYRYRWQIKPKSGRYRLIESPKELLKGAQRRVLRKILNLIPPHEAAHGFRPGGSIRNFVEPHSGKPMLLRFDLEDFFPSITSTRIFHIFLTAGYPENVAQALTAICTHSTPSQTIGEKPLNSHERSRLTTRHLPQGAPTSPALANLSAYRLDCRLLGLAQSIGATYTRYADDLLFSGDQKFARKSKGLQAMIGGIILEERFSINHRKTRVLRQAQKQHAAGLILNQKPNIDRREIDQLKAILTNCIRFGPESQNRNNHPDFAAHLAGKLSWIRFIQPQKALKLESLFERIDWPA

SEQ ID NO: 5291 - protein, 430 aa, unidentified
  source 1..430: note = Related to NEUO01000019.1; note = Verrucomicrobiae bacterium Tous-C4TDCM
MPSQAQHVRRLAAALAAGPMDDREAMLARVKPLVGDLRKARWLEPLVRNLSLEFGEAPRPAIHHVAGRILGHPPFVKAWIAGQGRILPLPVTPQMAPAMGAPRDWQIPAITNLTELADELRLHGDDLGWLIAHGQADHYRHRWQAKPKSGRFRLIESPKTLLKFAQRQVLRRILDAIPPHEAARGFRPGNSIRDFVEPHTGRELLLRFDLEDFFPSLCAARVLRIFLTAGYPETVARALTRLTTRATPHSTLEEKTLAWAERRRLATPHLPQGAPTSPALANLGAFRLDCRLAGLAEAAGARYTRYADDLLFSGGADFARQSRRFETAVGAIILEEGFRPNHHKTRVLRQGQKQHAAGLVLNDKPNIDRRDFDRLKAVLTNCVRHGPASQNRDHHADFAAHLQGKLAWVRFIHPGKEEKLQGIFDKIDWD

SEQ ID NO: 5292 - protein, 451 aa, unidentified
  source 1..451: note = Related to JAFLEF010000009.1; note = Verrucomicrobia bacterium
MTPTEERWIASLAKMALAGEWEAAALLERGQVWLGSRPRWWLRLVHRLLRQFGPGTRPRLSRVESFLRRDPWLRKVLLKGDLKGDANPPEPVQCAARGRPATWKLPSFTRPVELASWLRVSVGELEWLADAQGWRSGEACERLGHYHYRWLRKRDGSARLIESPKQHLKLIQRGLLDAVVSAIPAHESAHGFQPGRSTLTHVGPHIGREVVLKYDLRDFFTRVTRPRVQAVFRTAGYPEAVAALLAALCTHRTPARIWRQFPGFETDPLIRARARNWQCPHLPQGAPTSPALANLVAYRLDCRLAGLAKAAGASYTRYADDLLFSGGSELARGAERFGIMVGAIALEEGFELNTRKTRVLRRGVAQRAVGLVLNDRINVPRAEYDRLKAILHHCVRQGPAGQNREGVPDFAAHLAGRVAYVTQTNPQRGARLQQWLDQIDWSRSSESAAAT

SEQ ID NO: 5293 - protein, 445 aa, unidentified
  source 1..445: note = Planctomycetes bacterium; note = Related to JAHWKS010000775.1
MQTARDAARTIAQLLLSGPFDEPAVWERLRPLAGRRRWLRFCIRRMLTAWKGTGHPSSAWIIDFLLSDARFQASWPTLRTPEPRMSPAAGAPLQWPVPSLGTPDEVATWLAVSHRELEARADTWGREARTPAGPMRNFDYSWRGKRSGAARLIEAPRPRLRSLQRKVLHGVLDAIPPHDAAHGFRRGRSVATFTAPHVGKQIVVRMDLRDFFASIHRAQIQAIFATAGYPPAVAKLLAALCWNAAPDDIWLDFPGTLPDDLGRLPAARLYRRPHLPQGAPTSPAVANLCAYRLDCRLAGLARSAGAAYTRYADDLLFSGDADFARTARRFTLHVAAIAREEGFAAHPRKTRLMRQGVRQFAAGVVLNERPNVPRRDYERLKAILHRAARIGPSPSAGETLMTYRARLAGKIAWVASISPRRGEKLQAVFEQIDWGRPNVGHSLCE

SEQ ID NO: 5294 - protein, 429 aa, unidentified
  source 1..429: note = Related to JABGQM010000001.1; note = Verrucomicrobia bacterium
MLKARHIESLTRGVAAALLAGPWEWEAMLDRSADALGRRWRWRRGLIRDMLLQHPSPVAYEALVQAIAANPHFRGAINDRTRPHIVHWFPWPTGMAPRYPAWHLPVISSVGALAALLDLPEEKLHWLADCEHRQGRPDELLRRHYRHYWLRKPSGGWRLVEEPHYLLKQAQRGILHGVLDRVPPHPAACAFVHTRSVVDYAAPHVGRELVLHLDLKEFFPSIPASRVHAMLTTLGYPTEVARLVTGLCTSTVPGYICRQRPGGKIYSAPHLPQGAPTSPALANLAAYRLDGRLAGAAASVGACYTRYADDLAFSGDEPFARSVNRFQAMVWRIVAEEGFDIHHRKTRLMHKSVRQRLCGLVVNDHLSIDRRVYDRLKAILTNCLRHGLESQNRDGHSDFRAHLCGRVAFVEQVNPARGARLRDLLKQVA

SEQ ID NO: 5295 - protein, 479 aa, unidentified
  source 1..479: note = Related to CP000442.1; note = Burkholderia ambifaria
MRRKSAGCALRNDCSRSTCHVDSSSRPFLAMHASRFDTARMIAEAMLAGPPERGGMLERIKTVLGAAPSWSHELVDHAIAHFGTHWADVDTDLLASALADTSAFMIAWYGRDRPVVMRIVRRPPVQRLLPARLAGADVPQWPTCGDLARWLGVSAPELDWLSERWRVDARGSGSPLHHYTYTGYDKRRGGCRLIEIPKGRLREAQRRILHGLLDRIPPHDAAHGFRKGRGIVSFAAPHADRDVVVRFDLADFFVSVRAARVHALFVTLGYPAEVARTLTALCTNRVPSARLLEADLRDRFDWTGRQRYRNRHLPQGAPTSPALANLCAFRLDMRLAALARSLDATYTRYADDLAFSGGGALAREAGRLQVRVAAIALEEGFALQLRKTRVMRRGVRQQLAGVVVNRHPNLARDEFDVLKAILTNCIRHGPASQNRAAHPDFRAYLAGRVAHARALNAARGAKLHALFARIAWDGCSFGA

SEQ ID NO: 5296 - protein, 420 aa, unidentified
  source 1..420: note = Related to NZ_CP086299.1; note = Burkholderia ambifaria
MHASRFDTARMIAEAMLAGPPERGGMLERITTVLGAAPSWSHELAEHAIAHFGTHWADVDTDLLASALADTSAFMIAWYGRDRPVVMRIVRRPPVQRPLPARLAGADVPQWPTCGDLARWLGVSAPELDWLSERWRVDARGSDSPLHHYTYTGYDKRRGGCRLIENPKGRLREAQRRILHGLLDRIPPHDAAHGFRKGRGIVSFAAPHADRDVVVRFDLADFFVSVRAARVHALFVTLGYPAEVARTLTALCTNRVPSARLLEADLRDRFDWTGRQRYRNRHLPQGAPTSPALANLCAFRLDMRLAGLARSLDATYTRYADDLAFSGGGALAREAGRQQLAGVVVNRHPNLARDEFDVLKAILTNCIRHGPASQNRAAHPDFRAYLAGRVAHARALNTARGAKLHALFARIAWDGCSFGA

SEQ ID NO: 5297 - protein, 449 aa, unidentified
  source 1..449: note = Related to CABVLY010000011.1; note = Burkholderia anthina
MHASLFDTVRTIAEAMLAGAPERGGVVDRIAAVLGAAPPWAHDVSDDALARFGAQWADVDTDRLAGMLADAPAFLNAWYGPHRPVVIRVVRRPPVQRPLPPRLAGCDVPLWPTCGDLAEWLGVSTAELDWLSDRWRVDARSADTPLHHYTYTGYDKRSGGCRLIEMPKGRLREAQRRILHGLLDRVPPHDAAHGFRKARGIVSFAAPHADRDVVVRFDLADFFVSVRAARVHALFDTLGYPVDVARTLTALCTNRVPSARLLAPDLRDRFDWAARQRYRYRHLPQGAPTSPALANLCAFRFDMRLAALARSLGATYTRYADDLAFSGGDVLARDAERLERRVAAIALDEGFALQLRKTRVMRRGTRQQLAGVVVNRHPNLARDAFDLLKAILTNCIRHGPASQNRAAHTDFRAHLAGRVAHAAALNPARGAKLQALFDRITWDTCSPGA

SEQ ID NO: 5298 - protein, 449 aa, unidentified
  source 1..449: note = Related to CP013399.1; note = Burkholderia seminalis
MHSSLRDTTRTIAEAMLAGSPERDGVVARMAAVLGGAPVWADEVADASLARFGAHWADTAIDALAAVVAEAPGFVRAWYGDPRPAVIRVVRRPPVQRPLPAPLAGCEVPPWATPGDLADWLGVSVPALDWLSDHWRVDARSGATPLHHYTYVAVDKRSGGCRLVEIPKGRLREAQRRILHGLLDRIAPHGAVHGFRKGHGIVSFAAPHAGRDVVVRFDLADFFVSVRAARVHALFATLGYPVEVARTLTGLCTNRVPSARLLAPDLRDRFDWIGRQRYRERHLPQGAPTSPALANLSAFRFDMRLAALARSLDATYTRYADDLAFSGGGALARDIERLQIRVAAIALEEGFALQLRKTRVMRRGARQQLAGVVVNRHPNLARDEFDRLKAILTNCIRHGPASQNRDAHPDFRAHLAGRVAHAAALNAARGAKLRALFDRIAWDAHDAGR

SEQ ID NO: 5299 - protein, 449 aa, unidentified
  source 1..449: note = Related to CP015035.1; note = Burkholderia cenocepacia
MHSSLRDTTRTIAEAMLAGPPERDGVVARMAAVLGEAQPWTPECAGTALARFGANWADTDTDALAALLAEAPAFVRAWSGERRPVVIRIVRRPLVQRPLPAPLAGCDVPQWPTPGDLAGWLGVSAPELDWLSDHWRVDARSGATPLHHYTYVAVDKRSGGCRLVEIPKGRLREAQRRILHGLLDRIAPHGAVHGFRKGHGIVSFATPHADRDVVVRFDLADFFVSVRAARVHALFATLGYPAEVARILTGLCTNRVPSARLLAPDLRDRFDWIGRQRYRERHLPQGAPTSPALANLCAFRLDLRLAALARSVDATYTRYADDLAFSGGGALARDVARLQVRVAAIALEEGFALQLRKTRVMRRGTRQQLAGVVVNRHPNLSRDAFDRLKAILTNCIRRGPASQNRDAHPDFRAHLAGRVAHATALNAARGVKLRALFDRIVWDAGGAGR

SEQ ID NO: 5300 - protein, 449 aa, unidentified
  source 1..449: note = Related to CP011301.1; note = Burkholderia cepacia
MRASLSDTVRTIAEAMLAGLPERGGVASRIAAVLGDAPPWAHELADAAIARFGPNWADADIDALARFVADAPGFVRAWHGDRRPGVMRVVRRAPVQRPLPAPLAASDVPQWPTCGDLAAWLGVSASELEWLSDRWRVDARSSGSPLHHYTYVAYDKRRGGCRLIEIPKGRLREAQRRVLHGLLDRVPPHDAVHGFRKGRGIVSFAAPHADRDVVVRFDLADFFVSVHAARVHALFDTLGYPAEVARTLTALCTNRVPSARLLAPDLRERLDWATRQRYRNRHLPQGAPTSPALANLCAFRFDMRLAALARTLDATYTRYADDLAFSGGAALARNAERLEVKVAAIALDEGFALQLRKTRVMRRGVRQQLAGVVVNRHPNVARDEFDRLKAILTNCIRHGPASQNRDAHPDFRAHLAGRVAHATALNAARGAKLHALFGRIAWDAGGFDT

SEQ ID NO: 5301 - protein, 449 aa, unidentified
  source 1..449: note = Related to NZ_CADFDQ010000020.1; note = Burkholderia pseudomultivorans
MYAPLSDTVHTIAEAMLAGSPEPDGVAARIAAVTGDAPPWARPLADAATVRFGPRWADLDIDTLARFVVDSPGFVRAWYGADRPAVIRIVRRPPVQRPLPLPLAGCDVPHWPTCGDLAGWLGLDAAELDWLADRWRVDARGSETPLHHYTYMACDKRRGGSRLIEIPKGRLREAQRRILHGLLDRVPPHESAHGFRKGRGIVSFAAPHADRDVVIRFDLADFFVSVRAARVHALFDTLGYPAEVARMLTALCTNRVPSARLLAPDLRDRFDWTGRQRYRNRHLPQGAPTSPALANLCAFRFDMRLAALARSLDATYTRYADDLAFSGGATLARAIDRLQVRVAAIAFDEGFALQLRKTRVMRRGARQQLAGVVVNRHPNLARDEFDLLKAILTNCVRHGPASQNRDAHADFRAHLAGRVAHAAALNAARGAKLRALFERIAWGDAEAGT

SEQ ID NO: 5302 - protein, 451 aa, unidentified
  source 1..451: note = Related to JAAGPL010000085.1; note = Burkholderia sp.
MYSSLYDITRTLAEAMLAGPPETDGVAARMAAVLGDAPPWVHAVARDAIERFGNLGKQWAAIEPNDLSLLVASAPGFVAAWHSDARPTIVRIVLRPPQQQPPPPALDAPDLPRLPTLGDLADWLGLSVPELDWLADRWRVAPRSETPLHHYTYRAFDKRGGSCRLVEIPKGHLREAQRRILHGLLDRVPPHHAAHGFRKGRGIVSFAAPHADRDVVIRFDLADFFVSIRAARIHALFRTLGYPLEVARALTALCTNRVPSARLLAPDLRDRLDWSGRQRYRNRHLPQGAPTSPALANLCAFRLDTRLAALAHSLDATYTRYADDLAFSGGAVLARAAERLPARVGAIALEEGFALQWRKTRVMRRGVRQRLAGVVVNRHPNLARDEFDTLKAMLTNCVRHGPASQNRVAHPDFRGYLAGRVAHATMLNDARGAKLQAIFDRIVWDAGDGDA

SEQ ID NO: 5303 - protein, 445 aa, unidentified
  source 1..445: note = Related to NZ_SMRO01000001.1; note = Paraburkholderia flava
MNASLYDLTHTLAEAMLAGPPEPDGVTARIASVLGDSPPWAREVAVNAINSFGPRWADATPRDLSFVIADTSGFVNAWQSDNPPTIARIVLRPPEQRPPPQALAALDLPQWSTTRDLADWLGLAIPEFEWLADRWRVEPRSSGTPLHHYTYRTFDKRDGGCRLIEIPKGHLREAQRRILRGLLDRIPPHEAAHGFRKGRGIVSFAEPHVDCDVVIRFDLADFFVSIDAKKVHALFATLGYPLEVVRALTALCTNRVPSARLLAADLRDRLDWAGRQRYRERHLPQGASTSPALANLCAFRLDTRLAALAHSLDATYTRYADDLAFSGGPVLARVAERLPVRVASIAIEEGFTLQLRKTRVMPRGVRQRIVGVVVNRHPNLARDQFDALKATLTNCVRHGPLSQNRDAHADFRGYLAGRVAHATMLNAARGSKLQAIFDRIVWEGV

SEQ ID NO: 5304 - protein, 464 aa, unidentified
  source 1..464: note = Related to NZ_JACBNX010000003.1; note = Burkholderia guangdongensis
MHSSLYDTTRTIADAMLAGPAEPDGVAARIAAVLGDSPPWVRDVALDAIARFGERWADVEPDELSRLVVGAPGFVEAWRRGGRPTIVRILRQPAVQRPLPPPLAALDLPPLPPLPQLPTSGDLADWLDLTVPELEWLADRWRVAARGSETPLHHYTYRAFDKRDGGCRLIEIPKGRLRDAQSRVLHGLLDRVPPHDAAHGFRRGRGIVSFAAPHADRDVVIRFDLADFFVSVRAARIHALFGTLGYPAEVARTLTALCTNRVPSARLLAPDLRDRFDWSGRQRYRNRHLPQGAPTSPALANLCAFRLDTRLAALARSLDATYTRYADDLAFSGGAGLARAIERLQVRVAAIALEEGFALHMRKTRVMRRSVRQRLAGVVVNRHPNLARDAFDTLKAMLTNSVRHGPASQNRDAHPDFRGYLAGRVAHATMLNATRGIKLRAIFDRIAWDAGDVDTIPDGNGSQP

SEQ ID NO: 5305 - protein, 449 aa, unidentified
  source 1..449: note = Related to CP013414.1; note = Burkholderia ubonensis
MRSSVYDTARTIADAMLAGPPDPGGVAARMAAVLGDAPPWLHDVERDAVARFGARWAAVEADDLTRLVAEAPGFVAAWRSDSPPAIVRILPRPAVQRPLPAALGALDLPQWPTPGELAGWLGIAVPDLDWLADRWRVAARGSETPLHHYTYHAFDKRDGGCRLIEIPKGRLREAQRSILHGLLDRVPPHDAAHGFRKGRGIVSFAAPHADRAVVIRFDLADFFASVSAAKVHALFDTLGYPLEVVRTLTALCTNRVPSARLFAPDLRDRLDWSGRQRYRNRHLPQGAPTSPALANLCAFRLDTRLAALARSLDATYTRYADDLAFSGGAVLTRATEWMTVRVAAIALEEGFALQLRKTRVMRRGVRQRLAGVVVNRHPNLARDEFDTLKAILTNCVRHGPASQNRAAHADFRGYLAGRVAHATMLNAARGMKLQAIFDRIVWDAGDIGA

SEQ ID NO: 5306 - protein, 449 aa, unidentified
  source 1..449: note = Related to VWWJ01000001.1; note = Burkholderia sp.
MQPGFRNTLVIVCDAMLAGAPEVAGVVTRLTATFGLYGAWMEEVAQQAVDAFGSRWDATRVDELTPLLENAPAIVAAFSSQASPEIIRIIRRAPAQRPPPPQLAHIGLPHLPTLRDLAEWLELNDSDLAWLATRWRVDPGEASSPLHHYSYHAREKRDGRHRLIERPKSLMRFVQHKLLHGLLDHVPPHDAAHGFRQGRNIVSFAAPHADKSLVIRLDLADFFASITQARVHATFHALGYPLAVSRALTALSTNRVPVRVLSCGALKDKFDWTEQQRLRARHLPQGASTSPALANLCAFRLDTRLAALARSLDADYTRYADDLAFSGAARLERVADRLPLWVAAIALEEGFTVQPRKTRVMARGVRQQLAGVVVNRHPNLARDRFDALKALLTNCVRHGPVSQNRDGRADFRASLAGHVAHATMLNPARGAKLRAIFDRIDWNRLESAS

SEQ ID NO: 5307 - protein, 445 aa, unidentified
  source 1..445: note = Related to NZ_CP046915.1; note = Paraburkholderia acidisoli
MRLNFRDTLVAACDALLAGPPELAGMVARLVSVFGTYRAWMDDVAREAAHGFAPRWDAIPAHELARSLEQLPVFATVFGNASRPEVVRIVRRAPVQRPLPPGLEQVSLPRLATLRDLAEWLEVAGGDLAWLATRWRVEPGEAASPLHHYSYHAREKRDGRNRLIERPKPLLRFVQHKLLHDLLDRVPPHDAAHGFRRGRSIVSFAAPHADQPLVIRLDLADFFASITQGRVHAVFHALGYPVAVARALTALSTNRVPSRMLTSGALKDKFDWTEQRRLRARHLPQGASTSPALANLCAWRLDTRLAALAQSLDANYTRYADDLAFSGAARFQRVADRLPLWVAAIALEEGFSVQPRKTRVMAQGVRQQLAGVVVNRHPNLARDRFDALKALLTNCVRHGPASQNRDGRADFRAALAGHVAHAAMLNPSRGAKLQGIFDRIDWSQS

SEQ ID NO: 5308 - protein, 449 aa, unidentified
  source 1..449: note = Related to LMPF01000021.1; note = Burkholderia sp.
MRLNFHDTLVITCEAMLAGPPEVASIVARLMLIFGEHSPWMDDVARKAADLFTPRWNDTPIDELIRVVEDTPTFVAAFGTHIRPEAIRIIRRPPVQRLPPRRLAHVDLPHLPTLRDLADWLELDGSDMSWLATRWRVEPGEAVSPLHHYSYHAREKRDGRYRLIERPKALIRFAQHKILRELLDRVPPHDAVHGFRRGRNIVSFAGPHADKALVIRFDLTDFFASVTQARVHGMFRTLGYPIAVASALTALATNRVPSRLFTLGELKGKFDWDAQQRLRARHLPQGASTSPALANLCAFRLDTRLAALAHSVDAVYTRYADDLAFSGEASLKRGADRFSARVAAIAREEGFNLHFGKTRVMGRGVQQRLAGVVVNRHPNLARDRFDMLKAILTNCVQHGPASQNRAGRADFRASLAGQVAHAMMLNSSRGAKLRAIFDRINWSQGNSAG

SEQ ID NO: 5309 - protein, 445 aa, unidentified
  source 1..445: note = Related to JAAGPF010000151.1; note = Burkholderia sp.
MRPGTPKTIALLCEAMLAGEPEPAAVAARLVLACNRHERWMEALAQLAVERFARVWRDTEPDELASLFALAAPFPPGWSARDLPAIARIVRRAPEQQLPPPRLVHLDLPSLPTLRALADWLELSDEDLAWLATRWRVAPHEAASPLHHYRYHVREKPDGRHRLIEQPKPLLRMAQHTLLHGLLDRVPPHEAAHGFRRGRNIVSFAAPHAGQPLVIRLDFEDFFGSVTEARVHGLFRTLGYPVAVAQALSALATHRVPSRLFDVGDLKGKFDWHAQQRLRARHLPQGAATSPALANLCAFRLDVRLAALARGFGASYTRYADDLAFSGGDKLKSVARDWPLWVARIAREEGFAVRSQKTRVLRNNMRQQLAGVVVNRHPNLSRERFDLLKAMLTNCVRHGPASQNRDGRADFRASLAGHVAHATMLNAARGAKLKAIFDRIDWTRG

SEQ ID NO: 5310 - protein, 455 aa, unidentified
  source 1..455: note = Related to NZ_MTZV01000006.1; note = Paraburkholderia acidicola
MQLSLHQTVIAIAEAMLAGEPYRDSVAARAASILGAQLPWLSEAADDAVHRFGHRWDDTQPDEVAPFIADLPGFVSSWMSEERLSVIRILRRAPVQRRLPPPLAQIEIPQLPALGDLADWLELSPADLGWLANRWRVGARDGPSPLHHYSYRVCEKRGGRYRLIERPKSLLRAAQHKLLHGLLDRVPPHEAAHGFRKGRNIVSFAAPHVGQPLVIRLDLADFFVSVTEARVHSVFRTLGYTSAVARAMTAMVTNRVPSAQLLAPDLKGKFDWLEQQRFRTRHLPQGASTSPALANLCAFRLDTRLAALARSLNANYTRYADDLAFSGGAQLMSVADRLPVKVAAIAIEEGFSVQPRKTRVMPRGVRQQLAGIVVNQHPNFSRDKFDTLKATLNNCVKHGVASQNRSAHRDFRASLAGHIAHVTMLNSARGAKLKAIFDCIDWSEPVGDEHGTSAL

SEQ ID NO: 5311 - protein, 489 aa, unidentified
  source 1..489: note = Related to NZ_CADFGU010000011.1; note = Robbsia andropogonis
MSHCTARAPLRTAQARSRHTGTLIRGSSFTMQLDLSAAVQLIAEAALAGPSKHASVVERIVAVVGADPPWCHDVATLAVQRFAYCWREASPEDLALLIVDVPAFAAAWSGVDRPTFVRVLKRVPTQVAPPVSLAHISIPLLPTLADLADWLELRSTDLEWLADRWRVEGHARRLHHYGYHACEKRDGRYRLIERPKPLLRSAQHKILHQILDHIPVHAAAHGFCKRRNIVSFAAPHAGQAMVLSFDLQDFFSSVTAGRVHAIFRTLGYPFAVARAITALTTNRVPSAYFDAPPLRGKFTWHERERLRARHLPQGAATSPALANLCAFRLDMRLSALARALGARYTRYADDLAFSGGSVLARASERLSIQVAAIALEEGFEVHSRKTHGMPRGVRQQLAGVVINRHPNLARDCYDRCKAVLHNCALHGPASQNREAHGDFRAHLMGKVAHATMLNPRRGAKLKVLFDRIIWPEDAPARPPDDGTVHAMPQ

SEQ ID NO: 5312 - protein, 490 aa, unidentified
  source 1..490: note = Related to FNCJ01000001.1; note = Paraburkholderia phenazinium
MISAVRRMSPLCVLRKTAHAALDALTRRPASFHAMRLSPLQRITYAIADAMLAGPAEPDSMVERMSDSLGVPSDWMLGLARRVAKRFGARWDSVDSKEVALVVAKTAGFVAAWRSEARPFVVRVLRRPPVQQLPPPRLREIALPKLATLGDLAAWLEVEVAELDWFADRWRVLPQGADTPLHHYTYKAIEKRDGRCRLIEIPKSRLRSLQRKILHGLLDRVPPHDCVHGFRKGRNTVTYAAPHAGKAVVVRFDLADFFASVHAPRVHAVMRTLGYPLEVARMLTALCTNRVPSARLLAADVRGKFDWLERQRYRTRHLPQGAPTSPALANLCAYRLDLRLEGLARAVGATYTRYADDLAFSGDEDLARVVERLKVRVAAIALEEGFSIQLRKTRVMRRGVRQHLAGVVVNQHPNLARSEFDALKAILMNCVRHGAASQNREGHADFRAHLQGRVAQAVMLNAARGAKLKGIFERIGWEDIANDSRLDSEA

SEQ ID NO: 5313 - protein, 451 aa, unidentified
  source 1..451: note = Related to QVQV01000003.1; note = Paraburkholderia sp.
MRLSSLQHVTFAIADAMLAGPPEPDALVARMTAALGVRADWMTGIARTTSRRFAARWEHVKRDELLRMIAATESFQLAWHNEHQRPVVVRVLKRAPQQVAPPPRLAHVALPQLPTLGDLAAWLEVDDADLGWFADQWRVMPQASSTPLHHYSYKAIEKRDGRCRLIEMPKSRLRDLQRKILKGLLEHVPPHECAHGFRKGRNTASYATPHLGKDVVVRFDLADFFASVHAGRVHALMRTLGYPLEVARALTAICTNRVPSARLLADDVRERFDWQEKQRYRTRHLPQGAPTSPALANLCAYRLDLRLAGLARTMCTSYTRYADDLAFSGGRELARGVERLAVRVAAIAMEEGFSIQLRKTRVMRRAARQRLAGVVVNQRPNLARDEFDALKATLTNCVRYGVEGQNRDGHRDFRAHLEGKVAQVCFLNPGRGEKLRGILRQIQWDVSGAHE

SEQ ID NO: 5314 - protein, 455 aa, unidentified
  source 1..455: note = Related to NZ_SNVI01000001.1; note = Paraburkholderia dipogonis
MPLSSLQHVTYAIADAMLAGSPEPASMVERMTLVLGESTRWMDGLARHVAKRFAARWDSVGRREVSAVVAGMPGFVSAWRSEQPPKVLRVLTRPPFQRPPPPWLHDVALPQLPTLGDLAAWLNIEPGDLDWFADRWRVPAHSAATPLHHYAYKAIEKRDGRCRIIEIPKPRLRALQRKVLSGLLDRIPAHESVHGFRHGRNIVTFAAPHVGRAVVMRFDLTDFFASVHAGRVYSAFYAFGYPLAVAMALTALCTNRIPSGRLLATDVRERLQWQERQRYRNRHLPQGAPTSPTLANLCAFRLDLRLAGLARSVGATYTRYADDLAFSGDEELARMADRLCIRVAAIALEEGFGVNLRKTRVMRRGVRQHLAGVVVNSHANVARPEFDALKAMLTNCVRHGPRSQNRDDHPEFRAHLAGRVAHVGMVNAARGAKLRALLESIEWDEESEAKAESNA

SEQ ID NO: 5315 - protein, 370 aa, unidentified
  source 1..370: note = Related to FNTG01000001.1; note = Burkholderia sp.
MAALPSFRPPFQRPPPLWLREVALPQLPTLGDLAARLGIEPDELHWFAARWRVPAHSAATPLHHYSYKAIEKRDGRCRIIEIPKPRQRALQLKVLSGLLDRIPAHESAHGFRRGRNIVTFTVPHVGKAVVMRFDLTDFFASVHAGRVYSDFHSFGFSPAVAQVFTALCTKRVPSGRLLAADVRERLPWQERQRYRNRHLPQGAPTSPALANLCAFRFDRRLAGLARSVGATYTRYADDLAFSGDENVARMVERLSVRVAAIAIEEGFSVNLRKTRVMRRGARQHLAGVVVNWHANVGRTEFDALKAVLSNCVRHGLRSQNRDGHRDFRAHLAGRVAHVAMVNAARGAKLRALLERIEWDEESEAKAKSNV

SEQ ID NO: 5316 - protein, 453 aa, unidentified
  source 1..453: note = Related to NZ_QLTK01000012.1; note = Paraburkholderia bryophila
MPSSYLQYVANAIADAMLAGPAQPASIVERMVLALGAPADWMSGLARRVSRRFGKRWDSVGRHELSRVIADHAAFVSAWQSDNRPRVVRLLTRPPVQRQVPPWLHGITLPQLPALADLADWLEVEPTELDWFADRWRAPAHAAATPLHHYSYKAIEKRDGRCRIIEIPKSRLRTVQRKVLHGLLDRIPVHDAAHGFRRGRNTLSFATPHAAKAVVVRFDLTDFFASVNAGRVYSTFRDFGYPLAVARSLTALCTNRVPSGRLLEADVRERIDWLERQRYRNRHLPQGAPTSPALANLCAYRLDLRLAGLARSVGATYTRYADDLAFSGDEDLARIAERLSIRVGAIAIEEGFALNFRKTRVMRRGARQHLAGVVVNRHPNLARPMFDTLKAILTNCVRHGPESQNREAHPDFRAHLAGRVAHLAMLNARRGAKLEAIFERIGWEGGEGSGTTV

SEQ ID NO: 5317 - protein, 449 aa, unidentified
  source 1..449: note = Related to NZ_CP024941.1; note = Paraburkholderia terricola
MPQSSLQVVTYAIADAMLAGPADPATMVERMTRVLGESADWMTGLARRVERRFGARWDSVEAKHLSKIIAETAGFVAAWRSENRPRIVRVLTRPPVQRPAPRWLRDVTLPQLPTLGDLAAWLDVEPLELDWFADRWRVAAHDATTRLHHYSYKAIEKRDGRCRIIEIPKSRLRELQRKVLHGLLDRIPAHDAVHGFRRGRNTVTFAAPHAGKAVVFRFDLTDFFASVHAGRVYSAIHALGYPLEVARALTALCTNRVPSGRLLAPDVRDRIDWQERQRYRNRHLPQGAPTSPALANLCAFRLDLRLAGLARSVGASYTRYADDLAFSGGNDLSRMTERLSIRVAAIAIEEGFAVNMRKTRVMRHAVRQHLAGVVVNSHPNLERPAFDALKALLTNCVRHGPRSQNRDAHTDFRAHLAGRVAHVTMLNAARGEKLKGIFERIGWDERDQS

SEQ ID NO: 5318 - protein, 430 aa, unidentified
  source 1..430: note = Related to CP010026.1; note = Paraburkholderia fungorum
MLAGPPEAAAMVERMTLVLGERADWMNGLARGIAKRFGARWDSVDGKELSKVVAENTGFVAAWRGESRPRVVRVLPRPPVQRPPPPWLHGVALPQLPTLGDLAMWLEVEPDELDWFADRWRVPAQSAATPLHHYSYKAIEKRDGRCRIIEVPKSRLRALQRKVLHGLLDRVPAHDAVHGFRRGRNTVTFAAPHAGKAVVIRFDLMDFFASVHAGRVYSVIRALGYPLNVARALTGLCTNRVPSGWLVAPDVRDRIDWQERQRYQNRHLPQGAPTSPALANLCAFRLDLRLAGLARSLGATYTRYADDLAFSGGEDLARMAQRVEIRVAAIAIEEGFAVNLRKTRVMRRGGRQQLAGVVVNSHPNLARAEFDALKAVLTNCVRHGPGSQNREGHEDFRAHLAGRVAHAGMLNAVRGAKLKAIFGRIVWDDG

SEQ ID NO: 5319 - protein, 447 aa, unidentified
  source 1..447: note = Related to NZ_CAJHCR010000004.1; note = Paraburkholderia kirstenboschensis
MSLSTLQTVTNAIANAMLAGPPEPAAIVERMTCALGEPADWMKGLASRVAQRFAARWDSVDPSAISKVVAETTGFVSAWRSETPPRVVRTLIRPPSQRPAPPWLQDAVLPQLATLAELAAWLEVEPDELDWFADHWRVPAQQAATPLHHYSYMVADKRDGRCRIIEIPKSRLRGLQRKVLRGLLDKIPPHDAVHGFRRGRSTVSFAAPHVGKAVVIRFDLTDFFASIHAGRVYSVWRSLGFPKGVARSLTGLCTNRVPSGRLLAPDLREKTDWQERQRYRNRHLPQGAPTSPALANLCAYRMDMRLAGLARSVGASYTRYADDLAFSGGDDLARMATRLSIRVAAIAIEEGFAVNLRKTRVMQRGARQQLASVVVNQHVNVARSEFDALKAVLTNCAKLGVESQNRDGHPDFRSHLAGRLAHVEMVNAARGAKLRRIFGRIVWGRSG

SEQ ID NO: 5320 - protein, 434 aa, unidentified
  source 1..434: note = Related to nan
MNSAFVAENLAAALLLGEWTGRGLLDSALRVVRYREPWLHRFLRRLRRAFPEPPARQEFRALVDWISNDRGFLNRSLDGVFEFVSLTPAMSQSRWPVPQLATVGTLAQWLELTPRELDWFADGQGREAVQPRGPLRHYVYKAIPKRGGRLRLIESPKSRLKAIQRRILDQILSVIPAHDAAHGFCRGRSVVTYAAAHANKDVVLRLDLADFFPSVPASRVHAIFCTAGYPKDVARMLTGICTNVTPRDELPESFGADNRGWTLLQRLLSPHLPQGAPTSPALANLSAYRLDLRLSALAQASGIAFTRYADDLAFSGDEEFARGVLRFYEKACQIVIEEGFAVRPAKTRIMRRGVRQQLAGVVVNVRPNAPRGEYDRLKAILTNCSRHGVGSQNREKHPSFREHLLGRITWLTSLHPERGKKLRARFDRIDWNGG

SEQ ID NO: 5321 - protein, 509 aa, unidentified
  source 1..509: note = Related to NZ_JAGKQQ010000001.1; note = Gemmata sp.
MVRENRVRHRSGVTPETFYHLGLQARDSPGASTPPMSRGTGLVDPLAALTFTDEMSTQQRFVRNLAAGMLAGEWTAAGLRESAYRATGHTFAWAPALAKRVLETHSTAPPFPTLLAVLTADAGFQRAFAALASDRNADDRFPVWHLFPVPTPPPLPRPEWAKELPDLPNEPALAEWLGVPLERLLWLADPKGRNTGHRPGSVRTYRARWVPKTHSRARLLEVPIPALMRAQRKVLVGLLNSVPSHPAVHGFRVGRSAITNAAPHCGRAVVIRFDLADFFPSIPAGRVFRMFLTLGYPETVARLLGSLCTTRLPTKDWNARPNPRTDSAEYQTRIRLATRHLPQGAPTSPALANLAAHRLDRRLAGLASACGATYSRYADDLTFSGGEDVRRSASRLARRVALIAAEEGFTLNRGKTRMQGRSERQTVTGAVVNVRPNIPRADFDLLKAILTNCVRHGPATQNRASHPDFRAHLAGRIAHLASVNPVRGRKLWATFDRIAWDADSTQSGQ

SEQ ID NO: 5322 - protein, 453 aa, unidentified
  source 1..453: note = Related to NZ_LR593886.1; note = Gemmata sp.
MTTQQRFVQNLAAGMLAGEWTAAGIRESVYRATGRRFAWGPALAKRLLNAHATAPTFPTLLATLTADAGFQRGLTVLASARNADNRFPVWHLFSAPAPPPLPRPQWAAELPDLPNEPALAEWLGVSLERLLWLADTKSRNTGHRPGSVRTYRARWVPKTHGRARLLEVPIPALMRAQRKILAELLNLVPAHPAVHGFRPGHSAITNAAQHCGRACVIRFDLTDFFPSIPVGRIFRMFLTLGYSEPVARLFGCLCTTRLPAEDWNRRPNPRNDSSEYQTQTRLASRHVPQGAPTSPALANLTAYRLDCRLAGLASACGATYSRYADDLTFSGDDTLRRSAARLARRVALIVVEEGFALNRGKTRVQGRGERQLVTGVVVNVRPNIPREDFDQLKAILTNCVRHNPATQNRTNHPDFRAHLAGRIAHVASVNPTRGRKLWATFDRIVWDTNSAQS

SEQ ID NO: 5323 - protein, 452 aa, unidentified
  source 1..452: note = Related to CP025958.1; note = Gemmata obscuriglobus
MTANRFVSNLAAALLAGEWSVAGLRTSVYRATGKRFGWTPRFAKRVHTAHATPPTFNELLAFLGRDPGFVRALAALATARYPADRFPVWHIFAPPEPPPRPRPDWASGLPVLPNEPALAEWLGVPVGHLLWLADPAGRNAISKGVRSYRVRWVPKPKGRARLLEIPVPPLKRVQRKLLADLLNHVPPHPAVHGFRPGRSIVTNATPHCGHAIVIRFDLTDFFASVPVGRVLALFLALGYRESVARLLSGLCTTRLASNDWNERPNPLNDGSEHATRARLTSRHLPQGAPTSPALANLVALRLDRRLAGLAAACGATYTRYADDLTFSGGELLRRNAARFVRRVTLIAAEEGFALNRGKTRVMGGGGRQTVTGVVVNQRPNVPRAEFDRLKAILTNCVRHGPADQNRSGHPDFRSHLAGRVAYVAGVNPVRGRKLWALFDRITWPGAHTYPAS

SEQ ID NO: 5324 - protein, 460 aa, unidentified
  source 1..460: note = Planctomycetes bacterium; note = Related to VGZJ01000033.1
MDPQQRFVRNIAAGMLAGEWSRAGLRDAIRRATGREYRWASPLVTRLLAAHIEPPSSIALLDVLVRDTTFAGVLARLAGARTAGDRYPRRTLFAVPGEAIPPAPTWNADLPRWDTEHDCADALGVALPQLLWLADPTGRNPYRRDETLRTYRARWVLKPRGGARLLEVPKPLLRRTQRRLVDLLLNRVAPHPAAHGFRAGRSAVTNAAEHCGRAAVLRFDLTDFFSSIVAGRTFGLFRNLGYPEPVVRLLGALCTTRLPRAVWDVRPHPTADGSDYPAWVRVNTRHLPQGAPTSPALANLIAYRLDRRLARLAAACGATYTRYADDLTFSGGPGLLRAARGLARRVALIAAEEGFRVNRGKSRAYGRGTRQTVTGIVTNVRPNVTRAEFDLLKAILTNCTRHGPAGQNRAQVPDFRAHLAGRVAHVAGVNSVRGRKLWELFDRIVWPVDESSSMIDLKDS

SEQ ID NO: 5325 - protein, 442 aa, unidentified
  source 1..442: note = Related to PNKH01000003.1; note = Isosphaera sp.
MPTFDAERFLFSLAGGLRAGAWADADLRAALRGAASDRPVRAPGLVPRLLRRFHGTPGYGELLLFLVNDPGLARAVDRLTWSRPQPGPAKPAMGQPPPRLGTLAIPALATEAALGTWLGVGPDRLRWLADLTGRNRRHPPGPLRTYRHRWVPKADGRARLLEIPRPGLKLVQRKILADLLDAVPAHPAAHGFRPGRSAVTNAAEHCGRAVVVRLDLADFFPSVPAARVSRIFRTLGYPDPVARLLTGLCTTRVPADVWDTRPNPGPADHPARVRFAGRHLPQGAPTSPALANLAAHRLDRRLARLATAVGATYTRYADDLAFSGGNAVRRGAARLARLVAVVAREEGFAVNPGKTRVMTRAGRQTVTGVVVNARPNLPRAEFDRLKATLTNCVRHGPGGQNRGGHADFRAHLAGRVAHLAAVHPGRGRKVWALFDRIAWPAG

SEQ ID NO: 5326 - protein, 443 aa, unidentified
  source 1..443: note = unidentified bacterium; note = Related to JAFKFQ010000274.1
MLDRTRFLFALAGACLREPWTATGLRAALDRAAAGHRVHVPGLAARILGHFPEPPGYGALLAFLVADARLMRALNRPTGRAIPKRGRPAMDSPPPSLAAVQLPPLATEVALAAHLNLDPARLRWYADLTGRNRHHPPGPLRTYRHRWVAKPGGRARLLEVPTFSLKRIQRTILTDILNHVPPHPAAHGFRPGRSAVTNAIEHCGRSVVMKFDLADFFPSVAAARVVRLFRTLGYPEAVARLLAGLCTTRTPADVWKARPNPAADGSDHVSRLRLVARHLPQGAPTSPALANLAAHRLDRRLAGLATAIGATYTRYADDLTFSGDIDLARRSHRLAGLVAEVASEEGFALNARKTRVLRRGGRQTVTGVVVNAKPNLPRAAYDRLKATLTNCVRKGTASQNRENRADFRAHLAGRVAHAAAINPARGRKLWALFDAIAWAEPPP

SEQ ID NO: 5327 - protein, 461 aa, unidentified
  source 1..461: note = Related to JAIEQN010000341.1; note = Gemmataceae bacterium
MAQSARGRFVANLAAALVAGRWDRRVMRAAAAAAVGGKPGWLAPLVRRVHAAYPEKPQFDPVRAFLERDPTLGRVIDRDGPPAVVRVFVPPAEMLPPPTAAGLVELPQLPTEAALAEWLGITPARLLWLADASGRNRKHPPGPLRTYHHRWVPKPGGRARLLEVPVHLLKEVQRDLLERLLDRIPPHPAAHGFRPGRSVVTNARPHCGRSVVIRFDLQDFFPSVSAARVRAIFRTFGYPEAVARLLTGLCTTRLPADVWDARPNPAADGSDHPAWQRLAARHLPQGAPTSPALANLAAFKHDRRLSKLAAALGADYTRYADDLTFSGSVELARGAKRLATLVAVIAGQEGFAVNHRKTRVMRRAGRQEVAGVVVNARPNVRRAEYDEIKAILTNCVRHGPAGQNRANHPDFRAHLTGRVAHLAAVHPAHGRKLWALLVRIEWRAAKVAGGEQAETATDNNR

SEQ ID NO: 5328 - protein, 450 aa, unidentified
  source 1..450: note = Gemmataceae bacterium; note = Related to JAIEQO010001050.1
MAKTARGRFLDNLAAALVAGRWDRRVMRAAAVAAVGGKPRWLAPLIRRVHAAFIDKPHFGRVRAALEQDEQLIRAVAADGPPPVVRVFVPPAEMLPPPAAAGPVELPQLPTEAAVAEWFSTDPGKLLWYADPAGRNRQHPPGFLRTYRHKWAAKPGGRSRLIEMPTESLKRHQRWLLISILNRIPPHPAAHGFRTGRSVATNAGPHCGKAVVIRFDLADFFPSVSAARVRAIFRTFGYPEVVARLLTGLCTTRLPADVWNARPNPAPDGSDHATWQRLNARHLPQGAPTSPALANLVAFKLDCRLSKLAAALGADYTRYADDLTFSGGDELARGSKRLATLVAVIAAEEGFALNHRKTRVMRRAGRQEVAGVVVNTRPNVRRAEYDTIKAILTNCVRHGPAGQNRGNHPDFRAHLTGRVAHVAAVNPARGRKLWAILDRVTWEAHEPAAR

SEQ ID NO: 5329 - protein, 439 aa, unidentified
  source 1..439: note = Related to CP042425.1; note = Limnoglobus roseus
MLDTTLANLLDAFLAGSWTEDRLVARAKAALGRSHRFIRPFVRRVLAAFPAPTHSDRLRVFALADEEFRKGWRRAEPHTAKRFFPVPVMAPHQAARGWLIPEITTAEKVCEVLRIDRHQLDWLADCAGRNHRESSPKLHHYRYRWIPKPSGRSRVLEIPKPILKQVQRNVLGQILDAIPPHAAAHGFRIGRSILTNAVPHSGRAVVLRFDLAIFFSSISADAVTAIFRTAGYPPDVARQLTGLCTTRLPKAVWDQRPRPAADGSDSLEERHLRNRHLPQGAPTSPALANLVAFRLDRRLDGLAKSLDVTYTRYADDLAFSGGIDLTRRSEKFRNAVARIVSEEGFRLNPLKTRVMPQSVRQTVAGVVVNIRTSIPRAEFDRLKAVLTNCLRHGPESQNREAHPNFRAYLAGKLAHVARLNPTRGRKLLALFDQIRWQSA

SEQ ID NO: 5330 - protein, 447 aa, unidentified
  source 1..447: note = Planctomycetes bacterium; note = Related to JAFATI010001257.1
MSTRHSIARNLAAAFLTGTWSLDGLVQQGARACGKRERWLRPLARCVLAAFPGPPAGIDPEALARWMEENPVFRTAWAKYGREGRFPLGQVFWVPPRMTPRTGAPATWRVPPLTTSGALAEWLGLKPKELDWFADCHGGEEKLPPGPLRHYTYRWLVGRSRKLRLLEMPKQRLKALQRRVLHDLLDHLPCHEAAHGYRRGRSVATYVGPHTGRRIVLHLDLRDFFPSIRSSRVQALFRTVGYPFPVARLLTGLCTNVVPGEVWHSSPVRGEPGEWNRSPHYQVPHLPQGAPTSPALANLCAYRLDCRLTGLARAVGAAYTRYADDLAFSGGRDLERSTRGFQVQVARIALEEGFEVHTRKTRFMRQGVRQQLAGVVLNEHANLRREEYDRLKAILFNCVRHGPGLQNREGRPDFRESLAGRIAYVQMLNPSRGRRLRELFDRIAWEK

SEQ ID NO: 5331 - protein, 422 aa, unidentified
  source 1..422: note = Planctomycetes bacterium; note = Related to JACPPF010000025.1
MATFHVDPDFVEQLAATLRAGNWVRLALKSRVWFTFPDDRALTAKVVGQVWEHFGGSRPSLKQLTKFLKKAISALPHEPEQRAVPVEPAPMTARWPVPVLATPVQLAHWLNVPLTRLEWLADIKEWTLRQADAKLRHYVNVWVPRRRGKPRLLEAPKPHLKAIQRRILHEILDHIPPHDTAHGFRTGRSIVSYARPHVGKQMVLHFDLRDFFASVSAARVRAIFRTAGYPADVASLLTGLCTTRTPDDVTVAGIHWRRRHLPQGAPTSPAFANLAARRMDVRLSALAEKLGATYTRYADDLAISGGHDLERAVRRVNVLVGIIAGEEGFELNFRKTRFMRQSVCQQVAGVVVNVKTNCRREDFDRLKAILHNCARHGPACQNRERHPDFRRHLLGRVAHLRHLNPARGARLQALFEHIDWTR

SEQ ID NO: 5332 - protein, 456 aa, unidentified
  source 1..456: note = Related to NZ_CP011125.1; note = Sandaracinus amylolyticus
MTEWTFDADDLDEDEEDADPPPGPAELRLARALALAFLGTDGRRRAMIEAALATLHVPDEARARAWIGALVALVRRTFDPLRRASLDELTTTIAHGRALARRDRGVHVVRWVATPGEMRAPRWDVPRIDTVGDLARWLDVEIGELDWLADRRAMLVRARVGPLHHYVRTWVPKPSGGARLIEAPKARLAAIQRRVLREVLERVPMHDVAHGFRRGRSVATFVAPHVGRAVVVRVDLEDFFASVTRGRVIGIFRSAGYPEEIARTLAALCTTRTPASEMRGIEHAVRARLRVPHLPQGAPTSPALASLAAFRLDARIEGLARAVGARCTRYADDVALSFERDRSHGAIDRVIARIAEIAREEGFGVASHKTRVMRRGARQSLAGVVVNERPAVAREEYERLRAILHRAATRGPSPDELGAHRDLRAHLAGRIAWIAQWSERRGAKLAAMLARIDWSA

SEQ ID NO: 5333 - protein, 455 aa, unidentified
  source 1..455: note = Related to NZ_CP070225.1; note = Sandaracinus amylolyticus
MTDSTFDDWEDDDDDPEDLPPGRRAWRLSRALALAFLGTDGSRRAMIDAALAALRVPHEARARAWLGGLVALVRRTFDPLPRASLDELTTTIAHSRALARYDRDAEIVRWVVTPGAPLETRWDVPRIDTVGDLARWLEVEIGELDWLADRRAMLVRAPLGPLHHYLRTWVPKPSGGARLIEAPKSRLASIQRRVLREIVERIPMHDVAHGFRRGRSVATFVAPHVGRAVVVRVDLEDFFASVTRGRVIGIFRSAGYPEEVARTLAASCTTRTPSREMRGIEHAVRARLRVPHLPQGAPTSPALASLAAFRLDARVEGLARAIDARCTRYADDIALSFERPQSHVAIDRVIARIAEIAREEGFRVAPHKTRVMRHGARQSLAGVVVNEKPAVPREEYERLRAILHRAAIEGPRAEDLAAHRDLRAHLEGRIAWIGQWSEHRRAKLAAMLARIEWTP

SEQ ID NO: 5334 - protein, 430 aa, unidentified
  source 1..430: note = Deltaproteobacteria bacterium; note = Related to JACPFM010000079.1
MTRADLAARAIADALLDGEWALEPMVQRLGTTFGARRAWMTKLARRALSLFPRAPADARDLLARTARTLPGFPAACRARVRHWAIPEPRMGRVRWPVPTIETAADLSAWLGVDAAALAVLADRRGLARDADPKMRHYTYEWIAKRTGGRRLLEAPKQRLKAVQRRILHGVLDAIPAHDAAHGFRAGRSVVSFARVHVGAALVLRVDLEAFFHSVFAGRVYGIFRGAGYPEDVARTLTALCTHRSPRDVLAGAPRDLVGDRPRSLQRLRTPHLPQGAPTSPALANLAAFALDVRLDALARSWGARYSRYADDLVFSGRVAQPQRLVAAIDHIVRDEGFLIARHKTRLLRASTRQEIAGVVVNQKTSVRRDEVDRLRAILHNCARTGPAAQNRDGHPDFRAHLLGRVAWVEQVSPDKARRLRALFDHLRWDT

SEQ ID NO: 5335 - protein, 440 aa, unidentified
  source 1..440: note = Related to JABFXX010000467.1; note = Kofleriaceae bacterium
MTWLVREFAGALLAGPWERRPMIARLAYVTNLPEAGWIVKLVAAVLRKHGEPPDHEALTDWLYSHRPLQRVLVDPEIRIRRWLEPPLEMADSPWDVPPLGSRKELATWLGLDVQRLEALADERGRVREAREQRMRHYRYTWIAKRAGGHRLLEAPKPRLRAVQRLVLDDIVAKVPPHDAAHGFRAGHSVVGFAAVHVGREVVIRVDLHAFFASVSRPRVAAIFRSAGYPREIAGVLAALCTHRTPRDVLAAAPSREWSELAKLRGAHLPQGAPTSGALANLAAYRLDVRVAALAAAIGASYTRYADDLVLSGPRALARAASSIVGRIGAIAHDEGFALNFRKTRVMTASDRQRITGLVVNEKLAVTRDEVDRLRAILFNCARTGPAAQNREGHADFRAHLLGRISWVSAVDRGKGDRLRALFDRIRWDEAPADATDEDVR

SEQ ID NO: 5336 - protein, 410 aa, unidentified
  source 1..410: note = Myxococcales bacterium; note = Related to JADJMO010000033.1
MKWLEPALARTVAEALADALPGSREDREARCLDVLGACDEEALASLLERVPPALGWRALVAWILGDDAFGRLLAGGVAVEPPRAMAPSRFEVPSLDTEGDLAAWLAVTPRALEAFTDPTDATRRAPRGPMRHYTHRWVGARLIEAPKPRLRAIQRRILQGVLDAVPPHDAAHGFRRGRSIFTSAAPHVGKPAVLRVDLRRFFQTIHLARVVAVFSALGYPRAVSRAFARVCTHAVPDDELVGQPFLTRQRLRTRHLPQGAPTSPTLANLAAHGLDVRLSALARAAGLAYTRYADDLVFSGDVAPGFPSRVASICAEEGFPVATEKTRLRRASDQQRVVGLVVNDHLGVARVERDRLRAILHNCARSGVNAENRAGHADFRAHLEGRVSFVEQADPRQGARLRRLFCTIPW

SEQ ID NO: 5337 - protein, 425 aa, unidentified
  source 1..425: note = Related to JAGQJB010000072.1; note = Myxococcales bacterium
MKRRDPSRDIALAALGETWSPAAIEGALADLFASEQRWMRAMARRMTRRFGEAPPLDVLEAFVRADRDLRQARRLLVRHPSLAMPPMPPSRFGAPPIASMGDLATLLEVPVEDLDWLADRRGTTRDAEAPVRHYRARWIPKRSVGWRLVEAPKARLRRAQRCLLDRVLASVPPHEAAHGFVPGRSVLDHARAHVRQAVVVRLDLEDFFASVPAAQVRAVFRTAGYGEDVAVALTALSTTRTPPALLRSPWVSRFETRQRLAHRHLPQGAPTSPWIANLAAYRLDLRVSALARSLGATYTRYADDLVLSGDEGFARGVERLLPRLGAIAIEEGFALQHRKTRVTRAGASQRVCGLVVNEGARVSRRERERLEAILFNCVKHGPASQNRGDHPRFRDHLLGRIAWVEQAHEPHAARLHALFARIEWP

SEQ ID NO: 5338 - protein, 532 aa, unidentified
  source 1..532: note = Related to JADJOY010000023.1; note = Deltaproteobacteria bacterium
MAAAPEHVARAIADAFLCGPWTALGLRASGAELFARRARWLDPLIRATLRAFPDPPRASRDALARFLGPHVERLTARLEPPRWPPVRRRLVPAPAMAERRRWPVRELATTAELARWLGLTPGELDWFADRHGTAARAVDPRLVHYRETWIPKRSGVGERLLEIPRPRLRAIQRAILDEILVAIPPHAAALGFRRGRSALDHASRHAGRAVLIRLDLEDFFAATPAGRVYGTFRAAGYPAEVALTLTRLTTRRASPDARRRARRWTPAHGDGSGGTLQSEGGRTSGRLAAAHLPQGSPSSPALANLAAFHLDVRLAALAEAIGARYSRYADDLAFSGEDTLERAAERLLPRIAAIVIEEGFRPRFRKTRIERATGRQTLMGLTVNVRPAVPRAERERLRAILTNCVRHGPASQNRERHADFRAHPRRARDVGRARERRSRAAAAHAARRDRLDALSQTEATQQEPAPACGDPSRGDGAPRATKTIGATGVPSPVAGSSDRDRSDRRCDTETCRWRGTRRPYPAGGRAGTCPTE

SEQ ID NO: 5339 - protein, 442 aa, unidentified
  source 1..442: note = Related to JAHBWB010000013.1; note = Labilithrix sp.
MSPTIVADALAAAFLDGAWSAPALARRGARALGQSTRWLPALARRVVAAFPDGAPRDRFEALATLLARDAAVRKAGRPDAPWRLVITAPTLAMRDAHPEWRLPRLHTAGDLATWLGLEIGDLLWFADTRGLSRRRRAVALDHYHRRWLPKRSGGARLVEAPKRWLKEVQRRILRELVERIPPHEAAHGFRRRRGVLSHAALHAGRDVVLRMDLEDFFVSIPASRVFAVFHAAGYPLEVARLLTGLCTTRAPSDPGAPMPATPTRAELEARHRARERYAERHLPQGAPTSPALANLCAWRLDVRLSAAARTAGAVYTRYADDLVFSGDDRFARWPAARFAYVVGGIAIEEGFNVQHRKTKLMRAGTRQQVTGLVVNRSAAIPRRDFERYKAILHNCVLTGPDRQNRDGRPDFRAHLEGVVAWVTHVQPARGAKLAKLLDAIRW

SEQ ID NO: 5340 - protein, 442 aa, unidentified
  source 1..442: note = Myxococcales bacterium 68-20; note = Related to MKVQ01000030.1
MDRRIVGEALAAAFLDGTWSPQPMARRGARAIGRPGRWLPALARRTVEAFPEGPPVDRFEDLARSLAEDKAVVRACATPAPWHLAFVAPALAMRDAHPSWGLPRLDTAGDVAAWLGLDVGDLLWFADTHGLARHRRDPRLEHYVRRWLPKRSGGARLVEAPKKWLKDLQRRILHELVERIPPHDAAHGFRRAHSILTHAASHAGREVVLRMDLEDFFVSIPAARIFAIFRAAGYPAEVARLLTGLCTTSSPPDAGAPVSAAPTVAELQARHRARARYASRHLPQGAPTSPALANLCAYGLDVRLGAVARSAHAVYTRYADDLVFSGDERFVRWPAKRFGILVAGIALEQGFTVQHRKTKLMRAATRQAVTGLVVNRAPSIPRRDFERYKATLHNCVRFGPESQNREGHADFRAHLEGVVAWVRHVQPERGARLAQLLDAVSW

SEQ ID NO: 5341 - protein, 443 aa, unidentified
  source 1..443: note = Related to JABFRG010000265.1; note = Polyangiaceae bacterium
MRHETLVVQAVASAMLADGAWSSADLVTRGAMVFDKRPRWMVAAVSAVMATHPTREGVTVAELVALLSSRPGVMRAIRRAHAVVRRWAIPLVTLVPPRWPVPAFASANALASWLELSPAELAWFADVKGLGRDPELDEPLRHYRVHWVPKRRGGVRLLEAPKPRLRDMQRRMLREILDAIPPHDAAHGFRRGRDARSHAALHEGQAVVLRVDLEDFFLSISLARTVATFRSAGYTDDVAHLLGRLCTHRTNASCPLPVLGAYPTEADLRARRNAERLARALHLPQGAPTSPAVANLCAYRLDVRLEAAAASVGATYSRYADDLVFSGGEDFAARAHRFAALVGGVVLDEGFRVNHRKTRIMGRGARQLVGGLVVNAHAQVPRASFDTVKAIVRNCIQYGPASQNRDSHPDFRAHLRGLVGWAGGAADSPRRAKLDALFRQIVW

SEQ ID NO: 5342 - protein, 444 aa, unidentified
  source 1..444: note = Related to JAHBWD010000001.1; note = Labilithrix sp.
MKTKVPERVAEALASAFLAHGAWTRDALAERGRVTLAEDARWMRGVVDRVLATFPEPPRARFSALARFIASVSIAAPRERRAPRWRPKVARWLEPEIAMGVRRWDVPAIATPGDLARWLGLSPAECDWFADGRGLERLRRPEALDHYRRRWVAKRRGGFRLLEAPKARTKAVQQRILREILDRVPAHDAAHGFVRGRSVRTHAALHVGRAVVVRLDLEDFFLSISAARVAGVFRAAGYPDDVAWSLTLLCTNVAPPSGLVLGRDATHDDVARLRRAEMRARTRHLPQGAPTSPALANLCARGLDVRLTALATKLGAVYTRYADDMTFSGDRRLARSSSRLEAWASAIASDEGFTVNHRKSRVMRAGVRQLVTGVVVNTRLNVARDAYDRLEATLHNCRRLGPGSQNRDGHPDFRAHLVGRVAHVKSLHPARGEKLAALLEQIAW

SEQ ID NO: 5343 - protein, 444 aa, unidentified
  source 1..444: note = Myxococcales bacterium; note = Related to JAGQIZ010000167.1
MASYLEHVSRALGSAFMMGPWTRLALMGLGERVLGERPPWLGGLVSRTLSALPEPPPTVEAVAAVLREHRAFRNAFADQASRPRVRRWLHAPPSAPAEAPWPVPPLRTFDDLARHLELPDEQLSWLADPRGVLRRAPSERLHHYHRDFLPKRAGGHRLVETPKPRLKAVQRRLLRTIFDHIPPHPSAHGFVKGRSPITHAGQHAGRAVVLRLDLEDFFTSVTYARVYRVCRFAAYPDEVARLLAGLCTTSLPPPIWRRAPRPDHPADLPAYQRQRERALRRHLPQGAPTSPSLANHCASRLDRRLHAAAERAGAHYSRYADDLVFSGDDGFARSVTRFIPFAAAIAMDEGFVVNFRKTRVMPRNRRQQVAGLVVNAHPNVSRQTYDRLKAILTNCARHGPASQNRDGHPDFRSHLRGLIAWIDSVAPKRGAELRALFEAIEWKG

SEQ ID NO: 5344 - protein, 442 aa, unidentified
  source 1..442: note = Related to JACQYO010000099.1; note = Deltaproteobacteria bacterium
MTLDDVVRAFAGALLAGEWTESTVRERAVEALGAKPRWLWPLVRRVVRLGSPPRRRQVELAIRASSAFVGAWKRGLVQPTRALEVRAVLSSPRMGPVRWAVPSLGTEGELARWLGLGVSDLFWLADPLAGERRARVERIRNYVYTWVPKRSGGVRLIESPKPLLKTLQRRILREIISLVPVSDSAHGFVLGRSTLTHASSHISQRVVLRLDLRDFFSTVSAWRVAAVFRTAGYPENVARLLAGLCTNSAPEAVLQLAGPSLSRFQKQRLRSAHVPQGAPTSPAVANLCAYRLDRRLAGLARVSGTIYTRYADDLVFSGDFTRSKDFDRPRPSIDRFVARAHAIVLEEGFTPHFEKTRVMGCGRRQEVTGIVVNRQPNVSRADLEVFEATLYNCRRSGPSTQNRTGHPDFRAQLAGRLGYVEMVLGERARWLRTLFEQIDWSR

SEQ ID NO: 5345 - protein, 393 aa, unidentified
  source 1..393: note = Deltaproteobacteria bacterium; note = Related to BJHF01000062.1
MARTLSRRPPPMEADRDFTERLARFPGAKEAVLKRLPIRRWFVVTPVQRPGRWPVPLLPTPSDLATALRLDVDALDWFADNRGLEAHTRSRALRHYHYRWLAKPTGGARLVEAPKGRTVDIQRWILRNLLDSVPPHPAAVGFRRGFSTLDAAAPHVGREVVLSLDLEDFFASVSAARVAATFAALGYPRPVAYCLSGLCTTRVPAAILAEQPRGGDLPAAWRQRRRLRDAHLPTGAPTSPALANLAAFALDTRLAAAAAAVGATYTRYADDLSFSGDAEFSRRARRFSVLVGAIAIEEGYRVNLRKTRLAGKGARQEVVGVVVNVRPALARDRWDRLRAILHNCQVHGPSTQNRDGHEDFRAWITGTVAAARAIDAKRGGRLLEMLAGVDWGR

SEQ ID NO: 5346 - protein, 441 aa, unidentified
  source 1..441: note = Deltaproteobacteria bacterium; note = Related to JADZFZ010000151.1
MNRSDRTSLARDLAATFLAGPWERREMARRAAASFGLPRSPRWLSTLAREVVRVFGPDPPHGRDGRIAALIAPRLRPLRRAGIARRPALVHPCLVPARMGTAAAPVLRERGLPEVATPGELAAWLGLDRDRLAWLADVRGLSRRTHDGPLVHYRYRWVPKRSGGARLLEIPKPDLAAAQRKILRELLDRVPPHASAVGFRKGRNVLDHASAHAGAAVVLRMDLGDFFASVAATRVHAIFVALGYPAAVSSLLTGLCTHRTSMFVRHASTDHAAWSRLRERHLPQGAPTSPALANLAAFGLDVRLAALASKAGAAYTRYADDLAFSGGTGFARSAAAFHVLACAIVIEESFAPNPRKTRIMRASSRQQITGLVVNAKPSLPRDELDRLKATLHNCVAHGPASQNRDGRADFRAWLAGKVAWVASVHPARGARLRAMLERIRW

SEQ ID NO: 5347 - protein, 442 aa, unidentified
  source 1..442: note = Related to NZ_RAWM01000011.1; note = Corallococcus interemptor
MSERNVVAKALASAFLAAPWTRAGLIANGAEVVGGRFPWLASLARSTLRFFPRPPHDRLELLAEILATRPALKQACANPTAPVRLLRWLTAEPQMGRAPWPVPALPTQADLAAWLGVTDAQLDWLADGKGLEHRTSPGRWRRYGYTWIPKRSGGQRLLEQPGEELARLQRKVLHCILDRIPPHEAAHGFVKGRGIRGFVEPHTRQAVVVRLDLEDFFLSVRPPRLWGVFRAAGYPDGVAGALVGLCTNRTPGAVVAQARKPTHAQEVESRWLLGRRLESRHLPQGAPTSPALANLAAYRLDVRLSALAGVLGMRYTRYADDLAFSADAARPGSIRRLLRSVRRIVRDEGFTVREDKTRVMSKGHQQWLAGVVVNEHPNLRREDYDRLKAVLHLCRTRGPASQNTGGHPDFRAHLLGRIAWVTYLHPARGARLRALFDRIAWD

SEQ ID NO: 5348 - protein, 442 aa, unidentified
  source 1..442: note = Related to NZ_CP079946.1; note = Corallococcus sp.
MSGRTVVARALASAFLAAPWTVSGLVAKGSEVVGGRFSWLRSLARSVLRFFPRPPHGRLELLAEVLATRAALKQACANPEAPVRVVRWLTSEPEMGRQPWPIPALSTQADLADWLKVTSAQLDWLADGMGREHTSSPGRWRRYRYTWIPKRSGGERLLEQPGEELARLQRQVLHGILDRIPPHEAAYGFVKGRGIRGFVEPHTGQAVVMRLDLEDFFLSVRPPRVWGVFRAAGYPDGVAGALAGLCTNRTPGAVVAKARRADDARKVDARWLLARRLESRHLPQGAPTSPALANLAAYKLDVRLSALAAALGMHYTRYADDLAFSGSDARAGSAHRLLRCVRSIVRDEGFTVREDKTRVMHQGHQQWLAGVVVNQHPSLRRADYDRLKALLHLSRTRGPNSQNTGGHPDFRAHLLGRIAWVTHLHPARGARLRAIFEQIVWD

SEQ ID NO: 5349 - protein, 442 aa, unidentified
  source 1..442: note = Related to NZ_VIFM01000112.1; note = Myxococcus sp.
MSKRIAVANALASAFLSGPWTTAGLVERGAEVIGGRTPWLLSVVRSTRRFFPRPPHARFELLAEILATRPALQRACGNPHAPVKILHWVATEPEMGRQPWPVPSLPTQAELTDWLGMTDAQLGWLADARGLERMTPPGQWRRYRYTWIPKRSGGERLLEQPGLDLSRLQRKVLHGILDVIPPHEAAYGFVAGRGVRGFAEPHVGQAVVVRVDLEDFFLSVKPARVWGMFRAAGYPDDVATTLAGLCTTRTPSGVLEQARRAADGEALTARWRLARRLESRHLAQGAPTSPALANLAAYRLDVRLSALASALGARYTRYADDLAFSGGDALARSTGRLLRCVARIVREEGFTVRTEKTRVMRRGRQQRLAGVVVNEHPSVPRADYDRLKAILHLCRTRGPASQNTGSHPEFRAHLLGRVAWVSQLNPTRGARLRAIFEQIAWE

SEQ ID NO: 5350 - protein, 449 aa, unidentified
  source 1..449: note = Related to NZ_CP071091.1; note = Myxococcus sp.
MALGDSAVSNRQSVASALASAFLAGPWTYEGMVERGAHVVGGRAPWLLAVVRGIRRFFPHPPVARMELLTELLATRPALIKACRNPAVPVHLHRWLIPEPSMGQRPWPVPELSTQAEVARWLGVTDAQLGWLADGSGFERTSRPGQWRRYRYVWIPKRAGGKRLLEQPGVDLGRLQRQVLHGLLDLIPPHDAARGFVRGRGVRDFAEPHVGQAVVVHMDLEDFFHSVRPSKVWGVFRAAGYPDSVTEVLAGLCTNRTPGTVVEEAPRATHLGEQKARWRMTRRLTARHLPQGAPTSPALANLAAYRLDVRLSALAAALGARYTRYADDLAFSGGASLLQRPLRLVRCVAAIVREEGFAIRADKTRVMHQGQQQRLAGVVVNAHPTVPREDYERLKAVLHLCRTRGPTSQNTEGHHDFRAHLLGRIAWVSHLHPSRGARLRATFDRITWD

SEQ ID NO: 5351 - protein, 444 aa, unidentified
  source 1..444: note = Related to NZ_FOIB01000009.1; note = Myxococcus fulvus
MSTRHPVAAALASAFLAGPWTRAGLRERGAHVVGGRPRWLVPVVRGILRYFPRPPHARFELLTELLATRPALIKACGNSAEPIRIRHWLDVEPQMSRRPWPVPELTTQAALAQWLGVTDAQLGWLADGSGFERTSRPGQWRRYRYVWIPKRTGGKRLLEQPGLDLARLQRKVLHDILDVIPPHAAARGFVRGLGVKDFAEPHVGRAVVVRVDLEDFFHAVRPAQVWGVFRTAGYPDGVVNALAGLCTNRTPGAVVEQARRAESAQELDACWRLSRRLSARHLPQGAPTSPALANLAAYRLDVRLSALAATLGARYTRYADDLAFSGDEVLARRVRRLLTCVTRIIRDEGFTVRQGKTRVMHQGQQQRLAGVVVNAHPTVPREDYERLKAVLHLCRTRGPESQNTEQHPDFRAHLLGRIAWVEHLHPARGARLRATFERIPWAPE

SEQ ID NO: 5352 - protein, 443 aa, unidentified
  source 1..443: note = Related to NZ_CP022203.1; note = Corallococcus macrosporus
MSERRVVAQGLASAFLAGPWTLKGLVERGTEAVGGRAPWVRSMARSAMIFFPRPPHARLELLAEVLASRPVFPKGFADSSGRARIVRWLTSEPRMDRQPWPVPSLPTQADLADWLGVTGAQLDWLADAPGIERTSKPGRWRRYRYTWIPKRSGGERLLEQPGLDLMQVQRKVLHGILDRVPPHDAAHGFVAGRSVRSFVEPHAGQAVVVRVDLEDFFFSVRPARIWAVFRTAGYPDGVTNALAGLCTNRTPQAVLAQARQPESVSEVDARWRLARRLESRHLPQGAPTSPALANLAAYRLDVRLSALATAMGARYTRYADDLAFSGGDALSRRTHKLLRYVSQILREEGFMTRAGKTRVMRQGAQQRLAGVVVNAHPSVSRADYERLKAILHLCRTRGPASQNTEGHPDFRAYLLGRIAWVAHLHPARGAKLRATFEQVVWAG

SEQ ID NO: 5353 - protein, 442 aa, unidentified
  source 1..442: note = Related to NZ_CP068048.1; note = Myxococcus xanthus
MSEQRVVAQALASAFLAGPWTLKGLVERGTEVVGGRAPWVSSLARSAMIFFPRPPHARMELLGDLLASRPAFMRGCTDPSARARIVRWITSEPRMARQPWPVPSLSTQAELAAWLGVTGAQLDWLADVPGIERTSSPGRWRRYRYTWIPKRSGGERLLERPGLDLLLVQRKLLHGILDHIPPHDAAHGFVAGRSVLGFAEPHARQAVVVRVDIEDFFFAVRPARIWAVFRTAGYPDGVVSALAGLCTNRTPSAVVSQARRPDSLADASARWRLARRLESRHLPQGAPTSPALANLAAYRLDVRLSALAEAMGARYTRYADDMAFSGGDALARRTHKLLRYVSQIVREEGFTPRTGKTRVMHRSTQQRLAGVVVNDHPSIRRVDYERLKAILHLCRTRGPASQNTEGHPDFRAHLLGRIAWVAHLHPARGAKLRATFDQIAWD

SEQ ID NO: 5354 - protein, 449 aa, unidentified
  source 1..449: note = Related to CP012109.1; note = Myxococcus sp.
MACESAMSERRVVATALASAFLAGPWTIQGLTERGLEVVGAPSPWVASLARSAVRFFPRAPRARMELLADLLATRAAFQRGFEDPEARARIVRWRVSEPRMARQPWPVPSLPAQADLADWLGVTSAQLDWLADVPGIERTSPPGRWRRYRYTWIPKRSGGQRLLERPGLDLACVQRKVLHGILDRIPAHDAAHGFVSGRGVRSFTAPHVGQAVVVRLDLEDFFLAVRPARIWGVFRAAGYPDGVVRALAGLCTNRTPGAVMARAPTPTSLATVAARWRWTRRLESRHLPQGAPTSPALANLAAYRLDVRLSALAAAMGARYTRYADDLAFSGDASLARRTRRLLHLVGLIVREEGFTPRAGKTRVMSQGTQQRLAGVVVNARPSIPRADYDRLKALLHLCRTRGPDSQNNTGHPDFRAHLLGRIAWVSHLHPTRGARLRALFEQIAWTA

SEQ ID NO: 5355 - protein, 419 aa, unidentified
  source 1..419: note = Related to NZ_JAAIYA010000009.1; note = Pyxidicoccus sp.
MHERAVTALGQHFQWLTGVVRNVRRGFHRPPVDAPDTLARYIAHLPSFRQAMAHPDTRPRIRHWLVAPTDMGRMRWPVPALPTTGELAAWLGLSDEDLDWLADRKGYSHSARDTRLLHYQWRWVPKRTGGVRLLESPKARLKALQRQVLHAILDAIPPHESAHAFQQGRSVLTFAAPHVGQHVLLRMDLEDFFTSISAGRVFGVFRTAGYPEAVSSTLASLCTHALPLLVLRDMPRPASVEDIDAHWRARARLSSPHLPQGAPTSPALANLCAWGLDVRLSTLAASMGVRYSRYADDLVFSGGEDLSHALERFRHLVETVIRDEGFVPNVRKTRVLRQSVRQQVAGVVVNARPNVPRADFDTLKATLTNCIRQGPSTQNHTGHPDFRAHLVGRVAWVASVHPQRGARLHALLDAIDWSR

SEQ ID NO: 5356 - protein, 447 aa, unidentified
  source 1..447: note = Deltaproteobacteria bacterium; note = Related to JADYYK010000281.1
MIEPQAARAILAEAFLGGDWSADGLLQRALEVVAEPAPRQSLRALIKLVLGRFPATPPLRRRDLEEVIASSRSFSKATRAQRLRVWRPWLRSPVMTPLAGAPTSWPVPALPTTTELAAWLGLDVDALEWFAGTHGRARRAPPGPLGHYTYSWAGKASGGYRLIEAPKARLKALQRRVLDGILAEVPVHPAAHGFCRGRGVLSHAAPHAGQRLVMALDLRDFFASVRASRVLAIFRTLGYPEATARLLTGLATHTVSALVWASAPPPRDAAEASARFHAGRFFQSPHLPQGAPTSPALANLAAFRLDLRLTALARAADATYTRYADDLAFSGGERFARGAERLFSLAAQIIFEEGFRLNAGKTRLLGQGMRQRLAGVVVNAHPNLARRDFDQLKATLHNCRRDGAQAHDRDGLGAGFRAHLLGRVAWAEQVNPARGGKLRTIFDGIRW

SEQ ID NO: 5357 - protein, 639 aa, unidentified
  source 1..639: note = Planctomycetes bacterium; note = Related to DOEP01000754.1
MAGEVSPGLGKLSGGDYEGLELVRARVEFASGVRWFHPGELDRVHPHVEAALVRHAITRDLIAAGNATRLEQSLEAFWEGRQEFYRTPGLLDELWLLHRGPAPTELGELFDAPRAELLAIVPQLAPPLPQLPRETRLLEAEELHAEAWKQVTPIGELEEDEDWSSEWERAAPLGALVPPRTRADYLADDQDDDDPDDDEEWELRRRRKQLAEAASALCQAFLSAEWSADDLLDRGQRTLGTSEPWLEELVDRVLAAFPARPHPEDEDLVLFLAEDEALHEQLLEGSLVVWTRFFVPPQMRADRRFPVMPLEGAPDVERWLRIGTGDLQWLADQERWLYRHPSGPLQHYHYHWLPKRSGGRRLVEAPKELLKSVQRQILRDVLGPVPPHEAAHGFCRGRSVRSYAEPHAGQELVLGFDLREFFPTIRAPRVSALFRALGYPSGVAQLLSDLRTTVTPSDVLEEGPLSGGARGRLEQRHLPQGSPTSPALANLCAYGLPVRLSAAAAAVSARYTRYADDLAFSGGADFLRQASRFRYLVMRIAAEEGFEINPTKNRWMRPQRQQRLTGLVVNVRPRPSRAEFDRLKATLHNCGRHGPASQNRAGLPDFRAHLAGRVSWFEQTDPVRGERLRELFHQITWET

SEQ ID NO: 5358 - protein, 440 aa, unidentified
  source 1..440: note = Related to JAHBXY010000029.1; note = Planctomycetes bacterium
MNVDEVARGLAAAFLAGDWLQEGMVARGREALGGRFGWLPGLARRAREAFLDPPLHDPEALEDLLAADARLQAALRRRARQGHPPLVVRRLFLHHTAMRSERRFAVPSFDTEADLARWLGLALTDLDWFADRKAWLIHAPQGPLQHYHRTWIRKRGGGLRLLEAPKATLKAMQRRVLHGLLAHVPPHDAAHGFRPGRSVVTHAAPHAGKALVLRLDLRDFFPSVPAGRVAALFRSLGYPRSVAGLLTGLVTTRTPLATLEGVDLDREAEDALRRSHLPQGAPTSPWLANLCALGLDVRLSAAAAKVGADYTRYADDLAFSGDEAFRRVAARFRTLVHAIVLGEGFDLRPEKTRWMTPSVRQRLTGLVVNQRPRPSRAEFDRLKATLFNCARRGPTAENREGHPDLRAHLRGRVAWFEHTDPARGARLRALFERIAWAPAR

SEQ ID NO: 5359 - protein, 433 aa, unidentified
  source 1..433: note = Related to JAJTCO010000005.1; note = Pseudoduganella sp.
MMLATVASPASLIAACQRVFGTTPAWVPRVCFALIDRTGDNFHCFSRQELADILLQLLFHGPQTERIALPPVRRYCTEPARQAPRPAWLAALALPDLPSVGALAGWLGEPVGALAWLADQWRSEDGNRSRLQHYHYRWVPKRSGGVRLIEIPKARLRRIQHKILRQILDRVPPHPAAHGFLRGHSCLTHAALHAGQEVVIRMDLKDFFPSIQYARIHALFEKLGYTTNVAGTLARVCVNRTPPSAIRDQAAGSLSWPERHALKSPHLPQGSPCSPALANLCAYRLDLRLASLARPLGASYSRYADDLVFSGGPDFARSAERFRVRAAAIALEEGFQVNTRKSRVMRKGARQQVTGIVVNAHPNLARSEYDRLKATLTNCVRHGPDSQNRQNHPDYQAYLAGRVSYVKMVNASRSAKLQRLFDAVAWPQDAPSA

SEQ ID NO: 5360 - protein, 395 aa, unidentified
  source 1..395: note = Related to JAIENA010000076.1; note = Burkholderiaceae bacterium
LLWQCLGRGDGNEDDNDGDGDGDGDGDAWVVGADLPPLRRYCVDPPVRPVPPAWLAALALPALASVGALAAWFDEPVGALGWLADQWRLGGEGQERLQHYHYRWVPKRSGGVRLIEIPKARLRRLQQKILREILDRVPPHPAAHGFRRGHSCVTHAALHAGQTVVIRMDLKDFFPSIQLSRIHALFAKLGYCASVAGTLARLCVNRTPPSAFNDRQLGAALNWTERQALKSPHLPQGSPCSPALANLCAYRLDLRLSSLAQSQGATYSRYADDLAFSGGAAFARRAERFHLQVAAIALEEGFQVHHRKTRLMRAATRQQVTGVVVNRHPNIARSDYDALKATLTNCVRHGPATQNRDRHTDFRAYLAGRIAHVKMVNADRATKLQRLFEAIAWPA

SEQ ID NO: 5361 - protein, 456 aa, unidentified
  source 1..456: note = Related to NZ_LMDJ01000008.1; note = Massilia sp.
MNTKQFTVLALADMVLATDGSLASLIGACNRVFDAEPPWVPAACAALIERTGDYFHYYSRRELAALLLECIGHGSAGARDEDAEPGHERGLECLVMPDVRRLCVEPALRPPKPAWLAALALPDLPTAGALAAWLNEPVGALDWFADQWRLARDAQSPLQHYHYRWVPKRSGGQRLIEIPKARLRRIQQKILREILDMVPPHPAAHGFRRGHSCVTHAALHAGRHAVIRMDLKDFFPSIQLSRVHALFEKLGYPHRTAGTLARICVNRTPQGALRDKLAGGALPWLERQALKSPHLPQGSPCSPALANLCAYRLDIRLSALAQSLGGSYSRYADDLAFSGGPAFARAADRFHVRVAAIALEEGFRVNTRKTRLMREGTRQQVTGIVVNAHTNVARDEYDKLKATLTNCVRHGPASQNRDRHPDFKAYLAGRVSYVRMVNAGRASRLQGLLDAIAWAA

SEQ ID NO: 5362 - protein, 459 aa, unidentified
  source 1..459: note = Related to NZ_CP086370.1; note = Massilia sp.
MNIKQHTVLALADMALATDGSLASLTAACHRVFDAEPPWVPAVCEALIARTGEHFHYYSRHELAGLLLECIGHGRGGPGADGQDGDDAEDFALPEPIALPAVRRYCVDPPVRPPKPEWLAALALPELANAAALAAWLNEPVGALDWFADQWRLARDGQSPLQHYHYRWVPKRSGGVRLIEIPKARLRRIQQKILREILDLVPPHPAAHGFRRGHSCVTHAAQHAGQHAVVRMDLKDFFPSIQLSRVHALFEKLGYPYKTAGTLARICVNRTPLGAFRSTPDGDSLSWSERQALKSPHLPQGSPCSPALANLCAYRLDIRLAALAESLGGAYSRYADDLAFSGGPAFARAADRFHIQVAAIALEEGFRVNTRKTRLMRAGARQQVTGVVVNAHPNIARDEYDKLKATLTNCVRHGPASQNRDRRPDFHAYLAGRISYVKMVNAARASRLQSLMDAIAWAA

SEQ ID NO: 5363 - protein, 460 aa, unidentified
  source 1..460: note = Related to NZ_AUDI01000016.1; note = Pseudoduganella violaceinigra
MTTDKLTALALADTMLATDGSMESLIAACNRVFGSRQPWATGICVALIERTGESFHYFSRHELADILLQLLGHQFDDDEYGEYNDDEFGEEDSSPPYIELPQVRRYCLDQPIRPPKPEWLAALALPELPTIGDLAHWLNEPVGALEWFADQWRLAGDAQSRLQNYHYRWVAKRSGGLRLIEIPKARLRRVQQKILRQILDLAPPHPSVHGFRRGRSSVTHAALHAGKRVVIRMDLKDFFPSIQVSRIHALFEKLGYSQSVAGTLARICVNRAPYGLFRDKQTGGSLPWVERQALKTPHLPQGSPCSPALANLCAYRLDIRLETLAQSLGASYSRYADDLAFSGGADFARAAHRFHIQVAAIALEEGFRVNTRKTRVMREGTRQQVTGVVVNTHPNLARSEYDTLKAMLTNCVRHGPTSQNRHNRPDFRAHLAGRISYVKMLNVNRAVKLQRLFESIAWTP

SEQ ID NO: 5364 - protein, 452 aa, unidentified
  source 1..452: note = Related to NZ_WNKX01000014.1; note = Massilia eburnea
MNTEKLTALALADMMLATDGSMASLVAACHRVFDSPQPWSATICAALIERTGDNFHYFSRHELAHILLLLTGRRFDDFEDGDDEPSPPLIELPAVRRYCLNQPIRPPKPAWLASLALPELKTVGDLAGWLNEPVGALAWLADQWRLAGDEQSRLQHYHYRWVPKRGGGLRLIEIPKARLRRIQHKILRQILDLAPPHPCAHGFRHGHSSVTHAALHAGKNVIIRMDLKDFFPSIQASRIHALFEKLGYPPSVAGTLARMCVNRAPRGIFRDKQTGGSLPWSERQALQSPHLPQGSPCSPALANLSAYRLDIRLASLAQSLGASYSRYADDLAFSGGPDLARAADRFHIQVAAIALEEGFRINTRKTRVMRKGTRQEVAGVVVNSHPNLARGEYDLLKAILTNCVRHGPASQNRHRHPSFRAHLAGRISYVKMLNANRAVKLQRLFETIEWAD

SEQ ID NO: 5365 - protein, 458 aa, unidentified
  source 1..458: note = Related to LMDB01000012.1; note = Duganella sp.
MDNEKLTALALADTMLATDGSPENLIAACDRVFDATQPWAPGVCMALVMRTGENFHYFSRHELADILLQLLGRGHVDYDDEDEDEEEGGADAPPFIKLQDVRRYCLEQPIRPPKPAWLAELALPDLPTVGDLAVWLNEPVGALRWFADQWRIARDEQSRLQHYHYRWVPKRSGGLRLIEIPKERLRRIQQKILRQILDLVPPHASAHGFRRGHSCVTHAARHAGQHAVVRMDLKDFFPSIQHARVQALFEKLGYPESVAGTLARICVNRAPHDLFRDKQSGGSLAWSERQALKSPHLPQGSPCSPALANLCAYRLDIRLESLARSLGASYSRYADDLAFSGGDEFARCAERFHIQVAAIALEEGFRVNTRKTRLMREGTRQQVTGIVVNAHPNIARDEYDKLKATLTNCVRHGPESQNRESHPNFQAYLAGRISYVAMVNSDRAAKLQRLLDDIVWPT

SEQ ID NO: 5366 - protein, 308 aa, unidentified
  source 1..308: note = Related to CP051684.1; note = Duganella sp.
MAGAARRADSASALPLPLGAQAQRRPAPDRNSQGAAAAHPANNPAPDPRPGAAACGRPRIPARPVERHARRLACRPPNRRPHGPEGFFPSIQYARIVALFEKLGYPDKVASLLARLCVNRTPNGAWRDRKVAEAVTWSERQALKSPHLPQGSPCSPALANLCAYRLDIRLTALAQSLGASYSRYADDLVFSGDHDFARAAERFHIQVAAIALEEGFRVNTRKTRLMREGTRQQVTGVVINRHPNIARDEYDKLKATLTNCVRHGPASQNREGRTDFRAYLAGRISYVNMVNANRATRLQRLADAIVWS

SEQ ID NO: 5367 - protein, 459 aa, unidentified
  source 1..459: note = Related to NZ_WKJN01000036.1; note = Duganella alba
MAIEKLTLLALADTLLATEAHLASQIAACTRVFDAPQPWAPPVCAALLARTGDNFHYFSRYEIADLLRQLLARAQEEREGAAAEDADTAAADSAPLVTELPPVRRYCIDPPLRPPQADWLVALGLPQLHSVGALAAWLDEPVGALGWLADQWRLPHNAPARLQHYHYRWVPKRSGGLRLIEIPKARLRRIQQQILRQLLDLTPPHAAAHGFRRGRSSVTHAALHAGRHTVIRMDLKDFFPSIQYARIVALFEKLGYPEKVAGLLARLCVNRTPNGALHGRQVADAVTWSERQALKSPHLPQGSPCSPALANLCAYRLDIRLDALAQSLGAVYSRYADDLVFSGDRDFARAADRFHIQVAAIALEEGFRVNTRKTRLMREGTRQQVTGVVINRHPNIARDEYDQLKATLTNCVRHGPASQNRDGRADFRAYLAGRISYVRMVNAQRAARLQRLADAIVWR

SEQ ID NO: 5368 - protein, 477 aa, unidentified
  source 1..477: note = Related to WHUF01000005.1; note = Rugamonas rivuli
MSRVAFPRKTAHASRDSLKALRSFSLRMTIKKLTVLALADTMLASERNLDSLIAACGRVFGAPPPWASEVCAALIERTGENFYYFSRHEIAGILLQLLSHDNADDDDGDDEAPEPMELPPVRRYCIDPPIRPPRDAWLAALALPELRTVGDLAAWLDEPVGALEWFADQWRLAGDKESRLQHYHYRWVPKRSGGLRLIEIPKERLRSIQQKILRQILDPLPPHPAAHGFRRGHSCLTHATLHAGRHVVIRMDLKDFFPSVQLSRIHALFEKLGYPDKVAGALARVCVNRAPHGVFRDTHDGASVTWAERQALKSPHLPQGSPCSPALANLCAYRLDVRLEALAQAMGASYSRYADDLAFSGDRDFARAAERFHIQVAAIALEEGFRINTRKTRLMREGTRQQVTGVVVNAHPNIARDEYDRLKATLTNCVRHGPATQNRDSHPDFRAYLAGRISYVKMVNASRAVKLQRLLATVAWA

SEQ ID NO: 5369 - protein, 446 aa, unidentified
  source 1..446: note = Related to QVIN01000001.1; note = Duganella sp.
MTIAKLTALALADTMLASDGSVEKLIAACGRVFGAPQPWAPKLCAALSERTGDNFHYFSRHEIADILLHLLGHDYNDDEERPVIALPAVRRYCIDPPIRPPQDEWFAALALPELPTVGALAAWLDEPVDALDWFADLWRVESGQQSRLQHYRYRWVPKRSGGLRLIEIPKARLRRIQQKILRQLLDRLPPHPAAHGFRRGRSCVTHAALHAGRRIVIRMDLKDFFPSIQYSRIHALFEKLGYSPTVAGTLARICVNRAPCGVFSDPMEGGSLPWAERQALKSHHLPQGSPCSPALANLCAYRLDMRLQALAQSLGASYSRYADDLAFSGDQDFARTAERFHIQVAAIALEEGFRIHHRKTRLMREGTRQQVTGVVVNTHPNIARDEYDRLKATLTNCARHGQATQNRDSHPNFRAYLAGRISYVGMVNANRALKLRRLFDAIAWPA

SEQ ID NO: 5370 - protein, 456 aa, unidentified
  source 1..456: note = Related to QVIO01000002.1; note = Duganella sp.
MNIEKLTVLALADTMLASDRSLGSLISACGSVFGMSPLWAPSICAALIERTGENFYHFSRHELADILLHLLGRGSDDVHDDEDEDNPEEYTEVAERLELPEVRRYCIEPPIRPPQTAWVAALALPQLPSVGALAAWLDEPVGALAWFADQWRLASDAQSRLQHYHYRWVPKRNGGQRLIEIPKARLRVLQQKILRHLLDRLPPHPAAHGFRRGHSCVTHAALHAGRPVVVRMDLKDFFPSIQLARIHALFEKLDYPPAVAGTLARICVNRAPQGVFKEAGSLPWAERQVLRSPHLPQGSPCSPALANLCAYRLDMRLEALAQSLGATYSRYADDLAFSGDRDFARAAERFNIQVAAIALEEGFRINTRKTRLMREGTRQRLTGVVVNAHPNIARDEYDRLKATLTNCVRHGPASQNRDRHPDFHAHLAGRISHVKMVNANRAVKLQRLLEAIAWTV

SEQ ID NO: 5371 - protein, 457 aa, unidentified
  source 1..457: note = Related to NZ_WWCJ01000021.1; note = Massilia guangdongensis
MDIDKLAVLALADTMLASDGSMAALVAACHRVFAAPQPWAPRICAALIEHTGENFHYFSRHELADRLWQLLGRATSDADVDVDDFVALAAPPFIALPPVRRYCIDLPQRPPAPGWLAALALPELATVGDLAAWLGEPVAALDWFADQWRLDGPAQTPLQHYHYRWVPKRSGGWRLIEIPKERLRRLQQRILRQLLDRVPPHPAAHGFRRGHSCLTHATLHAGQRAVIRMDLKDFFTSVQPARIHALFAKLGYPPSVAGTLARLCVNRAPHGVLRDRQGDVALPWSERQALKTPHLPQGAPSSPALANLCAYRLDLRLAALARTLGASYSRYADDLAFSGGEEFARAAARLHIQVAAIALEEGFRVNTRKTRLMRAGARQQVTGVVVNAHPNLARDEYDRLKAMLTNCVRHGPATQNRAGHADFRAHLAGKISHVRMLNPQRAGRLQAVFDAIRWDLH

SEQ ID NO: 5372 - protein, 458 aa, unidentified
  source 1..458: note = Related to JACMNR010000433.1; note = Bdellovibrionales bacterium
MIPAPSVALALADTLLAGEASPDGLAASAASALGTAYAWGPAMCGFILQRTGDKFRYFSRHELAAIILDSDAFHAAFEPGKEAPQIKRYCLQLPVRPEPDAWLSALSLPAIPTLGELALLLNVELQDLGWFADQWRRGSAEAAPLQHYHYRWVAKRSGGWRLIEIPKQRLRRMQQTILRKILEDVPVHGAAHGFRRGHSCVTHAALHAGQRVVIRMDLKDFFPSIQASRIHALFSKLGYSDSVAGTLARLCTSRAPASAFADPHTGGSLPWAARRALRSPHLPQGSPCSPALANLCAWRLDLRLDALCGSIGATYSRYADDLVFSGGREFERSVERFHVQVAAIAIEEAFGVNTRKTRVMRAGVRQQVTGVVINQHPNLRRDEFDRLKAVLTNCARHGPVAQNREGRENYWHYLAGKVAWVKMLNPARGAKLEKVFAGIDWPEAGSGSVAAPASESSS

SEQ ID NO: 5373 - protein, 492 aa, unidentified
  source 1..492: note = Related to WHJH01000043.1; note = Massilia mucilaginosa
MPLRGYPVGTILLCNSPHEPPCAAAHLSSSFTRLVEGSPPPQSYPSMIPKDAVALALADTMLARDATLAGLIASATWAFDHPWPWIPALCEEIHARTAAHFYYFSRDELARIIFELDVFHAAWDGEGPAPQLQRYCLDLPVVPPAPDWLAALALPALPSVGELARWLGLRPDELGWFAGQWRKDPMPAAQLEHYHYRWVPKRSGGVRLIEIPKPRLRAMQAIILRELLDRVPAHPAAHGFRRGHSCVTHAALHTGQRVVIRMDLKDFFPSIPASRIHALFAKLGYSQTVAGVLARLCVNRVPAGVLREPAGGNALTWTQRQALRAPHLPQGSPCSPALANACAWRLDVRLETLAQLLGARYSRYADDLVLSGGRELERAMDRVHAQVGAIALEEGFAINTRKTRVMRAGVRQQVTGIVVNRHPNIARDEFDVLKATLTNCVRHGPQGQDRENRPDFRAWLAGKVAYVTMVNPQRGGRLQRLFDAIAWPHPPL

SEQ ID NO: 5374 - protein, 459 aa, unidentified
  source 1..459: note = Related to NZ_CP065053.1; note = Massilia antarctica
MIPKDAVAQALADTMLARDATLAGLIASATWAFGHPWPWIPDLCEQIHSRTAEHFYHFSRHELAQIIFELDVFHDAWDGDGPAPELERYCLDLPLVPPPPDWLAALALPALPSVGGLARWLRLRVDDIAWFADQWRVDAAPAAQMEHYHYRWVPKRSGGVRLIEIPKQRLRAMQATILRELLDRVPAHPAAHGFRRGHSCVTHAALHTGQRVVIRMDLKDFFPSIPASRIHALFAKLGYSQSVAGVLARLCVNRVPAGVLRAPVDDNALTWMQRQALRTPHLPQGSPCSPALANACAWRLDVRLDTLAQSLGARYSRYADDLVFSGGRALERAMDRFHAQVGAIAIEEGFAVNARKTRMMRAGVRQQVTGIVVNRHPNIARDEFDLLKATLTNCARHGPQAQNRDHHPDFRAYLAGKVAYVTMVNPQRGQRLQGLFETIAWLSAPGQPDNNSGKQYNFP

SEQ ID NO: 5375 - protein, 438 aa, unidentified
  source 1..438: note = Related to FQWU01000004.1; note = Massilia sp.
MIPAHSVALALADTMLAGAAGVAALIGSAARAFEVEHKWVPPLCEAIHVRTGEHFHSFSRMELAAIILDDEHFLGAWENGKAPPQIRRYCISLPVVPEQPAWLVALALPAIPTVGDLARWLTVRPDELGWFADQFRLTHDATSRLQHYHYRWLPKRSGGWRLIEIPKQRLRAMQQKILREILDLVPAHSAAHGFRRGHSCVTHAALHVNQRVVIRMDLKDFFPSIPASRVHAMFVKLGYSQSVAGALARLCVNRTPAGAAAAVDISWAERQALRSPHLPQGSPCSPALANACAFRLDIRLQALAASMGAVYSRYADDLVFSGDAQLARALDRFHVRVAAIALGEGFRVNTRKTRMMGAGVRQQVTGIVVNCRPNIARDEYDALKATLTNCVRHGPASQNRIGHDNFRAYLEGRVAHVHMVNPARAERLRNLCAAIVWP

SEQ ID NO: 5376 - protein, 441 aa, unidentified
  source 1..441: note = Related to NZ_CP013232.1; note = Collimonas fungivorans
MNPKTFVALALADTFLAREASLDAMLQGARWALGKKWRWIPSLCRAIHKQTGEQLHSHGRTELAALILAHEGFADAWLDSEPPQVRHFCLDPPVAAEPPAWLSALALPVLATAADLAQWLKVTPSELDWFADQWRNSQATTTALQHYHHRWIAKRSGGLRLIEIPKPHLRTMQTQVLRGLLDRIPLHQAAHGFRRGHSCVTHAALHAGKRVVIRMDLKDFFPSIPAARVHALFIKLGYPPKVAGLLSRLCTYRTPGNVLNQPGQKIPWQERQALRTRHLPQGSPCSPALANLCAYRLDMRLQALATALDARYSRYADDLVFSGESGLERAMDRFHVQVAAIALEEGFAVNARKTRMMRSGVRQQVTGIVVNRHPNIPRQEFDKLKAALTNCIRHGPASQNREGRDNYRQFLAGRVSYAQMVNPQRGKRLHRLFEQISWPGS

SEQ ID NO: 5377 - protein, 445 aa, unidentified
  source 1..445: note = Related to FOLC01000015.1; note = Collimonas sp.
MTPQTFVALALADTFLAREASVEAMQQGARRALGKKWRWIPSLCRAVYKQFGDRLHRHGRTELAALILAHQGFADAWLDSEPPQIRHFCLDLPLPAGKPAWVSALPLPALATTADLAQWLKAGPSELDWFADKWRTSPPPAAALQHYHHRWIAKRSGGLRLLEIPKPRLRTMQGQILRGLLDLLPLHPAAQGFRRGHSCVTHAARHAGKRVVIRMDLKNFFTSIPAARIHALFTGLGYPSRVAGILSRLCTHRTPGSVLNHQDPASAGALSWQERQVFRQRHLPQGSPCSPALANLCAYRLDLRLQALAASLNAGYSRYADDLAFSGDGELERAMDRFHVQVAAIALEEGFSVNTRKTRMMRSGARQQVTGIVVNRHPNIPRQEFDNLKAALTNCIRHGPASQNRDGRDNHRQFLAGRIAYVRMVNPQRGKRLQQLFDKIAWPKG

SEQ ID NO: 5378 - protein, 447 aa, unidentified
  source 1..447: note = Related to PDBX01000001.1; note = Collimonas sp.
MTPKTFVALALADTFLAHDASTNALIAGARRALGKKWRWIPSLFRTILKQHGEQLHCLGRSELAALILAHDGFSDAWQESSPPQIRHYCLDAPLAVEQPGWLAALGLPRLASVAELAQWLQVAPLELDWFADKWRNNMPAPSALQHYHYRWLQKRSGGLRLLEIPKLRLRAMQSQILRHLLDLVPPHPAAHGFRRAHSCATHAALHAGKRVVMRMDLSNFFPSIPAARIHGLFVKLGYPANVAGVFSRLCTHRTPASVLANPDKGLRSAHVMSWQERLALRTRHLPQGSPCSPALANLCAYRLDMRLQALAVSLNASYSRYADDLVFSGDQELERAMHRFHVQVAAIALEEGFSVNTRKTRMMRSAVRQQITGIVVNSHPNIARPDFDNLKAALTNCIRHGPASQNREGRDNYRQFLAGKVAYLHMVNPQRGKRLQQLFEQIVWSAD

SEQ ID NO: 5379 - protein, 440 aa, unidentified
  source 1..440: note = Related to JACOUL010000024.1; note = Burkholderiales bacterium
MTSKTLVALALADTFLSREAGLASMVHSAAWALGKKWKWIPSLCRAIVEQAGEHFYDYSRDELAALILAHAGFSDAWQDNAPPRIKHYCLDLPIAPEKPAWLSSLALPELATIADLTQWLKLSAAELDWFADKWREQSPTARALQHYRYRWLVKKSGGLRLIEIPKQRLRSIQTHILRKLLDLVPPHSAAHGFRRAHSCVTHASLHAGKRVVVRMDLKNFFTSISYARIHAMFGKLGYSSSVAAALARLCTHRTPLGVFSEREITKTIPWQERHALRTPHLPQGSPSSPALANLCAHRLDIRLDALANSLNARYSRYADDLTFSGEYELEQAMERFSIQVAAIALEEGFSVNTRKTRLMRAGVRQQVTGLLVNRHPNTPREEFDILKATLTNCIRHDPASQNREGRENYRQYLAGRIAFVHMVNAKRGVRLKQLFEKIKW

SEQ ID NO: 5380 - protein, 446 aa, unidentified
  source 1..446: note = Related to NZ_QJKB01000006.1; note = Undibacterium pigrum
MDIPKQVALAIADALLAGECSHIALMKNMSWVLGKKWPWIPSLCPKIYLHAGPHFYHYSRHEIAAIILDDHGYYDAWRGKDKPQIKQYCLLPAIAPEKPAWLQALALPEFNNSADLARHLNLTVNELAWFADQWRQDAQAAPQLRHYHYRWLEKATGGWRLLEIPKSRLRNIQRKILQRILNQVPPHAAAQAFQQGRSSISHAAQHTGKLVVVRLDLKDFFTSIPGSRLHALFAKLGYPEKVAGTLARLCSNRTPTVIAKEKTRYLAPLSSAHLLRSPHLPQGAPTSPALANLCAYRLDMRLQALADSMQASYSRYADDLTFSGDEQFDQSLRRVIPQVAAIVLEEGFVLNYKKTRIMRASTRQQVTGIVVNRHCNIKRADYDTLKAILTNCLRSNPASQNREGHANFRAHLAGKLAYMRMINPARTAKLQALFEQIKWPDSAVMI

SEQ ID NO: 5381 - protein, 446 aa, unidentified
  source 1..446: note = Related to JAKZHX010000011.1; note = Undibacterium sp.
MDKPEQVALALADALLAGPCDPVIMMKNMRWVMGRKWPWIPALCKKIHRHTGDHFYHYSRHEVADMILADNGFDNAWFRSESPPVIRHYCLLPPVAPDRPVWLEMLNLPSLANSDELANYLNLPHGELAWFADQWRDSAPESTGLRHYRYRWLDKPTGGVRLLEMPKQRLRNIQRKILRQILDRVPPHAAAQAFRKRHSCLSHASLHTGKQVVLRLDLKDFFSSIPGSRIHSLFAKLGYPQSVAAILARLCTHRTPNTVLDEIMARQGAPWQVRHMLRSRHLPQGAPTSPALANLCAFRLDMRLHTLAASMQATYSRYADDLTFSGDEELARALQRFIIQAGAIAIEEGFSLNHKKTRIMRATGRQQVTGIVINRHCNIRRSEFDRMKAILTNCVRNGPATQNRDHHADFRVHLAGKLAHLHMINAARATKLQTIFEQINWPAKPE

SEQ ID NO: 5382 - protein, 452 aa, unidentified
  source 1..452: note = Related to JAGOHT010000005.1; note = Alphaproteobacteria bacterium
MDAKDFVALALADAWLAEPAGQDFTGRATVLFGQPHPWIPRLARRIKRQFGTTEHYDRRTALAQFIRADDGYTTAWSSYAKPRLRQYVFATPQMRLQSAWLSTAKLPPLATCGALAEWLGLTTEELAWFADTRGMNRTATGKLNHYQYQWRKKRSGQYRLIESPKERLRAIQRKILTGILNQVPPHDAAHGFRRQRSCLSFVAPHIGKDCVLRMDLCNFFGTITAARIHALFRALGYPMAPARLLTGLCTHSLPQQFIDQLHTAGIELSWAERRAYQAPHLPQGAPTSPALANLCAYGLDVRLSALVAKHGADYTRYADDIAFSGGGAFKSQAADISTFVAVVAQEEGFAVNFRKTRRMPTSQRQQLTGIILNKKPNVRRTDYDALKAILHNCQQGDPASQNRSRHPDFRAHLLGKINYVKQINPQRGTKLLTLYSEITWPENPSQTAPEQP

SEQ ID NO: 5383 - protein, 448 aa, unidentified
  source 1..448: note = Related to NZ_JONR01000045.1; note = Nevskia soli
MTPRDQVAEGLADALLAGPSSVDDLAARAAEALGRKHRWIRPFARRVFKRFGAALAHAQRGELIGFIQTDPGYCKAWKAAGKLRIRRYFFGVPSMGPRPGALARCVLPELPTSADLAAWLGITIPELEWYADLRGMIGSSDGALCHYHYKWIPKRHGDYRLIESPKPRLSAIQTRILREILDLIPTHEAAHGFRRGRSCLTYVAPHVGKLVVLRMDLHNFFGSIPFARINALFKTLGYPEETAKYLAGLCTNRLPARVALKIPGADPGFVLPWPECKKLNERHLPQGAPTSPALANLCALHLDFRLAALASKVNADYTRYADDLAFSGNEGVRRKIGDLSTTIAAIALAEGFEVNFRKTRAMHKSDRQILTGIVVNERVNMQRNEYDRLKATLYNCLRFDPDSQNREGHRDFQAHLLGRVNHLKNLNQRRGAKLQALLERVEWQAGAG

SEQ ID NO: 5384 - protein, 445 aa, unidentified
  source 1..445: note = Betaproteobacteria bacterium; note = Related to JAEUMY010000023.1
MTSKSRKHFVACGLADALLAGPPGITEFEARAKQALGRKPRWVLPLCKRIFARFGSGLGTQQRAKLIEFIETDQGYLDAWLADTKPRIRHYFLATNSMAPRVGALALCPLPNIPTSVDLAAWLDISIEDLEWFADVRHMVKAPGPLCHYHFRWLPKRSGGWRLVEIPKQRLRDLQRKILREVLDPVMPHDAAHGFRRGRSCLTNAAPHCGKDVVLRMDLLNFFTSIPASRIHALFTTLGYPDPVAKRLTGLCTCEVTTRMLPALPAGAEPLPWAMRKRYAERHLPQGAPTSPALANLCALHLDFRLAGLAESLGGAYTRYADDLAISGGEPLRRRVGAITSLLSAIAREQKFDINHRKTRVMHRSDRQRLTGVVVNEKPNVSRAEFDQLKAVLHNCVVHGPQSQNRMGHPNFREHLRGRVSYVAGLNGARGERLRLAFEEIDWAR

SEQ ID NO: 5385 - protein, 443 aa, unidentified
  source 1..443: note = Related to NATR01000129.1; note = gamma proteobacterium symbiont of Ctena orbiculata
MGNGLSSLATNLRLLALSVLAGAWDKPGLIERLEQALEYSPTDAAQLASRLLFHYEAGQPPSRQRLMAFLANEVSLQQRFASPDAKPPRLVLDPPRMGRPPERLITLPLPPLETRKDLAEWLGLFDHELAWFADLERRQCKVKESKLHHYRYQWIEKRSGKLRLIEIPKPRIKAIQRRILREILNRVPPHPAAHGFCRGRSCRSFVASHLGKPVLLRMDLKDFFHSVPIARIGALFRRVGYPAHVAWLLQGLTTHSTSPALAGEAFERLPWQRRKHLIDKHLPQGAPSFPALANLCAWRFDCRLQGVAERFGLDYTRYADDLAFSGDRNLLRLAPFLKGLIGAIAIEEGFEINHRKTRLRTQAQSQRLAGMVINQQPNLPREEFDRLKAILYNCTRWGPESQNREGVEDFRAHLEGRVAYALWLNPEKGRRLKDLWRYIQWSE

SEQ ID NO: 5386 - protein, 347 aa, unidentified
  source 1..347: note = Related to NZ_MARB01000009.1; note = Candidatus Thiodiazotropha endolucinida
MGRPPDKLLTFPLPSLSTVKDLQQWLGLFDHELAWFADRERRQCKVTESRLHHYRYQWIEKRSGPPRLIEIPKTRLKMLQRQILREILNRVPPHPCAKGFVRGRSIKHFVEPHLGKEVVLRMDLKDFFHTVPVYRIGAMFHRLGYPWSVAYLLQGLCTHTSSALLAGDTFNALPWAMQKRLRDKHLPQGAPTSPTLANLAAFRFDCRLQGVANRFSLDYTRYADDLAFSGARELLRLAPFLQGLIGAITIEEGFEINHRKTRVQTQAQSQRLGGMVINQRPNLPREEFDRLKAILHNCVRWGPESQNREGVDDFKAHLGGRVAYAVWLNPEKGKRLRQLWKRIQWLD

SEQ ID NO: 5387 - protein, 433 aa, unidentified
  source 1..433: note = Gammaproteobacteria bacterium; note = Related to JAGRGZ010000050.1
MRRLMLSIQFGRWDRESLGDRLRRALDGGPPDPDRLAARLLFQFPPGHPPSRSQLAGLLAADRELAAASQSGGKGFEARIVLDTSVMQAPTGHFSTLPLPTLDHARDLGLWLGLNQRELAWFADCESRQTSVRNPKLHHYRYRWLARRSAPPRLLEIPKARLKLMQRQVLHHLLDCVPPHPAAHGFRRHRSCLSFATPHLQKPAVLHMDLEDFFPSIPAPRVGALFRRLGYPPGVARVLQGLCTHAVAPALVGAEFDALPWETRRRLQAPHLAQGAPSSPAIANLCAWRLDCRLQGLADRFELDYTRYADDLAFSGPASLLRRGPFVQALIGAIAAEEGFRINHRKTRLNTQAQSQRLAGVVVNQRPNLQRRDYDRLKATLHNCARFGPEGQNHEGRQDFRAHLAGRIAHVAWLNPDRGARLKALWARISWPD

SEQ ID NO: 5388 - protein, 451 aa, unidentified
  source 1..451: note = Gammaproteobacteria bacterium; note = Related to JAGRGX010000033.1
MPTHRTKIRRLTQALSTGLWQKDTIADRASRALHGGPPDPRRLTARLLLQFGDAQHPPPAELEAFLRHDHEVASALRSITDNNTPALLLDPSTMQPQRHRISLPLPVLDTVRDLQQWLGVSAGELAWFADCDGRQAKSTTQRLHHYRYRWAEKRRGGWRLIEQPKSRLKAIQRQVLREILDRVPPHPAAHGFRRGRSCLSFVAPHCGRPLLLRLDLRDYFTRVPVARIGATFRRLGYPAAVAHTLQGLCTHAMSASLADPPAGAVDWQQRQYLRSKHLPQGAPTSPALANLCSWHLDARLSGLAHRYGLAYTRYADDLAFSGTDALRHDAPFLRDLIAAIALEEGFRINHRKTRLVTAAQRQRLTGIVINAHPNPPRSEFDRLRATLFNCVRYGPQSQNRDARTDFAAYLAGKLAYVTQLNPNKAVRLHRLWRQIDWQEYDGTSTMHDDGS

SEQ ID NO: 5389 - protein, 382 aa, unidentified
  source 1..382: note = Gammaproteobacteria bacterium; note = Related to JAGRGY010000021.1
MEAMLAGDAEVRAALDRSDDPDLPAILLDPPVMHPPADRRISLPLPRIETWRDLRQWLGVFDGELAWFADREGRQADVVEPRLHHYRYRWLAKPAGGWRLIEQPKTRLKAIQRQILRGVLDRVPPHPAAHGFRRGHSCRSHAAVHTGRAVVLRMDLQHFFTSVPVARIGAMFRRLGYPAGVAHLLQSLCTHCLSPPLAAAPDGALNWEQRQRLRAKHLPQGAPTSPALANLCAWRLDCRLDGLARRFGLDYSRYADDLAFSGPHGLVANVDFIEGMVGAIALEEGFRVNHRKTHLATRSQCQRLTGIVVNARPNLDRRAFDRLRATLHNCARYGPAGQNRDGVADFRAHLAGRLAYARWLNPDKARRLERLWRQIDWPSDGD

SEQ ID NO: 5390 - protein, 435 aa, unidentified
  source 1..435: note = Alphaproteobacteria bacterium; note = Related to SCTB01000034.1
MPRKFKQAEWLASSVCTGAWERAAVAERLARALPADGPDPVALAASIRNRFYEDGPPNLKALTLFLIDHPLLQPVFQKGGIRGLLLDPPVMGRRQDNLAPLQLPELPTLRDVGLWLCLSDAEISWFADTRLRQGRVTEEKLHHYRYLWIPKRSGGIRLIETPKVRLKEIQRMIVSRILRHVPPHDSAHGFTRGRSIKTFAAPHLRQQVVLRLDLKDFFHSVPVARIAALFRRLGYPPNAARVLQGFCTNSVSPSLAGKPFTRLSWHDRKRLQGRHLPQGAPTSAQLANLCAWGLDCRLKGLADHYGYQYTRYADDLAFSGPSSLAGRARFIEALTGAIAQEEGFSLNHRKTRLRLASQRQRLAGVVVNERVNCSRADWDRLKATLHNCVKHGPESQNHDKHPDFKAHLKGRVTHAAWLNPSRGGKLQFLFNQIVW

SEQ ID NO: 5391 - protein, 421 aa, unidentified
  source 1..421: note = Related to WGNE01000059.1; note = Alphaproteobacteria bacterium
MHAGAWDRAALAERLAKVLPAGAPDPARLAARIYRRFGEGPPPSVTALAAFMREEKLLEPLFEGKGIRGPSLEPYAMGRRPDLLAAVPLPDLPTLRDVGRWLGLSDEEVSWFADVRFRQDKLTEPKLHHYHYSWIPKRSGGLRLIEMPKFRLKEIQRRIVREILGRIPPHDCAHGFTRGRSIRTFAEPHTGQYAVLRLDLKDFFHSVPIARIAALFRSLGYPPKIARVLQGLCTNAISPPLAGKPFEKLPWHERKALQDKHLPQGAPSSAPLANLCAWRLDCRLEGLAIRYGYRYTRYADDLALSGPSSLARRAEFIEALVGAIATEEGFCLNYRKTRLRLSSQRQRLAGVVVNEKANCGRAEWDRLKATLHNCAKHGPEGQNRGNHPAFKSHLEGRVAHFAWLNPARGEKLKSLLGRIVW

SEQ ID NO: 5392 - protein, 438 aa, unidentified
  source 1..438: note = Pseudomonadales bacterium; note = Related to PBDO01000002.1
MTNSVRARRLALSIIDGEWTQPAVTDRLRRVLELHPQDIKQLAARLCFLYEQPPASFKRLATLLLNEPLLEYFWQHAAQQDIPGILLDTPQMQPPPANLRCFPLPRLDTLKDVALWLAVQPRELDWLADINGRQAQVVEPRLHHYRYRWVNKRSGGQRLIEIPKSQLKRIQRLILHDILDRILPHDAAHGFVRNRSCASYVAAHVGQPVILHLDLKDFFHSVPITKVLAFFRTLGYPAAVARTLMGLCSHGVSPSLAGKPFADQSWQRRRQLRHPHLPQGAPTSGALANFSAYRLDCRLAGLARRYGLRYSRYADDLVFSGPETLRPQAAWIESVTGAIALEEGFCLNHRKTRVRSQSQSQRITGLVINEKINISRTDYDQLKATLHNCVRHGSESQNRCAHPDFRAHLAGRIAHVTHINPQRGKKLQQLFNAVHWED

SEQ ID NO: 5393 - protein, 456 aa, unidentified
  source 1..456: note = Related to NZ_AONC01000057.1; note = Imhoffiella purpurea
MNTLRRDIQTLAASLLAGRWALPDLTDRLQRALHWPHPPASLLAARLLRDLGEHHAPEARTLASWLLQDALLLAHLERGSDARPHIEWLLDAHVMEAQPPAMAADVPQLPTTGDLADWLRISPGELGWFSDLWCSQARASREPLRHYRYQWRHREDRPRLIEIPKPRLKRLQRRVLHEILDPPQPHPAAHGFRAGRSCLTYARPHTGQPVVARMDLRDFFQSVPIRRVTAFFRCLGYPAPVARVLRGLCTHGVSRDVLTRAGLDLPWERRQRLASPHLPQGAPTSPALANLCCYRLDCRLTGLADKLGLRYTRYADDLAFSGAESLRHGFERFHILVARIALEEGFELNTRKTRLMTAAQRQSLTGILVNAHPNLPRREYDSLKAILHNCIRTGPAAQNRAGLPDFRGHLRGRIAYLAQINPDRGARLLRLWEAIEWPDRRATDSADAETAGRRAR

SEQ ID NO: 5394 - protein, 447 aa, unidentified
  source 1..447: note = Related to JAAIJQ010000073.1; note = Thiorhodococcus minor
MSRLRRDLRTLSASLLAGRWARPDLSDRIQRALEWTHAPASQLAARLTRDLGDHHPPQAQRLEDWLRQDSTLVARLERGSDHHPQVRWLLDAPVMEAQPAALAARVPQLPTIGDLAAWLRLSPGELEWLSDRWCQQSRETREPLRHYRYQWRPRAGRAPRLIEMPKPRLKRIQRRILRHILDPLQPHPAAEGFRRGRSCLTHAEAHTGQAVVVRMDLEDFFQSVPVRRVTALFRCLGYPAPVARVLRGLCTHCVSGDAWTRSGLDIPWERRQRLSSPHLPQGAPTSPALANLCCYRLDCRLTGLAARLGLRYTSYADDLAFSGAETLRHGFQRFHVLVARIALEEGFALNTRKTRLMTSAQRQILTGILVNARPNLPRPEYDLLKATLHNCIRYGPKEQNREGLPDFRGHLLGRIAHLSQVNPERGARLRRLWEEIDWSNEASEDRL

SEQ ID NO: 5395 - protein, 436 aa, unidentified
  source 1..436: note = Related to JAGRGW010000386.1; note = Gammaproteobacteria bacterium
MSQLTRNARLVALCIVDTAWNLPALTERLTIVLAGGPPDPQRLVARLLFHCEAGRSPSFQRIVDVLEADVDFVRHHADAAYHLQPGAATMQPLPDSLVTFPLPTIPTLRHLATWLGLSDRELAWFCGGHRRYTTDPNPVFHHYRYHWQDRCSGIPRLIEQPKPKLKALQREVLRNILDRVPPHDAAHGFRRHRSCLTGATPHTGQATLLRMDLQDFFTSINRARVAGVFRILGYPAAVATALAGLCTNRSVLKLSDNPIANIPWQTRKKLEAWHLPQGAPTSPALANLCAWRLDSRLTGLAAHWDANFTRYADDLALSGGRQLRKHKSHKEALIAAIVLEEGFRINHRKTRWSTSAQRQRYCGVVVNRHANVERAEYDRLKAILNNCVRHGPVEQNRAEHPDFRRHLQGRISHVAQLNPARGNKLSKLFDRIHWPQ

SEQ ID NO: 5396 - protein, 518 aa, unidentified
  source 1..518: note = Related to LUKZ01000009.1; note = Acidovorax sp.
MSAPIRALARALALALLADADSPERRSLRALAARAGHCLGHAAPEPGNPPLPEVLFEQLRRLSTVSTAEWVRLEPEDLATWLCRGFWWRKAGVRNGTAPWPLQDDGELITEDDDGDGDDPSATPWHLRTDAQLAQSFRTWAASPRTRGPLHWLLRPGTAGPAPAWMGRAPQCSAPVLATAQDLVQLLGVPLEDLLWLAPDHAHWREPQGGCALPASHYRYRLLPKPSGGLRLLEAPRPRLATAQRRILDRLLADIPVHEAAHGFVRGRSVGSHAQAHTRQAVVVRFDLADFFTHINATRVRTLWRALGHGRPAAELLTRLTTTRTPAPVRERLWEGSAPTSAQTIVQRRTTHARLAQLHLPQGAPTSPALANLCAFGLDLRLHALAQRFGARYTRYADDLVFSGPQNLQGQFGALRAWVGAIAQDEGFALRGDKTRLMPAHRRQSVTGLVVNQRPNYSREQFDILKARLHRLARLPGVDVAERARLEGEIHWAGQWLAPTRKEKLQRLFGAIRFTDAP

SEQ ID NO: 5397 - protein, 532 aa, unidentified
  source 1..532: note = Related to NZ_NOIG01000002.1; note = Acidovorax kalamii
MTLSAPIRALARALALALLADADSPDRRSLRALVARAGHCLGHAAPEPGPSPLPEVLLEQLRRLSTVSAAEWARLEPEDLANWLCRGFWWRKAGVRNGTAPWQLQDGGDLVTEGDDIGFWDPEDNDGDAPSATPWHLRTDAQLAQSFRTWAASPRTGRPLHWLLRPGTAGPPPAWMGSAPQCSVPMLATAQDLFQLLGVPLEDLLWLAPDHGHWREPQGGYALPASHYRYRLLPKTSGGLRLLEAPRPRLATAQRRILDRLLAGIPVHEAAHGFVRGRSVGSHVQVHTRQAVVVRFDLADFFTHINATRVRALWRALGHGRPAAELLTRLTTTRTPAPVRERLWEDNAPTSAQTIAQRRSTHARLAQLHLPQGAPTSPALANLCAFGLDLRLHALAQRFGARYTRYADDLVFSGPQDLQGQFGALRAWVGAIVQDEGFALRGDKTRLMPAHQRQSVTGLVVNQRPNYSREQFDILKARLHRLARLPGVDVGERARLEGEIHWAGQWLAPTRREKLLRLFGAIRFTDAAQDKG

SEQ ID NO: 5398 - protein, 529 aa, unidentified
  source 1..529: note = Related to NZ_CP035951.1; note = Acidovorax sp.
MTKTPARTRALAKALAMAVLADAREPERRTLQALAARAGACLGNNTTLADSPVPLPPPLLEQLRRLSHASGAEWARLEPEDVATWLCWGVWWRKAGLRNGSTLQSLTTTFSQQEEKDQDAWDELVGDDDENAEPALPLHQWPDPQLARAFRTWAASPRTGEPLHWLLRSATAGAHPAWMGRERTTPVLLTATDVTETLAISLDDLLWLAPEHAHWRERQDGGHALPLSHYRYRLLPKPSGGLRLLEAPRPRLASTQRRILDSLLAGVPVHEAAHGFVRGHGVGTHAQVHTQQAVVIRFDLADFFMCITATRVRALWRALGHGRPAAELLTRLTTTRTPQAIRERLLEAAPLPREAIAHRRAINTRLKQPHLPQGAPTSPALANLCAFGLDLRLNALAERFGARYTRYADDLVFSGSKALHQQWVDLRAWVTAIAQDEGFTLRADKTRVMPAHQRQYVTGLVVNERANYSRTQFDILKARLHRLGQQPQVDISERARLTGEIQWASQWLAPTRRAKLQRLLHAIRFSNEL

SEQ ID NO: 5399 - protein, 529 aa, unidentified
  source 1..529: note = Related to NZ_AFBG01000026.1; note = Acidovorax radicis
MKKISARTRALAKALAMAVLADAREPERHTLQALSARAGACLGGRTTPADSPDPLPEPLSEQLRRLSNMSDPEWARLEPEDVATWLCWGIWWRKAGVRNGSALQALTANRGQDAEEQDAWDHLADEGDEDAEPALPVHQWPDPQLARAFRTWAANVRAGETLHWLLRPAAAGPQPAWMGRDSTTPVLLTATDVTEALAISLDDLLWLAPEHAHWRERQNGGHALPLSHYRYRLLPKPSGGLRLLEAPRPCLASTQRRILDSLLAGVPVHEAAHGFVRGRSVGSHAQVHTHQAVVIRFDLADFFTSITATRVRALWRALGHGHPAAELLTRLTTTRTPQAVLDRLLEATSIPPEAIAQRHTIGARPKQPHLPQGAPTSPALANLCAFGLDLRLHALAEHFGARYTRYADDLVFSGPKALLHRQWVDFRAWVTAIAQDEGFTLRADKTRVMPAHQRQYVTGLVVNQRTNYSRTQFDTLKARLHRLAQQPPVNISERARLAGEIQWASQWLAPTRSAKLQRLPHAIRFSNEA

SEQ ID NO: 5400 - protein, 506 aa, unidentified
  source 1..506: note = Related to JAHUWH010000023.1; note = Acidovorax sp.
MAVLTDAQGGPERRTPHALAARAMACLGTPAAQDAILPDSLTEQIRRLSLVSALEWARLELDDVATWLCWGRWWRKAGVRNPHAVHSEPEIDDDATFLFDMSEDEEAHEQGSADVPLALWAPQDLARAFREWAASPRSGAHLRWLLRPATTGPQPAWMDHAPGFALLATAADVTQALTLSREDLQWLAPEHAHWREHHNSGLALPPSHYRYRLLAKPSGGLRLLEAPRPRLAQAQRRILDKLLASVPVHEAAHGFVRGRGVGSHAVAHAHQAVVIRFDLADFFTSINATRVQALWKALGHGRSAAQLLTRLTTARTPSAVRERLLEALGSSSAHLAQRRALNQRLSRAHLPQGAPTSPALANLCAFRLDVRLQALAQRFGANYTRYADDMVFSGPRALRGQFAALQSWVSAIAQDEGFTLRADKTRVMPAHQRQYVTGLVVNERVNYSRAQFDKLKAQLHRLSQQPRVAASERSRVAGEIQWASQWLATTRAAKLKRLFDTIRFSP

SEQ ID NO: 5401 - protein, 534 aa, unidentified
  source 1..534: note = Related to AKJX01000004.1; note = Acidovorax sp.
MKTPVRSRVLAKAISMAVLADAQTPEHRTPQALVARVQASLGLEPAAGSPLPAFLLEQLQRLSAMSSPEWARWEPEDVAAWLCWGRWWRSAGLRWGTEHSGAGVEDGASAWDGDDEDIAEPDGDGEGDDILPGLPPTDWTAPRLGQAFRIWTATARSAVPRRWLLRPAGAGPLPAWMDRGTTVPVLATATDVAQVLAVSVEDLLWLAPQGAFWRERHSEGHSLPASHYRYRLLPKPSGGLRLLESPRPRLVHAQRRILYTLLANIPTHEAAHGFVRGRSVGSHARIHTGQAVVIRFDLADFFTQIHATRVRALWRALGHGRAAAELLTQLTTARTPAGVRDRLLESMPELPTSIAQRRATAQRLARPHLPQGAPTSPALANLCAFGLDVRLQALAQRFGANYTRYADDLVFSGPDMLRRQFIALRAWVAAIAQDEGFALRADKTRVMPAHQRQFVTGLVVNQRANYSRVQFDTLKARLHRLAQQAQVDAGERARLEGEIRWASQWLAPARTAKLQRLLAAIRFGSMDSGLAAKG

SEQ ID NO: 5402 - protein, 533 aa, unidentified
  source 1..533: note = Related to JACHLK010000020.1; note = Acidovorax soli
MKTPVRSRVLAKAIAMAVLADAQTPGHRTPQALVARVQACLGLEATAGPTLPACVLEQLRRLSAMPSLEWSRWEPEDVATWLCWGHWWRSAGLRQGGLPWAAGHGDAPTWEGDGDDFAEPEGEGDGGGTLPGLPPTDWTAPRLAQAFRIWAATARTAVPRRWLLRPAEAGPPPAWMERSTAPPLLATAADVAQMLAVSLDDLSWLASQGAFWRERHATGHALPPSHYRYRLLPKPSGGLRLLESPRPRLMHAQRRILDTLLAAIPLHEAAHGFVRGRSVGSHAQVHTGQAVVIRFDLADFFTQIHATRVRALWRALGHGRAAAELLTRLSTTPTPAGVRERLLECMPEVPAFVAQRRAMAQRLARPHLPQGAPTSPALANLCAFGLDVRLQALAQRFGANYTRYADDLVFSGPETLRRQFIALRAWVAAIAQDEGFALRADKTRVMPAHQRQTVTGLVVNQRANYSRTQFDTLKARLHRLAQQAWVEAGDRAQLEGEIRWASQWLAPARAARLQRLFDAIRFAPVDGEAAAKD

SEQ ID NO: 5403 - protein, 524 aa, unidentified
  source 1..524: note = Related to JAFKGX010000054.1; note = Comamonadaceae bacterium
MHVHVHARVLAKAIALAVLADAQAPQRRTVEALRARVQACLGHAPGEEQRPLPAPLQEQLRRLATLPTREWARLGAEDIGTWLREGFWRRMAGVRTGAPSARGARVPDDSFDEEDNDTDDDGMPAAPPSQWTARALAEAFRQWASHVTPKRWLLRSATTGPLPAWRDSDGARAGPLLATAADLAGALAVSLEDLLWLAPEHVHWRERQPDGGHAMAPSHYRYRLLPKPSGGLRLLEAPRPRLAQAQRRILDLLLAPIPVHEAAHGFVRGCGVGSHAQVHAGQAVVIRFDLADFFTHIHATRVRALWQALGHGHAASDLLTRLTTARTPAAVRERLRDACTPLGHPSSEHWHATGRHLASAHLPQGAPTSPALANLCAFGLDLRLEALARRFGARYTRYADDLVFSGPQTLLHAFVRLRAWVSAIAQDEGFALRASKTRVMPAHQRQYVTGLVVNHRVNWSRAQFDTLKARLHRLARQACVDPGERARLAGEIQWARQWLAPTRSAKLQRLFEAIRFADSGSRDG

SEQ ID NO: 5404 - protein, 527 aa, unidentified
  source 1..527: note = Related to JAGOEM010000124.1; note = Ottowia sp.
MATPSRILSKAVAMALLADAQTGAAARRPSALAARASHCLASNAGAPSGAQPLPATFLEQLRRLSQLPAREWQRLEVEDLATWLRHGRWWRQAGLVASSGPGEELDEPVGDFADEDLFFDDDDESIPDPPAPALQSNAQLAQAFRVWAAQPSVQVRRWLLRPAQPGPQPPWLDERTHGSRAAPRWATATGLAQALNLELDELLWLAPAHAHWRERAGLAMPPSHYRHRLLPKRSGGLRLLEAPLPRLAQVQRSLLDQALNPIPTHEAAHGFVRGRGVASHVAMHAGQAVVARFDLRDFFTQVHTTRVRALWRALGHSRAMAELLTGLTTTRTPSAVRERLLDAVPTVPSAAVAGALAQRRARAQALARGHLPQGAPTSPAIANLCAFGLDVRLAALAQRFGARYSRYADDLVISGNEDLRRQWPNLRAWVSAIVRDEGFALNADKTRLMTASQRQHVTGLVLNTRPNLPRAQFDVLKAQLHRLAKQAGVPLQERPRLLGQLQWARQWLVPTRAAKLQALFDAIRFAD

SEQ ID NO: 5405 - protein, 510 aa, unidentified
  source 1..510: note = Related to NZ_JADKYZ010000005.1; note = Diaphorobacter sp.
MKAANHVRHAALAVAHAWLADSDAEGGRLGHALMARAQSSLGLAPQDQPDWLRAWSLRLQNLPDPMWARLDVWRLASTLCGETSLGAACYPERRMAGLTDENATLPDPAASWNWGEEGEEDVVDWLDDEHPARAETDFEIWVERSHRRVRRWLLRPARMQVATMALHDLELPTWPDSALLAEALAISVDDLAWLARPAWQLAPRDQPHKALSASHYRHRLIPKARGGLRLLEVPKQRLAAAQQQIRVQLLERIPVHEAAHGFARGRSVLTHAATHAGQPFVCAFDLQDFFHSITAAQIRALWRTLGYPAGIATELTALTTTVTPAPVRERLLEDASVTRTQARRLALPHLAQGASSSPALANLCAFQLDLRLSALAERFGARYSRYADDLVFSGPASLQRHFAALHGWVRGIAEDEGFALHPEKTRRMPRHARQRITGVVVNDQPNLARHDYDLLRAELHQLSLQKEAVSDEVLASLRGRVAWACQLVTPARQEKLKALLIRCSAGSQTP

SEQ ID NO: 5406 - protein, 511 aa, unidentified
  source 1..511: note = Related to NZ_CP060783.1; note = Diaphorobacter aerolatus
MALAVAHAWLADSDADGGRHQRSLIARAQNCLGLASSDQPDWLVTWSLRLHHMPDPMWARLDVQRLASALVEQQSLGAACYPQWRVITQAAAEKGIPDDEEPDPHGLGIGWAEGYGEEDDDTESTNAAPNFSQWVQQERPAVRRWLLRPARMQIAAMALHDLGLPNWADSQQLAQALGIGVSDLDWLARPAWQFAPRDQHGKSLAASHYRHRLTPKARGGLRLLEVPKQQLAAVQKKIHVQLLSRIPVHEAAHGFVTGRSVLTHAALHAGQPVVCTFDLRDFFHSITAAQIRALWRSLGYPAGIAAQLTALTTTVTPAGVRERLLEDASATRSQIKRLATPHLTQGAASSPALANLCAFHLDMRLSALAERFDARYSRYADDLVFSGPDSLRRHFASLRGWVRGIAQDEGFALHPDKTRRMPDHTRQRITGVVVNEKPNLSRADYDLLRAQLYRLAAQQDPASDELLATLRGRVAWACQLVSPSRQEKLKTLLSRIPRDDAPHKMVKPIFQ

SEQ ID NO: 5407 - protein, 443 aa, unidentified
  source 1..443: note = Burkholderiales bacterium; note = Related to RDZW01000120.1
MNDRHWIARGIARALLARFRENGDFSAEGLLAQASMALNGNPPWLKRLIRPLAKLSLPTWQNFTVDTLSERLMKDARFDEAFRQVESPRIRQLFMHRATMGLRPFALQDCELPAITDDVMLAEFLKVSTEQLHWLAPELPLERLPGAGHYRYRLIPKASGGLRLLEMPKARMKAAQRQLLDKLLNRIPLHEAAHGFCAGRSVISHALMHSGQDVVIRFDLKDFFTSITAARVHAIFRTLGYPEGVSKALTTICTNRTSRMIVERLLDERGVHAGAAQRLRIPHLAQGAPSSPTLANLAAFSLDLRLSGLADKFGARYSRYADDLVFSGEKHLRADFRVFAVWVKAIIESEGFILHPDKTRCMPAHQQQRITGVVVNTKTNLSREEFDHLKARLHQCVVNGVASQNSMGHPDFKAYLQGRIAWARQLNASKAQRLQRLFDQITW

SEQ ID NO: 5408 - protein, 470 aa, unidentified
  source 1..470: note = Related to NZ_BCWR01000006.1; note = Hydrogenophaga taeniospiralis
MPPAHHRRWLATGLAHAFLADHEQPGARTPEALLARAKVCLGCEGAAPGWLASLAQAVAIRWARQGLIDTVDSLAQMLLQRPEWALDKQAFDEGDEEPSDDSANRPEPVPVGQWAVRHWLLRPARMAAPPWGLQHIDTPDLPTAADWVQWLGIEPDRLLWLTHPSQHWREGSERPHATVAHHYHHRLLPKRSGGLRLIEAPKSELKQVQRLLLDRLLAQLPTHEAAHGFVRGRGVHTHAQVHAAQPCVISFDLRDFFPSIGAARIRAFWRSWGYPEAAARMLTQLCTTRTPVAVRERLREAQALDFNAAKRLATPHLPQGAPTSPALANLCAFGLDLRLEGLAHRFGARYSRYADDLVFSGPAPLAQRFRQLHAWVGAIAADEGFALHPGKLRRALSHQQQRITGLVVNAQPNIARADYDLLRAELHHAVRSASVDAQQRAHLQGRVAWACQALAPSRVAKLQALLARIA

SEQ ID NO: 5409 - protein, 470 aa, unidentified
  source 1..470: note = Related to PHCR01000005.1; note = Betaproteobacteria bacterium HGW-Betaproteobacteria-15
MTTTQHRRWLATGLAHAFLADHEQPGARTPDALLARARACLGCEGAAPEWLVSMAQAVATRWARQGLIDTVDSLAQTLVQRPEWSAGENALDDDDETVDDTATHPEPVSVGEWTVRHWLLRPARMAALPWGLQHIDRPDLPTTEDWAQWLGITTDRLLWLTHPSQHWREGNERPHATVAHHYHHRLLPKRSGGLRLLEAPKTELKQVQRLLLHRVLAHQPAHEAAHGFVRGRSVHTHAQVHAAQPCVISFDLRDFFPSIGAARIRAFWRSCGYPEGVSQMLTQLCTTRTPAAVRERLREAKALDFQAAKRLASPHLPQGAPTSPALANLCAFGLDLRLEGLAHRFGARYSRYADDLVFSGPASLASRFRQLHAWVDAIAADEGFVLHPGKLSRRLSHQQQRITGLVVNAQPNIARQDYDQLRAELHCAARMGPVGAQQKAYLQGRVAWASQALAPARVTKLRSLLAQVQS

SEQ ID NO: 5410 - protein, 472 aa, unidentified
  source 1..472: note = Related to NZ_CP063400.1; note = Hydrogenophaga sp.
MTTSHRHGLAIGLAHALLADHERPGGLTASALLGRASACLGCEGAAPSWLRRLTQSIATRWQRHGAIDTLDTLAQALLDLPDWGALFHDDDDAEGDDTPAVNPDEDKLPLSAWRVRRWLLRPARTVPPVWGLPAIDRPDWPSASDWADGLSLTPERLAWLTHPSLHWRESSERPHQRVASHYRHALLPKRSGGLRLLEAPKPELKQAQRRLLDTCLTQLPCHEAAHGFVRGRDVHSHAAVHAGQPCVIAFDLRDFFPSIGAARIRALWRSLGYPEPTADLLTRLCTTRTPAAVRERLREDGGLHFLAAKRLARPHLPQGAPTSPSLANLCAFGLDLRLDGLAHRFGARYSRYADDLVFSGPVSLQQQFRSLQAWVKAIAADEGFVLHPGKQRQMRAHQQQRITGLVVNQHANLPREDYDRLRAELHQAARSGPVDASKQARLQGRVAWASQHLAPTRITKLKALLARVEARA

SEQ ID NO: 5411 - protein, 511 aa, unidentified
  source 1..511: note = Related to NZ_BCTF01000032.1; note = Hydrogenophaga flava
MATSDGWHTRRAIRAAPLAQDRSHPTGWLAHQVHYPHHTPRMTALHRRLGLSIGLAHAMLADHRRPGGSAAPALLARACVCLGCEDAPPPWLASLAQAVALRWQRHGPIDTLDSLAQFLAGQLECDDTEPDEDDDLAAPAINDLWSDRPPSTWRVRHWLLRPAQTAQPAAGLPAVERPDLPTEDAWAAWLGLDPQRLRWLSHPSVDWREDHHRPHRRIAAHYRHVLLPKRSGGLRLLEVPRPDLRQAQRRLLDGWLSLVPAHEAAHGFVRGRNVHSFAQVHAGQACVIRFDLQDFFPSLGAARIQAFWSAWGYPEPVARMLTRLCTTTTPAMVRERLQEAPSMDAMSLKRLARPHLPQGAPTSPALANLCAFGLDLRLDGLARRFGAVYARYADDLVFSGPQSLYREARALQAWVQAIAEDEGFALNAAKQRQMRAHQQQRVTGLVINERPNLPREDYDRLRATLHRAALSGPADPAARARLQGQVAWACQSLAPSRVAKLQALLARIAPT

SEQ ID NO: 5412 - protein, 453 aa, unidentified
  source 1..453: note = Related to NZ_CP071796.1; note = Ottowia testudinis
MAADRTPRSNAIALAHALLADAEVPGARSLTALHDRVAACLGLTAPLPPGLFQICTELAAWPEPMWRQHGLDSLADVLLQRPEWPAPPHAWQARHWLLRPARMQLAPMALAGVALPELPTHAALAAWLGTTPDDLQWLAHPSQRWRESQPTDRPHRSVAPHYRYQLLTKPGGGLRLLEMPLPRLKTLQRRLLHGLLARVPVHEAARGFVAGRGVRGHANLHAGQPCVLCFDLRDFFGSVGGGRIHALWRSLGYPEGVARTLIQLCTTRTPPAVRERMADAGSLDRPAARRLASAHLPQGAPTSPALANLSAFGLDLRLDGLAWRFGARYSRYADDLVFSGPAALRRDFRVLHAWVEAIALDEGFALNPAKTRCLPAHRQQRVTGVVVNERPNLPRADYDRLRAELHALGHQTRVPAALKPRLQGRIAWARQWLAPERAAKLQRLLERIAFDGA

SEQ ID NO: 5413 - protein, 463 aa, unidentified
  source 1..463: note = Related to NZ_CP011514.1; note = Mitsuaria sp.
MTVAAPLTYPRWIALALARALQADDESPRAREADALQARAEQCLGVESRPWLKPLCVALARWTTPVWRAHSIRSFADALLEMDAFHEGFDLERFSRPTVRRLLLRPSRMRPLPFALEHLVLPDLATEADLAAWLGLTLDELDHFAGPARRYREAVATPERPHVAPTPHYRCLLVPKRRGGLRLVEAPLPRLKAVQRRLLDGLLNTLPCHEAAHGFVPGRNVATNAAVHTGQDFVIRFDLRDFFPSIGRARIAATFRTLGFSDAVVERLTTLCTARTPAPVRERLREDGSIDFDGAKRLASPHLPQGAPTSPALANLCAFPLDMRLDGLAHRFGARYTRYADDLVFSGPATLRRDQREFRAWVQAIVEDEGFRLRRDKTRAMPAGGRQQVTGVVVNEKPNLAREDFDRLKAELHRLVGSTDVDPAQRSVLLGRLAWARQFLAPMRVEKLQRMFDAIAFGAAKNL

SEQ ID NO: 5414 - protein, 463 aa, unidentified
  source 1..463: note = Related to FOZE01000001.1; note = Mitsuaria sp.
MSLAAPLTYPRWIALALARALQTDDDAPRGREAHALQARAEQCLGAEARPWLTPLCAELARWARPVWLAHSMASLADALQALEAFHAGFDPERPRPTVRRLLLRPSRLRPPPLALASLVLPDWSTEADLAAWLGLTLDELDHFAGPARQYRERTATPRRPHAHPTPHYRGLLVPKRRGGLRLIEAPMPRLKAVQRRLLDDFLQPLPCHEAAHGFVRGRNVATHAAGHAGQDFVIRFDLRDFFPSIGRARVSATLRTLGLPDAVVERLVLLCLTRTPAPLRERLREDGSIDADGARRLASFHLPQGAPTSPALANLCAFPMDLRLDGLAQRFGARYTRYADDLVFSGPASLRRDQRALRAWVTAIVEDEGFRLRRDKTRAMPAGGRQSVTGVVVNTRPNLARERYDGLKAELHQLGLRSRSAPVDPALRGPLLGRLAWARQFLAPSRVEKLTRMLAAIQFNADR

SEQ ID NO: 5415 - protein, 460 aa, unidentified
  source 1..460: note = Related to NZ_BCYP01000018.1; note = Mitsuaria chitosanitabida
MSHATPLTYTRWIALALARALQTDDETPGGRGARALQARAEQCLGVEARLWLRPLCVVLARWPDPVWRAHSVRSLADELQDTSAFLDGFDAALHPRPRVHRVLLRPSRRRPLPFALEHLSLPDWQTEAELAAWLGLSGEELDHFAGPSQRYRETVATPRRPHIAATRHYRCLLIPKRRGGLRLIEAPMPRLRALQRRLLDGLLHALPCHEAAHGFVPGRDVASHTACHAGQDFVIRFDLQDFFASVGRARVAAIFRTLGYSDGVVERLATLCTTRTPAMVRERLREDGALDLDGARRLAAPHLSQGAPTSPELANLSLFGLDLRLAGLAERFGASYSRYADDLVISGPATLRRDQGRLRAWVRAVIEDEGFRLRPDKTRAMPAGGRQQVTGVVVNQRPNLAREDYDRLRAELHRLAGMPRVDAALRDPLRGRLAWARQFLAATRVAKLDRMFDAIVFGEA

SEQ ID NO: 5416 - protein, 458 aa, unidentified
  source 1..458: note = Related to CP013729.1; note = Roseateles depolymerans
MTSSASLTYPRWIALALARAFQTDDDAPGGRSPQALLGRGMACVGEEHRRWLLPLCQHLASLSAPVWLGMTPRTLAEHLDQRPEFFDAWDPAGPRLQVRRLLLRPARMTPPPFALEDLPLPAWHTVADLAAGLGIDLSMLDVLAGPAQRYREAEARPHRPHVQAIRHYRAVLVPKRRGGLRLIEAPMPALKAVQRRLLRSLLDLVPVHEAAHGFVAGRNVASHAGLHAGQDWVFRFDLQDFFPGIGAARIRALFRTLGMEEAVAEYLTTLCTVRTPRAVRERLQDDGGLTWIDTRRLAAPHLPQGAPTSPQLANLCAFRLDLRLDGLAARFGAQYSRYADDLVFSGAGTPALDAVTLHAWVKAIVEEEGFRLRPDKTRLMRAGGRQTVTGLVVNETPHIARADYDRLRAEMHRLGREPAVDLSLRAPLLGRLAWARQFVAPTRAAKLQRLFDAISFVQ

SEQ ID NO: 5417 - protein, 458 aa, unidentified
  source 1..458: note = Related to JACHXO010000004.1; note = Roseateles terrae
MTPPAPLTYSRWIALSLARACQTDDDAPGGRTASALLGRATACLGAEHRAWLLPLCEQLARLSLPVWQQMTPRLLADHLELMPAFVAGFDPERPPVHVRRLLLRPSRMRPPPFALEHLPLPPWHTLADLAAGLGLELSMLEVLAGPAQRFREADPTPHRPRVQATAHYRSLLVDKRSGGLRLIEAPLPALKAVQRRLLRTLLDRVPVHEAAQGFVAGRNVAGHARMHAGQAWVFRFDLKDFFPSIGAARIRALFRTLGFTEAVADTLTTLCTVRTPRAVRERLRDEGGLSWLEARRLASAHLPQGAPTSPVLANLCAFALDLRLDGLAVRFNAQYSRYADDLVFSGPTTEGLDAVSLHAWVRAIVEDEGFVLRADKTRLMRAGGRQTVTGLVVNETPHLSRPDYDRLRAQLHRLGHEAQVPMSLRAPLLGRLAWARQFVAPSRAEKLQRLFNAIAFVQ

SEQ ID NO: 5418 - protein, 475 aa, unidentified
  source 1..475: note = Related to FOAV01000002.1; note = Roseateles sp.
MTLAAPLTYHRWIALALARAIQADDDQPQGREAHALLGRTSECLGKEHVPWLRALCQALARMTKPQWDRFTTHTLADHLESMHEFFGWAHVRGDGDPDDESEEDPDGEPFPTPRVRRLLLRPARMTARPYALEALELPVWHTLPDLANGLGIDLDMLEVLAGRAHHYRDAVATPLRPHVRATHHYRSLLVPKRREGMRLIEAPMPALKAVQRRLLDVLLARVPVHEAAHGFVTGRNVASHAAAHTGQHWVLRLDLQDFFPSIGRARIAALFRTLGYAEGVADRLTTLCTVRTPVNVRERLRDAGAIDFHGAKRLASPHLPQGAPTSPHLANLCTFSLDLRLEGLAYRFGAHYSRYADDLVFSGSRDTRLAPTALHAWVRTIVEEEGFRLRRDKTRLMRAGGRQTVTGVVVNLKPNLSRPDYDRLRAELHRLSHQAAVDGALRSPLLGRLAWAQQFVAASRAAKLRRLFGAIRFVP

SEQ ID NO: 5419 - protein, 449 aa, unidentified
  source 1..449: note = Related to JACORT010000001.1; note = Ramlibacter sp.
MTRSSSYRNWIATALAHAFLADAAQAGGRSAEALHARAVQCMGEDAPWLRALAASIATEFSRRRDAHTVPTLSAWLCELPQLDDAFDPEREHPRVRRLLLRPARMVRAPCALEGLRLPRWDTPADLAAWLGVPLERLEWLVGRAQDFRETQAGRTRSAHYHPLLKAKRSGGLRLIEIPKPALKQVQQKLLSGLLDAIPTHESVHGFVRGRSAISHAREHAGRAVVIAFDLRDFFNSIGVARVRALWRTLGYAEGVAEALARLTTTRTPLAVRERLVEAGGIDFMAAKRLASRHLPQGAPTSPALANLCAFGLDLRLDGLAWRFGAHYSRYADDIVFSGPRELAARSRNLQAWVEAIVRAEGFTLHPGKTRRMRAHHRQQVTGVVVNERPNVARDAYDRLRARLHSCAASGCDAETWMQLQGQVGWACQLVAASRAEKLQRMLAAVPVRR

SEQ ID NO: 5420 - protein, 450 aa, unidentified
  source 1..450: note = Related to RKMB01000020.1; note = Ramlibacter sp.
MTHSYRHWIATGLAHALMADADQPGGQSAQALQARAQQCMGTRGTWLKPLAEAVAREFARNPRHHTVATLADHIFELPQFDAAFAPGQPRPRVRRLLLRTARMAAPPFELAGLELPSLPTLTDLAAWLDVSLERLQWLIAPSQNFRETEPAPGRANVPPGLHYHALLKPKRSDGLRLIEIPKPDLKRVQRRLLSGLLDRIPVHECVHGFSKGRSVLTHAAEHTGQAVVICHDLRDFFNSIGIARIRALWRTLGYPEGVSAALAALCTARTPRAVRERLLECGSIDRRGAARLASPHLPQGAPTSPALANLCGFALDLRLDGLAWRFGARYSRYADDLAFSGPADLMPRRRNLQAWVQAIAHAEGFALHPDKTRAMPSHRRQRLTGVVVNERPNLERCAYDRLRAQLHALAALGCDEATRMRLQGQVSWASQLVCGSRARKLDRLLAAISS

SEQ ID NO: 5421 - protein, 466 aa, unidentified
  source 1..466: note = Related to JAHBZO010000019.1; note = Ramlibacter sp.
MPKPNHSYRRWVATGLAHALLADAHKPGGATSQALHARAIQCLGADHPWLLPLIAAMGPHSVGQWRRHSVASLAEYIDQLPAFDAAFLGQDSHPHIRRLLLRPDRMLAPPFELAQLGLPRLASHADLAQWLGISPERLQWLIEPAQNFRESEAAPGQPHCHPGRHYRQLLKQKNSGGLRLVEAPKSELKRVQKRLLSGLLNKIPVHEKVHGFVRGRGVLTHASEHAGRHTVLAFDLSDFFSSIGVARIKALWQTLGYPEAVARALAALCTTRTPLAVRQRLMDAGGINFFQQRRLASAHLPQGAPTSPALANLCAFMLDLRLDGLAWRFGANYSRYADDLVFSGSELLARDQRKLTGWVAAIVEAEGFRVHPRKTRVLLKYGRQRVTGVVVNTRPNLGRDDYDRLRAELHRLAGADRLDKGVKQRMWGRISWACQTVCASRAAKLYRLFEALPNDHQGAGYDASTS

SEQ ID NO: 5422 - protein, 455 aa, unidentified
  source 1..455: note = Related to NZ_JABRWJ010000001.1; note = Aquabacterium terrae
MPASSTYRQWLARALAHALLADALLPGGCLRDALLARAASTLGKRPAWLAGLVDALLPFDPLREDVQALGRRIAVLPAFDPAFDAEHPPRIRHLILRPATMLRRPLGLHELELPALATHADLASWLGLDSEQLAWLAAPARAWRPPGAGGRAAATHYRCLLMPKRSGGLRLIEAPMATLKAVQRHLLDGLLDHVPAHEAAMGYVSGRSVIDHAAAHAGRAVVLRFDLRDFFNSIPASRVHALWHTLGYPDGAARTLTALTTARTPVALRERLQDDGGLDVLGAKRLASAHLPQGAPTSPALANLCCFRLDLRLNGLAKRFDASYTRYADDLVISGPAACAKRRRELQAWVEAIVRDEGFALQPRKTLTMPAHQRQQVAGIVVNAHPNLDRASFDRLKARLHRCTRDGPSPADDPQQLRGQLAWVTQLNPARGAKLQKLFEGIRWLNVAPSSTPVR

SEQ ID NO: 5423 - protein, 474 aa, unidentified
  source 1..474: note = Related to NZ_CP045644.1; note = Variovorax paradoxus
MPPPPSSIGLITFMTRELSYREWLSRSLARALLADARQPGGTAPDALHARAAATLGTDAAWLKPLAEVLGKRSQATWQRTDLPALAKAIHDMPELDLAFAQDELPHVRRIILRPAQMLPRPLGLDHFALPEVPTLADLARWLELEPDRLAWLTSATQVFREPDASSPCPASHYRYQLQPKRLGGLRLLEIPKADLKRAQRRILDDLLQHVPVHEAAHGFVQGRSVASHAAAHAGKDVVIGFDLRDFFPSVRASRVHAMWRTLGYPEGVARALTALCTHRTDSAVIERLRDDGGLDWLGAKRLAAPHLPQGSPCSPALANLCAFRLDLRLEGLAWVFGATYTRYADDLVFSGPATLRAQFTALRAWVSGIAADEGFALHPRKVRCMPQHRQQRVTGVVVNDKANAPREDFDRLKAVLHRCVMHGPAAQNHAKLDDFRGHLLGHIAWIGQFSPTRKVRLMRLFDRIDWPDAAQPPS

SEQ ID NO: 5424 - protein, 462 aa, unidentified
  source 1..462: note = Related to NZ_CP046508.1; note = Variovorax sp.
MTTREPSYREWIARGLAHALLADARQPGGTTPDALRARAEAALGANPPWLTLLAEDLGKRSLATWERTDLPGLTQAILETPALELAFEQDEPPRIRRLILRPADMFPRPMGLDHFALPRLPTFANLAQWLEIEPDRLAWLTAASQAFRAPDASSPRPASHYRYQLQPKRLGGLRLLEIPKADLKRLQRRILDDLLQRVPAHEAAHGFVQERSVASHAAAHVGQEVVIGFDLRDFFPSVRASRVHALWRTLGYPDGVARALTALCTHRTSAAVIERLRDDGGLDWMGAKRLAEPHLPQGSPCSPALANLCAFRLDLRLEGLAWAFGATYTRYADDLVFSGPATLREQFNALRAWVDGIAADEGFALHPRKVRCMPRHHQQRVTGVIVNEKANTPRVDFDRLKAVLHQCVLHGPASQNRAKVTDFRGHLLGHIAWIGQFNPARKARLMRLFERIEWPAVSQPPG

SEQ ID NO: 5425 - protein, 502 aa, unidentified
  source 1..502: note = Related to NZ_RXFT01000006.1; note = Variovorax guangxiensis
MASHSGAQAALRIRADQLAHHRLVEGPGATTFIGFAASGFMTRELSYREWIARSLARALLADAKQPGGTDPGALRARAAATLGADAPWLKPLAQALGNRSQATWRRTDLPALARAIHDMPEFDAAFEQNEPPRVRRIILRPAQMLPRPMGLDHFALPHIPTLAELAQWLELDADRLAWLTSAAQAFRAPTDPDTRQPASHYRYQLQPKRLGGMRLLEIPKADLKRAQRRILDDLLRHVPAHEAVHGFVLGRSVASHAAAHAGKEVVIGFDLRDFFPGIRASRVHATWRTLGYPEGVARALTALCTHRTDDAVIERLRDDGGLDWIGARRLAAPHLPQGSPCSPALANLCAFRLDLRLEGLAWVFGASYTRYADDLVFSGPASLRAQFNALRAWVSGIAADEGFELHPRKIRCMPRHRQQRVTGVVVNDKANTPREDFDRLKAVLHRCATQGPASQNRAKVDDFRGHLLGSIAWIGQFSATRKTRLMRLFDRIDWTDATQTPS

SEQ ID NO: 5426 - protein, 454 aa, unidentified
  source 1..454: note = Related to FOLP01000001.1; note = Variovorax sp.
MSRSLARALLADARQPGGTAPGALRARAAATLGADAPWLKAFAEALGQRSQATWQRTDLPALARAIDDMPAFDAAFAQDEAPRVRRIILRSAEMFPRPLGLDHFALPRIPTLAELAQWLELDAERLAWLTSPAQALRTSHEHDAPGTAPASHYRYQLQPKRLGGLRLLEIPKADLKRARRRILDDLLQHVPVHEAAHGFVQGRSVASHAAAHAAKEVVIGFDLRDFFPAVRASRVHATWRTLGYPDGVARALTALCTHRTGAAVIERLRDDGGLDWMGAKRLAAPHLPQGSPCSPALANLCAFRLDLRLEGLAWVFGATYTRYADDLVFSGPASLRARFTALRTWVGGIAADEGFELHPRKVRCMPQHRQQRVTGVVVNDKANAPREEFDRLKATLHRCALHGPAGQNRAQVPDFRAHLLGRMAWVGQFNPARHARLLRIFERIAWPSASPTPS

SEQ ID NO: 5427 - protein, 460 aa, unidentified
  source 1..460: note = Related to FOWG01000009.1; note = Variovorax sp.
MTREPNYREWIARSLARALLADARQPGGTAPGALRARAAATLGSDAPWLAPLIEALARRSPATWRRTDLPALAQAIHDLPEFDAAFEQDEPPRVRRIILRPAQMFPRPLGLDHLALPALPTQAELARWLDLDPQRLEWLASPAQAFRTPQGTSPAPARHYRYQLQPKRLGGLRLLEIPRPELKRAQRGILDALLARVPVHEAAHGFVPGRSVASHAAAHAGKAVVIGFDLRDFFAGVRASRVHATWRTLGYPDGVARTLTALCTHRTDAAVIERLRDDGGLDLMGGKRLAEAHLPQGSPCSPALANLCAFRLDLRLEGLAWVFGATYTRYADDLVFSGDESLRLRFDALRAWVGGIAADEGFELHPRKLRCMPRHRQQRVTGVVVNDRPNAPRADFDRLRALLHQCTLHGPASQNAAGLADFRGHLLGRIAWFGQFSPTRQARLRRLFDRIEWPAGAAPA

SEQ ID NO: 5428 - protein, 474 aa, unidentified
  source 1..474: note = Related to FPBM01000001.1; note = Polaromonas sp.
MRETRFRHLIARGLARALLADAGKPGGTALPALQARAAAALGQRPAWLRELLQPLTLLSPITWQKFDITSLARRLEDSPAFGLAFGDEDDDEDEDGEADSSEPQASQAIDDRDDPEPERPPRIRRLILRPPAMRPRPLGLQACTLPDITTDADLARWLQLSREQLRWLAPATRPVVEHYRYSLQAKQAGGLRLLETPKVELKRVQRHILHALLSEVPVHEAAHGFTAGRSVKTHAAAHVGQAVVIRFDLRDFFGSIGAAQVNAVWRTLGYPEGVARSLTALCTHHTAGMVIERLRDDGGLDWMGAKRLASAHLPQGAPTSPALANLCAFNLDLRLEGLAWVFGASYTRYADDLVFSGPASLRLQFRALHAWVAEIVRDEGFALHPDKTRCLPRHQRQRVTGVVVNVRPNVPRDDFDRLKACLHQSALHGQASQNKERLADFRSHLLGRIGWVGQFSMTRQARLMRLFDKIDWAN

SEQ ID NO: 5429 - protein, 462 aa, unidentified
  source 1..462: note = Related to FNJA01000002.1; note = Rhodoferax sp.
MRDISYRTWIARSLARAMLADSDQPGGTSAAALQARAAATLGDNPAWLHTVVAPLAQLPAVSWQKMDLDSLTQRILAPAPRQPTVVDDENDDEEIQAESPFDAAFANGARPHIRRLILRPASMQPRPLGLEGCELPDLPTVHDLAEWLKMPLDRLAWLGPETPLGAEHYRYKLLPKRTGGLRLLEIPKVDLKQVQRAVYSGLLQHVPVHEAAHGFVPGRSVATHAAMHAGQAVVIRFDLRDFFGGIGAARVMALWRTLGYPIGVARCLTALCTHRTARMVVDRLRDDGGLDWLGAKRLRSAHLPQGAPTSPTLANLCAFGLDLRLDGLAWAFGARYTRYADDLVFSGPAALRPQFRALQAWVAAIAEDEGFALHPAKNRCLPQHRQQRITGVVVNAQPNTPRQDFDRLKACLHQCVHQGPASQNHANLVDFRGHLQGRIGWVGQFNAARAAKLMGLFEQIRW

SEQ ID NO: 5430 - protein, 452 aa, unidentified
  source 1..452: note = Burkholderiales bacterium; note = Related to JACRAZ010000105.1
MPPSTHRLWIARGLAHALQADCQQPGGTEAHALLARATRALGHRPPWLPPVIEALGAAAVRRLDLQGLSERIAGLPAFDAAFAPGQPAPRIRRLMLRPPHMAGAPLGLHEAPLPALTTHEALGDWLGLAPERLAWLVSEAQHYREPPGGRPGAARHYHALLRPKRLGGLRLIEAPKAELKLAQRRLLDGLLNAVPVHEAAQGFVPGRSVRAHAQAHAGAPVVLRFDLQDFFPSVPASRVHAIWRTLGYPAGVARALTALCTTRTPAAVRARLREAGAIDGGGAQRLAAAHLPQGAPTSPALANLCCFRLDLRLAGLAAHWGARYTRYADDLVFSGPAVLRERRLALTSWVGGICADEGFTLHARKTRCMPQHRQQCITGVVVNQHPNLPRDEFDRLKACLHRRLLHGATDAAEREALRGRIAWAAQLNPARGEKLLALFAQIRWPQPGSVPG

SEQ ID NO: 5431 - protein, 446 aa, unidentified
  source 1..446: note = Related to SCTQ01000267.1; note = Aquabacterium sp.
MRSWTYREWIARGIARALLAGDDRSMPALRSRAAQALGGSPPWLGHFLGRLKSMDAGIWARTDLDALTWRLLRGETLSRAVGAEDRPRIRRLMLASPVMLPPPMGLDVLGLPALPTTGDLADWLGLTVDRLDWLAGEQLDWREDARRARHYVLHASPKSAGGLRLIESPKPELKRAQRRLLAGLLDRVPVHEGCHGFVRGRGVRSHAQVHAGQALVLRLDLQDFFPCVRAAQVRAVWRTLGYPREVAEVLTRLCTTRACAADLRPLRAAGRLEWTAAKRYAARHLPQGAPTSPMLANLCAFDLDLRLDGLAQAFGGEYSRYADDLAFSFAQPLGGRQAAFHAWVAAIAKDEGWSLHPQKSRAMPAGAQQRVTGLVVNEKPRPARVDYDRLKAVLHQCTLHGPASQNHAQVEDFRAHLLGRIAWIAQGSEARARKLQALFERIAWTG

SEQ ID NO: 5432 - protein, 401 aa, unidentified
  source 1..401: note = Related to NZ_LMDI01000005.1; note = Rhizobacter sp.
MAQRCADMPGERWRRLTVRSLATWIEQDGHYDDGWRAHEKPHARRYILREAAVMQPLPVGLEQCQVPYWPHVGALADWLGVPAAGLWRLTRAPQWQRQAPLGEQHYHAQLLAKRTGGWRLLEVPAPHLMPLQRRVLDDLLDRIPPHEAAHGYTRERSARSHAAAHTGQAVVLKFDLQDFFTTVRPSRVSALFAKLGYSEEVARALTALCTTATPEPVLRRMHEAGQLTWEQLQRLRESHLPQGAPTSPALANLCAFRLDLRLDGLAFALGARYTRYADDLVFSGPTHLATARERITARITRIVVEEGFSLNTRKTRCQKAGGRQSVCHIVVNERPNLPRDEFDRLKAILHLCVRDGASRQNRDAHPDWQAHLRGRVAWATQLNPAKGLRLKRVFDRIDWGV

SEQ ID NO: 5433 - protein, 444 aa, unidentified
  source 1..444: note = Related to CP015118.1; note = Rhizobacter gummiphilus
MASLVRLTALALARALQVGQRTPDGMAARIRACLGAEASWCGPLVERCAAMAGERWRRLSVRSLADLIERDQGFHFAWIAHEPPCVRRYLLREADRMNPLPLGLDRCQVPFWPHAGALAAWLGIGTGGLWRLTRPSDWQRRTPMVEQHYRSHLRPKRTGGWRLLEVPEPYLMPLQRRVLDDLLDRIPPHEAAHGYTRERSVIDHARRHCGQAVVLRFDLKDFFTAVKASRVHALFTTLGYPEEVARALTALCTVATPEPALRRLRAEGGMDWEQVQRLRDPHLPQGAPTSPALANLCAFGLDVRLAHLATSLGARYSRYADDLVLSGPARLRTAFARIERHVSRIVIEEGFALNPRKTRCTGAGRRQTVCHVVVNDRPNLPRDEFDRLKAILHQCVRDGPATQNRENRPDWRAHLRGRVAWATQLNAAKGARLARLFERIDWAA

SEQ ID NO: 5434 - protein, 434 aa, unidentified
  source 1..434: note = Related to PTEU01000001.1; note = Ideonella sp.
MARAMQAGPRTPQGLAARMRACLGCAEHPWITALSARCARMAAERWQRLSARALAGLIERDAGFEHAWQQDPRPFVRRYILRPGGHLRTAPLGLDTVERPAWTDEAALAQGLGLSDAALWRLTLPTPWQRAAPLSQQHYAWRWQLKRHGGWRPLEVPAAYLRAAQRKLLKHLLDGIPPHEKVYGFVRGRSVIDHAQVHTGQPVVIKFDLQDFFTSIKASRVHALWTTLGYPETVATLLTRLCTVATPEPVLQRWRQEGGATWHQVLRAREPHLPQGAPTSPALANLSAFRLDLRLDGLAQAYGARYSRYADDVVISGPRALLAARGRLEAAVQGIVEAEGFALNQRKTRCETQASRQTVCHIVVNQRPNVARSEFDRLKAILHGCLREGPSAHNRAGLADWRAHLHGRVAWVAQLNPAKAKRLQAMLQHIDWAL

SEQ ID NO: 5435 - protein, 416 aa, unidentified
  source 1..416: note = Candidatus Aquabacterium excrementipullorum; note = Related to DXIO01000116.1
MHACLDNKPSWCKPLAERCAQMPRERWRRLSVRTLASLIEEDIGFAHAWLAHQKPGVRRYILRVRQGMGSLPLGLHRCQLPYWPNTGILGPWLGVSAGSMWRLTRPSAWQRRMPLGEQHYRCLLLPKRTGGWRLLEVPHPYLMRLQRQLLDHLLDRIPAHEAAHGYVRERSVVHHAQAHAGQAVILKFDLQDFFTSVRASRVHALFHTLGYPDSVARELTALCTTATPEPVLRRLHQEGQLPWHRLQQLREPHLPQGAPSSPALANLCAFRLDLRLDGLAHALDARYTRYADDIVISGGTGLRASYQRIAQWVARIASEEGFALNFRKSRCQTIGSRQTVCNIVVNQHPNLLREEFDRLKAILHNCVRHGPASQNRDAHPQWQMHLKGRLDWASQLNPGKAERLQRLYARIDWKQP

SEQ ID NO: 5436 - protein, 447 aa, unidentified
  source 1..447: note = Related to NZ_JAJNKD010000019.1; note = Ideonella azotifigens
MTSVRRFTALAMARAMMAGPPRVDGLAARLQACLGRKAAWYRSLAERVAQLPGEHWRAATPQALNRLADLVEADDSFEAAWLAHERPQVRHYFLELPGGMQPRPLGLDELELPDWPDVPALSRWLGIPAAGLWRLTLARERQRKQPLGQQHYRSQLLPKRSGGFRLLEVPEPYLMALQRKLLDAVLNRVPPHEAACGYTPGRSVLDHARAHAGQAVVLKFDLQDFFASVRHSRVHALFATLGYPAAVARALAALCTVATPEPVLHRRHQAGSLSWPQLQRLRDAHLPQGAPTSAALANLCAFRLDLRLDGLAFALGARYTRYADDLVISGGAELGGLAERVERWVGRIALEEGLALNHRKTRCQTAGRRQSVCSIVVNQRPNLPRDEFDRLKAVLHQCVTAGPAAQNREGHADWRGHLQGRVAWAAQLNPAKAAKLQGLLAQIDWAR

SEQ ID NO: 5437 - protein, 445 aa, unidentified
  source 1..445: note = Related to nan
MPSIQRVTALAIARALLAGPQEPGGLAARVRLCLGTGACDWHGELAARIAKLSALHWQYLTPRALARLVEIDPGYQHAWISDERPTAHRWILREAQGPRPAPLGLERIQRPAWPHAGALAAFLGMPIEGLWRLTLPADRQRRRPLAEQHYRCRLLAKRSGGMRLLEVPEPHLMAVQRRLLDALLDFVPPHEAAFGHARGRSVVDHAAAHAGQAVVLKFDLRDFYSSVRASRVHALFATLGYSDEVARALTALTTVATPEAVLRRLREAGSLTWEQLQRLRDPHLPQGAPTSAALANLCAFGLDLRLDGLAYALGARYTRYADDLVLSGGPELARWRDRIERWVGRIAREEGFALNHRKTRCQRSGARQTVCSIVVNAKPNLPRAEFDRLKAILHRCVVDGPAAQNRDGIERWREHLAGRIAWAAQLNAAKAARLQSLFARIDWER

SEQ ID NO: 5438 - protein, 437 aa, unidentified
  source 1..437: note = Related to JAEKKG010000289.1; note = Burkholderiales bacterium
MSHRTTAIAIARAVLATPVSRSQILERMARCTGFSEATDRALVDGLLEAGLASHWTIAQVADALGADPFFQATCQETRHRPLIRGWFMTRASTLAAPPVPLRAVERPAWPGVGHLADDLGVSAEGLWRLTRSASWQRQAPLALQHYRYELLPKRTGGWRLLEVPEPYLRTLQRRVLDRLLAHVPPHEAACAYVRGRSVADHARAHVGQAVLLKFDLQDFFATVRASRVQATFATLGYSQPVARALARLCTTATPEPVLERLRIEGGLAWTQAMRLRDAHLPQGAPTSAALANLCAFRLDVRIAALARTLGARYTRYADDIVLSGDAGLLRAADHVEARLGAFALDEGFALNHRKTRRVTRARRQQVCNIVVNARPNLPRDEFDRLKAQLHLCATRGAAAQNRAGLPDWEQHLRGRVAWAETVRAACREFWTADAGTP

SEQ ID NO: 5439 - protein, 436 aa, unidentified
  source 1..436: note = Related to JAJTWU010000010.1; note = Pelomonas sp.
MGHARMMTARALAHAMLAGAPREEALAARMAACLDARPPWLADLARAMARVPGEVWQRLDVAALGERVEAHAGFADAWVSDARPDARRWLLRSPEDLPPAPAGLARPHWPTVGTLARGLGLTPAGLWRLTLPADWQRRRPLAHQHYRQQLVPKRSEGWRLLEVPAPHLRAIQRRLLAQLLSGLPPHDAAFGYTPGRSVVEHAMRHAGQARVLRLDLSDFFSTVRAARVHALFRTLGYSAAVARALTALCTTATPEAWLRAEPRLAFLQRQRLRDPHLPQGAPTSPAVANLCAFALDARLTGLAEAFGARYSRYADDLVFSGPASLPVRTLVAWVTAIAEDEGFAVNPNKTRAQGVAQRQSVCGIVVNERPNLPRDAFDRLKATLHRCVVDGPAGQNREGHADFRAHLQGRVAWAAQLNPAKARKLQALFDRIDWRA

SEQ ID NO: 5440 - protein, 438 aa, unidentified
  source 1..438: note = Related to NZ_LMFP01000011.1; note = Pelomonas sp.
MDAARTTTARALARAMLAGPHEAGGLAARMAACLDARPPWLAALAEAMARVPGEVWRRLDVATLARRVDAHDGFAEAWFSAARPEARRWLLRAPDAPAPAPAGLERPDWPTVGALARGLGMTPAGLWRLTLPTDWQRCRPLAQQHYRQALIPKRGEGAGWRLLEVPEPHLRAVQRRLLAQLLNGLPPHDAAFGYARGRSVVQHAARHVGQGRVLRFDLGDFFSTVRAARVHALFKTLGYSTAVARALTALCTTATPEAWLRAEPRLGWLQRQRLRDPHLPQGAPTSPAVANLCAFALDARLTGLAERFGARYSRYADDLVISGPAALPVRSVGAWVAAIAEDEGFVVNPRKTRSLGIAQRQSVCGIVVNDRPNLPRDEFDRLKAVLHRCVVDGPAGQNRDGHADFRRHLQGRVAWATQLNPGKAEKLKALLDRITWPG

SEQ ID NO: 5441 - protein, 438 aa, unidentified
  source 1..438: note = Related to JAJTWT010000006.1; note = Pelomonas sp.
MDHARRMTARALARAMLAGARREDALAARMAACLDESPPWLAGLAAAMARMPGEVWRRLDVDALAARVEAHEGFLEAWCGDGRPEARRWLLRPPQEPGAAPAGLERPHWPTVGALARGLGMTPAGLWRLTLPADWQRRRPLARQHYTQRLCPKRGDGAGWRLLEVPAPHLRAVQRRLLTQLLDGLPPHEAAFGFTRGRSVVQHAARHVGQGRVLRFDLADFFSTVRAARVHALFATLGFSTAVARALSALCTTSAPEAWLRQEARLPWLQRQRLRDPHLPQGAPTSPALANLCAFALDARLSGLAAAFGARYSRYADDLVISGPAALPVRAVSAWVAAIAEDEGFVVNRRKTRSLGAAGRQSVCGIVVNEHPNLPRDAFDRLKAILHRCVVDGPAGQNREGRADWRAHLQGRVAWAAQLNPARGARLKALFDRIDWHR

SEQ ID NO: 5442 - protein, 432 aa, unidentified
  source 1..432: note = Comamonadaceae bacterium; note = Related to JAACZV010000015.1
MTARALARAMLAGPRDAAGLAARMAVCLGERPPWLAALAQAMARVPAEVWRRLEVATLAERVEAHEGFAAAWAGEARPRARHWLLRPPDELAPAPAGLERPHWPTVGALARGLGLTPAGLWRLTLPVDWQRRRPLVQQHYRQALVAKRGDGAGWRLLEVPAPHLRAVQRRLLAQLLDGLPPHEAAFGYAAGRSVVQHAAQHAGQARVLRLDLSDFFSTVRAARVHALFKTLGYSTATARALTALCTTAVPEAWLRGEPRLSWPQRQRLRDPHLPQGAPTSPALANLCAFGLDARLAGLAARLGARYSRYADDLVFSGPASLPVRQIAAWVSAIAADEGFTVNPRKTRSLGVAQRQAVCGIVVNAHPNLPRAEFDRLKATLHRCVVNGPAGENRDGHADWRAHLQGRVAWAAQLNPAKAGKLSRLLARIDWSR

SEQ ID NO: 5443 - protein, 430 aa, unidentified
  source 1..430: note = Burkholderiales bacterium; note = Related to JAEKLF010000057.1
MTARALAHAMLAGPRFEAALAARMAVCLDEQPPWLAGLARAMARVPGEVWRRLDVQTLGERVEAHEGFAEAWFGEHRPEARHWLLRSPDELPPAPAGLERPHWPTVGALARGLGMTPAGLWRLTLPPDWQRRRPLAQQHYRQQLIPKRSAGWRLLEVPAPHLLAVQRRLLGQLLNGLPPHAGAFGYARGRSVVQHAALHAGQGRVLRFDLSDFFSTVRASRVHALFKTLGYSAAVARALTALCTTSTPEAWLRAQGRLDWQQCQRLRDAHLPQGAPTSPALANLCAFALDARLAGLAEQFGARYSRYADDLVISGPAALPVQAISAWVAAIAADEGFVVNPRKTRSLGVAQRQSVCGIVVNTHPNLPRDEFDRLKATLHRCVVDGPASQNRDGHADWRAHLQGRVAWAAQLNPAKAERLRKLLGRIDWAR

SEQ ID NO: 5444 - protein, 447 aa, unidentified
  source 1..447: note = Related to QAJN01000008.1; note = Paucibacter sp.
MARLSRLTALALARALLAGPHQAQGLAARMTNCLGLGLEPRPWLETLALRLARMPGERWARLEPRSLATLIEKEQAFRDACASAAPPRPQRYLLRPREHKAGAPLGLEACDLPDLPHVGALADWLGLPLGGLWRLSKPRDWQRREPLSAQHYRFQLMAKRSGGWRLLEVPEPHLMGVQRKILRGLLQQLPLHEAAMAYAPGRGVREHAALHAGQAVLLRYDLCDFFAAVQAARLRALFLTLGYPHEVAVSLAALCSVATPEPVLRRMHEAGQLTWTQLQKLRGAHLPQGAPSSATLANLCAFRLDLRLDGLAQALGARYSRYADDLVFSGPQHLRQAQARISAWVGRIALEEGFALNHRKSRCLSAGGRQMVCGVVVNALPNLPRAEFDRLKALLHQCVLHGPASQNRQQHADWPAHLRGRVAWAAQLNPAKAQRLQALLARVDWTR

SEQ ID NO: 5445 - protein, 446 aa, unidentified
  source 1..446: note = Related to LMHL01000001.1; note = Rhizobacter sp.
MYASRLRHLDALALARALWAGPQTPASLKARAEQALGASPHWLADFIDELPTVSGATWQRQEVDDLAARIEQTRAFVNAPRVPGLPFVRRWILRASRMRPAPLGLDDLDLPPLPHSAAIADWLGITLDDLDWFTHDRRPALPLHAQHYAFTLQPKRSGGGRLIESPRSRLKALQGRALHELLDKVPVHEACHGFVAGRSVLTHARLHVGQPVVLHFDLKNFFGHILSSQVAAVFHTLGYPPGVARQLAALCTVSTPEPVIERLRDDGWVDWQDARALRRAHLPQGAPSSPMLANLSAFQLDLRLDGLAHVLGATYSRYADDLVLSGPPSLRNSFDRIAAWVGRIALEEGYALNHRKTRMATQASAQRVCGVVVNAHPNLPRREFDRLRAVLHRCALHGPASQNRDGHADFRAHLWGRVQWATQLNAAKAPRLHALWSRIEWIASPA

SEQ ID NO: 5446 - protein, 443 aa, unidentified
  source 1..443: note = Related to FRCQ01000002.1; note = Rhizobacter sp.
MHAHRHRHLNALALARALWAGPQARTSLRARATHALGHEPAWLTLLLDELQPVSEATWQRQSVEDLADRLERTDTFADAVRTTPRPFVRRWILRASRMHPAPLGLEGLGLPPLPHSAAIAAWLGITLDDLDWFTHDRRHLLPLQSQHYGFTLQPKRSGGGRVIESPRSRLKALQGRVLHDLLDKVPVHEACHGFVTGRSVLTHARLHTGQPVVMHFDLKNFFGRILSSQVAAVFHTLGYPRGVARQLAALCTVSTPEPVIERLRDDGWVDWQDARALRRAHVPQGAPSSPMLANLCAFQLDLRLDGLAHVLGATYSRYADDLVLSGPASLRSAFERIATWVGRIALEEGYALNHRKTRLATQASAQRVCGVVVNEHLNLPRAEFDRLRAVLHQCALHGPASQNRDGHADFRAHLWGRVQWATQLNPAKAERLQARWQRIDWAP

SEQ ID NO: 5447 - protein, 354 aa, unidentified
  source 1..354: note = Betaproteobacteria bacterium; note = Related to VBCX01000083.1
PLGLHDLLLPELDHTEALAQWLGVSLETLRWFTACPPRRRHADLQRQHYAFRLLPKRSGGGRLIEAPRSRLKALQRRILDGLLDAVPVHEACHGFTRDRSVLTHARVHVGQPVVIRFDLMNFFASITAAQVRATFQTLGYPAGVAQDLTALCTLLTPEPVIARLQDDGWLDWHQARCLRSPHLAQGAPSSPILANLCAFQLDLRLAGLADTMGARYSRYADDLVFSGPASVGSSFDRLAAWVGRIALEEGYTVNHRKTWLASQATQQRVCGVVVNQHPNLPREAFDRLRALLHQCATHGPASQSDRALDEFRLHVLGRMTWAEQINPSKARRLRKLFDRIVWDAAPAQELPQSG

SEQ ID NO: 5448 - protein, 438 aa, unidentified
  source 1..438: note = Sandaracinaceae bacterium; note = Related to JACKEI010000001.1
MTRDRRTGSRLELLALACLELWQDVVSAGWPPSDTLLTALERVFDDVPAPLRTAARAVTPADLGLPPTAGVADAEAVAARLGALLDPEAQELLARLPVRRVPLPPLSNDARVLAPADVAQRLGLRWDELMWLADPQERLRRGAPEQGHYRYVRVPKRRGGERLLECPRPRLLSVQRAVLRRFLEPLVPHDAAMGFRPGVGFVDHAALHAGQAVVLRLDLASFFQTVRRALVVRALMHGGLARPTAQLLGAIATHVTHPSALRGVSESERARLRSPHLPQGAPTSPALANLVCRRLDARLTGLAASVGARYSRYADDLVLSGGGHLARDAERLVTTVGAIAIECGFTLNMRKTRVMRASQRQQLGGVVINAGPSLPRHELERLEATLTNCVRHGVAGQNRAGVPDFRAHLQGRVAWARALRPSRGDALARIFEQIDWST

SEQ ID NO: 5449 - protein, 429 aa, unidentified
  source 1..429: note = Sandaracinaceae bacterium; note = Related to JACKEJ010000006.1
MALRLEALALSAVEQHASREDGSTLADALDHIATDASPRLRRACRRVPLSALSAELAHPPVDLDRLMRAIGARLSTRARSELATLRVRRFPLVSLGDPAQPFPSFGPSGLDTRLGLSSTELHWLADPQCRRDRLTVTESHYRYVVVPKRRHGVRLLECPLPRLRRAQRALLDEVLAPLPVHPCAAGFRRGMGFVEHAARHAGQDVVLRVDLRDFFPSIHRGMVVRALVDGGTPLATAHLAAALATHTTHRDVARRFDGSTRARLRSAHLPQGAPSSPALANLVCRRLDARLHGLAESLGATYSRYADDLVFSGPRHLLDDAARIVSLVGRIASSCGFALRPEKTRVMSAAQRQSLGGVVVNTRPTLARPELERLEAILTNCVRHGPAGQNRADVADFASHLRGRVAWVEQLHPARGAKLRNLYAQIAWG

SEQ ID NO: 5450 - protein, 445 aa, unidentified
  source 1..445: note = Related to JACRCU010000218.1; note = Deltaproteobacteria bacterium
MNASRPLWRHRLARALAAAFLCGPWRHAELVARGAACLGEKPPWLPIAARWTRHAFPSPPASIEPVVERLLRLPSFQLATTGRPPTPKWRKAFLYVPPDPVARFAVPPLPSDGALARWLAIPEPLLAWLADVRGLNRRTAEARLHNYHPRWLPKAHGGVRLLEEPKPLLKQAQRRILAGLLAHLPPHAAAQAFCSGRSVHSHAALHAGQAVVIRIDLADFFGSIGRARVRALFEAAGYPRPVARSLAGLCTTATPPLVVARLPRPVDAAEVPYAASQRRHLLAPHLPQGAPTSPAIANLCAWELDVRLTALATTFGARYSRYADDLTFSGGPEVARRAGHLVELAMFAAYACGFAVRHGKTRVVRSGARQVVTGLVVNERPHVARAERDQLKAILHNCVRHGPAGQNRENHPDFRAHLLGRLGWVAAGDPRHGAKLRALFDRIAW

SEQ ID NO: 5451 - protein, 334 aa, unidentified
  source 1..334: note = Myxococcales bacterium; note = Related to JACKDN010000045.1
DAGVPPLPTPGDLAAWLGLTTDRVDWLADRLRPEERPAAGAVHYHHRWKGRRLIEAPKRTLRSVQRRILDGILADVPPHPAAVAFRPGVSVVDGAARHVGQPMVVRFDLRDFFASVRRARVRAIFARLGYPDPVADLLANLTTHATPAAVFDAVAPRDAEAHRAHVERRRRFAERHLPQGAPSSPALANLSVYGLDCRLAALARTLGATYTRYADDLVLSGDFAPNPVVRLVDRIVRSEGFALNAAKTRVMAASQRQRVTGVVVNARPNVARADFDRLKAVLTNCARHGAASQNRDAHPAWQAHLEGRVAWVASVHPERGARLRALLAQIDWSA

SEQ ID NO: 5452 - protein, 417 aa, unidentified
  source 1..417: note = Related to JACKIB010000005.1; note = Planctomycetes bacterium
MDADTLADAWLSGDWTLAGMRSRTQRLIHPDRLSKSLASMILGFWLELRDRPHERRRATLAAAITAHRAFFRIARTNTYGTVLDAPKMVPPPRAWDVLPLDTPATAGAWLGLTATDATWLTDPRGIARHYDRYWSGTRLIEAPRRRLKAAQRRIAAELLAAIPPHEAAHGFRRGRSVLSAVHPHAGREVLVVADLTAFFPSVRVSRVHAMFQRVGYPEEVARFLTRMCTTRCRTLPKAEHEVTPGQAQLYRARHLPQGAPTSPALANLCAFHLDARLAGFASSLGGTYTRYADDLIFSGPAVLGRGGFLATVSTIAVEQGFRLNTAKSRVMRRSQCQLVLGMVVNEAPTLPRAQLELLEAELFRCARRGPPVHHQHGVAWLRDHLAGRVAWAKHVNPRRAQRLVELLAAIDWSGAHS

SEQ ID NO: 5453 - protein, 430 aa, unidentified
  source 1..430: note = Related to MDLA01000158.1; note = Chromatiales bacterium (ex Bugula neritina AB1)
MPPVNKLNFFSKHLAMWLSQADWHFVTLLSTAIECVDELPDDCDSLINELLLRYPEKPSEPALAGHLQSSYRLSSWFKRGQSAPKIMRFNLDSPTFIERDNREYPRIDTPGDLADWLKITPSQLEWFSNCWRFDSNTPRYLQHYQYQLMEKRDGRMRLIEKPKTTLKRLQRKIYQEILSTLETHPAVHGFRKDRNCISHASVHTGKKYLLMFDITDCFQSIHWPMVKVVFKRMGYPDAVSILLTALCTHSVRLKPAQLKLFDTAQRNRLRQRHLPQGAPTSPALTNAALHRLDIRLTGLAHHFGLDYSRYADDLAMSGNTHRDWRFLEPLIGGICLDEGVTLNYKKTRIKKSHQKQRVVGIVVNSKTNIDRNYFDTLKAILTNCTKYGLDSQNRYRHPHFRAHLLGRIQYVKSLNERRGAKLEKLYQAIN

SEQ ID NO: 5454 - protein, 427 aa, unidentified
  source 1..427: note = Related to JAHQWB010000596.1; note = Granulosicoccus sp.
MNTKGFFCRHLAIWFYEETWHFTTLLAIFIDVVENLPSDADLLVHETLLEFPDKTSAENIAAFLSRSQRVLHWFSDGADKPAIIRINLQQSPVVKLVNSKLPELNSIGDLAGWLGISIGQLDWLADLKRYDSSRPERFNHYHYRTTEKRDGRLRLIESPKRLLKSIQRQISDDILIYAPVHNAAHGFCKGRNCQSHASNHIGKNYLFLFDLAHCFQSVHWLQVFRVFTQLGYTRTIARYLTSLATHRAYSNHVLLDRLDVDQRIRLRQRHLPQGAPSSPALSNAVLSRLDKRLNGLAKSLRLDYSRYADDLAFSGNEHRDWRFLESLVGAICNEEGFALNYRKTRLVRPGQRQKITGVVVNQKTNIDRRYYDSLKAVLTNCLRNDLDSQNRFNHSDFRAHLRGRIQHVKSLNESKGTKLEKIFEQFP

SEQ ID NO: 5455 - protein, 430 aa, unidentified
  source 1..430: note = Gammaproteobacteria bacterium 45_16_T64; note = Related to MABD01000012.1
MNKKIRFCRQLAEWFLVSDWHYSTLLAVFIDVADELPGDADDLVSELLAEFDTKPELNPIVDYLMQSLRLGCWFYDDHGPRVVPVCLINSQLSRLSNDALPVLNTESDVANWLNVSIQELTWLAELYRLDPTSPSYFKHYHYSIAKKRNGSPRLIESPKSRLRAIQRKVYSEILDHAVIHDSAHGFLKGKGCKTHASQHSGKDILFTFDLSHYFHSIRWPNVYAIFSGLGYTNSVSKILTALTTHRCYMKDRCLGELDTDHRSLLRERHLPQGAPTSPSLSNAVLYFLDCRLSGLAASLNMKYSRYADDLAFSGDTGRDWRFLEPLVGSICLEQGFRLNHRKTRIMKSHQKQRLTGVVVNTKPNVDRKHYDRLKATLTNCLRHGLESQNRDNHPDFFAYLEGSIAHVGHLNSARGKTLKAMYDRVIATQG

SEQ ID NO: 5456 - protein, 424 aa, unidentified
  source 1..424: note = Related to NZ_ML660090.1; note = Exilibacterium tricleocarpae
MIQTFTRELAQCLYHSEWHFTTLLAACIQRIDNLPDDIDGFISQLLNVYNEKPALELLAGFLEQSRWVRSWFVVPARAPRFRIYNLEPVSGTTRAELPPLDSPAGLSLWLGLSPGHLDWIAGLKRVDASRPRRLDNYHYSLLRKRHTGSRLIESPKTILKAVQRRILNRILCHAPVHRAAMGFRKGCSSLDHARLHCRKRYVFCFDLENYFQSIQWLPVWRVFRTLGYPKKTANYLSALCTHACPPGALARFGLGDHYNRLLRERHLPQGAPTSPALSNAIMLGLDRRLSGLARRLELDYSRYADDLVLSGNGKRNWDFLAPLVGSICLDEGFSLNHRKTRRLTRSQSQKVVGVVVNEKINIDRRYYDDLKATLFNCVRFGPDSQNRGQHKDFCAHLLGKIHYVASVNTSKGQKLLQLFDRIAF

SEQ ID NO: 5457 - protein, 444 aa, unidentified
  source 1..444: note = Related to NZ_CP035490.1; note = Hahella sp.
MRYDRWLAARLADAYQSGAPIAREMQQRAAMALGEQPAWLAPLTRRMWRRFQQVWETTSAHTLTEAILADRGFQRGLALSSRPIQVRRIFLPPPQELAPDSLAARYRLPALRCAGDLMHWLRLTPEDLDWLTQARGAPSGASSALGHYIYRWLDKPRGGARLLEAPKPWLKTIQRRIHQEILAPLPLHEAVHGFRAQRSSLTHARIHIGQTLLLKFDLKDFFPSVSYAQIYRAFRRLGYGHQVARLLSKLCSHVTPDEILRQPLAGYLERGNELFRRAHLPQGAPTSPALANLAAAHLDRRLSALADSMGRRYSRYADDVVLSGPRMSPGAIARLQALVGAIALEEGFVLNTRKSAVIGQGARQQVGGLVVNAKANIPRKDYDELKAVLHNCLRFGPDGQNRQGHGDWAAHLRGKIAYMAGINPEKGRKLLALYQRIVWPQESV

SEQ ID NO: 5458 - protein, 444 aa, unidentified
  source 1..444: note = Related to NC_007645.1; note = Hahella chejuensis
MRYDRWLAARLADAYQSGAPTVREMQQRAVVTLGEQPTWLASLTRRMWRRFQQGWEGASAYALSEAILADRGFQQGLAVSARPVQVRHIFLPPPRALPPDSLASQYGLPALRCAGDLMHWLRLTPEDLDWLTQARGAPRKAASALGHYTYRWLDKPRGGARLLEAPKVWLKGIQRRIYQEILAPLPLHEAVHGFRAQRSSLTHARVHVGQALLLKFDLKDFFPSVGYPQVYRVLRRLGYGHEVTRLLSRLCTQVTPNEILRSPAARHLERGEELFRRAHLPQGAPTSPALANLVAAHLDRRLSALADSMGRRYSRYADDFVLSGALMSPGAIERLQALVGAIALEEGFVLNTRKSAVIGQGARQQVGGVVVNAKANISRKDYDELKAVLHNCLRFGPDGQNRQGHGDWAAHLRGKIAYVAGINPQKGRKLLALYQRIIWPQESA

SEQ ID NO: 5459 - protein, 445 aa, unidentified
  source 1..445: note = Related to NZ_AQXX01000078.1; note = Hahella ganghwensis
MNYQRWVATSLAETLLSGPRDVASQRQRLTKVLGEEPEWLSPLVALGRSPDFVKGEDSETLKRQLTEAILDCEDFLLAFVEEDTTPRIRHIKCQTLPPTFPSNCPVEVCNLPKLATEGDLLAWLHLSHHDLLWLINEYREEFGQDSRLQHYHYRWLEKPRGGARLLESPKPLLKSLQRRIHREILSPLPLHSGVQGYRQGHSCLTHARLHQGQSLLLKFDLKDFFLSIGYQQVYRIFRRLGYNHRVTQILSRLSTNKTPRAKLRPPPGIMTERDIQLFRRPHLPQGAPTSPILSNLAAAMLDNRLSGLAKKMGYRYSRYADDFVLSGPGMSQHAAEKLQHLVGAIAEEEGFSLNTRKSAVVGQGQRQQVAGIVVNEKTNLSRKQFDSLKAMLNNCARHGPISQNHQQLPNFQAHLKGKIAYLRSLNPQKGDKLMTLYQKIQWPDQ

SEQ ID NO: 5460 - protein, 440 aa, unidentified
  source 1..440: note = Related to MRYI01000026.1; note = Hahella sp.
MNYKRWVASCLADAFIIGPRDSSAILLRWSKVLGEQPEWLRRLSKEILSPETAHHENLNFSMVLERIQASEDFDEAFSESDQPPRVRYVYLPEAEYSFSAEQHELPKLAGISDVLNWLNLTVNDLEWLCGNYRNAPGASSKLAHYHYRWLEKRRGGSRLLESPKPLLKSIQQKILHDILSAVPQHPAVHGFRAGHSCVSHARQHLEQPLLLKFDLKDFFASIHYPMVFQVYRKLGYPPTVCRILTKLSTNVSPVKILKSRPDTCIDKDDNYFRRPHLPQGAPTSPALSNLAASKLDKRLTGLADTMGFRYSRYADDLVFSGPRLKRGSIDKLQSLVGAIVLEEGFLLNTRKSAVVGQAQRQQVTGIVVNRKANISRQQFDQMKAILHHCIHQGPHHQNRDQVPDFQAHLKGKISYMQSINPQRGNKLMKLFQQIQWQNAD

SEQ ID NO: 5461 - protein, 427 aa, unidentified
  source 1..427: note = Gammaproteobacteria bacterium; note = Related to JABLXQ010000049.1
MNAHRYFAYTLARICLQSSWEREPMAEAVELSLQGQGPWVNSLIRQVLHRFPRRPGLPALFDFLRQSEGLAAIRLRYQPRICRYPLTLPHVVLPSSLPPLDSVGALCEWLRLAPADLDWFADRSNRAAGHAAPKVRHYHVTTIPKRQGGMRLLEVPKSRLKQIQRRIHDDILLQLPLHPAAQGFVRGRSPVAHAGLHVGQAVVLRFDLRDCFLHVHGGRVFQAFRALGFPEDVSRLLMGLCTHRLPQWLSTQLPLDEVQRQKARQNHLPQGAPSSPLLSHFALRGVDVRLSAYASALGANYSRYADDLVLSGGEHLRHSFRAIEARVGAIVAEEGFALNFRKSRCVSAAQRQQVTGVVVNRQLNVPRVQFDALKAELHNCVQQGWVSQRPTHVADYRAHLLGRIGWVMQVNPQRGAKLRGLFERIDW

SEQ ID NO: 5462 - protein, 464 aa, unidentified
  source 1..464: note = Alteromonadaceae bacterium 2753L.S.0a.02; note = Related to VISH01000001.1
MYGGARCARKYTQNQRLVLEPLILNDMDAHYKKLLIRQLARAVLIGEHSPAGITRSITHCLGIGTEQARALAVEISAEHLFRAYPHHAELFLRTTLQESTTLTAIFAGRDLRVINWPLAALQSQQNPPAKYLWQLPVIKSAEQLADFLDVQLNDLYWFAQRFAKPNSSFKQQHYYYRFITKSDTSLRLLEIPKSRLRCLQRTILKKVLQPMPVHEAAHGFVKNKNCASFAEPHVAKSLIVSMDLENYFLHIPVARITRLFQVAGYPVDVASLLAGLCTHRTPNQIIANTPGSHSKYLHIRHLPQGAPTSPMLANLASFWLDVRLNALAKTMGYHYTRYADDLAFSCDSDNHNPKRLIRSVSDIIQAEGFRLNHQKTRVQKPGQRQCLAGLVVNEKLTIPRNIVKRLQAELYNCVQHGPESQNRLNKADYKSHLAGRIAQVAGVSNVKAEKLFALFDQISWPQER

SEQ ID NO: 5463 - protein, 432 aa, unidentified
  source 1..432: note = Related to RCHN01000046.1; note = Ketobacter sp.
MNYRKLLIRQLALSLLEGAHHPVGLANSIAGCVNLTLRDALPLAEELARNLDWGSLTVMQLEQWLEASERLAVLYRSQRLRVVKWPLTAIPAPQRAALGSAWGLPPFHNTDHLAQWCGLSPGDLNWYSQRYPNQRPDARKLQHYHYQPRHKSDGSQRILETPKSRLKSLQRKLNHDLLNKVPVHDAAHGFVAGRSVKSFSRLHVDRPVVLAMDLKHFFLSIAPGRLVRLFQRLGYDLAVSKALIGLCLNQTPEAVLSPIHCLATRQRYRQPHLPQGAPTSPVLANLMAFRLDLRLEAAAHGQGFCYTRYADDLAFSSHRHDRAATRILQRQVRSIAADEGFAIKEEKTRVMTRAGRQQLAGVVVNKKQSLPKAEIKQLEAILNNCVRYGPHSQNRARHPQFRAWMEGKLAYVQHLAPHHFERLQRHFELIQW

SEQ ID NO: 5464 - protein, 445 aa, unidentified
  source 1..445: note = Methylococcales bacterium; note = Related to JABJPU010000111.1
MSNQNQIIGFISHAILAGEWQTDAIKERIGRSIGYQFNARLLIKELMSEFELTQAQTQHTAIQQFLKNNVTFQQCWGEQRQLIQLDKIYIPKQDRCRPPRQLNHIELPALNTEQQLGDWFKISVNDLIWLSGIWEKPYDAKSCKLYHYHYQWLKKHNGKKRLVEIPKSRIKSLQKKISIQCLDSIPIHQNAHGYCKNKSCQTLVQQHIAKPTILKMDLQNFFASIDYRKIFNLFFSLGYNKDISRLFAHLCTTATPLSVLSAELIAGQQKDYWHQRKLYRERHLPTGAPSSPVISNLCFFNLDCRLTAFAEKMGLNYSRYVDDMVFSGGREFYNKSDYLIKTISKICQSEYFFINHKKTQLLKPHQSQQVCGLVVNQKPNLTRKNYDQLKAILYNCVRTSPKQQNRLNHANFKEHLAGKIAYLSQINPQKGQKLADLFDQICWME

SEQ ID NO: 5465 - protein, 431 aa, unidentified
  source 1..431: note = Alphaproteobacteria bacterium; note = Related to CP065008.1
MQNLARTSRLLAASIIDGPWETGPLARRIAHAISLRGFNPERLALALVRRFGKGKTPVLRDLTAAIAANEHFAVCFESTGRPAWFRMGVEPPQMTRPPSNLVTFPLPVIETAKELSAWLNVDLSTLEWLADTRRRQKNAKDFRFVNYSYIWKKRPGKPPRLIESPKSKLKATQRKILTEILNKIPPHEAAHGFCRNRSIITHALLHTEKDAVACFDLKDFFHSIPPARIMAMFRTIGYPQEVSRRLTNLCIHTPNPEFLGKTLETLPWAVRKKILIPHLPQGAPTSPALANLCSFHLDTRLQALAESMNLTYSRYADDLTFSGGKELKSRFSYLRGTVQGIAQDEGFTINPEKTRLMTQAQRQVVTGVVVNKRPNISRTEYDRLKATLYTYSKSTGLDGLIKAQLRGKVEFVRALSPQRGEKLFELWKKIP

SEQ ID NO: 5466 - protein, 432 aa, unidentified
  source 1..432: note = Related to JAGRIJ010000030.1; note = Alphaproteobacteria bacterium
MPGYKQTTRLLAASIIGGPWESGPLSRRIHHAISLKGLNSERLALDLVHRFGEGRTPSVKELASAIAANKHFEKCFMASEGQAEWLRMGVEPAQMNPPKGDLATLPLPALATSRDVCEWLEIDQPALEWFADTRKRQPHVRDERLLHYTYLWKRRRGKSPRLIESPKGKLKKFQRKILSEILNKIPPHEAAHGFARNRSIITHALLHTEKECVASFDLKDFFHAVPPARIASLFRALGYPHEVSRILSGLCLHAPDAHYLGSPLTNLPFPVQKKILSPHLPQGAPTSPALANLCAFRLDVRLQSLAQSMDLTYSRYADDLTFSGGKDLKKQFSYLRGTLSEIAAQQGFKLNPEKTRLMTQAQRQVVTGVVVNKRPNISRAEYDRLKATLYQCAEGEEKDALLKQSLRGKVEFVRTLNPQRGEKLLRLWEKIT

SEQ ID NO: 5467 - protein, 350 aa, unidentified
  source 1..350: note = Related to QFQP01000062.1; note = Archangium gephyra
MGPSKWNVPELHVVGDVAAWLSVSPEELRWFSDTSGVERARRRQSARNYVHQWVARGEKLPRLLEAPKAKLKALQRAVLHGLLGKIPVHDAAHGFVAGRSALTHARLHVGKKVVVRFDLRHFFTSIDTARAFGVLRWLGYTHEVSAVLIGLCTTRTPNHVLGRAPIPDLAEGEVLNQRFMMLRQLEAWHFPQGAPTSPAWANLCAWWLDVRLSAYAKKFGLTYSRYADDLVFSGDQLSSISRLRDVVDGVVRAEGFVINRAKTKVMHAHARQFVTGVVVNERPNVTRVEFDQLKALLHRCEMKGALSQSKGPVDQFRAELEGKVAWVAQLNAARGAKLKAQLSRIDWTEG

SEQ ID NO: 5468 - protein, 450 aa, unidentified
  source 1..450: note = Archangiaceae bacterium; note = Related to JAACJQ010000409.1
MNERERSPWPTPTSLRRNDARFIARQPWNRTDLLRALSVAFGSSGIPLRDLVDRLLRAVTAPQRELIAIQRVLEGSPFGVERYRAFERRPNAVDRFDLPRISSAPALHDWLGLPTEWASWFTDFRELERKRQPPKTKHYPRWWTARRWSIPRLIEAPKSQLRRMQRKLLHELLERVPFHPAAHGGVRGRSAVTHASLHTGRRVVAQFDLADFFPSITFKRVSGFFVALGYPKPVAREVAALTTTTTPAELLDLQQLHSGGDRVVFHQLVMRLRERHLPQGAPTSPALANHLTFMLDQRLSEAAKSMGLTYSRYVDDLAFSGDVPVSLERLERIVESNVISEGFTLRHRKSRLHTSSTRQRVTGLVVNVKPQPGRREFDRFRALLHQQAKTPTLPLAELEGKAEWFSTGRPARRAKLRRLLDAINSAAASAAAGAAASTAAESRAGADRAR

SEQ ID NO: 5469 - protein, 445 aa, unidentified
  source 1..445: note = Related to JAEUIQ010000011.1; note = Planctomycetaceae bacterium
MVFDKLAELLLDSDWTHEAIVRLLTACYRPPLSLRKTRPPKHELLATSILTAFPSPPSQARLIEHLRLSPGARRGFRYGKVQQVKLDAQMAGGQMRHTPTLQSGWDYPRISNLRELAECLGILDQTLNWLARGPRGNHACAAHYRIQAVEKRAGGCRLIEAPKATLKRTQREILRHVLNRLPVHVAAHGFVPQRSTLSHARLHVGQKWMLRMDLEDFFPSIDGSRVFGLFRSLGYPYEVVQALTNLTTHVLSIDAIRESVRHLARNARNERTITDLARLYFRRHLPQGAPTSPMLANLIAYRFDCRLTGLAKTCHVTYSRYGDDLLFSGSSTCHSSLSKIEDHVGAIAIEEGFRVRHRKTAFIPNSQRQAAVGIVLNEKPNVARHEYDQLKAILHNCVRYGPESQNRVGHDNFAAHLLGRIQWLRSLHPQRGEKLFECFKRIHFG

SEQ ID NO: 5470 - protein, 478 aa, unidentified
  source 1..478: note = Candidatus Accumulibacter sp.; note = Related to JAGFNH010000001.1
MDELSDRSSYASAAQRRVATALARACMAGEASPPAMRARAERVLGHPTPWLVPLALHLHFECAPPAGEVWHPRQHDQVVAAILAFPAFLAAFEQPEGAPGVRAYYPFHQPMGHPPEPLAGLLLPSLATIGDLADWLEMTPSLLDWYADAAAWSVRSRVEKRDHYHSRWVAKAAGGARLIEAPKENLRFIQRRILREILNRVPVHEAAQGCVRGRSVVDNARRHLGSALLLKLDLRDFFVGISGARVHALFRTLGYPRETARYLTGLTTRCSPAWLLRQVPQEAYPSPEERCRRRDWARQFMGRHLPQGAPTSPALANLCAYRLDLRLAGAARECQAGYSRYVDDLVFSCADGDLARGRRIVSMVQEIILEEGFSPNWRKTRLAPACASQRITGLVVNERLNLPRTEYDRLKAILTNCRRHGPASQNHRGVPDFGAHLQGRLSWFRQVNPERGARLQALFDAVPWEHDRPDDSVPGLAR

SEQ ID NO: 5471 - protein, 465 aa, unidentified
  source 1..465: note = Related to JADKJO010000032.1; note = Propionivibrio sp.
MDEIPDLPNYPLNATRKVAIALARAFLAGEGSPAAMRVRGERVLGRSYSWLVGLTLHIHFALGPALGRGWQPELHDQIVTHILAFPDFLAAFEIPDEVPQVRGYFPFHASMRSPPVPLAGLALPSLATPGDLADWLDVSPSMLDWYANTAAWVYAPGASKLDHYHYRWVAKARGGVRLIEAPKENLRFIQRCILREILDRVPVHEAAYGCVRGRSAVSNARLHSASPLLLKLDLRDFFVSIPGARVHAMFRTLGYPQETARYLSGLSTHNTPARVLREVPQEEYPSPEEHRHRKEWARQFTGRHLPQGAPTSPALANLCAYRLDLRLSGVARECQARYSRYVDDLVFSCADDDPARGRRILTMVQGIILEEGFVPNWRKTRMAPASTSQRVTGLVVNDRPNLPRREFDILKAILTNCRRHGPASQNRLGLPDFRAHILGRLSWFQQVNAERGERLKLLFDQVSWD

SEQ ID NO: 5472 - protein, 459 aa, unidentified
  source 1..459: note = Related to NZ_AUCH01000007.1; note = Azovibrio restrictus
MDEPWFPPPITPHIRQVAEALTRAFLYGDDRPGPMRERGTRLLGSPWPWLTDLCLRLHFELGQGRPWQPEQHDEILALILAYPPFLGATPPRVRGFFPLQPRMAPRPGALAGVALPALASTGELADWLELSPTQLDWFANPGGRRPQAPELGHYHYRWMQKRQGGARLIEAPKARLRALQRRILAEILNRVPVHPAAQGCVRGRSVLSNGALHTGAPLLLKLDLRDFFVSIPGARVHALFRTLGYPRETARYLTGLTTHGTPPGVLRQVPQEEYPSPEERRQRQAWARQFMERHLPQGAPTSPALANLCAYRLDLRLAGAAREAGAVYSRYVDDLVFSLPSHDPGRGRRILTMVQEIILEEGFTPHWRKTRILPASTRQSVTGLVVNQQLNLPRQEYDRLKAILTNCRRHGPASQNREGRPDFRAHLQGRIAWFAQVHPPRGARLMALFAGIDWDGLRS

SEQ ID NO: 5473 - protein, 498 aa, unidentified
  source 1..498: note = Related to NZ_CP075192.1; note = Ferribacterium limneticum
MSSSSATRQAGEGTAFHRIAKAPMDEFSESPEPPDLPEKAMRQVAVALARSFLAGERSPAGMRQRGTAALGHAWPWLVQLSLHLHFELGQDLQARKHDQIVAFILAFPRFRAAFDTPGQHPRVRSYFPFHPVMGTPPPPLAGLAFPALATPGDLADWLGITPRELDWFANDWNSTAAQPKFKHYHYRWLAKRSGGARLIEAPKENLRAIQRHILHGILDHVPVHEAAHGCVKGRSTLDNARRHAGAPLLLKMDLRDFFVSIPARRIHALFRSLGYPVATASYLTRLTTHATPAYLLQQVPQAEYPSPEERRQRQIWARQFMERHLPQGAPTSPALANLCSYRLDLRLAGAARECNARYSRYVDDLAFSCDDNQAHGRRILAMLQDIILEEGFTPNWRKTRLASAATTQRLTGLVINAHPNLPRKEFDTLKAILTNCRRFGAASQNRDGRPDFRSHLQGRIAWFRQVNPERGEKLRRLFEQIDWASAETIRNRARISLT

SEQ ID NO: 5474 - protein, 462 aa, unidentified
  source 1..462: note = Related to JAGTRU010000007.1; note = Proteobacteria bacterium
MDEFSDDPELPELPTKAMRQMAVALTRAFLAGEPNPAGMRERGGIALGQAWPWLVPLSLHLHFELGSELQAREHDRIVALILAYPRFRAAFAVPGERPKVRGYFPFHPPMGRPPPALADLALPALATPGDLAGWLGLTPGELDWFANAWHQPAATGKLDHYHYRWLAKRSGGARLIEAPKENLRAIQRRILHGILDRVPVHEAAMGCVKGRSVLDNARRHAGSPLLLKMDLRDFFVSIPARRVHALFRSLGYPSATARCLTGLTTHATPAALLRQAPQTKYPSPEERRQRQQWARQFMEHHLPQGAPTSPALANLCAYRLDLRLAGAARAGQARYSRYVDDLAFSCANGDPRHGRRLLNMLQDIVLEEGFTPNWRKTRLAPASTAQRLTGLLVNAHPNLPRGEYDRLKAILTNCRRHGPASQNRDGLPDFRAHLLGRIGWFGQVNPARGEKLHRLFEQIDWA

SEQ ID NO: 5475 - protein, 466 aa, unidentified
  source 1..466: note = Related to WBUO01000290.1; note = Dechloromonas sp.
MNDPDDFDDDFDPDDLLPARAMRSVAIGLVRAFLAGSSDPASLRERGRRALGESPRWLPSLVLHLHLELGSQFTTRQHDALLDAVLAYRQFRNAFLPGSTRPRILCHFTFHPPMDEPPAVLAGVAVPTLPTSGDLADWLGLLPNELAWFCGNWREQPSQPKLGHYRYRWLNKANGGRRLIEAPKETLRSIQRRILHGILDKLPAHTAATGCVRGLSVVDNARRHADSPLLLKMDLRDFFASIPAGRVFALFRTLGYPPASAHCLTQLCTHATPMRVLRELPQDGHGSWEWRRQQQEWARRFNTRHLPQGAPTSPALANLCAYRLDLRLAGLARECRATYSRYVDDLAFSLPRHDSARAHRIQLLAEEIILQEGFAPNRRKTRLCPAGQTQTLTGLVVNRHPNLPRAEYDRLKAILTNCRRHGPTGQNHDQHPDFRAHLQGRLAWLRQVNPPKGEKLLVLFGEIDWG

SEQ ID NO: 5476 - protein, 465 aa, unidentified
  source 1..465: note = Rhodocyclaceae bacterium; note = Related to JAGRFZ010000003.1
MDDEEAHPPFGPEHAGRDKARVALGLASAFLAGSPEPASLRERGRRALGRDWPWLPALALRLHHTFGKAFPPHRLDDLQRLIVRDPDFIASFADSEGGPRIRAWFPLHPRMAPPTIPGLPALPQLATLDALADWLEVRLEDLDRLAEPQAWRPPRSASPLEHYRYHWRQKRDGGLRLIEAPKPRLRRLQRRILHGLLDLVPVHPAAMGCVRGRSVIDHAGQHAGQPRLVKLDLRDFFPGNRASRIHALFRSLGYPTMVARHLTGLTTHCSPPRILRTLPHGEYDSPEQRLRTRRRAMALCDRHLPQGAPSSPALANLCAFRLDLRLAGAALACGARYSRYVDDLSFSGAFDAARGHRMLAMIDDIVRDEGFDPNWRKAAVVGAGAAQRLTGLTVNRHPNLPRAEYDRLKAILTNCRRHGPTSQNKAGHRDFRAHLLGRVAWACAVNPARGEKLRSIFDRIVWPEG

SEQ ID NO: 5477 - protein, 465 aa, unidentified
  source 1..465: note = Related to JAGRFY010000153.1; note = Rhodocyclaceae bacterium
MDEEEADLPFGPAHAGRGLARVALGLAAAFLAGSSEAAGLRERGRQALGRDWPWLPSLALRIHFAFGSEFSPDRLEDLQSLILGDPGFAKALADPDGGPRIRAWFPLHPQMASPVVPGLQALPQLATLDQLADLLELSVDDLDWFADPQAWRAPKPDSPIARYRYHWRRKRDGGLRLIEAPKPRLRRLQRRILHGLLDPVPVQPAAMGCVRGRGVIDHAGLHAGQPRLVKLDLRDFYPGIRASRIHALFRSLGYPTKVARYLTGLTTHCSPPRILRALPYGEYDSPEQRMRTRRRAVSLCDRHLPQGAPSSPALANLCAYRLDLRLAGAARACGARYSRYVDDLCFSGAFDAAQGHRILAMIDDIVREEGFEPNWRKAAVVGAGAAQRLTGLTVNRHPNLPRAEYDRLKAILTNCQRHGPSSQNKGNHRDFRAHLQGRVAWACAVNPARGEKLRSLFDRIDWRQG

SEQ ID NO: 5478 - protein, 460 aa, unidentified
  source 1..460: note = Related to NZ_KB892867.1; note = Uliginosibacterium gangwonense
MSRLPKPPIDPAILHVARGLARAFLHEAGGITDLQQRGKAALGTAHDWLPRMVRRLDQHFGLPLRPAQFEDIVTCIATLPSFIGAFERRPVPKIRRYFSFQPQMAALPRTLAGLDLPALPTVGDLAAWLALSMDELEWLADVHSISSKTGSEALRHYHYQWKAKASGGHRLIESPKPLLCAIQRKILHGLLDKIPVHDAAHGCVPHRSILSNAQVHAGSPLILKMDLQDFFTSIRASRVHALFRTLGYPEEVTRYLTALTTHVTPSFIFHTQPRPEGLTSKALQTRRKQAESYRARHLPQGAPTSAALANLCAWRLDLRLAAAAQESGVRYTRYVDDLIVSFPSHTRAHAWRISLMIDTIILEEGFTPHPRKTRLTSQSQAQWVTGVLVNEKPNIARSDYDRLKATLTNCMRHGPHGQNREALPDFRARLQGRIAHVKHINPARGEKLQTLFDAIGWQAI

SEQ ID NO: 5479 - protein, 507 aa, unidentified
  source 1..507: note = Related to JAEUNN010000841.1; note = Rhodocyclaceae bacterium
MEGRTAFGAKAAEGGRVEDSYDDEEAAAAWLAARARATQAVATALARAFLAACASQAQTAADAGGPVAAPHTATGARAAAAAMQACGRRVLRRKYPWLARLVRHVQAAAGDCPRPAQHDEVRALILEFPPFRSAFEDDEPPRVHAWFPWHECMRAPPRRLAGLNLPQLDTPGDLAAWLHVSVGELAWFADPGGWAEASGVEALRHYRYRWNAKAGGGWRLLEIPKPRLAALQRKILREILDRVPPHAAAQGAVRGRSALGNAAMHADCGLVLRLDIEDFFPRLAGARIAALFRTLGYAPAVARLLAGLCSHATPAAVSSTAPCAGLPGIDGLRARRDLADMYGSPHLPQGAPTSPALANLAAYRLDLRLDGAARACGWRYTRYVDDLFFSGPGGSPAHALRTAQMLQGIVLDEGYRPNFRKTRVMPRGRRQLVTGLVVNRRAAIPRDQFDRFKAMLTNCLRHGAASQNRDGVADFRASVAGRLAWFEQVNVARAAKLRALFDAINWA

SEQ ID NO: 5480 - protein, 487 aa, unidentified
  source 1..487: note = Related to JAHCAA010000009.1; note = Rhodocyclaceae bacterium
MRIAQQGEGEEPYAHRFAAPTAAMDAVAIALARAFLAAVTQTADSAAGAAEAMEPSQRALAAAMQACGRRVLARKWPWLARLVRHILSETGPQLRPAQHDEVRALILGFPPFRLAFAADQPPAVHAWFPWHDAMRSAPRALAQLALPQIDTPGDLAAWLGLTVGELAWFADSGGWAARSDTERLRHYRYRWLAKPSGGWRLLEIPKPRLAALQRKLLREILDRVPPHGAAQGAVRGCSAATNAAAHTGRGLVLRLDIENFFPTLGAGRIAALFRTLGYPGAVASLLAALTTHGTPAAIAGAAPLGEYAGAADLRARRDIAQLYRRAHLPQGAPSSPALANLAAYRLDVRLAGAARACGWIYTRYVDDLFFSGPATTPAQARRNAQMFLSILCDEGYTPNCRKTRIMPRGRRQCVTGLVVNERPGIARDEFDRFKALLTNCLRHGAASQNRAGVADFRASVAGRLAWFEQIDSARAAKLRRLFEAIEF

SEQ ID NO: 5481 - protein, 477 aa, unidentified
  source 1..477: note = Sterolibacteriaceae bacterium; note = Related to JADJSA010000006.1
MRAAPMHDESHPRFDSQYIEPDLLALATQLANALLAGEQRSPALRKRLQTVLGRNWPWLAQLIRQVRLDFGDGISSAEHDELVRSILAFAPLRRAFESDGEVPRVRGWFPFQPPMGAPPARLGAIDLPALATPGDLADWLGLRIGELDWFAGSLRPQVAANGPLWHYSYCWLAKRRGGYRLIEIPKPRLRNLQRRILRDILERVPVHPAAHGCVRGRSVVSAALPHTGTDVVLQIDLREFFSTVTAARVHAVFRTLGYPPAVARLLTGLATHSTPHSVLRAAPVAEHADAQAKRSQMQRQVLLTVPHLPQGAPSSPALTNLCAYRLDLRLSGAAAACGVGYTRYVDDLIFSGDVAFARKIERFKSMVYSIIVDEGFEPHFQKTRARTQATPQHVVGLVVNRRLNVPRCEFDALKALLHNCRCHGPAGQNRHAHPMFRQHLLGCIARVAQVNPARAARGCCGISAPSTGPDRAKPRCA

SEQ ID NO: 5482 - protein, 368 aa, unidentified
  source 1..368: note = Sterolibacteriaceae bacterium; note = Related to JADJHQ010000003.1
MGEPPASLRAKAKELPRLATPGDLADWLGLPIGELDWFAASLRSDLTADGPLCHYRYRYRYRWLAKRRGGYRLIEIPKPRMRGLQRRVLHRILEQVPAHDAAHGCVSGRSTISAALPHSGKNLVLQIYLQDFFTGVTAGRLHAMFRTLGYPPAAARTLTGLVTHSTPYSILRASPSPELGQNDDAGTKSRRHAMLRIAHLPQGAPSSPALANLCAYRLDLRLSGAAAACGIGYTRYVDDLIFSGDDAFARKMERVKSMLYSIIVDEGFEPHYRKTRAQRQATSQRIVGMVVNQKPNVPRREFDTLKAILHNCRRHGPQGQNHLCHPHFRQHLLGRISRVAQLNANRGERLLREFRQIDWSPAVLPKAG

SEQ ID NO: 5483 - protein, 502 aa, unidentified
  source 1..502: note = Related to NSJF01000001.1; note = Vandammella animalimorsus
MAFALPHPMGLNPHDDVALRAFAQHLARALLAGPWTPMAMRARLRRALGLARGGASPDWLRQLVRQLHAQPPFALPAQPQRRKAAGAATGPVPGSAHLQAVADAVAQCPALQQAWSATPAHAPWRIKGFFLPPPPPKPAAIAKLQPFVRELPPLAQVGDIAAWLELEPGQLDWLANCQDRPTPSPKLAHYRAHWLPKGQGGLPRLIEAPKARLKQIQRRILQELLAPIPLHNAAHGGVRGRSALSHAQAHAGMPVLLKFDLRDFFPSIRAARIHAIFACLGHTPAVCRVLTALVTTRTAHGVLRTAPLTAPPQSAPCGAGTGPSLAVQQAQLRQLYGQRHLPQGAPSSTLLANLATARLDMRLAAAAAALQGRYTRYVDDLAISLPQLPRAQLLRMQRLVRRIVHEEGFVLNEAKCGLYTASQAHYLTGICINAHPNLPRAAYDQLKAILHQCVLHGPSSQNRDGHRDFRAHLQGRIAWCRSLNPARAAKLQRLFERIDWQD

SEQ ID NO: 5484 - protein, 431 aa, unidentified
  source 1..431: note = Related to JAKGTI010000001.1; note = Maritalea sp.
MDKRLFSHNLAVHLSLCPWSLDQISACLRRNLPKGAHKYTTEIANELHIGLPTIFTPSVSAIEIVLRRAIRLESTYQFCRKQGKWPALNLSSPTMCPTPAFEGLDIPQLPTTASVADWLSISERRLDYLADEQNRHEEHGEASINHYHYIFKNKNGGGIRVIEAPKENLKSIQRAILKNIIGIVPPHDAAFGFVKGRNCLKAANRHVGEKVVLCFDLKNFFPSIGAGRVFGLFRCLGYPDAVARVLTSLCTSLTPRRILERFPLEERSIYNKRHLPQGAPTSPALANQICFGLDKRLNALAKCLGAQYSRYADDLTFSGDKHIARPLQYFLPVIAQDEGFSLNRAKTRVMPRASRQTVTGVLVNEHLNIDRRSFDKLKAIIHACGKPGDRRLLDPSFRKSLMGKIDWVESVNPHRGQRLRQLLSKAVENHI

SEQ ID NO: 5485 - protein, 430 aa, unidentified
  source 1..430: note = Related to FNUZ01000001.1; note = Thalassococcus halodurans
MNRNEVSLNLARSITRGEWSKEFINSNLLRRLPSTVHKLVPAISEDLVTELSARYAPTEKYVAEHLLYDRNFERIYRYCARKGIWPTPDLSPPVMAPIPAFQKIDLPQIPTLSALAEFLFLTPEQLEYLADRNGRHEEHGDMAVNHYHYVLKPKRTSGHRLIEAPKERLKAIQRHILRSILDKLPTHPDTFGFVRSRNCLQGANRHAGEQVVLRFDLKNFFPSISAGRIFGLFRCLGYPHNVAVDLTALSTTKTPARVLERLFYPDRGLYKTTHLPQGAPLSPALANHAAFGLDRRLAGLAKRLDANYSRYADDLTVSGDHTITSNLLRLVPQIIKDEGFALNTSKTRVLPQTTRQTVTGIVVNDHLNIDRKTFDHLKAVIHAFQKEGDHRLSDPAFRASLEGKIAWVEAINPSRGQKLWRLLDNAEKPS

SEQ ID NO: 5486 - protein, 424 aa, unidentified
  source 1..424: note = Related to JAESRD010000022.1; note = Rhodobacteraceae bacterium
MAASLSATQWQAHALERVFRSRLPTPLAQYAAEFSAGLIAALPSAYAPEPAAVAAVLVHLTSFEQVTAWAVKNGHWPVPDLRETQFLPIAAFADLSVPKLATMAQLGDWLGLSQERLAYLADTQARHEEHGETAINHYHYVLQRKKGPGLRLIEAPKQRLKAAQHQILRQMLDPLPVHDDAYGFVRGRSCQAHAARHAGTQMVVSFDMRQFFPSISAGRVFGLFRCLGYPSAVAHHLTGLCTSATPPRILQRLPYADRVVYRAAHLPQGAPSSPALAYHVAFRLDRRLSALADSLDATYGRYADDLSFSGDRRITEPLMRLVPQILREEGFCLNPSKTRAMPQTARQSVTGIVVNQHLNIARGQYDRLKAVVHACGKPDDSRLADPVFRGRLEGQIGWVASLNRARGAKLQALFNTALDGALGG

SEQ ID NO: 5487 - protein, 455 aa, unidentified
  source 1..455: note = Related to VICH01000004.1; note = Aliiroseovarius halocynthiae
MSCTLRLTMERHERHMNDQHLALLLATRLTGPWSVQDITQSLCRHLPAPLHTQAEAISQKLLRIHPGPYAPPIKQIARTLRNADEFPRIKAHCVRYNVWPAANLTPPQMMPIGALASLDLPQIPTLEDLADWLLIPTDQLNYLADPQKRHEAHNEMAVNHYHYHIHPKSNGASRLIEAPKQRLKAAQAQILRGILAHVPDHDEAFGFTKGRNCMSGATRHVGEQVVVGFDVKNFFPSIGAGRIFGLFRCLGYPESVARFLTAICTNVTPSRILNRLQAPERQQFRHPHLPQGAPTSPALSNKVAFTLDRRLSGLATRLGANYSRYADDISFSGDVGITHPLLQQVPRILRNEGFAPNPAKTRVMPRGGRQSVTGIVVNQHLNISREKFDHLKAVIHACRLPTDLRLDDLAFRMKLEGQITWIECINPVRGCKLRRLLKKSLKARIAETTKTGRAL

SEQ ID NO: 5488 - protein, 443 aa, unidentified
  source 1..443: note = Hyphomicrobiales bacterium; note = Related to JABDJG010000107.1
MDKRDLASNIAISLTNGTWSKDQVTAQLMRRFPKSLHRFSNQLSAELLAACPTIYAPSANAVQNVLQMSAIFERIFRYCQRRNIWPNPVLVEPIMAPTATFSELEIPQLPTVEALADWLLVPIDRIDYLADPIGRHENHEVAAVNHYHYLLHPKKSGGLRLIEAPKHALKSIQRQILRGILDKVPTHDDAFGFVRGRCCVGAAARHAGEQVVVNFDLKDFFPSVGTGRVFGLFRCLGYPNTVAGLLTGLCTTRTPHRLLKRLNPADRAQYRERHLPQGAPTSPALANHVAFALDRRLAGLARSIGANYSRYADDLSFSGDLQISATLLGIVPQIVHEEGLSLNPHKTHIMSAGSRQLVTNIVVNRHVNVTREKFDKIKATIHACAKPDDERLSDPVFRAKLLGQIGWVETVNPKRGLKLRKRAIEAIRKATIRSPSRNTSTQI

SEQ ID NO: 5489 - protein, 432 aa, unidentified
  source 1..432: note = Related to JAGRLY010000042.1; note = Alphaproteobacteria bacterium
MDSKSLARNLAQSLAMGPWSRQFIRATLVRRLPRQLHRMIAGLSEELIKSLPCAYAPSVKTVAGALGRSDRFEKILRHCIRHDVWPDPDLSSPAMAPVAAFATLDLPQLATLDALAEWLFLPPDRLEYLADKDSRYEEHRDAAVHHYHYIEKVKASGGVRIIEAPKPHLKAAQRRILRGILDKVPVHADAFGFVSGRNCLNGANRHVGEDVVVCFDLRNFFPSIGLARIFGLFRCIGYPHEVARLLTGLCVTTTPMHVANTLTTVDRQTYRRPHLPQGSPASPALANLAAFPLDRRLSGLAKSLDTNYSRYADDLSFSGDRESVGALLRAVPGIVADEGFELNQTKTRIMSATSRQMVTGIVVNDHLNIDRREFDRLKAIIHACGRPGDTRLADPVFRSALLGKIAWVEAVNSQRGQKLLTLLSLSITSRHA

SEQ ID NO: 5490 - protein, 314 aa, unidentified
  source 1..314: note = Related to JABDRA010000277.1; note = Anderseniella sp.
MSPVAVFAALDIPQLATLDALSDWLLLPIERLDYLADLHSRYENHGDTQVNHYHYVLHRKKSGGMRVIEAPKATLKTVQRQILHGILDKVPAHPDAFGFAKGRNCLDAANRHAGEQVVICFDLKDFFPSIGAGRIFGLFRCLGYPHQVASCLAALCTSVTPSRVVEHMSGPDRDTYRKPHLPQGSPASPGLANLAVFTLDKRLSALAKSVDANYSRYADDLSFSGDSHVAGILLRAVPQIIEDEGFQPNSAKTRIMSKTSRQVVTGVVVNHHLNVTRKAFDQLKAIIHACGKAGDLRLNDPVFRTSLLGKIGWV

SEQ ID NO: 5491 - protein, 319 aa, unidentified
  source 1..319: note = Related to JABURO010000157.1; note = Rhodobacteraceae bacterium
MDRGALAVNLAQGLCSGGWSAPEVGAILARRLPGAARRLAPRIASELVTAAPGPYAPTARITRAVLQRCESFERLYRWCNRNDIWPAPDLSRPSMAPVAAFARLDLPGLATQKALADWLLLPPERLDYLSDPASRHERHGDFAVNHYAYVLHRKTHGGLRLVEAPKPTLKSLQRQILRGILNRVPPHDDAFGFVRGRNCRGAARRHAGEQVVICFDLKDFFPSIGAGRVFGLFRCLGYPQPVARHLTGLCTNTSPSRITDRLPPPDRPMYRRPHLPQGAPCSPAMANLAAFGLDRSLSGLARSLGAGFSRYADDLAFSG

SEQ ID NO: 5492 - protein, 434 aa, unidentified
  source 1..434: note = Related to NZ_JAEHHL010000001.1; note = Proposed Thermohalobaculum xanthum
MKPRALAYRLAVSATQGAWSLPEVQAVLARRLPPAHRHLAKDIAAAMLSCGEGSDLTPPPQVVARALPGTPAFENLYLHCRNTNVWPAPETEPPVMRPLPPFDGLDLPQLPTEGELAAWLMLSPERLAQFADLAGRAEASPETAINHYFYRVVPKRAGGVRLIEAPKPALKGLQRQVLRGILDPVPVHRDAFGFVRGRGVTAGAARHAGEAVVLRFDLADFFHSVGRGRVFGIFRAMGYPHNAARCLAGLTTTAAPPWIMERLGAGDRPYLRIPHLPQGAPTSPALANLSAFGLDRRLAGLARRLGAAWSRYADDICFSGDPDIVAPLMAAVPGIVAEEGFRLNAAKTRVMRAQARQCVTGLVVNRHLNLPREEFDRLKAIIHRAASPGDARLADPRFRAALAGRIAWAEAVNPARGAKLRARLEAALAQKVAL

SEQ ID NO: 5493 - protein, 424 aa, unidentified
  source 1..424: note = Related to NZ_FOIZ01000001.1; note = Cognatiyoonia koreensis
MTPQSPKRLAQNLAESLSLSVWDKRGIADCLCRRFPPALQRFTQLQTQGLLDHFPTQIAPGRTAVASALAQSSVFARIHRYCVLNSVWPAPDLRAPKMQPLQAFAHLEIPQLATLGDLADWMLLTPQQLDYYADQTGRHEEHGDMAVNHYHYHLSPKIGGGHRLIEAPKPRLKSLQRLILRAILDHILPHPNAYGFVQGRNCIEAAARHVGEKAVVAHDLRDFFSSIQGGRIYGIFRALGYPPNVAHALTGLCTVTTPARIRNRMGFHQRQALRVAHLPQGAPTSPALGNLAAHGLDRRLTGLARSLGATYTRYADDLTFSGDEHIIRAICVAVPDIVSEEGFALNPAKTRLMPSHRRQVVTGIVVNNATNVDRREFDQIKAAIHARAWQTDPALQARLSGQIAWVRQLNPARGAKLERLMARA

SEQ ID NO: 5494 - protein, 386 aa, unidentified
  source 1..386: note = Related to NZ_BLJE01000002.1; note = Litoreibacter roseus
MIVEFPQRYAPDANRIAEMLSKQLVVRRLFKHCNKADVWPSLPLEPPRMLPVAPFDALVLPTLHTAIDLADWLLLTPEQLDAFVDRNGWRETHPMPGVNNYFYRMSPKSSGGLRLIEAPKPRLKSLQRLINHRILAKVPTHPDSFGFVRGRNCIGAAQRHAGEEVVIGLDLKNYFSSLRYGRVYAFFRHLGYPVSVAHGLSGICTIVTPSRIRQRMPYEQRQTLMEPHLPQGAPSSPALANLLTYRLDRRLAGLARSLGANYTRYADDLTFSGDSGVRDAVLTTVPEIVEEEGFRIRTGKTRIMPCYRRQMVLGIVVNETINISRKEFDRLKAIIHQKAWKNDPAEFEKILGQIGWVEQVNPSKAQKLYAKLELANAREHVQGSST

SEQ ID NO: 5495 - protein, 436 aa, unidentified
  source 1..436: note = Related to JACXGQ010000004.1; note = Yoonia sp.
MHPDQRNSLKIFARLVAPSLAKGRWAVSDVTGALKRRLPAQFQREAQLIAEDLVAFLPAMTAPNAGAISKALCACDAFVRLHGECLRRGLWPDPDLNSGKMLPLFPFARLDLPNIPTFAALADWLVIDGGRLMYMADIANRHNEHPDAPVHHYLYGLRPKPTGGYRVIEAPKSGLKALQRQILRGILDKVPVHSDAFGFVRGKSCAQAANRHCGAQTVVGFDLRDFFPNLAAARVFGLFRRLGYPDAVARTLTGLCTTTTPQRVRARLPHLQGQLMRTPHLPQGAPSSPALANLIAFTLDRRLAGLARALDAQYSRYADDLTFSGDAGIAPVLTRAVPHILQEEGFVLNPRKTRVRNAAQRQVVTGIVVNQHINVPRARYDLIKAKINALRHTDDLGRLGHAHCLSLEGQIDWVCTLNPSRGQKLRQLYARAINGG

SEQ ID NO: 5496 - protein, 411 aa, unidentified
  source 1..411: note = Related to NZ_PKFN01000009.1; note = Yoonia maritima
MPELTGALQRRLPPQFHREAQLIAADLIPLLPVMVAPTDGAITKGLLNCGAFARLHRECLRLGIWPAADLQSDQMRPYAPFAQLDLPDLRTEANLADWLMLDYSRVAYFTDISNRQNDHPDAPVHHYLYGLRRKSSGGLRVIEAPKSNLKSIQRRILHGILDQVPVHTDAFGFVRGRSCVQGAARHCGEECVVRFDLRDFFPSIQSKRVLGLFRRLGYPRWVAQSLTGLCTTATPGRVLVGLPPQQRQQMRVPHLPQGAATSPALANLIAFTLDRRLSGLARSVGAGYSRYADDLTFSGDIGITGVLEDAIPQIIADEGFVINPNKTRVTHRSERQTVTGIVVNQHLNISRKQYDQIKAIIHALRRPDDPRRLDQAFCLSLEGKIDWVCAVNPHRGNKLRRLYQVTIEDFG

SEQ ID NO: 5497 - protein, 433 aa, unidentified
  source 1..433: note = Related to NZ_JADCKQ010000007.1; note = Paenihalocynthiibacter styelae
MNRTQFASSLAPSLLAPRWSETELSQCLLQRLPGQQKALSARLTAELLQTFPGPVAPPERQLVAGLRGRPTFERLYRHCAKQAIWPAPVLTQTRMQPASGLGRPEVPHLDTPGDFADWLPLPEDRLNYLADVDGRYACHAYRTIRHYHAVAEAKKSGGHRLIEAPKSQLKAVQRQILQGILRQIPVHEAAYGFAPGKGCADAARLHCGRDEVVCFDLADFFPSVSFAWVFGVFRHLGYPEAVTRLLAGLCTTETAPDVLVQFPFAMRQLYRIPHLPQGAPTSPALADILLFNLDCRLNALATKLGASYTRYVDDLTFSGPAGLGRGLLKLVPEIIRDEGFRSNPGKVRVMPSGGRQVVTGIVVNAHLNMRRAEFDQLKAEIHACGRPGDLRLSDPHYRARLIGRIQWLRHLNPIRGEKLLTLLGRAEAQKITA

SEQ ID NO: 5498 - protein, 437 aa, unidentified
  source 1..437: note = Related to FWXB01000002.1; note = Roseovarius aestuarii
MARYTKQDLLFGPLSQGLSQLEWTFWDIRHHLEQRLPSRLRSVSHRLARELKQTFPATAAPDDRQILLYLKQSPATDPLFRHFTLTGAIPDPLIDPPQFRPVPALDGLGLPVLTTSDDLAAWLALPPLQLTRFADLLGLSANADSAFAPHYRHHLIAKRNGTLRLIEEPRPFLKKLQRRILRDMIAHIPTHPAAFGFCRGKNCAQAAARHAGEEMVVSFDLSGFFPSIHHHRIYGLFRSFGYPAAVARHLAGLTTALTPRDVLATAHLADRDHLTGRHLPQGAPTSPALANLAAFTLDTRLAGLARSLGANYTRYADDLTFSGDAPIANPLQRMVPQIVRDCGFVLNAAKTRIQPAHRRQTVTGLVVNRHLNLPRADYDHLKAVIHHLRDPVDPRRADRIFIDQLAGRIAWFEQVNPTKGAKLREWLANALQTGTIG

SEQ ID NO: 5499 - protein, 441 aa, unidentified
  source 1..441: note = Rhodobacteraceae bacterium; note = Related to DQCI01000287.1
MSGRSVSDRVFGPLAASLVRQAWTALTLRQHLQARLPQALSAEAPGLARDLKAAFPGTAAPDRKRVALWLSMCPLAGDLVTIARASGAPIPPPLDPDRFQPPPAFAGLDLPPLGTLADLADWLALTLPQLSRFSDLHGISAAQDNPFAPHYHHHLLEKRDGTQRLLEEPKPVLKHLQRRVLRQILARIPPHPAAFGFCAGRSCLQAAQRHAGEALVVCFDLKAFFPSIGWHRVYGLFRAFGYPPAVARHLAGLCTAITPPRVLAAPRLAARDLLTNRHLPQGAPTSPALANLTAYALDARLAGLARSLGLTYTRYADDLTFSGDTRPAAALHRAVADIVRDCGFTLNRDKTRVQPRHRRQVVTGVVVNRHLNLPRADYDRLKAVIHHLRNPDDPRRADRVFLDRLAGRIAWLEQINPAKGAKLRDRLAAALATTRATRHHG

SEQ ID NO: 5500 - protein, 433 aa, unidentified
  source 1..433: note = Related to NZ_NSBT01000024.1; note = Actibacterium ureilyticum
MSVLVDPVFAALASGLVHVDWTADQIAAHLRRRLPRRFQSRAGDIARHLHDRFPGAASPDEERIAAALSDGPAARALVRFSDKTGELPAYIWTPARFQPIPAFATCGLPALTTPEELADWLGLTTAQLTRFADLKGLSAQTDNAFAPHYRHHLRPKRDGTLRLIEEPKPLLKTLQRRILRGILARVPPHDAAFGFRAGRNCTMAAARHAGEGGVVRFDLAAFFPSIAQHRVYGLFRGFGYPAPVARHLTGLCTAHTPARVLTTPGLAAAGHLSSRHLPQGAPTSPALANLVAFTLDTRLAGLARRLDATYTRYADDLCFSGDARIAPVLRAALPGIVADCGFHLNPAKTRVQPAHHRQTVTGIVVNQHLNLSRRDYDRLKAQIHHLSDPADPRRGDRAFLTRLEGRIAWLEQLNPHKGAKLRARLAAALSPGP

SEQ ID NO: 5501 - protein, 438 aa, unidentified
  source 1..438: note = Related to NZ_BMYJ01000004.1; note = Gemmobacter tilapiae
MLSLHVLLPLAHRLANQPWDQPLLAACLRSYLPPPLNRQANRLANRLIKDFPGTTAPDAQQIAKALGQTTTAARLATLARQQTRPPSPDLNPPHFRPNPALHIPAIPVMETIPDLAFWLGLTEDQLTRFADLRGLSARSHPEFGSHYRQHLIPKSDGTLRLIEEPRPFLKRLQRRILTGLLNHVPPHPAAHGFRPGHSVLTAARAHAGEQIVLRFDLRHFFASITIARVYGLFRTMGYPATIARPLAGLTTAITPTEVHKTPHLAGAELFAARHLPQGAPTSPALANLAAWFLDLRLAGLARSVNAQYTRYADDLTFSGDRRIAPVLLDALPHIITETGFRLNLSKTRIMPAHQRQTVTGLTVNRHLNLPRDQYDRLKATIHHLTCPDDPRRQDPAFLAQLSGRITWAEQANPHRGAKLREALAAALERLPPPPISPI

SEQ ID NO: 5502 - protein, 441 aa, unidentified
  source 1..441: note = Related to NKIU01000001.1; note = Pseudorhodobacter sp.
MTRPLRPPFPDRAALAPLAASLAQQDWTEAALVLHLRQRLPGDQPARAARLARSLLQSFPARSAPDAAQILRHLQQSPQGRAVLAHARRYQLLPAHSLTPPAHRPIPPLHHLALPPLATEAELADWLAITPDQLTRFADLRGLSARTDSPWAPHYHHHLIAKSNGQLRLIEEPKPFLKRLQRRILAGLLNHIPPHPAAYGFVPGRNCIQAAARHAGEQIVLCFDLAQFFPSITDRRIYALFRALGYPAHCARSLAGLTTALTPAHVLHTANLAARDQLSNRHLPQGAPTSPALANLSALQLDRRLAGLAHSLGASYTRYADDLTFSGDARIAPILQRAVPQIVAEQGFRLNPAKTRAQPAHHRQTVTGITVNETLNPARGSYDLLKATIHHLSRPTDPRRHDRAFLANLHGRIAWVAQINPAKGAKLHDRLHAALLTPQDS

SEQ ID NO: 5503 - protein, 395 aa, unidentified
  source 1..395: note = Related to JADJTJ010000002.1; note = Rhodobacter sp.
MPASFVRAPETLAEALIRAFPGPVAPDPALILGLLAHQPEIARLLSHARRHDVAPAVWLQPPPFRPAPALADLPLPRLATCDALADWLALPPDRLTLYADLRGLSARTDSPFAPHYHHHLLPKADGSLRLLEEPKPILKRQQRQVLHGLLSRVPPHDAAFGFCPGRNCIGAAARHAGEAVVLGFDLVDFFPSIGIQRVYAVYRTLGYPRAVAWALAGLCTALTPPKILATPALAAREALSTRHLPQGAPTSPALANLCAHALDRRLAGLARSLGASYTRYADDLAFSGDTRIAPILRTAVPRIVAEEGFRLNPAKTRQMPAHHRQCVTGLVVNAGVNTPRAAFDQLKATLHRLARAGDPRRTDPGFLARLSGQIAWVEQVNPARGARLRTRFDAL

SEQ ID NO: 5504 - protein, 445 aa, unidentified
  source 1..445: note = Related to NZ_WCHR01000012.1; note = Gemmobacter serpentinus
MPPAFNRPVVSLAVLGPIASSLVQAEWKEASLKQVLLQRLPVRMRNQAGRVAGRLIQAFPGGSAPDVGRLRRMLQDLSISARLRDHARRTDSLPAPVLDPPRFRPVSALDRLDLPKLATPGDLADFLAITPEQLIRFADLRGLSAHSTDPFGPHYLCHLRPKRNGGHRLIEAPRPFLKTLQRRILRGILDHVPPHHAAFGFRRGRNCVQAAARHAGERVVLGFDLTDFFPGLDVARVYGLFRSLGYPAATARDLAGLCSALTPRRYLLGHDPTLTGRLHARHLPQGAPTSPALANLLAFRLDCRLAALARSLDAQYSRYADDLSFSGDARIAPILLRAVPEICAEEGFRPNHRKTRVMPSHQQQKVTGILVNHHTNLPRVEYDRLKAILHRLQQPDDPRRQDMAFLGHLSGRIAWLAQLNPHRAARLSQSLQLVSASARTVPPAR

SEQ ID NO: 5505 - protein, 440 aa, unidentified
  source 1..440: note = Related to NZ_VKKX01000051.1; note = Gemmobacter caeruleus
MAPLHPDDPPPLPPVAAVFGPLAASLSQSPWQEDALHRLLLTRLPGPLRAQARRIAQGLIGAFPGSVAPDAARLCKVLRDLPGARGLRAHAARTGLRPAPELTPPTFLPAPGLAGLALPVLTSPADVADFLAISPDQLIRFADLRGLSARSPDPFGPHYLCQLRPKRRGGWRLIEAPRPFLKTLQRRVLSSLLAHVPPHPAAYGFRRGRNCIMAAARHAGEPLVAGFDIADFFPRLTVARVYGLFRALGYPAAVARDLAGLCTAITPAATLAALPARDAPIWRTRHLPQGAPTSPALANLLAWRLDCRLAGLARILGATYTRYADDLTFSGPARIGPILRDAVPAILRGEGFAPNLAKTRLMTAQGAQIVTGVMVNRHVNLPRAEFDRLKAVLHHLARPDDPRRQDAGFLAALSGRIGWVEQINPARGAKLRARLVALTG

SEQ ID NO: 5506 - protein, 401 aa, unidentified
  source 1..401: note = Related to CP059262.1; note = Exiguobacterium profundum
MPTSLRRLASPLAAELRAAFPGLSAPDAARLLAHLLASPLGQRIADHAARTGTRPASVLDPPAFQPLPALADLPLPRLSSPGDLAEFLALSPDQLIRXADLRGLSARSPTPFGGHYRIHLMPKPANGLRLIEEPKPFLKKLQRRLLHGLLDAVPPHAAAHGFRXGRSCIGAAAAHXSEAMVACFDLADFFPTFGFARVYGLFRSLGYPAAVARDLAXLCTALTXPDILRGTPGLAAGRXTNRHLPQGAXTSPVLANLMAFALDSRXRGLARSLGARYTRYADDLTFSGDARIAPILARAVPEIVAEEGFRLNPSKTRLQPAAHRQVVTGLTVNTRVNIPRSEYDQLKAILHHLANPADPRRADPAFLSSLQGRIGWVEQVNPHRGARLRHALATLALDGAR

SEQ ID NO: 5507 - protein, 427 aa, unidentified
  source 1..427: note = Related to NZ_WQIE01000002.1; note = Ruegeria sp.
MHLQQAIRSLAASLSQAQWTYFDTKLILQQRLPPRLRNLAPSLARRLVSALPQPYAPSARTIAQTLASFPETGQIARYTEPRKLVAPFPIAPQKFAPIDIFRSLNLPDLSSCDELAEWLAIPPIQLVRFADLNGLSNRTKNAFAPHYRFHIIPKRDGTSRLIEEPKPALKRLQRRILRSILNQVPTSPHAFGFVQDRTCIQAAARHCGEPVVVSFDLKNYFTSITYPRIFGVFRCLGYPADVARHLTGLVTLVIPAHVRAQLGRIGHHDLRRRHLPQGAPTSPALANLCSYNLDRRLAGLAQSLDATYTRYADDLTFSGETHIARTLCSVVPDIIRDERFTTNPDKTRVMPSHTSQVVTGIVVNHHVNITRKDFDRLKARIHRLRSQGKDDLETLQHLDGQIAWVEQVNPLKGAKLRQRFEHALSLT

SEQ ID NO: 5508 - protein, 395 aa, unidentified
  source 1..395: note = Related to NZ_RYZK01000009.1; note = Shimia sediminis
MAFASHLASEILLWYPKTYSPCQSDLATTLSRLPEIADVWNYARQKNVWPRSRIDTPEFLPAPALEGLDIPHLATCADLADWLLISQDQLTRFADLKSLSASTDNAFAPHYRYHTISKASGQARLIEEPKPFLKTLQKRILKGILNHVPTSEISFGFTRGRDCLQAASKHCGEDVVVTFDLRSFFPSVRQSRVIGLFRCLGYPDAVARHLAGLTTVITPAFVLKRLRLENDRFLPNRHLPQGASTSPAIANLSAYALDRRLMGLARRLDAQVTRYADDITFSGPREITTPLKHAVPEIIADSGFVVNPQKTHIMPRTQCQVTTGLVVNDHINILRRDYDNLRAELHHLLTLDDPRRRDASYLFALDGRITWVERVHPVRGQKLRESFNQVLLRGN

SEQ ID NO: 5509 - protein, 429 aa, unidentified
  source 1..429: note = Related to NZ_JABUFE010000011.1; note = Sulfitobacter algicola
MNRANLAQSLAGSLVCCDWTLWAVEHHLTSRLPSGWSKTASNLASELIAAFPAPYVPSQAALVQRLISSDYLTRILDHAMKHDLRFSPILDSARFAPIPAFEGLDIPQMTTLSDLADYLALNTDQLVRFTDLMGLSNGTDNVFAPHYRFHLIAKRNGRQRLIEEPKPVLKSLQRRVFQTILNKVPVHDEAYGFVPGRSCRDAAARHTGEQVVIGFDLRNFFPSVSYGRIYGLFRALGYPDGVAHHLCGLCTIRTPPHIRARMSYDDGRGLEARHLPQGAPTSPALANLVCHRLDCRLSGLAHSLDARFTRYADDLTFSGDRRMANAILKVVPQIVTSEGFALNPTKTRCQGQHGRQVTTGIVVNSHINLPRETYDYLKAVLHHLIQPKDPRRGDPAFLKSLSGQIGWVEQINPGKGAKLREKFDQIIQH

SEQ ID NO: 5510 - protein, 443 aa, unidentified
  source 1..443: note = Related to NZ_JAKJIC010000019.1; note = Pleomorphomonas sp.
MQEERTPPIGRTALASALVHALSTTAAWTETALVDTFTHVLQGAAPGSVASLARLLAADASVACGPERRLGQIIEDAPSFVRILQTVQRRRLVLAPPLTPPLFRPASRFAGLPLPCLATSGELAAWLGLTPTELDWFAATLPQRGETQPPLQHYSLRAVAKASGRLRLIEAPKTRLKAIQRQILAGILAHVPAHPAAHGFIAGRSVLTAVNPHAGEGLVVAVDLADFFPSTPIGRVWRLFRHLGYPDAVAHLLTGLVTTRTPSPALDGLLLPPETRRRLRVRHLPQGAPTSPALANLAAYGLDVRLSSLASRLDASYSRYADDLVFSGSGPQLRQSQRFLRLVSEIAAAEGYALHPDKTRIMPSSGRQQVLGVTVNAHLNLPRPSYDLLKAILTNACRHGLASQNREGLPHFRDHLNGRIAWFEQVNPARGLKLRALFDRIAE

SEQ ID NO: 5511 - protein, 440 aa, unidentified
  source 1..440: note = Parvularculaceae bacterium; note = Related to JAIENJ010000270.1
MTARAAQYLGKRAPRSLQRLIEHVIASARTPYPPSSEHVARALLNSTYFDAAARAVLQADSPPKAVLHSPAFAPARAFAGLPIPRIETAGELAAWFKLSVDELDWLADTRRGHGRASQAQLQHYSYALAAKRVGAPRLIESPKPRLKAAQRRILHEILDHAPSHSNAHGFVRGRSCISGAQIHAGEPVVLRLDLQRFFTGIRASRVHGLFRALGYPSETARLLTGLCTTCTPQIATAAIEDWRIRQEYGAPHLPQGAPTSPSLANLCAWRLDQRLGGLARRLAINYSRYADDLCFSGDRALAARAPSFVSLVETIASEEGFVVNSDKTKVMRASSSQRVTGVVVNQHVNAQRHDYDALKATLHNCRTSGDPETQNRKGLPDFRAHLEGRINWVEQLNPHRGMKLRLMFDAIHWPAGARDAGDRRADASRRPPLPFAGEAD

SEQ ID NO: 5512 - protein, 442 aa, unidentified
  source 1..442: note = Related to JAEUMS010000015.1; note = Hyphomonadaceae bacterium
MADRALIARELAAFLLAGAWTKGRLLARTRQYIGNSAPKALQRLIEHVFALVETPYPPAPDELARMLMASRDFDVAARRMLRADRPLQLALHSPKFAPCRSLAGLPVPKLETPGDLAAWLGLPMELVDWLADTRRGHAHAATTQLQHYSYTFVPKRIGAPRLIEAPKARLKAVQRRILHEILDHLPPHSSAHGFVRGRSCISGAQLHVGEYIVVRLDLRRFFSSIGSARVHGLFRSIGYPWAAARLLTGLCTTCTPAKTLAALTDWRERQEYTAPHLPQGAPTSPTLANLCAWRLDNRLTGLGRRLGINYSRYADDLCFSGGRAFAKHMPRFLSLVGTIVGEEGFALNGRKTSLLRANAAQRVTGIVVNQHVNVAREQYDALKSILHNCRVSSDPTTQNRDSHPDFKAHLDGRIGWVEQVNPHRGRKLRLMFDQIKWASARA

SEQ ID NO: 5513 - protein, 438 aa, unidentified
  source 1..438: note = Related to JAEUMQ010000004.1; note = Hyphomonadaceae bacterium
MASSTTIAKGLAAALVAGVWTERALLARCEGFLGAATRASQKKLISALLVRAYDRYPHSPASLVRWLLRSPAFERAAAPLLRAGPKPPVVLKPPLFWPAPPLAGLDVPKLATPRDLADWLEISVEQLDWFACAKRQAIALSFPKLRHYECALVRKRSGGSRLIEAPRRRLKAIQRRLLREVLDHVPTSDRAYGFVRGRSCIDGAQVHAAEEVVVTLDLQRFFQSIAARRVHATFRGIGYPWAVARLLTGLCTTRAPSWGFADVPYTEFDWRARKMLEAPHLPQGAPTSPTLANLAAWRLDRRLAGLARRLDANYTRYADDLAFSGRRNIASPTFLRAVGEIVVDEGFVLNRPKTHIMRRGARQEVTGIVVNEHVNLPRDAYDALKATLHNCIRNGAAVENRDGHTDFRAHLDGRIGWAETVNPHRGARLRAMFERITW

SEQ ID NO: 5514 - protein, 433 aa, unidentified
  source 1..433: note = Related to NZ_LMUJ01000042.1; note = Acidisphaera sp.
MPTRHWAANNLAARLLAGPWTQEAIAIVIDAVLGPVDLRARADLITDVAALAEATYPPTPQALTTYLVRSRSFKPHPERPIPAVLAPPRFAPTPPFAGLPIPALATQGDLAAWLGQSPEQLDWLADERRRHSRVTRPPLRHYHYTFASKRTGAPRLIEAPKPRLKAIQRRILREILSPVPTHPRIHGFVAGRSCLTGAQIHAGEAIVATFDLTQFFPSIGLPRIHGLFRSLGYPWAVARRLTGLCTTTTPSGVFPDPQHPDHALYRVPHLPQGAPTSPALANLLAWTLDRRLDGLARSAEANYTRYADDLAFSGDEAFVARIDRFRRTVETILEEEGFALNTAKTRIMPRSTRQRVTGIVVNEHCNIGRAEFDTLKAILHNCTRTGPAAQNREAIPDFRTHLDGRIAWVEQVNFPRGLKLRRLFDQIDWTPPP

SEQ ID NO: 5515 - protein, 418 aa, unidentified
  source 1..418: note = Related to JADLHI010000158.1; note = Hyphomonadaceae bacterium
MEARAAAYLGKSTKRWQKRLIAEIVSANGAGYPPSPAALADRLLASSHFDRAVAIVLRQKTPPPMVLDPPAFAPAPAFAAMHPPRIETIGDLATWLEIPIARLDWLADEKRQHSRANLPILQHYHYRFVPKSSGAPRLIEAPKAQLKALQRRILVEILDLAPVHPRAHGFVRGRSCLTGAQVHAGEQLVVCADLRDFFPSIRAARIHGLFRSFGYPTAVARALTGLCTTSTPRSIFQRIDEGQQFDWFTRRRYSAPHLPQGAPTSPALANLCAWRFDQRCDGLARALGGSYTRYADDLTFSGDAAFAARTSRLIAALGKIIGEEGFAINESKTRLMRRARPQRVTGIVVNDHVNVPRRGYDELKALLHNCCKHGPASQNRDRRTDFRAHLDGRVGWVEQVNPNRGAKLRTAFDAISWS

SEQ ID NO: 5516 - protein, 443 aa, unidentified
  source 1..443: note = Proteobacteria bacterium; note = Related to JADFVY010000399.1
MSFENWTAWHLAEILIATDWTPQAMEDAARKALGGNRQRKWLPRLIADIMGSSPTAYAPSPRTVAGLILDSRAFRGLRLNDRERPLFDRYFLPAPIFSPTPAFRDLAVPELANALDSARWLNLSPRHLDWFADIEGYRSSAAAESTRHYVQAWIPKRTGPPRLIEAPKQILKDLQRKILREILDPVAVHDSAHGFRRGRSCITAAQLHAGEDMVITMDLKDFFPSVPIRSVHGIFRSLGYPWAVARLLTGLCSTTAPASLFDNPPGDSGHDEETRRLFHQRHLPQGAPTSPALANLCARRLDGRLNGLAHCMEARYTRYGDDLAFSGDRDFAARSGAFLRMASAICAAEGFAVNHRKTRIMRQGDCQRITGLTVNSHINVPRGAYDRLKAILHNCTRHGPANQNRENHPDFRAHLDGRITWVENVNPPRGLRLRLMFMAVEWG

SEQ ID NO: 5517 - protein, 400 aa, unidentified
  source 1..400: note = Related to JAEUME010000009.1; note = Hyphomicrobium sp.
MLRRLAAFADHSGQPPSPDWLTDFFLAAPEFAGAVARILKEPQILHCVLKPAKFAPAKKFAGLNVPKINSSGDLAAWLGLSNEHLEWLSDTRRQHSRTAIPVLQNYQYTFVLKKHGPPRLIEEPKPRLKTIQRRILREILDRVPVHACAHGFVAKRSCVTSAQAHCGEFIVLAADLKDYFASIPAARIQGIFRAIGYPSSVARLLTGLCTSGTPTSVFASRSGGRMCDWQTRKLYEQPHLPQGAPTSPALANLVSFSLDRRISGLAARFGAKYTRYADDLAFSGDEIFDRRVDTFLEHVAMIAVDEGFMLNAAKTRIMRRSQSQRIIGVTVNDHINLPRGTFDELKAILHNCRKFGPNTQNLLGVANFEEHLRGRIAWAASLNPARGAKLHAMFNLIRWT

SEQ ID NO: 5518 - protein, 441 aa, unidentified
  source 1..441: note = Chitinophagales bacterium; note = Related to JACMJQ010000424.1
MNTPPWIARNLAASFLGSAWNKNDLRLAATKTLGLATRAAQRALINRLFDAHNAPTPPSEDWLTSYFLMSEWFEIASLRAREHPRGVNAVLTPPRFAPSQRFADFGAPKLTAPGELAKWLAVSIEYLDWFADRKRMQAKTDIPLLQHYSYKFAPKKSGPPRLIESPKPQLKAMHRLILREMLNCAPVHECAQGFVRRRSCLTAAKIHAGEHVLITADLKDFFLNTRLSRVHGVFRNLGYAQPVARLLTALCSTSTPQSLFARLPVSQRHDWETRKRFEAPHLPQGAPTSPALANLCAWRLDCRLFGLAKSFGANYTRYADDMAFSGDKAFADRVAGFVAALETIAADEGFALNRRKTRVMRGHTSQRVTGVVVNEHVNIARKDYDRLKAILHNCRRNGPEAENRAQIRTFRAHLDGRVNWVETVNPNRGTKLRRIFNEISW

SEQ ID NO: 5519 - protein, 376 aa, unidentified
  source 1..376: note = Alphaproteobacteria bacterium; note = Related to JABFRX010000116.1
MKKDDPAKALAAALLAGEWSRSALEKRAITALGARSKRRASRIVDDIWTNHKAPYVPHRNELRRLIYASNAFAGLGETAITRLNELKPKEQPPRFAPLPRFQNANLPPLATAGDLAQWLGLSPSQLDWFADERRTLARASDTLQHYSQTWLPKRSSGWRLIEAPKPRLKDIQRRILRGILDPIPTHDAAFGFVPGRSCTTAAAKHAGEGVVVTLDLRDFFVSVPAHRVHALFRCLGYLWSVARLLTGLCTAATPHATLASDQLDHETRQRLRARHLPQGAPTSPTLANFAARRLDARLDGLARRFEARYTRYADDLTFSGDERFHTSVPRFLIAVAQIARDEGFALNAAKTRIMPRHTRQTVTGIVVNDHINVARP

SEQ ID NO: 5520 - protein, 441 aa, unidentified
  source 1..441: note = Alphaproteobacteria bacterium; note = Related to JAIOQG010000119.1
MKSNRHLVPILAFMLLDGPWTPMALKRRAVRILGRRSRTRAIELVEEILASIKTPYAPQFKQLERAIVSCSSLHKIGEATADRLGKLSVTVPPPRFAPLAPFRGAGLPGFTTTAALAHWLAVPLGQIEWLADSKHTLSHATSDVLHHYACHWIPKQTGSWRLIESPKPRLKAIQRRILHDILDHMPVHDSAFAFIKGRSCATAAARHAGEDVVITVDLKDFFLTTPPRRIHAIFRCLGYPTSVTRVLTGICTTATPAAVLETNADIAARNHETRKRYASPHLPQGAPTSPTLANLAARGLDCRLTGLASRFNARYTRYADDLTFSGDKALLARSNRFIRAIQEIVQDEGFALNASKTRIMPRSTRQSVTGLVVNQHINIARPDYDNLKATLTNCARHGAPSQNREGHADFRAHMDGRVAWVENVNRRRGEKLRRIFEKISW

SEQ ID NO: 5521 - protein, 436 aa, unidentified
  source 1..436: note = Alphaproteobacteria bacterium; note = Related to JAEUML010000192.1
MSRRTDHFPVLALALLQGRWTRNALRKRARDLLGPRSKTRANRLVDEILAVHRLPYTPGWRTLTKIVAGASALHGLSDATIERVASTPGRQHPPRFEPIAPLQPASAPTLATTADLATWLEIPIDHLDWFADERRTLDREQDKALSHYAYHWRLKRSGAWRLIEAPKPRMMAVQRRILKDILNRLAPHEAAHGFVAGRSCVTAAAKHAGEHVVVTVDLRDFFLSAPVGRVHAIFRCLGYPHAVARALTGLCSTSTPRHVAAEHFDHEAQRRHATRHLPQGAPTSPALSNLAALGLDRRLAGLANRFGARYTRYADDLTFSGDSPFCARVPGLLKAVADIARDEGFALNAAKTRIMPRHQRQSVTGIVVNDHINFARDDFYRLKAALTNCVRHGPASQNRDAHPDFRAHLDGRITWVERLNLRRGEKLRRLFDAIAW

SEQ ID NO: 5522 - protein, 447 aa, unidentified
  source 1..447: note = Hyphomonadaceae bacterium; note = Related to JADMJM010000043.1
MPSQNQIAGDLAAALLGGAWTRRALLRRLSGYLRNKAARSNARLVDEILERTEGSYPPSPFALKRFILDSRAFPRAAAVLLRTTVPVAAVLTPPRFWPAAGNAAPGVPEIETPGDLAIWLGVPISRLQWLADEQRRHHTTAIPMFQNYRYRFMPKASGGWRLIEWPKPHLRAIQVKILREILDRLSVHEAAHGFVRGRSCKTAAAMHAGEAVVACMDIRDFFGSVRLQRIHAIFRRIGYPWAVARLLSCLCVTSTPASVFARAPDDAGLDWETRKRFSERHLPQGAPTSPALANLVVGEMDRRLEGLARHCDARYTRYADDLSFSGDETFARRIGGFLGSATDIVRDEGFSIHTAKTRIMRRGARQVVTGLVVNEHVNILRHDYDTLKAILHNCAKHGAESQNRSGVPNFPAHLAGRIAWVEHVNPVRGARLRTLYNKVAWTPRAEI

SEQ ID NO: 5523 - protein, 318 aa, unidentified
  source 1..318: note = Related to JABDIP010000422.1; note = Inquilinus sp.
LPPELDWFADTRRQHGVTEKRPLQHYSYAWVPKRRGAPRLIEAPKPRLKALQRQILRDILDRIPVHEAAHGFVKGRSCLGGAARHGGEAVVATLDLADFFPSVPLERVHGIFRCLGYPTAVARLLTGLCSTTTPRGVLAAAPGVKRPPGAFVPEAAPHLPQGAPTSPALANLSANRLDARLDQLAEYAGARYTRYADDLAFSGDDEFAAGIGSFLATVEEIIRAERFAPNRRKTRIMRRAGRQQVTGLVVNQHLNVPRPDYDRLKAILHNCARHGPAGQNRDGHPDFRAHLDGRVGWVQTVNPHRGLKLRLLFEAIAW

SEQ ID NO: 5524 - protein, 445 aa, unidentified
  source 1..445: note = Related to JAFECD010000003.1; note = Proteobacteria bacterium
MHWPNSSRHRLIARNIAVTLLAGAWTERAMADRLETLLGSTTRSTQRGLIGAIFDKSGGPYPPSLAELTASILEAPQFPAAARLALEYTTRLDIATRQPRFAPIARFADLEIPRLTTPGDVAAWAGLSIPELEWFADERRQHGRTAIPIFQHYTYAFRKKSSGPPRLIEAPKPRLKTIQRKILRDILDHIPVHPAAHGFVEGRSPRTGAAQHVGAPVVIAVDLENFFLSVPVGRIHALFRSVGYPDEAARALTRLCTTMTPRSVIDRVPNPARHTRAALAPYLDPHLPQGAPTSPALANLVAWRLDVRLAGLANSFGAKLTRYADDIVFSGDLTAPGKTQSLIAAIAEIVEDEGFGLNDKKTRIMTASQRQSVTGIVVNSRLNARRDSYDSLKAILHNCRLNGFEAENREGHADFRAHLEGRIGWIESLNPTRGRRLRDIFSRIP

SEQ ID NO: 5525 - protein, 434 aa, unidentified
  source 1..434: note = Related to JABFRT010000004.1; note = Hyphomicrobium sp.
MARNIANVLLSGLWAERAMLLRLQTALGKATAKSQRALIAEVLKANPASYPPPAAELVRTIFSAPSFEKAAASALLSKAPLHMALRPPKFAPTADLSDCDVPALPTSGDVARWLGLPLEHLDWFTDERRQHGRTAIPDLQHYVYAFRAKPHGPPRLIEAPKPRLKTMQKRILHGILDSVPVHEAAHGFVKGRSCKSGAEQHAEAAIVICFDIADFFLTSPLGRVHALFRGLGYPHAAARVLTRLCSTSTPETVFDRISSPRKHTRAALQAYCEPHLPQGAPTSPALANLVARRLDIRLTGLALSLGGRYSRYADDLTFSGDAAFAKKTNSLMAAVAGIVEDEGYALNERKTRVMTSSRRQQITGIVVNARTNAPRDAYDQLKATLHNCRKTGLAAENRDGHADFRAHLAGRIGWVASLNPARGDRLRAMLTEIA

SEQ ID NO: 5526 - protein, 449 aa, unidentified
  source 1..449: note = Hyphomicrobiaceae bacterium; note = Related to JAEUMD010000019.1
MRFEELIARNLAAAWLAGPWTEAGLFERGQEVIGKAGRRRFLQLVRAAIQAAPSDYPPSPGWITAFLRERDGLPDYTERFLNSRRSISLALEPAHFSSSLSLAPLDVPRLETPHDLAVWIGVPIEHLDWLADSRRQAYSTDIPMLQNYRYAFVPKRTGPPRLLECPKPLLMAAQRKILSGILDKIRAHDAAHGFVAGRSCLSGASRHAGEDIVIALDLKDFFLTTPVRRVHGIFRALGYPWAVARLLTGLCTSAVPLSVFRRLPPAERHDWKTRQLFNSRHLPQGAPTSPALANLAAYRLDVRLTGLARSLDATYTRYADDLAVSGSLTDRNAQKILATVRSIAREEGYEVHPSKQRVMRSDARQCITGVVVNRHVNVPREDFDRLKATLHNAARHGPRSQNRDGHADFRAHLDGRVTWVENVNPNRGAKLRRLFDAIVWKEGSGDAIG

SEQ ID NO: 5527 - protein, 354 aa, unidentified
  source 1..354: note = Related to JADKAD010000001.1; note = Deltaproteobacteria bacterium
MLDALDLPPLPHAEALASWLGIDADELVVLADCEGRERRRAARAQHYHYRRVAKPGGGERLIEAPKPRLKAVQRHILHGILDRVPPHDAAHGFVPGRSVWTGAGRHTGREMVIRVDLRDFFASVRGARVFALFETIGYPRSVCSLLTGLCTNATPATVWGTPSHAISTAALRERWHRIQRYAAPHLPAGAPSSPALANLAAHRLDRRLAGLAHAVDGSYTRYADDLTFSGDALRRGTLAFFSSVCRIVVEEGFEVHARKTRFHHRSQRQLVTGVVVNEHPAARRSAYDRLRAILFNCVRHGARSQADRDLAAFRAHLRGRIEWFAHSPARAAKLHALFDRIDFSEPDDDPPADG

SEQ ID NO: 5528 - protein, 333 aa, unidentified
  source 1..333: note = Related to JAEUJU010000311.1; note = Myxococcales bacterium
ALADVLALDDAALRGLADLEGHERRRRPTARHYHYACARKADGGERLIEAPKPRLKAAQRRVLRRLLDRVPPHDAAHGFVRRRSAVTSAELHAGQAMVIRVDLRDFFASIPASRVHAIFGALGYPVAVRRLLTGLCTNATPLAVWGPASPSLSSVALRERRRRLAQYAGPHLPAGAPTSPSLANLAALGLDRRLAALARSMDCRYTRYADDLTISGGDALRRGAHACVSTICRIAVEEGFVIHPRKTRLQPRGVRQTVTGLVVNARPNVPRDTYDRLRATLFNCVRLGPRTQSDLPLAELEAQLRGRVEWCAVNPGRAAKLRALFDAIDWSAA

SEQ ID NO: 5529 - protein, 352 aa, unidentified
  source 1..352: note = Related to JACMJN010001335.1; note = Deltaproteobacteria bacterium
MTEPLRFESEVELARWLALTPAELWWFADVEGIGRTRVNGPLAHYRYRFHAKPDGSTRLIEIPKLRLKLIQRRIARRLLAPLQLHDSVHGFVRGRSAITGARVHVGRALVLRVDLREFFASVSAGQVRAVLRRLGHADAVARALTGLCTNCTPRAAWTGSSTPANAEAVRQLWHRRQRYASPHLPTGAPTSPALANLVAGTLDLRLAALARSFGAAYTRYADDLTFSGDAPFRRDAERFFELVCGAVAEHGFAVHGRKTRFQGAETRQQVTGVVVNVHTSLVRRELERLEAIVHNCVRFGPAGQNRSGHPDFRSHLAGRIAHVASVHGRHGARLRERFAAIDWSPLDERSEA

SEQ ID NO: 5530 - protein, 423 aa, unidentified
  source 1..423: note = Related to NZ_NGFO01000034.1; note = Gordonia lacunae
MTDPFLRAHEAAEVAADFSRTYTSWTWPEVLTALRVLLPAEVTADVADRIFELSPHEPRHPATVVLEALAPWTHPEPQPRRPLVLHEPESSGTVLDDLPDLYDVEQVAHWLDFTVPELEWFADRGQWLRTARPPLRHYRIWRRDKREGVRVIEAPKPRMRETQRRLLRRLVERIPAHSAARGFVPGSSPAAFAWPHTDRPAVVRVDLRHCFESITVQRVRAVFRDAGFQPHIARLLAELCTTATPVDELRGLDHMHAALLRERHLPQGAPTSPHLANLVMRSLDRRLDGYARRNGLRYTRYGDDLAISGDAIDADRVLWTVLRIVDAERFTVHPDKVRIMHSHQRQRLAGLVVNDRPQVARSEYDNLRALLHNARRHGAASQNRADHPDFRAHVYGLIAWVGATGEARRRRLLDLAATVDWET

SEQ ID NO: 5531 - protein, 423 aa, unidentified
  source 1..423: note = Related to NZ_CP095552.1; note = Gordonia hongkongensis
MTEPFLQPHEAAEVAAAFSRTYTAWTWPEILAAVTAVLPAEVTSEVAAGIIELSPHEPRHPATVMIQALAPWTHPAPVAAQPVVVHEPRSAGTVSDALPDLYDVEQFAHWLDFTVPELEWFADRGQWLRTARPPLRHYRIWRREKRDGVRVIEAPKPRMRETQRRLLRRLIERIPAHPAARGFIPGSSPAAFAWPHTDRPVVLRVDLRHCFETITVPRVRAVFRQAGYPPHIARLLAELCTTATPVDELRGIDHTHAALLRERHLPQGAPTSPHLANLVMRPLDRRLDGYARRHGLRYTRYGDDLAISGDAMNADRALWTVLRIVEDERFTVHPEKVRIMHSHQRQHLAGLVVNDRPQVARSDYDNLRALLHNARRHGASSQNHDEHPDFRAHVYGLIAWVGATGETRRRRLLNMARTVDWDS

SEQ ID NO: 5532 - protein, 423 aa, unidentified
  source 1..423: note = Related to NZ_JAKOIW010000003.1; note = Gordonia sp.
MTDPFLTAADAAETAAAFARTYAAWTWPEVVAALRAVIPAHFVDDVAERVFELSPHEPRHAAELMTEALAPWTHPPEPVREPLILREPISPGTVPDELPDLYDITQLAHWLDFTVPELEWFADRGGWLRTAHPPLRHYRIWQRPKRDGVRLLEAPKPRLRETQRRLLRRLVEKIPAHRAARGFVPGSSAAAFAWPHTDRPVVLRVDLRHCFESITDRRVRAVFRDAGYPPHIARVLAELCTTTTPVDELRDIETGHAALLRERHLPQGAPTSPHLANLVMRPLDRRLDGYARRHGLRYTRYGDDLALSGDSMDADRALWTVLRVAEAEDFTAHDDKVRIMRRHQQQRLAGLVVNDRPQVARSDYDNLRALLHNARQHGASSQNHDDHPDFRAHVYGLIAWVGATRDERRRRLLTMADAVDWDA

SEQ ID NO: 5533 - protein, 422 aa, unidentified
  source 1..422: note = Related to RKME01000013.1; note = Gordonia sp.
MTPSLSADEIAEVAAAFSRTYAAWTWPEVLEAVHAVLPSSIADDVSVRLFELSPQEPRHPAAALTDALTPWTAPAPTVRPQISLQEPTSTGTVIDGLPDLYDVEQLAHWLDFTVPELEWFADRGGWLRQARPPLRHYRIWRRAKREGVRVIEAPKPRMRETQRRLLRRLVEQIPAHPAARGFVRGSSAAAFAWPHTDRPVVLRVDLRHCFESISVRRVRGVFREAGYPQHIARVLAELCTTATPVDELHDIEAGHAALLRERHLPQGAPTSPHLANLVMRSLDRRLTGYAQHNGLRYTRYGDDLALSGDEMNADRALWTTLRVVRAEGFTVHPGKVRIMHRHQQQRLAGLVVNDRPRVARADVDNLRALLHNAIHYGASSQNVDDHPDFRAHVHGLIAWIGATGEARRRRLLEMADQVDWDR

SEQ ID NO: 5534 - protein, 423 aa, unidentified
  source 1..423: note = Related to NZ_SLVY01000022.1; note = Rhodococcus sp.
MIEPSLPAVEVSEAAAVFSRIYTAWTWPEVLRALDSVLPGEIAPDVAHRLFRLTRAEPRHPAAALVDALAPWTIPRPAVPRHIELHEPTSTGSVLDGLPDLYSVEQCAHWLGLTVPELEWFADRGNWLRTAGPPLRHYRIWHRTKRDGVRVIEAPKPRMRETQRRLLHRLVGKIPAHPAARGFVPGSSPAAFAWPHTDRCTVLRIDLRRCFETITLRRVRGVFDRAGYPPRIARLLAELCTTTTPVDVLHGVTSAHAALLRDRHLPQGAPTSPHLANLVLRSLDRRLDGYARRNDLRYTRYGDDLALSGDTLDVDRTLWMVVRVVSAEGFVVHPDKLRIMHRHQRQRLAGLVVNDRPQVARSDYDTLRALLHNAIREGAASQNRSGHRDFRAHVYGLIAWIGATSPARRQRLLEMAAAVDWQS

SEQ ID NO: 5535 - protein, 424 aa, unidentified
  source 1..424: note = Related to NZ_FTNT01000002.1; note = Williamsia sterculiae
MAAPVLTVAEAAEAAADFSRGYGGWTWPEVLRAAGAVLPEGIAEDAVERLFAANPREPRHPAQAFTEALQPWTLPTPAPPRVIELSDPVPVGPMPYGLPDLYDVELLAQWFGLTVGELEWFADRGRWLRNARPPLRHYRIWRRHKRDGVRVIEAPKPWMRETQRRLLRRVVERMPAHPAARGFVAGSSTAAFAWPHTDRPTVVRVDLRHCFESITVGRVRRVFADIGGYRAPIARVLADLCTTATPVDELTGVEYGHAALLRDRHLPQGAPTSPHLANLVMRSLDRRLAGYARRNGLRYTRYGDDLAVSGDGIDADRVLWVVMRIVAAEGFVVHPEKVRIMHRHQRQQLAGLVVNDRPQVARDDYDNLRALLHNAIRDGAATQNRDGHDDFRAHVYGLIAWVGATSPARRQRLLEMARQVDWAR

SEQ ID NO: 5536 - protein, 422 aa, unidentified
  source 1..422: note = Related to JAADZU010000055.1; note = Gordonia desulfuricans
MSEPSLPAGEVAAAAAEFSRILTAWTRSEIVRAVIAVLPYDVAAEAGNRLFERTPHEPRHPAAAFVAALQPWTLPTPVTRTWDLTEPVRADGLPAGLPDLHDVEQFAYWLDFTVPELEWFADRGGWLRTARPPLRHYRIWRRAKRDGVRVIEAPKPRMRETQRRLLRRLVERIPAHPAARGFVPGGSTAAFAWPHTDRPSVLRVDLRHCFETVTTARVRRVFADVGYPPAIARLLAEICTTATPVDELTDIDHTHASLLRYRHLPQGAPTSPHLANLVMRSLDRRLDGYARHNGLRYTRYGDDLALSGDDFDADRALWVVLQVVGDEGFLVHPGKVRIMHRHQQQRLAGLVVNDRPQVARADYDNLRALLHNAIRDGAQAQNRDAHPDFRAHVYGLIAWIGSTGTLRRDRLLEMAARVDWDS

SEQ ID NO: 5537 - protein, 429 aa, unidentified
  source 1..429: note = Related to CP003119.1; note = Gordonia polyisoprenivorans
MLLDHSMTDATLAFDQVRELAAEFSRIYTGWTWPEVLRALRAVLARDLADAVAPRVFELAPTEPRHPEAVLVEALSPWTLLPPDPQLVLRPQEPRSSGTVPEGLPDLYDVTQLAHWLDFTVPELEWFADRGGWLRTSRPPLRHYRIWRRSKRDGFRVIEAPKPRMRETQRRLLRRLVEHVPAHPCARGFVAGSSTTAFAWPHSDRPVVLRADLRHCFETITTTRVRRVFHDVGYPAHIARILAELCTTATPIDELGGIDLAHRALLRDRHLPQGAPTSPHLANLVMRGLDRRLDGYARANGLRYTRYGDDLALSGDSMDADRTLWVVLKIIETEGFTAHPDKVRVMYRHQQQRLAGLVVNDRPQVSRASYDNLRALLYNAAAHGAQSQNHADHPDFRAHVLGLISWVGATNPTRRQRLLQMADAVDWDS

SEQ ID NO: 5538 - protein, 425 aa, unidentified
  source 1..425: note = Related to BAFC01000046.1; note = Gordonia sputi
MTRPQPPFTTDQVRVLAAAIADRIVDWTWPAVVRAVGIELPAEICVDVAQEAFALAPDEPTHTAEIFRLALVPWTVPDPPATRVVELPGPPPATALAHDLPLLSDVEQFAVWLDFTVPELEWFADRGTWLRTANPRLRHYRVFRREKRSGVRVIEAPKPRMRETQRRLLRRLVVRIPAHPAARGFEPGSSPAAFAWPHSDRTTVLRVDLLHCFESIGVGRVRRIFDEVGYPPHIARLLAELCTTSTPADQLSGIDYAHASLLRRRHLPQGSPTSPHLANLALAQVDRRIAGYANANGLRYTRYGDDLAVSGDDLDLPRALWTVTRIVDDCGFAVNTKKTRVMHRHQQQRLAGLVVNDRPRVSRHDYDALRALLHNAALTGAQAQNHHGHNDFRAHVYGLIAWIGATGEVRRQRLLDMADRVDWTA

SEQ ID NO: 5539 - protein, 425 aa, unidentified
  source 1..425: note = Related to NZ_BANR01000005.1; note = Gordonia aichiensis
MTRPEPPFTAAQARAISAAIADAMADWTWPEALRAVGAQLPAEISADIAQSAFAMAPAEPAHTAEVFRLALLPWTAADSPSGRIVELTGPTPVAGLPHGLPPLADVSEFASWLDFTVPELEWFADRGGWLRTANPRLRHYRVSRREKRSGVRVIEAPKPRMRETQRRLLHRLIARIPAHRAARGFEPGSSPAAFGWPHSDRPTVLRVDLQHCFESIGAGRVRRVVEDVGYPPHIARLIAELCTTSTPADQLTGIDHAHASLLRRRHLPQGAPTSPHLANLALAQLDRRLEGYANANGLRYTRYGDDLAISGDEFDAGRALWTVLRIVDDCGLHLNAAKTRVMHRHQQQRLAGLVVNDRPQVSRREYDAVRALLHNAAITGANAQNRHGHNDFRAHVYGLIAWIGATGEVRRQRLLEMADRVDWNR

SEQ ID NO: 5540 - protein, 425 aa, unidentified
  source 1..425: note = Related to NZ_CP085974.1; note = Gordonia otitidis
MTRPDPGFTTDQVRTVAAALADRIIDWTWPTVMRAVAAELPEEICVDVAQEAFAVAPHEPPHLAEVFRLALSRWTLPEPPIPRAVELPGPTPVTDLPYGLPPLHDVAQFAAWLDFTPAELEWFADRGTWLRTANPRLRHYRVFRREKRQGVRVIEAPKPRMRETQRRLLRRLVSRIPAHPAARGFEPGSSTAAFAWPHSDRPTVLRLDLEHCFESIGAGRVRRIFDDVGYPAHIARLLAELCTTSTPADQLGGIDLTHAALLRRRHLPQGAPTSPHLANLALARLDRRIDGYARANRLNYTRYGDDLALSGDDFDHGRALWIVRRIVSDCGFVVHPDKVRVMHRHQQQRLAGLVVNDRPQVSREDYDNLRALLHNAARSGARSQNLQGHNNFRDHVYGLIAWVGATGHERRRRLLDMADRVDWSR

SEQ ID NO: 5541 - protein, 442 aa, unidentified
  source 1..442: note = Related to NZ_BANX01000005.1; note = Gordonia soli
MTEPSRSAPQPFLSVADAAVVGALFARHHTAWTWPETLRAVDSALIDALQAGVTALADVPDGLARAISLRILDGGPLRDPVAVFVHAAARWTLPADAAPRSIETPGPTPSVGLPDELPELHDVEQFAHWLDFTVPELEWFADREGRLRTARPTLRHYRVWRRDKRSGVRVIEAPKPRMRETQRRLLRRLVERIPAHQAARGFEPGSSTAAFAWPHTDRPTVLRVDLRHCFESVPAARVRRVFADVGYPASVARLLAELCTTTTPIDELTGIDSEHAMLLRGRHLPQGAPTSPHLANLAMRSLDRRITGFAELNGLRYTRYGDDLAISGDEMDAGRALWTVARIIRAEGFTVHPEKVRIMGRHQQQRLAGLVVNDRPRVSRVDYDNLRALLHNAIRDGATAQNREGHPEFRSHVYGLIAWVGATDPARRRRLLAMAADVDWDA

SEQ ID NO: 5542 - protein, 423 aa, unidentified
  source 1..423: note = Related to NZ_AGFF01000003.1; note = Dietzia alimentaria
MTTPVLTADEVNDAAAWFSRTYTGWTWPELLRALESVLPAAIARDALPALLTLSPAEPRHPAESLRRALKKWTQPPARHPTVPMPEPPPRDTIADGLPQLYSVPEVAQWLDLTTGELEWFTDHGGWLRTAPTRLRHYRVWTREKRDGVRVIEAPKPRLREAQRRLLRLLVSRIPAHPAATGFIPGSSTADFARPHSGKATVLRADLRHCFESITAPRIAEVFRRAGYPPEIARLLADLSTTATPADQLAGVPAEHATYLRGRHLPQGAPTSPHLSNLVMRSLDRRLNGYARANGLAYTRYGDDLALSGDAMDADRALWVVLKVIASEGFTVHAGKVRIMRHHQRQNLAGLVVNDRPRVSRSDYDNLRALLHNAQRHGASSQNHSGHPEFRAHVLGLIAWIGANDPARRERLLHMANEVDWTRS

SEQ ID NO: 5543 - protein, 421 aa, unidentified
  source 1..421: note = Related to NZ_CP046569.1; note = Dietzia sp.
MTTPVLTTDEVNDAAAWFSRTYTGWTWPELLRALESVLPAAIARDALPALLTLSPVEPRHPAEALRRALKKWTRPPAKPTIVPPSVPPPHDTIAEGLPELYSVSEVAQWLDLTTGELEWFADHGGWLRTAPSRLRHYRVWTREKRDGVRVIEAPKPRLCEAQRRLLRLLVSRIPAHPAATGFIPGSSTADFAQPHSGKATVLRVDLRHCFESITAPRIAEVFRRAGYPPAIARVLADLCTTATPADQLAGVPAEHATYLRGRHLPQGAPTSPHLSNLVMRSLDRRLDGYARANRLAYTRYGDDLALSGNAMDADRALWVVLKVIASEGFTVHAGKVRIMRQHQRQSLAGLVINDRPRVSRSDYDNLRALLHNRSVSNQMRREVLGWAWLVSGDRASGSLMVAFSGSRGGRGRRVNRSGCLA

SEQ ID NO: 5544 - protein, 422 aa, unidentified
  source 1..422: note = Related to NZ_CP046567.1; note = Dietzia sp.
MTSPVLTVEEVGEAAARFSRTYTGWTWPELRRALDSVLPEAITRDALPILLAWYPDEPRHPAAALRQVLTEWTRPAGAPTTVPLPEPPPRTTIVDGLPQLYSEAEVARWLGFTAGELDWFADPGNWLRTAPPRLRHYRVWTREKRDGVRLIEAPKPRLREAQRRILRLLVSRIPAHPAATGFIPGSSTSAFARPHSGSATVLRVDLRHCFESITTPRIAEVFRRAGYPSSIARLLAHLCTTATPADQLADVPASHAAYLRGRHLPQGAPTSPHLSNLVMRSLDRRLQGFADANDLAYTRYGDDLALSGDAMDADRALWVVLRVIASEGFTVHAGKVRIMRRHQRQNLAGLVVNDRPRVSRAEYDTLRALLHNARLHGASSQNHSGHPDFRAHVLGLIAWIGATDPTRRERLTRMADRVDWAM

SEQ ID NO: 5545 - protein, 372 aa, unidentified
  source 1..372: note = Related to NZ_NTGA01000019.1; note = Dietzia natronolimnaea
MTSPVLTVEEVGDVAAWFSRTYTGWTWPELRRALDSVLPEAIARDALPTLLAGFPDEPRHPAAALRQEWFADPGNWLRTATPRLRHYRVWTREKRDGVRVIEAPKPRLREAQRRLLRLLVSRIPAHPAAAGFIPGSSTSAFAQPHSGSATVLRVDLRHCFESITTPRIAEVFRRAGYPPTIARLLAHLCTTATPADQLTGVPAAHAAYLRGRHLPQGAPTSPHLSNLVMRCLDRRLQGFAVANGLAYTRYGDDIALSGDAMDADRTLWVVLKVIASEGFTVHAGKVRIMRRHQRQSLAGLVVNDRPRVSRVEFDNLRALLHNARQHGASSQNYSGHPDFRAHVFGLIAWIGATDPTRRERLTRMADQVDWTR

SEQ ID NO: 5546 - protein, 421 aa, unidentified
  source 1..421: note = Candidatus Dietzia intestinipullorum; note = Related to DWWP01000013.1
MTERRLTADEAGDAAAWFSRTYTGWTWPELRRALDSVLPSDIAREALPALFQWHRVEPRHPAAALRRVLARWTVPPAPRPLSVAEPVDPGTITEGLPALYAVADLARWLDLTVGELEWFADHGGWLRTAAPRLRHYRVWARAKRDGVRVIEAPKPRMREVQRQLLRLLVSRIPAHPAATGFLPGSSTVDFARPHAGKATVLRADLRHCFESITAPRVTDVFRREGYPPAIARLLAEVCTTATPVDHLTGVPAEHAAYLRGRHLPQGAPTSPHLSNLVMRSLDRRLHGYAAANGLTYTRYGDDLALSGDRMDAGRALWVVLKVIASEGFTVHAGKVRVMRAHQRQTLAGLVVNERPRVSRAEYDALRALLHNARRRGASSQNHAGHPDFRAHVLGLIAWVGASDPDRRERLLRTADEVDWAS

SEQ ID NO: 5547 - protein, 423 aa, unidentified
  source 1..423: note = Related to NZ_JAIFXZ010000017.1; note = Dietzia aurantiaca
MTEPRPPARLSPAEVGDAAAWFSRTYTGWTWPELLRALDAVLPGDVAREVLPSLLMLPREPRHPAAALRRVLRPWTAPAPQLATMPVPARRDTVAEDLPALYSVREVADWLDLTVGELEWFADHGGWLRTASPSLRHYRVWTREKRDGVRVIEAPKPRLREMQRRILRQLVSHIPAHRAAKGFVPWSSTADFAWPHSAKAIVLRADLRHCFESITAPRIADVFRRAGYPPTVARLLADLCTTASPADKLRGVPSEHAAYLRGRHLPQGAPTSPHLSNLVMRSLDRRLYGYAAANGLTYTRYGDDLALSGHEMNADRALWVVLKVIASEEFTVHAGKVRVMRAHQRQTLAGLVVNDRPRVRRADYDNLRALLHNARRSGASSQNHAEHPDFRAHILGLIAWVGASDPVRRERLLRMADEVDWEA

SEQ ID NO: 5548 - protein, 426 aa, unidentified
  source 1..426: note = Related to DWWG01000159.1; note = Candidatus Dietzia intestinigallinarum
MSETHPPTQLSAAEAHDAAAWFSRSYTGWTWPELLRALESVLPPDIARDALPGLLASHRREPRHPAEALLRALRPWIIRTPKPPTTVTDVPPARDTIAEGLPTLYSVREVAEWLDLTIGELDWFADHGGWLRTAAPRLRHYRVWTREKRDGVRVIEAPKPRLREAQRQILRQLVARIPAHRAATGFIPGSSTADFVRPHSGKPTVLRTDLRHAFESITASRVADVFRRVGYPPAISRLLADLCTTATPPDRLRGVPSAHAARLRVRHLPQGAPTSPHLSNLVMRSLDRRIQGYARANDLTYTRYGDDLALSGEAMNADRALWVALKVIASEGFTVHAGKVRVMRRHQRQTLAGLVVNDRPRVSRADYDNLRALLHNARRHGAASQNHTNHPDFRAHVLGLIAWIGASDDVRRERLLRMADEVDWTR

SEQ ID NO: 5549 - protein, 433 aa, unidentified
  source 1..433: note = Candidatus Dietzia merdigallinarum; note = Related to DXGN01000154.1
MTDSDPAPRLSLAEAHEAAAWFSRTFTGWTWPELLRALESVLPAEIAREVLPALLMRHRDEPRHPAQALLRVLRPWIIASPPAQLSVTVPDPHDPTTPPERDTITEGLPTLYTAGEVSEWLDLTIGELEWFADHGNWLRTAAPRLRHYRVWSREKRDGVRVIEAPKPRLREVQRRILRQLVSKIPAHRAATGFLPGSSTADFARPHAGQPTVLRADLRHCFESITAPRVRDVFRHAGYPPPIARLLADLCTTATPADQLRGMPAEHAALLRGRHLPQGAPTSPHLSNLVMRSLDRRLHGFAAANDLHYTRYGDDLALSGHEMNADRALWVVLRVITDEGFTVHAGKVRIMREHQRQRLAGLVVNARPRVSRAEYDNLRALLHNARHHGAASQNHAGNEDFRAHVLGRIAWVGAGDEVRRERLLAMAAEVDWEN

SEQ ID NO: 5550 - protein, 352 aa, unidentified
  source 1..352: note = Related to JAKWBF010000007.1; note = Gordonia sp.
MRRWQQPEHRGHPIDLPGPAPIDSLPYELPVLTGVDDVAAWLALTPAEVDWFADRGSWLTTARPALRHYRVSHREKRTGTRIIEAPKPMLRETQRRILRRLVQRIPAHPAARGFVPGGSTAAFAWAHSDRPVVLRADLRHCFESITVSRVRHVFAQAGYPAGVARVLAELCTTTTPPDQLIDVDPAHAGLLRRRHLPQGAPTSPHLANLALLRLDQRLDGYARRNQLRYTRYGDDLAVSGDAMDADRALWTLLRIVEDCGFVVHPEKVRIMPAHQRQRLAGLVVNDRPQVSREDYDRLRALLHNAARHGPESQNHSAHPDFRAHVYGLIAWVGATSETRRRRLLDMADHVHW

SEQ ID NO: 5551 - protein, 440 aa, unidentified
  source 1..440: note = Related to CP045804.1; note = Gordonia amarae
MTPNELSGDELRAVATHAADAITDWTYPRIRGAVHAALAATTPRRFALPHVVADRVATDALALSPDRPDNVAAFIGEALQPWRRPDPPPPPPDTRLRLQPAEPQPPTGMRHGLPPIAGYEELAFWLNLTVGELDWLADRGRWLEHARYPLQHYRITRREKRGGHRIIEAPKPLLRETQRRLLRRVVEHIPAHPAARGFVRGSSTAAFAWPHADRAAVVRVDLRHCFESIGISAVRAVFTSAGYPPHIARVLADLCTTTTPADQLHGIDWEHRDLLRRSHLPQGAPTSPHLANLVLRRLDRRIDGYAKRNDLQYTRYGDDIAVSGDSIDAHKTLRVVLAIVEDCGFTAHPGKVRIMYAHQQQRLAGLVVNDRPQVSRADYDALRALLHNAVHHGPDSQNHHGHPDFRAHVHGLISWVGATNPTRRRRLLDLAAQIDWNTEQ

SEQ ID NO: 5552 - protein, 430 aa, unidentified
  source 1..430: note = Related to NZ_BMCS01000002.1; note = Williamsia phyllosphaerae
MSDPLFSPDEAAEIAAHVEAHLTAWTWPEMQRALIAAGLSPEFADVVGLRLFDPSDDVVAGASDIESRILGALRDRTAPLPETDDRSAPAVWELTEPSSTGRVRDDLPDIYDVEQLAHWLNFTVPELEWFADRGRWLRNAREPLRHYRVFRVEKRDGFRVIEAPKPRMRETQRRLLRRLVERIPPHPAARGFVRGSSTAAFAWPHTDRPVVLRVDLRHCFESIDARRVRHVFSAAGCSPAIARILTELCTTATPPDAIHGLDPVHAGLLRERHLPQGAPTSPHLANLVLRGMDRRLAGFAAHNDLRYTRYGDDLALSGDRMDADRVLWTVLRVVADEGFTVHPAKTRIMHAHQQQRLAGLVVNDRPQVSRADHDALRALLHNAIRTGGAAQNHDGHPDFRAHVYGKIAWIGATSPARRDKLLDMASHVDW

SEQ ID NO: 5553 - protein, 437 aa, unidentified
  source 1..437: note = Related to NZ_RBKV01000001.1; note = Williamsia muralis
MTTDSTHPGDSTDSAHPDDLGGLGPEIRIPARSLDLLINRLEVDPRWSVHALGDMLAATTAPATATALLGLLLEKFPERPEPEAVRRALWSMVIENRSHVFGELPTPEMTFALTPLADATDVARWLGLTVGELEWFADRGLWLRSKKTALAHYRYVTIPKRDGVRVIEAPKPHLREIQRRILREILDRIPPHRAAQGFVAGRSTASFAWPHSDRNVVLRVDLRNCFPTITSARVRAVFAAVGYRRTSRLLSEICTTATPPDVLRGLDFAHASLLRARHLPQGAPTSPALANLVMRTMDRRIWGYARHNNLHYSRYGDDLAISGDVMDAGQVLWTVLRIIADEGFTVHPDKTKIMYSHQRQQLAGLVVNDRPRVGRVDYDNLRALLHNAIRTGAHAQNRDDHPRFREHVYGKIAWIAATSPSRRNTLLAMAERVDWDR

SEQ ID NO: 5554 - protein, 425 aa, unidentified
  source 1..425: note = Related to NZ_JAFRDR010000008.1; note = Williamsia soli
MNDSYSLGGLGPRMRLTADSVEHLLTRLEVDPRWTVSALVEMLVATVEQPVVTELLGMLLDRFPERPTDLGDVRTFLAPLIGEPRSREFDDPADPVMRFDLPRLPDYSDVARWLNLTVGELEWFADRGHWLRTKDGPLQHYRYWQVPKRDGVRMIEAPKPHLREIQRRVLRTILDHIPPHRAAQGFVPGTSTASFAWPHTDRPVVVRLDLRDCFSSIGTARVKAIFAAVGYERTARVLAELCTTTTPIAHLRDIDHRQAALLRQRHLPQGAPTSPALANLVMRAMDRRIWGYAQRNRLHYSRYGDDLAISGDHMNPEAVLWVVLRIVADEGFTVHPDKTKTMRAHQRQQLAGLVVNDQPRVARRDYDNLRALLHNAIRTGAQAQNRSAHPNFRAHVHGKIAWIGASSPRRRNTLLALAEQVDWDR

SEQ ID NO: 5555 - protein, 436 aa, unidentified
  source 1..436: note = Related to NZ_CP011853.1; note = Gordonia phthalatica
MGDLFGGPQGVSHPRRYDSAQVRLAVHAIDRLRRPVTPDRSAEVWTSREINGALVTVLDPVVADDVTRLLVTAFAAPPHRDDLAAFLAAIPADRTVRVAEPVVSHPVFAVRPIDDVTALAHWLAMSVTELDWFAARGRWSRRAKPQLRHYRVQRLPKRDGGFRIIEAPKERLATAQRRILDEILSAVPPHPAAHGFVRGRSVQSYASTHALHDTVVRVDLRRCFEHVTYPRVRAVFAAIGYAPAVAAYLASLCTTTIAIDDEKLVDPIHAALLRERHLPQGAPTSPALLNLVLRRIDFRIAGYAAKHRIAYTRYGDDLAFSGDDLDAGKLVWFVTRVAAAEGFVVHPSKTRIMHDHQRQQLGGLVVNRGVRSSRADFDALKALLHNAIRHGAQSQNRDGHPDFRAHVYGRIGWVSTGSPARRKRLRDMAARVDWES

SEQ ID NO: 5556 - protein, 435 aa, unidentified
  source 1..435: note = Related to JAAYXO010000187.1; note = Gordonia sp.
MSDDRTSPGIGARRRFDSVQVDRIVIAIDELLRSVEAPRVADVWTSREIDGALVDVLDPVDADDLTRALLAAFPAPPRSGPVAAFVADLPAAPRVVVPELRVSAPVFEVRQVEDIAALAGWLNMSLEELEWFTASGRRSRRLKPALRHYRVSRIPKRDGGYRIIEAPKERLATAQRKILDQILTGLPPHPAAHGFVRGRSITSFAAKHALHDTVVRVDLRRCFEHVTYPRVRAVFAAIGYAPAVAAYLGSLCTTTIAVDDEALVDPHHAALLRERHLPQGSPTSPALLNLVLRRLDFRVAGYADKHHITYTRYGDDLAFSGDQIEIGRLLWFVERVAAAEGFVVHRRKTRIMHDHQRQQLAGLVVNRGVRAGRAEFDALKALLHNAIRDGAHSQNRERHPDFRAHVYGRIDWLSTGSPQRRERLRTMAAQVAWDR

SEQ ID NO: 5557 - protein, 863 aa, unidentified
  source 1..863: note = Related to NZ_AEUD01000002.1; note = Gordonia neofelifaecis
MEQWITTSEAAARLGVKRGTLYSYVSRGVLTSRRMPGQNESLFDRTQIDSLAAAKHDGRRSGDRLLRFRAVASGVSAIRDDRLYLRGRDIEELCADMDFADVAQLVLDSSEARPVPDVDTTVVHGVSIERRIPLTVALVAAADPLRADLSDVGARVLGLLPHLAAAVPEIDFAHRWVDLLATVLIDNGLAASTTAARVAASARAGIFDALLAGYAALAGPLHGGAPATARALLDAVVGGAAVDRALADAVVGGLVPGFGHVIYSGPDPRAQIVLDRVRAERPRSSALAAAEAVEQRVGRPMNIDFAGAVVTHELGLPARSGEVLFVGSRRAFREPPPAASSLCGGGVRRGPAALARQSDGLSCSAAAVRTLSSRRSPRTTTRHLIGGASGAFTVGPRSRAQAAHSVCWVRADDDKSGRTVLPAAEREDVIEPGMRSPFRFDQHRVHRAVGAVVGLLGAAAGDDAGDDAGSLRTAPELDGALVAVIDPVDADDLAQALIREFASPPSSERLTAFIAAIPAAPRVRWPEPRTSAPRFDVRQVADVEALAHWLNLDLGELEWFAARGRWSRRTAEPLRHYRVKRIVKRDGGFRIIEAPKERLATVQRKVLDEILVHVPPHPSAHGFMRGRSVESFGSRHALHDVVVRVDLRRCFEHVTYPRVKAVFSAIGYAPAVASYLACLCTTSRAIEDRHRVDFDHAVLLRERHLPQGAPTSPALLNLVLRRLDYRVAGYAARHGVTYTRYGDDLAFSGDDVDVGGLLWFIERVVKAEGFAVHRDKVRVMRDHQRQQLGGLVVNRGPRSCRSDYDALKALLHNAIRDGAESQNRDDRPDFRSYVYGRIGWVSTGSARRGEKLRTMAAQVDWHR

SEQ ID NO: 5558 - protein, 432 aa, unidentified
  source 1..432: note = Related to BAOP01000031.1; note = Gordonia malaquae
MGAGLSRPRRFTARETAMMAGAVAQRLMRVRGSDLGPEWTRPELTDLLMRVVSPADAEEVARAILEAFPAPPADPREAIRELIDAMCDGPFRFVADPDVSTPVFDVKRIADVEALAAWQNMSLPELDWFAARGRRSKRLPERLRHYRVWRIPKAHGGFRIIEAPKERLATAQRRILDDVLAAVPPHPAAHGFVRGRSAVSFAGPHSLHDTVVRIDLKHCFEHANYRRVKAVFTAIGYTPGVCEYLAALCTTTCAIDDAAQLDPFHAALLRERHLPQGAPTSPALLNLILRRMDIRIAGFAEKNRLTYTRYGDDLALSGDDIDPKLVTWVVSSIVHDEGFRVHPDKLRVMGDHQRQQLAGLVVNAGPRARRTDFDALKALLHNAVRDGGESQNREGRGDFRGYVYGRIGWVSTGSPTRRRKLMALAAQVDWSV

SEQ ID NO: 5559 - protein, 433 aa, unidentified
  source 1..433: note = Related to NZ_JACIFP010000001.1; note = Gordonia humi
MTGQGLEPPQRFTGHDANAMGFAVSRRMMRLRPAERADAWTWLTLQEMFADTVWPDDADEIAQAVLAVYPEPPSRIQEALTAVIVAMPGRREPFAADPGSSSPVFDVRQIADVEELAAWQNLSMPELDWFAARGRGSRRAPTRLRHYRVWQIPKRHGGLRIIEAPKERLATIQRRILDDVLAHVPPHPAAHGFVRGRSVTSFAGPHALHDVVLRIDLRHCFEHVTYPRVKAVFTAIGYQPGVAAYLTALCTTTIAVDDQRLTDSLHAALLRERHLPQGAPTSPALLNLVLRRTDIRIAGFAAANRLTYTRYGDDLALSGDDVDVGRVLWAVSSIIRDEGFTVHPDKVRVMGEHQRQQLTGLVVNAGPRAARADYDALKALLHNAIRDGGQSQNRAGRDDFRAYVYGRIGWVSTGSQARRRKLTEMAARVDWER

SEQ ID NO: 5560 - protein, 433 aa, unidentified
  source 1..433: note = Related to NZ_JABBNB010000006.1; note = Gordonia asplenii
MVGKQTAAQPDRFSRNDIHRMSAVIRRLLGPPLDDGYAERVWTRRELNGALVTAVDPVDAEEVARELLMRYPTPPPLPGIADAVRRVVAVLTAPVIREPVGPPRFGLPEIGDVGALASWLNVSVDELDWFADHGLWLQRATPRLRHYRVTRIPKRHSGFRVIEAPKERLATLQRRILDAILADVPAHPAAHGFVRGRSPYSFAAPHSLHDTVIRVDLKHCFEHITAAQVRAVFTAVGYRSATARCLAEICTTATAFDDLPGDDPFHAGLLRGRHVPQGAPTSPALVNLALRRLDFRIAGYAAKNGLAYTRYGDDLALSGDEMNVGQLLWVVRNVIVDEGFTLHPEKVRVMGDHQRQQLAGLVVNVGPRSRRSDFDELKALLHNATCTGARAQNRGAHADFRAHVYGRIGWVATGSAARRRKLLALAAEVDWDG

SEQ ID NO: 5561 - protein, 423 aa, unidentified
  source 1..423: note = Related to JAHCSG010000002.1; note = Williamsia sp.
MTAGLRSEQRFSADRAASLANWILEDRDLLWDSWAVSARLSWQLPPEIADEVADAILVALPEQPSAPEVLAEFLAAIPSEPVIIIPSEPNPPVVAAGLPVITDVGELAASLNLDIGELEWFADRGTWLRTARVPLRHYRITRIPKRDGVRIIEAPKPRLAEIQRKILRRILDHRDPHPAACGFRRGKSVAHFAWPHTDRPVVLRLDLRHCFTTIGTARVRRVFADCGYSPAVSRVLAELSTTTTSSDALGDLDPWLAAMLRARHLPQGAPTSPALANLVMIRLDRRLAGYARRHALRYTRYGDDLAFSGDAMDADRVLWAVLRIVAAERFVVHPDKTRIMGRHQRQQLAGLVVNDHPQVPRAEFDALKALLHNAITTGASTQNHAGHPDFRAHIYGRIAWVGATNASRRERLLALADQVDWSA

SEQ ID NO: 5562 - protein, 417 aa, unidentified
  source 1..417: note = Related to NZ_JXYP01000014.1; note = Williamsia herbipolensis
MRRYPRSTAEMLAAIVDAADPEWTREGLADALSAHRRGLDDAQADAVAGHLLVAFPRQPPDRRDAIAGRIVELAMPPMRERPALRELWDGLPRYTDYYALAAAYDMTVPELDWLADRGTWLRSRTGPLQHYRVTPIPKRRGARVLEIPKPRLRETQRRILRRVLDRLPPHPAAQGFVAGTSPATFSSPHAGRPVVIRIDLRRCFETITVARVRAVFAAVGYPPAVARALADLCTTTTPAERLVGVDPVHAAILRSRHLPQGAPTSPALANLVMRTLDRRITGYAHRHGLVYTRYGDDMALSGTIDDPSAVVWVVRQIVADEGFTVHGDKTRIMYAHQQQRLTGLVINDRPRVCRSEYDDLRALLHNAIRTGARAQNRDDVGDFEAHVRGRIAWVGATSPARRQKLLEMASRVDWSSD

SEQ ID NO: 5563 - protein, 427 aa, unidentified
  source 1..427: note = Related to NZ_AUFT01000012.1; note = Nakamurella lactea
MTGDYLYSPDWARLLADLVVAARARWRRSDLAAAMAEVLDDAEADGTAHRILQAFPREPVDVRATLAGYLVELRSVSEPLSEPQTGALLAASARTPVLWAGLPVLNTPAELASFLDLTIGELDWFADHGNWLRSHRGPLQHYRQRRIAKRSGLRLLEIPKPRLREIQRKLLRTLVSVIEPHPAAHGFRPGRDARSFAAPHAGGPIVLRVDLRDFFASVPGARIRAVFVAVGYPPPIAALLADLCTTATPIAALCGLDPAIAGLLRGRHLPQGASTSPALSNLVLRNTDRRIAGYVARHGLRYTRYADDLAVSGSGFDPAAVRWVIEKIVTDEGFRLHPDKTSVMRSHQRQRLASLVINTRPQVNRSEYDALRALLHNAASTGAAAQNRGGHEHFREHVFGRIGWAGASNPDRRRVLLGLAERVDWSR

SEQ ID NO: 5564 - protein, 421 aa, unidentified
  source 1..421: note = Related to JABEND010000002.1; note = Nakamurella aerolata
MADWAFDSGTAARLARVVVESRTSWRAADVAEALTQLLPPEQAEELAARMLAAMPSPPVDVGPAVTGYLAGLRRQDAPATIAFEVRTAELWAGLTPLADPAALARLLDITVGELEFFADRRGWLRTKPTALQHYRYRTLPKQSGLRVLEIPKPRLRELQRRVLRHCVAPIPPHPAAHGFVPGRSVHTFAEPHTGSRVVIRVDLRDFFLTVARPQIEATFHTVGYPPAVGEVLAALCTTATAPAAFAGIDSATAARLRRPHLPQGAPTSPALSNLAMFEVDRRLAAFAGRHGLSYTRYADDLAFSTGLGEPAIAVSAVLAVTRKVVAAAGHRLHPRKVLVRRAQQRQQLTGLVVNRTPQPPRAEFDTLRAILYNCARFGPESQNRDDLADFRGHLLGRMQWVASGSATRRRALAELFDRIAW

SEQ ID NO: 5565 - protein, 425 aa, unidentified
  source 1..425: note = Related to NZ_CP070357.1; note = Tsukamurella tyrosinosolvens
MTVVEVARRVPRSWRHAVADRVVLLTEEMWTAETIASLVRGTVPDELVGPVVEALLSGHPQPPVQVVDGHVRRPRTAPLVAALDAVRIVETLDSGGPVDVPGLALPDVASIARMLDLTVPELEWFADHGRWLRHARPPLRHYRVARMVKPAGGFRVIEAPKPRLAEAQRRILLRVLDPAGAHPAARGFRPGGSVLAYASPHVGSLSVVRLDLRDCFSTVAVPRVRSVFRRLGYPAPVATVLADLCTVATPADELRGLDPWRAATLRSRHLPQGAPSSPALVNLALHRLDARLTGLAHAQGARYTRYGDDLAFSGARDPALIAGVAPKIVAAEGLSVNPRKTRIMRAGARQELAGVVVNARAQVPRAEYDDLRALLHNAARSGGESQNRDGHPDFRAFVYGRIAWVAQGNEQRRLRLLAMAARVRW

SEQ ID NO: 5566 - protein, 425 aa, unidentified
  source 1..425: note = Related to NZ_VIGX01000010.1; note = Tsukamurella conjunctivitidis
MTAVEIVRGLPRAQRYAVAGRVVSLTEDLWAADVIAPLIRGAVPDELVDAAVQALLAGHPEPPVRFVDGDVLQSGPGPLVAALDGVRIVVALEPAGPGDVPGLALPDVAAVTRLLDLTVPELEWFADHGMWLRHARPPLRHYRVSRMDKPAGGIRMIEAPKPRLAEAQRRILRRVLDPAGAHPAARGFRPGGSVLAYAAPHVGARSVVRLDLRDCFSTVTVPRVRNVFRRLGYSAPVAGVLADLCTVSTPADELHGLDPWQAATMRSRHLPQGAPTSPALVNLALHRLDARLTGLARAQGARYTRYGDDLAFSGALDPALIAAVVPKIVAAEGLSVNPRKTRIMRAGARQELAGLVVNARAQIPRSEYDALRALLHNAARSGGEIQNRDGHDDFRAHVYGRIAWVAQGNDARRERLLAMAARVRW

SEQ ID NO: 5567 - protein, 425 aa, unidentified
  source 1..425: note = Related to NZ_UHII01000001.1; note = Tsukamurella pulmonis
MSAVEISRRLPRAWRYAIADRVEMFTEEMWTADRVAVAIRGIVPGELVPTVARELLAAHPAPPLAIIDGTPVAPDRDAIVVALDTVRTVERLGARAPLEVPGVALPDVAAVARMLDVTAPELEWFVDHGQWLRHATGPLRHYRVRRMAKPSGGVRVIEAPKPRLAEAQRRILHRVLDPAGAHPAACGFRPGGSVLAYAAPHVGARSVVRLDLRDCFSTVTVDRVRGAFRRLGYPVPVAGLLADLCTTSTAVDELRGLDPWQAAVLRSRHLPQGAPTSPALVNLVLRGLDARLTGLARAQGARYSRYGDDLAFSNARDAALIAGVVPKIVAAEKLSVNPRKTRIMRSGDRQELAGVVVNARAQVPRAEYDALRALLHNAARFGPESQNRDGHEDFRAHVYGRIAWVAQGNDARRERLRAMAERVRW

SEQ ID NO: 5568 - protein, 425 aa, unidentified
  source 1..425: note = Related to JAIULG010000072.1; note = Tsukamurella sp.
MTGVELSRRLPRAWRYAIADRVEFFTAAQWTEEFVAAAVADLVPVDHAVPVARTLLAEHPAPPLSIVDDLPVAADRNALLSALEAHRTVQLLESKGSGTPPGIALPDVGSIARMLDLTIPELEWFADHGQWLRHAGRPLRHYRVRRIAKPAGGVRVIEAPKPRLAEAQRRILRRVLDDAGAHPAARGFRPGGSVLAYAAPHVGTRSVVRLDLRDCFPTVTAPRVRAAFRRLGHPAPVAAVLADLCTVATPGDELRGLDPWQAAALRGRHLPQGAPTSPALVNLVLRRLDARLTGLARSQGARYTRYGDDLAFSGALDSSLIAGVVPKIVASEGLSVNPRKTRIMRAGARQELAGVVVNARAQTPRGEYDDLRALLHNAARFGAASQNRDGHPDFRAHVYGRIAWVAQGNEHRRERLLSMAARVHW

SEQ ID NO: 5569 - protein, 426 aa, unidentified
  source 1..426: note = Related to AP025688.1; note = Tsukamurella sp.
MTSVEVTRRLQRAQRYTIAARVEWFTPTQWTVDRVAGAISGVVPADEASAVAAALIAAHPRAPLDPQDDGPPVLANPAALVAALDGYRTVELLEPDGPLDVPGLALPDLSAVARMLDLTAPELEWCADPGGWLRHSSKPLRHYRVRRIPKPAGGVRVIEAPKPRLAEAQHRVLRRVLDPAGAHPAARGFRPGGSVLAYASPHVGASSVVRLDLRDCFSTVTVSRVRDVFRRMGYPAPVARVLADLCTVATPGDELRGLDPWQAAVLRSRHLPQGAPSSPALVNLVLRRLDSRLTGLAQSQGARYTRYGDDLAFSKPRDPSLIAGVVPKIVAAEGFSVNSTKTRVMRAGSRQELAGVVVNARAQVPRAEYDALRALLHNAARFGAESQNRDGHSDFRAHVYGRIAWVGQGNESRRERLLTMAARVRW

SEQ ID NO: 5570 - protein, 425 aa, unidentified
  source 1..425: note = Related to NZ_LSRF01000001.1; note = Tsukamurella pseudospumae
MTAVEVSRRLPRGTLYAIAARLEWFTASQWTGEFVAAAIGDLVSTDLAGPVARFLIAAHPDAPLRIVDDRPVRADLGALRAALDGFRTVDLLDAPGVLDVPGRALPDSAAVARMLDLTAPELEWFADHGQWLRHSAAPLRHYRVRRMDKPAGGVRVIEAPKPRLAEAQRRILRHVLDPAGAHPAARGFRPGGSVLAYATPHVGARSVVRLDLRDCFSTVTAPRVRAVFRRLGYPAPVARVLADVCTTATPGDELRDLDPWQAAVLRARHLPQGAPTSPALMNLVLHRLDARLTGLARAHGAMYTRYGDDLAFSGAPDPMLIAGIVPKIVVAEGFSVNPAKTRVMRAGTRQELAGVVVNTRAQVSRDEYDDLRALLHNAARFGAESQNREGRADFRAYVYGRIAWVGQGSERRRERLLAMAAAVRW

SEQ ID NO: 5571 - protein, 415 aa, unidentified
  source 1..415: note = Related to CP001966.1; note = Tsukamurella paurometabola
MPAVEIARALARAQLRQAIRIAVQLHPEEWNRVELAADLGAVLPAELAEEVARFVIASAPTKPRGAILANLLQDFRVESLLEPEPARETPDRPLVDLAAVAAMLDVTVPELEWFADTGSWLRHSSRPLRHYRVRRMSKPAGGVRVIEAPKPRLCEAQRRILRHVLDAAAPHPAARGFLPGGSVLRYAEPHVGAGSVIRLDLKDCFTTVGASRVRAVFHRLGYPNAVARVLAALCTTETPADELHGLDAWQAATLRFRHLPQGAPTSPTLMNLSLRQLDSRLTGLARAQGARYTRYGDDLAFSGAPDASLIAGVVPKIVAAEGFAVNPRKTRIMRRGSRQELAGLVVNDRAQVPRHEYDALRALLHNAARFGPASQNRDGHDDFRGHVYGRIAWVGQGNRERRERLLALAERVPWE

SEQ ID NO: 5572 - protein, 414 aa, unidentified
  source 1..414: note = Related to BPMV01000001.1; note = Tsukamurella sp.
MPSVDLSRPLTRAQQAQSALLVGRIDPAEWNRIELAADLGAALPAELAEEVALFVTEAAPTKPHPAVIRRLLQTYRVDSALEPEAGGAVPGRVLADLDGLAAMLDLTVPELDWFADTGRWLRHSAAPLRHYRVRRMPKTAGGVRVIEAPKPRLREAQRRILRHVLDPAAPHPAARGFVRGGSVLHYAEAHVGSAAVVRLDLKDCFTTVGENRVRAVFRQLGYPAPVARILAALCTTATAGDELRGLGAWQAATLRARHLPQGAPTSPALMNLALRRLDSRVAGLARAQGAHYTRYGDDLALSGARDPSVIAAVVPKIVRSEGFSVNPRKTRIMRSGTRQELAGVVVNARAQPPRRAYDDLRALLHNAARFGPDSQNHDGHDDFRAHVYGRIAWVAQGNPTRRERLLAMAARVPW

SEQ ID NO: 5573 - protein, 414 aa, unidentified
  source 1..414: note = Related to NZ_CP070609.1; note = Rhodococcus koreensis
MTERPALPPEFARRLAAAAIDGTWTRAGLVLRFEESGVPDAARIAARLHDLMPTPPIDGIDSVFRLLSDLPLIERAEPIVDEVSGNDWRFDVPQWSRTAAVAEAVGLTSAELDWFADPGGWLRTKAPPLQHYRYRIRPDNRLLEAPKERLREVQRRILRTVLDRVPPHAAAHGFVRGRSVHTFAGPHAGHEVVLRIDLRAFFPSVSRTRVRAVFDALGYPTRVSRVLAGLCTTSTPPGVLAELPFDAASRLRGAHLPQGAPTSPALANLVAHRLDRRLAGLARAHRVAYTRYADDLAFSGSDLAVDRLIHAVGRIVTDEGFAVHPGKTRVMRAHRCQHLAGLVVNTRPQASRAEYDDVKALLFNCVRHGPDSQNRDGRPHFREYVYGRIAWVGESNESRKRSLHALAARVDWTG

SEQ ID NO: 5574 - protein, 405 aa, unidentified
  source 1..405: note = Related to RRBB01000228.1; note = Rhodococcus sp.
MASTNATQARDSGETPARAGLILRFEETGAPDAGRLATRLYDLMPTPPIDGVDSVYRLLSELPQIEQPEPVVEVSGNGWKFDVPRWSRTSSVAEAVGLTPAELDWFADPGGWLRMKAPPLQHYRYRIRSDNRLLEAPKERLREVQRRILRSVLDGVPPHAAAHGFVRGRSVHTFAAPHAGHDCVLRIDLRAFFPSISQTRVRAIFDALGYPAPVARVLAGLCTTSTPPGVLAQIPFDAASRLRGAHLPQGAPTSPALANLVAHRLDRRLTGLARAHHSGYTRYADDLAFSGSDLAVDRLIQAVGRIVADEGFSVHPGKTRVMREHRRQHLAGLVVNTRPQTARADFDDLKALLFNCVRYGPESQNRDGRPHFREYVYGRIAWVAESNESRKRSLHALADRVNWAG

SEQ ID NO: 5575 - protein, 416 aa, unidentified
  source 1..416: note = Related to CP003949.1; note = Rhodococcus opacus
MTAGRALQPEIARRLAVEATVGAWTRAGLILRFEEAGEPDAGRIATRLYDLMPTPPIDGVDGVYRLLSELPQIEQPETVVESSGSDWKFDVPRWSHTAAVAEAVGLTPAELDWFADPGGWLRTKATPLQHYRYRIRSDNRLLEAPKERLREVQRRILRSVLDRVPPHAAAHGFVRGRSVHTFAAPHTGHDVVLRIDLRAFFPSVSQTRVRAVFDALGYPTRVSRVLAGLCTTSSPSGVLAQLPFDAASRLRGAHLPQGAPTSPALANLVAYRLDRRLTGLARTHRAGYTRYADDLAFSGTELAVDRLIHAVGRIVAHEGFSVHTGKTRIMRAHRRQHLAGLVVNTRPQAARTEYDDLRALLFNCARYGPDSQNRDGRPHFREYVYGRIAWVGECNASRKQSLHALAARVDWADQRR

SEQ ID NO: 5576 - protein, 413 aa, unidentified
  source 1..413: note = Related to NZ_CP058638.1; note = Rhodococcus sp.
MTGRRALSSAVARRLAAVATSGSWTRAAIAQRFEEIGTPDADRIATRLFDLLPTPPVEGVDSVYRLLSELPHIDEPAPVVEQPDHEWRFDVPKWTHTVAVAQAVGLTPAELDWFADPGEWLRNKAPTLQHYRYRIRSDHRLLEAPKERLREVQRRILRGLLDRVPPHAAAHGFVRGRSVHTFAAPHAGRDVVVRIDLRAFFPSISQARVRAVFDSLGYPPRVSRVMTGLCTTSTPPDVLARLPFDTASRLRGSHLPQGAPTSPALANLVAYRLDRRLTGLARSSRAEYTRYADDLAFSGVDLAADRLISAVGRIAADEGFSVHPRKTRIMRAHRRQHLAGLVINSHAQAARTEYDQLRALLFNSLRTGPDLQNRDGRPYFREHVYGRIAWIGESNPNRKRALLALADRIEWTG

SEQ ID NO: 5577 - protein, 409 aa, unidentified
  source 1..409: note = Related to NZ_VLNY01000005.1; note = Rhodococcus cavernicola
MTDQRALPPVMARHLAEVADAGPWTKYALTQRFEEAGARDAVSIAHRLFDLMPSPPIEGAESVYRLLVELPRIDRPAPIAPRVLWKFGVPQWSQTAAVAEAVGLTPTELDWFADRGGWLRTKAPPLQHYRYRTRGDRLLEAPKERLREVQRKILRAVLDSVPTHPAAHGFVVGRSVHTFAAPHAGREAVVRIDLRAFFSTITQARVRAVFGALGYPDHVARVLAGLCTTATPAKVLAPLPFESATRLRTPHLPQGAPTSPALANLVCHRLDRRLTGLARSHRAAYSRYADDLAFSGSELAVDRLVHAVGLIVADEGFTVHPRKTRIMRAHRQQHLAGLVVNDRPQAARSDYDDLRALLFNCVRYGSHSQNRDDLPHFREHVYGRIGWIGESNETRKRTLLSLADRVDWA

SEQ ID NO: 5578 - protein, 412 aa, unidentified
  source 1..412: note = Related to JACHWS010000003.1; note = Hoyosella altamirensis
MPSRPPRAFTRLEADLLAAAAVAGPWTRSGLEERLGEAGAADPVLLARRVLDLMPGEPIEGESTVRNVLAELPELPARPVEVTVESSLWKFDVPRWQTPHALCQAFDLTMPELEWFADVQGRLRGKPGRLHHYRYHNGARLIEAPKVRLREVQRRILRKVLDRLPVHAAAHGFRRGRSVHTFGSGHAGADLVVRIDLRWFFSTITAARVRAVFLAVGYPPSVASLLAGLCTTATPVPILRGMPFEQATLLRTRHLPQGAPTSPALANMVARNLDRRLAGLAQSQGLYYTRYADDLAFSGDVVNVEQLLWTVGAIVRDEGFFVHPSKTKVMRAHHRQRLAGLVVNAHPQASRDDYEALKALLYNCVRYGPASQNRDGRTHFREHVSGHIAWVGESNSRRREKLRRLEQRIVWS

SEQ ID NO: 5579 - protein, 317 aa, unidentified
  source 1..317: note = Related to NZ_QRCM01000001.1; note = Rhodococcus rhodnii
MSRALDAGWAARLAAAAMSGPWTKNALAQRFSEIGFDRAEEIARRLHDLAPTPPVDGVDAVDRLLAELPRLEGPIPVRAQRPQWLFGVPRWNTLPALASSLNLTPGELDWFADPRGWLRTKPDRLQHYRVKTLPSGRVVEIPKERLREVQRKVRVSVLDAVPPHPAAHGFRAGRGVVGFAAAHSNSEVVIRVDLRAFFTTITATRVRAVFAALGYPPWVAGRLAGLCTTSTPPAALAGVPFEIASLMRAPHLPQGAPTSPALSNLVAGNLDRRLSGVARRHALTYTRYADDLAFSGSDVDVSRLLAMVPPCVRTRAS

SEQ ID NO: 5580 - protein, 435 aa, unidentified
  source 1..435: note = Related to NZ_CP018082.1; note = Nocardia mangyaensis
MQRSTVDEGFWSLHHRRIFMSRMISVELAAELARAFELLDDEWAQARLAEAFGAVIEPGLAEEIARRVVDLMPVVPVDPVATLCRLLAELPKLPTIVVPLDPPEVRMRFGAVEIPDLATLAMLLNVTPSELEWFADRGGWLRRSTQPLSHYRYRRLPKANGTRLVEAPKVRLREIQRRILHKVLTGIPADPACHGFEKGRSAATFGAPHAGAPVVVRMDLRDFFPTIGLARVRTVFTACGYSPAVARVLAELCTTASPVAELRGLDHAQRTLLAVPHLPQGAPTSPRLANLVARGLDRRLTGYANRHGLTYTRYADDLALSGNANTAHLVWTVTRIAEDEGFTVHPAKTRIRRAHQRQILAGLVVNAHPTAPRDRYDAVRALLHNCLRTGATAQNLHGHNDFRAHVYGLISWIGETSPHRRDKLLTMADRVDWTR

SEQ ID NO: 5581 - protein, 418 aa, unidentified
  source 1..418: note = Related to NZ_BDBG01000003.1; note = Nocardia salmonicida
MSRAIGLELAVRLARSFELLDDDWGLSPLAEAFAEVIEPGSAQEIAGRVIDLIPIEPVDPVNTLRRVLVDLPKLPTTVVALDPVVVPMRFGAVEIPDLAALALLLNVTPAELDWFADRGGWLRRASQPLSHYRYRRLPKATGVRLVEAPKVRLREIQRRILHRVLAGIPADPACHGFEKGCNAATFATPHAGAAVVIRQDLRDFFPTVAVARVRAVFAACGYSTVVARVLAELCTTTSPVAELRGLDYSQRTLLGARHLPQGAPTSPRLANLVARGLDRRLTGYANRHGLTYTRYADDLALSGDADLDTARLIWTVTRIARDEGFTVHTGKTLIRRAHQRQVLAGLVVNDRPAAPRDRYDAVRALLHNCLRTGVSAQNRDEHNDFRAHVYGLISWIGETSPHRRDKLLAMAERVDWTG

SEQ ID NO: 5582 - protein, 430 aa, unidentified
  source 1..430: note = Related to NZ_JACVEE010000002.1; note = Nocardia sp.
MSGAVPPDLARELAYSFEFLGAEWSRSNLAEAFAEIVEPGRAEELARRVTDLMPSEPLDPVGTLQRLLAELPKLATIVVSLPPAADELADELPRTQPARTRFGAVDIPDLAALCALLNVTPAELEWFADHGNWLRRAAQPLSHYRYRQLPKTSGVRLVEAPKVRLREIQRRILHRVLSEIPAHPACHGFEKGRSATTFAAPHAGAEVVVRVDLRDFFTSIGVARVRAVFAACGYSPTVAQVLADLCTTATPVAELRTLDFNQRNLLRARHLPQGAPTSPRLANLIAHGLDRRLAGYATQHGLVYTRYADDLAISGKSDLDPGRTIWLATKIAKSEGFSIRPGKTRIRRPHQRQILAGLVINTHPAVPRDRYDALRALLHNCLRTGPATQNRDGHNDFRAHVYGLISWVGETSPARRDRLLAMADQVDWSK

SEQ ID NO: 5583 - protein, 418 aa, unidentified
  source 1..418: note = Related to NZ_JAGGMR010000001.1; note = Nocardia goodfellowii
MTGAVPAELARELAYAFEFLDAEWTRSNLAEAFAEIVEPERAEDLARRVTDLMPSEPLDPVGTLCRLLAELPKMATVVVPLEPLSAPVLFGAAELPDRAGLCALLNVTPDELDWFADHGGWLRRASKPLTHYRYRRLRKSDGVRLVEAPKVRLREIQRRILRHVLSGIPAHPACHGFEKGRSASTFAEPHAGAEVVVHLDLRDFFTSITVARVRAIFAACGYAPAIAQILADLCTTATPVAELRGLDYDQRNLLRARHLPQGAPTSPRLANLIAHGLDRRLTGYAIRRGLEYTRYADDLAISGKSDLDAAEILWLVTKIAKSEGFAIHPGKTRIRRPHQRQILAGLVVNSHPAVPRDRYDALRALLHNCLRTGPTAQNRDGHHDFRAHVYGLIAWIGETSPSRRDRLRAMADRVDWSK

SEQ ID NO: 5584 - protein, 416 aa, unidentified
  source 1..416: note = Related to NZ_BAGK01000206.1; note = Nocardia thailandica
MSHAVSGGLAAELAAHYADAEIGWERAALAEVFAEVIEPGRAEELAGRVVGLMPSEPLDGAATLRRLLAELPVLTVSTVALEPARRRMRFGATPIDDLAALAALLNLTQPELEWFADRGGWLRRSARPLTHYRYRRLPKSTGVRLVEAPKVRLREIQRRILRHALAGVPAHPACHGFEKGRNTATFGAPHAGAAVVVRIDLRDFFSSIEAARVRAVFAACGYAPAVARVLGELCTTAAPVAELRGLDHTQRTLLGARHLPQGAPTSPRLANLVARALDRRLDGYARAHGLAYTRYADDLAFSGPADADALAWAVTAIARDEGFAVHPGKIRVRRAHQRQVLAGLVVNAGPAVPRDRYDAVRALLHNCLRNGAAAQNRDGRPDFRAHVYGLIAWIGETNPHRRAKLLAMAARVDWDA

SEQ ID NO: 5585 - protein, 440 aa, unidentified
  source 1..440: note = Related to NZ_BDAY01000016.1; note = Nocardia altamirensis
MNRPALPALVAARLADEFGRCGGRWHRDDLAEAFAAVLDRERAEVFAVRVIGLMPTEPIDSVVTLRALLTELPALPIVIAQLEPVPDELRFGAPELPDTSAVARMLNLTPDELDWFADHGGWLRRTREPLAHYRYRRIPKKDGVRLVEAPKPRLREMQRTIARRILAGIPAHPACHGFEKGASAATFAAPHARAAVVVRLDLRHFFPSIGVARVRGVFRACGYRENVATVLADLCTTATAIRALTGLDHEQASLLRTPHLAQGAPTSPRLANLIARNLDRRVSGYARRHGLTYTRYADDLALSDPADTDVDAMIWALTRIIEDEGFEVHRDKTSVRRPHQRQVLAGLVVNDRPAVARAQYDAVRALLHNCLRTGAAAQNHNAHPNFRAHVYGSIAWIGATSPTRRQKLLDMAKRVDWTQSDAAGSGLAADAVEDFHEGGG

SEQ ID NO: 5586 - protein, 419 aa, unidentified
  source 1..419: note = Related to NZ_JAEMNV010000003.1; note = Antrihabitans stalagmiti
MTRRAVPPQLADLLADEFDAADRTWQRSDLAEVFGSFVNAVRAEELAQRVIALVPTEPVDRRNSLRSILAELPVLQRVVNLVEPAQHELRFGVPELTDLRSVASMLNVTPAELDWFADRGGWLRNSTEPLTHYRYLRRPKASGVRLIEAPKPRLREMQRTIARKVLASVPAHPACHGFEKECSAASFADPHTGSDVVVRVDLRNFFSSIGVGRVRAVYRAIGYDYAIANVLAHICTTATAVSALRGIDNQHASLLRMPHLAQGAPTSPRLANLIARNLDRRVAGYATKHDLTYTRYADDLAFSGPATTDVDALLWAVSHMVDDEGFTVNRRKTSVRRRHQRQLLAGLVVNSQPRAPREAYDALRALLHNCARTGAHEQNTDGHTDFRAHIYGRIAWIGETDPRRRQRLLDMAARVDWNR

SEQ ID NO: 5587 - protein, 451 aa, unidentified
  source 1..451: note = Related to NZ_BCRU01000034.1; note = Smaragdicoccus niigatensis
MRRISWQQRPKPLGTLRVRPGDKDKSRSSATVARPLMQGRFSLPHAQAIARAFGRRELSWRRENLAEVFAGFVEAGLAESLASQVIDNVPLEPIEPYPTLVAQLRSLRWEIDLNPPLAKPLRFGVPELPDVSALAQFLNLTPSELDWFADCGGWLRTASGPLSHYRYRQLPRRSGRRLVEAPKPRLREIQRTINRRILACLPVHSACHGFESGRNPATFSAPHSSAGLLIRMDLKNYFSSIGEPRVRAIFEAMGYSEVVSRSLAGLSTNASSIAALRGLDHEQRTFLRVPHLPQGAPTSPKLGNLAARGLDRRLSGFALRVGMTYTRYADDLAFSGADGINAGSIVSAVERIIAAEGLFVNRQKTLIRRSHQRQILAGLVVNDHPQVPRDSYDKVRAILHNAARTGAAAQNRGGHADFRAHVLGLISWIGETNPDRRERLLDLAAEVDWTT

SEQ ID NO: 5588 - protein, 416 aa, unidentified
  source 1..416: note = Related to VLIY01000014.1; note = Skermania sp.
MTPRAVSPAVAHALADEFARGGFRWRHSELAEAFAAIIDPVEAESLALRVVGLIPREPIDPQTTLQAVLADLPELPETVVAPEGEPGGLRFGVPEILDCGALATMLNLTTAELEWFADHGGWLRTAREPLSHYRYRRLPKSTGVRLVEAPKPRLREIQRTINRRILSGIPAHPSCHGFEKGRSAETFAMPHAQADVVVRVDLRDFFSSITVARVRAVFRACGYPDSVATALADLCTHASAIAPLRGLDHRQRTLLRVPHLPQGAPTSPRLANLVARNLDRRISGYARRSGLAYTRYADDLALSGTMDADSAVWAVTRIAEAEGFLVNPAKTSVRRQHQRQILAGLVVNNRPAAPRYAYDQVRALLHNCQRTGAAAQNRQGHNDFRSHVYGLIAWIGETSPARRQRLLAMAELVDWD

SEQ ID NO: 5589 - protein, 420 aa, unidentified
  source 1..420: note = Related to JAFBBK010000001.1; note = Rhodococcus corynebacterioides
MSETFWHHHTARMVAARLVDIEWNSTELGEVLARFEHVADVETLITRLLERRIHAPDSTEVAAELLEVIGYPGDPFVLPAPPVRPTPTVRFGVPAFATTAELAASLDVTVSELDWFADVGGWLRRAAPPLRHYRAREVAKSRGGTRILEIPKPRLREMQRRVLHRVLDHVVPHPAAHGFRAGRSAVTFARPHEGRDVVVRVDLADFFPTVTRPRARAVFEACGYPYRVASVLAGICTTAMPVDEVAGLPRSQAALLGVPHLPQGAPTSPALANLVARGLDRRVAGLARARGLVYTRYADDLALSGPSDTDVSTLLWALDRIVRDEGFVVNGDKTHVARAHRRQTLAGLVVNESAAAPRDRYDALRALLHNSVRTGAAAQNRAGVPDFRASVYGQIAWIGESSPSRRSRLLAMADRVDWES

SEQ ID NO: 5590 - protein, 408 aa, unidentified
  source 1..408: note = Related to LMRP01000002.1; note = Rhodococcus sp.
MPWTGAELGEVLGPFDRWFDVETLITRLSDAVRDAPDSVEAAVELLEGVGYPGLPFIPTPPPRIRPYRFGVPEISTPADLATSLGVTVPELDWFADLGGWLRRAAPPLRHYRAVEVPKKAGGKAGGRSDLGNIRILEVPKPRMREMQRRVLHRIVDHVDPHPAAHGFRTGRSAVTFARPHEQQDVVVRVDLADFFATVTAPRVRAVFEACGYPSKVAALLAGICTTAMPVDEASRLTTRRAAVMRTPHLPQGAPTSPALANLVARRLDRRVAGLARARGLTYTRYADDLALSGPSSTDVGTLLWALEHIALDEGFEVNAAKTHVRRSHTRQTLAGLVVNRSAAVPRDRYDDLRALLHNAARTGAAAQNRDELPDFRAHVYGLIAWVGESSPIRRVRLLDMAASVDWDA

SEQ ID NO: 5591 - protein, 450 aa, unidentified
  source 1..450: note = Related to JABUBR010000003.1; note = Rhodococcus corynebacterioides
MHAPRAALRRRRESMVAPVPLPLATVTPPPENPHWARHHVPAIAPLLVDTAWTRAALDEMLVPFGGFLDVDTLRRRLMDAITGAPYTVDIAVRVLLEAGFPGPPPRISIPRAPLVVRPWRFDVPRYASAAELAASLDVTLDELDWFADLQGRLCRAPTPLRHYRALTIPKSAGAHRLLEIPKPRLREMQRRVLRRIVERIEPHDAAHGFRRGRGVHTFAAPHRQQDVVIRMDVRNFFPTITFARIRGVFAACGYPDAVAAVLAGICTTSLPVDEARPLPWREATDLRGRHLPQGAPTSPALANLVARGVDRRLAGLARARGLAYTRYADDLALSGPSSTDVRTVIGTVDRILRQEGFTPNEAKTRVRRSHRRQSMTGLVVNVSPQVPREEYDALRALLHNCRRTGAAAQNHDGVPDFRAYVLGRVAWVGESNDTRRRRLLALADEVDWAS

SEQ ID NO: 5592 - protein, 399 aa, unidentified
  source 1..399: note = Related to NZ_BMCU01000001.1; note = Rhodococcus trifolii
MLVDARWTRSGLEEALESFSHRHDVDALVTRLLDLMPSAPLDVESGLSLLRGMPVLPMYLPPRPKPPSWHFDVPRYSSNIDLARSLDVTPWELEWFADLGGWLRTKPYPLQHYRTRTIDKRDGHRLLEVPKPRLREMQRRLLTRILDRIPPHDAAHGFVRGRSAVTFARPHEYADVVIRMDLADFFTSIRRPRVAAIFASAGYPRTVARTLAGICTTETPAERLSGLPHDRAVALRAPHLPQGAPTSPALANLVARRLDRRLAGFARKNGLTYTRYADDLAFSGSADVRVDKLITVVTTIVRAEGFSVNVRKTRIRRAHRRQVLAGLVVNESAAVPRARYDALRALLHNCSITGASEQNRDGLPDFRSHVYGVIAWIGESNEVRRAVLHDLAARVDWDS

SEQ ID NO: 5593 - protein, 415 aa, unidentified
  source 1..415: note = Related to NZ_CP032762.1; note = Rhodococcus sp.
MSRQFSPQMAAWLASLAAEAPWTRGGLEEAFMPLLGDKAARLAYRLIDLLPSAPYDTESLRGLITGLPLLPEPRSVEPSRRRDGVKPWLFEVPRYVTTGDLAESLNLTIPEIEWFADAHSRLTVAPEPLRHYRVTPIPKRVGARLLEIPKPRLREIQRKILRRILDNVPAHAAAHGFVKGRSPRTFGIPHAGREVVMSVDLKDFFPTVGINRVVAVFDALGYPRNVAWNLAYLCTTSTPAGQLGGMPYATASLLRSRHLPQGAPTSPALANLVARRLDIRLTGLARSMGLRYTRYADDLAFSGSADVDAVLWVARQVIVDEGFVVNPVKTRVRRAHKRQILTGLVVNDWPAVPRKEYDELRAILHNCAVTGPEPQNRHGVPDFRAHLFGRIARIGETNSARRRRLLEMAEQVDWA

SEQ ID NO: 5594 - protein, 407 aa, unidentified
  source 1..407: note = Related to NZ_NPFR01000010.1; note = Rhodococcus sp.
MAAWLASLAADALWTRSGLEEAFLPILGEKAPRLADRLIDLSPVAPYDPESLRGLITGLPLLPEPATVEPSRRTDGFKPWLFEVPRYASTGDLAESLDLTISEIEWFIDAQSRLRTAATPLRHYRVTPVPKRVGFRILEIPKPRLREIQRKILRRILHNVPAHSAAHGFVTGRSPRTFGIPHAGHTVVVSVDLKDYFPSIGIERVVAVFDALGYPKSVAWSLAYLCTTATPAEQLGGFPYATASLLRTRHLPQGAPTSPALANLVSRRLDIRLTALAKSLGARYTRYADDLAFSGDIDADKIIWSASKIIADEGFAVHPYKTRVRRAHKRQQLTGLVVNDWPSVPRKEYDALRAILHNCAVTGPDPQNLSAIPDFRAHLYGRIARIGATSAVRRRKLLELAERIDWE

SEQ ID NO: 5595 - protein, 472 aa, unidentified
  source 1..472: note = Related to NZ_LVCV01000404.1; note = Rhodococcus sp.
MAHGRVSVRATDLRGNPWVGKKNWALRPTPVRTLRVHDGAEHERFRSPVAAAPWIAMTERQFNAQLAAYLAQLAADAQWTRERLEEAFMPILGERAPRLADRLIDLYPSQPFDQASVHRLIAELPRIPEAISHEPVRRSNSPKPWRFDVPRYFTTGDLAESLNLTIPEIEWFADAHSRLTTASPPLRHYRTTAIPKRVGARLLEIPKPRLREIQRKILRRILDHVPAHGAAHGFVKGRSPRTFGIPHAGKEVVISVDLKNFFPSIGISRVIAIFDALGYSRSVAWNLAYLCTTSTPAGQLNGLPYATASLLRTRHLPQGAPTSPALANLAARMLDIRLTGFARSMGLRYSRYADDLALSGDADVDKVLWVARRIITDEGFILNPLKTRVRRAHERQQLTGLVVNDWPAVQRREYDELRAILHNCTRTGPTSQNRSDMEDFRAHLYGRIARIGETSPTRRRTLLEMAERVDWT

SEQ ID NO: 5596 - protein, 416 aa, unidentified
  source 1..416: note = Related to NZ_JABFAO010000002.1; note = Rhodococcus sp.
MSERQYIPPMAAALARLAADAPWTRERLEEAFMPLLGARASRLADRLVELHPAPPFDEASVHRLIADLPLLPETASITPERRTSSFAEWRFEVPRYVTTGDLAESLNLTIPEIEWFADAQSRLRTAPEPLRHYRTTPIPKRVGARLLEIPKPRLREIQRKILRRILDRVPPHSAAHGFVKGRSPRTFGIPHAGHEVLVSVDLKDFFPSIGIDRIVAIFGALGYPRTVAWNLAYLCTTSTPAEQLSGFAYPSASLLRTRHLPQGAPTSPALANLAARKLDIRLTGLAGSMGLRYTRYADDLAFSGSCDADVLLWTIRQIVRDEGFGLNPGKTRVRRAHKRQQLAGLVVNEWPAVPRREYDGLRAILHNCILTGPAAQNRAGVPDFRAHLYGRIAHIGETSAARRRRLLEMAEQVDWS

SEQ ID NO: 5597 - protein, 407 aa, unidentified
  source 1..407: note = Related to LVHI01000032.1; note = Rhodococcus kyotonensis
MAAFLAELASDVPWTRDRLEEAFMPVLGVKALRLADRLIDLYPSPPFDEESLYRLIADLPRLPDKKSEEPERRTSGPKPWRFDVPRYFSTGDLAESLNLTIDEIEWFADAQQRLKTASSTLRHYRATSISKRSGARVLEIPKPRLREIQRKVLRRILDQVPAHGAAHGFVTGRSPRTFGIPHAGRDVVLAADLKDFFPSIGIGRVVAIFDALGYPRTVAWNLAYLCTTSAPAGELAGVPYETASLLRTRHLPQGAPTSPALANLAARMLDIRLTGLARSMGLRYTRYADDLAFSGTCDVDRVLWVVRHIVRDEGFMLHPNKTRVRRSHKRQQLTGLVVNEWPAVPRSEYDELRAILHNCARTGPEAQNRSGHGDFRAHLYGRIARIGETSATRRRKLLELAERVNWS

SEQ ID NO: 5598 - protein, 418 aa, unidentified
  source 1..418: note = Related to NZ_CP010797.1; note = Rhodococcus sp.
MTERELTPQAAATLARLAADAEWTRSGLAEAFEPLVPAKATWLADRVINLYPSPPFDEASIFVLLRDLPFIPEPSVSSQRPTRNSDKPWRFEVPRYETTGQLARSLDLTISEIEWFADLQGRLRTAPFPLQHYRSARLDKRQGIRLLEVPKPRLREIQRKILRRILDRIPSHPAAHGFAKARSPRTFAMPHSERDVVISVDLRRFFPSIGFDRVVAIFEAVGYPRTVAKTLAALCTTVTPASELTGMDRPTAARLRATHLPQGAPTSPALANLAARQLDIRATGLARSGGARYSRYADDLAFSGGPDLDVDRLLWLITQIAHDEGFTIHPDKTRVRRAHQRQQLTGLVVNSWPAVPREEYDTLRALLHNCIASGPAEQNRHHHNDFRAHVYGRIARIGETNETRRAKLLSMASRVNWD

SEQ ID NO: 5599 - protein, 441 aa, unidentified
  source 1..441: note = Related to NZ_JABFAU010000077.1; note = Rhodococcus sp.
MTERELTPRAAAILARLAVDADWTRSGLDEAFARLIPAKATRLADRVMNLYPSPPFDEASIFVLLRDLPFLAEPSISSEIPTHFGGKPWRFEVPRYETTGDLARSLDLTISEIEWFADLHGRLRSAPYPLQHYRSARLDKRQGIRLLEVPKPRLREIQRKILRRILDRIPPHPAAHGFRKARSPRTFALPHSGRAVVVSMDLRRFFPSIGFDRVVAIFEAVGYPGTVAAHLAALCTTVTPAVELIGMDRPTASRLRATHLPQGAPTSPALANLVARQLDIRASGLARSVGAHYTRYADDLAFSAAADLDVDRLLWVMSQIAYDEGFAVHPGKTRVGRAHQRQQLTGLVVNSSPAAPREEYDNLRALLNNCIRAGVSGQNRRGADDFRAHVYGRIARIGETNEARRTKLLNMAARVDWPTPVFEPRNSGSRTAHTPATEEDR

SEQ ID NO: 5600 - protein, 422 aa, unidentified
  source 1..422: note = Related to CP015235.1; note = Rhodococcus fascians
MNDRELSPRAAATLARLAADAEWTQSGLEEAFSRFMPAKASRLADRIIDLYPSPPFDEASIFVLLRDLPLIAQSSKSSQRSPIRGRVVPWRFEVPRYETTGQLAQSLDLTISEIEWFADLQGRLRTAPFPLQHYRSARLDKRHGVRLLEVPKPRLREIQRKILHRILDRIPPHPAAHGFRKGRSPRTFATPHAEREVVVSVDLRRFFPSIGFDRVVAIFEAVGYRRRVAANLAALCTTVTPAGELTGMDRATAARLRTTHLPQGAPTSPALANLAARQLDIRAAGLARTMGARYTRYADDLAFSGPADLDVDKLLWVLSQIVRDEGFTIHPDKTRVRRAHQRQQLTGLVVNAWPAVPREEYDNLRALLHNCLGSVAAQQNRNGLTDFCAHVYGRIARIGETSETRRRKLLEMAARVDWEGSG

SEQ ID NO: 5601 - protein, 416 aa, unidentified
  source 1..416: note = Related to NZ_CP039254.1; note = Rhodococcus sp.
MADRELTPRSAAVLAALAADVQWTRSGLQEAFAALVPARASWLADRVINLFPMPPFDESSIFRLLRDLPFIPEPLVSSHTPPPGGNVKPWRFEVPRHETTGQLAQSLDLTIDEMDWFADLQGRLTRAPFPMQHYRSARIDKRVGSRLLEVPKPRLREIQRKVLRRILDRVPAHPASHGFRRGRSARTFAIPHAGREVVVSVDLKNFFPSIGFDRVVAIFEAVGYPPTVASNLAGVCTTVTPAAELVGIDRPTASRLRSTHLPQGAPTSPALANLAARQVDIRLTGLARSMGLRYTRYADDLAFSGSPEVDTLLWVVGQVAQDEGFALHPDKTRVRRAHQRQQLTGLVVNDWPAVPRAEYDALRALLHNCMTTGADVQNLNGSADFRAHVYGRIARIGETSSTRRERLLAMAARVDW

SEQ ID NO: 5602 - protein, 416 aa, unidentified
  source 1..416: note = Related to NZ_CP007255.1; note = Rhodococcus erythropolis
MRDFELDPELARRLAVAAADAPWTLSGLEEAFGTVFGVSPTLLAVRVLDLMPAPPFEPQTLYRLLRELPRLRPVPLSLDTNESSVWRFDVPRYNTSVDLARALDLTISELEWFADRGEWLRTKPLPLRHYRPMQISKKTGARLLEVPKPRLREIQRKILRRILDLVPPHDAAHGFVRGRSPLTFAAPHAQSEIVIGVDLAQFFPSISGSRVHAVFTALGYPPAVAGVLTGLCTVATPADTLRGLPYAQASQLRTAHLPQGAPTSPALANLVARKLDIRLSGLAQANWLTYTRYADDLAFSGIEVADVGTLLWSVEQIARDEGFAIHPRKTKVMRPHRRQHLTGLVINDQPSYPRDDYDRLRALLYNAASTSAQEQNRDGIENFRAHVYGRIAHIGETSTTRRHTLLRLAERVDWDG

SEQ ID NO: 5603 - protein, 444 aa, unidentified
  source 1..444: note = Related to JAGRPD010000186.1; note = Verrucomicrobiales bacterium
MSLDRVPLVQQLVRRALDGRWESHAILARWHTLGARPCITLRALAHLAVHCAGRGIRPTEKRLIRTLLSSPLLSRWLRQQHRTLLPLPPPAPKFEPVEKLAHLALPPLTTETDLAQFFHMELAELSWHADPQLRLRHQPDGRLQHYTYRWLPRRNGSPPPRLLEIPKPWTRQLQRRIWDQLLRPVPVHAACHGFVPGRSRLTAAAPHCGKEALLRIDLKDFFVSIPRWQVRALWMTLGYPEAVARLLAGLCTTVTPAAVLDACPAPPQDPSQRWWWRKRASTPHLPQGSPCSPALANLCAWRLDTRLTAYATAAGLDYTRYADDLLFSGSARTLRRPQRRHALMEIIRSEGFCVHPDKVRLMTQSQSQQALGLVLNQRLNLPRASFDQLKAELHHALHHQGLPSEASARSQKLAQLRGRIQEMIDIHPRRGQKLLALWQRLLRD

SEQ ID NO: 5604 - protein, 334 aa, unidentified
  source 1..334: note = Related to JAJTHZ010000014.1; note = Xanthomonadaceae bacterium
MPPTRSARAPALDSLDQLRRWLRLSTGELLWFCDVYGNGRRACATALRHYRHRWIAKRSGGLRLLEIPKARLKRMQRRILDELLSHAAIHPAATGFVRGRSCLDHARTHVGARWVVTSDLRDWFGSIPRARIAAQFRRSGASKHVADALARLCTACTPSAIVDLAAVPDRAHLRVPHLPQGAPTSPALANLVASRLDRRLAGYARHAGLNYSRYADDIALSPQPGVETPPQRALEALQRIARSEGFRVNPRKIRIKRHGSRMTVCGIVINERLNLARDAYDRLRAAVHRLASSTDVDPLEIARVRGRLSWLESLNPRRAAKLRRLLESRGTPST

SEQ ID NO: 5605 - protein, 458 aa, unidentified
  source 1..458: note = Related to NZ_JACCBH010000001.1; note = Microbacterium pseudoresistens
MTDAATPASRVLARTPHPLPRDVAAALGDAFLAAEAWERAALIDAGADVLGARRRWLGPLVRDVLTELARPPSDAPRLLVSVIVRSSAFLEAVRKAEERGSPLRIRHRVIAPSVSREPTGALPAIGDVTDLAALLEIDLGRLQWLADVKHWNRRARSPALQHYRYEWRRRPGRVPRLLEIPEQRLRRAQRRLLHAVLALIPVNDAAHGFLPGRSAATGAARHIGAETVISLDLTTFFARVTAPRIYGVLRQSGFSEPVAHTMTGLCTTAVPPAVLAAMPPGGSPDERFALRRALASTHLPQGAPSSPMLANLAIRRLDSRLTGWADALDATYTRYADDLAFSGGPALARRADAFIRGARRIIADEGHEANARKTRVRGRGVRQSVTGIVVNERLNVSRDDYDRLKAIVHNCVVHGPATQNRGGVADFRAHLLGRISWVESLNARRGERLRAEFARIRW

SEQ ID NO: 5606 - protein, 456 aa, unidentified
  source 1..456: note = Related to NZ_BMCM01000001.1; note = Microbacterium murale
MAATTASRVLARTPRPLPSSVAASLADAFLASEVWAPKELIRTGAFVMGARRRWLTPLVGDVMSAFVRAPVDAPRLLTSVILRAPDFIEAVRKADERRSPLRIHHHVVGPSTSQPPSGPLPRIDSIPDLAVLLDLDVGRLQWLADTKQWNRRARPGPLHHYQYEWRARPGRIPRLLEIPEQRMRRVQRTLLERVLGLIPVNGAAHGFVPGRSAVTGAAHHTGSDIVISLDLTTFFARVTAGRIFGTLRQSGLSEPVSHVITGLCTNAVPPRVLAAMPPGGSPEERFALRQALATSHLPQGAPSSPMLANLAIRRLDSRLTGWADAVDATYTRYADDLAFSGGSTLAKRPDAFIRGVQRIIEDEGHLANPRKTRVRRQGVRQTVTGIVVNQRANVSRADFDRLKATIHNCVLHGPHTQNHRSLDDFRAHLLGRISWVESLNPPRGARLRQEFLRIRW

SEQ ID NO: 5607 - protein, 459 aa, unidentified
  source 1..459: note = Related to NZ_PCOT01000008.1; note = Microbacterium sp.
MTEALTPATRVLARTPRAGASAIATALADAFLAADAWTAPHLVDAGSFVLGARRRWLPRVVDDVMVDFVRAPVDSPRLLIAVIRDSPAFRAAIEKADAARTPIRIHHHVVATTRSREPAAGLPRIDDIAALAVLLELTDGQLAWFADTKRWNRRARPGPLHHYRYEWRSRPGRVPRLLEVPEERLRRVQRRLLERVLGLIPANDAAHGFMPGRSAVTGAARHVGAGIVVSVDLTTFFARVSAGRVYGTLRQSGYSESVAHTIAGVCTSAVPPRVLAAMPPGGTPEERFALRRALAANHLPQGAPSSPMIANLAVRRLDSRLTGWAAAVDAAYTRYADDLTFSGGPSLAARPDAFIRGVRRIVEDEGHSLNERKTRIRRQATRQAVTGIIVNERLNLVRGDYDRLKAIIHNCILHGPSSQNRAGVADFRAHLRGRISWVESLNAQRGARLRAEFARIVWA

SEQ ID NO: 5608 - protein, 465 aa, unidentified
  source 1..465: note = Related to NZ_JAFBBQ010000001.1; note = Microbacterium keratanolyticum
MTSTAAARALGHSPQPAASAIARALADAFLETPSWTRPELMAAGARVLGARRRWLGPVVDEILGDLVRAPHDSPRLLATLIEDSPAFREGVSKAAARRAPQQIHYRPLAPQHPPALSHPLDPEPPLPRLRTLPELAALLDLSLGHLEWLADTKNWNRRARPGSLHHYRYEWRTRPGRVPRLLEVPEDRMRRTQRALLDQLLSRIPANDAAHGFLPGRSAVTGAARHVASDIVISLDLTTFFARVTATRIYGTLRQAGYDEQIAHAITGLCTNAVPPRVLAAMPPGGSPEERFALRRALAASHLPQGAPSSPMLANLAVRRLDSRLTGWAEKAEASYTRYADDLTFSGSGVIARRPDAFVRGVRRIIADEGHIANPAKTRVRRQGTRQAVTGIVVNQHPNLSRVEFDRLKAILHNCAVHGPAAQNRSDASDFRAHLLGRISWVESLNPGRGAKLRREFSRIDWGSP

SEQ ID NO: 5609 - protein, 469 aa, unidentified
  source 1..469: note = Related to VFRA01000001.1; note = Rhodoglobus vestalii
MSGSFGKRAVPNTAVVIMAAHRSYRAPHPSPSAISHALAYAFLASDVWETKQLVDAGWSVLGAHRRWLRAVVADVVAAYHRPPTDSSRELAAFIRNSPAFVDAIAKARQQRRPIRIHHLVVAPSQARDVGGLVPRINTVAELAELLGLTIGQLDWYADTKNWNRRAPVGPLQHYRYEWRTRPGRTPRLLEVPEERIRRVQRLLLDAVIALIPVNDAAHGFIANRSAVTGAALHTGREIVVSLDLTTFFTRVTASRIYGVFRQSGFPETVAHILTGLCTNSVPPRVIAAMPPGGDADERFALRHALAANHLPQGAPSSPMLANLAIRRLDSRLTGWAHSVGAIYTRYADDLAFSGDRDLARRPDAFIRGVQGVVREEGQTINPRKTRVRRSGVRQTVTGIVVNDHTNISRHDYDLLKATLHNCATLGVERQNRGGHNDFRAHLLGRIAWVETLNPLRGEALRQKFALIRW

SEQ ID NO: 5610 - protein, 465 aa, unidentified
  source 1..465: note = Related to NZ_CP035375.1; note = Salinibacterium sp.
MTDAPPQTTGSPISGVPRVRRVPHPTPAAIAGALSYAFLAADQWATNSLIDAGARVLGARRRWLRTVVADVVAVYHRPPADSSRELASFVVQLPAFVEAIAKAKQQRRPIGLHHFPAAPSQARDRGDPVPVVDTVGELATLLGVTVGHLEWCADTKNWNRRAPAGRLQHYRYEWRQRPGRTPRLLEVPEERIRRVQRTLLDTVIGLIPTNVAAHGFVASRSAATGAALHTAREIVVTLDLTTFFTRVTAARIYGVFRQSGFPESVAHILTGLCTNSVPPRVIAAMPPGGSADERFALRQALAGNHLPQGAPSSPMLANLAIRRLDSRLTGWANAIGATYTRYADDLAFSGDRDLARRPDAFIRGVHRIVLDEGHNVNPRKTRVRRSGTKQTVTGIVVNERTNISRHDYDALKALLHNCAQHGPDSQNLSHHVDLRAHLMGRIAWVTALNPHKGEVLHTKFALIRW

SEQ ID NO: 5611 - protein, 470 aa, unidentified
  source 1..470: note = Related to nan
MSLRFWSMTMDAASSTRAKAGLRGIRRPHPAPSAVSQALAYAFLASEVWAAKELVDAGSLVLGARRRWLRPVVADVMAAYHRAPTGSTRELAAFIATVPAFVDAVAAAAQQRRPIRIHRVVATASQARPAGGPLPAIDTVADLAVLLGLSLGELEWFADTKNWNRRAPAGALHHYRYEWRARPGRTPRLIEVPEQRLRRAQRALLECVIGMIPLNDAAHGFVPGRSAVTGATLHTGREIVVSLDLTTFFARVRASRVYGVLRQAGFAESVAHVIAGLCTNSVPPRVIAAMPDGGSAEERFALRHALADRHLPQGAPSSPTLANLAIRRLDSRLSGWATSVGATYTRYADDLAFSGDRELARRPDAFIRGVERIVHEEGHSVNPQKTRVRRSGVRQSITGIVVNEHTNISRREYDQLKAILHNCAAHGPESQNRDHHNDFGAHLLGRIAWVSTVNPLKGRSLRQKFALIDW

SEQ ID NO: 5612 - protein, 338 aa, unidentified
  source 1..338: note = Related to LMDN01000001.1; note = Leifsonia sp.
MPVPRLDTLADLSALLGLDIGELEWFADARGWNRRAPERLQHYRHEWRTRPGRTPRLLEVPEQRMRRAQRTLLDTVIGVLPAHDAAHGFMPGRGVISGAEAHLGSAVVISLDLVSFFSRVSARQIYAVLRRAGLPEVVAHRVTALCTHAVPPAVLAGMPPGGSPEERFALRQALARPHLPQGAPSSPMLANLAVRRLDARLSGWSDAAGARYTRYADDLSFSGGAELSRRSDAFVRGVARIVAAEGHELNERKTRVRRAGERQSVTGVVVNDRLNLARRDVDQLKAILHNCAVHGPESQNRAGHPDFRAHLEGRLNWVESLNPARAARLRRDFERIAW

SEQ ID NO: 5613 - protein, 463 aa, unidentified
  source 1..463: note = Related to NZ_JPRS01000007.1; note = Cryobacterium sp.
MSDSPGATGAGRAALVLGREPHPSSAGVATALAFAFLAADVWSPSGLSTAGTAVLGVRRRWLGPLIRDVLEAYRQPPHDASLELSRVIGATESFRAAVRLADSRGAPLRVLHHKVAESRAREMPGLVPHIDTPADLARLLELSVGDLDWFADAKQWNRRSAVAALHHYRYEWRLRPGRTPRLLEIPETRVRAAQKRLLVEVLGLIPTHDAAHGFVPGRSAVTGASRHTGSDVVVSLDLTTFFARVTGAAVYGTLRRAGLPEAVAYAITGLCTTAAPPRVLSAMPPGGDPDERFALRKALASTHLPQGAPSSPMLANLAIRRLDARLQGWAAAAGGTYTRYADDLAFSGGGQLARRPDAFVRGVQHIVIAEGHTANPRKTRVRRASVKQTVTGVVVNARTNMSRRDVDRLKAIIHNCVLHGPESQNTAAHADFRAHLLGRLSWLESLNPERARTLRTEFRRIEW

SEQ ID NO: 5614 - protein, 432 aa, unidentified
  source 1..432: note = Related to NZ_PJJO01000056.1; note = Cryobacterium sp.
MALAFLAADDWSATRLSAAGSLVLGARRRWLGPLVRDVLAAYREPPHDASRELTTVISGSDAFRAAVDRADARGAPLQVTHHLVAQSRGREAPAPAPLLDTVSGLARLLDLSVGDLDWFADTKHWNRRAPAGALQHYRYEWRLRPGRTPRLLEIPGSRLRATQRKLLVGVLGFIPTHDAAHGFVPGRSAVTGASRHTGKNVVISADLTSFFARVSGARVYGTLRRAGIPETVAYTITGLCTTAAPPRVIAAMPPGGNLDERFALRKALAATHLPQGAPSSPMLANLAIRRLDARLEGWSSAAGAVYTRYADDLAFSGGGALARRADAFVRGVDRIVTSEGHTLNSHKTRVRGASLKQTVTGVVVNKHTNMSRRDIDELKAILHNCVVNGPDSQNQGAHPDFRSHLLGRLSWLEAVNPARGQKLRVEFGRIHW

SEQ ID NO: 5615 - protein, 461 aa, unidentified
  source 1..461: note = Related to NZ_JACHBQ010000001.1; note = Cryobacterium roopkundense
MTSKLRGATPAALVLARRPHPSSSEVASTLALAFLSSKFWHATALSEAGSAVLGARRRWLGPLVRETLTVYREAPHDAPRALTAFIAAADVFRAAVAHADASGVPIGLAHHRIPLTRARPVPGVVPPLGTLAELADFLELPIGDLDWFADTRQWNRHAPSGALQHYRYEWRARAGRTPRLLEIPGARLRSAQRTLLTGVIGLVPTHDAAHGFVPGRSAVTGASRHTGTDVVISLDLTTFFARVTGARIYGTLRRAGLPEAVAYTITGLCTTAAPPRVIAAMPAGGRPEERFALRQALAATHLPQGAPSSPMLANLALRRLDSRLAGWAAAASSVYTRYADDLAFSGDLTLARRADAFARGVERIVAAEGHLVNPHKTRVRRASVKQTVTGIVVNTQTNMSRQESDRLKAIIHNCARHGPESQNRGAHPEFRAHLLGRLSWLETLNPARGRKLRAEFSRIHW

SEQ ID NO: 5616 - protein, 467 aa, unidentified
  source 1..467: note = Related to NZ_QZVS01000068.1; note = Cryobacterium melibiosiphilum
MSAGAAVPRPTPAALVLARRPHPSTDALAATLAAALLGAKTWSKTEMIDAGAHVLGARRRWLGPLATEILSSYPRAPTDSPRELAAHIIDCAAFSNAIEAATSRGVPNIIAHYPLTPPLTPPQARAVTSALPRLDTLGDLAAFLTLTPGELDWFADTGQWNRTARPGALHHYRHEWRVRPGRTPRLLEVPGTRLRALQRTLLHDLLGLIPTHGAAHGFVPGRSAVTGAARHTGTAAVISLDLTTFFASVTGSAIYGTLRRAGYPESVAHSITGLCTHAVPPRVIAAMPPGGDPAERAALRRALAAPHLPQGAPSSPVLGNLALRRLDARLAGWADAAAATYTRYADDLAFSGGTDLRRRADAFVRGVTRIALAEGHTVNPHKTRVRPASVRQSVTGIVVNEHPNISRVDADRLKAILHNCELHGPAGQNRAGHADFRAHLLGRISWVEQLNPERGARLRASFGRIRW

SEQ ID NO: 5617 - protein, 417 aa, unidentified
  source 1..417: note = Related to SOHE01000083.1; note = Cryobacterium sp.
MIEVGARALGARRRWLGPLASEILSSYPRAPTDAPRELAAHITGCTAFSNAVEEATSRGVPITIASYPLTPPQAGAVTSALPRLDTLGDLAALLGLTPGELDWFADTGHWNRRARPGVLHHYRYEWRARPGRTPRLLEVPGTRLRALQRTLLNDLLGLIPAHPAAHGFVPGRSAVTGAARHTGAAVVISLDLTSFFASVSAQNIYGTLRRVGYPEAVAYSLTGLCTHAVPPRVIAAMPPGGDPGERAALRRALASAHLPQGAPTSPVLGNLAIRRLDARLDGWAEAAEATYTRYADDLAFSGGDALHRRADAFVRGVTRLVTAEGHTVNPHKTRVRPASVRQSVTGIVVNARPNLVRVEADRLKAIVHNCVVHGPAGQNRGAHPDFRAHLLGRISWVEQLNPQRGARLRATFARIRW

SEQ ID NO: 5618 - protein, 391 aa, unidentified
  source 1..391: note = Related to NZ_JAALGE010000001.1; note = Marisediminicola senii
MIRGHTPHSSTADVASALAGAFLAADAWTERDLVAAGAHVLGARRRWLPPLVRETLAAYRRPPVDAPRELGDFVEMTAAFGLAVVAAHDRRTPIRIEHRVLVAARAVPATPAVPRVDGLDDLADLLGLTPGELDWFADRRHYTRRATDTRLQHYRHEWRTRPQRTPRLLEVPGSRLVAVQRTVLAELLGPLPVHGAAHGFVPGRSAITGAARHTGAAVVIALDLSTFFSRVTAGRVYATLRRAGYPEAVAHAITGLCTHAVPPRVIAAMPSGGDADERFAARRALAAAHLPQGAPTSPMLANLSVRRLDARLSAWAERVDATYTRYADDLAFSGPPALARRSDAFIGGGERIVTAEGHPPNARKTPGRPARPPPRGPGNAGTDPPHTPRTG

SEQ ID NO: 5619 - protein, 370 aa, unidentified
  source 1..370: note = Related to JABMLG010000003.1; note = Microbacteriaceae bacterium VKM Ac-2855
MRAALRRAVKRGTPVIIAHHVLAEPVAPASASPVPRLASVTELAAALHLEIGELEWFADTRLQLRRASSTRLQHYRYEWRERPGRLPRLLEVPGRRLRAAQRAALDAVIGLAPLHDAAHGFVPGRSARTGAERHVGSEVVIALDLTTFFARVTARDVYRALRAEGLPESVAYVLTGLCTHAVPYRVAAHPPRGGDLDERFALQKALTVPHLPQGAPTSPALANLCVRRLDARLAGYAEAAGAVYTRYADDLAFSGGPALARRADAFARGVRRIVASEGHELNDHKTRIRTASVRQSVTGIVVNTRPNVTRAEYDALKATLHNCIRDGPASQNRAGHAEFRAHLLGRISWIASLNPARGERLRAEFDRIPW

SEQ ID NO: 5620 - protein, 364 aa, unidentified
  source 1..364: note = Related to JABMLH010000001.1; note = Microbacteriaceae bacterium VKM Ac-2854
MRAALADAAHRGRPLGIAHHLIAEPPSGTHPGSLAELAALLELTPGELDWFADTQLRQRRAPDGPLQHYRYEWRERPGRLPRLLEVPGRRLRAAQRVLLEEVVGLLPLHDAAHGFVPGRSVRTGAERHLGQEVVIALDLTTFFARVSARDVYRLLRGASIPEAVAYTITGLCTHAVPYRVAAHPPRGGDLDERFALQKALTVPHLPQGAPTSPALANLSLRRLDARLAGYAAAAGAAYTRYADDLAFSGGPALARRADAFIRGVERIVAAEGHLINAHKTRVRKAAVRQSVTGVVVNRVTNVTRTEFDALKATLHNCVVHGAASQNRGAHPDFRAHLLGRISWVAALNPARGAKLREEFDRIHW

SEQ ID NO: 5621 - protein, 459 aa, unidentified
  source 1..459: note = Related to NZ_CP017146.1; note = Marisediminicola antarctica
MKETTVSAAALVLARHPHPSVPALATALGHAFLAADQWTARELIASAARTLGARHRWVGPLVAEVLAAYHRPPIDAPRELASMIEAAEAFRAAVARAEQRRAPIRIAHYAVEPGTARPMPAGVPRINGHGALAELLGLSPGELDWFADTALWNRRGTSERLQHYRYEWRQREGRVPRLLEVPQRRLKGVQRSVLASILGPIPAHDAAHGFVPGRSAVSGAALHTGNDVLIALDLSTFFARVPARRIFGTLRQAGLPEAVAHTVSGLCTHAVPPRVIAAMPRGGTAEDRFALRRALATPHLPQGAPTSPALANLAIHRLDARLSGWADAAGATYTRYADDLAFSGGPPLARRADAFVRGVTRIVEAEGHSLNRLKTRVRASSVRQVVTGIVVNDRTNLPRAEFDRLKAVLHNCVMHGPHSQNRAGHSDFRAHLLGRISWVEALNPGRGPRLREELERIRW

SEQ ID NO: 5622 - protein, 491 aa, unidentified
  source 1..491: note = Related to nan
MNETGPIPGDDDPTGPATARRRGGRHVPSPRSTRGSATLGREPAPGAPGLSLLLAYAFLAAPDWRQEELIAVGAVLLGARRRWLGPLARGVLTGYPRRPVGAPRELARWIAAQPAFTDAIARASARGMPISPARYLTAVTEGPAPAGSAPGSAVATPGTRDLAWLARELRLTPGELDWFADTRHWNRRAASRALHHYRYEWRVRPGRVPRLLEVPGIRLRTVQRHVLDHILAPIPLHDAAHGFAPGRSARTGAAVHTGADVVVALDLVSFFAHITPGRVFGVFRQAGFPEATAHALTGLCTHEVPDAVLQSMPDGGGSGERFALRQALRAAHLPQGAPSSPALANLAVRRLDARLAGWAAAAGGSYTRYADDLAFSSPAPLARRADAFIRGVERIVVAEGHAVNRPKTRVSGASVRQTVTGVVVNARTNVARTDYDALKAILHNCRVHGPESQRRGQADFRAHLAGRIARVESLNPQRGRRLRDAFERIRW

SEQ ID NO: 5623 - protein, 492 aa, unidentified
  source 1..492: note = Related to NZ_CP095501.1; note = Arthrobacter sp.
MDRTGPTTGDDDRMRPATARDGGGRGRPSPRPTPASATLAREPAPGVPGLSLLLAHAFLAAPQWRREELIVAGAALLGARRRWLGPLVRGVLSGHPRPPDGAPRELARWIAAQPAFTEAVARASARGTPIGPAHHLPAVPEERTPLRTTASADAVRTPGTRDLAWLARELRLTPGELDWFADTRHWNRRAAHRALHHYRYEWRVRPGRVPRLLEIPGIRLRTLQRRVLDHILAPLPLHDAAHGFVPGRSARTGAAVHTGADVVIALDLVAFFARVPPGRVFGVFRQAGFPEATAHALTGLCTHAVPDAVLRSMPDGGSAGERFALGRALRTAHLPQGAPSSPALANLAVRRLDSRLAGWAAAAGGTYTRYADDLSFSGPASLARRADAFVRGVERIVVAEGHTVNRLKTRVGGAPVRQTVTGIVVNVRTNVARTDYDALRAILHNCRVHGPESQRRGQADLRAHLAGRISWVESLNPQRGRRLRDAFERISW

SEQ ID NO: 5624 - protein, 484 aa, unidentified
  source 1..484: note = Related to NZ_PRKW01000004.1; note = Arthrobacter pityocampae
MDGAGPRAVRGPARPRRGRGAPEGPTSASATLAREPAPGVPGLAFLLAHAFLAAPDWRREDLVAAGAALLGARRRWLGPLVRGVLAGYPRRPEGAPRELARWIAAQPALTDAVARAAARGEPVRPARYLPPAPEEQAFGDRSAPGGVEASGARDLAWLAREVRLTPGELDWFADTRHWNRRAGAPALHHYRYVWRARPGRAPRLLEIPGIRLRTVQRRVLDHLLAPIPLHEAAHGFVPGRSARTGAALHTGADVVIALDLVSFFARVPPGRVFGVFRQAGFPEATAHALTGLCTHEVPDAVLRAMPDGGSAEDRFALARALRTAHLPQGAPSSPALANLAVRRLDARLSGWAAAAGGSYTRYADDLAFSGPADLARRADAFVRGVERIVVAEGHTVNRRKTRVRGAAVRQTVTGVVVNARTNVARTDYDALKAILHNCRVHGPESQRRGQADFRAHLAGRISWVESLNPQRGRRLRDAFERISW

SEQ ID NO: 5625 - protein, 488 aa, unidentified
  source 1..488: note = Related to NZ_CP024915.1; note = Arthrobacter agilis
MDDTESLPDDGGSFPARGGPVRASRGTAAARTLARTPAPGGPGLAFLLAGAFLTAPAWQREDLLDAGAAVLGGRRRWLGPLVRAVLAGYPRRPDGAPRELARWIRAQPVFTDAIGRAAARGVPITPARYLTAGAPEEGHRPSRVDLGTGAPAAPGAGDLGRLARELRLTPGELDWFADTRSWNRRAPSQALRHYRYEWRSRPGRVPRLLEVPGIRLRTVQRRVLDLVLAPIPLHPAAHGFVPGRSARTGAALHAGTDVVISLDLVSFFAHVSPGRIFGVLRQAGCPEATAHVLTGLCTHSVPEAVLRAMPGGGTPEERFALARALRAAHLPQGAPSSPALANLAVRRLDSRLAGWAEAAGGTYTRYADDLAFSGPAGLARRADAFLRGAERIVAAEGHEVNRHKTRVRSAATRQTVTGVVVNAHPNVARADYDALKATLYNCLVHGPESQRRGQADFRAHLGGRISWVESLNPLRGRKLREAFDRIGW

SEQ ID NO: 5626 - protein, 559 aa, Vibrio sp.
  source 1..559: note = Related to WNZI01000030.1; note = Vibrio cholerae
MLGWQRRIPAEAEHVHRARSSPGLPRGTQTDQHRAPQAPDCASRSSAPEQREQVGRDPSPADRQGGTGEGGHGGRRSNDGRQPDVSSRTRRAGPPPTTAGAALARLPTPGGPGLAFLLASAFLDSPSWQREHLVEAGAAVLGARRRWLGPLVRSVLSGYPRRPDGAPRELARWIAAEPVFSDAVGRARARRSPIRPARFLVQEDSERADPPEPVPPDAAVESGRTSGIKDLAWLARELRLTPGELDWFADTRHWNRRAGSALQHYRYVWRVRPGRVPRLLEVPGIRLRTVQRRVLDLLLAPMPLHGAAHGFVPGRSARTGARVHSGSDVVISLDLVSFFARVPPGRVFGVFRQEGFPEATAHVLTGLCTHAVPERVLRDMPDGGSGQERFDLAQALRAPHLPQGAPSSPALANLAVRRLDSRLAGLADAAGGRYTRYADDLAFSGPGALTRRADAFIRGVERIVEAEGHSVNRRKTRVRGASTRQTVTGVVVNVRPGVARPDYDALKATLHNCVVRGPESQRRGRADFRAHLAGRVSWVESLDPPRGRKLREAFDQIVW

SEQ ID NO: 5627 - protein, 487 aa, unidentified
  source 1..487: note = Related to LR131272.1; note = Arthrobacter agilis
MVSDERGHHRGSDGAPGAPGRPALISRATAPTSAASRALARTPDPGTAGLALLLAEAFLEASAWQREELVRVGAELLGARRRWLGPLLRGVLGGYPRRPGGAPRELARWIEAQPVFVEAVSTARAAGRPIVPVRYLVGERDGPRTPEDPEASEAECRDLAWLARELGLPPGELEWFADTRHWNRRAGLLLQHYRYVWRSRPGRVPRLLEVPGIRLRTVQRRVLDRHLLPIPLHPAAHGFVPGRSARSGATLHTGSAVVITLDLVSFFARVTPGRVFGVFRQAGYPEATAHVLTGLCTHSVPEAVLRAMPDGGTAEERFGLTQALRAPHLPQGAPSSPALANLAVRRLDARLTGWAEAAGGVYTRYADDLAFSGPAELARRADAFVRGADRIVTAEGHAVNPRKTRVRGSSVRQSVTGIVVNARPNVARTEYEVLKAILHNCTLHGPESQSRGQGDFRSHLAGRIAWVSSLNALRGKKLRDAFERISW

SEQ ID NO: 5628 - protein, 326 aa, unidentified
  source 1..326: note = Related to LMLU01000001.1; note = Arthrobacter sp.
MARELRLTPGDLDWFADTRQWNRRAVPVLQHYRYSWRQRPGRVPRLLEVPGPRLRVVQRRLLDRILAPLPLHPAAHGFVRGRSALTGAALHTGADVVISLDLTAFFAHVVPGRIFGALRQAGYPEATAHVLTGLTTHSVPDAVLRSMPDGGGPDERFALRRALRTAHLPQGAPSSPALANLAVRRLDARLTGYAEAAGGVYTRYADDLAFSGSADLARRADAFVRGVGRIVTAEGLAVNARKTRVRGSSVRQSVTGIVVNAHPNVARTEYDTLKAILHNCALHGPESQRRGRAEFSDHLAGRIAWVSALNASRGEKLRDAFERISW

SEQ ID NO: 5629 - protein, 427 aa, unidentified
  source 1..427: note = Related to LGIU01000097.1; note = Arthrobacter sp.
MARLLARAFLDAPTWQREDLLAAGADLLGARRRWLGPLVRTVLSGHPRRPAGAPRELAAWIERAPAFEEAVARAAAAGTPLAPSHFLLEDAPADTHDLGELARELRLTPGELDWFADTRSWNQRTPQPALRHYRHAWQVRPGRTPRLLEIPGIRLRTVQRRVLDRILTPLPLHGAAHGFVPGRSARTHAAAHTGSDVVIALDLVSFFASVPPGRIFGVLRRAGYPEAVAHTLTGLCTHAVPERVLRAMPDGGTPEERSRLTQALRAPHLPQGAPSSPALANLSLRRLDARLEGWAEAAGATYTRYADDLAFSGPASLARRAHAFVRGVERIVTAEGHRVNPPKTRIRGASVRQQVTGVVVNRHPNVPRKEYDALKAILHNCRVHGPESQRRGRVRFLEHLAGRIAWVASLDPQRGRKLQDAFDAIGW

SEQ ID NO: 5630 - protein, 457 aa, unidentified
  source 1..457: note = Related to NZ_JAFMPX010000005.1; note = Arthrobacter sp.
MTNDYKAAQVLAHTPHPTPAIVATALSHAFLAAPDWTVEALVSAGAEVLGARRRWLGPLVRAVVCAYHRKPADALRELAAHIGASEPFAAAVDKAHDQRKPLRLAAYAVAEPELREGTHPVPEVAGLEQLAAVLGVKLGELEWFADTRHLNRLASRSCLQHYRYMWRERPGRTPRLLEIPGLRLRSIQRKVLHGLLAPIPLHNAAHGFVPGRSASSGAALHTGADVLISMDLLSFFANVTAGKVFGALRQSGYPEAVAHRLTGLCTHIVPPRVISSMPPGGSAAERFALTQALRLPHLPQGAPTSPALANLALRRLDSRLQGWAEAAGAKYTRYADDLGFSGGPALARRTERFLRGAKHIAADEGHKLNERKTRVRPRSTRQQVTGIVVNQHLNAPRREFDALKAILHNCMLFGPESQNRADHTDFRAHLLGRITWMESLNSARSVRLRRDFDRISW

SEQ ID NO: 5631 - protein, 488 aa, unidentified
  source 1..488: note = Related to VFOO01000001.1; note = Subtercola boreus
MLGATQSVFGVRHRWLPALVREVLVVFRTAPVDAPRELAAVIRRSAALTGALSRAGERGRPLAIAHYPVGEAEHPEPAPAAEPARASASASASAPEPARASASAAEPPPAPSAAEPAPALSGAEPAPAASALVPVPPPALALPLEPPLPPPMPLPRTLPALAALLDVTAGELDWLADTGGWNRRAREGPLHHYRYEWRTRPGRVPRLLEVPNERMRTAQRTLLAEVLGGLPLHDAAHGFVLGRSALTAAGLHTGTDVVITLDLVTFFTRVTAGRVYGTLRQEGVPERVALALTGIATNRVPPRVIGAMPPGGDPGERFALRQALATAHLPQGAPTSPMLANLAIRRLDSRLAGFALAADARYTRYADDLTFSGPLPLRRRADAFLRGVTRIVVDEGHTVNRRKTRVRPAATSQRVTGIVVNERTALPRAEFDRLKAILHNCAEHGAASQNRAGLEDFRAHLLGRISWARALNPVKAERLQREFDRIVW

SEQ ID NO: 5632 - protein, 532 aa, unidentified
  source 1..532: note = Related to NBXA01000026.1; note = Subtercola boreus
MRWSADEVDGSRRDPPSPGPPRGTQTDSGTSPQASHRTSSGRTPAQTHRSSAGHRSTIRAPRPTAAAAVLARRPTASAGQVATALALALLAAADWTPEGMLAVLQSVFGRRHRFLPVLVREVRAVYRTAPQDAPRELAAVIRQSAALTDALDRARAAGRPLAIVHHPVSPGSEDHRESALPHAPAALSAPAPSTAAPPPRTLTELAALLDVTPGELDWLADTGGWNRRAPAGPLHHYRYEWRSRPGRVPRLLEVPTERMRAAQRILLHEVFALLPLHGAAHGFVPGRSALTAARLHTGRDVVIALDLVTFFTRVTAGRVYGALRQEGTPERIALALTGLATNRVPARVIGAMPPGGDPDERFALRQALAAAHLPQGAPTSPALANLAIRRVDSRLAGYAEAADAVYTRYADDLTFSGPVALGRRADAFIRGVTRIVEDEGHLVNRQKTRVRPAATSQRVTGIVVNEHTALPRVEFDRLKAILHNCAERGPESQNHDGHSDFRAHLLGRLSWARDLNPSKTERLEREFARIRW

SEQ ID NO: 5633 - protein, 532 aa, unidentified
  source 1..532: note = Related to PSTT01000018.1; note = Subtercola sp.
PTPASLAAAGVPSPSSARAAPVSPGSGVLARRPVSTPDTVATALALALLAEGEWAGERMIARAATVFGVRHRWLPRLVRELLAVYRQAPEGSPRELAAVIRRTASFTAALEHATEVGRPLTIVSYPVAADGPPRLSPALSPPSAAVDGIPLVAASNPRDPRHGTAPAALATAAGPAALATATGPAALTPAAPPRGLAGLRTLADLAELLGVTPGELDWLADVGAWNRRASPGPLHHYRYEWRARPGRVPRLLEVPSARMRSAQRTLLHDVFALLPLNDAAHGFVPGRSAVTAARLHTGAAVVVTLDLTTFFATVTAGRIFGALRQAGAGERVALALTGIATNRVPPRVITAMPPGGDPDERAALRRALAAAHLPQGGPSSPALANLALRRLDSRLAGYAGAAGARYTRYADDLTFSGGTDLRRRADAFVVAVRRIVEEENHTVNLRKTRVRPAATSQRVTGIVVNEHTALPRAEFDRLKAILHNCAERGPASENRAGHDDFRAHLLGRLTWARSLNPAKAERLQREFDRIAW

SEQ ID NO: 5634 - protein, 532 aa, unidentified
  source 1..532: note = Related to NZ_NBXE01000029.1; note = Subtercola boreus
MRWSADEVDGSDADPSSPGLPRGTQIDSGTTSQAPLRTPSGRAPALQHRSSAGHRTPPPPTPATPASAVLARRPQPSAEAVASALALVLLAPPAAPDWTPTGMLSALQGVFGARHRWLPALVREVRSVYRTPPQDAPRELAAIIRHSQPFLDAVGRAEARGRPLAVLRYPITAEAPAQPPVAPGPTPATPGPIPATPAALAALLGVTPGELDWLADVRAYNRRARPGALHLYRYEWRLRPGRCPRLLEVPTERMRRVQRTLLHEVLALLPVHHAAHGFVTGRSALTGARVHSGSAVVISLDLTTFFARVTAAGVYGSLRRAGFSEAVATTITGLTTNRVPPRVISAMPPGGGPDERFALRQALATAHLPQGAPTSPALANGAIRRLDARLEGYAAAVGARYTRYADDLVFSGPVALQRRAEAFVRGVTRLVDDEGHEVNPRKSRVSPASTSQRVTGIVVNTGSSLPREEFDRLKALLHNCATLGPASQNRAGVPDFRAHLLGRISYSSSVNPLKTRRLIREFNSIDWGVPRE

SEQ ID NO: 5635 - protein, 561 aa, unidentified
  source 1..561: note = Related to RCUY01000005.1; note = Mycetocola lacteus
MPADASRRTAHGRLNRSIAPPRCRRSGSFSRRIVMGRPAGHTPAPSLAAVADSLAAAFLAAAHPKPARDRDPAQGSDPTGDREAASGPAPTQNQDAPQGQDSTQGTDLTGDRDPAFTIAWTRSVLIAAGADVLGARRRWLPGLVSAVLAAYPRAPFDRPRELGRWIAQSAELTAAAEQAAAAGRHLVLVRHALYEIPAAHGAGAAGERPASSGAEVLAREPASRRPRTPADLARLLGLDAGELDWFADLRGWNRLAPGTKLHHYRYEWRSRPGRVPRLLEVPGQRLMYLQRQLIAEVYTDLPVHPAAHGFVSGRSAITGAAVHAGSHVVIGMDLTTFFARVTRGQIHAGLCRQGWGEALVPILAGLGTHAVPPAVIRAMPPGGDPGERQALAAALRIPHLPQGAPTSPLLANLAMHRLDERLTGWANAVGARYTRYADDLTFSGDTRLAARSDAFIRGVEAIVTDSGQRINPRKTRVRPRGTSQRVTGIVVNEHPAMDRHAYDRLRAILHNCARTGPEAQNRDRHPHFRLHLLGRINWAIALTPERAPGLWRLWDAIEWTD

SEQ ID NO: 5636 - protein, 478 aa, unidentified
  source 1..478: note = Related to NZ_RCUX01000009.1; note = Mycetocola tolaasinivorans
MTPNPGHTPAPSIRAVADSLASAFLDAARVPLDPGSGGEVLGHGAAAREHGWNRPVLIAAGASVLGARRRWLSPLVRAVLDAYPRAPFDRPRELAAWIEASAVLGDACAAATARGQHLVLVRHAVYEPVGAASPLPATPAELAGLLGLDIGELAWFADQRGWNRRAGSARLQHYRYEWRARPGRVPRLLEVPGQRLMRLQRQLVHEVLTALPIHPAAHGFVPGRSARTGAAVHAGSHVVIGMDLTTFFARVGRSEITAALRRAGWGEAVAPVLAALATHAVPEAVIRAMPPGGNPEERFALAQALRLPHLPQGAPTSPMLANLAMRRLDDRLLGWAAAVGARYTRYADDLTFSGDQRLAARSDAFIRGVSGIVADCGQRVNERKTRVRPRGTSQRVTGIVVNAHPAVDRRSYDALRAPLHNCARTGPAAQNRENLPYFREHLRGRIDWVVSLTPKREPALRRLWEAIEWEEPGSAPLR

SEQ ID NO: 5637 - protein, 441 aa, unidentified
  source 1..441: note = Related to NZ_CP080203.1; note = Mycetocola spongiae
MISSALAHGFLAASTEADWARAPLIAAGSAVLGARRRWLPALVDDVLRAFPRPPLRGLRELREWIASAPGPIAAVEAAAERGRPLRLARHPVYHEPGAAPGGMPANPAELAALCSIAPGQLEWFADTRLWNRRLSGDQHRLEHYRYRWLERPGRVPRLLEIPGERLRAVQRSVLDCVLAELPVHPAAHGFVPGRDARSGAAAHTGRDVVIGLDLRTFFARVGYPQILRVLRAAGHTEAVATLIAGLSTHAVPPRILREMPPGGSPEERFALRRALAARHLPQGAPTSPALANLVSAGLDRRLAGWAQKFGATYTRYADDLTFSGDRALRSRATRFIRGVDLIIAEEGHALNPRKTRVQPAAISQRVTGIVVNRHPNLPRREYDLLRAILHNCALHGPASQNRAGHPDFRAHLRGRIGWAAALNPDREAALTAAFNRIDWDR

SEQ ID NO: 5638 - protein, 501 aa, unidentified
  source 1..501: note = Related to CP007595.1; note = Arthrobacter sp.
MPDSCTAGASLRSAQQRTRTDSQVIGETIAALTTQHGPEHAEPTTASVTAASATLKRTPRPSSSTIASTLAQAFLGSPDWSKPGLVDAGAHVLGARRRWLGPLAAHVLRGYPRPPVDAPRELAAVVLQCEPFLDALAKAAQQRKPIRLANYVLASAVARENLVQGAPRIDTLADLAALLHVNCGELEWFADTKHWNRRAGGTLAHYRYEWRTRPGRLPRLLEIPAPRLRSIQRTVLRELLYPLELHDAAHGFVPGRSAVTGAAQHTGRDVVVNLDLVSFFAKVTAGRVFGTLRQSGFTEAVAHRLTGIATHVVPPRVLSLMPPGGDPAERFALRQALSLPHLPQGAPTSPMLANLSLRRLDARLAGLVEKFDGGYTRYADDLAFSGGRDMARRADAFVRAATVIVKDEGHSVNRLKTRVRPAGVRQSVTNVVVNERTNVPRVDFDRLKATLHNCRVHGPESQNWNGHPDFRGHLLGRISWVAALNPARGARLRQDFDRIQW

SEQ ID NO: 5639 - protein, 454 aa, unidentified
  source 1..454: note = Related to CP013200.1; note = Arthrobacter alpinus
MTRAAATLKRTPRPSSSAIAQTLAQAFLASPQWTKAELVAAGAHALGARRRWLGPLAAQVVRGYPRPPLDAPRELGAMIGSCDPFIEATAKALQQRKPILIANYVLAPSVARENRHAGVPQIGTLGELAERLKLSGGELEWFADPKHWNRTAARKLQHYRYEWRTRPGRLPRLLEIPAPRLRALQRTVLRELLYPLELHDAAHGFVPGRSAVTGAAHHMGRDVVLNLDLVTFFAKVTAGRVYGTLRQAGYTEAVSHRLVGIATHVVPPRVLAQMPSGGDATQRFALRQSLSVPHLPQGAPTSPTLANLSLRRLDSRLAGLAEKFDGGYTRYADDLAFSGGQDLAQHADAFLRAATLIIEDQEHSVNQQKTRVRRSGVRQMVTSVVVNERTNVPRPDFDRLKAIIHNCRMHGPQSQNREARSDFRAHLLGRISWVAVLNPARGAKLLQDFHRIQW

SEQ ID NO: 5640 - protein, 504 aa, unidentified
  source 1..504: note = Related to NZ_JAGIOI010000001.1; note = Arthrobacter stackebrandtii
MPDPCTAGAALRSAQLRTRTDSRVIGEAIAAMTAQPRARAAGRADPAVAPVTAASATLKRTPRPSPTAIAATLAQAFLSSPDWSKPALMESGAQVLGARRRWLGPLAAQVLRSHPRPPVDAPRELAALVLVSEPFVEALAKSVQQRKPIHLARYVLAAGAARDSQVRGAPRIDTVGALAARLGLGVGELDWFADPRHWNRRADARLQHYRYRWLVRPGRVPRLLEIPRPRLRFLQRAVLRELLHPLPLHDAAHGFVPGRSAVTGAAQHTGRAVVVNLDLASFFAHVTAGRVFGVLRQAGFTEAVAHQLTGLCTHVVPPRILVQMPPGGDPADRLALRQALSLPHLPQGAPTSPTLANLSLRRLDSRLAGLAEKFDGGYTRYADDLAFSGGRDMLRRADALVRAAGTIVEDEGHRLNRLKSRVRPAGTRQAVTSVVVNERTNLARDDFDRLKAIIHNCRVHGPESQNRDSVPEFRSHLLGRISWLSSLNPARGARLRQAFDLITW

SEQ ID NO: 5641 - protein, 533 aa, unidentified
  source 1..533: note = Related to NZ_QJVC01000003.1; note = Arthrobacter psychrolactophilus
MVVSGDTVVSVSMGACDGFSDEAGSVFRRPSLPGVTPGHAVLPDPCTSDASLRSAQLGNRTDSQVIGETIAVLNPNIAHITPASATLKRTPRPSTLAVTETLAQAFLAAPQWNKAALMAAGAHVLGARRRWLGPLVSDVLRGYLRAPVDAPRELAARIHHAEPFVEALAKAAQQRKPIRLAHYVLAPAVARENAPRQTPRINNLGDLAHLLELTPGELEWFADTRHWNRMATRKLQHYRYEWRVRPGRLPRLLEVPAPRLRAIQRIILHKLLYLIELHDAAHGFVPGRSAVTGAAQHTGQEVVMNLDLVSFFAKVTAGKVFGALRKAGFPEAVAHRLAGICTHRVPPRILALMPPGGDPAERFALRQALSLPHLPQGSPTSPMLANLSVRRLDSRLAGLSEKFDGVYTRYADDLAFSGGKDLARRADAFVAAVTAIVRDDGHRINRLKTRVRPASVRQSVTSVVVNQRTNPARSDVDRLKAILHNCRTRGPESQNWDGHPDFRGHLLGRISWVATLNPERGAKLLREFHRIQW

SEQ ID NO: 5642 - protein, 461 aa, unidentified
  source 1..461: note = Related to NZ_CZJT01000056.1; note = Paeniglutamicibacter antarcticus
MTGSQKPVTPASSVLSRTPRPTDSAVAATLAQAFLNSSRWTSAGLIEAGAQVLGARRRWLGPVVTLVLRSYPRPPVDAPRELGAMILGCEPFAQARAKAAVQRKPLRLAHYVLEPMVARENGQPRVPRLDTLADLAAMLELTGGELEWFADPQQWNRLAVPALQHYRYVWRRRPGRLPRLLEIPAPRLRGIQRTVLRDLLYPLEIHDAAHGFVPGRSAVTGATRHTGQDLVLTLDLVTFFARVTAGKVFGVLRRAGYTEAVAHRLVGLCTHVVPPRVLSAMPPGGSPTERFALRQALSQPHLPQGAPSSPVLANLSLRRLDARLTGLADSFEAVYTRYADDLAFSGGKKLARRSAAFIRFATVTIGEEGHGVNQPKSRLRTAGERQQVTSVVVNERTNAVRSEFDRLKATLHNCWTHGPDSQNRDRHADFRAHLLGRISWMASLNSDRGARLLRDFQRIQW

SEQ ID NO: 5643 - protein, 522 aa, unidentified
  source 1..522: note = Related to NZ_CP013745.1; note = Arthrobacter alpinus
MAPCDGFFDEAGSGFWRASLPGATPGYAVLPDRSTSGAALRSAQLGTRTERQVIEETIAAMTTSSIPVTPASATLKRKPRPSTSAIAATLAQAFLNSPQWSKPEITVAGAQVLGARRRWLGPLAAHVLLSYPRPPVDAPRELTATILASEPFIEAVAKAASQYKPILLASYALAPTTARENRQARVPRIDTLAALAEKLHLTLGELEWFSDPQHWNRTAARKLQHYRYVWRSRPGRLPRLLEIPGLRLRNIQRTVLTELLYPLELHDAAHGFVPGRSVVTGAARHTGKEVVVNLDLTTFFAKVTAGRVFGTLRQAGFTESVAHRLTGICTHVVPPRILAQMPPGGDADQRFALRRALSQPHLPQGAPSSPVLANLALRKLDSRLAGLADTFDAGYTRYADDLTFSGGRELARRVNAFIRTATGIIENEGHGVNKLKSRVRPAAVRQVVTSVVVNQRTNINRLDFDRLKATLHNCRRHGPESQNREAHADFRAQLLGRISWVTALNPDRGAKLLRDFHLIAWE

SEQ ID NO: 5644 - protein, 392 aa, unidentified
  source 1..392: note = Related to NZ_JAAWVT010000016.1; note = Paeniglutamicibacter terrestris
MYPRPPIDAPRELAATIFLSDPFTEAVAKAAHQRKPLRVANYALLPATARENRQPKIPRLDTLASLAGLLELSYGELEWFSDPQHWNRKAERKLQHYRYEWRQRPGRLPRLLEIPAPRLRNIQRTVLRELLYPIELHDAAHGFVPGRSAGTGAAQHTGQEVVINLDLVTFFAKVPAGRVFGTLRQAGFTESVAHRLTGICTHSVPPRVLSLMPPGGNLTERFALRQALARPHLPQGAPTSPMVANLSLRRLDSRLSGLAEKFDARYTRYADDLAFSGGNELARRTSAFIRTAISIIEAEGHEANRLKTRVRPASVRQLVTSVVVNKHTNVTRSDFDRLKAILHNCLSFGPESQNREAHADFRGYLLGHVSWVAALNPDRGAKLLHDFHRIQW

SEQ ID NO: 5645 - protein, 471 aa, unidentified
  source 1..471: note = Related to NZ_JAJJBU010000018.1; note = Arthrobacter cryoconiti
MTTPTPGAAVLARTPNPSPRNVSTALAYAFLAAPTWSEAELAAATTYVVGKRGGTRSAKWHTQLASSVLRAYPRPPLREPRQLAVFIAGAKPFYLAVDRATRLHATLTIAHYVLPPTNVAELKSPLEERSLIPQTLAELAGVLDLTVGELDWFADPLQWNRTARNKRLVHYRHQWRLRPGRTPRLLEIPAPRLREIQRSVLRELLSPLPLHDAAHGFTPGRSPATNAAHHTGRNVVVNVDLTTFFARVTAGKVFGILRQAGFPETVAHRLAGLCTHTVPLGVIAEMPQGGGASGRFAFRQALATPHLPQGAPTSPALANLSLRRLDSRLAGLAASFDADYTRYADDLAFSGGPGFSHRSLAFVSLVHKIVEQEGHTVNDAKTRVRGSGVQQRVTGVVVNAHTNVSRAEFDRLKAILHNCAVHGPAGQNRCGPQGSEHSDFRGHLQGRIAWVRHLNPARAAKLERIFAAIIW

SEQ ID NO: 5646 - protein, 456 aa, unidentified
  source 1..456: note = Related to NZ_JAAKZI010000011.1; note = Arthrobacter silviterrae
MKPSQPTAAASVLVRIPHPSANTVATALAHAFLAAGDWSKPALTAAGADILGARRRWLGPLASHVLRNYHRPPADAPRELAAVVLGCPAFGEALAKAATQRRPIKLAHLAVAPAVAQAARVPRLDTVADLAGMLALTPGELEWFADPRHWNRTAGPRLQHYCYQWRSRPGRVPRLLEIPQPRLRTLQRTILRELLAPIPLHDAAHGFVPGRSAVSGAAMHTGADVVVSLDLAAFFAHVSPGKVFGVLRQAGFTEAVAHRLTGLCTHAVPVGVLAEMPPGGDPASRFALRQALAVAHLPQGAPTSPMLANLALRRLDSRLSGWAGAFDAVYSRYADDLAFSGGAELARRADAFIRGAGRIVADEGHSLNGLKTRVHKAGVRQTVTGVVVNERTNIARAEFDQLKAVVHNCAAHGPEGQNRGGHPDFRAHLLGRIAWVSSVHPARGARLRAAFDEISW

SEQ ID NO: 5647 - protein, 459 aa, unidentified
  source 1..459: note = Related to NZ_CP029642.1; note = Arthrobacter sp.
MIPAGQAVAPAAAVLARSSRPTPDALASALSHAFLAADDWSKPALMTAGTGILGARRRWLGPLATHVLRSYHRPPTDAPRELAAVVLGSEAFGEALEKAARQRRPITLVRYAAEPAVARAARVPRLDTLAELAEVLDLSVGELEWFSDPGQWNRTASSRRLQHYRYQWRSRPGRVPRLLEIPLPRLRGLQRTVLRELLSPIPLHDAAHGFVSGRSAVSGAALHAGTEVVVNLDLAAFFAHVSPGRVYGVLRQAGFTEAVAHRLTGLCTHAVPVGVIAEMPPGGEPGDRFALRKALATAHLPQGAPTAPMLANLALRRLDSRLSGWAGAFDAVYTRYADDLAFSGGTELSRRADAFVRGAARIVADEGHSLNRLKTRVHRAGVRQSVTGVVVNTRTNVARPEFDRLKAVLHNCLLLGPEGQNRDGHDDFRAHLLGRIAWVTSVNPDRGAKLRAVFDAISW

SEQ ID NO: 5648 - protein, 476 aa, unidentified
  source 1..476: note = Related to NZ_CP012479.1; note = Arthrobacter sp.
MKHTPDSTRPGPLADSTPGPTPASAVLGRTPRPSPKTVATALAHAFLAAESWSKPDLVEAGATVLGARRRWLGPLAGHVLASYRRPPADAPRELTAVVLGSAPFAEAVAKADLQCKPIRIARYAVPPAGMGEAAGVPAGVPRLDTLAELAAILGVDAGRLEWFADPKHWNRTTGNPRLQHYRYQWRTRQGRVPRLLEIPHPRLRAVQRTVLRELLAGIPLHASAHGFVPGRSAVSGAARHTGRDVVINLDLAAFFAHVTPGKVYGVLRAAGYPESVAHRLTGLCTHAVPVGVIAEMPPGGSAEDRFALRQALRKAHLPQGAPTSPALANLTLRRLDSRLQGWAGGFDAVYTRYADDLAFSGGPVLARRADAFLKGAARIVADEGHTLNATKTRVHKAGVRQSVTGVVVNRHTNVSRRDFDRLKAVLHNCVVHGPDGQNRDGHPDFRAQLRGRIAWVASVNPGRGARLLADFTLIDW

SEQ ID NO: 5649 - protein, 479 aa, unidentified
  source 1..479: note = Related to NZ_PPXB01000002.1; note = Arthrobacter glacialis
MGAPLRSAKRGAQTDRLVIIEAVAAMIPTLSAAVLARNPRPTPQAIATALAHAFLAAEDWSKPSLISAAASVLGARRRWLGPLAEHILGLYHRRPADAPREVVAVVLHSEAFETAVEKAAKARKPIIVAHYVVQPAVAREARVPHLDTLAGLAGLLGLSIGELEWFADPRQWNRTATSKRLQHYRYQWRSRPGKVPRLLEIPQPRLRALQRTVLHELLAPIPLHNAAHGFVPGRSAVSGARAHTGAEVVVNLDLAAFFTHVTPGKVFGVLRQAGFTEAVAHRLTGLCTHAVPVGVLAEMPPGGDPTDRFALRKALALPHLPQGAPTSPMLANLALRRLDSRLSGWAGAFDACYTRYADDLAFSGGSELARRADAFVRGAARIVADEGHSLNRLKTRVHRAGVRQSVTGVVVNQHTNVTRGDYDALKAVLHNCVSLGPEGQNRDGQANFRAHLMGRVAWVSSVNPGRGATLRALFERIVW

SEQ ID NO: 5650 - protein, 460 aa, unidentified
  source 1..460: note = Related to NZ_KI519454.1; note = Arthrobacter sp.
MAVATTGAATLARTPRTSPADLATALAHAFLGAESWSKAALVASAAGSLGARRRWLPPLAGHVLAAYHRPPADAPRELAAVVGQCDAFREALAKSARQRKPIRLAHLVPVAGKARDSATDIPRIDTLAELAGRLELSTGELEWFADPGQWNRSARTPRLQHYRYEWRSRPGRVPRLLEIPGTRLRAIQRRILRDLLQPIPLHDAAHGFVPGRSAITGAARHTGNEVVINLDLSTFFARVTPGKIFGVLRQAGYAEAVAHRLTGLCTHAVPARVLAAMPAGGDPGERFAVRQALARAHLPQGAPTSPLLANLALRRLDSRLAGWAAAVGASYTRYADDLAFSGGPDLARGADAFIRGAARIVADEGHDLNRRKTRVRGAATRQSVTGVVVNAHTNISRGDYDRIKAILHHCVLDGPGEQNRSGHPDFQAYLRGRIAWIESLNAARGAQLRAEFDRIQWQTA

SEQ ID NO: 5651 - protein, 454 aa, unidentified
  source 1..454: note = Related to NZ_PJIO01000003.1; note = Arthrobacter sp.
MSNNGSAVLARTPHALPMALSTALADAFLAADQWTAPALVQAGNHTIGSQRRWIPTLAAHIIATYPRRPLDAPRELAAVVRRSKPFARALARASRTGKPLPLANYCLDPASARESPLGIPVVDNLGVLSQHLGITPGELEWFADPKHFNRSAAPILQHYRYEWHTRPGRVPRLLEVPAPRLRTLQRTILANLLSPIPLHSAAHGFVPGRSAVSGAAAHAGNLVVINLDLATFFAKVSAGRVFGVLRQAGYAEAVAHRITGLCTHRVPARILSRMPAGGEPTDRFALRQALALPHLPQGAPTSPMLANLAVRRMDSRLSGWAGKFDAGYTRYADDLAFSAGTTLARGSDDFIAGVSRIVTDEGHSLNPRKTRVRGASLRQTVTGVVVNEHPNVTRADFDRLKAILHNCAVLGPELANRQAHADFRSHLLGRIAWVASVNPRRGAQLRADFARIVW

SEQ ID NO: 5652 - protein, 447 aa, unidentified
  source 1..447: note = Related to CP012677.1; note = Arthrobacter alpinus
MLARTPHPSPEAVSTALADAFLAAEQWNAEALARAGNHTCGSPRRWITTLAAHIVASYPRPPVDAPRELAAVVRQSKPFTRALARASRTGKPLPLKHYTLDPAVARHSPLDVPDIGNLSELARLLGITPGELEWFADPKHLNRNAAPILAHYRYVWHTRPGRVPRLLEVPAPRLRALQRVVLSQLLCPIPPHPAAHGFVPGRSAVTGAGAHTGKLVVVNLDLATFFAKVTAGRVFGVMRQAGYAEAVAHRLTGLCTHRVPARVLSQMPPGGDPADRFALRQALALPHLPQGAPTSPMLANLAVRRMDSRLAGWARRFDAGYTRYADDLAFSGGRDLARGADAFIAGVGRIVADEGHRLNHRKTRVRGASARQSVTGVVVNAHPNVRRTDIDRLKAILHNCATYGPSSQNLEGHAEFQAQLLGRIAWVAGVNPHRGAQLRAVYRRISW

SEQ ID NO: 5653 - protein, 489 aa, unidentified
  source 1..489: note = Acidobacteria bacterium; note = Related to JABBNV010000050.1
MSTNSTATRRATSSGLPTPSPEGLATALAHSFLAAKSWTAQDLKQSAADILGARRRWLGPLVRGTLAAYHRRPDGASRELASFIATSEPFFEAVSRARKQRKPIRLAHYAILGPLPPRHAIANQPQKTGKIPSVSGLEGLATMLGLEMGELEWFADIGGWNRRATAGSGTAGFTRETGRRYRHSKFQHYSYIWRSREGRAPRLLEAPLPRLKTIQRAVLDTFLAPIPLHPAAHGFVPGRSVVTGAAKHTGSAVIISADLSTFFARVTAGKIYDALRQSGYSEAVAHRLTGICTNAIPASVLNAVPPGGAPEERHALRQALATPHLPQGAPSSPALANIAIRRLDSRLAGWASKMNATYTRYADDLTFSGGPELARRADAFMAGVGRIVKDQGHTLNHRKTRVRRAGVRQTVTGVVVNQHVNTTRRSYDILKATLHNCVRYGPESQNPDSQTSADNAHFRERLAGQIAWVASVNPARGAKLRAKFQQISW

SEQ ID NO: 5654 - protein, 461 aa, unidentified
  source 1..461: note = Related to NZ_JADNYM010000009.1; note = Arthrobacter sp.
MMHAPRRIQSEGTRVLARTPHPTTSGVATAVAFAFLAAGEWTKAGLVQSGTELLGVRRRWLPSLAAQVLGWYPRPPVDAVRELAAVVEGCPAFINAVDRAARQRVPIRIARYVLAPGQARQTPFPIPRISSAGDLADLLELTSGELDWFADVKHWNGRAEPRLQHYRYVWRTRSGRTPRLLEIPAPRLRSLQRTVLRSILAPVPLHDAAHGFVSGRSAVTGARLHTGAQMVIALDLTAFFARVTAGKVFGILRQAGYSESVAHLLTGLCSHVVPPRVLSRMPPGGAVDERFALRQALSLPHLPQGAPTSPMLANLAVRRLDSRLSGWASVAGAVYTRYADDLTFSGGKELAGRADAFVRGAARIVGEEGHALNPRKSRVRAAGVRQVVTGIVVNERTNVARSEFDRLKAVLHNCVVHGPAGQNRDGHGDFRAHLLGRIAWLEALNPGRGARLRADFARIRW

SEQ ID NO: 5655 - protein, 451 aa, unidentified
  source 1..451: note = Related to NZ_JAATJL010000001.1; note = Arthrobacter pigmenti
MTTTTPGARVLARTPHPSPVAIATALAHAFLATDDWSKNGLLAAGAEVLGARRRWLGPVAAEVLRFYRQPPVDAPRELAAVVVLNDAFRAAVARAKKNGVPIRIAHFAPTPVRAPRGLNDLSDLARLLRLPAGELDWFADTRHWNRRAHSKRLQHYRYEWRSRPGRMPRLLEVPRPRLRELQRTVHREILAGLRVHSAAHGFVSGRSAATGARFHEGARVVINLDLATFFTRVRAGRVYGIFRRAGFAEPVAHALTGLCTHSVPSGIARNAPAGGTAGEWFELRRALVLPHLPQGAPSSPALANLAVRRLDFRLEGWATAAGAVYTRYADDLAFSGGDQLARRADAFVRGATRIIEAEGHLVNAHKTRVRGSSVRQTVTGIVVNERANASRPEYERLKAILHNCVRHGPESQNRSGHHDFRAHLLGRVAWMELLNPARGLKLRESFDRIEW

SEQ ID NO: 5656 - protein, 402 aa, unidentified
  source 1..402: note = Related to NZ_KI915009.1; note = Arthrobacter sp.
RWLPRVVAGVLGFYHRPPRDAHRELAAVIELSDTFRAAVERSVEQRRPIRIAHYVVGPGHGAKHAVLPLNDLADLTRLLGLTPDQLDWFSDTRHWNRRASSGSLQHYRYEWRARAGRVPRLLEVPRPRLREVQRKVLSLILSRLAVHDAAHGFVPGRSAATGARPHEGAKVLINLDLSTFFTRVTAGRVYGVLRQEGFPEAVAHTITGLCTHSVPPRLVTAAPSGGRLDERFVLRQALAVPHLPQGAPSSPMLANLAVRRLDRRLTGWAEAAGAVYTRYADDLAFSGGDDLTRRAGAFIRGVRRIVEDEGHFVNARKTRVSGWSVRQSVTGIVVNEHTNVTRSEFDRLKAVLHNCVLHGPGSQNRSGHHDFRSHLLGRIAWVAMLNPARGAKLRETFDRILW

SEQ ID NO: 5657 - protein, 462 aa, unidentified
  source 1..462: note = Related to NZ_JAAOYV010000002.1; note = Frigoribacterium endophyticum
MLAAPAWTEAALVAACAAALGPAAELSTTFHHDADPGDGGLRDDGSRDDGPHDDGPPHPWLPGLAHEALRAFPRAPHDEPRLLAEVLHTSGALGRGRARAAAQGASLRIVRVAVVTTPTRAADPRLRRLGSVADLAALLHLTVGELDWFADVRHWNRRHASGPLQHHRYEWRTRPGRTPRLLEVPGHRLRDLQRVALDEVLAAVPLHDAAHGFVPGRSAVTGAAVHTGAEVVVALDLRSFFARVGAGRVYGALRREGLPEAVAHVLTGLTTTSVPPAVLSAMPPGGDPSERAALRRALALPHLAQGAPTSPALANVASRRLDSRLAGWAAAAGARYTRYADDLTFSGGPGVAARSDAFVRGVGRVVADEGHELNPHKTRVRGAATRQTVTGIVVNEHVTVTRTSYDALRALLHNAERTGLEAQNRAGVPEFRAHLEGRIGWVEQLHPARGARLRELLARVPR

SEQ ID NO: 5658 - protein, 457 aa, unidentified
  source 1..457: note = Related to RKIE01000002.1; note = Frigoribacterium sp.
MTGAPDAVARGLALALLAVADADWTEPGLVTAASDALGLEPGDVDARWLPGLAHEVLRRFPRPPRDEARLLAVVVDRSGALGRGRERARTERRALRVVHPGVVAPGRTETDDAGAGAPDGRPELRGVGDLAALLGLTIGELEWFADTRLWNRRHPSGPLQHHRYEWRARPGRTPRLLEVPGFRLRDLQRVVLDRVLAGAPVHDAAHGFVPGRSAVTGAAVHQGSEVVVALDLRSFFARVTATQAYGALRREGLPEPVAHLLVGLCTNAVPAAVLSAMPPGGELDERVALRRALAVPHLAQGAPTSPALANLAMRRLDSRLAGWAAAAGARYTRYADDLSFSGGQEVAARADAFVRGVGRIVADEGHELNPHKTRVRGAATRQTVTGIVVNSGTNVTRASYDRLRAMLHNAASTGLEAQDRGGEPDFRAHVLGRIGWVEQLNPARGARLRELLARVPR

SEQ ID NO: 5659 - protein, 456 aa, unidentified
  source 1..456: note = Related to NZ_LMQR01000001.1; note = Frigoribacterium sp.
MSVRSPASAAGAHEPDPGPDAVATVLADAFLGAEWSVRGLAAAAGEAIDGSARFWRPLARDLVHALPRAPLDDPRTLAALIRRDPAFTEAVAEARRRGRPLRNVHHVPVTQEARSADPRLLRLGTVADVARLLHLTVGELDWFADPGRWHRRVDGGPLQHHRYEWRSRPGRTPRLLEVPGFRLRDLQRVVLDEVLAAVPLHDAAHGFVPGRSAVTGARRHVGREVVIALDLTSFFARVTAGQVFGSLRREGLPDAVAHVLTGLCTTSVPPGVLSRMPPGGSPEQRFALRHALAVAHLAQGAPTSPSLANVAVRRLDSRLDGYARAAGATYTRYADDLAFSGDGTLAARADAFVRGVGRIVGDEGHLLNQAKTRVRGAATRQVVTGVVVNQGTNTVRSEYDQLRAVLHNAATTGLEAQNRAGHPDFAAQLWGRIGWVEQLHPGRGARLRAAFARVPR

SEQ ID NO: 5660 - protein, 458 aa, unidentified
  source 1..458: note = Related to NZ_CP014619.1; note = Frondihabitans sp.
MDESSGSRRSHLVTRPGPPPAPDVATALAGAFLAAEEWSAPSLREAAAACLGSRRRFVGPVVTAVLTAHLRAPRDAPRELAALILRVDGFEDTVRRASRRRPVRIAQLSPTTTVSRVADERRPRVDTVADLARLLGTDVGHLDWFADTKLWNRRAPAGPLHHYRYEWRQRPGRVPRLLEVPGLRLREIQRTVLDELLAPLPLHDAAHGFVAGRGARSGAALHTGREVVIALDLVSFFARVDGRRIYSVLRQAGLPEPVAHSATGLVTHAVPPAVLSAMPPGGTSDERFALRRALAVPHLPQGAPTSPMLANLAVRRLDSRLGGYARAAGATYTRYADDLAFSGDAALAGRVDAFVRGVGRIVSDEGHRLNHAKTRVRRRGVRQTVTGIVVNESTTIGRREYDRLRAILHNCAAYGPSSQNRAGHADFRAHLLGRIGWVESLDPDRGRRLRAEFARIAW

SEQ ID NO: 5661 - protein, 478 aa, unidentified
  source 1..478: note = Related to NZ_PVTL01000004.1; note = Glaciihabitans tibetensis
MNARDLDAYTRTVATALAHAFLMADTWMKPALLDAGASVLGARRRWLGPLAREILATYRSRPTDAPRELVAVIRSAPSFVSAIEVSVERQAAIRIIHHPTSPTEARIRVDQVSAELALASLANAHTASANPASAHTPSAHTVTRLDSLVDLAALLDLTQGELDWFADVRLWNRRARPGRLHHYRYEWRQRPGRTPRLLEVPGQRLRAIQRTVLDEVLSPIPLHPAAHGFVAARSAVTGAAVHTGAAVVINLDLTSFFARVTAGRIYGVLRQAGLPEAVAHTLVGLAVHAVPPHILSQMPPGGSPGERFALRKVLAVPHLPQGAATSPALANLAVRRLDSRLAGWADAAGGQYTRYADDLAFSGGPELARRADTAIRGITRIVEDEGHTINPRKTRVRAAIVRQVVTGVVVNKRTNTPRREFDQLRSVLHNAATQGPDSQNRGSHSDFRAHLLGRISWMESVNPSRGPRLRAAFARIEW

SEQ ID NO: 5662 - protein, 442 aa, unidentified
  source 1..442: note = Related to JADKRN010000004.1; note = Agreia pratensis
MRQRSVAVGLSHAMLACPEWAFDALVDACGRALGVRPGWLWPLVDGVLGAYRRPPLDAHRELARWIEASDDFQSAFVAAREAGRVITLARLETVAASMAPTSLAVPSIAGLGELADFLEVSPSQLDWLTDTVHWNRRTPRGRLHHYGYDWLVRPGRTPRLLEVPTPRMRRVQRLVLREILGRLPLNDAAHGFVPGRSAATGAAAHVGAQTVITLDLRTFFARVPARRVFSVFRQAGYPEGVAHALTGLCTHAVPPWVGARMPAGGSSENRAALRRAISESHLPQGSPTSPALSNLAVRRLDSRLSGWAEASDATYTRYADDLAFSGVRLRGRAAVAFIAGVERIVRDEGHVLNESKTRIAGRGASQRVTGLVVNDVVAVDRAYFNELKAILHNCAAHGPRGQNRAGHPDFRAHLAGRLAWVESVSPSRGARLRRDWDRIDWS

SEQ ID NO: 5663 - protein, 442 aa, unidentified
  source 1..442: note = Related to NZ_FXAY01000002.1; note = Agreia pratensis
MRQRSVAVGLSHAMLACPEWAFDALVDACGRALGVRPGWLWPLVDGVLGAYRRPPLDAHRELALWIEASDDFQSAFVAAREAGRVITLARLETVAASMAPTSLAVPSIAGLGELADFLEVLPSQLDWLTDTVHWNRRTPRGRLHHYGYDWLVRPGRTPRLLEVPTPRMRRVQRLVLREILGRLPLNDAAHGFVPGRSAATGAAAHVGAQTVITLDLRTFFARVPARRVFSVFRQAGYPEGVAHALTGLCTHAVPPWVGARMPAGGSSENRAALRRAISASHLPQGSPTSPALSNLAVRRLDSRLSGWAAASGATYTRYADDLAFSGDGMRGRAAAAFIAGAERIVRDEGHLLNGSKTSIAGRGARQTVTGLVVNDSVAVDRPYFDELKAILHNCAAHGPRSQNRAGHPDFRAHLLGRLAWVESVSPSRGERLRREFDRIDWS

SEQ ID NO: 5664 - protein, 537 aa, unidentified
  source 1..537: note = Related to FUYG01000003.1; note = Agreia bicolorata
MAASIREEAAISRTSVPEENNGARRRRRLPLAWGNATDCGRGGWSRQTNTLSGVTPGYNSQPERTTAGTTPRFARSRARTDRSVARGSSHPFQGSVKEHSIAVGLSHAMLAAPEWAFDPLVDACGRALGARPGWLWPLVDGILDVYRRPPRDAHRELARWIEASTAFRGAIEAAREAGRSIALAHLETIPASMGPTPLTVPSIAGLGELADFLGVSPGQLDWLTDTAHFNRRTPRGRLHHYSYDWLVRPGRAPRLLEVPTPRMRRVQRRVLREILTALPLNDAAHGFVPGRSAVTGAAAHAGAETVITLDLQNFFARVPAQRVYSVFRQAGYPEAVAHALTGLCTHAVPPWVGARMPVGGSLEDRLALKQAISGSHLPQGSPTSPALSNLSVRRVDTRLNGWAAASGAAYTRYADDLAFSGEGLRGRAAATFIAGVARIVLDEGHLLNESKTRISGRGARQSVTGLVVNDGVAVDRLYFDELKAILHNCAVHGPHGQNRAQHADFRAHLLGRLAWVESVSPSRGVRLRREFDRIDWS

SEQ ID NO: 5665 - protein, 345 aa, unidentified
  source 1..345: note = Related to LMNF01000001.1; note = Agreia sp.
MAPTSAAVPSLDGLGELADFLEVTSPQLDWLTDTAHFNRRTPRGRLHHYSYDWLVRPGRAPRLLEVPTPRMRRVQRRVLRDILGPLPLNDAAHGFVPGRSAISGASAHAGAHTLITLDLSTFFARVPARRVYSVFRQAGYPEAVAHALTGLCTHAVPPWVGARMPSGGSPEDRAALRDAISRSHLPQGSPTSPALSNLTMRRLDSRLTGWAAASGAVYTRYADDLAFSGSDLRGRAATSFISGVDRIVRAEGHVLNRSKTRIAARGARQSVTGLVVNDGPSVDRPTFDELKALLHNCVVHGPASQNRAGHPDFRAHLLGRLNWIASVSQTRGTRLRRDFDRIDWS

SEQ ID NO: 5666 - protein, 451 aa, unidentified
  source 1..451: note = Related to NZ_LR882035.1; note = Agreia sp.
MRPGATAQPSATTLAAGLAHAMLACPLWTFDVLVDGCGRALGSRPGWLWPLVERVLSSYHRPPHDATRELARFIAQTRALHDAVEAARADGRTIALQHLETTPARSGENGARGVPRIDGLNQLAEFFAVTPGQLDWLTDTAHYNGRTRRGRLHHYSYDWMRREGRAPRLLEVPSRRMREAQRLVLAEILTPLPLHDAAHGFVPSRSAITGAAAHVGAETLITLDLSTFFARVPARRVFGILRRAAYPEAVAHALTGLCTHAVPSWVLARMPPGGSPEERAALRESLTRSHLPQGSPTSPALSNLSVRGLDGRLDGWAAASGFSYTRYADDLCFSGPHLTHRAAASFIAGAERIVAAEGHRVNRRKTRISGAGSRQSVTGIVVNERLNATREHVDELKAILHNCAVHGQASQNRFGHPEFRAHLEGRITWVAALNPGRGARLRRQFDLIDWG

SEQ ID NO: 5667 - protein, 395 aa, unidentified
  source 1..395: note = Related to NZ_KI914784.1; note = Arthrobacter sp.
MLAAYHRPPGGAPRELARFIAQTSAFGAAVARAVEKGVPIPVARYAVGFAAVGTSAGIAADVGALAELLDLTVGELEWFADTGHWNRRARPGPLRHYRYAWRTRTGRVPRLLEVPGPRLKAVQRRVLHQMLGSIPLHDAAHGFVPGRSVATGAGRHLGAEMLISLDLRAFFSSVGASRIHGIFRQAGMPEAVAYTLTGICTAAVPPAVLSRMPDGGSPDERFALRRALAAAHLPQGAPSSPALANLSVRRLDSRLAGWAEATGAVYTRYADDLAFSGSEPLARRADAFVRGVEGIVTSEGHLVNPRKTRVKGASVRQTVTGVVVNSVPNVPRPVFDELKAILHNCVADGPESQNGARGPAHRDFRAHLLGRISWVESLNPARGQRLRDDFDRIQW

SEQ ID NO: 5668 - protein, 432 aa, unidentified
  source 1..432: note = Related to CP047186.1; note = Rathayibacter sp.
MQGREVLVETLVHAFLGAEWTADALSAAAVDALGARRRWRGRVVAGVLVAFPHPPLDAPRELARCLDALLPDRAQPGVAHLAPVAARASASSSPVPRIDGWGDLARLLALTPGELEAFADVQHWNRRAPEGPVQHYDHVWRERPGRAPRLLEVPRPRLRAVQRSVLDQLVGLAPVHPAVHGFVPGRSAISGAAVHAGAAMVVTLDLQRFFAQVTAPRVFGVLRAEGLPEGVAHALTGLCTHEVPVAVLRRMPSGGTPEERAALRRSLSLAHLPQGAPTSPALANVALRRLVARLAGYAEAAGARYTRYADDLAFSGGPAFARRADAFARGAARLAAESGWAVNPRKTRLRPASTRQTVTGVVVNAHPNVRRADVDRLHAILHNCAVHGSAGQNRAGVPDFRAHLLGRVAWVAAVNPRRGAALRALFDSITWT

SEQ ID NO: 5669 - protein, 453 aa, unidentified
  source 1..453: note = Related to NZ_CP047180.1; note = Rathayibacter festucae
MHGRDAVVEALAHAFLGAEWTPAGLRAAAADSLGARRRWIGPLVTAVLVAFPHPPLDAPRELAQVVAGLLPERAQPVVAHLAPVPARAVPSSSPVPAIDGRDDLARLLGLAPAQLDGFADLGQWNRRTPHGALNPGALQNYDHVWRQRPGRAPRLLEVPRSRLRAVQRSVLDEIVGLAPVHPAAHGFVPGRSAITGAAVHAGSAMLITLDLQRFFAQVTAARVFRLLRGEGLTEAVAFALTGLCTHAVPVAAIHRMPAGGEPEERAALRRSLALAHLPQGAPTSPALANLALRRLDARLTGYAEAAGARYTRYADDLAFSGDARFARRAEAFARGAARIVEDAGYAVNPRKTRLRPASTRQSVTGIVVNAHPAVRRADVDRLRAILHNCAVHGPAGQNRAGVPDLQAHLLGRIAWVSAVHPGRGARLRALFERIPWPEPSGAAPSLDPAGPRP

SEQ ID NO: 5670 - protein, 434 aa, unidentified
  source 1..434: note = Related to NZ_FXBM01000004.1; note = Rathayibacter oskolensis
MQGRDVLVETLTHAFLGAEWTRDSLRAAAVDSLGARRRWLGPLATGVLVAFPHPPLDAPRELARCIAGLLPERAQPVVAHLAPVPARALPSSSAVPRIDGRDDLARLLAITPAQLDGFADLGQWNRRAAEGAVQHYDHVWRERPGRVPRLLEIPRARLRAVQRTVLEEVVGLAAVHPAAHGFVPGRSAISGAAVHAGSAMLVTLDLQRFFAQVTAPRVFGLLRAEGLPEAVAYALTGLCTRPVPIAVLRRMPTGGDVEARAALRRSLTLPHLPQGAPTSPALANLALRRLDARLTGYAEAAGARYTRYADDLAFSGDERFARRAEAFARGAARIVEDAGYAVNPQKTRLRPASVRQSVTGVVVNVHPNVRRADVDRLHAILHNCVVHGPSGQNRGAVPDFGAHLLGRIAWVAAVNPARGARLRALFDAIVWPGA

SEQ ID NO: 5671 - protein, 432 aa, unidentified
  source 1..432: note = Related to NZ_PZPL01000001.1; note = Rathayibacter caricis
MRGRDALVEALVHAFLGAEWTHDALRAAAADSLGARRRWLGPLVTRVLVAFPHPPVDAPRELGRCIAALLPDKAQPVVAHLAPVAASAAESSSPVPRIDGIADLAALLGLSVDALDGLADSGSWNRRAPEGRLQHYDHVWRERPGRVARLLEVPRGRLRAVQRSALDEIVGLAPVHPAAHGFVPGRSAITGAAEHVGSAVVVTLDLQRFFAQVTAPRVFGLLRREGLPEAVAYTLTGLCTHAVPVAVLRRLPEGGSPEERAGLRRALTLPHLPQGAPTSPALANLALRRLDARLTGYAEAAGARYTRYADDLAFSGDESFARRAEAFARGAQRVVEDAGYAVNPRKTRIRRASVRQSVTGVVVNVRPNVRRADVDRLHAILHNCAVHGPAGQNRAGVGDFRAHLLGRIAWVAAVNPGRGAALRAVFDRIEWG

SEQ ID NO: 5672 - protein, 477 aa, unidentified
  source 1..477: note = Related to NZ_LMMJ01000014.1; note = Curtobacterium sp.
MAEPTGVDGAHPFARTADVTIARTTDATTTRRTAVASARTAEIATVLADAFLAAEDWAVDALLAAGTAAVGPHRRFVPMTVLAALRGYPRAPRDAPRELAAFLQSVDGFAEAVRRSAERAPITVASRRATPTEAPPNTGHVPRIDTVADLARLLDLTIGRLEWFADTKQWNRRTHDAVLQHHGYVWRARPGRVPRLLEVPKPRLRAVQRTALDEILTFLPVHDAAHGFVPGRSAVSGAAQHTGRQAVVTLDLAHFFAAVSAPMVYGLLRRGGLPEPVAHTLTGLCIHVVPPRVIAAMPPGGTPEDRAALRRALATPHLPQGAPTSPTLANASVWRLDTRLAGWAASADATYTRYADDLAFSGDDRFAARVDAFVRGVGRIVTDEGHILNASKTRVRRRGVRQSVTGIVVNERPSVGRAEFDRLKAILHNCAEHGPDGQDRVGVPDFRAHLRGRVGWFEQVHPERGARLLAEFQRITW

SEQ ID NO: 5673 - protein, 437 aa, unidentified
  source 1..437: note = Related to LMPO01000009.1; note = Curtobacterium sp.
MVAGALADAFLAAEGWHRDELTAAGYDVLGVERTYVGVAVGVALEAYPRAPVDAPRQLAAVLASAPRLVRLHDSRVPLRPVRVLLRRATAVRARPIVASRLLVDTLPELARELDLTAGRLLWLADTKGWNRHRGPTSALHHHRHEWVQRPGRAPRLLEKPMAMLKRTQRTILDELLAAMPVHDAAHGFIAGRGVVSSAAEHVGCPVVLSADLTAFFANVRAATVYGVFRSAGFAEPLAHVLTGICTHRVPPHVLTAMPPGGDPDQRTALRRALTEAHLPQGAPTSPALANLALRHLDVRLAGWAAAVDATYTRYADDLTFSGGDALAARPDAFLRGVDRIVTEQGHTLNARKTRVRRAGVRQSVTGVVVNERTSPGRREVDRLHAILHNCVVHGPASQDRDGHADFRAHLLGRIGWVGQVHPVRGAALMTLFAQIRW

SEQ ID NO: 5674 - protein, 496 aa, unidentified
  source 1..496: note = Related to JALGRO010000013.1; note = Curtobacterium sp.
MEFPGEADGARDASTSPGSPRGTQYQQDDTPREARRAPRALPHGGTDRSPGNPTPTPLDVVARALADSFLAADRWNRDDLTAAGYDVLGVERTYVGLAVGIALDAWPRPPVDAPRQFAAVLASDPRLIRLHDSRVPLRPVRVLLRRATAVRAVPRVDSRLLVDTLPELARELDLTVGRLMWLADTRGWNRRPGPSSPLHHHRHEWVHRAGRAPRLLEKPMAMLKRTQRTILDELLVAMPVHDAAHGFVPGRSVVSGAAEHVGRSVVLSADLTSFFASVTAPSVYGVFRSAGFAEPLAHVLTGVCTHRVPPHVLTAMPPGGDADARGALRRALAAAHLPQGAPTSPALANLTLRHLDVRLAGWAAAMGGTYTRYADDLTFSGGDAMAARADAFLRGVDRIVREQGHTLNTRKTRVRRSAVRQSVTGVVVNERTSPGRREVDRLHAVLHNCVVQGPASQDRGGHPDFRAHLLGRIGWVEQVHPGRARRLRDEFARIRW

SEQ ID NO: 5675 - protein, 439 aa, unidentified
  source 1..439: note = Related to MJGI01000025.1; note = Curtobacterium sp.
MDVVAGALADAFLTAARWERDGLTAVGYDVLGVERTYVGVAVGVALDAYPRPPVDAPRQLAAVLAGAPRLVRLHEAREPLRPVRVLLRRAAPVQAHPTVASRLLVDTLPELARELDLTVGRLLWLADTRGWNRGPGPTSPLHHHRHEWLQRPGRTPRLLEKPYAMLKRTQRTVLDDLLAVLPVHDAAHGFVAGRSVVSGAAEHVGRPVVLSADLTSFFASVKSPTVFGVFRSAGFAEPLAQVLTGLCTHRVPPHVLTAMPPGGDPDERAALRRALAAPHLPQGAPTSPALANLSLRHLDARLAGWAAAVGGTYTRYADDLTFSGGDALAARPEAFLRGVDRIVTEQGHTLNRRKTRVRRAGVRQSVTGVVVNERTSPGRREVDRLHAVLHNCVEHGPSSQDRGDHADFRAHLLGRIGWVEQVNPGRARRLWAEFARIRW

SEQ ID NO: 5676 - protein, 436 aa, unidentified
  source 1..436: note = Related to MJGP01000013.1; note = Curtobacterium sp.
MAQALADAFLAADDWSRDALTAAGYDVLGVERTYVGVAVGTALDAYPRPPVDAPRQLAAVLATAPRLVRLHDSRGPRRPVRVLARQATAVRARPVTDSPLLVDTLPELARALDLTVGRLLWLADTRGWNRRPGASSPLHHVRHEWVARPGRTPRLLEKPMAMLRRTQRTVLDDLLAALPVHDAAHGFVPGRSVVTGAAGHVGRRVVLTADLTSFFATVRAPTVYGVFRAAGYAEPLAHVLTGLCTHRVPVHVLTAMPPGGSIDERRALRDALVEAHLPQGAPTSPALANLALRHLDARLAGWATAAGATYTRYADDLTFSGDDRLAARADAFLRGVERIVADQGHTLNPRKTRVRPAGVRQSVTGVVVNERTAPGRREVDRLKAVLHNCVVHGPASQDRAGHADFRAHLLGRIGWVGQVHPDRAAKLRALFARIEW

SEQ ID NO: 5677 - protein, 494 aa, unidentified
  source 1..494: note = Related to JACGXP010000002.1; note = Curtobacterium pusillum
MEFPGEAAGARDAPTSPGSPRGTRYQQDDTPRAGRRAPRATPHGGTDGSSGNPTPLDVVAVALADSFLTAEQWAHDELTAAGYAVVGVERAYVGLAVAAALEAYPRPPVDAPRQLAAVLASSPRLAELHRSREPRRPVRVLARRATAVRSRPETVSRLLVDTLPELARELDLTVGRLLWLADTRGWNRRPGPSSPLHHHRHEWVRRPGRTPRLLEKPMDMLRRTQRTILDELLTALPVHDAAHGFVAGRSVVTGAAAHTGQQVVVSADLTSFFASVSAPTVYGVFRSAGFAEPLAHVLTGICTHRVPPHVLTAMPDGGTPEERAALRQMLAAAHLPQGAPTSPALANTALRHLDARLAGWAAAVDAVYTRYADDLTFSGGHRLARRTDAFLRGVDRIVTEQGHRLNPRKTRVRRRGVRQTVTGVVVNERTSPGRREVDRLHALLHNAAEHGPASQNRAGHPDFRAHLLGRIGWVEQVHPGRARRLREEFTRIVW

SEQ ID NO: 5678 - protein, 494 aa, unidentified
  source 1..494: note = Related to JAFBBT010000001.1; note = Curtobacterium herbarum
MEFPGEADGARDASTSPGSPRGTQDQQDHTPREARRAPRARPHGGTDRSPGNPTPLDVVATALADAFLAADAWDVDHLTAAGYDVVGLERAYVGLAVRAALETYPRPPVGAPRQLAAALAGSPPLVRLHDARRDRRPVRVLLRRAVAVQAVPTVSSRLLVDTLPELARELDVTVGRLLWLADTRGWNRRPGPASPLHHHRHEWVHRPGRTPRLLEKPMDLLRRTQRTVLDELLAMLPVHDAAHGFVPGRSVVTGARVHVGQQVVVSADLTTFFASVRAPSVYGVFRSAGLAEPLAHVLTGLCTHRVPVHVLTAMPPGGDADERGALRRLLADSHLPQGAPTSPALANTVLRHLDARLAGWAASVGAAYTRYADDLTFSGGAELARRPDAFLRGVERIVTDQGYRLNAPKTRVRRAGVRQSVTGVVVNERTAPGRREVDRLHAVLHNCVVHGPVSQDRGGHADFRAHLLGRIGWVAQVHPAQAVRLRAEFDRIAW

SEQ ID NO: 5679 - protein, 316 aa, unidentified
  source 1..316: note = Related to QKLJ01000002.1; note = Curtobacterium sp.
MLADTRGWNRRPGSASPLHHHRHEWVRRPGRTPRLLEKPLDMLRRTQRTVLDELLAVLPVHDAAHGFVPGRSVVSGATLHVGQRVVITADLTSFFASVRARSVYGVFRAAGFAEPLAHVLTGLCTHRVPTHVLTAMPPGGDVDERAALRRALADAHLPQGAPTSPALANTVLRHLDARLAGWADAAGAVYTRYADDLTFSGDDRLARRADAFLRGVDRIVTDQGLRLNARKTRVRPASVRQSVTGVVVNDRTAPGRREVDRLHAVLHNCAEHGPESQNRSGHPDFRAHLLGRIGWVEQTNPGRADRLRREFVRITW

SEQ ID NO: 5680 - protein, 494 aa, unidentified
  source 1..494: note = Related to NZ_CP017580.1; note = Curtobacterium sp.
MEFPGEAADARDASTSPGSPRGTQDQQDDTPRAGRRAPRATPHGGTDGSPGNPTPLTVVAGALADAFLTAEHWGPDDLTAAGWAVVGVERAYVGLAVAAALAAHPRPPVDAPRQLAAVLEASPRLAELHRAREARRPVRVVARRATAVRARPETASRLLVDTLPELARELDLTVGRLLWLADTRSWNRRPGPSSPLHHHRCEWIRRPGRTPRLLEKPMDMLRRTQRTILDELLTALPVHDAAHGFVGGRSVVTGAAAHTGRQIVVTADLTSFFASVTAPTVYGVFRAAGFAEPLAHVLTGVCTHRVPVHVLSAMPDGGSPEERQALRAMLREAHLPQGAPTSPALANTALRHLDARLAGWAASVGAVYTRYADDLTFSGDERLAARPDAFLRGVDRIVTEQGLRLNPSKTRARRRGTRQSVTGVVVNDRTSPGRREVDRLHAILHNAAEHGPESQNRAGHPDFRAHLLGRIGWVEQVHPGRARRLHEEFARITW

SEQ ID NO: 5681 - protein, 494 aa, unidentified
  source 1..494: note = Related to NZ_CP081964.1; note = Curtobacterium sp.
MEFPGEAAGARDASTSPGAPRGTQDQQDDTPRAGERAPRATLHGGTDRSSGNPTPLSVVTAALADAFLTAERWEADELTAVGYVVVGVERAYVGLAVAAALEAYPRPPVDAPRRLAAVLAAAPRLVALHRSREDRRPVRVLVRRATAVRARPETASRLLVDTLPELARALDLTVGRLLWLADTRAWNRRSGPSSPLHHHRHEWITRPGRAPRLLEKPMDMLRRTQRTILDELLTMLPVHDAAHGFVPGRSVVTGAAVHTGQQVVVTADLTTFFASVSAPTVYGVFRAAGFAEPLAHVLTGLCTHRVPVHVLSAMPAGGSPEERHALRQALATAHLPQGAPTSPALANTSLRHLDARLAGWAGAVDAVYTRYADDLTFSGGDRLAARPDAFLRGVDRIVTEQGYRLNPSKTRVRRRGVRQSVTGVVVNERPSPGRREVDRLHAVLHNAAVHGPASQNRSGHPEFRAHLLGRIGWVEQVNPGRARRLREEFARIVW

SEQ ID NO: 5682 - protein, 494 aa, unidentified
  source 1..494: note = Related to NZ_CP027869.1; note = Curtobacterium sp.
MEFPGEAADARDASTSPGSPRDTQDQHDDTPRAGERAPRATPHGGTDGSPGNPTPLSVVASALADAFLTADRWAVDELTAAGYAVVGVERAYVGRAVSAALDAYPRPPADAPRQLAGVLAANPRLAALHRSREARRPVRVLARRATAVRARPVTDSPLLVDTLPELARALDVTVGRLLWLADTRAWNRHAPAGSPLHHLRHEWVVRPGRVPRLLEKPMDLLRRTQRTVLDGLLTRLPVHDAAHGFVPGRSVVTGAAVHTGQQVVLTADLTTFFATVSAPTVYGVFRSAGFAEPLAHVLTGLCTHRVPPHVLARMPAGGTPEERAALREALAVAHLPQGAPTSPALANTALRHLDARLAGWASAAGGRYTRYADDLTFSGDDRLAARSEAFLRGVERIVADQGHRLNPHKTRVRRRGTRQSVTGVVVNDLPSPGRREVDRLHAVLHNCVVHGPASQDRTGHPDFRAHLLGRIGWVEQVHPGRARRLREEFARIRW

SEQ ID NO: 5683 - protein, 437 aa, unidentified
  source 1..437: note = Related to NZ_CP076544.1; note = Curtobacterium sp.
MVATALADAFLAAEGWDTAHLTAAGLDVVGPERAYVGLAVRAALETYPRPPVGAPRQLAAVVARAPALARLHHRRADRRPVRVLQRRAVPVRAVPTVSSRLLVDTLPELARELDLTVGHLLWLADTRGWNRRPGASSPLHHHRHEWVRRPGRTPRLLEKPMDLLRRTQRTLLDELLVHLPVHDAAHGFVAGRSVVTGAAAHTGQEVVVTADLTTFFASVRAPSVYGVLRSAGYAEPLAHVLTGLCTHSVPVHVLRAMPDGGSLDDRAALRRALADAHLPQGAPSSPALANTVLRHLDARLAGWAAASGAVYTRYADDLTFSGGTALAGRVDAFLRGVDRIVTDQGHRLNPAKTRVRRRGVRQSVTGVVVNERTSPGRREVDRLHAVLHNCVEHGPASQDRAGHADFRAHLLGRIGWVEQVHPGRARRLHEEFARIRW

SEQ ID NO: 5684 - protein, 497 aa, unidentified
  source 1..497: note = Related to NZ_CP093378.1; note = Curtobacterium luteum
MEFPGEADDARGASSSPGSPRGTQDQQDTTPRAGRRAPRATPHGGTDGSPGNATPLDAIAVALADGFLAADAWDLPTLRAAGFDVVGIERVIVGAAVVAALDAFPRPPTDAPGSLAAVLARTPRLVSEHGRRTRRRPVRVLARPVSPVHAARHVEGPLLVDTLPELARALDLTVGRLLWLADTKGWNRHADPDGPLHHYRHTWTVRPGRTPRLLEAPMHLLRRAQRTVLDELLTTLPVHDAAHGFVPGRSIVTSAARHVGTEVVVTMDLTSFFATVRAPSVYGVFRNAGFAEPVAHVLTGLCVHEVPPHVLRAMPGGGGGSLDERVALRRALAEAHLPQGAPTSPALANLALRHLDARLTGWAVAAGATYTRYADDLTFSGGAALAARVDAFIAGVDRIVRDQGHEVNPHKTRVRRRGVRQAVTGVVVNDRLSPGRAEVDRLHAILHNCVRHGPASQNRDGHPEFRAHLLGRIGWVGQTHPARAARLRAEFDRIDWR

SEQ ID NO: 5685 - protein, 496 aa, unidentified
  source 1..496: note = Related to JAGGPH010000002.1; note = Curtobacterium sp.
MGFPGEADGVRGASSSPGQPRGTQEQLTHPPREARRAPRALPHGSTDQSPGNPGPLAEVAQALADAFLTADDWSRPALTAVGYDAIGVERAIVGLAVGAALDAYPRAPSDAPRQLARVLAAAPRLQSAYAARDPRVRPVRILARPVGAVRAGRSVDSPLLVDTVPELARALDLTVGHLLWLADPGGWNRRPDASSALHHYGYAWIPRGGRTPRLIEKPKPLLRRTQRLLLDGLLGALPVHDAAHGFVAGRSAVTGAAEHVGRQVVVTVDLTAFFASVTAGSVFGVFRTAGFAEPVARVLTGLCTARVPVHALRTMPDGGSVEHRFALRQALRLPHLPQGAPSSPVLANLSLRHLDARLAGLAAASGATYTRYADDLTFSGDDHFAGSVDGFLRAVGRIVVEQGHTINQAKTRVRRRGRRQSVTGIVVNERVAPGRAEHDRLKAILHNCAVHGPQGQNRAGHPDFRAHLEGRITWMMQLNPERGARLRAVFERIEWG

SEQ ID NO: 5686 - protein, 499 aa, unidentified
  source 1..499: note = Related to NZ_CP014513.1; note = Frondihabitans sp.
MARFRGEADDARRAPSSPGSPRGTQNDQQHTPREARRASRARPHGRIDGSPRNRGHTPLAVVAQALADAFLAAPEWTIPALDEAGFATVGVVRPFVRVTVVTALEAYPRPPRDAPRQLAAVILRSPRVVDLFEARAATNPVRVVSRSVGPVEARADHETASRLLVDTVPALARELDLTVGRLLWLADTRGWNRTAAEGPLHHYRYEWLARPGRTPRLLEKPLHRLKTTQRTILDDLLTALPVHDAAHGFVTGRSAVTGAALHVGQDVVISADLTSFFPSVRAGSVYGVFRDAGFAEPLAHLLTGVCTHRVPVGILSAMPPGGSPDERFALRQRLSAAHLPQGAPTSAALGNLVLRHLDARLAGWAKSAGSVYSRYADDLTFSGGASLASRADAFARGVDRIVADQGYALNPQKTRVRRQGVRQSVTGVVVNERTSAGRREYDLLKATLHNCLRDGPARQNRGGRPDFRAHLAGRVGWFEQCNPERGARLRSLFEQIAWA

SEQ ID NO: 5687 - protein, 512 aa, unidentified
  source 1..512: note = Related to QKTP01000001.1; note = Curtobacterium sp.
MRWSPGEADGARAAASSPGLPRGTRIDQEHTPQELGRAPRADAPERHDESSGDHQHADPPPTSRLVAPERSAGLVETAIALADAFLAASAWRPAELSAAGTTTVGRRPGLVEPAVAAVLAVYPRAPRDAPRRLAGVLASDRSFTAAFARLTARRPVRLRVRTVAPVVAAPVAAHVPVVDALPDLAALLGVTTERLLWFADTRGWNRRVPAGSPLHHYEHRWVQRPGRTPRLLEAPLHQLRTMQRVVLDQVLAPLPLSDAVHGFVRGRSALSGAEVHVGHDVVVSADLVSFFAAVPASRVYGIFRRVGYAEPVAHVLTGLCTHVVPDAVLRAMPPGGDLDERWALRQALATPHLPQGAPSSPALANLSLRRLDARLAGWAQAADAVYTRYADDLAFSGDGAIAARPDAFLRGVDRIVADEGHALNPRKTRVRRQGVRQSVTGVVVNAVPGVGRRELDRLRAVLHNCVRYGPASQDRGDHADFRAHLEGRVGWVEQVHPARGATLRAEFERIAW

SEQ ID NO: 5688 - protein, 506 aa, unidentified
  source 1..506: note = Related to NZ_LMNV01000002.1; note = Frondihabitans sp.
MQRPPGEAGGTRAVPPSPGLPRGTKIDENTTPREAERASRALPPAPADESFGGRSQHDANADIAHEPPGATLAEVARALADAFHAAPEWSAPSLLAAGSSVVGSRRAFVRVAVGGILESLPRSLPDSPRLLARLILDLPGFVASFRRGTRRTPVRIRSRAIAPTRAVGPGPRVDTVVDLARLLGVTVGRLEWFADTQGWNRLAEEGPLHHYRYKWRVRPGRVPRLLEVPLDRLRTMQRIILDELLTPMPLHDAAHGFVAGRSAITGAAEHTGRDVVIGLDLVSFFASVTAKQIYGLFRRAGLPETVAHLLTGVCTHSVPPRVLRAMPAGGSASARFALRQALSTPHLPQGAPSSPALANLSLQRLDSRLAGWADAFGATYTRYADDLAFSGDASLASMVREFVRGATAIVVDSGHTINAPKTRIRRAGTRQTVTGIVVNATTAPGRREYDRLRAVVHNCVTHGPEGQNREGHPAFRQQLLGRIAWVSQLHPERGARLRREFELIRW

SEQ ID NO: 5689 - protein, 473 aa, unidentified
  source 1..473: note = Related to RJUO01000002.1; note = Frondihabitans sp.
MTPREAKRASRTLPPAPADESSGGRLHARGGQPSGASPYEVAVVLADAFAAAPGWDVRSLSAAGTAAFGSGRRFVPLAVLGVLQALPRPILDSPRTTARLIVALPGFVEAVRRSAERAPVVVLSREVVPVAAVGPGPRVDTVADLARLLGVTVGRLEWFADTKGWNRRAPAGPLHHYRYEWVSRPGRTPRLLEVPLGLLKTVQRTVLDELLAPMPLHDAAHGFVPGRSAVTGAALHTGREVVLALDLVSFFAAVSARQVYGLFRRAGLAEPVAHLLAGVCTHAVPVHVLSAMPDGGSSTERFELRRALAAPHLPQGAPSSPALANLSLAGLDRRLDGWARAAEAVYTRYADDLSFSGDGELGGRVPAFLRGVERIVTDEGHTVNARKTRVRRAGVRQTVTGIVVNQTTSPGRTEHDRLKAIVHNCVRYGPASQNRDGHPAFREHLLGRIAWVEQLHPARGARLRAEFDLIRWD

SEQ ID NO: 5690 - protein, 457 aa, unidentified
  source 1..457: note = Related to NZ_UEXK01000004.1; note = Klenkia terrae
MKPPGTRTARALAAAFLGSPEWSAPALVEQGRVVLDPAPDWLPAVAAAAVAAHREPPRDAPRELAGFLLGVREELLDARPRLDDDGEPLPRPAEPRVRAWLPTTPRMGRARWPVHPLHDLADVAEMLGTDLDHLSWYADPQGRQRTEPAGHLQLYRRRWLPRPGRVPRLLEVPTPRLRAVQRVLLDRVLAPIPPHPAAHGFVAGRSALTGARQHVGAEELLTLDLAAFFATVRAGRVWATLRSAGYPEPVASLLTGLCTTSATRDDLATMPPGGSEGARAHVRAALATPHLPQGAPTSPQLANLAAHRLDRRLAGLAAAAGAVYTRYADDLTFSGRRGTAALRHRVAVVVADEGFALQPAKTRVRGRGARQAVTGVVVNERPSLPRAELDALRARLTNAVRRGPSAADLAAVDGDRQALRRELAGRGAWVTQVHPVRGERLAALLAAVDFAEPDTDL

SEQ ID NO: 5691 - protein, 484 aa, unidentified
  source 1..484: note = Related to NZ_FMUH01000007.1; note = Klenkia marina
MSVRSAHAYAGTTGQVDPHHRTPLFHVKQPPEQRTARALATALLADGPWTVEGLTARGRRALDPAPDWLPALAAATVAAWREPPRDAPGEFARYLSAAREHPPAEPPGYDDEEDLPPPVPEPRVREWLPTATRMGRARWPVHPLHDLSDVAELLATDLDQLRWYADPLDRQRTEPAGHLQLYRRHWLARPGRVPRLVEVPTPRLRRVQRVLLDAVLAPVPPHPAAHGFVAGRSALTGARQHVGAEQLLTMDLAAFFATVRSGRVFATLRSAGYPEPVAALITGLCTTRATRDDLATMPAGGTPGARDHVRAALALPHLPQGAPTSPQLANLAAHRLDRRLAGLAASAGAVYTRYADDLTFSGRRGTAGLRHRVAAVVAEEGFTVQPTKTRVRGRGARQTVTGVVVNDRTSLPRAELDALRARLTNAVRRGPSAADLAAFDGDRHALRRHLAGRVAWVAQVHPARGGRLAGLLAAVDWSGPDTDL

SEQ ID NO: 5692 - protein, 460 aa, unidentified
  source 1..460: note = Related to NZ_FNIR01000011.1; note = Klenkia soli
MNQRTPPGTHTARALSAAFLGAPHWTVDALVAHGRRALDPAPDWLAGVAAAAVEAWREPPRDAPREFARFLLAVRTQLAAVPPAYDDEEDLPPRPAEPRVRAWLPAATAMGRTPWPVHPLHDLADVAELLGTDLDHLAWYADPQGRQRHEPAGHLQLYRRRWLARPGRVPRLLEVPTPRLRAVQRVLLDAVLAPIPAHPAAHGFVPGRSALTGARQHVGADVVLTMDLAAFFATVTAGRVWATLRTAGYPEPVATLLTGLCTTRATRDDLATMPGGGTDAARDHARAALARPHLPQGAPTSPQLANLAAHRLDRRLDGLAAAAGAAYTRYADDLSFSGGRGTAALRDRVAGIVVDEGFAVQPAKTRVRGRGARQTVTGVVVNERTSLPRAELDALRARLTNAVRRGPSAADLAAFDGDVHALRRHLTGRVAWVAQVHPARGERLAALLADVDWGRRDTSL

SEQ ID NO: 5693 - protein, 545 aa, unidentified
  source 1..545: note = Related to LMQC01000019.1; note = Modestobacter sp.
MARGRGRRTAGRSGSSGDAPGTARRLHHDASGAALRSAQQSAGPTGQVDPRHRTRLFHVNPPTARTTARALADAFLGAREWQVPALVARGRLVLDAEPDWLTDLARAAVTAWRVTPHDAPAELARVLLAVPGVFEPPVPEMVTSGEDGEDDDEDGFLVWAADEEPEGWQGARAAAPGSPRVVRWLPAHTRMGRTPWRVAPLDDLADVAELLATDLDHLAWYADRQGRQRAEPSGRLQLYRRHWRVRPGRVPRLLETPRPRLRTAQRVLLDRVLAPVPPHPAAHGFVTGRSAVTGAQQHVGADVVLTMDLAAFFATVTSGRVYATLRTAGYPEPVADLLTGLLTTRATRDDLATMPPGGSDAARAHVRSALAAPHLPQGAPSSPQLANLCAQRLDRRLAGYAAAAGAVYTRYADDLTFSGGPDVARRVGALRHGVARIVAAEGFALQPAKTRVRGRGARQTVTGIVVNDRTSLPRRELDALRARLTNAVRLGPSVQDLAAFDGDRGALRAHLAGRVAWVAQVHPVRGERLAALLAAVDWDPVDTHL

SEQ ID NO: 5694 - protein, 449 aa, unidentified
  source 1..449: note = Geodermatophilaceae bacterium NBWT11; note = Related to CP043652.1
MNREVARALADAFLGAPAWRVSVLVDRGRAVLSTEPSWLGRAAVAAVTSWPEPPVDAPGELARFLLGVDVGPEDEEARPEPPPRVVRRVPTPTRMGRTRWPVHPLHDLADVAELLGTDLEHLDWYADRQGRQRAEPAGHLQLYRRRWLPRPGRVPRLLEVPTPRLRAVQRLLLDRVLGPVPAHPAAHGFVPGRSAVTGAAQHTGADVVLTLDLAAFFATVTSGRVHATLRTAGYPEPVVALLTGLVTTRATRDDLATMPPGGTDAARHQLRGALAAAHLPQGAPTSPHLANLGAQRLDRRLAGYAAVAGAGYTRYADDLTFSGGPDVARRVRALQHGIERIVADEGFVVHPTKTRVRGRGARQTVTGIVVNRGTSLPRAELDALRARLTNAARRGPSAADLAAFDDDRVALRAHLTGRVAWVAQVHPAKGARLAALLAAVDWDGPDTSL

SEQ ID NO: 5695 - protein, 453 aa, unidentified
  source 1..453: note = Related to NZ_JAABOZ010000008.1; note = Modestobacter sp.
MSTDRGQEVARALADAFLGAPVWLPSALLARAELVIGARPPWLAAVAVTAATAYQEPPRDAPGELAGFLAASSALEAGLLAGNPTVTARGRRRRAPVRVVRRLPASTAMGRTRWPVVPLDDLGDLARLLDVDPGHVAWYADGQGRQRLDPPGRLHLYRRAWLPRPGRTPRLLEVPTPRLRRVHRLVLDQVLAPVPAHPAAHGFVPGRSALTGARQHVGAGVVVSMDLLSFFATVHVRRVYWVLRTAGYPEPVASALAGICTVATPVADLRAMPAGGDDQERSALRRALAAPHLPQGSPSAPHLANLCAQRLDRRLAGYAGSVGAVYTRYADDLTFSGRFRAGPLISGVGAVVREEGFRLNVDKTRVRGRGSRQSVTGIVVNERPTVPRPEYDALRAQLFNAARRGPSARDLAEHPDLRAHLTGRVAWVAQLDPERGRRLRALLDRVDWSGPAS

SEQ ID NO: 5696 - protein, 354 aa, unidentified
  source 1..354: note = Geodermatophilaceae bacterium; note = Related to JACCXW010000487.1
MTGRGEQAVASALAGAFLAGDWTASELFERGSTTLGRRPRWLRRVVVEVLSLYREAPVDRPRELATVVLATDGFQTAASPAQRHEGPPLRVVRILVEPTRMVRSRWPVARVDTVTDLADLLELGVGHLTWYADTAGMQRRTRVQALQLYRYRWLDRPGRAPRLLEIPKPRLRRAQRLLLDRIVARVPAHAAAHGFVPGRSARTGATPHVGTDVVIGLDLAGFFASVPAQRIYGILRVAGYPEAVAHIITGLCTTATPIAVLAAMPAGGSADDRYALRRTLTMPHLPQGAPTSPQLANLSAYRLDCRLAGLVAALGATYTRYADDLRCPADPTWRGRPRGSSAASGGSSATRGSG

SEQ ID NO: 5697 - protein, 345 aa, unidentified
  source 1..345: note = Geodermatophilaceae bacterium; note = Related to JACDAB010000197.1
MAGSRWPVATVDDLADLAGLLDLSMGHLGWYADPAGMQRRNRVPALQLYRYRWLDRPGRAPRLLEVLKPRLRRAQRMLLDRIVGLVPAHAAAHGFVAGRSARTGAAPHVGTDVVIGLDLAGFFGSVSAHRIYGILRVAGYPEAVAHIVTGLCTTATPIAVLGTMPPGGPVDDRYALRRALTTPHLPQGAPTSPQLANLSAYRLDCRLAGLAAAVGATYTRYADDLSLSGGPEVARQTARIVGGVRRIVSDEGFRLNEGKTRVQPRAGRQTVTGIVVNERANAARADYDRLRAILHNAARTGAQGQNRGGHRDFRSHLLGRIAWVEALNPARGRRLRADFDRIDWT

SEQ ID NO: 5698 - protein, 443 aa, unidentified
  source 1..443: note = Related to JABEMA010000014.1; note = Pseudokineococcus marinus
MTTGPAVAQALADAMLAEGAWDAAALARAAARVVGPRRRWLPALAAEVLATCPRPPRDAPRYLGAVVAGAPSFARAEERAQRRGHPLPVLSRPVVATRAGGSRWPTAPLDDVGDLADLLGLDVGHLDWMADVRGLQRRAPAGPLHLHRYRWVERPGRVPRLLEVPSPRLRRVQRTVLDAVLAGLPAHDAAHGFVPGRGVLSGAREHVGRAVVVRADLTAFFAAVTAGRVFRVLRALGQPEAVAHVLTGLCTTRAPVRVLAAMPPGGRDADRHLLRRWLAEPHLAQGAPTSPHLANLAAHRLDVRLSSYAAACGAVYTRYADDLVLSGGDDVARRAGPLLEGVRRVVREEGYRVNEAKTRVQPRHRRQSVTGVVVNDRPGAGRRETDALRALLHNCVRHGPASQDRDGRGEGFRAHLEGRVSWVEHVSPRRGAALRGELGRIAW

SEQ ID NO: 5699 - protein, 441 aa, unidentified
  source 1..441: note = Related to NZ_QCXS01000003.1; note = Nakamurella deserti
MSAETALASALAEAMLAGTWHRRGLIRAMSATLNRTSRRVRWVRPLAVEVLAAYPHPPLDRPRELAGFVGTTPAVQRALGRRRPPKALVRVATPTTTVSRPFPTPRVDHVAQLAEFLAVDPDELVLLADPQSRARRAPSRRIAHYRYHWLDKPAGARLLEAPKPRLKALQRKVLDGLLTPIPVHPAAHGFVPGRSAVTGAAPHVGAAVVVTVDLEHFFAAVRAGRVWGVLRAAGYPEPVAHLLTALTTHASPVATLSAMPPGPDRGRDFRLRRRLATPHLPQGAPTSPQLANLVAFSLDRRLDAYARAAGVTYTRYADDLTFSGGPELSRAAEALLHAVDGIVRAAGYRLNPAKTRIRRSHERQSVTGIVVNRHTTLARPEYDRLRAVLHDCVTNGPEAADRNGHDDFRAHLLGRISWVAALHPARGARLRAAFDAVAWGD

SEQ ID NO: 5700 - protein, 422 aa, unidentified
  source 1..422: note = Related to QXCQ01000133.1; note = Nakamurella silvestris
MLAGKWAPKAARKRLGRTLGQQPKWLKRLVREVLTAYPRPPLDRPRELAAFVLRSAALERAHRKSGPLPRPVRRFSTPTSTVLRPFPTPVLDHAGALADLLDLDLDELELLADTALRARRAHDPRIAHYRYHWRMRPGGPRLIEAPKPRLLTVQRRILEEIIGLIPVHPAAHGFVPGRSAVTGAALHVGAGTVVNLDLEHFFAGITAGRVWGVLRAAGFPEPVAHLLTGLTTHATPVAVLSVMPDRPGEARNFRLRRSLGTPHLPQGAPTSPQLANLILYSLDRRLQAYADAAGLRYTRYADDLTFSGPQVRHPDSVVAAVTSMAAAEGFRVNDAKSRVRRHHQRQVVTGIVVNEWTNLARPEYDRLRAVLHDCRVNGPAAANRDGHDDFRAHLQGRVSWAGSLNPGRGAKLAAMFDRIVWD

SEQ ID NO: 5701 - protein, 440 aa, unidentified
  source 1..440: note = Related to NC_013235.1; note = Nakamurella multipartita
MTGPADRLATALADAMLAGSWDYQSILDRTRQVIARRPPWLDSLAREVLAAYQRAPADRPRELAAFVVSSAAMARARRSPPRLPTPVVRFSSPTRMIRRPFATPVLHHAGDLADHLGITLEALDAFADTRLRARRARAERIAHYRYRWMHRPGGARLLEAPKRNLRALQRTVLDDILAPIPTHPAAHGFVAGRSAITGAAEHVGAEVVITLDLEHFFASVTPGRIWGLLRAAGYPEPVAHLLVGLTTHATPVATLASMPASADPGRDFRLRRRLAGPHLPQGAPTSPALANLVAFSLDRRLDSYARAAGSRYTRYADDLTFSGDAALARRSAALIAAVKRMIRQEGFTVHPGKTREHHRSRRQVVTGIVVNDRTNIPRADYDRLKAVLHDCRRNGPLAANRDAHPDFRAHLLGRLSWVSALNPDRGARLRAIFDEIRWTS

SEQ ID NO: 5702 - protein, 509 aa, unidentified
  source 1..509: note = Related to SZZH01000005.1; note = Nakamurella flava
MSDTPDPGPPPRRSGDDPGGLVRRGGPPRPPSGGPPAPPIRPRRKRPRGRPSPFREDRPGRPDALVDAIAGALLADADDWTASGLIGRVAVVFAGPHDWVPRLVEQVLELYPRPPADRPRELQAVVGVLLNDLLDPAPDDDGDEPTTEIRPVPRPVHWPVASTRTVRRPFATPPLDDAGDLAALLGVDLVQLTALADTRLRGRRARSEQIANYRYQWLDRPSGPRLLEAPRPRLLSAQRVVLHELLDLIPTHPAVHGFVSGRSVVTGAREHVGAETVLTLDLEHFFAAVTAGRIWGVLRSAGYPEPVAHLLAGLTTTATPVRVLTAMPPGPDPGRQFRLRRRLAVPHLPQGAPTSPALANLVAFTLDRRLAAYAAAVGLKYTRYADDLTFSGPFRQRAHVRSFARAVGRIVADERFRINEAKTRWRGRHERQTVTGVVVNEHPAIARDEVDRLRAVLHDCRRSGPAAANRHGHPDFRAHLLGRISWVASVHPARGARLREQFDGIDWTA

SEQ ID NO: 5703 - protein, 444 aa, unidentified
  source 1..444: note = Related to NZ_JAERWK010000005.1; note = Nakamurella leprariae
MRSEHAVALADALLTGPWDAGRMVARARLVFAPVPVELAHVVDVVLAAHPTPPVDAPRSLQHLLLGLPLSAPVPVVAEGAPLLPTPRIRVVRRLLFTTSMVGSRFPLPRVDDVAALAERLGLTVGELDWFGDRRGWQRREPRSVLQHYRFRWLSRPGRTPRLLEAPRPRLKALQRQVLDELLAPVAVHPAVHGFVAGRSVLTGAAVHAGRDTVITLDLEQFFAGLTASRVAGVLRSAGYPEAVSWALTTLVCSTVPMAVLRAMPGAEAGGERFRLRRRLAAPHLPQGAPTSPHLANLAAFGMDRRLTALARRFGADYTRYADDLTFSGAPSLGRAADRLIGTVARIATAEGFSINPAKTRVRRAWQRQRVTGVVVNDRPAVARDEVDALRATLFNCVRFGPVSQNRSGVQDFRAHLLGRIAWVASTDARRGERLRALADRIDWN

SEQ ID NO: 5704 - protein, 511 aa, unidentified
  source 1..511: note = Related to NZ_JAERWL010000005.1; note = Nakamurella flavida
MAGRSFPRPHARPALVAAASDALLAGPWTAAAMLARLAESIDPVGPWGADLVGAVLAAHPFPPADAPREFMVFIDLALPPDVGVTTWQSVLVPAGEPTGAGHRADEQDEDEQDEDDGEDDDEEDDEEDGGGAFTGAWPALFEPVPGPVVVRRLAASTAMGPRRWPVPAVDYIAALASRLALTTGELLWFADTRGFQRRDTRSELRHYRFAWVERPGRVPRLLEAPRPRLRSIQRRILDGLLAPLPMHPAAHGVTGRSAITGARVHEDAAVVLTMDLESFFSAVTAGRVYGVLRSAGYPEPVAHLLAGVCTLRTPVDVRRRMPTGAAATTSAAWRLGRRLDVPHLPQGSPTSPALANLVAFTLDRRLTDYAARAGWRYTRYADDLTFSLPGGGTGGARAGRAALRLAEAVTGMVASAGFRVNEAKTRIRGAHQRQLVTGLVVNASAAVPRTEYDRLRAVLHRCGTDGPAAQADDHLRFREHLQGRIAYVAASHPGRGARLLAAFDAITWPDD

SEQ ID NO: 5705 - protein, 442 aa, unidentified
  source 1..442: note = Related to NZ_LT629799.1; note = Microlunatus sagamiharensis
MTHDPDEGLARGLAWAFLAAETWTRPALVGSAATALGRRPRWLGPVVDVVLQHHRSAPTDRPYALSRFLVRETTLLEHAARARRGRALRIVTVPTVTAATGRRRWPVPDVADLPSLAGLLELPLDQLVWLADARSQQRRAPDGPLHAYRHRWVERPGAVPRLLEAPTPLLRAVQRRVLERILVWVPTHPAAHGFVRGRSAISHARSHEGADEVVCLDLRAFFASVRVARVDGLFRGVGYPEAVAWTLACLCTHQTPVRVLHDMPAGGADDARAWLRAGLRERHLAQGAPTSPALANLACFALDRRLAGLAAATGRAYTRYADDLTFSGAAGGAGRLVSAVRAIVGDEGFALHPAKTRVRSRDQRQVVTGLVVNDRVGVPREYHEQLRAVLHDAGRHGPAVANRVGYPDFRSYLKGRVGWVESVSPQRGRRLRSQLDAIVWPA

SEQ ID NO: 5706 - protein, 443 aa, unidentified
  source 1..443: note = Related to nan
MSRHQDEALARGLAWAFLAAEAWTVPALVDAGATALGRRYRWLPRVAAAVVAAHRSPPTDGPYAFTRFVLQQTSLVEHADRASRRGSVVRVVRVPTLPGAMGVRRWPVPELPDLPALADALELPLDQLVWVADTHGLQRRTPDGPFHVYRHRWVERPGAAPRLLEVPTPLLRAVLRRVLDRILVWVPVHPAVHGFVRGRSAVTHAANHVGAESVVCLDLRAFFASITVNRVNGLFRGLGYPEPVAWALACLCTHPTPRVALAGMPGGGSASSRAWLRAGLRSRHLPQGAPTSPALANLAGFTLDRRLAGLAAATGLTYSRYADDLTFSGPRVDQGRFVSLVGAVVRDEGFALNPPKTRIRSAQQRQEVTGLVVNDRVNVPRAYHDQLRAVLHDATRNGPAAANRQAHPDFRSHLEGRVGWVESVNPVRGRRLRAQLEAVVWPA

SEQ ID NO: 5707 - protein, 443 aa, unidentified
  source 1..443: note = Related to JACHZG010000001.1; note = Microlunatus antarcticus
MSHRPDEGLARGLAWAFLAADRWTAPALVDAAGTALGHRYRWMSALVRQVLENHRFAPTDRPYELSRFLLGRTALVEHAERAAQRGRALRVVRISTVAGVMGERRWPVPEVPDLPALADLLELPLEQLDWVVDARGLSRRTPDGPFHLHRHRWVERPGAVPRLLESPTPLLRAVLRRVLDRVLVWVPVHPAAHGFVRGRSAVTHARTHVGAASVVCLDLRSFFTSITVGRVNGLFRGLGYPEAVAWALACLCTHQTPVAVLGRMPPGGSEAARAWLRSSLRARHLPQGAPTSPALANLACFTLDRRLAGLAATAGLTYSRYADDLTFSGPRGSAHRLVASVGSIVRDEGFDLNPAKTRVRGTGERQEVTGLVVNERLNVTRAYHDQLRAVLHDATRNGPSAANRADHPDFRSHLEGRVGWVESVNPVRGRRLRAQLDAIVWPG

SEQ ID NO: 5708 - protein, 448 aa, unidentified
  source 1..448: note = Related to AP012204.1; note = Microlunatus phosphovorus
MVMRIDPDEGIARGLAWALLAAAEWDKAALTSALGHALGRRHRWIPKVVTEVLAAYPRAPIDRPHELTGFLRTGTSLVHSLARARRQGRAVRLQHIPMVTGTMGLRHWPVPEIDDLGGLALLLELPLEQLIWAADTQGRQRATRSGPLHLYRHTWRPRPGAAPRLLESPTPLLRAVLRRVLDRILVWVPVHPAAHGFVPGRSAPSNARAHVGADVVICLDLRTFFTSITAARVNGLFRVMGYPEPVAWTLAALCTHQTPAHVLAAMPAGGDSTVRHRQRAELRVRHLPQGSPTSPALANLAAHGLDRRLAGLADRLGLTYTRYADDLTFSGSLGNGIGVPRLVGVIGEIVRNEGFVLNTSKTRVRHTGERHEITGLVTNQQLSVPRAYHDQLRAVLHDAVMHGPAVANRAGLPNFRDHLAGRVGWVESVNPVRGRRLRAQFDAIAWPD

SEQ ID NO: 5709 - protein, 448 aa, unidentified
  source 1..448: note = Related to LT629749.1; note = Friedmanniella luteola
MPVKRRDPTAHVARALAWSFLAAPDWTEAALRRSAWVTLGRRHRWVSALAGSAVATYRTAPLGRPHELAGLLAGSAVLTTALHRAARRGTPVRVRVLPTTPAAMGRRRWPVPEVDDGPALARLLQVPDEQLSWLADVQGRQRRTPAGPHHLYRYRWVARPGTVPRLLEAPTPLLRHVLRRLLDEVLVWVPAHPAAHGFVRGRSVLSHARRHVGADLVLGLDLRHFFAAVTAARVAGLWTLLGYPEGVVTLLTGLTTHRTPVHVLTAMPPGGDVSGRHLLRARLRAAHLPQGAASSPALANLACFTLDHRLSGYAAALGATYSRYADDLTFSGPRDLPAARLVRSVTTVVAEEGFAVNPTKTRVQRSSARQQVTGLVVNAGLGIPREDEDRLRAVLHDAVRRGPQAANRDGVPDFRAHLEGRVGWVTSVNPVRGARLRRQLEAVVWPPR

SEQ ID NO: 5710 - protein, 446 aa, unidentified
  source 1..446: note = Related to JAGIOB010000001.1; note = Microlunatus capsulatus
MRRADPVAHVARALAWAFLAAPAWTEPELRRSAWTTLGRRHRWVTPLVRLALVVHRTAPTGQPAELARLLAGTDELPAALHRAARRGAPVRVRVVPAVPARTASPRWPVPEVAGAPDLARLLGVPLEQLDWLADAQGRQRRTPAGPLHLYRYRWVERPGAVPRLLEAPTPLLRHVLRRLLDEVLVWVPAHPAAHGFVRGRSALSHARLHVGAAQVVSLDLRHFFAAVTAARVRGLWTLVGYPEGVTALLTGLTTHRTPVHVLTAMPPGGDASARHLLRARLRAPHLPQGAASSPALANLACARLDRRLAGYAAALGATYSRYADDLTISGPADLAAPRLVRAVSAVVVEEGFAVNPAKTRVQRSSARQQVTGVVVNARTSVPREEEDRLRAVLHDAVRNGPDAANRAAVPDFRAHLEGRVGWVSAVNPVRGARLRRQLDAVVWPGR

SEQ ID NO: 5711 - protein, 468 aa, unidentified
  source 1..468: note = Related to JACGWT010000003.1; note = Microlunatus kandeliicorticis
MPVHTRRDGDDGTRRESHRPRGVPVTLAPDDGLARGIAWGLLAAEDWTADALQAAVTRTLGRPCEWAGRVVGPVLAAYREPPTDRPDELARFLLLATPLTEIAHAVRQEHEPLRVRVLAPVPGRMGRRRWPVPDLPDLVALARLLEVPLDQLDWLADTARLQRRSPPGPYQAFEHRWRSRPHAAPRLLEAPGPLLRAVQRRILDRILAWVPVHPAAHGFVGGRSAITNAARHVGAPTVVALDLRSFFSTITAARVGGLYRTMGLPEAVVRVLTGLSTHATPGWVLSGMPAGGDPSERHRLRATLRSRHLPQGSPTSPALANLACFSLDHRLQRYAETAGLVYSRYADDLTFSGPVARPAALLATVSTIIVAEGFVVHPGKSRVRRTGERQTVTGIVTNRRPGIARSDRDRLRAVLHDARRHGPEAANRERHPHFREHLHGRITWVESVSPVQGRRLRAQYEAIVWPER

SEQ ID NO: 5712 - protein, 448 aa, unidentified
  source 1..448: note = Related to NZ_LT629772.1; note = Microlunatus soli
MSSKTVQDDLARRLGYRMLAVEWDRDHLLIGCRRALGSAPPWLGPVIDAVLQQYPVKPSGRHHELTALIASTEEFQDAVFVSRSGRHWQIRSLPVGDLDPDELRMATSRWPVPTLGTEAALADLLRVDLPVLLWLADPKRMLRRRPDGGLQPYRYRWLERHGRTPRLLEIPGPLLRHVQRRLLERVIDRIPPHPAAYGFVRGGGPHRNAAQHVGADWVINFDLRSFFAGVRTGRVAGIFTAAGYPASVVALLAGLVSRPTPEFVLRGMPDGGDPSDRALLRARLRAAHLPQGSPSSPAIANLVAFNLDCRLNRLAKNAGFGYTRYADDLTFSGSGPRPAAGFVPLVRKIIIDEGFAPNDRKLRIRGRGQRQLVTGIVVNQHTNLRRRDHDRLRAVLHDAIRNGPDAANRDHHPDFRAHLEGRVGWAEQLNPTRGARLRRQLELISWPS

SEQ ID NO: 5713 - protein, 447 aa, unidentified
  source 1..447: note = Related to NZ_BMMZ01000006.1; note = Microlunatus endophyticus
MTPEEDLALRLAYVFLSTSWRRADLTDAAIASLGGEPAWLGGLVSRLLGSIRERPADRPYDLARVIMGQQVYLDGLDRDHHQDTVWRVRSFPVGGLVAETERMAVPDWPVPRLGTERALADLLRVDLPVLLWLADPRGYLRRADDGLQPYRYRWIRRPGRTPRLIEAPGPLLRYVQRRLLDRVLVGIPVHPAAYGFARGRNAVRAARRHVGSDWVINFDLVSFFNGIRESRVRGIVRVAGYPEPVARLMAAIMTTATPVRTLQRMPDDGPDDDRAVLRSVLRTAHLPQGAPTSPAIANLACYRLDVRLAGLAESLGLRYTRYADDLAFSGHGTRPGRRFFRLVTEIVTDDGYCLNDHKQRLQTRRGRQTVTGIVVNDRANLRRSEYDRLRAVLHDAMINGPEHANRNGYPAFREHLDGRIGWVEQLNPARGARLRRQFELITWPEDR

SEQ ID NO: 5714 - protein, 443 aa, unidentified
  source 1..443: note = Related to JADJPO010000003.1; note = Kineosporiaceae bacterium
MRLSDSTLARALAMAFLDGDWEFDPLLDRAAQVLGGRRRWVRRLVKDLLAAFPRTPRDAPSALAGWIGAHPSLIEAAARARDAARPLRVAAIHPGHTEMGRRRWPVATLDDLADLAELLDLDQAHLAWFADQQHRARRAPDGPLHHYRRRWISRSGRTPRLLEVPLPRLRALQRTLTHEVLAHIPTHPAAHGFVRGRGAVTGAQQHVGRDAVLSLDLSAFFASVSAARVRAIWRAAGYPEPVADALTGVVTTLAPVRMLTAMPPGGPPEARALLRAWLRASHLPQGAPTSPALANLAAHRLDARLAGYAAAAGWCYTRYADDLTISGGPEMVRRTDAVVAALSRIVTEEGFRVNPTKTRLRTASQRQLVTGIVVNRRPGPGRSEYDQLKALLHNASRTGGQAQNRDGHPAFAAHVRGRIAWVAQLHPERGARLLATWHEVDWS

SEQ ID NO: 5715 - protein, 482 aa, unidentified
  source 1..482: note = Related to JAHBAY010000005.1; note = Kineosporia corallincola
MPRSAPRCYARALHDRSHPDATVMTSDRVRTLARGLGNAFLGAEAWATRPMAEAAVSVVGVGGRRRWPRKLAREVLAAYPRPPADRPRELARFIENSPVLWAALNRSAPPGRAPVLRARRIPPTPVRMADRRPWPVPELHDLADLAALLDLDPAHLDWFADVKGLQRRAAPGPLHHYRYRWTTPGSGRPRLLEAPRPRLRSVQRTLLDEVLALIPVHPAAHGFVPGRSAVTGARRHTGAAVVISLDLAAFFAHLNGGRVYGVFRTAGYAQPVAHALTGLCVHRTPVAVIAAMPPARPGSTPEAVSARPGLRRLLAGAHLPQGAPTSPALANLCVMALDRRLSGLAAATGLTYTRYADDLTFSGDLEPRAAQRVTEAVGRIVRSEGLALQPAKTRVRERSRRQEVTGIVVNEHSNLPRTEYDRLRAILHNAARSDPAVQNREQHADFRAHLLGRIAWATQLNPARGQKLRAQFERIVWPGEQP

SEQ ID NO: 5716 - protein, 447 aa, unidentified
  source 1..447: note = Related to NZ_JAJOMB010000003.1; note = Kineosporia babensis
MSDPRTRVLARALGNAFLTAPEWALRPLTDNAATVLGGRRRWTRRLAREVLDAYPRPPADRPRELAAFIQASPILFTAVLRSVETGRPLRVIRMPPAPVQMNTRRPWPVPKIDSIQDLARLLDLETAQLDWFADVKGLQRRAAPGPLHHYRYAWASTASKRPRLLEAPLPRLRSRQRTLLEQILARIPTHPAAHGFVPGRSAVTGAEPHAGAAVVIGLDLAAFFASIQVGQVYGIFRAAGYAEPVAHVLTGLCTTRTPVRVISNMPATSDVESRVRLRRLLAGGHLPQGAPTSPALANLCALGLDRRLNGLAAAVGMTYTRYADDLTFSAGEEVNARRLITAVDEIVRSEGFALQSAKTRIRRDFQRQEVTGIVVNAHPNLNRREYDELKAILHNALRHGPEGQNRAGHRDFRAHLLGRIAWVAQLNPERGRKLRETFEAITWPSLS

SEQ ID NO: 5717 - protein, 453 aa, unidentified
  source 1..453: note = Related to JAANNO010000010.1; note = Motilibacter aurantiacus
MSRRTTREAGLANALALSFLAGAWSVDGLEQRGTTVLGDRPRWLRRLVRLVTDAYPRPPVDRPRELAAYVLAAPPLRRAAYSAARRGHRLPAPRAWLAVPTAMAPTRMAPSRWQVPAIDDVGALADLLDLEMGQLEWLADARGLLRRAPQGPLHHYRYRWQPKAGGARLLEAPLPRLRRLQRTLLDTVLARVPVHPAAHGYVPGRSAVTNAAAHVGAAVVVSLDLEAFFSSLSAGRAYGVLRTAGYPEPVAHLLTALCTNAVPVHVLRGLPDSVPVDVRFRLRRALATPHLPQGAPTSPTLANLCAHALDRRLAGYAAAAGVTYTRYADDLTFSGGPGLLRAAPALVTAVRRIAAAEGHRVNVAKTRVRSSAQRQVVTGLVVNERLNLPRGEYDRLKAVVHDAVRHGPAAANRHGHRDFRAHLEGRVAWLEAVHPERGARLRAQLARVAWPVS

SEQ ID NO: 5718 - protein, 443 aa, unidentified
  source 1..443: note = Related to NZ_LT629710.1; note = Nakamurella panacisegetis
MRARDRLAAALADGMLAGDWAGAPMRAQGALVLGERHAWIRRLVREVLEFYPEPPADRPRELARLIGRTRTMEELERRARRRRRRLPIPQHRVTTPTTTVRRPFPVVSINDATALAECLGLSVPDLLWFADTKGLQRRAASVGLHHYRSTWVGTRSGSRLLEAPRPRLKEVQRQILQQLLAPIPVHEAAHGFVAGRSAVTGARPHVDAATVISLDLESFFSSVSGRRIYGLFRMAGFPEPVAHLLTGLCTQATPVDVLRRMPSGHPAAFRLRRKLAEPHLPQGAPTSPHLANLAAFGLDRRLAAYASRIGARYTRYADDLTFSGPDLRRRSRGVVAAVARIVAEEGFALNTTKTRVRGQDDRQTVTGVVVNRHPTVSRAEYDTLRAILHNCVRFGPESQNRLLHTDFRSHLRGRVAWVAALDPERGRRLLATYSQIDFSPSGT

SEQ ID NO: 5719 - protein, 441 aa, unidentified
  source 1..441: note = Related to NZ_CP060298.1; note = Nakamurella sp.
MPDGRARLAIALADAFLAGAWTSDGLRTQGQLVLGARHAWLRRLAREVIKAYPEPPSDRPRELFAFVLQTQAMAQVERRAARPGGGFPLPLHRLTAPTSMIRHPFPVTSLDHAGDLAALLGVSMEELLWFGDTNGLQRRARSDRLQHYRSTWVPSVSGGRLLEAPLSRLKAIQRQILAQILTPIPIHDAAHGFVVGRSARTGAAPHVGTGLLISLDLESFFASITGSRIYGVLRAAGYPEPVAHLLTGLCATATPVRVLAEMPGTAAPSAFRLRRRLAEPHLPQGAPTSPQLANLCAFAIDRRLSAYASAIGAVYTRYADDLTFSGDTLVVRQRGVVAAVARIVAEEGFRLHIDKTRTRGRDARQQVTGVVVNASTTVPRRDYDTLRAILHNCVTHGPSTQNRVEHNDFRAHLRGRISWVASLDAGRGRKLLATFEQIDWT

SEQ ID NO: 5720 - protein, 441 aa, unidentified
  source 1..441: note = Related to JAAALN010000029.1; note = Kineococcus siccus
MSEALVASALAAALLDGPWDAAALTTRATAALGGRRRAWVAGVVADVLAAHPRPPLDAPRSFTTELARHPALARAVHAAERRGRPLRPAHLEPVPSSMGRRRWPVPVLDGVADLAALLDLDLAELDWFADPRGLQRRASGTALHHYTSRWVAKRGTPRLIEAPKPRLRHLQRIVLHAVLDVVDVHDLAHGFVPGRSAVTGARRHTGADVVVRMDLSAFFASVGAARVYGEFRRLGYPEAVAHLLTGLCTHRTPLTVLRTLPAGGRAEDRFRLRQWLSAAHLPQGAPTSPALANLVAGPLDRRLAGLADSMGLRCTRYADDVTFSGGPQLRSGAGRLVRCVTAIAAEEGFVVNGDKTRVRGAEQRQVVTGIVVNERTSVPRDEFDRLKALLHNAVRSGPALQNRRGHPDFRAHLAGRVSWVEAVSPAKGRRLRATYDRIAWG

SEQ ID NO: 5721 - protein, 439 aa, unidentified
  source 1..439: note = Related to JALDAT010000072.1; note = Paenibacillus sp.
MSAAVAAALAAAFLDAPWEAPQLAAAGRWALGLRRAAWLDRLAADVVAQHPRPPCDAPRALTALLVAHPELASAQAVARRRGRPLRVRHLVAVPAAMGRARWPVPPLGGAADLAALLEVSPGELDWFADVRGWQRRAEGTALHHYRASWVAKRGAPRLLEAPKPRLRALQRRLLREVLGAVPAPPVVHGFVPGRSAVTGAREHCGAAVVVRVDLTAFFASVDAARTYRAFRSLGYPEAVAHLLTGLTTHATPARDLRGMPPGGDADERFALRHRLAAAHLPQGAPTSPALANLCARSLDRRLAGLAAALGARVTRYADDVTFSGGEELAAGAQRLVRCVTRVAADEGFTVNPAKTTVRGRGERQLVTGVVVNERPNPVRSEFDRLKAVLHRCAVHGPASVEAPGGVDLRSHLAGRVGWVEALSPSRGRRLRESFDAIAW

SEQ ID NO: 5722 - protein, 439 aa, unidentified
  source 1..439: note = Related to JACCBB010000001.1; note = Kineococcus aurantiacus
MAEPDAVAAALAAAFLDGPWTADALTARAREAVGVPRARWVARLAGEVTGRFGTPPLDAPRELRAAVAGSPAYAGARDAARRAGRPLRVAHLATGTTRMGRNRFSVPPLDTVDDLAAFCGLDPAQLDWFADVHRFQVRAGGSALHHYRARWVAKRGAPRLLEAPKPRLKAVQRKVLHEVLDRFPVHDAAHGFVPGRSPVTGAWDHVLARTVVRFDLEGFFASVPAARVHGTFRSTGYPEPVAHLLTGLVTHVTPLRDLRAMPDGGSAEARHRLRRNLSHAHLPQGAPTSPALANLCARGLDARLDGLARVLGATFTRYADDLTFSSTTGLDPVRLHRAVRAVVADEGFTLNPAKTRVRGAGSRQVVTGLVVNERPNVPREEFDRLKAVLHNCVRHGPTSQDREGHRDFRAHLLARVARVESVNPAKGRRLRRSFEQIAW

SEQ ID NO: 5723 - protein, 448 aa, unidentified
  source 1..448: note = Related to JAFAOY010000834.1; note = Solirubrobacterales bacterium
MYDARGRAFLGRCLADAFLAGVWNERALVDRAGRALDRRPRWVRAVAREVLAAYPRPPSDRPRELARLIELALRERPAPEGDSEPPRVRRWLVPEPAMGRRRWPVPEIASLGALAGFLQVSDGELAWLADARGLERTVENERLRHYRYGALPRPGRPVRVIERPKHRLKSIQRRVLHELLDWIPVHEAAHGFTRGRSVRTHARAHTGRFVVVRFDLEDFFASVRAARVYGIFRTAGYPESVAYALTVLTTNVVPATVWHELPRPVAPRLLGAHHHLGRRLATPHLPQGAPTSPALANLAAFRLDRRLDGLAKSLEISYSRYADDLTFSGDARLVRAAATVRRAVTQIAREEGFTVNESKSMLATRAGRQRVCGVVVNEHLNTPRREYDVLRAILHNSSRYGPQTQNRAAIPNFRAHLLGRISWIESVNPRRGDKLRRHFASITWQEDS

SEQ ID NO: 5724 - protein, 448 aa, unidentified
  source 1..448: note = Related to JAFARL010000184.1; note = Solirubrobacterales bacterium
MYDVRARAYLARCLADAFLAGVWTERAMVDRAGRALDPRPRWVRAVAREVLAVYHRPPADRPRELARFIGLVLADRSAPEDAPNPPQVRRWLIPEPAMGRRRWPVPEIASVGDLASFLGVSDGELAWLADARGLERMVKDERLRHYRYATLPRAGRPVRVIERPKHRLKAIQRRLLHEVLDWIPAHEASHGFTRGRSVRTHAGGHTGRFVVVRLDLADFFASITAGRVYGIFRTAGYPESVAHALTALMTNVIPAVLWHTLPRPAIPRQIAAHHHLGRQLATPHLPQGAPTSPALANLAAFRLDRRLTGLAGSLEISYSRYADDLTFSGPTQLVRRAGTLRRAVAQIAREEGFTVNDDKSMLATRAGRQRVCGVVVNQHLNVPRREYDLLKAVLHNSAIHGPQTQNREGVVNFEAHLLGRITWVESLNPTRGDKLRRQFAKIVWHDDP

SEQ ID NO: 5725 - protein, 449 aa, unidentified
  source 1..449: note = Thermoleophilaceae bacterium; note = Related to JACCUP010000282.1
MLSAPMYDHLTRASLSRCLADAFLAGAWNENRLAGRAGQALAPRRGWIGPLVREVLAVYHRPPADRPRELTRFIALQLEQMPPSDLDPPRVRRWFVAELAMGRRRWPVPDLASAGALAGWLEVAPGHLDWLADARGLERTTATERLRNYRYSWLPRAAGPPRLIERPKARLKAIQRRLLHEILDWIPAHESAHGFTRGRSVRSHAAAHTGRYVVVGLDLKDFFASVVAGRVFGIFRTAGYPEPVAHVLTALTTNAVPVEEWASVPRPRDPGLVGAHHRLGRRLATPHLPQGAPTSPALANLVAFALDRRLAALARATGVTYTRYADDLTFSGPASLLRGADRFRSSVADIAREEGFRVNERKSTLMTRAGRQRVCGVVVNQRLNVARTEYDELKAILHNAARSGPSSQNRHAVADFRAHLLGRIAWVESLHPGRGERLRARFEVIDWDR

SEQ ID NO: 5726 - protein, 450 aa, unidentified
  source 1..450: note = Solirubrobacterales bacterium; note = Related to JACCUX010000400.1
MDRRTRAYRSLSPCLADAFLAGPWDPAALATRAGLVLEPRPPWIGLLVRNVLAAYERRPADRPRELARYIALQLERVDADTAGPRPRVRRWLLAELAMVRRPWPVPELASVGAVANHLEVSDRHLAWLADVRGLERTGSDEKLRHYRYGWLPRHGGPPRVIERPKARLKSIQRRVLHEILDWIPAHDAAHGFTRGRSARSNAAAHTRRPVVMALDLEDFFASVRAPRVYGIFRTAGYPEPVAHTLTGLCTNAVPIEEWAAVPHPTASPLAQAHHRLGRRLATPHLPQGAPTSPALANLAAFTLDRRLTGLALALDATYTRYADDLTFSGSSRLLDRGGQIRATIATIAREEGFAVNTRKSVVTTRAARQQVCGIVVNDRLNVTRHEYDELKAIIHNAARRGPSGENRAGLSDFRAHLLGRIAWIESLHPARGARLRSQFTRIVWDRQGAA

SEQ ID NO: 5727 - protein, 476 aa, unidentified
  source 1..476: note = Related to NZ_KI912613.1; note = Patulibacter minatonensis
MRRGPAPLGTPPGDLAQAAAAALLAGAWTERAMLRRLQQAVRPLGPRLPARLVASVLALHRTPPADAPRALAQEIDDLVRGHAPRGGWPPNARVRRRYAPPTAMRGARWPVAPLPTVAALGRLVGERDPGALAWLADVRGLEREVPDERLRAYRYTHHPRTGGPPRVLERPKARLKEVQRTLLREVLAPIPPHDAACGFVAGRSVLDHAARHVGRTVVVQLDLEDFFAQVTAGRVFGILRAAGYPEPVAHAIVGLTTNVVPYGFWARIPRPDGPREIERHHRLGRRLATPHLPQGAPTSPALANLAAFRLDRRLDGLARSLGLTYSRYADDLALSGGRHLARRAYELERTIAAIAADEGFRVNPQKTRVRAREGRQTVCGIVVNERPAVARRDVDRLRALLHEAEVAGPRAADRGGMGPAFEAHVRGRVAWVAQVHPARGARLREQLRRVDWSALRDTGDAGVHRSSPPGDRPFTS

SEQ ID NO: 5728 - protein, 456 aa, unidentified
  source 1..456: note = Related to NZ_AUKG01000002.1; note = Conexibacter woesei
MPPPPDQPQPLRSDAAAALADAFLAGAWTRPGMIQRGHDALGVEAVPGLRWLRREVDRVLAAYAHPPRDRPRELAAFVAATIDARRAAPFPPKHRLVAPGAMAGRRPWPAIPELDTAGDLADWLALSHGELAWFADVQSRERRADDRRLRHYTYAWSARPGAPVRFLEQPKARLKAIQRRILHKLLVHVPAHDAAYGFVPGRDVLQHARRHAGAAAVLRFDVRDFFVSLPAGRVYGIFRLAGYPEAVAHALTGLTTNAVPPGAWADVPAPADPALHRQHVLLGRRLAAPHLPQGAPTSPLLANLCAFTLDRRMAALAVKLGATYTRYADDLVLSGDRALARHAQRTTQTVRAIVRGQGLRLNETKTTIMVAAQRQRVTGIVVNDHPNIARDEYDRLRAILHNAARAADPHAENRAHVPDFRAHLRGRIAWVEHVNPQRGAKLRARFEQIAWPASPR

SEQ ID NO: 5729 - protein, 444 aa, unidentified
  source 1..444: note = Solirubrobacteraceae bacterium; note = Related to JAEMSV010000041.1
MTSDLQTVAGALASAFLRGVWNERRLVARGERMIGQRPVWLTPLVRRVLEGYHRPPADRPRELQAFIRVSLRDITGRARLAKRVEMRHWSPTPTVMVDRRWRVPILHTVGDLGALLGLDPGALMWLADARGLERFAPEERLRNYRYTWVPRTTGAPRLLEAPKARLKVAQRDVLRRILCWVPPHDAAYGFIRGRSARDHAARHTGREVVLSFDLMDFFAGVPARRVYGIYRLAGYPEPVAHCLTALCTNQIPRTVSNDILGRPDPAYALLRRRLGTPHLPQGAPTSPALANLVAHALDRRLTGLAAALGGTYTRYADDLVISGDAQLARRIGVAQRAVAEIAADEGFVIRPAKTRRMSRADRQAVCGIVVNARTNIPRRDYDRLKAILHDAVRHGPDAANRDGIADFRAHLAGRVAWVTSLNPDRGAKLRTTFDAIVWDPRPQT

SEQ ID NO: 5730 - protein, 419 aa, unidentified
  source 1..419: note = Related to nan
MLTRREVSEVLAVAFLSGEWHFEELQRRARRALGRRAWLRPLAIEVVDAYRRPPLDRRRELVAYIEHAIPRRVRLPPRILRQPTFHPAMGFARWPVPRIDTVGDLAAFLGLEVGELEWFADVRGLERVVDDERLRHYRYTRLPRASGPPRVLEAPKPRLKALQRRLLREVLAFVPVHPAAHGFVGGRSARTHAATHVGRRVVVRVDLEDFFAGVTAARVFGIFRACGYPEGVAHVLTGLCTNAVPAGESVAGHWRLSRRLAAPHLPQGAPTSPALANLAAFALDRRLSGLAAAVGARYSRYADDLVFSSDTHLRTPVAAIGGIARDEGFQVNAGKTRVMGRGRRQTVTGVVVNAHPNVPRVEYERLKATLHRAAHDGPAGLDPTVLLGRIAWVESLNPARGAKLRTAFGHIAWTPLENG

SEQ ID NO: 5731 - protein, 403 aa, unidentified
  source 1..403: note = Related to NZ_RBIL01000001.1; note = Solirubrobacter pauli
MASSLSRRETARVLAGSFLGGEWELEAMAKRAGRALGRRVWHRRVAERTLRAYRHPPRDRPRELADFVFTLLDDVRLPPRLLREPVFHTEMAPGRWPVPRIDTLGDLADRLELEPGQLGWLADVRGLERTSTGKLRNYTYVRVPRRSGPPRVLERPKARLKEIQRWILRELLAWIPTHDAAHGFVKGRSAHTHAALHVGRKVVVRLDLEDFFAAVSAARVYGVFRTAGYPEAVAHTLTGLCTNVVPADESVPGHFRLARRLATPHLPQGAPTSPALANLAAHALDRRLTGLAREIGATYSRYADDLVLSADHHLRTPHAAVTELARDEGFTVNRGKTRTMGRGSRQVVTGIVVNAHPNVPRAEYDRLKAIIHRGDYDREHVLGRIAWIAAINPARAAKLRSSM

SEQ ID NO: 5732 - protein, 461 aa, unidentified
  source 1..461: note = Related to QHCD01000081.1; note = Pseudonocardiales bacterium
MNRDAAGHRATAADVRALIPVLRPSLRSVAGSLADALLDGEWEADAMVSRVTAALDRPGRWVRQLVRITRLSFPVAPHDSPESLRRVILAGPPLPQVAAADALAGRPLPTLARRPLPARVVALQAGLPRWDGVGDLAAYLGLTVGELAWFADTRGYEARVRAETLRHYRYRLLQKRIGGCRLIESPKWQLREIQRRILHEVLDQLPVHDAAHGFRPGRSVIGYVEPHAGRRVVIHLDLRDFFARVGAGRVWSVFRWAGYPDAVAHVLTGLCTNVSPTAVRSDVRRTGALRLAAACGTVHLPAGAPTSPALANLCAYALDRRLAGLARRVSMRYTRYADDLAFSGGRSLLWGTDALIDRIAAIAAAEGFPVNSQKTAVLTASRRQRLAGVVVNDHPNLDRREFDALRATLHNCVHSGPSSQNRGSHQDFRAHLTGRVSWACLLNPAKGARLERLLEQIDWAR

SEQ ID NO: 5733 - protein, 454 aa, unidentified
  source 1..454: note = Related to CADCTB010000222.1; note = Acidimicrobiales bacterium
MTRESAAVTVARGLAHAFLAGDWDPPAMASRGREAVETRRVWVRHLADAARHAYPDAPRDRPRELATFLSVCPPLTKAIAAARRRSEEPPTIRNWLVAETAMGPAPWPVANLHTLRDLQDLIGMSTATLNWFADTRGLERTVADERLRHYRYHWAPKRNGGARLIEAPKPVLKHLQRVLLREILEPVPVHPAAHGFRRDRSALSHANGHIQRNVVIRVDLEDFFASVRAGRVYGIFRGCGYPEPVAHVLTALTTNAVPRAVSAQTGAPSVVESTAAFRRLAGHLAHPHLPQGAPTSPALANLAAFGLDRRLAGLASAAGLTYTRYADDLAFSSIDPRSEGQNRRLVEWITGIAEDEGFRVNVAKTSVRHAGQRQRLAGVVVNERANVERRQYDLLKATLHNAARHGPAGQNRTGHPAFRDHLRGRISWVNQLNPARGERLLATFAQIDWDSADR

SEQ ID NO: 5734 - protein, 324 aa, unidentified
  source 1..324: note = Related to JAFMRN010000002.1; note = Solirubrobacterales bacterium
MPAWNVAAIDSLPELAERLELSLEQLQWLADVRGLERSVNSERLRNDRYRLLPRASGVPRVLEIPKGRLKEVQRWVLREILNQIPTHPAAHGFVRGSSVRTHAEVHSGQAMVLGLDLKDFFASVRRAQVKAIFRAAGFETEVARTLAGLCTNTTPRHVGASRLLATPHLPQGAPSSPALANLAAFALDRRLSGLAYAHDLLYSRYADDLTFSGPMPGRGRRRFLVALATEIARDEGFAINERKTAMHPAGGRQQVCGVVVNARPNVPRRDYDRLKATLHNLAAAGPVDRSEAAALAGRIAWVASLNPARGAKLREKYAKIEWSE

SEQ ID NO: 5735 - protein, 440 aa, unidentified
  source 1..440: note = Related to NZ_PPDK01000002.1; note = Euzebya tangerina
MRIIVAAFLDGSWEPTAMAARAHHDLGLLTVRREIDFGGTEPYVWLHRAADLVADTFVAPPRSELRAMRVLVAEHAAPAILPLLDHPIAGPHTGTALVSSAMSEPRWPVVHLDTVGDVAAALGLLPTQLSWFADVASLEQSVTDERLRHYRYRWVAKSGSGQRLVEAPKQTLRRVQRWVLRRVLHNIPVHPATHGFVPGRSVHTYVGPHVGRRVVVSLDLRNFFTSVAAGRVFGIFRVAGYADSVAHTLTGLMTNAVPADILRGHPDAPRALRFPHLPQGAPTSPALANLAAFSLDRRLSGLATAMDLRYTRYADDLAFSSAGGLSRRARRRLVVTVEEIARAEGFDVNRAKTRAATAGRQQRLAGRVVNAVDNAPRRDYDRLRAVLHDASINGPVAANREGHPAFEAHLRGRIHWVASDSPARQRRLWQLFDQIDWSEG

SEQ ID NO: 5736 - protein, 436 aa, unidentified
  source 1..436: note = Related to NZ_JACXYY010000008.1; note = Nocardioides hwasunensis
MRPELARALAAGFLAGEWTRAGLTASGAVVLGRRPRWLAPLVRQTLDLYPRPPGDRPRELATNLARLPAAEKAALAGPQVHPVAETHMIANRWRLPELDRLADLASYLRVTDGELDWFADPRHLARLTVQPPLQHYRVSHRVAASGGIRVLEAPKPRLRAIQRRLLDELASRIPPHDAARGFRPGGSVRAYAAPHAGRSVVLRMDLEAFFASVTVSRVYGIWRTAGYPEPVAHALAGLVTSVLPLASWRAIPTPVDEGLLDAHWRLGRRLARPHLPQGAPTSPAMANLAAYHLDVRLSALARSWGGRYTRYADDLAFSGATGWGTGTSRLLDAVERIVVDEGFRLNPRKTGVMPRAGRQSLGGLVVNERPRVSRADVDRLKAILHNCRVHGPSSQNRDDHPAFEEHLRGRVAWVAQHDRLRGARLLAMHAEIDWSR

SEQ ID NO: 5737 - protein, 436 aa, unidentified
  source 1..436: note = Related to NZ_FNRT01000002.1; note = Nocardioides exalbidus
MRPELARALAAGFVAGEWTRPGLEASGAVVLGRRPRWLAPLVRQVLELYPRAPVDRPRELATNIASRPAAAKALRARAVVLPIAETRMLANRWRLPVLDDLGDLAAFLGTSPAELDWFADPRRLARLTKQAPLQHYRVSHLVAASGGIRVLEAPKPRLKAIQRRLLHEVASLVPPHDAARGFRPGGSVRSYAAPHAGRSVVLHLDLEAFFASVTVSRVYGIWRSAGYPEPVAHALAGLVTAVLPLAAWRAIPAPADDGLLDAHWRLGRRLAAPHLPQGAPTSPAMANLAAFGLDVRLTALARSWGGRYTRYADDLAFSGERGWGTGTSRLIDAVERIVVDEGFRLNPRKTGVMPRAGRQALAGLVVNERPRVSRRDVDLLRAILHNCLVHGPSSQNRDDLPAFEEHLRGRIAWVAQHDTLRGARLLAVHREIDWSR

SEQ ID NO: 5738 - protein, 349 aa, unidentified
  source 1..349: note = Related to NZ_JACJGN010000045.1; note = Nocardioides lijunqiniae
MLTNRWRLPELHDPADLAELVGITTSELDWFADPRRLARSAGDVPLQHYRVGHRTAASGGIRVLEAPKPRLRRIQRQILDEVASLIPPHDAARGFRPGGSVRSYAAPHAGRPVVIRLDLEAFFASVTVARVYGIWRSAGYPEPVAHLLAGLVTSVLPRSAWRGVPRPADERLLDAHWRLGRRLAASHLPQGAPTSPAMANLAAFGLDVRLTALARSWGGRYTRYADDLAFSGAAGWGSGTSRLLDAVETIVRDEGFTLNARKTGVMPRGGRQTLGGLVVNERPRVSRHDVDLLRAILHNCHRHGPSSQNRHDVPAFEEHLRGRIAWVAQHDPVRGARLLAVHESVDWSR

SEQ ID NO: 5739 - protein, 436 aa, unidentified
  source 1..436: note = Related to NZ_CP053660.1; note = Nocardioides sp.
MRADLARALAAGFLAGEWTRPGLVESGSVVLGRRPRWLAPLARQTIDLYPRPPHDRPRELAASISARPAAAKAAGVRPLVQPVSPTRMMTNRWRLPVLDGLGDLADLLGLTSSELDWFADPRHLARTAADGRLQHYLVSHRVAASGGIRVLEAPKRRLKGIQRVLLDEVASLIPPHDAARGFRPGGSVRSYAAPHAGRPVVVRLDLEAFFASVTVSRIYGLWRSAGYPEPVAHCLAGLTTTVLPHAAWRAVPRPADDDLLDAHWRLGRRLAAPHLPQGAPTSPAMANLAAFGLDVRLTALAESWGGRYTRYADDLAFSGARSWGTGTSRLLEVIEEIVRDEGFRLNTRKTGVMPRAGRQALGGLVVNEQPRVARREVDLLRAILHNCRRHGPSTQNRDGVPAYEQHLRGRIAWVAQHDPVRGARLLTEHEAIDWTR

SEQ ID NO: 5740 - protein, 436 aa, unidentified
  source 1..436: note = Related to NZ_JAFBCA010000001.1; note = Nocardioides cavernae
MRSDLARALAAAFLAGEWTQPGLVASGTTVLGRRARWLPPLVRQTLALYPRAPVDRPRELAANLASRPAAAKALRAVPLVRPVVATQMLTNRWRLPVLDDLADVASFLHLSASDLDWFADPRHLARSASDVPLQHYRVSHRVASSGAIRVLEAPKPRLKAVQRRLLHELAALIPPHDAARGFRPGGSVRSYAAPHADRSVVLRLDLEAFFASVTVSRVYGIWRTAGYPEPVAHCLAGLVTSVLPLSAWRAVPTPADDGMLDAHWRLGRRLAAPHLPQGAPTSPAMANLAAFRLDVRLTALARSWGGRYTRYADDLAFSGERGWGTGTSRLIDAIGSIVADEGFRLNARKTGVMPRAGRQTLGGLVVNERPKVARHQVDLLRAILHNCHRHGPSTQNHDDVPAFEEHLRGRIAWVAQHDPVRGRRLQAVHDTIDWSR

SEQ ID NO: 5741 - protein, 436 aa, unidentified
  source 1..436: note = Related to NZ_CP022296.1; note = Nocardioides sp.
MRVDLARALAAGFLDGEWTQQGLLASGTAVLGRRPQWLAPLARQTLALYPRAPVDRPRELATNISSRPAAARARSAAPQVQPVVATRMLGNRWRLPVLDGLGDVADFLGVSASELDWFADPRHLARGTAGVPLQHYRVSHRVAASGAIRVLEAPKARLKVIQRRLLREIASMIPPHDAACGFRPGGSVRAYAAPHADRSVVLRLDLEAFFASVTVSRVYGIWRTAGYPEPVAHCLAGLVTSVLPRSTWRAVPQPRDDRLLDAHWRLGRRLAAPHLPQGAPTSPAMANLAAFRLDVRLTALARSWGGRYTRYADDLAFSGAAGWGSGTSRLIDAVETVVRDEGFRLNPRKTGVMPRAGRQSLGGLVVNDSPRVARHQVDLLRAILHNCHRFGPSTQNRDDVPAFEDHLRGRIAWVAQHDPVRGARLQAVHDAIDWSR

SEQ ID NO: 5742 - protein, 436 aa, unidentified
  source 1..436: note = Related to JABJQY010000002.1; note = Nocardioides sp.
MRDDLARALASGFLAGEWTQDALVASGTVVLGRRHPWLPPLVRRVLTAYPRPPADRPRELAAVIAALPAAARARNAAPVVHPVAETRMLTNRWRLPVLDGLDDVAAFLRLEPSELDWFADPRRLARSASDVPLQHYRVSHRVTPSGAIRVLEAPKPRLKALQRRVLTEVASLIPPHDAATGFRPGGSIRRYTAPHAGRSIVLRLDLEAFFATVSVSRVYGIWRTAGYPEPVAHCLAGLVTCVLPRSAWRAVPRPADERLLDAHWRLGRRLAAPHLPQGAPTSPAMANLAAFRLDVRLSALARSWGGGYTRYADDLAFSGDAGWGTGTSRLLDAVEAIVRDEGFRLNQRKTGVMPRAGRQVLGGLVVNEHPRVARHQVDLLRAILHNCRRFGPSSQNRDDVPAFEDHLRGRIAWVAQHDPVRGARLQAVHDAVDWSR

SEQ ID NO: 5743 - protein, 436 aa, unidentified
  source 1..436: note = Related to NZ_CP087710.1; note = Nocardioides sp.
MSPDLARALAAAFLGGEWTEPGLVASGAGLLGRRPAWLRPLARQTLALYPRPPLDRPRELATNVASRPAAARAGAAAPLAQPVAQTRMVANRWRLPELDTLADLAGFLGLTATELDWFSDPRRLARDASAVPLQHYRISHRPAPSGAIRVLEAPKPRLKALQRRLLRELAGRIPPHDAARGFRPGGSVRSYAAPHAGRSVVLRLDLEAFFASVTVSRVYGIWRSAGYPEPVAHALAGLVTTVLPRAAWRSVPRPADDSLLDAHWRLGRRLAAPHLPQGAPTSPAMANLAAFGLDVRLTALARSWGGRYTRYADDLAFSGERGWGTGTSRLLDAVEVVVRDEGFRLNPRKTGVMPRAGRQRLAGLVVNDAPRVAREEVDLLRAILHNCARFGPSTQNRAGVVAFEDHLRGRIVWVAQHDPVRGARLLEAHRAVDWSR

SEQ ID NO: 5744 - protein, 436 aa, unidentified
  source 1..436: note = Related to JAKJHZ010000001.1; note = Nocardioides sp.
MRPDLARALSSAFLAGEWTRAGMVESGAVVVGRRARWLGPLARQVLELYPRAPLDRPRELATNLARCPAATRALASGPMVHPVAVTRMMTNRWRLPVLHDLDDLATLLDLDQAALAWFADPRHLARGATEAPLQHYRVSHRPAPSGAIRVLEAPKPRLKRIQRRLLDELAGRIPPHEAARGFRPGGSVASYAAPHAGRPVVLRLDLEAFFASVTVSRVYGTWRSAGYPEPVAHALAGLVTTVLPASAWRAVPTPSADHLLDAHWRLGRRLALPHLPQGAPTSPAVANLAAFGLDVRLTALAASWGGRYTRYADDLAFSGDRGWGRGTSRLIDAIETVVRDEGFRLNARKTGVMPRAGRQRLAGLVVNDRPRVARSEVDLLRAILHNCRRHGPSSQNRDDLQAWEAHLRGRIAWVAQHDPARGARLQEVHDAIDWSR

SEQ ID NO: 5745 - protein, 436 aa, unidentified
  source 1..436: note = Related to FOKC01000001.1; note = Nocardioides alpinus
MRADLARALASGFLADEWTQPALVASGRTVLGRRPAWLTPLVRQVLELYPRAPADRPRELAANIAACPAATRAGQAGPVVHPVARTQMVANRWRLPVLDRLDDVATFLDVSHTDLDWFADPRRLARSASDAPLQHYRVSHRPAPSGAVRVLEAPKPRLKVIQRRLLDEVAGLIPPHEAARGFRSGGSVRSYAAPHAGRPLVLRLDLEAFFASVTVSRVYGIWRTAGYPEPVAHCLAGLVTCVLPRSAWRAVPAPTDDGLLDAHWRLGRRLAAPHLPQGAPTSPAMANLAAFRLDVRLTALAQSWGGRYTRYADDLAFSGDAGWGRGTSRLIDAIGLIVRDEGFGLNARKTGVMPRAGRQRLAGLVVNDEPRVARGEVDLLRAILHNCRTHGPSSQNRDDVPAWEEHLRGRIAWVAQHDPVRGARLRAVHDAVDWSR

SEQ ID NO: 5746 - protein, 436 aa, unidentified
  source 1..436: note = Related to NZ_JZDQ02000022.1; note = Nocardioides luteus
MRADLARALAAGFLAGEWTRNGLVASGAVVLGRRTAWLRTLATQALELYPRPPHDRPRELAVILRSLPAAEKAVAVGPVTQPVAPTRMVTNRWALPQLDDLASVAAFLDVTAAELDWFADPRRWARAAEEPRLQHYRVSHRTAPSGAIRVLEAPKPRLRAIQRLLLDQVVSRIPPHDAARGFRPGGSVRSYAVPHAGRPIVLRLDLEAFFASVSVSRVYGIWRTAGYPEPVAHCLAGLTTCVLPRSAWRAVPRPGEDELLDAHWRLGRRLAAPHLPQGAPTSPALANLTAYGLDVRLTALARSWGGRYTRYADDLAFSGEAGWGHGTSRLLDAIEEIVRDEGFRLNPRKTGVMPRGGRQRLAGLVVNERPRVPREEVDLLRAILHNCRRHGPSTQNRDQVPAFEEHLRGRVSWVAQHDPVRGARLLAELDAIDWSR

SEQ ID NO: 5747 - protein, 436 aa, unidentified
  source 1..436: note = Related to FMZM01000021.1; note = Nocardioides lianchengensis
MRDDLARALAAGFLAGDWTATGLRASGAGVLGRRPRWLAPLVQQTLDLYPRPPHDRPRELATNLAGLPAAAKALRTRPVAQPVAPTRMLANRWRLPVLDDLGDLADLLGVTATELDWFADPRHLARSAADVPLQHYRVSHRIAPSGAVRVLEAPKPRLKAVQRLLLDEVLSRVPPHDAARGFRPGGSVASYAAPHAGRPVVVRLDLEAFFASVTVSRVYGIWRTAGYPEPVAHRLAGLVTAVLPRSAWRAVPRPAGDGLLDAHWRLGRRLAAPHLPQGAPTSPAVANLAAFRLDVRLSALARSWGGRYTRYADDLAFSGATGWGTGTSRLLDAIEEIVRDEGFRLNARKTGVMPRAGRQTLGGLVVNDRPRVARAEVDRLRAILHNCRRSGASSQNRDGVPAWEQHLRGRIAWVAQHDPVRGARLLAEHDAVDWSR

SEQ ID NO: 5748 - protein, 434 aa, unidentified
  source 1..434: note = Related to JAFBBZ010000001.1; note = Nocardioides salarius
MRDDLAHALAAGLLAGSWTQRGLVASGAEVLGSRRRWLDRLARHTLELYPRPPLDRPRELARIVAAFVDADAAARPATRPVVGTRMLTNRWGLPTLHDLNDLAGWLGLTSSELEWYADPRRLARTTSQGRLQHYRVSHRVASSGAIRVLEAPKLELKGIQRRLLDEVLSSVPPHEAARGFRPGGSVRTYALPHAGRPVVLRLDLESFFASVTVARVYGIWRSAGYPEPVAHRLSGLVTSVLPLSLWRSVPRPADDALLDAHWRLGRRLAAPHLPQGAPTSPALANLAAFRLDVRLSALAASWGGRYTRYADDLAFSGGRSWGTGTSRLLDAIEGVVRDEGFRLNQRKTGVMPRGGRQVLGGLVVNERPRVSRAEVDRLRAILHNCLTHGPSTQNRERHPAFAQHLRGRITWVAQHDPVRGARLLAQHDAVDWSR

SEQ ID NO: 5749 - protein, 436 aa, unidentified
  source 1..436: note = Related to NZ_CP075371.1; note = Nocardioides aquaticus
MRADLARALAAAFLAGEWTQSAMVQGGAVVLGSRRRWLTPLARQVLDLYPRPPLDRPRELATLISTRPAVARTGNARPVVQPVVATRMVRNPWRLPALDDLGDLAHHLGVEGSELAWFADPRRWARGTSEGRLQHYRVSHRVAPSGAIRVLEAPKPRVRRIQRSLLDDLVSRVPLHDAARGFRTGGSVRSYAAPHAGRPVVLRLDLEAFFASVTVARVYGIWRSAGYPEPVAHCLAGLTTSVLPRSVWQAVPGPADDGLREAHWRLGRRLAAPHLPQGAPTSPALANLAAYRLDVRLAALARSWGGRYTRYADDLAFSGERDWGDGTARLIAAIDVVARDEGFRLNPRKTAVMRRGDRQRLGGLVVNRRPHVGRTEVDLLRAILHNCRRHGPSSQNREGHPAFEEHLRGRVAWVAHHDPARGARLRAALDAVDWTR

SEQ ID NO: 5750 - protein, 349 aa, unidentified
  source 1..349: note = Related to NZ_JADCLL010000001.1; note = Nocardioides kribbensis
MLTNRWRLPVLHDLADLAALLELDAGELDWFADPKHWARTAGEAPLQHYRVSHRVAASGGIRVLEAPKPRLRRLQRRLLDEALGLVPPHDAARGFRAGGSVGSHAAPHAGRPVVLRLDLESFFASVTVGRVHGIWRTAGYPEPVAHALAGLTTAVLPLAAWRGVPRPADPGLLDAHWRLGRRLAAPHLPQGAPTSPATANLAAFGLDVRLTALAAAWGGRYTRYADDLAFSGDAGWGRGTSRLLDAVEEIVRDEGFRLNPRKTAVMPRAGRQSLAGLVVNDRPRVARHEVDLLRAILHNCRRHGPSTQNRDQVPAFAEHLRGRIAWVAQHDPARGARLLAEHGAIDWTR

SEQ ID NO: 5751 - protein, 436 aa, unidentified
  source 1..436: note = Related to NZ_VDMR01000001.1; note = Nocardioides litoris
MREDLARALAAGFLAGAWDRDGLLASGRGVLGRRPAWLRPLVRDVLLHYPRPPHDRPRELATVIGAFLAADRSYADAPAHRPLAPTRMLANRWGVPALHDLADLADLLDLDTGELDWFADPKRWARRTSEPRLQHYRVSHRVVATGAVRVLEAPKHRLKVLQRRLLDEVLAVVPPHDAARGFRPGGSVRRHAAPHADRSVVVRLDLESFFASVTVGRVFGTWRTVGYPEPVAHALAGLTTTVLPHAAWRAVPRPAPEHLLDAHWRLGRRLAAPHLPQGAPTSPALANLAAYRLDVRLSALARAWGGRYTRYADDLAFSGDRGWGRGTSRLLDAIEEVVVDEGFRVHPRKTAVMPRAGRQVLGGLVVNDRPRVPRAEVDRLRAILHNCRLHGPASQDRDGHPAFAAHLRGRIAWVAQHDPARGERLLAAWESVDWTR

SEQ ID NO: 5752 - protein, 436 aa, unidentified
  source 1..436: note = Related to JAAGXA010000003.1; note = Nocardioides zeae
MRPEVAAALGAGFLGGEWTEDGLLASGARVIGRRPQWLRQLAAQVVAAYPDAPRDRPRELAAAVASLPAAAKARRTRALRWTPTPTAMGRNRWALPVLDGLDDLAALLDVTQAELDWFADPKRWAREAAVAPLQHYRVAHRVASSGAIRVLEAPKPRLKRIQRLLLDEVLDRIPPHDAARGFRPGGSVARYAAPHAGRATVLHLDLEAFFASVTVGRVYGVWRTAGYPEPVAHLLAGLTTTVLPRAAWRTLPRPADPGLHDAHWRLGRRLAAPHLPQGAPTSPALANLAAYRLDLRLTALAEAWGGRYTRYADDLALSSDRGWGAGTSRLVTAVTEVVRDEGFRLNPLKTAVMRRGERQHLAGLVVNEHPRVARAEVDRLRAILHNCRVHGPSTQNRAAVPAFAEHLRGRVAWVAQHDPARGERLLEAWRAVDWER

SEQ ID NO: 5753 - protein, 436 aa, unidentified
  source 1..436: note = Related to NZ_SZVU01000003.1; note = Nocardioides dongxiaopingii
MRPDLARALAAGLLAGEWTPAGLVESGSTVLGRRRRWLTPLARQALELYPRPPHDRPRELAAVLAGLPAAGRAAADRPVSRPLSGTRMLANPWRLPALDGLDDLARHLDLTPGELDWFADPRRLARRTSEPRLQHYRVSHRVAPSGAIRVLEAPKPRTKALQRLLLDDVVSRIAPHDAARGFRRGGSVGSYAAPHAGRPVVLRLDLESFFASVTVARVYGIWRSAGYPEPVAHALAGLTTTVLPHAAWRAIPRPASPRLLDAHWRLGRRLAAPHLPQGAPTSPALANLAAYRLDVRLTALARTWGGRYTRYADDLALSGDRGWGTGTSRLLDAVETVVRDEGFRLNPRKTAVMPRGGRQTLGGLVVNQQPRVSRAEVDTLRAVVHNCRRHGPSTQNREERPAFAEHLRGRIAWVAQHDPARGARLLADYDTIDWSR

SEQ ID NO: 5754 - protein, 436 aa, unidentified
  source 1..436: note = Related to NZ_PVUE01000003.1; note = Antricoccus suffuscus
MRKDLATALAGAFLSGEWTSSGLFDSAVPVVQGPTPWLPALIRQILAVYPAAPLDRSRELAVVIGSRPAAGGAKSARPIAWPAATTQMTSNPWHLPALHGLGDLAEMLDLGATELAWFTDPRHWARSTTDRRLRHYRVTTKVAASGAVRVLEAPKYRLKSHQRRFLTEILDRIPAHDAAHGFRAGRSVASYAAPHGGQPVVVRMDLEGFFASITAGRVYGILRSAGYPEPVAHALTGLATTVLPRAEWNAISPPANPDLREAHWRLGRRLAGPHLPQGAPTSPALANLAAHRLDVRLSALASSWGGRYTRYADDLALSGGIGWRGDVSRLVALVGDIVRDEGFRLNDRKTAVLPAHSRQVLGGLVVNERPHVSRAEVDLLRAVLHNCRRDGPSTQNRAGVPDFEGHLRGRIAWVAQHDPARGARLRALFDAIDWSF

SEQ ID NO: 5755 - protein, 436 aa, unidentified
  source 1..436: note = Related to NZ_VCQV01000003.1; note = Leekyejoonella antrihumi
MRADLARALAGGFLAAEWTRPGLVDGGAVVLGRRVRWMPALTRQVLALYPRPPLDRPRELAAIISTRPAAAQAGRARPMAHPLAPVRMVSNPWRLVVLHDLAEVGSLLGLSQPELAWFSDPRHWSRTAQQVPLQHYRISSRTAPSGAIRVLEAPKRHLKAIQRQLLQEIVGRIPPHEATHGFRVGRSVGSYAAPHAGRAVVIRSDLEGFFASVTVGRVYGVLRTAGYPEPVAHCLAGLMTTVLPLSAWRKIPRPTDPVLLDAHWRLGRRLAAPHLPQGAPTSPALANLAAYRMDIRLDALALSWGGQYTRYADDIAMSGDRGWGPAADRILGIVAEIARTEGFRLNARKTGVLPQAGRQVLGGLVVNDRPHVSRAEVDVLRATLHNCIRHGPSTQNRQNRTAFEQYLQGRIAWVAQHDRDRGARLRTQFDAIDWTR

SEQ ID NO: 5756 - protein, 438 aa, unidentified
  source 1..438: note = Related to NZ_KB905425.1; note = Sciscionella marina
MRSELASAFAGAFLSGEWTESGLWGSGARVLGRDAVWLPALVREVLGLYACAPHDRPRELAAVIAMQEAAQGRDAEHAVPCRWPVSPTRMLRNPWHLPVLHSLEDLAGLLGLTTAELAWFSDPKRLARTAADPRLRHYRVTTRRAPSGAIRVLEAPKYQLKALQRRLLADLLGAIPPHAAAHGFRAGRSVATFAGPHAGKALVLRCDLEGFFASVTVGRVYGLFRTAGYPEPVAHALAGLTTTVLPASVWRKVPRPADPGLLDAHWRLGRRLAQAHLPQGAPTSPMLANLVAHRLDARCAGLAEAWGWNYTRYADDLAFSCAGGRRAGAAALLRMVERIVGEEGFRLNARKTAVQGSSARQSLGGLVVNEHVRVPRVELDRLRAILHNCARYGPSTQNRSGHADFAAHLSGRIAWVANHDPVRGARLRAGFEALDWSR

SEQ ID NO: 5757 - protein, 450 aa, unidentified
  source 1..450: note = Related to NZ_FQVX01000001.1; note = Geodermatophilus nigrescens
MTTPRQAAATASGIATALLAGPWRRREAVRRVAVALGHARAPRWVGALVGEVLDAYRDAPADRPRELAAFLASTRGWAQGQAGDVAPRVVRREPVPTRVVRPRPDLTEVPDLAALARLLDVDQGELAWFADTRGLERTAPEEALRHYRWRVVERPGGVRLLAAPKPRLREIQRRLLRHLVAPVPPHPAAHGCVPGHSVRTAAAPHAGADTVLALDLESFFASVPAGRVWGVLQGVAGLTEPVAHAVTGLVTTVVPLAVWRRVPVPEDGAARDRHARLGRRLAVPHLPQGAPTSPALANLVCARLDRRLAGLAASAGAVYTRYVDDLFLSGPPALRRPAFAARVAAIAADEGFRVHPGKTRSAGRGRRQTVLGAVVNVRPTLPRAERDALRALLHNCAVSGWASQVRDRDPATFREHVLGRVAWASSMDPVLGARLRVLAERIDWDAPGTA

SEQ ID NO: 5758 - protein, 448 aa, unidentified
  source 1..448: note = Related to NZ_QGTX01000001.1; note = Geodermatophilus normandii
MTASRRTAATASGVATALLAGPWRRRDAVRRVAVALGYARAPRWVGTLVGEVLLTYREAPADRPRELAAFLTTTAGWERGWSAGEVRPRVHRREPVPTRVVRRRPGVREVSDLAALARLLDVDQGELAWFADVRGLERTAPDEALRHYRWRVLERPGGVRLVAAPKPRLREAQRRLLRHLLAPLPVHDAAHGCVPGRSVRTAAAPHAGAAVVLSMDLESFFAGVPAGRVWGVLQGVAGLTEPVAHAVTGLATTVVPAAVWRRVPVGTDPDRHARLGRRLAAPHLPVGAPTSPALANLVCARLDRRLAGLAASAGAVYTRYVDDLTFSGGPGLRRDRFAARVAAVAADEGLRVNPAKTRTMGTGHRQQVLGAVVNVRPTLPRPERDALRALLHNCAVHGWRSQVRDRDPATFRDHVLGRVAWAASVDPVLGARLRELAARIDWDVPGTA

SEQ ID NO: 5759 - protein, 449 aa, unidentified
  source 1..449: note = Related to NZ_FMZF01000002.1; note = Geodermatophilus telluris
MTRPRQAAATASGIATALLAGPWRRRDAVRRVAVALGQARAARWVGTLVAEVLAAYRDAPADRPRELAAFVRTTEGWARGQAADVRPRVVRRQPVPTRTVRVRAPVADLPDLAALARLLDVDQGELAWLTDVRSWERTADAPLRHYRWRTVPRPAGGVRLLAAPKPRLREAQRRVLRHVLAPLPVHPAAHGCVRGRSVRTAALPHAGADVVLGMDLEGFFAGIPAGRVWGLLQGVAGLTEPVAHALTGLATTVVPVAVWRRVPVPADPAGRDRHHRLGRRLAVPHLPQGAPTSPALANLVCARLDRRLAGLAAASGAVYTRYVDDLTFSGGAALRRDRFADRVTAVAADEGFRVHPGKTRTAGSGRRQQVLGAVVNVRPTLPRPERDALRALLHNCAVHGWASQVRDADPATFRDAVLGRVAWASSVDPVLGARLHALAERVDWSAAPS

SEQ ID NO: 5760 - protein, 444 aa, unidentified
  source 1..444: note = Related to NZ_JABGCI010000002.1; note = Blastococcus endophyticus
MTTHRQDAVTAAGVATALLAGRWRRREMVRRVAVALDRARAPRWVGTLVGEVLVAYREAPADRPRELAAFVPTTEGWSRGRTALPRPRVARWQPVAVSVLRRPFPVAELPDAAALARLLDLDLGELLWFADPRGLERTSGEPLRHYRWHAVPHGSGMRLLAAPKPRLREIQRRLLRHVLAPVPLHAAAHGCVPGRSVRTAAAPHAGADVVLGMDLEAFFPSVAAARVWGLLQGTVGLTEPVAHLVTGLVTTVLPAAVWRRVPVPPGAGSADRHRRLGRRLAVPHLPQGAPTSPALANLVCFRLDRRLAGLAAAAGGRYTRYVDDLTFGGGRALAADRFAARVAAIAADEGFRVNDAKTRAVGAARRQEVLGAVVNARPTLPRPERDALRALLHNCTTRGWRTQVRDRDPATFRDHVLGRVAWASSVDPALGARLQAMAARVDWS

SEQ ID NO: 5761 - protein, 433 aa, unidentified
  source 1..433: note = Related to NZ_SPQN01000061.1; note = Geodermatophilus sp.
MTASGIATALLAGPWSRRTMVRRVSVALGFARAPRWVGALVDEVLAAYVSAPADRPRELAAFVTTTQAWQRMGALRRVVHRRPVATSVVRHRFGVPPLPDAAALARLLDLDQGELAWFADVRGLERTAGEPLRHYRWHAVERRGGLRLLAEPKPRLKEIQRRLLRHVLVPVPVHDAAHGCVPGRSVRTAAAPHAGSAVVLGMDLEAFFASVTAPRIWGLLQGTVGLTEPVAHLVTGLVTTSVPTSVWRALPLPDGTDARERHRRLGQRLAAPHLPQGAPTSPALANLVCYRLDRRLAGLASAFGARYTRYVDDLTFSGDRRIETGRLAALVTGIAAEEGFRINPAKTRVAGAGSRQRVLGAVVNTRPTLPRPERDALRALLHNCARHGWASQTREHDPATFREHVLGRVAWAASLDPVFGARLHALARRVDWS

SEQ ID NO: 5762 - protein, 347 aa, unidentified
  source 1..347: note = Related to FRDM01000010.1; note = Geodermatophilus obscurus
MVAADDGPPGRGRPRLRTRPALARLLDLDQADLAWFADVRVLERTVDEPLRHYRWHAVERRGRLRLLAEPKPRLKEAQRRLLRHVLAPIPVHDAAHGCVLGRSVRTAAAPQAGRALVLGMDLEAFFASVSAPRVWGLLQGTAGLTEPVAHLVTALGTTTAPVSVWRALPLPGGVEARERHRRLAAPHLPQGAPTSPALANLVCFRLDRRLAGLAASCGARYTRYVDDLTFSGDRRIRGDRLAALVTEVAAEEGFRVDPAKTRVAGAGSRQRVLGAVVNARPTLPRPERDALRALLHNCARHGWATQTRGHDPATFREHVLGRVAWAAALDPVLGERLHALAARIDWS

SEQ ID NO: 5763 - protein, 390 aa, unidentified
  source 1..390: note = Related to NZ_FNOT01000011.1; note = Geodermatophilus africanus
MLAAYAAAPVDRPRELTLFVQRTQGWERMGSPPRVVHRQPRATAVARDRFGVAPLADAAALARLLDLDHGELAWFADVRGLERTVGEPLRHYRWHAVERRGGVRLLAEPKARLEEVQRPLLRHVLARVPVHDAAHGCVPGRSVRTAAAPHTSRAVVLGMDLEAFFASVTAPRVWGLLQGTVGLTEPVAHLLTGLVTTTAPAGVWRALPVPSGAGARERHRRLGERLTTLHLPQGAPTSPALANLVCFRLDRRLAGLAATVGARYTRYVDDLTFSGDRRLRADQCASLVTEVAAEEGFRVNPAKTRVAGADSRQQVLGAVVNTRPTLPRPERDALRALLHNCARHGWTGQTRGHDPATFSEHVLGRVAWAGSLDPVFGERLHALAARIDWS

SEQ ID NO: 5764 - protein, 473 aa, unidentified
  source 1..473: note = Related to NZ_VFQE01000001.1; note = Blastococcus colisei
MTAPSERRAAGTAAGIATALLAGRWRRPEMVRRTAVALGRDRAPRWVGTLVGEVLDAYRDPPVDRPRELAGFVRTTAGWARGWTVVPQPRITRWQPARTDVVHRPYGVAALPDLTALARLLDVDAGELAWFADTHRLERTVAEPLRHYRWTTDGDRLLAAPKSRLKEIQRRLLRYVIGPLRVHGAAHGCVPGRSVRTAVTPHTGAAQVLQMDLESFFASIAAERVHGLLRSVGGLPEPVALAVTGLVTTVVPRSTWRRVPVPDDVDRHHRLGRRLAGPHLPQGAPTSPALANLVCFRLDRRLGGLAASFGAAYTRYVDDLTFSGGRGIDQGPFERLAGEIVVEEGFRLNRSKTRSTSSAGRQSVLGTVVNVRPTLPRTERDALRALLHNCATRGWASQVRDRDPATFRDHVLGRVAWASSIDPAFGARLRARAALIDWSRPDEGACGRTPADRPSDGTLPPPDDDGGARCGER

SEQ ID NO: 5765 - protein, 451 aa, unidentified
  source 1..451: note = Related to FOND01000013.1; note = Blastococcus sp.
MTAPGGRRAAGTAAGIATALLAGRWQRREMVRRTAVALGLPRAPRWVGTLVGEVLAAYRDPPVDRPRELAGFVRATAGWARGWAAVPQPRIVRWQPVPTALVRRRHGVAGLPDLAALARLLDVDAGELAWFADTHRLERTVGERLRHYRWTTAGDRLLAVPKPRLKEVQRRLLRHVVGPLGVHDAAHGCVPGRSVRTAVSPHAGADQLLQLDLESFFAGIAAERVHGLLRSVGGLPEPVARTVTGLVTTVVPRSVWRQLPVPDDAGRHERLGRRLAVPHLPQGAPTSPALANLVCFRLDRRLDGLAASFGAVYTRYVDDLTFSGDRGIDRGRFEQLAGEIVREEGFRPNRAKTRSTTSAGRQSVLGTVVNVRPTLPRPERDALRALLHNCATHGWRTQVRDHDPATFRDHVLGRVAWASSIDPVLGARLRAQAERIDWSSGPDGTAAPAPA

SEQ ID NO: 5766 - protein, 456 aa, unidentified
  source 1..456: note = Related to NZ_VLKF01000001.1; note = Modestobacter roseus
MTAPSGRRAATTAAGIAVALLGSRWRRREMVRATAVALGYARAPRWVGTLVGEVLVAYRDAPVDRPRELAAFVRTTAGWQRGWTRVPQPRVARWQPTVTEVAFRRHGVTELPDLAALARLLDLDTGELAWFADAHRLERTVREPLRHYRWRTVGSRLVAAPKPRLKEAQRRLLRHVVGPLPVHGAAHGCVPGRSVRTAVAPHAGAAVVLQLDLEAFFPSIAAERVQALLQTVGGLPEPVAHAVTGLVTTVVPRSVWAAVPVPAGPDRDRDRHHRVGRRLAVPHLPQGAPTSPALANLVAFRLDRRLAGLAASFGAQYTRYVDDLTFSGDRALDRGRFASLVGAVVAEEGFRLNAAKTRSTTSAGRQSVLGAVVNVHPTLPRTDRDALRALLHNCAVHGWRSQVRDHDPATFRDHVLGRVAWAASIDPAFGVRARRLADRIDWTAHPVRSPEGPGHD

SEQ ID NO: 5767 - protein, 449 aa, unidentified
  source 1..449: note = Related to NZ_JPMX01000077.1; note = Modestobacter caceresii
MTAERQAAATAAAIATALLAGPWRRREMVRRVAVALGQARARTWVGTLVGEVQTVYPTAPVDRPRELARVVRTTQGWERGQSHRPLARAVRWEPVPTALAWRRWPVADLPDQAAVARLLDVDAGELAWFADARRLERTAGEALRHYRWRVVQRPAGVRLLAAPKPRLKEAQRRLLRHVLDRVPAHDAAHGCVPGRSVRTAVAPHAGSAVVLRMDLEAFFASVAAGRVHGLLLGVAGLPEPVAHVLTGLMTTVLPTEVWRRIPPPDGIEARERHRRLEQRLTVPHLPQGAPTSPALANLVCHRLDRRLAGLAAASGGTYTRYVDDLTFSGDRRIARDRFADLVTDVVTDEGFRVNAAKTSATSAARRQAVLGTVVNDHPTLPRPERDALRALLHNCAVHGWTTQTRGRDPGTFRDHVLGRVAWAASVDPAFGARLHRLADRIDWTAPAHS

SEQ ID NO: 5768 - protein, 444 aa, unidentified
  source 1..444: note = Related to NZ_SJEX01000063.1; note = Modestobacter excelsi
MAAVTASGLATALLAGPWRRRDMVRRVAVALGQARAATWVGTMVGEVQTGYPQAPVDRPRELARFLRTTRGWARGQDTTPPPPVLRWEPQPTRLAWSRAPVADLPDQAAVARLLDVDPGELAWFADARGLERTVGEPLRHYRWQVVPRPHGVRLLAAPKPRLKEAQRRLLRHVLARVPVHDAAHGCVPGRSVRTAVAPHAGSPVVLRMDLEAFFASIAAERVHGLLLGPAGLPEPVAHVLASLVTTVAPAQVWRQVSLPTGIEARERHRRLGRQLAVPHLPQGAPTSPALANLVCFRLDRRLAGLAASCGARYTRYVDDLTFSGGTALGRDRFADLVTRVVADEGFRVNAAKTAATSAARRQSVLGAVVNTRPTLPRRERDALRALLHNCATSGWPGQTRGREPATSRDHVLGRVAWAASLDPAFGARLHALAERIDWSAEPAG

SEQ ID NO: 5769 - protein, 400 aa, unidentified
  source 1..400: note = Related to JAAGWH010000033.1; note = Modestobacter muralis
MVGEVQTVHPRPPVDRPRELSRVVRATQGFARGHASLPLPRVVRRNPVPTALAWERYPVTDLPDQAAVARLLDLDAGELAWFADTRGLERTAGEALRHYRWHAVDRPHGVRLLAAPKPRLKEAQRRLLRHVLAPVPVHEAAHGCVPGRSVRTAVAPHTGSAVVLRMDLEAFFAGIPAGRVHGLLLGPAGLPEPVAHVVTGLVTTVVPAQVWRALPVPPDVDARDRHHRLGRRLAVAHLPQGAPTSPALANLVCFRLDRRLSALAASSGARYTRYVDDLTFSGGRSVGGDRFAALVAEVVADEGFRVNAAKTSAVGAGRRQSVLGAVVNVHPALPRRERDALRALLHNCATHGWAGQTRGRDPDTFRDHVLGRVAWAGSLDPVFGARLTALAERIDWAAAD

SEQ ID NO: 5770 - protein, 450 aa, unidentified
  source 1..450: note = Related to NZ_VNHW01000003.1; note = Blastococcus xanthinilyticus
MTAGRRAEVTANGIATALLAGAWRRPQMVRRVAVALGYARAPRWVGTLVTEVLAAYWHPPADRPRELALFVRTTASWARGTASGPPPGVVRWEPVPTSVVRPRLPGVELSDLGALARLLDLDQGELAWFADARRLERTAPEPLRHYRWRIVDRPTGVRLLAAPKPRLKEIQRRLLRHVLDPVPVHGAAHGCVRGRSVRTAATPHAGAAVVLRMDLEHFFASVPAPRVHGLLLGQAGLPEPVAHAVTGLVTTVLPAAVWRRIPLPDDVRARERHRRLGARLAVPHLPQGAPSSPAMANLVCFRLDRRLAALADAFGATYTRYVDDLTFSGGARVGRGRLAGLVGEIARDEGFRVNTAKTRAISSARRQDVLGVVVNDHPALPRRERDALRALLHNCATHGWATQLRGRAPASFRDHVLGRVAWAAAVDPGFGARLHALADRIDWSRPLGSA

SEQ ID NO: 5771 - protein, 442 aa, unidentified
  source 1..442: note = Related to QHCB01000177.1; note = Pseudonocardiales bacterium
MNPREQVANGLATAMLGGAWSREPMRARIARALGRPRAPRWAGALVGQVLGAYRDAPADRPRELAAYVQTTPAWQLAWEHRRPPRIVRWAPTPTVMVARPWPVIELDDLGALARLLAIDQGELAWFADVRSIERRSGQPLRHYRWRALPKRGGVRLVAAPKPRLKEIQRRLLRHVLTQIPVHPAAHGCVPGRSVRTAVDPHAGAAIVIRADVEGFFSSISAGRIWGLLRMAGLPEPVAHTITGLVTTVVPTQVWRAVPRPTGALLLDAHLRMGERLATPHLPQGAPTSPVLANLAAFSLDRRLTGLAGAFGGQYTRYVDDLTFSGGPSLRNARSRFVELVDDIVRSDRLRLNERKTVVLGAAGRQQLLGAVINDHPTVARHERDALRALLHNCATRGWQTQTRGLEADEFRATLLGRISWIGGLDPSFGARLRRSFDAVDWS

SEQ ID NO: 5772 - protein, 425 aa, unidentified
  source 1..425: note = Actinomycetia bacterium; note = Related to JAFKEJ010000505.1
MTTRSDQQRQVADGLATALLAGPWTVPLMTRRVRTALGLRGRQPWVVGLVAEVADAYRDPPVDRPRELAAYLRATGSWRLAPVPRVVAWTPVPTSMGPMPWPVTALPDLGALARLLDIDQGELAWFADVRGLERRCAPPLRHYRWREIPGRSGPRLVAAPKPRLKEIQRRLLRHVLEPIPVHDAAHGAVATRSVRTAVAPHAGATVVLRADLVAFFPSIPAERAWGLLRTAGLPEAVAHTVTGLLTTVAPIEVSTDPRLRHPHVPQGAPSSPRLANVVAFSLDRRLAGLAARFGARYTRYVDDLTFSGGASLRTARSRFVALVEEIVRDEGFEVNERKTVVLGESGRQQVLGAVVNAHPALPRPERDALRATLHNCVVHGWASQARGRPRDEFRAHLLGRVAWVGSLHPGHGRRLRELADRIDWN

SEQ ID NO: 5773 - protein, 425 aa, unidentified
  source 1..425: note = Related to NZ_FQVU01000005.1; note = Jatrophihabitans endophyticus
MTGAGPAGPLADGLATALLAGPWTRPAMRTRGRDALGAARTPVWLGRTVDAVLTAYPQPPADRPRELAAFLLATAEFAKLARRRPPPRVVSWSPVPTDVMVRPWPVELLPDHAALAGLLDVDQGELAWFADVRGLERSSPEPLRHYRWRTVAKPGGVRVLAAPKPRLKEIQRRLLRHVFDAVPVHPAAHGGVRRRSVLTASAPHAAQPVVVRVDLVSFFASVRAGRVWRLLRTAGVPEGVAHTVTGLVTTVAPLPFRALDPRLRTPHLPQGAPTSPALANLIAFSLDRRLTGLAARFDASYTRYADDLVFSGGRGLGAARFLDRVGEIVRDEGFRVHDGKTAVLGRSGRQQVLGVVLNHHPAVPRRERDALRALLHNCATTGWRAQARDRDDFPAHVLGRIAWVQSLDPVHGRRLRAAYDAVDWS

SEQ ID NO: 5774 - protein, 444 aa, unidentified
  source 1..444: note = Related to BOMC01000025.1; note = Actinoplanes abujensis
MTTTAHRRRAAALRAGRRRHDRDSSGHAAAGTVADALLTTDWQTGKMQIAVRRVTAGRKGWARQFVQFVRRAYPRAPYDRPRELRLFLQARGGIPRDVVARHRLVSATRVVRMRWNTPGLGDLADLAAFLDLDGDALDWFADRREINRHARDERLRHYRYVWLPHRLIEAPKPRLRDLQRLVLDRILARVPVHDGVHGFVPGRGVHTFARTHTGRDVLVSMDLRAFFTSVTAARIYGLFRGIGYPEPVAHTLTALTTTRTPVAVLRSAPDPHLAALLRRPHLPQGAPTSPALANLCAYRLDRRLSGLAGRFGVTYGRYADDLAFSGTLSAPHVTRLTALTGRIADEEGFRLHPHKTRVRTRSQRQALTGLVVNTRPAVPREDYDRLRAILHNAATHGLAEANRDGHADFAAHLAGRVAWMSHHHPARAAKLHHLLAQALRDQPR

SEQ ID NO: 5775 - protein, 409 aa, unidentified
  source 1..409: note = Related to JAHKKG010000005.1; note = Actinoplanes bogorensis
MVAGAVADALLTTTWHKDQMLAAVRTVTAARPPWARRLVAVVLHAYPQPPADRPRELRRFLLHLTRRAHVRRRLVTPARTVHMRWGAPAIDSLADFLGLDGDELDWFADRREINRHARDERLRHYRYAWLTHRLIEAPKPRLRDLQRRVLDDILSAVPVHEGVHGFVRGRGVHSFARAHAGCDVLISLDLRAFFSSITAARIYGLFRGIGYPEPVAHTLTALTTTRTPAHVLRAAPDPHLAALLRQPHLPQGAPTSPALANLCAYRLDRRLAALATRFGVTYGRYADDLAFSGRLGRTETDHLIALVDGIAAEEGFRVHPGKTEVRRRSQRQALTGLVVNERPAVPREDYDRLRAILHNAATHGMAEANRDGHADFAAHLTGRVAWMSHHHPSRAAKLKTLLDRALATP

SEQ ID NO: 5776 - protein, 443 aa, unidentified
  source 1..443: note = Related to NZ_JAHWFK010000003.1; note = Actinoplanes sp.
MSTAAHRRRDAALRAALRRHDRESSGHAAPPQVAGALADALLTTDWRPAQMQAVVRAVVAGRAPWARRLVVAVWRAYPRAPVDRPRELRQFLINRALARRAVIRRRIVAPTRVVRMRWGAPALGDLAELAAFLGLDGDALDWFADRRELNRHARDERLRHYRYVWRPHRLIEAPKPRMRDLQRRLLDRILSVVPVHDSAHGFVPGRGTHTFARAHTGADVLVRLDLRAFFPSITAARIYGLFRGLGYPEPVAHTLTALTTTRTPAHVLREAPDPHLAALLRQPHLPQGAPTSPALANLCAFRLDRRLSALAGRFGVTYGRYADDLAFSGTLTNARADRLVELTGRIAAEEGFRVHPGKTRIRRRSQRQELTGLVVNERPAVPRKEYDRLRAVLHNAARHGLAEANRDGHADFAAHLAGRVAWMSHRHPTRAAKLHELLARALT

SEQ ID NO: 5777 - protein, 470 aa, unidentified
  source 1..470: note = Related to NZ_OBDY01000014.1; note = Actinoplanes atraurantiacus
MTTAAHRRRASALRAARRRHDRESSGHAAARTPKGAHRQSPWQVAGALADALLTTSWRPEDMVATVGSVVAGRPAWARRLVGAVLLAYPRAPADRPRELRHFLAGLEGRPRVAVRRAVVRHRPVVPVRVVRMRWGAPGVDGLAGLAAFLDLDGDALDWFADRREINRHARDERLRHYRYTWLTHRLIEAPKPRMRALQRQLLDQILSRVPVHPSVHGFVPGRDAHTFARAHAGASVLVSMDLRAFFSSITAARIHGLFLGIGYPEPVAHALTALTTTRTPARILRAASDPYLAALLRQPHLPQGAPTSPALANLCAFRLDRRLSGLAGRFGLTYGRYADDLAFSGTLADGRVARLVALAGQIAREEGFRAHPGKTRVRRRSQRQELTGLVVNDRPAVPREDYDRLRAILHNAATQGLAAANRDGHPDFAAHLAGRVAWMSHHHPSRAAKLKDLLDRVRSSGPEVSVERRS

SEQ ID NO: 5778 - protein, 418 aa, unidentified
  source 1..418: note = Related to AP023356.1; note = Actinoplanes ianthinogenes
MLTVDWQPERMTAVVRTVVRGRARWARRLVDAVLRAYPRAPADRPRELCRFLTNRGGIPRTRVRRRLMTPTRVVRMRWGAPPINDLAELAAFLGVDGDALDWFADRREINRQARDEKLRHFRYAWLPHRLIEAPKPRLRTMQRRLLDRILSRVPVHDSVHGFVPGRGTHTFARAHAGQAVLISLDLRAFFSSITAARIYGLFRGIGYPEPVAHALTALTTTRTPARVLRAAPDPHLAALLRQPHLPQGAPTSPALANLCAFRLDRRLSGLAGRFGLTYGRYADDLAFSGTLDSTGIARLVTLAGQITGEEGFRIHPGKTRVRRQSQRQSLTGLVVNAHPAASRKDYDTLRAILHNAAVHGLAAANRDNHPDFAAHLAGRVAWMSHHHPSRAAKLHQLLARTAGDQPRGPSSVSNSRSS

SEQ ID NO: 5779 - protein, 461 aa, unidentified
  source 1..461: note = Related to NZ_JOJL01000057.1; note = Actinoplanes sp.
MTTAAHRRRASALRAARRRHDRDSSGHAATSTWYGPHRQRPFRVAGALADALLTTDWRPEQMTAAVRSVAAGRAVWAVRLVKAVLLAYPRLPADRPRELRQFLANLPPTPRTTVRQAVIRHRLAVPTRVVRMRWGAPGIGDLAELAAFLGLDDDALDWFADRREINRHARDEKLRHYRYAWRPHRLIEAPKPRLRALQRQLLDQILSAVPVHDHVHGFVPGRGPHTFARAHAGNAVLVSMDLRAFFSSITAARIYGLFRGIGYPEPVAHALTALTTTRTPAPVLRDAPDPYLAALLRQPHLPQGAPTSPALANLCAFRLDRRLSGLAGRFGLNYARYADDLAFSGTLNTSGVDKFSTLAGRIVHEEGFRIHPRKTRIRRRSQRQALTGLVVNTLPAAPREDYDRLRAILHDAATHGLAEANRDGHPEFAAHLAGRVAWMSHRHPSRAAKLHRLLDQALAKP

SEQ ID NO: 5780 - protein, 458 aa, unidentified
  source 1..458: note = Related to NZ_BOMY01000054.1; note = Actinoplanes tereljensis
MTTAPHRRRTSALRAARRRHDRESSGHAAPAAQVAGALADALLTTSWQPDDMVAVVRSVAGGRPIRARRLVEAVLQAYPRAPADRPRELRRFLAALPTKPRTTVRRAVIRHRLAVPTQVVHLRWNAPALSDLADLADFFGLDGDALDWFADRREINRKANDQKLRHYRYGWLPHRLIEAPKPRLRALQRRLLDRILSAVPVHDRVHGFVPGRGTHTFAQLHAGAPVLVSMDLRAFFSSITAARIYGLFRGIGYPEPAAHALTALTTTRTPARVLRAAPDPYLAALLRRPHLPQGAPTSPALANLCAFRLDRRLTGLADRFGLTYARYADDLAFSGTLSRTRIDRLVTLATQIVHEEGFRTHPGKTRVRTSSQRQSLTGLVVNANPAVPREDYDRLRAILHNAATHGLADANRDGHPDFAAHLAGRVAWMSQAHPSRAAKLNALLERALGPEVPRPGRR

SEQ ID NO: 5781 - protein, 464 aa, unidentified
  source 1..464: note = Related to NZ_RJAC01000023.1; note = Actinoplanes sp.
MSTAAHRRRASALRAVRRRHDRESSGHAAIRTWNRKRLAPARRWYSPRRQPSSSVASALADALLTTNWRRPHMLSAVRVVAPARARRLVDAVLQAYPRAPVDRPRELSRFLAGFGVPRAVIRRRLVAPARVVRMRWKAPRIDDLAGLAAFLELDGGALDWFADRRELNRQARDERLRHYRYAWLSHRLIEAPKPRLRALQRRVLDEILATIPVHDAVHGFVPGRGTHTFAERHAGQDVLLTMDLRAFFSSITAARIYGLFLGAGYPETVAHALTALTTTRTPARVLRSAPDPDLAAVLRRPHLPQGAPTSPALANLCAFRLDRRLTGLAERFGLTYARYADDLAFSGTGPVDRLTPLVAHIATEEGFRVRPDKTKVRHRSQRQSLTGLVVNERPAVARADYDRLRAILHDAATHGLDAANRDGHPDFLAHLTGRVAWASHDHPSRATKLRRLLNQVQSSHIVGR

SEQ ID NO: 5782 - protein, 410 aa, unidentified
  source 1..410: note = Related to JAENHP010000015.1; note = Actinoplanes ovalisporus
MVAGALADALLTTTWQPEEMEAAVRSVAAVPEAWARRLVRTVLSAYPRNPADRPRELRRFLTARRAYIRHRLVTPTHAVRMRWNAPPINDLAELAAFLELDGDALDWYADRREINRHARDERLRHYRYAWLPHRLIEAPKPLLRDLQRRLLDDVLATAPVHEHAHGFVPGRGTHTFARVHAGRDVLVSMDLRAFFSSITAARIYGLFRGIGYPEPVAHALTALTTTRTPAHVLRAAPDPHLAALLRRPHLPQGAPTSPALANLCAYRLDRRLTGLADRFGLTYARYADDLAFSGTLTHAQVERLVALTTSIAAEEGFRVHPHKTRFRTQAQRQSVTGLVVNDRPAVPREEYDRLRAILHNAATHGLAEANRDGHADFAAHLTGRVAWMSHHHPSRAAKLQDLLVRALSAP

SEQ ID NO: 5783 - protein, 426 aa, unidentified
  source 1..426: note = Related to NZ_QHHV01000069.1; note = Actinoplanes sp.
MATALADALLTTSWRRKAMIGAGRALLGRPTRWVPRVVDAVAAAYRDAPADRPRELARFVAEIIRTTPGARRQSRRTVIRHRLVAPTRTVRMRWKTPRIDDLAALADFLAVDGDLLDWFADRREINRHARDEPLRHYRYQWLPHRLIEAPKPRLRAIQRRLLDHVLAAIPVHERAHGFVAGRGVHTFAGSHAGRAVLVSMDLRAFFSSITAPRVYAMFRQAGYPEPVAHALTALTTTRTPARVLRGAPDTTRAAMLRQPHLPQGAPTSPALANLCAFRLDRRLTGLADRFGLHYSRYADDLAFSGTLGERRTLDLISYVRGIAAEEGFRAHPDKTRVRRRADRQLLAGLVVNSRPAVPREEYDGLRAILHNAGRHGLAAANRDGHPDFAAHLAGRVAWMAHQHPARAAKLHNLLRAALTAPTTAGS

SEQ ID NO: 5784 - protein, 393 aa, unidentified
  source 1..393: note = Related to BOQL01000058.1; note = Actinoplanes auranticolor
MVFGRRARWVRPAVDAVLRAYREAPGDRPRELAGFLAASGRLGAHRTVVRHRLVAPTRTTRMRWPAPAIDDLGALADFLSLDGDMMDWFADRREINRYARDERLRHYRYTWLPHRLIEAPKPMLRDLQRRLLAEVLAGMPVHERVHGFVPGRGVHTFAASHTGQEVLVSLDLRAFFSSITAARVYAVFRQAGYPEPVAHTLTALTTTRTPAHVLRDAPDATRAALLRRPHLPQGAPTSPALANLCAFRLDRRLTGLADRFGLHYSRYADDLAFSGTVGDRRVGDLISYVRAIVTEEGFRTHPGKTRVRRQGDRQLLAGLVVNARPAVAREDYDRLRAVLHNAGRHGLAAANREGHPDFAAHLAGRVAWMAHRHPTRAAKLHSLLRSAVAADRQ

SEQ ID NO: 5785 - protein, 442 aa, unidentified
  source 1..442: note = Related to NC_022657.1; note = Actinoplanes friuliensis
MTTAAHRRRLAALRARTRRHDRVSSGHAAAAAPRVATALADAFLSTRWRRKAMVKAGAAVLGRERRWVDRAVVKVLRAYRIAPADRPRELAGFLEGITRPAVIRRRRVTPVQVVRMRWHAPPINDLGELAAFLDVDGDLLDWFADRREINRHARDERLRHYRYRWLPHRLIEAPKPHLLALQRRLLDEVLARVPVHERAHGFVPGRGVHTFAASHAGQAVVVRLDLRAFFSTVTAARIYGIFRSAGYPEPVAHALTALTTTRTPARVLRDAPDPRLAALLRRPHLPQGAPTSPALANLCAFRLDRRLTGLAGRFGLHYSRYADDLAFSGPDHPHNLIPYVHSIAVDEGFEINPAKTRVRGQADRQLLAGLVVNSSPAVPREDYDRLRATLHNAATHGLAEANRDGHADFAAQLAGRVAWVSHRHPARARKLQELLSAALAKP

SEQ ID NO: 5786 - protein, 427 aa, unidentified
  source 1..427: note = Related to NZ_RJKL01000001.1; note = Couchioplanes caeruleus
MSAALADALLTSRWRPGPLQRTGTAVLGGRPPWLRIAVVAVLRAYRHAPADRPRELAAFLSCLERSGRPLVRRHPIRLRRATPVRIVRMRWDTPRIDDLAALADFLGVDGDHLDWYADRRHLNRHARDERLRHYRYAWLPHRLIEAPKPRLRALQRRLLDDLLGRLPVHPHAHGFVPGRGVHTFAAPHAGQKLVIGLDLTAFFSSITAARIHGLFRTAGYPEPVAHTLTALTTTATPAAVLRGRTDPHRAALLRRPHLPQGAPTSPALANLVAYRLDRRLTGLADRFGLHYTRYADDLAFSGTLGRGEPAHLIAAVHTIAADEGFRVHPRKTRVRGRGDRQRLAGLVVNERPAASREDYDRLRAVLHDAARRGPLVANREGHDDFPAYLRGRVAWVSHRHPARAAKLHRMLAVALAGPAAPPTVTTP

SEQ ID NO: 5787 - protein, 447 aa, unidentified
  source 1..447: note = Related to CP005929.1; note = Actinoplanes sp.
MFCPPGTGGSLDRSLTFAGHANLGAVRQAVNSALAEAFLACGWRDGPARPALDRLTRAGAEVLGGRPWWLRPLAAEVLRAHRNPPLDRPRELAAFLGRRVAGSRPIMVRRAVPVRTVRMRWPTPRIDDLAALADFLGLTGEELDWFADRREINRHARAEQLRHYRYRWLPHRLIEAPKPRLRALHRRLLDDLLGRLPVHDAAHGFVPGRSVHTFAAPHAGRALVIRADLATFFSSITAPRIFGLFRTAGYPEPVAHALTGLTTTRTPAAVLRGHGYDTARMLRQPHLPQGAPTSPALANLVAFRLDRRLAGLAARFDLTYTRYADDLAFSGPRTDPRRFLDALRTVVADEGFRLHPAKTRVRGRADRQSLAGLVVNEHPAVPRTDYDRLRAILHDAARHGLATANRDGHPDFAAYLTGRVAWIAHHHPTRAAKLHRMLAAALNPPPP

SEQ ID NO: 5788 - protein, 393 aa, unidentified
  source 1..393: note = Related to NZ_LOJP01000001.1; note = Actinoplanes sp.
MVVAGLVRAGAEVLGARPWWLRPVVARVLRAYPHPPLDRPRELAAFLDRRVQPHPVVVRRAAPARVVRMRWDTPQLNDLGALADFLEVSGDELDWFADRKEINRHARDERLRHYRYVWLPHRLIEAPKPRLRALQRRLLDELLGRIPVHPAAHGFVPGRSVHTYAAPHAGQRMVVRADLAAFFSSITAQRSYGLFRLAGYPEPVAHALTALTTTRTPIDVLRGRPGSTRTLLREGHLPQGAPCSPALANLVAFRLDRRLTGLAARFGLTYTRYADDLAFSGPRALNLDALAAVVKDEGFRLHPAKTRIRGRGDQQRLAGLVVNEHPAVPRGEYDHLRAILHDAARRGLEAANREGKADFRAYLMGRVAWVSHRHPGRAAKLDRLLKDALRRGD

SEQ ID NO: 5789 - protein, 393 aa, unidentified
  source 1..393: note = Related to NZ_BOMN01000001.1; note = Actinoplanes humidus
MLGRLVRAGGEVLGGRPWWLRPVVAGVLRAYRDAPADRPRELAGFLSGRVQSHPVVVRRAVPVRVVRMRWDTPRIDDLGVLAGFLGLAGDELDWFADRKEINRHARDQRLRHYRYRWLPHRLIEAPKPRLRAVQRRLLDGVLGRIPVHPAAHGFVPGRGVHTFAVPHSGQPMVVRVDLASFFSSVTAPRIYGLFRTAGYPEPVAHALTALTTTRTPADILGGKYLPLLRHAHLPQGAPSSPALANLVAYRLDRRLSGLAARFGMTYTRYADDLAFSGPRVSAPRLLAALEAVVKDEGFQLRHAKTRVRGQGDRQVLAGLVVNERPAVARVEYDRLRAVLHDAARRGLDEANRDGHADFSAYLKGWVAWVSHRHPGRAAKLDRLLAATLGEDRA

SEQ ID NO: 5790 - protein, 460 aa, unidentified
  source 1..460: note = Related to NZ_BOPH01000102.1; note = Virgisporangium ochraceum
MSTAAHRRRASALRAGRRRHDGASSGHAATRRQAPRRVASALADAFLTVAWRRAELLAVGRTVLAARPRWLGPVVTAVLRAYRDPPVDRPRELAAFVAGATGPAGQRVGAAVVRERRMVPTRTQRMRWGTPAIDDLAALADFLDLDGDHLDWFADRRELNRHARDERLRHYRYTWLPHRLIEAPKPRLRAVQRHLLDTVVGLLPVHGSVHGFVPGRGVHTFAAAHAGKPTVVRLDLRAFFTTVTAGRVYGVFRTAGYPEPVAHTLTALTTTRTPAAVLRTAPDRAAAGARAALLRQPHLPQGAPTSPALANLCAYRLDRRLAGLAVRFGVGYTRYADDLAFSGDLTARQAGHLVTHVTAVATAEGFGTNPAKTRVRGRADRQQLAGLVVNAAPAVPRAEYDLLRAILHDAARNGLAAANRDGHPDFAAHLAGRVAWVGHRHPARAAKLRRLLADVGAPRT

SEQ ID NO: 5791 - protein, 407 aa, unidentified
  source 1..407: note = Related to NZ_BOPG01000148.1; note = Virgisporangium aurantiacum
MLWQRSELLAVGHTVLGARPRWLGPVVTAVLRAYRQPPADRPRELAAFVAAVTGPAGTRVQAAVIRERRFVATRVGRMRWATPAVDDLGALADFLDVDGDRLDWFADRRELNRHARDQQLRHYRYLWRPHRLIEAPKPRLRALQRHLLDTIVGLLPVHESVHGFVAGRGVHTFAAAHAGKPTVLRLDLRAFFTSVTAARVYGLLRTAGYPEPVAHALTALTTTRTPVDILRDAPNRAHAALLRQPHLPQGAPTSPALANLCTFRLDRRLAGLAGRFGADYTRYADDLAFSGDLGGRQAQHLITQVTAIATAEGFGVNTAKTRVRGQADQQRLAGLVVNAAPAVPRAEYDRLRAILHDAAQHGIDAANRDGHPDFAAHLAGRIAWVAHRHPTRASKLQRLLSAAVPAP

SEQ ID NO: 5792 - protein, 328 aa, unidentified
  source 1..328: note = Related to NZ_JADMLH010000017.1; note = Pseudosporangium sp.
MRWDTPRIDDLAALAGFLGFDADELDWYADRKELNRHARDERLRHYRYTWLGRRLIEAPKPRLRAVQRRLLDDVLGRLPVHPAAHGFVPGRGPHTFAAAHAGQPVVVRLDLAAFFSTITAGRVYGLLRTAGYPEPVAHTLTALVTTRTPAAVLRNAPDWRTAALLRHPHLPQGAPTSPALANLLAYRLDRRLSGLAARFDATYTRYADDLAFSGPLTGGVAGRLVAAATTVVAAEGFRVHPGKTRIRGRADRQLLTGLVVNDRPAVPRAEYDHLRAVLHDAARNGLAAADRDGRADFAAYLRGRVAWVAHAHPSRAAKLHRLLAAALS

SEQ ID NO: 5793 - protein, 438 aa, unidentified
  source 1..438: note = Related to NZ_JNYJ01000032.1; note = Dactylosporangium aurantiacum
MSTAAHRRRASALRATLRRHDRDSSGHAARAVAGALADAFLTVDWARGPLLEVGREVLGRRPRWLGPVVTAVLRAYREAPADRPRELAELISAPGRQPIRVRRATATRTVRQRWDSPRVDDLAALAEFLAVTPDELDWFADRRGLNRRHPDPRVRHYAYTWIGDRLIEAPKSRLKALQRRVLDELLGPLPVHPFAHGFVPGRSVHTFAAPHAGQVTVVRIDLRGYFSSVTAGRVYGLWRTAGYPEPVAHALTALCTTATPHAVSRRVEHRTPHLPQGAPTSPALANLVTFRLDRRLAGLAARFGATYSRYADDLAFSGPLRQPARLVAAVTAVAAEEGFRVNPAKTRVRGRGDQQRLAGLVVNDRPAVPRADYDRLRAVLHHAARDGLDAANRDGHPDFAAHLTGLVAWAAHGHPTRAARLHGLLRAAGINRRTATPP

SEQ ID NO: 5794 - protein, 353 aa, unidentified
  source 1..353: note = Related to NZ_CP061913.1; note = Dactylosporangium vinaceum
MELAEFIAAHLPARLPVRIVVRRAVPTRTVRMRWDTPVLDDLAALAELLELDGDRLDWLADRREMNRKTLREPLRHYRYTWMGRRLIEAPKPLLRGLQRRLLDEVLGRIPVHPAAHGFVPGRSVHTFAAPHTGRDVVVRIDLAHFFASISVQRVYGLFRSVGYPEPVAHALAALCTTSTPSDIARGSIALRTPHLPQGAPTSPALANLCTFRLDRRLTGLALSFGATYTRYADDLAFSGSFNADHVIAAVRQIVAGEGFRVNPAKTRVRGRGDRQRLAGLVVNERPGVAREEYDRLRAILHAAARDGLDAANRDDHPDFRNHLLGRIAWVGHGSPARAAKLRELFGLVAATGL

SEQ ID NO: 5795 - protein, 434 aa, unidentified
  source 1..434: note = Related to NZ_BMPI01000004.1; note = Dactylosporangium sucinum
MSTAQHRRPDAALRAGQGRHDRVSSGHAALADAFLATPAWERAALLGAGYEVLGRRPRWLGPVVTAVLGAYREPPADRPRELAAFVAALGRVPFRARVAVRRAVPTRVVRMRWDTPRLDDLAALAEFLEVDGDHLDWYADRREINRLAADGALRHYRYTWLATRLIEAPKPRLRTLQRRLLDEVLGRIPVHPAAHGFVPGRDVRTFTAVHLGKSTVVRLDLSAFFASMTVSRVYGLFRGAGYPEPVAHTLAALCTTRTPPDVVRDAPSFLLAAQLRQPHLPQGAPSSPALANLIAFRLDRRLAGLADRFGADYSRYADDLAFSGAFDAPRLVAAATDVVVDEGFRVHPMKTRIRGRADRQQLAGLVVNEHAAVPRTEYDLLRAMLHTAARDGLAAANRAGHPDFRAYLAGRIAWVGRDHPSRAAKLARLFTALP

SEQ ID NO: 5796 - protein, 310 aa, unidentified
  source 1..310: note = Related to NZ_JAGGJO010000001.1; note = Micromonospora sp.
MVRRPTRHEPPRHRPPPAPLPLPVDRGRPADRGTEVPAARPATPAPHRGPRPHPGPPAAHGFVPGRSAHTFAGIHTAQPVVVRIDLLAFFTHIPATRVHGLFRTAGYPESVAHTLTGLCTNRTPHPVLRRAPTELPHRAARLAALRTGHLPQGAPTSPALANLCAYRLDRRLTGLADAFAITYSRYADDLAFSGDLTTRRIDDLIADVTDIARDEGFQVHPAKTRVRGRADRQLLAGLVVNQHPATPRDEYDQLRAILHNAARTGLAAQNRTGHPDFAQYLIGRVTWISHHHPARAAKLAALLAHALAAP

SEQ ID NO: 5797 - protein, 442 aa, unidentified
  source 1..442: note = Related to WBKT01000007.1; note = Micromonospora sp.
MLWPAVVRVTGVPQQARRDPRRHRPDTGTAYRPINSAVQSRGTPAGTPVVPRQRDPALHGSLHRATRTGDTDDGLRSLRCSHGGVSRADQAGLPCGVRSRSLRGNSGKDHSPRHHTTGAKSRLRALQRRLLAEVLGRIPVHLAAHGFVPGRSAHTFAAAHAAQPVVVRIDPLGFFTHIPATRVHGLFRTAGYPEPVAHTLTGLCTTRTPHPVLRRAPTGLPHRATRLAALGTGHLPQGAPTSPALANLCAYRLDRRLTGLADAFETTYTRYADDLAFSGNLTTRRIHTRSPPSPTSPAKRASESTQPRPASVGAPTGNSSPDSSSTTTPPHHATNTTSSAPSSTTPPAPASPPSTGPTTPTSLHTSSDEFSESAITTRHAQPNSPRCWPKLLRHRRLTRRGSFAGSRQGHVGRPKRGLSRTYTCSADLRQASTATRLCDPLT

SEQ ID NO: 5798 - protein, 537 aa, unidentified
  source 1..537: note = Related to VDFY01000230.1; note = Micromonospora orduensis
MPGAAPFIGRGLTPRIHRHATCIADTHGGPRSLRCSHGGVSRADQAAPPRGVRSRSLRGNPGDAILTSAPHHRCVGTLREPVHPYDRASSGHAATPTGLPVNTIHALATALADAFLAGAGWRRGDLVDQGGLVLGVRRRWLWPVADAALVAYLHPPTDRPRELATFLSTLDPLRAAVTAARQHRRPIVIRARPVTPTRTVRRPWHTPVIDTVGDLAAMLDLSIEHLDWYADRRAMNRRAPAHRLHHYHNRWTDRGRLIEAPKSRLRALQRRLLAEVLGPIPVHPTAHGFVPGRSAHTFAATHAAQPVVVRIDLLAFFTHIPATRVYGLFRTAGYPEPVAHTLTGLCTTRTPHPVLRRAPTDLAHRAARLAALRTGHLPQGAPTSPALANRCAYRLDRRLTGLADAFEITYTRYADDLAFSGDLTTRRIDDLIAAVTDIARGEGFQVHPAKTRVRGQADRQLLAGLVVNHHPATPRDEYDQLRAILHNAARTGLAAQNRTGHPDFAQYLIGRVTWVGHHHPARAAKLATLLAQALAAP

SEQ ID NO: 5799 - protein, 459 aa, unidentified
  source 1..459: note = Related to NZ_RAQQ01000031.1; note = Micromonospora globbae
MTTVRALTTALADAFLADGDWHRPDLVNRGGLVLGVRRRWLWPIADAVLVAYPHPPRDRPRDLAAFLATLEPLRGAVTAARQHGRPIVIRARPVAPIRTVRHPWHTPVIDDIGALAAMLDLSIEHLDWYADRRAMNRRATDQRLHHYGYRWTNRGRLIEAPKPRLRALQRQLLAEVLGPIPVHPAAHGFVPGRSAHTFAAAHAGQPVVVRIDLLAFFTHIPASRVYGLLRIAGYPEPVAHTLTGLCTTRTPHTVLRQAPADLPHRSARLAALRAGHLPQGAPTSPALANLCAYRLDRRLTGLADAFALTYTRYADDLAFSGDLTNQRTSDLTAAVTTIARDEGFRIHPDKIRVRGQADQQLLAGLVVNHRPAAPRDEYDRLRAILHNAARTGLDAQNHTGHPAFAEHLTGRVAWIAHHHPTRAANLARLLDQALNPPDGRSTTATRQAPAQLDVGEAAT

SEQ ID NO: 5800 - protein, 533 aa, unidentified
  source 1..533: note = Related to POTY01000051.1; note = Micromonospora craterilacus
MAAEDIPVAANGSASRPATAERAATGVRLGWLGCTDGSVSRADQAAPPGGARSRSLRGNPGDATLTQAPHHRCVGTLREPVHPHGRASSGRAAPIRWAAVTTVHALATALADAFLAEDSWRRPDLVHRGGLVLGVRRRWLWPVADAVLVAYPRPPRDRPRELAAFLTTLDPLRDAISAARWQGRPIVIRTRPVAATRTVRRPWHTPLIDDVGALAALLRLSVEHLDWYADRRAMNRRASDQRLHHYRCRWTDRGRLIEAPKPRLGALQRRLLAEVLGPIPVHPAAHGFVPGRSAHTFAAAHAGQPVVVRVDLLAFFSSVPATRVYGLFRTAGHPEAVAHALTGLCTTRTPSSVLRQAPSDLPHRSARLAALRAGHLPQGAPTSPALANLCAYRLDRRLAGLADAYGATYTRYADDLAFSGDLSASSLITAVSEIVRDEGFRIHPDKTRVRGQGDRQLLAGLVVNGRPATPRDDYDRLRALLHNAARTGLDAQNRTGHPAFADHLAGRVAWIGHQHPARAAKLAALLAEALAAR

SEQ ID NO: 5801 - protein, 444 aa, unidentified
  source 1..444: note = Related to NZ_QUMQ01000001.1; note = Asanoa ferruginea
MTSARSLAVALADAFLADGEWRRPALADRGGLVLGVRRRWLVPVADAVLTAYPRRPSDRPRELAAFVAGLEPLREAVRRPILISSRQVVATRTITHRWHTPVLDHLGDLAAQLGLSIEHLDWYADRRAMNRRAADPRLHHYRYRWAGTRLIEAPKPRLRDLQRRLLTDVFGRIPVHDAAHGFVPSRSASTFATAHSGQPIVVRVDLLAFFATVTAARVYGLLRTAGYPEPVAHALTGICTIRTPANVLRMAPPHLIERPARIAALRAGHLPQGAPTSPVLANLCAFRLDRRLTGLAGAFGVSYRRYADDLAFSGGISGQRLDDLLVAVADVVRDEGFRVHPTKTRIRGRGDRQLLAGLVVNERPAVPRDEYDRLRAILHNAARTGLAAQNRGGHPAFAEHLAGRVAWVGRASPHRAAKLASLLDAALATAANPAHPHQRDIVDM

SEQ ID NO: 5802 - protein, 435 aa, unidentified
  source 1..435: note = Related to NZ_BONC01000044.1; note = Asanoa iriomotensis
MTDARGLAVALADAFLADGEWRRPALADRGGQVLGVRRRWLVPVADAVVTAYPRRPSDRPRELAAFVSGLGPLREAVRRAATPIVVRSRPVVATRTVSHRWSTPVVDDLGGLAAVLGLTIEQLDWYADRRLLNRRAADDRLRHYRSRWVGGRLIEAPKPRLRALQRRLLTEVLGPVPVHGAAHGFVPARSAATFAAAHAGRPVVVRVDLLAFFATIGAGRVYGLLRTAGYPEPVAHALTGLCTIRTPASVLRLAPHDLVDRPVRLAALRAGHLPQGAPTSPALANLCAFRLDRRLSGLAGAFGLTYGRYADDLAFSGELPGRRLDDLLVAVAEVVRAEGFRVHPAKTRVRRRGDRQVLAGLVVNERPLVPREEYDRLRAILHNAALTGLAAQNRTGHPAFAEHLAGRIAWVGQGSPHRAAKLAALLDAALSTDPR

SEQ ID NO: 5803 - protein, 439 aa, unidentified
  source 1..439: note = Related to NZ_LT607412.1; note = Micromonospora coriariae
MTTVGSLAVALADAFLAADRWLRGDLVASGGRVLGVRRRWLWPVADAALAAYPRAPRDRPRELAAFLANLALLAEVVGAARQRGHTVAVRARPVTPTRTVRRPWSTPVLDDLADLARLLDVTPDQLDWYADRRAMNRRADDQRLHHYRYRWTVAGRLIEAPKPRLCALHRRLLAEVLGPLPVHPAAHGFVPGRSAHTFAAAHAGRAVVVRIDLAAFFGSVPARRVYGLFRTAGYPEPVAHTLTAICTTRTPAAVLRAAPVDLPDRVWRLAALRGGHLPQGAPTSPALANLCAFRLDRRLTGLAAAFDVDYQRYADDLAFSGELPPRRVADLLAAVTEVVRDEGFRVHTRKTRVRGRADRQLLAGLVVNERPAVPRVEYDRLRAILHNAARTGLAAQNHAGHPAFAEHLAGRVAWVGHTHPGRAAKLAALLAAALASPQT

SEQ ID NO: 5804 - protein, 458 aa, unidentified
  source 1..458: note = Related to NZ_AP023359.1; note = Polymorphospora rubra
MLSGVGGEEPPGRPGERVAAALADAFLAGDWGRDGLLGRGALVVGVRARWLRRVAAEVLGAYPRVPADRPRELAGFVAASPVYRAAWHSARRRGRRLRVRARPVTATRTVRRPWPTPVVDDLAALAALLGLTPEELDWYADRRSINRHARDERLRHYRYTWLGGRLIEAPKPRLRALQRRLLAEVLGPVPVHPAVHGFVSGRSAHTFAAAHAGRPTVVRVDLVSFFATVSAPRIFGLLRLAGYPEPVAHTLTALCVTRTPAGVLRAAPAGLPDRPYRLALLRGPHLPQGAPTSPALANLCGFRLDRRLAGLAAAFGATYTRYADDLAFSGDLPPRRAAALVDRVTAVVAGEGFRVRPDKTRIRGRADRQLLAGLVVNTAPGVPRDEYDRLRALLHNAARTGLAAQNRAGHPDFEAHLAGRIGWVGRDRPARAAKLRALFEAARLRPDDGSPGAHAAAP

SEQ ID NO: 5805 - protein, 410 aa, unidentified
  source 1..410: note = Related to JADGGF010000365.1; note = Micromonosporaceae bacterium
MLGYAPQWTDGVVDEVLTYPRPPADRPRELARFIARLRAFRSHVAGAPGASPEAAPVRVVHRVVTPTVTVRQPFHTPRLDSVADVADWLGLSIVELEWFADVREINRQATDRRLRHYTYRWLNGRLIEAPKPRLRSLQRKVLDELLGPIPVHPAVHGFVSGRSPHTFAAPHAGQRMVIRLDVMSFFASVTAARVYGLLRAAGFPEPVAHVLTGLCTTRTPPDVLRRAPARVPNRDLRLALLRAPHLPQGAPTSPALANLCGFRLDRRLAGLAQSNGLRYTRYADDLAFSGFTSQPQRFIDIVRSIVADEGFRLNEAKTRLRGAADRQLLAGLVVNAAPAAPRDEYDALRALLHNAIYTGLDEQNRDGHPDFVAHLAGRIAWVGHRHPTRAAKLHALFQRALSGPPPEATA

SEQ ID NO: 5806 - protein, 446 aa, unidentified
  source 1..446: note = Related to JAHBSN010000079.1; note = Actinomycetia bacterium
MTRGRTLAVDAADALAGAFLAGEWDPPAMARRAQRALGDRRGWTLELARVVRAGFPERPADRPRELAGFIGRCEVFHRAVQDPDRPMRVRVWMAPPTEMGPARWPVAPLPDVAALATWLGVTVDHLAWFADRRSLERHVDDERLRHYRRRWLAKPDGTARLLEAPKEELKDLQRQVLHQILDRIPAHDAAHGFRPNRSVRTSAAVHRGQEVVVRLDLEAFFTSVDVGRVYGIFRLAGYPEPVAHTLAALCVTVTPGAVLRSAPPVPDSLVDARRRLLHRLRSPHLAQGSPTSPALANLVAFRLDRRLAGLAAALDARYTRYADDLVLSGGRNLVRSAGPILHLVERIARSEGFTVHDRKTRVLTSAQRQRITGLVVNGGVNVARPDYDRLRAVLHDAALHGPEAANREGHPDFQAHLQGRVAWVGAGNPGRAHKLARAFAAIDWDA

SEQ ID NO: 5807 - protein, 453 aa, unidentified
  source 1..453: note = Frankiaceae bacterium; note = Related to JAFAZI010000149.1
MSTSRASVANALAAALLDGEWKSVTTLAGRGARALGVSQRRLGAVAGDVLAAYREPPLDRRRELSSYLLELPSFHVLWEGPGRPPIVQRHRLPLADMGRARWPVPTIATSLELASWAEEDLSVLDWYADVRSLERSAAPKLRHYDREWRYNRRGGVRLLERPRSRIKGLQRRVLREMLDVVPAHGAAHGFVAGRSVVSFVTPHVGRDVVVRLDLTACFASITAPRVFGVFRMLGYPEAVAHTLTGLSTTVVPRDVLRSAPQALRNEDLDARRWLLTRLAEPHLPQGSPTSPALANLVLFHLDARLSGLAAAAGASYSRYADDLAFSLDGTDAVRRAKRLVASARSVVADERLRLNDAKTSITRRSQRQVLCGVVVNDKPAVERRRRESLRAALHNIRQHGPESQNRAGHEDFRAHLLGEIAWVSAVNPDHGERLRSEFAQITWSELGPGASQP

SEQ ID NO: 5808 - protein, 336 aa, unidentified
  source 1..336: note = Related to JACGZW010000002.1; note = Amycolatopsis dendrobii
MPVWRWQVARWTTFDECAAALDLTPGELSWFADERGWHRRSGPVLRHYSYRWIPTATGGARLIERPKPRLAEVQRRIRRQVLDALPVHEAAHGFRRGRSIHTCARPHAGQDVVVRLDLAGFFPTVSASRVRSLLDLAGYPKAVAAAIAGILTTRTPVDVLRSAPARSAMLSHLAGTHLPQGAPSSPSVANAVTHHLDRRLSGLAAVLGANYTRYADDLAFSGDASLPLHRLLPGVRRIVTDEGFRLRDDKTSVKPAYRQQRVAGLVVNAAPAVARAEYDELRAVLHNCARTGPAQQNRAGHPDFRAHLMGRIAWISATNAARGTKLRGLFDRIDWS

SEQ ID NO: 5809 - protein, 350 aa, unidentified
  source 1..350: note = Related to NZ_PDJK01000002.1; note = Amycolatopsis sulphurea
MNGERVTSASLLGPMPVWRWPVARWTTFDECAAALDLPPGELSWFADTRGWNRRAPARLRHHCHHWIPTASGGARLIERPKPRLAELQRRVRRHVLDALPVHEAAHGFRGGRSIHTCAQPHAGQEMVVRMGLEGFFPAVSATRVRALLELAGYPPAVRAALAGILTTRTPVDVLRAAPVRARSLGRLAGTHLPQGAPSSPSVANAVTHHLDRRLSGLAASLGVNYTRYADDLAFSGDAGLPLHRLLPGVRRIVTDEGFRLRDDKTSVTPAYRQQRVAGLVVNATPAAARAQYDELRAVLHNCAKTGPAPQNRAGHPDFRAHLRGRIAWISATNPARGAKLTDLFHRIEWD

SEQ ID NO: 5810 - protein, 369 aa, unidentified
  source 1..369: note = Related to NZ_CP080519.1; note = Amycolatopsis sp.
MNGERVTPASPTNPANPAEHTKPFGPQEPSLLDPLPPIWRWQVPHWPTFESCAAALDLTPGELSWFSDPRHWNDRANHTLRHYHHRWIPTSTGGLRLIERPKPRLAELQRRIRRHVLTALPVHDAAHGFHPGRSILTCAQPHAGQDKVIRMDLEHFFPTVSARRIRSLLELAGYPPAVAQALAGILTTTTPPVVLKNAPRKVRDQLKKPHLPQGAPSSPAVANAVTNRLDRRLSGLAQKLGANYTRYADDLAFSGEATLPLHRLFPGVRRIVEDEGFRLRDDKTSVAAKHQRQRVAGLVVNTKPAAQRTYYDDLRATLHNCATTGPQAQNHAGHPDFQAHLRGRIAWISATSAPRGVKLKELFDRIDWS

SEQ ID NO: 5811 - protein, 362 aa, unidentified
  source 1..362: note = Related to NZ_FOEF01000001.1; note = Amycolatopsis saalfeldensis
MNGESVTSASLLQPWPVWRWPVSRWASFDECAGALDLMPGELGWFADARSWNRRANPVLRHYSYRWIPTASGGIRLIERPKPRLAELQRRVRRHVLDALPVHEAAHGFRTGRSILTCAQPHAGQQLVVRMDLEAFFPTVSARRIRALLELAGYPAAVSAALAGILTTATPADVLREAPAGRRGPVRARLLNSLAATHLPQGAPSSPSVANAVTHHLDRRLAGLARTLGARYTRYADDLAFSGDAGLPLHRLLPGVRLIVTGEGFRLREDKTSVAAAHQQQRVAGLVVNSAPAATRASYDELRAVLHNCARTGPAAQNRAGHPDFRAHLLGRIGWIAATSRARGEKLKALFDRIDWHAETAGD

SEQ ID NO: 5812 - protein, 355 aa, unidentified
  source 1..355: note = Related to NC_021252.1; note = Amycolatopsis keratiniphila
MTGERVTPASLLGPMPVWRFQVARWTTFDECAAALDLTPGELSWFADAKGWNRRAAEPVRHYTYRWIPTASGGVRLIERPKPRLAELQRRIVRHVVDALPVHEAAHGFRRGRSPLSCAAPHAGRETVVRMDLEGFFPTVSARRISALLALAGYPPAVAEALAGVLTTAVPPAVLATVPGGRRDPARTRLLSNLAATHLPQGAPSSPSVANAVTHHLDRRLGGLARALGATYTRYADDLAFSGDSLPLHRLLPGVRRIVTDEGFRLRDDKTSIAGAHQRQRVAGLVVNSAPAATRADYDALRALLHNCARTGPETQNRSGHPDFRAHLLGRIGWIAASSERRAAKLRDLFGGITWP

SEQ ID NO: 5813 - protein, 357 aa, unidentified
  source 1..357: note = Related to NZ_ARVW01000001.1; note = Amycolatopsis nigrescens
MNGEKVTSASPLGPLPVWRWPVARWTTFDECAAALDLTPDELSWFADAKSWNRRAAGPLRHYRYRWIPTASGGIRLIEQPKPRLAELQRRLRRHVLDALPVHEAAHGFRPGRSAMTCAAPHAGRDLVVRMDLEGFFPTVSARRLRSLLLLAGYPEAVAGALAGMLTTAAPVDVLTAAPDGRRDSARTRLLNNLAATHLPQGAPSSPAVANAVTHHLDRRLAGLANVLGARYTRYADDLVFSGDTGLPLHRLLPGVRAIARDEGFRIRDSKTSVTAAHQRQRVAGLVVNSSPAIARAEYDELRALLHNCARTGPGVQNRHGHPDFRAHLLGRIGWAGASSPARAAKLREMFDRISWTG

SEQ ID NO: 5814 - protein, 349 aa, unidentified
  source 1..349: note = Related to NZ_FNON01000006.1; note = Amycolatopsis xylanica
MLDPVWRWPVARWETFTDCARALDLTEGELSWFADARTWNRRADAPLRHYTYRWIPTASGGIRLLERPKPRLAELQRRVVRHVVNALPVHDAAHGFRAGRSALTCAAPHAGQALVVRMDLEGFFPSVSARRVRSLLLLAGYPEAVALALAGVLTTAAPVDVITGAPDGTRDASRVRLLNNLARTHLPQGAPSSPSVANAVTHHLDRRLAGLARVLGATYTRYADDLAFSGPAELPLHRLLPGVREIVRAEGFRLRDNKTSVAAAQHRQRVAGLVVNSAPAAARADYDDLRALLHNCARTCPAAQNRYGHPDFRAYLLGRIGWIGTGHPARAARLRALFDRVEWPDTLPG

SEQ ID NO: 5815 - protein, 357 aa, unidentified
  source 1..357: note = Related to CP090063.1; note = Amycolatopsis acidiphila
MNGEKVTSVSPLGPRPVWRSPVPRWTTFDDCAAALDLTPGELAWFADARSWNRRAGTALRHYRYRWLATAGAGIRLLEQPKPRLAELQRRVCRHVVGALPVHEAAHGFRRGRSAITCAAPHAGRALVVRMDLEGFFPAVSARRVRSLLELAGYPAAVAAALAGILTTAAPVDVLAAAPDGRRDPARTRLLNNLASTHLPQGSPSAPAVANAVTHHLDRRLAGLARTLGVRYTRYADDLAFSGDATLPLHRLLPGVRLIVRDEGFRLRESKTSVTGTHQRQRIAGLVVNSSPAAARPDYDALKALLHNRVRTGPQPQNRLCHPDFRAYLLGRIGWIAASHPRRGEKLRALFDRISWQG

SEQ ID NO: 5816 - protein, 620 aa, unidentified
  source 1..620: note = Related to NZ_NKYE01000001.1; note = Amycolatopsis antarctica
MNGSGPDGARDDVPRDFVSRDCAPRDEVSGGEVSGGEASGGAASGTLPAATDAAPDAATAAADAAAADADADADADAATDAAAATAAAATDAAAAATAAAATDADAATAAAADADVAADDEPGHDMDELAPGPAHAEHPGGAPEPAEPVEPAELIERGDWPALIQRSRDRARTRWRSNAGRSVAAALAGPWQRDALADRLTEEAGHSADAAAELANRLVELNPSPPFGGERHLARLIADLPPLPAPAPVAPFRITGGTAEPQAGLSVAAREWRWDVPRWNTVGECAEALDLTVGELDWFADRGTWNRRAACPLRHYRYRWIPTSSGGVRLLEQPKPRLAELQRRITRHVLSRLPVHEAAHGFRPGRSAFTCAAPHAGSARLVRFDLEGFFAAVAPGRIRSLLGRAGYPRAVAGALAGVLTTAAPVDVLSAAPRASDDAVRHRLLRGLAAAHLPQGAPSSPAVANAVTAGLDVRLEALARALDARYTRYADDLAFSGDSTLPLHRLLPGVRRIVMDEGFLLRKGKTSVTFAHQRQRVAGLVVNSAPAVPREEYDALRALLHNCLRTGPAAQNVHGHHDFRAHVLGRISWVGATHPGRAGRLRTVFDRISWHETDVTGSRHG

SEQ ID NO: 5817 - protein, 434 aa, unidentified
  source 1..434: note = Related to NZ_JAENJH010000016.1; note = Prauserella cavernicola
MSAVERRVAARRRQAEELAAIALAGLWEQTELASRLEGHSRLDGDDARLLAQRLLETFPGGSPSVAGFVDALRRYPPLPVRTLPGSAVVPVEPWPVWRWDVPRWRTVRECAQALDLTEGELYWFADARGWNRRARASLRHYRYRWVPTRSGGVRLLEQPKPRLAELQRRVVRHVLAALPVHDAAHGFRKGRSAATCAGPHARRDLVVRLDLEGFFAAVPATRLQGLLALAGYPAGVAQLLAGLLATETPADVLSAAPRAGDALVRRRLLEHLARPHLPQGAPSSPSAANAVACHLDVRLAGLARVLGATYTRYADDLAFSGDARLALHRLLPGVRRIASDEGFRLRDTKTSVAGAHQRQRVAGLVVNTAPAAPREDYDALRATLHNCVRTGPAAQNRHGHPDFRTHLLGRIAWVGSTHPGRAAKLRALYDRITW

SEQ ID NO: 5818 - protein, 355 aa, unidentified
  source 1..355: note = Related to NZ_MASU01000002.1; note = Prauserella flavalba
MRTLPDSRAVPVEPEPVWRWDVARWRTVEECAHALDLTEGELYWFADARGWNRRAGTALRHYRYRWVPTRSGGVRLLEQPKPRLAELQRRAVRHVLGALPVHDAAHGFRRGRSAATCAAPHASKDLVVRLDLEGFFAAVSAARLRGLLRLAGYPDGVATLLAGLLTTSTPVDVLAAAPRSRDDAVRRRLLHRLAAPHLPQGAPSSPSAANAVAYHLDVRLAGLAGVLGAAYTRYADDLAFSGDARLPLHRLLPGVRLIAREEGFRLRDSKTSIAAAHQRQRVAGLVVNAAPAAPRAEYDALRAILHNCARTGPQAQNRHGHPDFRAQLLGRIAWIGSTHPGRAARLRALFERITW

SEQ ID NO: 5819 - protein, 457 aa, unidentified
  source 1..457: note = Related to VIVS01000002.1; note = Prauserella muralis
MPRVSEPGDDEAADVGDWRQRGRARRRRRTVERRRQAHQLALLALEGPWDRADLTARLVRGSRLDDDDARHLTARLHERFPDAPPDDPGRVAAAILALPPLPVRTLPGSVEAPVEPMPVWRWPVPHWRTLGDCAEALDVDVGELQWFADTRGWNRRAGAALRHYRYRWVPTRSGGVRLLEQPKPRLAELQRRVTRHVLAALPVHDAAHGFRPGRSAATCAEPHAGRSFVVRLDLEGFFAAVSAARVRALLRLAGYPPAVAAAVAGLLTTTAPADVLSAAPNTRDRESRRRLLRRLAAPHLPQGAPSSPAVANTVAQRLDLRLAGLAAALGARYTRYADDLVFSGDADLPLHRLLPGVRLITGDEGFPLRDSKTSVAAAHQRQRVAGLVVNASPAVPREDYDALRAILHNCVRTGPAAQNRDGHPDFRAHLLGRIAWVGATHPRRAARLRALFARISW

SEQ ID NO: 5820 - protein, 415 aa, unidentified
  source 1..415: note = Related to NZ_CP059997.1; note = Amycolatopsis sp.
MALHRATVALDGPWEPAAVADRLATTSIDFEAAQELAARLFALCPSRPFGPRQLANLLRSLPEPAPAEPSAPDLPSEAAPREWRWGVPRWETPAEVARALDLTVGELEWFADLGGWNRRAPLPVRHYRCRWLPGGRRLVEAPKPRLAELQRRIRRHVLDRIPVHDAAHGFRPGRSPLTCARPHAGRALVVRMDLEGFFAAVSGYRVRRMLCHSGYPDQVAAVVAGLLTTRAPVDVLGEPDRGDPARWRLARNLAAEHLPQGAPSSPAVANALAYGLDRRLAGLAGTLGATYTRYADDLAFSGDADLPLHRLLPGVRRIAREEGFRVREDKTGVAAAHQRQRIAGLVVNSAPAVARAEYDELRALLHNCARTGPAAQNRDGRPDFAAYLLGRIGWASTGNPARAAKLKEMFGRIPW

SEQ ID NO: 5821 - protein, 358 aa, unidentified
  source 1..358: note = Related to NZ_VTHK01000003.1; note = Amycolatopsis anabasis
MPEHARLRPAPPPEPPAPRPWRWGVPRWATPAECARALDLTPGELDWFADLGGWNRRAGRPLRHYRYRWVPTRTGGARLLESPKPRLAELQRRVVRHVVARFPLHEAVHGFRTGRSPVTCAAQHSGRDVVVRMDLEGFFTTVSGRRVRALLAAAGYPPRVAAVLAGLLTTATPADVLADAPAGRDPALRWRQVRGLAGPHLPQGAPSSPAVANAAAHRLDVRLAGLARVLGVAYTRYADDLAFSGDAAVPVHRLVPGVRRIAREEGFRIREAKTSVTGAHQRQRVAGLVVNSAPAVSRREYDALRALLHNCVRTGPRAQNRDGHPDFRAHLLGRIGWAGTGNPRRAARLRALFDRIAW

SEQ ID NO: 5822 - protein, 409 aa, unidentified
  source 1..409: note = Related to NZ_JACHMH010000001.1; note = Crossiella cryophila
MTSADLLHLARTALDGAWTRPALATRLAGISLHAAPNPDPEDLAARLLDLSPSPFFGPPEALARLLADLPRQVEPAAAPRPRWRADVPRWETPADLAAALRLTPGELDWFADARTWNRRAATPLRHYRHHWLGHRPLEIPKPRLAEIQRRLNRLLLARLPLHEAAHGFRPGRSAATFAAPHAGQPLVARFDLAGFFTSITAARLRAYFRHLGYPGNLAVALTGLLTTATPPEVLRAAPPGAQRHRLATPHLPQGAPSSPAIANALAARLDRRLAGLAERIGANYTRYADDLAFSGDLPVDRLRAGVRRIAADEGFRLHPGKTRIAAAHQRQKLAGLVVNVRPAVSRADHDRLRAVLHNCARTGPDAQNHVGHPDFRAHLLGRIGWVGATHPARAARLRAIFDTIHWGQA

SEQ ID NO: 5823 - protein, 402 aa, unidentified
  source 1..402: note = Related to NZ_RBXR01000001.1; note = Saccharothrix variisporea
MLTEAQAAAVLDGPWDRGGLAERLADVIGPVPAEDLAVRLLGLSPTAPPGGAPSLVRLVGDLALETPPEEPRWRGEVPRWETTGDLARALGLDVGELAWFADARAWNRRAGEPLRHYRTWWVPSRSHGRRLIESPKPRLAELQRRLVRHLLDRFDVHDAAHGFRKGRSTTTFAAPHAGKPLVVRLDLEGFFTSVTGARLRGLLTAHGYPITVATALTGLLTTRTPPEALHPADWPQRRRLAAPHLPQGAPSSPATANVIARALDRRLAGLARTLGATYTRYADDLAFSGDDDLPLHRLLPGVRGVVEDEGFRLNPRKTRIAAAHQRQRLAGLVVNDTPAASRAEYDDLKAVLHNCARHGLESQNRHHHPDFRAHLRGRVEWVSAGRPARRARLTALLDAISG

SEQ ID NO: 5824 - protein, 411 aa, unidentified
  source 1..411: note = Related to JAAATY010000004.1; note = Kibdelosporangium persicum
MYVRARGHRENESLRVAASALDGPWTQAEIATRLMPLYVDPAAAEVMADRLVSHSPRAPFGGIADLARLIAAFPPITQAPAPPPKPKRSLDIAGLLDVTPSELDWLADARGWNKRAGKPLWHYRSWWTGTSTGGLRLIEAPKPRLAEAQRRLVRHLGLPVHEAAHGFRKGRSGLTYAAPHSGKPVVVRMDLEGFFASVTGARVRALLHEYAQATTLAGLLTTRAPLAVLRDAPKTSGDPDVRRRLLAHLAHQHLPQGAPSSPAVANAVAYRLDLRLSGLARALGAHYTRYADDLAFSGPQTLPLYRLLPGVAKIAREEGFRVRPDKTSVTGQHQRQKLAGLVVNASPAAPRAAYDELKALLHNCRRTGPQAQNRAGHPDFQAHVRGRIDWVAAGHPARGAKLRALFGQIDW

SEQ ID NO: 5825 - protein, 401 aa, unidentified
  source 1..401: note = Related to JADBEI010000001.1; note = Kibdelosporangium phytohabitans
MESLRVAASALDGPWTRSAIATRLISFYADPAAAETMAGQLLDHCPRPPLGDAADLARMIAAFPPMPGYAPPPPKPKRSLDIAALLDVTPSELDWLADARGWNRRAGQPLWHYRSRWAGTSTGGLRLIEAPKPRLAEAQRRIVRHLDLPVHGAAHGFRKGRSAVTYAAPHAGKPLVVRMDLEGFFACVTGARVRALVHEYQQASALAGLLTTRTPLEVLRSAPPSSGDPDVRRRLLARLAYQHLPQGAPSSPAVANAVAYRLDLRLAGLARALGADYTRYADDLAFSGPQTLPLHRLLPGVRAIARDEGFRVRPDKTSVTGRHQRQKLAGLVVNAAPAVPRAEYDALKALLHNCRTTGPDAQNHVGRNDFAAHVRGRIEWVAAGHPARGAKLRKLYSQITW

SEQ ID NO: 5826 - protein, 412 aa, unidentified
  source 1..412: note = Related to NZ_FWXV01000002.1; note = Kibdelosporangium aridum
MYAWARGYRENRSLRVAASALDGPWTQTDIATRLSALYADPAAAEVMADLLVSHSPRQPFGSLDELARQIAAFPPLPKPPAPEPPKPKKSLDLQALLDVTASELDWLADARGWNKRAGQPLWHYRSRWVGTSTGGLRLIEAPKPRLAEAQRRIVRHVDLPVHEAAHGFRKGRSALTYAAPHAGKPLVVRMDLEGFFASVTGARVRALLHEYEQAATLAGLLTTRTPLKVLRAAPTTSGDPDIRRRLLAHLAHQHLPQGAPSSPAVANAVAYRLDCRLAGLAKALGAEYTRYADDLAFSGPQTLPVHRLLPGVVMIARDEGFRVRPDKTSVARQHQRQKLAGLVVNTAPAVPRVEYDALKALLHNCVKTGPQAQNRAGHSDFQAHVRGRIEWVAAGHPARGAKLRELFCQVTW

SEQ ID NO: 5827 - protein, 417 aa, unidentified
  source 1..417: note = Related to LN877229.1; note = Kibdelosporangium sp.
MSVRHLDLPVHEAAHGFRKGRSALTYAAPHAGKPVVVRMDLEGFFAAVTGARVRALLFEYEQAVVLAGLLTTRTPQEVLRAAPGTRGDPDVRRRLLSRLAHQHLPQGAPSSPTIANAVAYRLDCRLTGLARALGADYTRYADDLAFSGPHTLPLHRLLPGVRTIARDEGFRVRPDKTSAAGQHQRQKLGGLVVNVAPAAPRAEYDAVKALLHNCLATGPGAEPRWPQRLRRARAWPGRVGGGRTRGQGSEVARALQPDRLVVPYDPGVADGAADFEIGKDGLTVIIVGVDGSPPSLHAAAWAGGLARRERAQLVLVYVEPIASPAYWTAMGMAGATEAATAFVDEIRVEAAAYLDHAGIPWELVHYRGDPAHGLEAIAEERRADCIVVGRSRHGGGLVGSVPKMLVKGAKRPVVVVP

SEQ ID NO: 5828 - protein, 378 aa, unidentified
  source 1..378: note = Related to JAGINW010000001.1; note = Kibdelosporangium banguiense
MADRLLAHCPRPPLGNARDLSRLILEFPPEPVLVMPPVPRIWRWGVPQWEYTADVAALLDVTLSELDWLADAGGWNRRAGEPLRHYRPKWVATSTGGIRLIEAPKPRLAEAQRRIARHLSLPVHEAAHGFRPGRSPLTYAQPHAGKALVVRMDLEGFFAAITGARVRALLRTAGYPHQVAIKLAGLLTTRTPLDVLRDTPPTQGDPDVRRRLLARLPGQHLPQGAPSSPQLANAIAYRLDCRLAGLANVLGAEYTRYADDLAFSGPQTLPLHRLLPGVRAIAHDEGFRVRPDKSRVSAAHQRQKLAGLVVNSAPAVPRAEYDALRALLHNCVRTGPEAQNRAGHQDFQSHVRGRIEWVAAGHPGRSAKLRALYRNIAW

SEQ ID NO: 5829 - protein, 432 aa, unidentified
  source 1..432: note = Related to AM420293.1; note = Saccharopolyspora erythraea
MIWQDVALRALAETAVNADAWEQSELAAALLRHFRRDGGASDAFAWTLLAHVPEPPESAEELLALLVAVPELTAALPKAPRPALEVELSPGWRWPVARWHTAEQLAHGLDLDVGELMWFADRGGWLRHAHPPLRHYRCRWMRTRSGGIRLIEQPKARLAELQRRITRRVVDAMPVHEAAHGFRRGRSAATCAAEHAGRHFLVRVDVEGFFASLTFTRISRAMRAAGYPGAVAGAIGGLLTTATPRDVLAAAPRVRESEVDARRRLLGRLAAAHVPQGAPSSPALANALMHRLDRRIDAYAGTLGATYTRYADDLAFSGDRRLPVAALLRGVTAIVRAEGLRLRQSKTRVLAPHQRQRIAGLVVNDGRAVAPRAEYDALRALLHNCARTGPQAQNHEAHPDFRSHLLGRIAWVGINHPGRARKLGELFDRINW

SEQ ID NO: 5830 - protein, 316 aa, unidentified
  source 1..316: note = Related to NZ_CP007155.1; note = Kutzneria albida
MDDWLRLLRIDSGEFAWFADDRGWNRRAAEPLRHYRYRWMRTRSGGLRLIEAPKPRLAEVQRTLLRHLELPVHEAAHGFRRGRSVHTFAAPHAGRDLVLRMDLEGFFASVTATRVRALVGDLAGLVTTAAPVAVLRAAPPAPDVEVRRRLLDRLARPHLPQGAPSSPALANAVAHRLDRRITALADVLGATYTRYADDLAFSGDAGLPLHNLLRGVRRIAADEGFQVRPDKTRITPAHHRQRLTGLVVNDSPAASRAEYDELRAVLHNCVHSGPSTQNRGGHADFRAHLLGRIGWVGENRPARAAKLRALFDRITW

SEQ ID NO: 5831 - protein, 425 aa, unidentified
  source 1..425: note = Related to NZ_JAJGSX010000003.1; note = Pseudonocardia sp.
MAPDPHTVAAAALAGPWQLEPLTERLAEHGKWRSPEEIGDVVAILLGRWRARPRRPFERVVTEVEGLLAARPGTRPPDLEPDVPIWRWPVQQWTDLDALALGLDLRDGELEWFADPGGWLRRTPAGPLHHYRRRWVTARSGTPRLLESPGPRLQELQRRVGRHVLARIPVHDAAHGYVRGRSPATLAALHAGRAMVVKVDLEGFFGHVTGERLAGLMRIAGYPPAVAAALAGLLVTATPEPVLRSAPAAEGAWEARRRLLDRLAAPHLPQGAPTSPAAANLLAFRLDRRLAGLAAALGATYGRYADDLVFSAATLPASGLITRIGRIAEEEGFRLHATKTRVLPSHHRQRVTGLVVNAEPGAARREYDALRALLHNCARTGPDEQNTAEHPAFREHLLGRIAWVSTGRPRRADRLRALFDAIRWP

SEQ ID NO: 5832 - protein, 450 aa, unidentified
  source 1..450: note = Related to NZ_JAHKRK010000047.1; note = Pseudonocardia nigra
MDGPWRRDDLAERLAPLRGWLGPDEVGRTVAVLLARWPRPPTAAPAQVAAELARLLAALPRRGPIVPDPPPRPQWRWPVAPWTDLAALSHALNLRDDELNWFADPGGWLRRAPEGPLHHYRRRWTASRSGVPRLLETPGPRLQELQRRVARHVLARIPVHDAAHGYVRGRSPHTLAAEHAGRAMVLRLDLEGFFGHVTGARVAGLLRTAGYPPAVAAALAGLLVTATPAHVLRHAPAGEPHAWEPRRRLLDRLAGPHLPQGAPTSPAVANLLAHRLDRRLAGLSTAVGARYGRYADDLVFSGELPVHGLAARVTAIAREEGFRARTDKTRVMPSHHRQRVTGLVVNARPAAPRAEYDALRALLHNCARTGPQAQNRDGHPAFRDHLLGRISWVAAGSPNREARLRALFSEIDWSCRSGSRALMVGVDVLLVRQPRDGVHDLVGCGPADHP

SEQ ID NO: 5833 - protein, 353 aa, unidentified
  source 1..353: note = Related to NZ_JAAXKY010000083.1; note = Pseudonocardia xinjiangensis
MRPEEPAVPVWRWPVTPWSSLDALTGGLDLRAGELDWFADRGGWLHRRPEGPLHHYRTRWTASRSGVPRLLETPAPRLQELQRRIGRRVLARIPVHVAAHGYVRGRSPLTLAAAHAGRAMVVRLDLEGFFSHVTGDRIAGLMRAAGYPPAVASALAGLLVTSTPVHVLRGAPPAPPDVLDSRRRLLDRLATPHLPQGAPTSPATANLLAHRLDRRLAGLAAAVGAEYGRYADDLVFSGGARLPAHGIAARVTEIAAEEGFRVRADKTRVLPAHHRQQITGLVVNARPATPRREYDALRALLHNCARTGPDAQNRSDHPAFREHLLGRISWVEAAHPARGARLRARFAEIRWPD

SEQ ID NO: 5834 - protein, 424 aa, unidentified
  source 1..424: note = Related to NZ_JADQDF010000001.1; note = Pseudonocardia oceani
MAPEPHVLAALLPGPWTVDALTTRIAGCRGWGGPDEVGDVVAALLARWSRAPTGRPDRVGAQVAALLAARSRRRHVVPESPPADLAWRWPVEPWTGLDALARGLDLRPGELDWFADRGGWLHRTPDGPLHHYRRRWTTSRSGTPRLLETPAPRLSELQRRVGRRVLARIPVHDAAHGFVRGRSPHTLAAEHTGAATVVRLDLEGFFAHVSGARVAGLLRAAGYPDAVASALAGLLVTSTPAPVRRAAPAGGDVGARRRLLDRLAHPHLPQGAPTSPAVANLLAHVLDRRLHGLAGALGARYGRYADDLVFSGDRLPAHGLVARVTAIAAEEGFRVRPDKTRIAPAHHRQRVTGLVVNAHPAVARVDYDALRALLHNCARTGPDAQNRDGHPAFRDHLLGRIAWAGSGHPARAARLRALFDAISW

SEQ ID NO: 5835 - protein, 425 aa, unidentified
  source 1..425: note = Related to NZ_CP013854.1; note = Pseudonocardia sp.
MAPGAQVVAALARQGRWDTVSLTDRLAVASGWSGPEEIAGVVGHLVGRWRREPTVPDDLFAAQVAELLALPRRHLRVGAPPEPVWRWPVARWTDVAMVARGLHLDEGELAWFADTGGWLRHVPDGPLGHYRRRWTASRPGTPRLIEAPAPRLAELQRRLLRRVLDRIPVHPAAHGYVPGRGPRTLALLHAARPMVLRLDLEGFFSHVTGARIAGLLRTAGYPEAVATTLAGLLVTATPPAVLRACPPAADPQPRRRLLDRLAAPHLPQGAPTSPAVANLLTHRLDRRLSGLAAAVGARYGRYADDLVLSGAANLPVHGLAARVAAIAREEGFRVRPGKTRIAPAHHRQRVTGLVVNSGSPAASRRDYDDLRALLHNAARTGPAAQNRAGHPAFREHLAGRIAWVGGGRPRRAEVLRSLFDAICWD

SEQ ID NO: 5836 - protein, 423 aa, unidentified
  source 1..423: note = Related to MCIS01000001.1; note = Pseudonocardia sp.
MAPHPAAVAAAACAGPWGTDPLTERLAGLGGWSGPEELAGVVGALVARRRRAPRDSSAGVEAEVVALLAGPRRHRRVEQPDPVWRLPVPRWADLSALATALHLDDGELAWFADPGGWLRHAPEGPLTHYRRHWTPSRSGTPRLIEAPAPRLAELQRRIRRRVLDRIPVHPAAHGHVRGRSPHTLAAEHRARPMVLRLDLEGFYSHVTGGRVAGLLRVAGYPPAVAATIAGLLVTATPPGVLRACPHRGDPAARRRMLDRLAAPHLPQGAPSSPTVANLLTYGLDRRLSGLATAVGAAYGRYADDLVFSGDAALPVHGLTRRVAAIAAEEGFRVRPDKTRIMPAHHRQRVVGLVVNGDAPAASRRDHDELRAILHNAARTGPDAQNRAGHPVFREHLLGRIAWVGHGRPARAARLRELFDRISW

SEQ ID NO: 5837 - protein, 405 aa, unidentified
  source 1..405: note = Related to BEGX01000057.1; note = Pseudonocardia sp.
MTDPEAVLVAILRVPWRERAVAAAVREIVGAQRAPELAARLLERWPDAPRVTHAEILAGITTALGRRIVLDPLPPPRWRWPVQRWEDVDALAAGLDLRDGELDWFADTRGWLADGRLGHYRRRWHDRRLIEAPKPRLAELQRRVGRRVLAHIPVHDAAHGYVRGRSPLTLARVHAGQALVLRLDVEGFFTRIGPARIAGLLATAGYPAAVARTLAGLLVTATPPGVLRAAPAHVDAATRDRLRAPHLPQGAPTSPAVANVLAHGLDRRLTALAAAAGARYGRYADDLVFSGDTTLPVQGLLRRARDVAADEGFAVRPAKTRVMPAHHRQRVVGLVVNETPAVSRREFDALRALLHNCARTGPAAQNRDGHPDFRAHLLGRIGWVATGSPARAERLRALFGGISWD

SEQ ID NO: 5838 - protein, 396 aa, unidentified
  source 1..396: note = Related to NZ_BJVJ01000106.1; note = Pseudonocardia sulfidoxydans
MRPDPEVVLAAVLRVPWREEALAAAVTPEVARRLVELWPQPPRDTHAAILAGITRCLGRRIVLDPLPPPRWRWPVERWEDVDALAAGLDLRDGELDWFADVRGRLGDDARAHYRRRWHERRLIESPKPRLAELQRRVGRKVLAHIPVHDAAHGFVAGRSPLTLARVHAGREMVLRLDVEGFFTRIGPARIAGLLATAGYPAAVARLLAGLLVTSTPPGVLRAAPAGTAVERLRAPHLPQGAPTSPAVANVLAHGLDRRLSALAAAVGARYGRYADDLVFSGDGALPVQGLLRRARGVAADEGFAVRASKTRVMPAHHRQRVVGLVVNASPAVPRREYDALRALLHNCARTGPAAQNRDGHPDFRAHLLGRIGWVATGHPTRAARLTALFDAISWNG

SEQ ID NO: 5839 - protein, 412 aa, unidentified
  source 1..412: note = Related to CP002593.1; note = Pseudonocardia dioxanivorans
MRRRRPDPEAVLVAVLRVPWRADALTAAVAGEVGADAAPELVARLLERWPVAPRDTHAAIVAGIGASLGQRIVLDPLPPPRRRWPVQPWEDVDALAAGLDLRAGELDWFADPGGWLDRSASPRLAHYRRRWHGQRLIETPAPRLAELQRRVGRRVLAHIPVHDAAHGFVAGRSPLTLAREHSGRQWVLRLDVEGFFSRIGPARIAGLLGAAGYPAAVAGALAGLLVTSTPAAVLRRAPERPADAVRDRLRAPHLPQGAPTSPAVANVLAHGLDRRLSALAAAAGARYGRYADDLVLSGDGPLPVQGLLRRAREIAADEGFDVRPAKTRVMPAHHRQRVVGLVVNSAPRVPRHEYDALRALLHNCARTGPARQNRDGHPDFRAHLLGRIGWVATGSPARAQRLRALFDAIDWA

SEQ ID NO: 5840 - protein, 421 aa, unidentified
  source 1..421: note = Related to NZ_SHKL01000001.1; note = Pseudonocardia sediminis
MTEEAEGVLRDVLGVRWEVAPLAAALADRIGERAAGAAERLVERWPQAPRGTHADLVEEIAVLLAVRRRLVPAEPQPSWRWGVAEWESVDALSRGLDLRDGETEWFADPGGWLRRAPEGPLHHYRGTWRVSPSGAPRLLETPAPRIAELQRRIGRRVLMRIPVHPAAHGYVRGRSPATFAAVHAGAAMVLRVDVEGFFSRIGPARIAGLLRTAGYPAAVAAVLAGMLVTSTPRAVLRRAPGAPGEARRRLIDRLALPHLPQGAPTSPAVANVLAHGLDRRLDGLAGAVGARYARYADDLVFSGEADLPVHGLLRRAGEIAADEGFDVRPDKTRVMPAHHRQRVTGLVVNAGPAVSRRDYDDLRALLHNCARTGPDAQNTAGHPAFREYLLGRIAWAGTGRPARRDRLAALFARIDFGQDRS

SEQ ID NO: 5841 - protein, 400 aa, unidentified
  source 1..400: note = Related to NZ_FNBE01000010.1; note = Pseudonocardia oroxyli
MTDPEAVLRALLGVPWRLGALTHTLGEVLGERAPEVAARLVDQWPEAPRAAHAELLAGIRGALGRRIVVEEPAPVWRWPVARWASVDELAAGLDLRAGEPEWFADPGGWLRRAPEGPLHHYRAVWRGDRLIETPGPRLAELQRRIGRRVLGRIPVHPAAHGYVRGRSPFTLAAEHAGRAMVVRLDVEGFFTRIGPARIAGLLRAAGYPAAVARVLAGMLVASTPRAVLRRGPSSQRQRLALPHLPQGAPSSPAVANLLAHGLDRRLGGLAAAVGARYGRYADDLVFSGDELPVHGLVRRVSAIAAAEGFTLRPDKTRIMPAHHRQRVTGLVVNATPAASRRDYDDLRALLHNCVQHGPDGQNREAHPAFREHLLGRIAWVGAGRPARRARLRELFDRIAF

SEQ ID NO: 5842 - protein, 434 aa, unidentified
  source 1..434: note = Related to NZ_JIAI01000002.1; note = Pseudonocardia acaciae
MNWLSLAQRALDGPWLQGPLAERLGDELDPAAAERLASAVLAHRPRMPWTEQARFARELAEIPDVVAALAPGNGRGPRVLVSPEWRPVWRWPVPEWTTTEHLAHALDLTPGELAWFADSRGWLRRHRGGPLPHYRHRWLRTRGGVPRLLEAPKPLLAERQRRLLRHLLRAIPTHPAAHGFARGRSVLTFARPHAGKDLVLRFDLEGFFSCIGAARVAGLMRWAGYPGPVATALTGLMVTATPPPVLREAPPPAGPGQVDARRRLLTRLAGTHLAQGAPSSPALANLVAYSLDRRLSALARERGLAYTRYADDIALSGDHATSVPALRRAVSRIARDEGFRIRADKTRVMPSHRRQRLTGLVVNAEPAVARDEYDTLRALLHNCARTGPTEQNRTGHPDFAAHVRGRIAWVAATHPGRGEKLLAQYRAIRWPTPS

SEQ ID NO: 5843 - protein, 480 aa, unidentified
  source 1..480: note = Betaproteobacteria bacterium; note = Related to READ01000015.1
MSVRLFAERKHMLSASDTPPPPKDAAPLAGLSRSIADFLLYSLEQGFALNAKALRERARAHFFDASEILEAVYVELESDEWPWRGQTADVLAQRILVSEALLDLQAPIDEDELWYLDDETLASYKTQHESYLFSLSTMPVWKPPSVRGHAWLHSARSSVPSLESVSDIATWLNVSRDEWDGATNASKYRLRVHRKPSGKLRLLEIPPEPKRVLQRRLLHRLLDHVAPHEAAHGFVAGRSVHTHASLHIQQQVVIRLDLADFFANTLAARVFLLFRALGFVAHVANALTALCTTSQSRVSLRGALGAEYLNGNRYDIYSVNHLPQGAPSSPALANLCAHSLDVRLTAIAGQFGAIYTRYADDIVISGSGEIAARPRKFITLAREIIADEGWRLNPDKTRIMRNTGRQSFTGLVVNERVNVARDEFDRIKAAVHRATRDDVPHVLGLLSWLKQSSPERAAKLRQKLLARNDLTDVRSASKTR

SEQ ID NO: 5844 - protein, 471 aa, unidentified
  source 1..471: note = Betaproteobacteria bacterium; note = Related to REAM01000105.1
MSANEDTSPDDSRTPLLAFERFARSIAEFLLYSHREGFQLSVSALRARATRHFGGHDYLVCAIIREVIDDVAGWCDLPPTTLAQRILDSSALEELVAPFVEDDYWFLDDDALLDLRSAQARRVADAASLAAWLPPPQNGAEWLREARLISPSFATVVDLARWLDVSPEEFDAAMANRRYRLRVHAKPSGGTRLIEIPPESLRVLQRRVLHRLLDRISPHAAAHAYVRTRSAHTHAAQHVGREMVVRLDLRDFFPSIKGARVFLLFRSLGFAANIANVLTALCVASQSRASLRRALGAAHVAFFERFSANHLPQGAPTSPALANLCAHSLDVRLNALAESFNATYTRYADDLVFSGDEGIASEPREFVCLARAIVSDEGFQLNTEKTRIMRKSARQAFAGLVVNEKINLPRCDYDQLKAAVHRATLRSTSEEVSKLLGRIAWLRQNSPHRADKLRSKLISSLPNQSASPTAP

SEQ ID NO: 5845 - protein, 489 aa, unidentified
  source 1..489: note = Burkholderiales bacterium; note = Related to JAGNQL010000184.1
MVIDAAPPSPEWLAAQLAALFSHAVAHGYSLKPATLARRSSRHFAGASGIVRHVARDLQKRGQTGNDWTKWPTEVLADFILKSNAFVPLVDGYAVVTGEVESPKYETEPDAEIMALLAENPEALAAWLERDEADDVPLYAPFVATRPLPEVMPNFAATLPALNGVSDIARLLDVSREEWDDALARSRYRLRCVRKSSGGVRLIEIPSEALRVLQRRTLHRLLGRVSVHDAAHGFVRGRSVHTHAAAHVGRDIVIRLDLKDFFPSISGARVFLFFRSLGYNVRAANALTALCVAWQTRRSLRDGLKTLATTTDINALLPRYSVAHVPQGAPTSPALANLCARSLDLRLDAWAKSFGATYTRYADDLVFSGDAALAKSWRAFIATARVIIGEEGWELNVQKTRVMRRSVRQVFTGLVVNSRVNVARDEFDALKASVHRFCKPDATANADELRVLLGRVAWLGQSHPARAEKLRNKLYASTDSRADTNGDAA

SEQ ID NO: 5846 - protein, 486 aa, unidentified
  source 1..486: note = Related to NZ_CP041352.1; note = Casimicrobium huifangae
MPATVPSETTPPPEVDAIADALAAFMLAEHTAGRSLTARALTARASARFVGCSALLGAARRDLALHAELAWPHWSAAQLAARIRKLPAFERLVTQSVLLTAAIEDITATLAHAADEKERGEHADWVAGLQARRARLQADLPRIWPVAATAGSDPPRVESGLQPLADLARRIEISEDELDAALRTSRTPHAFRLLVMRKQSGGLRVIEQPQDALRVLQRRVLREVLATADLHPAAHGFVRGRSALTHAALHSGRRLVLRLDIADFFTSITAGRVHSAFLRLGMPPRVATALTALCTSVQRAGALRAALRRHDAFASQTRIVGHVRDWQQTLCVPHLPQGAPTSPALANWIAYRLDRRLSGLAAAWDMRYSRYADDLTFSTDASDCNSLRFVDQVRTIVATEGWLLNERKTLVMPQSNRQRVTGIVVNQTMNLCRQDYDALKAAVHRHVNAPPDDAQRSQLLGRIAWLAQFRPERADRLLHKLRSAPR

SEQ ID NO: 5847 - protein, 453 aa, unidentified
  source 1..453: note = Deltaproteobacteria bacterium; note = Related to JAFLCL010000155.1
MAAVHALAHAIASAFLDGPWVPREMAQRATYAVRGVRTETRVGLHLVIPHEAVRTRTWLPALARATVMRFPEPPHATLDALAVWIGDQDSLARHAHITVVRAIALPAPAMSTMRGALADLGVPSITTLPELAAQIGTSVAALDFLSRARPREIVRPQHRTTLLRKQSGGLRVLEIPSPPLARAQRAILDAIVAHVPIHDAAHGFVRGRSPRSAAVRHMHREVVVRLDLADFFLSITAARVRGVFSRMGYPDVIAARLTRLTTTATRPDVIASLRTHVDHASTHALAQRLRTPHLPQGAPSSPALANLVAYHLDARLAGLARRFGATYTRYADDLTFSGDASLSHHVRGLVRSVVAICRDESFGVRHDKTRVLRRHRRQDVLGVVVNDRPNLARDRYDLLRAVLHRVAREGWERAEIDGQPIGPSALAGHVAHACTLVNDARARKLRAMLARLP

SEQ ID NO: 5848 - protein, 408 aa, unidentified
  source 1..408: note = Related to JACKEY010000014.1; note = Alphaproteobacteria bacterium
MLLRSPWELYALWAALDEAFGRRMPFTRQLAMEALRVGRVGEERLARGLREGRAFRGLLRDEEPLRLVLWDLPVTQMQPPRVPLHWEPPELPTDDALAAWLGLELGPLRAFADLQDRARHHPPAWRNYQHRWIGRRLIEAPKARLKHVQRRVLHGILDALVVHPAAHGFVRGRDRRSHAAPHVGHEVVARVDLARFFPSIHRRRVTGLFEAMGYPRRVARLLAGLCAARTPPDVVEAGPADAPVRYDAPHLPQGAPTSPAVANALCWRLDQRLSARATASGHVYSRYADDLTISGPRRGMRALVAAVQVIAADEDFVVAADKTRVMHQSEQQRVTGIVVNAQPGVPRRERERLEAILVNCGRTDPAAQNRDGHPDFAAHLRGRVAAVGAVNARHGEKLLALWQAVDWG

SEQ ID NO: 5849 - protein, 437 aa, unidentified
  source 1..437: note = Related to JAHQVJ010000021.1; note = Myxococcales bacterium
MHAATFCALLAEAFLAGDWQPADMARRGSAMIDAAGSQRRWMRRLAGRVAESLPRGEHLTPARVASFVERDLGFRRVWSTWLSSCRIRQRFWVHPTMGPSQLPLEAALPQVATAGQLADWLGVGVSELAGFADLQGRHLRASARSRRHYRRRWREPRSVAGSPRLLEAPKDRLRRLQRRILRGILSQVQVHDAAHGFVPGRSVHSCAARHACRPVLVRMDLSAFFTGIDGRRVAGLFEAMGIPRTVARVLAGLCTTATPADELAALAHTWWLRVLYARPHLPQGAPTSPALANLCAFRLDARLDAFARSKGWRYTRYADDLYLSGPDRPHRLVRMVHRIARQESFTVNARKTSIMRPGRAHRCLGLSVDRQPAVPRQLRERLEAILTNCVRHGPNGQNREGHPDFRRHLEGRVAWVTAACPRHGERFARLLEEIQWP

SEQ ID NO: 5850 - protein, 450 aa, unidentified
  source 1..450: note = Related to JAGQJO010000674.1; note = Myxococcales bacterium
MISHLPRGIPGVPTSMHDHRQAADPAVRRAGSQGTESEVSLHHPLIDALADALLAVPWDREALQRGFREVLGGYDPLAAGLAARLWTDARPDRGEAVRLLVEDVELRRLLQGPVVARRRAWHFPEEDPAPLRFEGLPELPDVAALARWLGWSVPVLLGHADLRHDHRRRAEYRDYVYRWHGARLIEAPKDRLAGGQRRILRELLVHVPLHDAAHGFVRGRSPRTHARLHVGCAVVVRVDLERFFASITAPRVRGMFRALGYPRRVASLLAGLTTSWPPPDVVPGGSPWSAPHLPQGAPTSPALANIVSHGLDRRLQGLARHHGAAYSRYADDLTFSGRALPSSLVPTIEQIAVSEGFRVRRCKTRRMGEGAAQRVTGLIVNRHVAVSRRERDHLRALLHLALTRGPASVRVEGVDDVRSWLRGRIAWVAHARPAHAERMLEVFHQIAWTA

SEQ ID NO: 5851 - protein, 454 aa, unidentified
  source 1..454: note = Related to JACKEN010000003.1; note = Deltaproteobacteria bacterium
MLDVLRQGRPGPSPFWVGLVARVRDAFGPTSPPPTLDALTRMLAEDPIFDEDYRAEMALLTEADGWKTPPYVDRLIFRPVGSRFRPGAAAAEWPVPRLESVPELAAHLEVPEATLEGWADVGGWLGRYPSDRRQHYVRRWIPGVPGRRSRPTPLRRAAPGCAPCLRSSGGSGPRLIEAPKTQLAKMQRRILRSILDLVPVHPAAHGFVRGRSIRTHAARHVHMQVVLRFDLRRFFPSVQAPRVQGLFRYLGYPEEVARLLAGLCTTITPHDVFPPRTAADVRQLYRQRHLPQGAPTSPALANLLCLGLDRRMMGLARAFDAGYSRYADDLVFSGGAALAARSRRFGGFVARVVEEEGFLLNHDKTRRMPRSGRQEVTGLVVNQGPAYPRDEFDRLKAILHQCALDGPERHNREGHPDFRAHLLGRVSFVESVDPRRGAKLRVRFERIRWGSSQR

SEQ ID NO: 5852 - protein, 413 aa, unidentified
  source 1..413: note = Related to JAEPMI010000002.1; note = Deltaproteobacteria bacterium
MSHAVAAAIALALLEPERWRSGVRASLESFEGLDAESRTAIGRLVKSLYVRPEVDELAALIARDPKVTLRGVIPRRWALPPLRMTRPPYGAPPLPTPADLAAFLDVEVGELSFLADPKGWNTDARRQHYRTRWVPKRRGGRRLIEAPKARLKRVQRKVLRGILDPVPLGAAATGFAPGASPSKHAARHSGKRWVLKMDLADFFAHVGSGRVRAIFETLGYPLAVRRLLVGLCTTRAPAELLLDADPVERALHGRRRLPQGAPTSPTLANLAAAPLDHRLWNLAARLGLTYSRYADDLAFSGDRMPESLIPRIAAIGIEEGFPLQLRKTRRMGRAVRQELTGLVVNADPAPRRESYDRLRAILHQAALDGPAAANREAREDFRAYLRGRIEWVAGGRPQRRAKLDALFARIDWS

SEQ ID NO: 5853 - protein, 351 aa, unidentified
  source 1..351: note = Related to JABTUV010000001.1; note = unidentified bacterium
MGLIIYAILSRGKIDAVAIRRSRKDYRSPFLFRRAGRPDAGKLASRGLPVLGNVNEVAALLGVSPKQLRWLSVADFGHYHSFLLEKKSGAARLIDAPKPQLKAAQRKIYELLLKKQPLHPAAHGFCPGKNVRDHAARHCGKQTVLGMDVANFCPSVSARRVCGLFKSWGYGEDVALLLTTLTTYNGHLPQGAPTSPALANLVFTHADARLAGLARRFGAEYSRYADDMTFSGGQAFQRKLSAFSKAVQGIVKEEGFALNHNKTRQMRHGRRQVVTGLVVNETPHVSRRMRRRMRAILHNAQRKGLEAQNRFKHPRFAEHLRGRIAWITSLHPRLGGRLLEGWKAARARFAG

SEQ ID NO: 5854 - protein, 462 aa, unidentified
  source 1..462: note = Related to NZ_CP036267.1; note = Thalassoglobus polymorphus
MGLFDFIKGLFGGSAQVQSGPTHADVNPAHDQAGRDQTETSYAESIHADAGEAVPHEHSSPQNSSSNKVFRERKASKNIVLRKFSYRPSTVATPQEQEIVRHRPYKFAVPGPHTGEFLDLSQDADERWLEYYGLPTLATPDDLADWFGISIGKLAWLTHRMRDGNRPKDVKDAHYHFQWKKKRSGSWRLIEAPKEELKGVQTKILREILDLVPAHPAAHGFVPGRSILSNAVPHVGSKFLLKLDLENFYPTVRYSRVVAIFRSLGFSREVSIWLARLTVSAPPWSLDAPKKNWEFWQLMPPHLPQGAPTSPALANLSAFALDVRLSGMAKAYNLKYTRYADDLTFSGPGLSIPALNEFIPLTSKIIAAERFFVNKKKRKIIRNSQRQCVTGVVVNEKINVSRQDYDQLKAILHNCVKTGPQQQNRNQHPDFASHLRGRIAHMMQLNPSRGAKLLEIYQKIRW

SEQ ID NO: 5855 - protein, 358 aa, unidentified
  source 1..358: note = Related to JABJMI010000419.1; note = Planctomicrobium sp.
MGLFDFIRGLFGSSPNHQVEQSGEQRDTTPGRSDPGVSETASPTPQVEPRQSVSKRTQTHLPCSKRSPVKLQQLEYRPGIVRTPSEQEVSKQKPYRFASIGPRTGEYLNLSRDMDERWLEYFGLPQLATPDDLAQWLNLSIGKLAWLTHHTREGYRPKNESDSHYHFQWKRKRSGGLRLIEAPKQELKNAQHQILHQILDSVPTHQAAHGFVRGRSILSNASRHVGSKFILKLDLENFYPSVKYSRIVAIFRSMGFSREVSLWLARLTTSAPYWGLKAPEKNWEYWQLMQRHLPQGAPTSPALANLSAFSLDVRLSGLAKAYNLKYSRYADDLTFSGPGMSIPALNEFIPLTNKIISD

SEQ ID NO: 5856 - protein, 459 aa, unidentified
  source 1..459: note = Related to NZ_SIHI01000002.1; note = Thalassoglobus neptunius
MGWFDFLRKIFGFGRAESSQGSQTVADAPLAEAPVTESSAAESPSSDVSDSEVSEPAEKRKAEPRPNSTVPRPDVHLRPLDYVPSTVPIPPDREIVSEKPYRFAVPAPRTGEFLDLSRDSDERWLEYYGLPRLKTPDDLADWLGVTTGTLAWLTHRFREGHRPSDERDSHYHYRWIAKRSEGWRLIEAPKSKLKDVQTKILRGILDSVPAHSAAHGFVPGRSIVSNATPHSGSKFILKMDLEDFYPTVRYSRVVAIYRSLGFSREVSLWLARLSVSALPWSLKSPVSAHEYVVYTAHHLPQGAPTSPALANLSAYGLDIRLAGMANAYRIRYTRYADDLTFSGPGLSIPALNEFIPLAKKIIREERFTMNRRKLKVIRNSQRQIVTGVVVNEKTNVSRKEFDQLKAILYNCIKHGPQSQNRAEIANFAEHLRGRIAHISQLNPRRGAKLMRMYSQIGWT

SEQ ID NO: 5857 - protein, 366 aa, unidentified
  source 1..366: note = Planctomycetaceae bacterium; note = Related to JAGQQQ010000703.1
DRPYHFAWPGPRTGEYLDLSTDADERWLQYYGLPTLRTPEDLADWLHIPIGKLAWLTLRTNDGHRPVSTEASHYRYQWIPKRSGGWRLIEAPKEQLRLVQTQILREILDRIPPHSSSHGFIAGRSIITNAEPHLGQKFILKLDLQDFYASVRYARIVAIYRSFGFSREVSIWLARLSTTAVPWSLQFPTRDARSWTFHAYYAFHLPQGAPTSPALANLSAYGLDVRLAGMAAAYGLNYTRYADDLTFSGPGRAFPSLREVIPFANRIIRSERFRPNQKKAKVIRRSQRQTVTGVVVNEHLNVSRQEYDRLKAILHNCVKMGPSSQNRGELADFPAHLRGKIAHVMLLNEDRGLKLLEIYHRIDWSR

SEQ ID NO: 5858 - protein, 452 aa, unidentified
  source 1..452: note = Related to NZ_FOQD01000010.1; note = Planctomicrobium piriforme
MGLFDILKRLLGFGPRPDTGPAAPPGQPAPPPESLPGPASATIAEPSPQKRASAREAHEQPARRVRVVLKPLRYQSNLIPTSSSQEIVSGKPYRFAGIGPQQGQFRDLSRDIDQRWLDYFGLPVLATPDDLAAWLNIPIGQLAWLTHRTSRGHRAESVKQSHYVYSWIAKRSGGHRLIESPKSDLKHAQEQILRGLLDHVPPHTAAHGFVPGRSILTNASPHVGQRFVLKFDLRDFYVTVRYSRVVAIFRSLGYSREVAIWLARLTTSSVPWGIKAPVKEWELAKYASRHLPQGAPTSPALANLSAFGLDVRLDGLAGAYGLEYTRYADDLTFSGPGTAIPALHELIPLIQKIIRAERFSSNWQKRRVLRNGQRQTVAGVVVNEKLNVSRRDYDSLKATLHNCRKLGPSTQNHKSHPEFASHLRGRIAHVRQLNPARGEKLLAIYQQIDWSK

SEQ ID NO: 5859 - protein, 455 aa, unidentified
  source 1..455: note = Planctomycetaceae bacterium; note = Related to JACKHO010000006.1
MGLFDFLSRLIFGSPASHDSAADVPPTAPEPSRADAAPKHNSPPPKRPSRIKNRTSSTRPVRLVPLRYVGSLVRTPQQQELTAEKPYPFASRNLNPRTGEDLGWLDLSTDGDERWLQYYSLPILKTPTDLAQFLGIPLGRLAWLTQRRHSNYRPATIRESHYHYRWITKRSGGHRLIEAPKQQLKQVQQKILSGILDRVPAHPSAHGFVAGRSILTNAQAHVGKRFLLKLDLEDFYTTVRYRRVVAIFRSLGYSREVALWLSRLTTSAVPREFVGPDSRPGWHHSLSRYALLHLPQGAPTSPALANLSAYALDVRLAGIAGAYDMDYSRYADDLTFSGEGRSIPALQEFVPLVQQIIRAERFRPNRSKRRVVRDSQRQIVAGVVVNERTNVARKDYDLLKAILHNCMREGPSSQNRYNLENFAEHLRGRIAHVTQLNPERGARLLEMYLRIDWNC

SEQ ID NO: 5860 - protein, 446 aa, unidentified
  source 1..446: note = Related to JAGQPW010000040.1; note = Planctomycetaceae bacterium
MGLFEFFKRLFFGSPAPDVTSSAGSASAPHSSPTPAAPAKSTPRRRRKRVPGQSSRPPVQLRSLRYRSTLVQTPRQQEQVPTKPYAFAVRDFDAYLDLSQDADPRWLEYYGLPALRTPQDLANWLGIPVGRLAWLTQQHLPDRRPASPKEAHYHYQWKQKRSGGYRLIEAPKELLKTVQTQILREILDRVPPHPAAHGFVEGRSIVTNARPHLGQRFILKFDLENFYPSVRYSRVVGIFRSLGFSREVAIWLARLTTTAVPQEFRSPDSRPGWHWSMSTYRSHHLPQGAPTSPALANLSAYALDVRLSGLAKAYHVTYTRYADDLTFSGAPRTVPALGEVIQLTEKIVRSERFRLHPRKRKVLRNNQRQVVTGVVVNDRLNISRKEFDQLKATLHNCIKLGPASQNRAEHPEFAAHLRGRIAHVRQLNALRGDKLMALFQRINWNR

SEQ ID NO: 5861 - protein, 466 aa, unidentified
  source 1..466: note = Planctomycetaceae bacterium; note = Related to JAGQQB010000156.1
MGLFEFIKRLLFGSPAPTTATQSGDDSPLERPAESGSASAATSAMTPAEQHRQRMRYQSRQRNAGRRERVRVSLRPLRYESSLVPTSASREQVAEKPYLFATCSVDPRQGPRHGYLDLSQDADPRWLEYYGLPVLRTPQDLADWLQIPVGRLAWLTQRQHRERRPPTVREAHYHYQWIRKRTDGHRLIEAPKEKLRAVQTQILEGILNHVPPHPAAHGFVEGRSIVTNARPHVGQRFVLKFDLENFYTTVRYSRVVGIFRSLGFSREVSLWLARLTTTALPEQVKNPEGLPGWHWSLAPYRAAHLPQGAPTSPALANLSAYGLDVRLQGLAKTYHVNYTRYADDLTFSGEARVLPALSEFIPLCQRIVRSERFVLNLRKRRLVRSNQRQVVTGVVVNQRTNVSRREYDRLKATLHNCLRQGPQSQNREDVENFAAHLRGRIAHVTQLNPARGAKLLEMFQRIHWTG

SEQ ID NO: 5862 - protein, 438 aa, unidentified
  source 1..438: note = Related to NZ_CP036275.1; note = Maioricimonas rarisocia
MGLITLLKRILFGSAPSIPHAGGQPEPAAESTGDHTARVGAVSQRPSGPVRLAPLRYQSSLVRTPPDREHADGAGKPYRCAHIDPRRGGYLDLSTDGDARWLEYYGLPHIATPEQLAVWLQLPLGKVGWLTDRFCQNHRPQNTREAHYHYHWLAKRSGGHRLIEAPKSQLKQVQQQILREILCRVPPHTAAHGFTAGRSIRTNARPHVGQRVLIKFDLEDFYPSCRYARVVAIYRSLGYCREVALWLARLTTSAAPANLRFPDGNLRSLMPYLPRHLPQGAPTSPALANLSAYSLDVRLAGLAARYHLKYTRYADDLTFSGDGHSIPALREILPLITRIVRDERFRVNRKKRKVIRNNQRQTVTGVVVNQHLNIRRDEFDRLKAILHNCRKHGPASQNRDDHPDFAAHLRGRIAHVMQLNRHRGEKLLAMYDQIDWAR

SEQ ID NO: 5863 - protein, 428 aa, unidentified
  source 1..428: note = Related to JAGQQF010000427.1; note = Planctomycetaceae bacterium
MGLLRLLQRLFFGSSATAEEPRQDVRPSSQSKPSASAERQRERLAPLRYQSSLVATPRSREVVEGSSPPYRFAHRDAVGGAYLDLSQDVDPRWLDYYGLPHLSTPEDLAGWLRLPIGKVAWLTYRFCENRRPQSAKEAHYHFRWIRKRSGGHRLIEAPKKTLRLVQIQILREILDRIPPHPAAHGFVRGRSLTTNAAPHVGKRVVVKFDLDNFYGSVRQSRIVAIFRSLGYSREVALWLARLTTSAAPGSLKLPLGESTSIWKYMPRHLPQGASTSPALANLSAFGLDIRLAGLARAWHVDYTRYADDLTFSGDPKFVAAVGDFIPLVQQIIRDEGFQSKRSKRRVLRTNQRQTVTGVVVNQHINVSRAKYDRLKATLHNCVKHGPASQNHDLHADFAAHLRGRIAHMHRLNPHRGQKLLALFAKIKW

SEQ ID NO: 5864 - protein, 419 aa, unidentified
  source 1..419: note = Planctomycetaceae bacterium; note = Related to JABISG010000096.1
MGLFDFLRQLFLPSSRDVASPSHRRRERAPRRRVKLTPLRRRHGQRPWSEPIEEETPPYRFAQYGIRDGRFLDLSRDGDESLLDSFDLPVIHTPEQLAEWLQMPLGQVAWLTQRFSDGYRPENEQQAHYHFRWVKKRSGGWRLIEAPKQKLKQVQTQILREILDRVPPHNCAHGFVRRRSIVTNARRHVGQRAILKLDLEDFYANVGFSRVVGIFRGLGYSREAALWLGRLTTSKVPSNLRYPERFSSAFFPFLKRHLPQGAPSSPALANLSAYGLDVRLSGLARSYSVEYTRYADDLTFSGPQSFIRALPVFIPLTSQIIRDERFRVNRNKRKVVRNNQQQVVAGVVVNAHTNMPRREFDRLKAILTNCVRHGPASQNREHHADFSAHLRGRVAHAVQLNPHRGNKLRELYHAIDWKR

SEQ ID NO: 5865 - protein, 431 aa, unidentified
  source 1..431: note = Planctomycetaceae bacterium; note = Related to JAGQPX010000026.1
MGLLDFLRRLLGGQPASPNDQPSAPDTSTLVRDPRTGGVTPAAPKLLAPLRYRSSLNRTATAAERVAELPYRFANLSVDGDGYLDLSTDADERWLEHFDLPHLRTPEDLANFLQLPLGKLAWLTHRFEEGGRPAGEKESHYHHHWVKKKLGGHRLIEAPKQTLKMVQRRILRDILDHVPPHPAAHGFVTGRSIRTNAEPHVGKSVLLKFDLQNFYPSVRYSRVVAIFRSVGFSREVAIWLGRLTTSAIPASLKYPQDDPSALWMYYPRHLPQGACTSPALANLSAFALDVRLTGLARKYDVHYTRYADDLTFSGTGRFGGALSEFIPLVTHIAKSERFYIHRQKRRVLRGSQRQTVAGVVVNEKPNVSRRDFDRLKSILHNCAKHGPSTQNHDDHPDFAAHLAGRIGHVLHLNPHRGAKLRELYNQIDWSR

SEQ ID NO: 5866 - protein, 300 aa, unidentified
  source 1..300: note = Planctomycetaceae bacterium; note = Related to JAGQQG010000136.1
RPAGVREAHYHYHWVKKKTAGHRLIEAPKQTLRAVQQRILRDILDKVPPHPAAHGFVSGRSIRTNAEPHVGQRILLKFDLQNFYPSVRYSRVVSIFRSVGYSREVAIWLARLTTSAIPASLSFPKGDPSALWTYYPRHLPQGAATSPALANLSAFALDVRLAGLARKYDVRYTRYADDLTFSGSHRFGGALSEFIPLVVHIAKSERFVLHRQKRKVLRSSQRQSVAGVVVNQKANIARHEFDRLKAVLYNCVKHGPSTQNHDAHPDFAAHLAGRIGHVLHLNPARGAKLRELYNRIDWSR

SEQ ID NO: 5867 - protein, 445 aa, unidentified
  source 1..445: note = Planctomycetaceae bacterium; note = Related to JAEUIG010000100.1
MGLFDWLKGMLGGAPPSPTPAAPSPPAAGVRINPFTQEVVQLGIDRRTSAPSLHAFRYRSSLVRTPPSREFAAKRPYPSAQRQVYKGWLDLTTDSDPRWLEHFGLPPLKSPDDLAKWLNVPLGRLNWLSGRYRDGGHPGTAKEAHYHFQVIPKRSGGARLLEAPKPQLKAIQQRILRDILDRIPVHSQAHGFSKGRSIVTNAEPHVGKRIILKYDLENFYPSVRYNRVVAIFRSIGFSREVGIWLARLTTSALPWNTSDIPRLGELSGLETRGRYWELYGSRHLPQGAATSPALANLSAYSLDVRLSGLARKFDADYTRYADDITFSGTKRFAGALSDFIPLVERVVRAEKFVVHKGKRRVLRNNQRQSITGVVVNSKPNIRREEFDRLKAILHNCLKYGPSTQNRDRHPRFADHLRGRVAFVSQLNADRGEKLREMYDRIDWRK

SEQ ID NO: 5868 - protein, 434 aa, unidentified
  source 1..434: note = Related to QQVO01000002.1; note = Planctomycetes bacterium
MGLFNWLRTVLFGAPPQPTGDFTPDQPPPAGRDVHPVTGERVSHSRARLDRLEYRSSLIRTPSRRESAGSDPPYQFAHRNPRTGRWLDLTTDADPRWLDYYGLPHLKTPADLADWLEMPIGRLGWLTHRFCDDRRPPSAQTAHYHFQWLNKKTGGHRLIESPKTSLKGAQRKILSGIIERIPPHRNAHGFVAGRSILSNARPHVGAYAVLKLDLENFYPSVRYSRVVAIFRSVGFSRDVAIWLARLTTSAVPHDIPRPAGGHAAVWPYFSRHLPQGAPTSPALANLSAYSLDVRLTGMARAYDVTYTRYADDLTFSGSYRFAAAIRDFAPLVTRIVRDERFKANRSKQRIIRRNKRQTVTGVVVNEKPNISRDAYDTLKAILTNCAKRGPSTQNRGAHENFAAHLRGRIAHVAHLNPRRGAKLLQLYATIDWSR

SEQ ID NO: 5869 - protein, 438 aa, unidentified
  source 1..438: note = Related to NZ_CP036271.1; note = Caulifigura coniformis
MGLFDLLRRLLFGAPASPTDTAGSSPAPRASQMPVAPKSLPVATPAGKRGPARKLPPFRYQSKPRRTSPKAERVARRPYTFAAPTALGEYLDLSTDADLGLLDHLGLPRLQTPADIAEWLEIPLGRLAWLSGRFFENHKPQSERSAHYNFRWLKKRSGGHRLIESPKKQLKAVQEKILREILDKADAHPRAFGFIAGRSAILNAREHVAPYVLLKFDLENFYPSVRYSRVVAIYRTLGFSRAAAIWLARLTTSAVPSSMSFPGGDPYGLNPYLSRHLPQGAPTSPALANMSAYGLDVRLTGLARSFGVTYTRYADDLTFSGDQKFAGALRDFIPLTETIIRKERFFLNVSKRRIIRRSGRQTVTGVVVNQHPNLARAEFDRLKAILFNCVRLGPSTQNRTNHPQFAAHLQGRIAHAASINPSRAARLRALYDRIDWSK

SEQ ID NO: 5870 - protein, 429 aa, unidentified
  source 1..429: note = Related to JAHBXW010000001.1; note = Planctomyces sp.
MGLFAFLRRILFGAPEDAADDGGSTAPRQSPPPQSPATARRRRTPLPPLRYGSKHPRTPAALEQVAERPYQFANLGPAGRFLDLSTDADLSRLEQLELPRLLTPADVAHWLNMPPGRLAWLSGRFEPQQRAASEKAAHYHYRWIRKRSGGMRLIEAPKVRLRQVQTRILREILDHVAAHDHAHGFVRDRSALTNAKPHVGSYVVLKLDLENFYASVRYSRVVAIFRALGFSRAAALWLARLTTSAAPASLSFPDRSPLGLLPYLPRHLPQGAPTSPALANLSAWSLDVRLTGLAKKYHATYTRYADDLTFSGSHRFAAALSEFIPLAEKIIRSERFKVNRAKRKVLRRSGRQTVTGVVTNARPNIAREDYDRLKAILHNCVRRGPSTQNHDSRKDFQAHLRGRVAHVRSVHPARGAKLLALYQRIDWKR

SEQ ID NO: 5871 - protein, 348 aa, unidentified
  source 1..348: note = Planctomycetes bacterium; note = Related to VGXY01000890.1
MGFFTWLFRWLGWGADSRDFPSDTERTSDLGVRTSSGSLNRSSFDDSDAPRRNSDLTETAIHSNSERSVTTRPVTSRPKLTLSRREEERIRNPPERSPCVEVVGETPYRYARFGSTTGRHLDLSQDGDDSQLNARCLPIFHTPEELAGWLQIPLNQLVWLVHRFSAGRPPASDAAHYVFQWLKKKSGGWRLIESPKPILKRAQVKILREILDRIPAHRSAHGFVAGRSIVTNAEPHVGQDVVVAFDLSNFYTTVGFSRVVAIFRSLGYSREAAIWLGLLTTSAIPGNMAFPERNPYAFDPYLKRHLPQGAPTSPALANLSAFGLDVRLTGLARSFGATYTRYADDISL

SEQ ID NO: 5872 - protein, 314 aa, unidentified
  source 1..314: note = Candidatus Saccharimonas sp.; note = Related to JACMJF010000970.1
MAFFAWLFRWLGWSTDPRDSWDAPAPPQAADRSAVRTATLEAPPRAPSRPPSEPLPRPRLTPTRRDTTRHDARKSHATFVEVTGAVPYKYARFGSGTGRHLDLSQDGDEARLQQRGLPVFRTPEQLADWLGVPLKKVAWLVHRFSAGRPASVEQAHYHFRWLKKKSGGWRLIESPKQTLKQAQVKILREILDRVPTHSAAHGFVTGRSILTNAKPHVGHAMLVKLDLSNFYATVGFSRVVALFRALGYSREAAIWLGLLTTSAIPGNMAFPARDPYAFEPYLRRHLPQGAPTSPALANLSAYRLDLRLAGLSKS

SEQ ID NO: 5873 - protein, 451 aa, unidentified
  source 1..451: note = Planctomycetes bacterium; note = Related to JAFEBS010000049.1
MFSWLGGGEPSSPSQPTTDRGQQPDPQHSPTPPADHGPDRTSRSTTPPRQRPRIRRFPPKRNPRLNVRSHDQQHRRNRKKASFLEVTGASPYRFARFGSQTGRYLDFSRDGDDARLRDRGLPVFHTPEELAEWLGLTLNKLAWLVHRFSNGRPDSVDHAHYHFTWRKKRSGGVRLIESPKQTLKEAQVKILREILDRVPTHPAAHGFVAGRSVLTNAKSHVGQGIVVKFDLTNFYTTVSYSRVVAIFRTLGYAREAAIWLGLLTTNAVPGNMPFDRQKLYSILPYWRRHLPQGAPTSPALANLSAYHLDARLTGMARAFGADYTRYADDLTISGPETLSYALRTLIPLVEQIIRRERFQSNRSKRQVLRAHQRQVIAGVVVNVKPNVSRANLDRLKATLTNCVRMGPSTQNRDQVEDFQAHLRGRIAHVLQLNPARGEQLLAIFHRIDWRR

SEQ ID NO: 5874 - protein, 501 aa, unidentified
  source 1..501: note = Related to QWPM01000121.1; note = Planctomycetes bacterium
MGLIRWLLHRLGWRPAPLTRSLPTAGPVSPAPATPAPLDTPPLDTPPLAQASLTPAWPVVASPVVAPPAQASPIVASPNPDSVPPSILFDPPAVAPANSRKRPRIWSRTSRIRLVPTRRKQQRQAARRPAMLVEETQGAAPYRYARYGSRTGHYLDLSRDGDVVRLQRFGLPEFHTPEQLSHWIGLPLNRVAWLVHRFSGGRPEMEELAHYHFRWIKKRLGGWRLIESPKTTLKLVQTKILRELLDKVPVHAASHGFVKGRSILTNARAHVGQSVVLKFDLTNFYTTVSFARVVAIFRSLGYSREVAIWLGLLTTSAVPGNLRFQDQGPYALVPYLRRHLPQGAPTSPALANLSAFGLDLRLTGLARSFGAHYTRYADDLTLSGPEELGKALRTLIPLTQQIIRQERFVLNPEKRRVLRSHQRQTVTGVVVNQKTNVSRGDFDRLKAILTNCVKQGPSTQNQKMVEDFYHHLQGRIAHVSMLNPLRGQKLTLLFQAIDWTR

SEQ ID NO: 5875 - protein, 443 aa, unidentified
  source 1..443: note = Related to NZ_JH636437.1; note = Schlesneria paludicola
MGLIRWLMQRLGWGSSRGPVPTESNSRPASEQASAKSENLTPTSLRTTRRSYPPGRARLVASTRVESDITRPSMAYVETEGEPYNYARYGSQTGRYLDLSRDANEARLAQFGLPVLRTPDDLANWIGLPLNKVAWLVHRFSAGRPATVKDAHYHFHWLKKRQGGWRLIEAPKAMLKLVQTKILRELLDPIPVHRSAHGFTVGRSIVTNALPHVGQHVVLKLDLSNFYTTVSFARVVAIFRGLGYSREVAIWLGLLTTSAVPGNLGFQEQGPYALVAYLRRHLPQGAPTSPGLANLSAFGLDARITGLAKSFGATYTRYADDLTISGSKELTRGLRAIIPLVQQIVRQERFFVNHKKRRILRSHQRQSVTGVVVNEKPNISRGDYDRLKAMLTNCQRHGPSSQNRDGVVDFYNHLRGCIAHVSMLNPVRGQKLTELFQVIDWAR

SEQ ID NO: 5876 - protein, 445 aa, unidentified
  source 1..445: note = Related to QWPB01000058.1; note = Planctomycetes bacterium
MGLLAFLQRLFWGAPPRESSMVGRGTAGAPFGDPLSRDNSLSGPATSGQVLYKSRRGVFQNPASNRYAPHGDRTGRGQVVEQSPYRFARRDLPSGGFIDLTGDHRPDVLNQYGLPLLRTPDDLARWLSIPLPRLAWLIGRFDDNHRPQSESESHYHFHWIKKKSGGFRLIEAPKSQLKQIQLQILRGILDRLVPHPAVHGFVPGRSIRSNAAPHVGQAWVLKLDLTNFYPSVSFNRVVAIFRSLGYCREVAIWLGRLTTSAIPSSLNSPDRRMATVWPYLRRHLPQGAPTSPALANLSAFGLDVRLQGLAGAYGLRYTRYADDLTLSGPQRAVAALREIIPFAGWIVRQERFHLNKAKRRVLRRYQQQSVTGLVVNDQLGVPRAEFDRLKAILTNCLRHGPASQNREAHPAFAAHLLGRIGHLASVNPGRGVKLRSLYQQIDWNR

SEQ ID NO: 5877 - protein, 436 aa, unidentified
  source 1..436: note = Related to QWOR01000226.1; note = Planctomycetes bacterium
MGLIAFLKRLFWGTPTPSSVPSAESADSSRLAADSTSSSAKIIVRRKFRGPDLLRFSATVRRQGRTVQVVRGQPYRFARPFVISSVDYGDLSTDTNPAALGRFDLPVLRTPEDLAHWLGIPLGRVAWLTGRFFENERPQSDDVAHYHFHWVKKKSGGYRLIEAPKALLKFAQTQILRGILDRVPAHPAAHGFVKQRSIRSNAAPHVKSAWVMKLDLSNFYPSVTFSRVVAIFRSLGYSREVSIWLGRLTTSTIPSNLSAPDRRENTVWPYRLRHLPQGAPTSPAIANLSAFSLDVRLNGLAAKYHARYTRYADDLTLSGKGKSIPALREIIPMAEWIVRNERFHLNRSKRRVLKQHQRQSVTGIVVNQKLGVGRAEFDQLKAILTNCIRQGPVSQNRNQHNDFASHLRGRIGHFKSVNAERGTKLLKLYYQIDWTR

SEQ ID NO: 5878 - protein, 436 aa, unidentified
  source 1..436: note = Related to NZ_CP011270.1; note = Planctomyces sp.
MGLLSFLKRLLFGAPASNDAPARPKPSNDPASRPATPPASPPSTDGTATKKRVRLTPMRRQGPRERGQPARETARPPYPYAFPTYGGKFLDLSDGTDFERLRQFGLPELVYPGQLAEWLQLPLGHVAWLTYRFCDGNRPQTAGQAHYHFHWVRKKSGGHRLIEAPKSRLRRVQDQILREILDRVPSHPAAHGFVRGRSIVTNAEPHVGHKFVFKLDLENFYPSVRYSRVVATFRSLGYSREIAIWLARLTTSLIPTDLPTPGQRPGMLYAYFGRHLPQGASTSPAIANLSALGLDIRLSGLANAYGCTYTRYADDLTLSGPGKAAGALRELIPLSEQIVRSERFHLHPVKRRILRRGQRMRVTGVVVNDKVNIARGDFDRLKAILTNCIRTGPEAQNREGLPAFSDHLRGRIAHITQLNPNRGAKLQALFARIRWP

SEQ ID NO: 5879 - protein, 463 aa, unidentified
  source 1..463: note = Planctomycetaceae bacterium; note = Related to JADZEF010000283.1
MGLLDFLRRLFFPQPSPPPNKTAFDGVPSPRPPVRAPSDNGRHPSDNSHSAATSTAEPEVESRDRRPKRPRRTGPRPRAKLTPLRHAPPEFIADRSTEVTPIPYRFARFGVRSGGFLDLASDGDDARLRERQLPVLHTPEDLAAWLGIPLGKLAWLIHRFTANSRPLSEREAHYHFRWERKRSGGWRLIEAPKATLKDVQCRILEEILSRVPAHPAAHGFVPGRSIVTNAAEHVGKPIVVRLDLTNFYPTVTLARVAAIFRSVGYSREASVWMARLCTSSLPQTAGFPEGNASAIRPYLPAHLPQGACTSPALANLSAFSLDVRLSGLARAFGGVYTRYADDLTFSGPDGFRRALPNFLPLVEQVIREERFRINKAKRRIIRSNARQMVTGVVVNDRTNVRRVDFDRLKALLTNCLRHGARSQNHEGRDNFAAWVRGRIAHVQSLNAARGSKLLALYQQIDWR

SEQ ID NO: 5880 - protein, 385 aa, unidentified
  source 1..385: note = Related to JAGQPV010000469.1; note = Planctomycetaceae bacterium
MPLRYDGHRSGKRQKNAEEVDRLPYRFAQQGVRYGGYLDLSDDADVGRLEQLGLPILHTPEQIAVWLDRPLGQVAWLIHRFSSGYRPENEGEAHYHYRWQRKKSGGWRLIEAPKPILKTVQQQILTDILSQVPVHPAAHGFTAGRSIVTNAAPHAGQQVLVQFDLANFYATVSLSRVVAVFRSLGYCREAAIWLARLTTSAIPQTATFPDQDTHALTPFLPRHLPQGAPTSPALANLSAYSLDVRLTGFAASWGGTYTRYADDITISGSKSLIRALPKFIPLAERIIGQERFVFHRQKRRVVRDCSRQVVTGVVVNSHPNLSRPQYDRLKAILTNCIRHGPSTQNRENHADFAAWLRGHVAHARNLNPQRGLKLQALYDQVDWQR

SEQ ID NO: 5881 - protein, 433 aa, unidentified
  source 1..433: note = Planctomycetaceae bacterium; note = Related to JACCRE010000317.1
MGLLRWLLGLFGANSGTAVAKAWTDQALRSTAGRPWRRPRLSSIRRNAVSPPLRRTPAPTTPQPAYRFARQGVAGMLESLRGRSSYLNLATDLDRTRLDRWNLPPLATPDELADWLEIPVGKLAWLSGRLVSGNRPPSTREAHYVFRWKAKRSGGARLIESPKPLLRQVQTKILREILDKVPPHAAAHGFVAGRSILTNAKPHCDRVVVVKWDLTDFYASVRYSRVVAIFRSLGFSREVALWLASLTTSAIAADLPFPESGPQALRPYLGRHLPQGAATSPALANLSAFSLDVRLSGLARAFGGAYTRYADDLTISGDDAFARQLKNVIPLVEKVIRQERFHVHAKKRKVIRRGQRQVVAGVVVNQHPNIRRDDFDRLKAILYNSAKHGPASQNPNGHPDFAAHLRGRIAHAAMLNSVRGEKLMRLYEAIDFG

SEQ ID NO: 5882 - protein, 449 aa, unidentified
  source 1..449: note = Related to NC_015174.1; note = Rubinisphaera brasiliensis
MWRLFSSLWRLFTGHSGRQAKNPYATFGTTDESTANETFDDAMVSPPEPPRHQRKPKADQRYPRLTKFRYQPGRVSDREHAPQIVTGTPYRYANPFVVSPGMFLDMSNDLRSERLDRWELPQLKTPQDLADWLQLPLGKIAWLTDRFTEANRPVDASKSHYHYCWKQKKSGGYRLIEAPLPLLRQVQEQILDEILASVPVHAAAHGFCSGRSVVTNARPHVGQQLVIKMDLDNFYTRVRYARVVALFRSLGYSREVALWLARLTTSAVPSNLPFPGGEPKQLRLFLARHLPQGAPTSPAIANLVAYNLDVRLAGLARSFQVQYTRYADDLTFSGGEDLQYCSRVFLPLVSQIVRDERFQMHATKRKFLLPSCRQQVTGVVVNEKTNISRKEFDRLKATLYNCVKTGPAAQNHNAHADFQAHLRGRIAYVQQLNPARGAKLLDLYQQIRW

SEQ ID NO: 5883 - protein, 444 aa, unidentified
  source 1..444: note = Related to JAGQQR010000004.1; note = Planctomycetaceae bacterium
MWRLFSFLWQLLGGRSPDSRVSEPISPGGTVSERTASSSAALSPAPGRKKSKADQKRPVLVPLTYRRPRLSDREHAPEIVSESPYRYALPYVVSQGKYLDLSQDIRPELLQRWDLPLLKTPQDLADWLHLPVGQVAWLSGRFGEGGRPADASKAHYRYSWKKKRSGGYRLIESPLPLLRQVQEQILDEILSRVPVHQAAHGFCAGRSVVTNAAPHVGQHVVIRLDLDNFYSRVRHSRVVAVFRGMGFSREVSLWLAKLVTSAIPSNLEFPGDQPGLLRLFLPRHLPQGAPTSPAVANLVAYSLDVRLAGLARAFSANYTRYGDDLTFSGSAELSQGSRLFLPLAQAIIREERFRVNSRKRRFMRQSTRQEVTGLVVNEKVNYSRQEYDRLKATLHNCVKTGWESQNRAGHPDFLAHLRGRIAYVQQISPLRGAKLLALFTRIVR

SEQ ID NO: 5884 - protein, 371 aa, unidentified
  source 1..371: note = Planctomycetaceae bacterium; note = Related to JAESQE010000528.1
NRSSSIVSQQPYRMALPSVRSPGTFLDLTTDYSPDKLNQRDLPLLKTPEDLANWLQKPLGTVAWLTDYYNEARRPIDIRKAHYRYSWKQKRSGGYRLIEAPLPMLKEVQEQILDEILDRIPVHSCAHGFCTGRSILTNARPHVGQDVVVKLDLDNFYTRVRYSRVVAIFRSIGYSREVALWLAKLTTSAIPSNLEFPGNEPKLMRLFLPRHLPQGAPTSPAIANLVAYSLDIRLSGLTQSFGGNYTRYGDDMTFSGDWQFIKAMRLFLPLTQQIIRQERFVVNGRKRKVLRRSKQQSVTGVVVNDKTNISRKSYDNLKATLHNCIKSGPDSQNREEHPNFHAHLRGRVAFVQQLNRAKGDKLLRMFEQISW

SEQ ID NO: 5885 - protein, 444 aa, unidentified
  source 1..444: note = Related to JAGQQT010000159.1; note = Planctomycetaceae bacterium
MGLIQFLRSLFFGSGPQSAGTASRQYSDQWNAGSSSANQNSSTPTATAPETVRTRPKLVPLRRHKKGRNRQLISGERGLKTAPYQLAVPDVTSPGTFLDLSRDGDSARRADWELPELTTPQDLADWLEIPLGHLGWLTGRYLDGKRPLDASKAHYHYTWKQKRKGGFRLIEAPYPLLRQVQEQILDEILCCVPTHVSAHGFKTGCSVLTNAQPHLGKDVVVKLDLDNFYTRVRYSRVVALFRGIGYNREIAIWLARLTTSAIPGNLRFPGGQPKLMSLFLPRHLPQGAPTSPALANLVAYSLDIRLNGIAESFGAQYTRYGDDLTFSGDHKFRASLRLFLPLVRQIIRHERFVLNPKKMQVVRPCSRQLVTGVVVNQKPNISRKEFDRLKATLHNCVRLGPESQNRTNHENFRAHLRGRIAFVQQLNPARAEKLLMIYNRIKWS

SEQ ID NO: 5886 - protein, 445 aa, unidentified
  source 1..445: note = Related to NZ_SJPG01000001.1; note = Rubinisphaera italica
MRFLEFLKRLFFGGSAQSTADKYSRTPDDTRFQSTLAPTEPETHPESQISDHVKREQHWPVLVPLRRKRIRQTTHNGEETAGPKKYALALPYIMSPDSYLDLTQDVQPELLNNWDLPHIVTPADLADWLQISLGQLGWLTDRFSEGKRPIDARKAHYRYSWKEKRSGGYRLIESPLPMLRQAQEQILDEILEQIPPHAAAHGFRTGRSIVTNAEPHVGQAVLVKLDLDNFYTRVRFSRVVAIFRSLGYSREISLWLARLTTSAIPGNLQFPGGQPKLFSLFLPRHLPQGASTSPALANLVAFSLDVRLSGLAKSFNANYTRYGDDLTISGDERFRHSLRLFIPLARQIIRQERFVLNAKKKKIIRPMSQQRVTGVVVNEKTNIPRKEYDRLKATLHNCVRFGPESQNHDQHEHYQAHLRGRIAFVQQLNPHRGEKLLAIYRKINW

SEQ ID NO: 5887 - protein, 445 aa, unidentified
  source 1..445: note = Related to JAKFGB010000009.1; note = Rubinisphaera sp.
MLLLELLKRLLFGSSAVSSKKRVVETASSRSDGRFSPPAEASVAVADKPRKKPREEQTWPILRPLRRKKVRPERDAAANAGSKQYPFAYPYVVSDGSYLDLTKDTDRERLDRWDLPYFETPTQLAEWFNLPLGQLAWLTDRFSDGKRPVDKSKAHYRYQWRTKRSGGYRLIEAPLPLMRQVQEQILDEILDRVPTHDAAHGFCAGRSVVTNAEPHVGQAVVVKFDLDNFYTRVRYSRVVAVFRSFGYSREVAIWLARLSTSAIPANLDFPGRQPKRLRLFLPRHLPQGAPTSPCMANLVAFSLDVRLSGLAKSFGATYTRYGDDLTFSGDESYLRSLRVFIPLAHQIIRQERFVLNGKKKQIRRRVSQQKVTGVVVNDKTNIPRKEFDRLKATLHNCVQHGPDSQNHDQHPNFRAHLRGRIAYVQQLNEHRGNKLLSLYQAINWS

SEQ ID NO: 5888 - protein, 370 aa, unidentified
  source 1..370: note = Planctomycetia bacterium; note = Related to BJHP01000039.1
MDLSLDGDDSLLASYHLPVFHTPQRLADWLGIRVGELAWLVHRSTSDRRPADEQRSHYVYRWVKKRSASLEAGSPNSRPVQTQWRLIEAPKQTLKAAQRKILSEILEKIPAHHAAHGFVRGRSIVSNARPHVGQAVVIKLDLQNFYANVTYSRVVAIFRSMGYCREAAIWLGRLTTSAVPWSLAVPDGDEAMKSLYVRRHLPQGAPTSPALANLSAFGLDVRLSGLLKKFGGNYTRYADDLTLSGSDDFRFSLRCVIPLTEQIVRSERFRLNHRKRKVVRRGHRQLVTGVVVNAKPNIRRDEFDRLKAILYNCVKLGPSSQNRDAHADFSAHLRGRIAFVRQLNPARAEKLWRLFENIRWDGFPPTQGSR

SEQ ID NO: 5889 - protein, 439 aa, unidentified
  source 1..439: note = Related to VGZH01000005.1; note = Planctomycetes bacterium
MKLLLDFLRWLLGDRGGTSRTGSQQPTGTQSRRLKRRPVKLTKRRRLSGNALLMQRPKPIKSLAPPYQFSAYASDHRQFLDLSQDGDDSLLASYHLPVFHTPQHLAQWLGVRVGELAWLVHRSTSDRRPADEQRSHYVYRWVEKRLASVESGMPNTRPVSTQWRLIEAPKQTLKCAQRKILTEILEKIPTHQAAHGFVRGRSIVSNARPHVGQAVVIKLDLQNFYANVTYSRVVAIFRSMGYCREAAIWLARLTTSAAPWSLAVPNGDEATKSLYVRRHLPQGAPTSPALANLSAFGLDVRLSGLLKKFGGNYTRYADDLTLSGDDDFRYALRCVIPLTEQIVRSERFRLNHRKRKVVRQGHRQLVTGVVVNTKPNIRRDEFDRLKAILHNCVKLGPALQNRDGHGDFAAHLRGRIAFVGQLNPARAEKCQRLFEQIRW

SEQ ID NO: 5890 - protein, 446 aa, unidentified
  source 1..446: note = Related to JAFEBR010000742.1; note = Planctomycetes bacterium
MGLFDWVRGLLGFGNPAPNPVESPVETKNAPLPTPASGVASPPSGPASSRRDRGVTRSREFRRSRSAIQLRTLRFQLRPRSDLRTTVQDRAHYRFARPSVEGGFLDLTQSGDTGNLEQLSLPVFRTPEEIAGWLQIPLGQLAWLVHRFDEDQKAGDEKTSHYWYRLIPKRSGGQRLIEAPKAKLKRAQWQILDGILSKVPAHRAAHGFVASRSILTNATPHVGQRVIVKLDLENFYPSVTFNRVVAIFRSLGYCREAAIWLGRLTTTTLPRRISPELSRCADLNDYRGRRLPQGAPTSPALANLSAFALDLRLSGLARSFHANYSRYADDITFSGDDRFLRSLAVFIPLVKTILKSERFRANRRKWRVIRNNQRQTVTGVVVNARPNVTRRNYDRLKAILTNCIRRGASTQNHSQHKQFAAHLLGRIAQVSHLNAERGQKLYALYS

SEQ ID NO: 5891 - protein, 436 aa, unidentified
  source 1..436: note = Related to JACQFH010000599.1; note = Planctomycetia bacterium
MGLFQWLRGLFGFGDAAPESSAQPHSPSSSRASDSNRATPAARPPRKRRRPARLKPLRFKPPRKVGGRTTLPKDRGYRFARPSVTGGWLDLSQGGDASRLERYSLPVFKIPEQLAKWLEIPLGQLGWLVHRFDDEHRAADEKSAHYFYRWIDKRAGGKRLIEAPKVKLKGVQWKILDGILRKVPAHPAAHGFVTGRSISTNAVPHVGQRVVLQLDLENFYPSVSLNRVVAIFRSLGYCREAAIWLGRLTTTTLPASMTATFGRGPEIHPYRGRRLPQGAPTSPALANLSAFVLDLRLSGLARTFGANYTRYADDLTFSGDAVFLKSLAVFIPLVKQIVRDERFLINRRKWRVLRNNQRQTVAGVVVNTRTNVARKDYDRLKATLTNCVRRGASTQNHDRHERYASHLLGRIAHVAHLNPARGEKLRVLYDQIDWNK

SEQ ID NO: 5892 - protein, 449 aa, unidentified
  source 1..449: note = Related to RPPR01000054.1; note = Planctomycetaceae bacterium
MGFFDWVFGWLGLGLRSPAKTAGSAPPGSPGDSLGQPGETETQFRTRNRNYAKVALTPRTFRATRAGGEHPEERRATGDWPYKFARRAPDPARWLDLSRDADRVRLAQFGLPVLETPEDLARWLQVELGELAWLSGHFHFGGRPDSVARSHYHYSWIEKRSGGRRLIEAPKARLKHLQTQILRCILDRVPPHRAAHGFVAGRSILSNAAPHVGQRVLVQFDLSDFYPSVSYSRVVAIFRSLGFSREVGCWLARLTTSAVPHELLTGPSSTRFGSRFDSDHELYLRRHLPQGAPTSPALANLSAFVLDLRLAGLARAFQAHYTRYADDLTFSGGTRFQRSLAVFIPLARQIIRGERFSIHPLKFRVRRRGQRQTVTGVVVNDHLNVSRADFDRLKAILHNCARHGPASQNRSQLPDFAGHLRGRIAHVQMINPRRAAKLVALFGQIDWTR

SEQ ID NO: 5893 - protein, 430 aa, unidentified
  source 1..430: note = Planctomycetaceae bacterium; note = Related to DNUF01000128.1
MGWLDWLWRLFTGSGADRSPQELTSARGTAADPASKARRRPGRRRRLVPLRYRRNPSRSPPALAAQLPYRFARRSADLRHWNDLRQDGQPRRLEQLGLPVLAGPDDIACWLSLSAGEVAWLTGRFWEGRSAPRVAASHYHYRWIAKRRGGRRLIEAPKSRLKRVQQQILAEILGRIPPHVAAHGFVTGRSIQTNAQPHVGQRVLLKLDLENFYPSVTYPRVTAIFRSLGYSREAAIWLARLVTTAVPPNLWEAGRPSDVAETRYLRRHLPQGAPTSPALANLSAFVLDLRLAGLARSFNAQYTRYADDLTFSGGEVFQRSLAVFLPLVRQIVAQEQFRLNSRKTAVQRASQRQRVTGVVVNSKLNIRREDYDRLKATLKNCIQYGPTSQNRERHPEFASHLRGRIAFVTSLNSQRGAKLLALFEQIDWNR

SEQ ID NO: 5894 - protein, 429 aa, unidentified
  source 1..429: note = Related to NZ_SJPP01000003.1; note = Symmachiella macrocystis
MSFFDSILRWLGLKNTPPTGRDHAQQRRGKLRRRRGRLGHIYMVPLRRRQGQRSADPTEDAGEESAESPYRFARFGGYGEYRDLSKDSTPERLYQFGLPQLCTPSHIAEWLEVPCGRLAWLIHRFDDGGRAAHVAQAHYHYSWLKKRGGGYRLVEAPKPILKAIQQKILREILDRIPLHGAAHGFVAGRSICTNAQPHVGQRVVLKFDLENFYANVSFSRVVAIFRSVGFSREAAIWLGRLTTALPPEGLPAPGGDRNVVRPYLSRHLPQGAPTSPALANLSCYALDLRLAGMARAFGATYTRYADDLTFSGDQHLIDSLNVFIPLVTKIVRSERFTVHAGKRKVVRNNQQQRVTGVVVNERLNICRKDYDRLKAILTNCVRHGAATQNREQRADFAAHLRGRIGHVQSIHPGRSRKLQAIFDRIDWRS

SEQ ID NO: 5895 - protein, 432 aa, unidentified
  source 1..432: note = Planctomycetaceae bacterium; note = Related to JAGQQA010000064.1
MGLLNFFWRLIFGDPPSRPESSSSASRDSSVSRNPSTPRTRTRKLRARLIPDRVKRSRQDFPQNIVSSLPYRFARLNVTGGYLDLSQDLDEPQLQQLGLPLLATPEQLANWLGIPLGKLAWLTHRCDEGQRPRDVRHSHYHYRWVKKKQGGYRLIEAPKHQLRRLQDKILLEILCKIPVHPAAHGFVAGRSIRSNAEPHVGQRVVVKMDLANFYPTVRFSRVVSIFRAIGFSREVAIWLARITTSAVPLAFEGPPGELNRWALTPYYSRHLPQGAPTSPALANLSAYLLDRRLAGLARRFRANYTRYADDLTFSGDAKFLSGLRNFVPLVHTVIRRERFQLHYKKTKVHRSNQHQRVTGVVVNEKPNMSRADFDRLKAILTNCIRRGVSTQNHSQIPDFEAHLRGKISHAKFLNPARGAKLLALLRKIDWQS

SEQ ID NO: 5896 - protein, 429 aa, unidentified
  source 1..429: note = Related to JACRIH010000511.1; note = Planctomycetales bacterium
MGLWSWLRRLLFGQPKRSAASRSDDREQKRRRPRARLTPLRHRQRRTDRWRQRDAAGSINKITVKSQPYRFAWSSVFGGFLDLNRDGDPARLKQAGLPVFQTPQELADWLQMPIGRLAWLVHRFHDHQRPATVKLSHYHYQWIAKRSGDRRLLEIPKPQLKAAQEKILREILDLVPTHSAAHGFVTGRSIKTNAEPHVGQRVVMKFDLENFYPSVKYSRVVAIYRSLGYSREAAIWLGRLTTSITPPLGTLKDLATEAEWIPYATRHLPQGAPTSPALANLSAFALDLRLAGLARTFHANYTRYADDLTFSGPDQFLRSLRVFIPLVMQLIRQERFRVKLSKRKVIRNSQQQRICGVVVNEQIGIPRREFDRLKAILTNCVRRGPATQNHERHPDFAAHLRGRIAHVSHLHSERGARLLDLFEQIDWNS

SEQ ID NO: 5897 - protein, 432 aa, unidentified
  source 1..432: note = Related to SIAF01000026.1; note = Planctomycetaceae bacterium
MGLFNWLRCWFLGKRPPATNDVVSDQGAAPQRRKRRRKHSRARLVPLRAAAARDARRRFPGLTTAERTGAAPYRFARPCVLGGWLDFSLDGQTEQLGSAGLPVFETPQGLADWLELPLGRLAWLIHRFEIEQQPPDQAKAHYHFCWLPKRRGGKRLIESPKPILKRIQHRILREILDKVPLHPAAHGFAAKRSIRTNAAPHVGQRVILKMDLENFYPSVRFSRVVAIFRSLGYSREAALWLSRLTTSSLPANAAQWSLWSPELEAYLCRHLPQGAPTSPALANLSAFSLDLRLAGLARTFGARYTRYADDLTFSGDEHFSRSLAVFIPLAEQIIRAERFRTNKSKRHVVRDHQRQQVTGVVVNRHPNVARPDYDRLKAVLTNCIRRGPSTQNHSREDDYAAHLRGCIAHVAFLNPSRGEKLLDLFSQIDWNR

SEQ ID NO: 5898 - protein, 430 aa, unidentified
  source 1..430: note = Related to NZ_CP037422.1; note = Gimesia aquarii
MGIFQFIRRLLFGSSPSRPIAPADTHSALKQIKPSRPRRKPRLQPLRFNKKKNRDSPDMVDVSPLPYKLARPYELLRYRSQSDHYLDMTQDVDHQKLRQYHLPAFSTPEEIANWLEYPLGKLAWLTHRFNQADRPDDVNESHYTYHWLPKRNGYRLIESPKPFMKMAQQQILQDILNKIPAHPTAHGFVTGHSQVTNAVPHTGKRVVVKFDLENFYASVKFSRVISIYRSVGYCREAAIWLARLTTTAIPMSMPFPDGSLRPLYPYLSRHLPQGAPTSPALANLSAFSLDVRLSGLARSFDAEYTRYADDLTFSGSDQFLRSLRVFIPLVEQIIRSERFQVNQSKRRILRNNQQQKVTGVVVNEHTNVPRKEFDLLKAILTNCIRKGPASQNREGHPDFASHLRGRVAYVQQLNPNRGQRLLQLYQQIRW

SEQ ID NO: 5899 - protein, 422 aa, unidentified
  source 1..422: note = Related to NZ_CP037920.1; note = Gimesia aquarii
MGLFQFIRRLLFGSSSGRPVTPTDSYSKQNKTQRAYRKPRLKPFRYRQNRRTDTTELEEVSSPPYELARYASRTGHYFDMAQDTDFEKLDQYNLPRFCTPLELSQWLEFPLGKLAWLTHRFNQFDRPDDVKESHYVYHWLPKRNGFRLIEAPRPFIKIAQEQILKDLLNRIPVHPAAHGFVAGHSSVTNALPHTGKRVVVKFDLENFYTSVKFSRVVSIYRSIGYCREVSLWLARLTTSAIPMSMPFPDGSLRPLYPYLSRHLPQGAPTSPALANLSAFSLDVRLSGLARSFDAEYTRYADDLTFSGSDQFLRALRVFIPLVEQIIRSERFQVNQSKRRVLRNNQQQKVTGVVVNEHTNVPRKEFDLLKAILTNCIRKGPASQNRKGHPDFASHLRGRVAYVQQLNPNRGQRLLQLYQQIRW

SEQ ID NO: 5900 - protein, 430 aa, unidentified
  source 1..430: note = Related to NZ_CP037452.1; note = Gimesia fumaroli
MGFFDFIRQLFFGPAPDRSVARPETSANVKPSKAPRIFRKPRLSPLRYNKKKRFTPPENADVGSLPYKLARPYELLRYRSETDHYLDMTQDGDAAKLSRFDLPVFSTPEDIAHWLNLPLGKLAWLTHRFNQSDRPDDVKESHYTYHWLPKRNGFRLIEAPRPFIKMAQQQILQEILNQIPVHDAAHGFVTGHSPVTNAIPHTGKRVVVKFDLENFYASVNFARVVSIFRSVGYCREAALWLARLSTTAIPMNMPFPDGSLRPLLPYLSRHLPQGASTSPALANLSAFSLDVRLSGLARSFDADYTRYADDLTFSGSDQFLRSLRVFIPLVNQIIRSERFQVNQSKRRVLRNNQQQKVTGVVVNEHTNVPRKEFDLLKAILTNCIRQGPVGQNREQHPDFASHLRGRIAYVQQLNPNRGQRLLQLYEQIRW

SEQ ID NO: 5901 - protein, 424 aa, unidentified
  source 1..424: note = Related to NZ_CP036353.1; note = Gimesia maris
MGLFDFLRRIFFGSPPSQTVSPVESAPVPEETSSRKPRRKTTLEPLRYSSSHSSRVENIEEVAAPPYELARYGARTGHYYDMTRDGDTEKLARYELPLFSTPVELAEWLNIPLGKLAWLTHRFTQFDRPDDAQDSHYIYHWKPKRSGFRLIESPRPFLKMAQQQILHEILNQIPVHTAAHGFVRGRSSVTNATPHTGKRVVVKFDLENFYTSVKFSRVVAIFRNLGYCREASLYLARLTTSVIPMSLPFPDGSLRPLVPYLSRHLPQGASTSPALANLSAYSLDVRLSGLARAFDADYTRYADDLTFSGSEQFLRSLQVFLPLVNQIIRSERFQVNHMKRRILRENQQQKVTGVVVNEHPNVPRKEFDLLKAILTNCIRQGPRTQNRENHPDFASHLRGRVAYVQQLNPKRGQRLLHLYEQIRW

SEQ ID NO: 5902 - protein, 425 aa, unidentified
  source 1..425: note = Related to NZ_VTSR01000009.1; note = Gimesia chilikensis
MGLFDFIRQLFGSPPDRSGQAAAPDPVPEPAPHEPPQKRRPVRLHPLRYPKRRPRTEYNIEEVPAPPYELARYGAMTGHYFDMTQDTDAAQLSRHELPQFATPLELAQWLEIPLGKLAWLTHRYNHSDGPEDVKESHYTYHWLPKRNGFRLIEAPRPFIKMAQQQIQQEILSRIPMHHSAHGFVSGHSPVTNARPHAGKRVVLKFDLENFYANVKFSRVVSIFRSLGYCREAALWLARLTTSAIPANLPFPDGTLRPLLPYLSRHLPQGAPTSPALANLSAYSLDVRLSGLARSFGADYTRYADDLTFSGSEAFLRSLKVFIPLVQQVIRSERFQVNLSKRRVIRNNQRQTVTGVVVNDHTNVSRKEFDRLKAILTNCIRQGPETQNREQHPDFANHLRGKIAHVQQLNPNRGQRLLHLYEQIRW

SEQ ID NO: 5903 - protein, 425 aa, unidentified
  source 1..425: note = Planctomycetes bacterium; note = Related to JAADHY010000128.1
MFIPITGPLPSSIKIRRPISIVTPLLKPSSSHRTELEGKPRLTPLRYRPVESRAEAALPVDHLPYRFARLATRPGQYWDLSRDGDPDQLRTLGLPEFHTPEQLADWLQMPVGRLAWLTRRCAETQRPETERDGHYYCRWMEKRSGGWRLIEAPKPILKSVQQRIAREILQNIPPHEAAHGFVRGRSIVTNAQPHVGRRVVLKLDLENFYASVRFARVVAIFRRVGYSREAAIWLARLTTSAAPWSLSAPDGSDDTLRPYTAWHLPQGAPTSPALANLSAFSLDVRLTGMARCFGAAYTRYADDLTFSGSQRLIRALPTFLPLITQIIQSERFRVKKEKRKVLRNNQRQTIAGVVVNAHPNVTRSDFDRLKAILTNCIRHGPSDQNREQVPDFAAHLRGRIAHVMQLNPHRGAKLLALYEQIDWNH

SEQ ID NO: 5904 - protein, 331 aa, unidentified
  source 1..331: note = Related to nan
MGLWQWLKQLLFGSTSVEVEIPTEEERQERRPTPKLTPLRYHVSSWENHLPWKREFVSQRPYRFACNTDVWGMYNDGYVDLSLDANFGQLERWGLPKFSNPEELAEWLGLPVGRVAWLADRVRRGDWRGDRATDHYYRKFVSKRRGGWRLLEAPKPATKAVQYRILSEILERVPPHPAAHGFVRGRSIVTNARPHAGQAVLVKLDLENFYTSVSYARVVAIFRRLGYSREAAIWLARLTTTQAPENLQPPHGKARLDWRYTLRHLPQGAPTSPALANLAAFSLDVRLSGMARSFGAQYTRYADDLTFSGPKRFLQSLDTFLPLVIQIIQSE

SEQ ID NO: 5905 - protein, 426 aa, unidentified
  source 1..426: note = Related to CP036268.1; note = Planctomycetes bacterium Pan189
MFRWLLRLLFGEDESVTQRSQPEKIAPVETDEAPKVRVRPRLARFEFRRRRGHHSTSAATRTTEKPYRFALPNGVSGETIDRSQDQNFERLTRWELPALTTPEDLADWMEVSIGELAWLTHRTESAYRPPSLEAAHYHFRWVHKKSGGSRLIESPKRRLKHVQQLLLRGLLDRVPAHPAAHGFVRGRSIVSNAQPHVGKAVVLSYDLENFYPAVRYNRVVAVFRGLGYSREAAIWLTRLTTSALPPRMPLPEGRGANLIRAYAARHLPQGAPTSPALANLSAFSLDVRLNGLANSFEANYTRYADDLTFSGDDRFRRSLATFIPLVNQIVRSEQFVVHREKRKVVKHGQRQLVTGVVVNDRPNVSRAAYDRLKATLHNCVRQGPASQNRDEHLNFEAHLQGKISHVRQLNPARAEKLQRLFDRIEW

SEQ ID NO: 5906 - protein, 424 aa, unidentified
  source 1..424: note = Related to NZ_CP036316.1; note = Calycomorphotria hydatis
MLRWLFSLLFGSRDDGGRPAPAQRRKRPKYWRIGKIKLSRFQYGRRNRKLQRDELVREKPYAFAFRYPLHSKYIDRSGSGDSEKLARFELPDLRTPDDIAQWLGMPLGRVAWLTHITERQFRPQSLSEAHYTFHWMPKKFGGARLIEAPKPLMRKVQHQILRGILDHVPAHDAAHGFVKHRSVLTNAAPHVGQRVVLRMDLENFYANIRFSRVAAIFRELGYSREAALWLARLCTSGLPPRMPLPEGRGANLVRNYTARHLPQGAPTSPALANFSAYSLDVRLTGLANSFHANYTRYADDLTFSGGDRFLRSLRVFIPLVNQIITQERFIAQPAKRRVIRDNQRQKVTGVVVNQKPNCDRREFDELKAILHNSVRFGPASQNRHDHEDFYAHLNGRIAHIAQLNPQRGEKLRSMFRQINWANSP

SEQ ID NO: 5907 - protein, 440 aa, unidentified
  source 1..440: note = Planctomycetaceae bacterium; note = Related to JAGQQC010000202.1
MGLIDFLFRMLGLKRESRGELPTSVPTKPRPAAKTQTKTSYPRLHPLRFKRERWSKVKKSSQKLSASTRPFSVPDAKTERPYPLANQDVRYGGYLDLSQDSDPVQLRELELPQFTNPPELAEWLGIPVGQLGWLTYQFDEGHRPLTQRAGHYHLRWQPKRNYSVRLIESPKPLLKQVQRKILREILDHVPAHSAAHGFVSGESILTNAKPHCRQRVIVKFDLENFYPRIRFRKVTAIFRAMGYSREAAIWLARLCTSNIPVDTKLPSMDPEVIFLYTPQHLPQGAPTSPALANLAAYGLDVRLEGLARSFGANYTRYADDLTFSGDDKFLRSLKIFIPLVEQIIRETGFSVNKEKRKVIRDNQRQAVTGVVVNQHPNMNRKDYDRLKAILNNCVRHGAESQNRDQHPDYQAHLRGRVAHLLQLNPKKGTKLQRLFERIQW

SEQ ID NO: 5908 - protein, 438 aa, unidentified
  source 1..438: note = Related to NZ_CP036281.1; note = Polystyrenella longa
MGFFDFLLRLLGLKSKPQATMAPAAGTQFKKTTSPKRTDRKLDPLRFQRERWSKVAKSPQQQTTTSRPFSVPAVKVEQPYPFAHFSPMGDGYLDLSQDGDSVQLQELELPEFSNPQQMADWLQMPVGQLAWLTCQFEEGYAHATEKAAHYHFRWLPKRNFGCRLIESPKPLLKQAQRKVLREILDNVPTHQAAHGFVQGSSILTNAQPHCGKRVVLKFDLENFYPHVRFSKVVAIFRSMGYSREASIWLSRLCMSRLPLDCKPPTANPEALWIYQPTHLPQGAPTSPTLANLAAYVLDVRLDGLARSFGADYSRYADDLTFSGDAQFLRSLKSFIPFVEKIIRETGFKVNKNKRKVIRNNQRQSVTGVTVNEHPNINRKEFDRLKAILHNCVRYGSESQNRDQLPDFQAHLRGRVAYFQQLNPTRAAKLKQVFEQIRW

SEQ ID NO: 5909 - protein, 420 aa, unidentified
  source 1..420: note = Related to JABURQ010000038.1; note = Planctomycetaceae bacterium
MSLWQLLKNLLFGGTAASSNPAVRNTEHERRRGRPRLQPLNYSQHSRNRQPSRQVSEKPYLYARKDTYRQDGWYDLREGGDAEFLQQEGLPLIESPAELADWLDLKPGQLAWLTHFFSPGSRAESVEQSHYHYHWVSKRSGGERLIESPKPMLKQVQSKILQGILNQVPVHRSCHGFTRGRSILSNAEPHCGQRLLLKFDLQNFYPSVSLNRVIAIFRSLGYNREVAIWLGRLTTTAIPSSIPFPEEGPKGLRDYLADHLPQGAPTSPALANLSAFSLDLRLHGLANSFGANYTRYADDITFSGPETLLKSLKTLIPLVEAVIRDERFTVNKAKRKVIRNNQRQTVCGVVVNEHPNYSRKEFDRLKAMLFNCIRFGPDSQNREGHPNFREHLWGRISFVKQLNPARGAKLEALWNQISWS

SEQ ID NO: 5910 - protein, 431 aa, unidentified
  source 1..431: note = Related to WGME01000003.1; note = unidentified bacterium
MDQRWLGILIVVAAWIVVRTLFGKRRTQPRSSRSIHKERYEQQRVRPAIREKRPLIVGRNKSPLLAVASPPHSFAHRGLKPGTWYDLSQDGRNDELVRRGLPVFQTPDELAAWLNVPVNRLAWLAYRCTRGNLPGVSQSHYVYTWKPKRTYGYRLIESPKASLKTVQRQILTEILDHLLVSEAAHGFRKEHSILTNAQLHVNAAVVVKFDLSDFYLTVRSGRITNLLRRVGYSREVAIWLTRLTTSTIPGNLPPPPTNPIVMWNYRQRHLPQGAPSSPALANLVAYRLDQRLLGLAKSFGANYTRYADDLTFSGDESFAAALRAFIPLVEAIIRRERFQSNNAKRQILRRHQRQIVAGVVVNEKPNFCRKDFDRLKAILHRCVTQGPAAQNRDQIEDFAAHLRGRIAHVRQLNPQRALKLESLFQRIDWRR

SEQ ID NO: 5911 - protein, 421 aa, unidentified
  source 1..421: note = Related to nan
MMWYLILIAVVTGIGVMVARSRVRGASRSRPPGDSRWRRLRRPFQHPPTPRTSGEVVRQPPYAFSYGAGGKGRFCDLSQDLNLDRLTTWKLPVLRTPDDIAQWLGLPVNRLAWLAHRCRRGRPEGVQQSHYHYRWLPKASGGMRLIESPKRELKAIQRRILKEILQAVPVPAAAHGFVRGRSIKTHAVLHERMHVLVRIDLRDFYASVGFNRVVAIFRTIGYPREAALWLARLTTAALPTNLAGPPEDPGAVWRYRRRHLPQGAPTSPALANLSAYWLDKRLTGLARAFGANYSRYADDLTFSGDDALDPKLRVLIQLIEQVVRDERFHSHRKKRRVLRRHQRQVVTGVVVNDKPNVSRRDFDQLKAVLHNCVQFGPASQNREGHAHFAAHLRGRIAHVQQLNPSRGAKLLAVYGQIDWGR

SEQ ID NO: 5912 - protein, 483 aa, unidentified
  source 1..483: note = Related to LYDR01000158.1; note = Planctopirus hydrillae
MIAPILNWNPVYGGSTVDRIRNRHWLCDPAVDTLGNSMQTMHCQGKDVFMGLWSWFWSWWRPTGSNHALPSSPPANRASGQKRQWIGSTTTPKLPRLRYRSPEMVRQWRIEGRGTQVDQLPYVYARYARTRRRKQFLNLLTDTRVDLLQQHRLPVLTTLDELSQFLGLPIGRLAGLIHLADHGRPPTEKKSHYWLKWIRKKRSGHRLIEAPKPALKKVQEIILRQILDLVPAHPAAHGFVPNCDILSNAQLHAGRAVVVKFDLKDFYPSVTFSKVVAIFRSLGYSREMALWLARLTTSALPIGMAFPDKNPYSIMQFTRRHLPQGAPTSPALANLAAYSLDVRLTGLARRFGAIYTRYADDLTFSGDHRFLKQLKRFVPLTDQVIVQCRFHSQPAKRRILRQSNRQTVTGVVVNQSPNCSRRDYDQLKAILHNCVRHGHQTQNRDQQVDFRAHLQGRVAHIRHLNPDRGVRLQKIFEKINWNS

SEQ ID NO: 5913 - protein, 430 aa, unidentified
  source 1..430: note = Related to JAHBXV010000030.1; note = Planctomycetaceae bacterium
MGLLNWFFSLLFGSPRRAASPPTAMSQTSGARSSAQTHGRVRLKKDRPRQWSNRFRSTRVVVPKKPYPFARKSITGRGYLDMSTDGDDQALIAAGLPVFHHPQELADWLRLPLKELAWLTNHFRHGRPIDPQRAHYHFRWIEKRRGGWRLIESPKRLLKALQSRILDEILSRIATHSAVHGFVLGRSILTNAEPHVGQCVVVKLDLESFYPSIRLARIARLFRGLGYSREAAIWLGRLVTSRLPLNQPFPTGKSGTSSLTLWPYFPAHLPQGAPTSPALSNLVLSRLDARLAGLARKFGATYTRYADDLTFSGPERFAASLAVFIPLAKQIIRREGLRVNRGKTRVLRQAGRQIVTGVVVNERPNIDRRAYDTLKAILTNCHRHGPTSQNRDNHPQFALHLRGRIGHVSLLNPARGAKLLAIFEQIDWER

SEQ ID NO: 5914 - protein, 426 aa, unidentified
  source 1..426: note = Related to nan
MGFFDRIRRALSGEPPPTSKAGETGERPQEYRSFPRVKPVRTVARHLPVCQPDALVRVEKPYAFARRSPLTGEYLDRRVGGKVERLRKFRLPEFGTPEELATWMGLPVKTIAWLADFHNRNAGEKTAKKQHYRYTWRRKRGGRGWRLIESPKPVLKLVQQRILHEILDRVPAHGAAHGFVKGRSILTNAASHAGKYVVVRCDLANFYPSISFKRVRAVFAGLGYNSEIAWWLARLCTNCTPDTLEGPSGGALGRFAAGRHLPQGAPTSPALANLSAWALDVRLSGLARRFNVAYTRYADDLTFSGDEKCLNGLTMAHLLAYIRGIIRDERFVFHPTKRKLVRRGGRQIVTGLTVNRKPNVPRPYFDKLKATLHNCARHGPSLHNRENLPDFRAHLEGQIAFVRSVNPQKAARLQRIFDRIVWEGSG

SEQ ID NO: 5915 - protein, 428 aa, unidentified
  source 1..428: note = Planctomycetes bacterium; note = Related to JABTUM010000004.1
MGLGFLRRLFGGGSDKPPSGRKTNPKRRALKPTVVPGAHAPAPTAHPLPVFEKPYAFPLFAPDTQKESRARFLDGRVGGKPDRQKGWNLPRLETPEDLAKLCGVPLKTLAWLCDYHRRNADEKVKKKQHYHYVWKQKKAGGWRLIEAPKPLLKHCQQRVLREILDRVPPHGAAHAFRAGRSIKTNAAAHAGKYAIVKADLSYFFPSIRFKRVVSVFRGLGYNLELARWLARLCTNRLPPDLSIPGTNNTWALYSVLGHLATSLGRHVPQGAPTSPALANLCAWAMDVRLNGLARKFGAVYTRYSDDLTFSGSAELMGKRRINYFVRYVRGIVRNERFKWHPKKVRVVRRGSRQIVTGLTVNEKPNVGRADFETLKAILHNCVKQGPASQNRSGHADFRAYLSGKLAFVKSVNPQKAARLERDFAKIKW

SEQ ID NO: 5916 - protein, 418 aa, unidentified
  source 1..418: note = Planctomycetes bacterium; note = Related to JACQFI010000030.1
MGLSFLKKLFGGSESERPSGKKGKPSQRLPKTTLARYKPKPYVPSLRVKGAKPYPFAQPACPGFLDGRVGEDAARLQRYGLQRLQTPEELAAWLKIPLKTLAWMADYHRTNYLEDVKKKQHYHYKWVKKRSSAGYRLIEAPKPMLKMIQRRIHEEILSKVPPHPAAHGFVAGRSIISNASQHAGKYVILKIDLQDFYPSIKRRRVLAVFRGLGYGVEASHWLMRLCVNCIPSNCDAPDDSSKAFHWIIRGMYVPRHLPQGAPTSPALANFAAWALDVRLAGLAKKFGVTYTRYADDLTFSSDSKLMKGKSMTMLIRYVRGIVKDEGFRWNASKKAVVRRGSRQVVTGLTVNAKPNVARKEFDALKAILHNCAKKGPASQNRSGVADFRAHLQGRIGFVRSVNPPKAARLQKVYEKIAW

SEQ ID NO: 5917 - protein, 432 aa, unidentified
  source 1..432: note = Related to JAGQRG010000294.1; note = Planctomycetes bacterium
MGIFDWLFGKKKKAAYGADWDTTQSAPSYQGPANQPAPEQREPFINAPARRTKRTRTWGLKWRQQRSKHPLESVPNEEEPFSLWSNPFKHHALYGGTEAKPSKGGSAARIEALGLPNLENLDELAALLGETRNNLLHYIIRDRPGDRHYVARDLPKKSGGTRMLLVPKPRLKAIQRKLNAKLIRRLPLNPAAHGFRRSHDVLSGASVHVARSVVISVDIEAFFPSLTFRRVSGFLRSIGYSRGIATALANLMTIRPCNVAGIGRTADTRYPQLPQGAPTSPGIANAICWRMDKRLSALARKFGGDYTRYADDLTFSGFDEMAKGAGRLLQLVRKIVKTEGLALNEKKTRIMRKGRQQRVTGVVVNQQTNVSRREFDKLKAILHNCIKHGPGGQNRESVPDFKEHLRGRIAHISHIGPERGRKLKAMFDQIRW

SEQ ID NO: 5918 - protein, 403 aa, unidentified
  source 1..403: note = Related to JACKID010000003.1; note = Planctomycetes bacterium
MGILDWLFGRKRRLPAEPEVFVPRPVEVPDSPNAREPFLNHPMPRSKRRWYYERTANLFWRNGRSKEPKYSTSIEPSPSRIEALGLPDLRELRDLAALLGVALKDLKQYSARPNHANGHYLPLYITKKNGTKRLLLAPKPRLKAIQRALHQKLVRKLPLNEAVHGFRRGRDSLSSASAHVGRDVVICMDIEEFFPSFDFRRVSGFFRAVGYSREVAVMLANLTTVAPDDVPNAESRYCRDIPQLPQGAPTSPGLANAICWRMDKRLAALAHRFGAEYTRYADDLTFSGHDDLADGANKFVRMVREILLSEGLYVNEDKTRIMRKSRQQRVTGVVVNERTNVSRREFDRLKAILHNCAKHGPGGQNHERHEDFAGHLRGRIAYFCHIGPERGRKLMRMFELINW

SEQ ID NO: 5919 - protein, 400 aa, unidentified
  source 1..400: note = Planctomycetes bacterium; note = Related to JAKITN010000241.1
MCVANKPNPKEPFLSSPEHTLDRRHRKRWAGLAYRRKRSKWRISPVADQSIEGCDWRDKLGNVSADRVPQGVAGRVATLGLPAINSVEDLAALIGITPNQLAGFALRGDGQRSHYVGRPIPKKSGGERRLLVPLPRLKAAQQALHRKLISLLPLQPCVHGFRLKHDVLTGSSVHVGRQIVIGMDIAEFFPSFTFRRVSGYFRALGYSRGIAIALASLTITSCMDVPDYTPEAYSNHSYTELPQGAPTSPGIANAICWRMDKRLSALARKFGGDYTRYADDLTFSGFQDMADNTGRLLRIVRQIIETEGFVVNENKTRIMRRGSQQRVTGVVVNEKTNLPRREFDKIKAIIHNCIKHGPATQNHAQHENFKEHLRGRVAHAQHIGPERGQKLKAMFDSIVW

SEQ ID NO: 5920 - protein, 459 aa, unidentified
  source 1..459: note = Related to QEVF01000001.1; note = Planctomycetes bacterium
MGFLDWLFGRKRFLPPHTPPSPVGPRNPNIPTISESGTAPVRPPAGGQSQSGQHSLGSRYNPRILRPRRRRSSRPREIDAGKSEHLDRWPHDELDRPDPASLTLPAPRADWVPLGDQSALAALLGIQPTDLKYWLVGHHLDENYILREIPKKSGGTRLLMAPMPRLKALQRQLQQALVSRLPLSPSVHGFRRRHDVLTNAAVHVGKRVVVCMDIADFFPSFDLRRVCGYFRWLGYSRSVALSLASLTTADSFNARLAKGRGRTGLSSDWTERNEVENRCQSVNKIHRTSPLRYRGYRLPQGAPTSPGIANAIVWRMDKRLSALARRFGGDYTRYADDLTFSGFEKLAKHTRMFIKLVEKIVHTEGLAINRKKTRIMRSGRRQRVTGVVVNRQTNLARRDFDLLKAILHNCITKGPSTQNRSNHPNFREHLRGRVAHALHIGPERGAKLQQLFNQIDWSR

SEQ ID NO: 5921 - protein, 387 aa, unidentified
  source 1..387: note = Related to JAGPBM010000060.1; note = Planctomycetes bacterium
MRMLKPRYRRSKDPKSIEGKQNEPIGYWHEQMGGTVKDPVKGGNPSRTAQLGLPSIPHADALASLLGISTRALEGWIGGLLNEQNYVVRGIAKKSGGTRYLMAPMPKLKALQRTLRTSLVDKLPLNACVHGFRRDHDILSNGTVHVNKRVVICMDVLQFFPSFDLRRVCGYFRWLGYSRGIALSLAKFTTADSFNGQLVSASGREGFAQSTPAYVALKNQYRQPQLPQGAPTSPGIANAIVWRMDKRLTALARKFGGDYTRYADDLTFSGFEKMAKHAKLIVALVEKIVHTEGLAINKKKTRIMRKGRQQRVTGVVVNKQTNASREQFDLLKAILHNCAKKGPSTQNRSNHPNFKEHLRGRVAHIAHIGPERGAKLKKLFDAIDWSR

SEQ ID NO: 5922 - protein, 466 aa, unidentified
  source 1..466: note = Related to CAJPFM010000266.1; note = Planctomycetaceae bacterium
MGLFDWLFGRKKKDPPTYRNPYPPKVHSFSEFSADSTLPAPRQQARRNKPTRRKLQPFAPQSYKGHRTLGLSWRRERSKEPVDRVPNSYLSVAHFQHFGGTPSSIPEGGDAAKLLNVGLPVLRHFNELAALLEIDSTSLYKLVVRTSAQHYLFHEIAKKSGGIRLLMAPLPRMKAAQRRLLQALVSKVPLHLAAHGFREGQDVLTNAGPHVGKPIVICMDISDFFPSFTFRRVSGFFRHLGYPRGIAVALANLTTWSPRGQFQLPQTTGRNLRSVDYKERKVQLARAEWLDSGGNEIPSRMWPQLPQGAPTSPGLANAIVWRMDKRLSALARKFGGDYTRYADDLTFSGFEKMAEHSRTLISLVEKIVKTEGLTINVNKTRVMRKGRRQKVTGVVVNKQTNASREQFDLLKAILHNCAKKGPSTQNRSNHPNFKEHLRGRVAHIAHIGPERGAKLKKLFDQIDWSR

SEQ ID NO: 5923 - protein, 395 aa, unidentified
  source 1..395: note = Related to JAGQRI010000064.1; note = Planctomycetes bacterium
MSFRLRRSKEHIGPVKDLTLSGSRNPMTGEASSVGAIGNIGGSARHPDIGFDSATIRSLGLPEIEHLDQLAQVLQIDRNQLVWLAARPAFSENTDAHYTLKAIPKKAGGRRLLMVPLPLLKRAQQRLLAELVRKLPVHEAAHGFRVQRNTLTGASIHVGKDVVIGLDIADFFPSFTFRRVSGYFRSRGYGRGISVALANLTTNRLLDTITKDGKRWKYPKRNAFPELFEHPPHPILPQGAPTSPGIANAICWRMDKRLAALALKFGGDYTRYADDLTFSGFGDMARGAERLIKLVRKIVETEGLALNEKKTRVMRQGRQQRVTGVVVNDQTNVSRRDFDRLKAILHNCIKHGPHGQNRENVPDFEQHLRGRIAHVSHIGPERGRKLMRMFEQIRW

SEQ ID NO: 5924 - protein, 456 aa, unidentified
  source 1..456: note = Planctomycetes bacterium; note = Related to JAHBYA010000006.1
MGFFDWLFGKKKDPYGGKLQKGYSSPRAQPQPAKTYQHQPQGYGGPVPPPTPQQQRAVGVRFRFLKWRRARSKDPLPPLPDQTISGGIDPMTGAYTEPGAIAGLGGTAQHPDPHFKPDRVRAAGLPEIPHLDALAALVGVGRNTLVWLAGKPLASEGCDSHYTVKAIDKPSGGQRLLMVPLPKLKAVQRALVDRLINKLPVHDAAHGFRKGRDVLSGASVHVGKDVVISLDIRDFFPSFTFRRVSGYFRSLGYGRGTAVALANLTTARLNDAQVKQGKRWVYAAQVHKLRTYSHPELPQGAPTSPGISNAICRRMDKRLAGLARKFGADYTRYADDMTFSGSDDLAFHAPKFIGLVTKIVQSEGLALNDKKTRVMRQGRQQRVTGVVVNHKTNVSRRDYDRLKAILNNCIKRGPHGENRENHPDFRGWLQGKIAHVSHIGPERGRKLQALFSQIRW

SEQ ID NO: 5925 - protein, 445 aa, unidentified
  source 1..445: note = Related to JADZFR010000004.1; note = Planctomycetes bacterium
MGFFDWLFGKKKDPYSGNVQKDYTSPRQRPQTAQTYPQQPHGYGSPVPPPTVQQQQSLGIRDRYLSWRRNRSRAHVPPVADQTLGGNEHLGHLGGTSRHPDRHQNAAALQAAGLPLLPHLDALAAMVGVELKTLVWLASKPVASDECESHYTIKAIDKPSGGKRLLMVPLPKLKAVQRALVEKLVNKLPVHEAAHGFRKGRDVLTGASVHVGKDVVICADIRDFFPSFTFRRVAGYFRSLGYGRGTAVALANLTTARINDALVRQGDTWTYAAEVYKVHLWGHPELPQGAPTSPGIANAICRRMDKRLTGLARKFGADYTRYADDLTFSGGDDLAFHASKFLGLVRQIVQTEGLTLNDKKTRIMRQGRQQRVTGVVVNDKTNVSRRDYDRLKAILHNCVKRGPHGENRDNHPDFRGWLQGKIAHISHIGPERGRKLMALFQQIRW

SEQ ID NO: 5926 - protein, 444 aa, unidentified
  source 1..444: note = Planctomycetes bacterium; note = Related to JADJRK010000001.1
MGFFDWLFGKKKDPYGPRRDPYQQQPKAYGGPVPPPTAQQASAIGLRNIFLSWRRRRSKGPVPAQPDQTIRGGLNPQTGAWVDPGAISSIGGTRQHPDPYYDSAKVRAAGLPDLPHIDAMAEVLRVDRRTLVWLAAKPVPGDSLDSHYTLKEMPKSSGGTRLLMVPLPKLKAVQRALVEKLVNKLPIHEAAHGFRKGRDVLSGASEHVGKDVVICADIRDFFPSFTFRRVSGYFRSLGYGRGTAVALANLTTGRLMDARVQMNGRWQYAAKLKHPETHARYHPELPQGAPTSPGIANAICRRMDKRLTGLARKFGADYTRYADDLTFSGGDDLAFHASKFLGLVRQIVQTEGLTLNDKKTRIMRQGRQQRVTGVVVNDKTNVSRRDYDRLKAILHNCVKRGPHGENRDNHPDFRGWLQGKIAHVSHIGPERGRKLMALFKQIRW

SEQ ID NO: 5927 - protein, 444 aa, unidentified
  source 1..444: note = Related to JACKID010000003.1; note = Planctomycetes bacterium
MGIFDWLFGKKKKDPYGGGGLSKDYGAPKPYSDMPRQYQRPSDPAPPRTFEPDNREINLSFRLGRSKQPVTPLRDQTVGRNAKPGTTNLDHLGGTRDNPDPYTDVMKLRSNGLPEIDSLDALAELVGSTRESLLFLAARSGWDRPAHYSLRQIPKKSGGTRLLMAPMPKLKAVQRALHGKLVQLLPVHEAAHGFRKGRDALSAATPHVGKDVVISVDIENFFPSFTFRRVAGYLRTLGYGRGVAVAIANLTTARLADGKYKEGSRWVPGHNLRHPDMAGRYHPELPQGAPTSPGLANAICLRMDKRLDALARKFGATYTRYADDLTFSGYDDLAKSAGNLLQLIRQIVRTEGLRLNEQKTRIMRGGRQQRVTGVVVNQKTNVPRREYGTLKAILHNCIKHGPAGQNRDNHADFKEHLRGRIAHVSHIGPERGRKLMRMFEQIRW

SEQ ID NO: 5928 - protein, 451 aa, unidentified
  source 1..451: note = Related to JAIOJA010000048.1; note = Planctomycetes bacterium
MGLFDWLFGKKKDPYGTKPGQDYGDKDHAPKPYNDQPKQYQSAQKPYQAPPKSYGAPPPKPGERTEKLSFRQARSNKPVDPLADQTIKTPRRGPNLAHLGGTRESPDPHTDVIKLRNNGMPEIAHLDDLADLVGATRNEIIFLASRPGWGEPSHYTLKELRKKSGATRMLMVPMPRMKAVQRALNAKLISRLPVHEAAHGFRKGRDVLTSASPHVGKDVVISVDIEDFFPSFTFRRVSGYFRNLGYGRGVSVALANLMTARLRDGATKQGNKWKPVAYGSHPDIGKRYHPEIPQGAPTSPGLANAISRRMDKRLHALAQKFAADYTRYADDLTFSGNDELAKSVGNLLQIVRQIVRTEGLRLNEKKTRIMRKGKQQRVTGVVVNKQTNVSRREYDKLKAILHNCIKHGPTGQNRENVPDFREHLRGRIAHVSHIGPERGRKLMRMFEQIRW

SEQ ID NO: 5929 - protein, 452 aa, unidentified
  source 1..452: note = Related to JAGQRE010000003.1; note = Planctomycetes bacterium
MGLFDWLFGKKKKDPYGGSFRQDYDSGRSYNDQPVERYQSKATRRPPAVESPRQKHRTGKLSFRRLRSNQALDPLPDQTLDGRNPNTGQLTGSPLSHLGGTRQAPDPHTDAQRLRNHGLPVVEHLDDLAELLGTARDELVYLSARPTVEEPTHYTLKELPKKSGGTRLLMVPMPRLKSLQRTLNAKLISLLPVHDCVHGFRTGRDVLSSASAHVSKDVLVSMDIEDFFPSFTFRRVAGYFRSLGYGRGTCVALANLTTFRLADASVKRSNRNAWKLASVHHHPDAMRRWHPELPQGAPTSPGIANAIARRMDKRLHALALKFGADYTRYADDLTFSGGEELAKGVGRLLMLARKIVKTEGLALNENKTRIMRKGRQQRVTGVVVNQQTNVSRRDFDKLKAILHNCIKHGPGGQNRESVPDFKEHLRGRIAHISHIGPERGRKLKAMFEQIRW

SEQ ID NO: 5930 - protein, 335 aa, unidentified
  source 1..335: note = Related to JADKGX010000001.1; note = Planctomycetes bacterium
MPALPHLDAMAELLGTPRSELQWLAHRPVQEIAKSHVHYRLFEVRKKSGGTRLLAAPLPRLKAVQHQLLDKLISRLPVHGAAHGFRRGRGILSGANVHVGKDVLVCFDIKDFFPTFSFRRVSGYFRWLGYGRGIANAIALLTTAALHEATTGGKGQWTPAYNTRHPDLVRRHHPELPQGAPTSPGLANAICWRMDKRLSALASKFGGDYTRYADDLTFSGGQDLARHADNLIKLVRKIVRTEGLELNEQKTRVMRKGRQQRVTGVVVNEKTNLSRRDFDKLKAILHNCAKHGPAGQNRADHPDFKGHLQGRVAHAMHIGPERGAKLKAMFDKIVW

SEQ ID NO: 5931 - protein, 449 aa, unidentified
  source 1..449: note = Related to JAHBXZ010000001.1; note = Planctomycetes bacterium
MGLFDWLFGKKRDEYGAGLNRSYPPSQPQQVRPVPSQGGPVPSAGTPQNGKRTSYLSWRRRRSRESVVSVRDQTLGGSVDPQTGRHSEAGAIGNLGGSPRHPDPYFDAGRVASHELPALPHLDSLAALVETPLPELKWLSVMPPFGDKMWGHYCLFEVKKKSGGTRLLAAPLPRLKAVQRRILDKLVSRLPVHGAAHGFRRGRGILSGATVHVGKDVLVCFDIKDFFPSFTFRRVSGFFRWLGYGRGIANAIAALTTVRLTDTNRRREGKWEHPGLAKHPDMLKRRQPELPQGAPTSPGLANAICWRMDKRLSALARKFGGDYTRYADDLTFSGGEDFARHAANLIKLVRKIVRTEGLALNEKKTRVMRKARQQRVTGVVVNEKTNLCRRDFDKLKAILHNCAKHGPAGQNLENHPDFKGHLQGRVAHALHIGPERGARLKALFDKIVW

SEQ ID NO: 5932 - protein, 380 aa, unidentified
  source 1..380: note = Related to JABTUE010000002.1; note = Planctomycetes bacterium
MRDQTLGGARNPQTGAPSVAGAISGVGGTPGHPDPYFDAGRVASHELPALTHLDALAELIETPRNELLWLAVKPPFSNKLWGHYHLFEVRKKSGGTRLLAAPMPRLKAVQRKLLDKLVSRLPVHGAAHGFRRGRGILSGANVHVGKDVLVCLDIKDFFPSFTFRRVSGYFRWLGYGRGIANAIAALTTARLTETNQRQGTTWAAAHTGMHPDMNHRRHPELPQGAPTSPGLANAICWRMDKRLSALARKFGGDYTRYADDLTFSGGQDMARHTDNLIKLVRKIVRSEGLQLNDPKTRVMQKGRQQRVTGVVVNEKTNLSRREFDRLKAILHNCVKHGPAGQNRENHTDFKGHLQGRVAHAMHIGPERGAKLKAIFDKIVW

SEQ ID NO: 5933 - protein, 461 aa, unidentified
  source 1..461: note = Planctomycetes bacterium; note = Related to JADLBZ010000167.1
MGFFDWLFRRKKDDYSKGLQRGYQRPSSHPQPLPPQPATPPQRAGTPPEPAGWGSPPPPPPWKNRTHRSWINRRSRTPPEPQRSEPIPKGRPGELRHLGGTAKHPDPHFKPGRVQELGLPAIPHLDALATLLGTTISKVAGFAVRPPSTAMNWVHYFLHPVPKKSGGTRLLMVPCPELKRLQRRLHEVLVRKLPLHEAAHGFRARRDSLSNATAHAGKAVVICMDIADFFPSFDFRRVCGYLRWAGYGRGVAIALANLTTNSRNECKMRRKPDVQKGAGTLLSAWKCVPKHPDLLAGSLPELPQGSPTSPGLANAICRRMDKRLAALARKFGGAYTRYADDLTFSGGEEMSRRAGRLMQLARKVITSEGLAVNEKKTRVMRRGRHQRVTGVVVNEKPNLPRAEFDRLKAILTNCIRHGPASQNREQHADFRAHLHGCVAYAAHIAPARGGKLVKLFNEIRW

SEQ ID NO: 5934 - protein, 363 aa, unidentified
  source 1..363: note = Planctomycetes bacterium; note = Related to JADLAK010000089.1
MGLGNFFRKLFGGGDDYQRRPGGGDYRKPSVGATHASPAAHGGPPPPPPAASRVHAGDPAYRSPQSGQAINDREITDALKHPYRRKRRSKHPLQGHIHETGSSNWFSPDRTTNPVRLNALGLPVLSTPVELVPLLGEELKRLYDFAYANDRDSEDSHYAYRLVPKKRGGWRFIEAPKPRLKAVQKRIKEIFVDKLPVSNHAHGFLRKRDMVSNATPHVGKACVICADISDFFPTIGFNRVAGFLRSCGYGRMVAAALAMLTTNAHWASADVLIGDEVVKNKDARKRAPEVFKYTGAYRRTPQGAPTSPGLANAICWRMDKRLAGLAKKFNAVYTRYADDLTFSGGVELAGRAGAFLRYVARIV

SEQ ID NO: 5935 - protein, 381 aa, unidentified
  source 1..381: note = Armatimonadetes bacterium; note = Related to JABUFB010000006.1
MGFFSWLRGMLFPPATPLPPGMTRAEARRRRQPDFLPRPRRRRPRRHRYGRPEATFRPAELARFDLPALATVEDLAAALGVTTGKLRWLTWPCRDRTCDHYVRRRVPKKSGGERLLCAPKAETRRAQDWIFHEILARVPVSSAAHGFIRGRSIVSNASAHVGKRVVVSMDLEDFFPSVSMATVVGLFEWLGYSKEVAWHLSMLCTCAYGRRRALPQGSPTSPAISNLICWKMDRRLAGLARKFGATYTRYGDDLTFSGHFQRPDRPGRLIGIARAIISEEGFEVARHKTRIMRHNRRQSVTGLVVNERTGIGRDEVRRLRAILHNCKVHGVESQNREGDELFKERLRGKIALVKMANPDQGAKLLAAFHEVDWGATASPKG

SEQ ID NO: 5936 - protein, 383 aa, unidentified
  source 1..383: note = Phycisphaerales bacterium; note = Related to JADLBO010000333.1
MSWMYFLLAGAAVLLLLALSIPRAEQPAVAEPKSRRGPRRPLPGSRWRTQHPGDSDRLRSLGLPELRDTRDLLRWLRLSLRELVPLADHANRATRDRNNYIEWTVPKRRGGKRVIAAPKKRLKAIQTRILREILDRVPPSAAAHGFVRGRNIVSNAAPHVGRAIVVNFDLVDFFEHVHFPRVMGVFRRLGYSKEVARWLAYLCTHRPLLVAGDGHGPLAAARHAVQGAPTSPAVSNLAVHRLDARLAGLARRFGCTYTRYADDLTFSGDEPFKRSLKRFVPLVRRIVSSERFRLHEGKMRFLRAGRRQEVTGVVVNRKINARREEYDRLKAIIHNARRSGSLESQNREGRPHFRAYLLGRASHIAMLSPERGQRLMREIRRLT

SEQ ID NO: 5937 - protein, 376 aa, unidentified
  source 1..376: note = Planctomycetes bacterium; note = Related to JACRLV010000179.1
MTVLVSIGLAAIVIAFTALIMALSALDRSGAPRSRPLPGARVFPQAGGNIAKLRDLNLPELDSTHDLLRWLRLELVQLLPLANHANRTERSNYVEWAVPKKSGGLRVIAAPKKRLKAIQLRILREILDNVPPSSAAHGFVRGRDVLSNATPHVGKTLVVNFDLVDFFGHIAYPRVVGVFRRIGYGKEVSRWLACLCTHQPKPPRGRGHDREGRRRHAVQGAPSSPAIANLAAWRLDARLCGLARRFQCTYTRYADDLTFSGDEPFKRSLRRFLPLVRRIVAAERFALHRRKMRFARASRRQEVTGVVVNRKTNIRRADFDRLKAILHNARRAGSLESQNREQRPHFRAYLLGLAAHVAHLNPQRGERLRREILALE

SEQ ID NO: 5938 - protein, 416 aa, unidentified
  source 1..416: note = Related to JADJRI010000009.1; note = Planctomycetes bacterium
MLALAPTTWACYGIPLGVFLSVAIFLRYAYRRAGSESEKWDSLGGRRWRCERKGDGVGELRERVTRERVWLPGSKRLPQKPSNAQKLGDLGIPVLKDTADILRWLGVDLKSLLPLANPERRVRPGKSNYVEWTVKKRRAGLRVICSPKPRLKAIQRKIKAEILDRAPVHMAAHGFVRTRSIATNAAGHVGRKLVVNLDLRNFFEHIRIQQVYGVFRHLGYGSEVSRWLARLCTHAPQLGEASRGLDGQWEMQRIRRHAVQGAPTSPALANLACLRLDRRLTGLAKKFDAEYTRYADDLTFSGDERFKRGMKRFLDHLHMIIRLEGFSENYVKRRFMRSGQRQQVTGVVVNQRVNVARDEYDRLKAIIHNARKTGLDAQNRDHRPDFRAYLLGRAAHVAQLNPERGRKLVEAIRAVS

SEQ ID NO: 5939 - protein, 415 aa, unidentified
  source 1..415: note = Phycisphaerae bacterium; note = Related to JAFGQA010000434.1
MSYWAWGILVVVAIVVIFIARVTQRKLPSGFWRPGYSCGFAPGAWKRCDKREGADAGFPRAKDAERLKPLPGFKKHRQAPADRGRLVASGLPVLESTDDVLAWLGLDLRSFLALADPGDRIRPGKTNYVEWTVPKKRHGVRIICSPKPRLKAVQHRIKDEILDHIVPHEAAHGFVIGRSIVTNAEQHVGRALIVNLDLRNFFDYVRYHRVIGVFRWLGYSLQASRSLALLCTHRPNLSALHEDPPEAYVRHVFRHAVQGAPTSPALANLTVYRLDRRVAGLARTFDARYTRYADDLTFSGDEPFKRGMIRFLSLAKQIIAEEGFRLNMRKMRFMRPSQRQQVTGVIVNKKVNVRREDYDQLKAIVHNARKIGSLESQNRENHPDFRAHLLGRAAHIRQLNAARGQSLIDRIHAIA

SEQ ID NO: 5940 - protein, 440 aa, unidentified
  source 1..440: note = Related to JAHLLQ010000003.1; note = unidentified bacterium
MMPALQIGAVAIIGLLVAVFAIVVVLIIVVNIVNQARRGGPGGARLELGTDGLRVSVGGRSRGKILGSRAPIVLGNSPTSSYRERDDKMRQLHPQSIDRQRSLRLPVLEKPDDIVAFLQLRDFRELVHLCDTGRMQGLRNGPGKLRNYTMRTIPKRGGGQRFLFIPKPRLKAAQRRILHEILDKVPVHEAAKGFVRGRDATDHARPHIGKPIIVAHDIADFFPSIRYRRVCSFFMWLGYPHSVARILSLLCTTASLASLARVLPQGAPTSPALANALCYRLDCRLAGLAKKFGATYTRYADDLAFSGGEDFKRGLNRFVPLVETILKSERFHPKKAKRRFMRRGRQQNLVGLNVNDRLSVGRAEIDRLCAILHNASKAGSLESQNRDRIQNFADHLGGRIAWVERFHPGKGAKLRSQWRQLIGAPPAPPPPDLPAAPPPE

SEQ ID NO: 5941 - protein, 436 aa, unidentified
  source 1..436: note = Candidatus Poribacteria bacterium; note = Related to JACRIS010000205.1
MLLLVGILVLAVVAAILIAAAAVKSGGSPQTPHPAQAGGRAPGAVPEASGNRFAAPPGANFTGPFDKKKWLINPDWREADPKAASRYPRAEDRRRQWSLPILDNPEDVVRFLDLGGFGVLVNLCDPNLWSSAAGHSVPNPAANYRFRSIPKRGGGVRFIAAPKPRLKAAQRRILREILDKVPVHDAATAFRPRRSVADHARPHVGRQLILAYDLQDFFPRIRHGRVAGLFRWLGYPASVARCLALLCTCSDSMAVSTQARHLPQGAPTSPAIANLLCFRLDCRLTGLAKKFGASYTRYADDLAFSGDNEFKRGITRFIPLAEKIIRNEGFVLNKQKRRFMRHGRCQRLTGLKVNDSLSVGREESDLVKAILHNAKKAGSLESQNRQQRGDFEAHLRGRISWISQFHPARGAKLLAELDKVTGFQRRAGPPAITPPD

SEQ ID NO: 5942 - protein, 509 aa, unidentified
  source 1..509: note = Related to OCMT01000001.1; note = Pedobacter xixiisoli
MSEKLSRQQIYDRIRATSKDSYVLEEMQRLGFWESSDTPSLSEVLIKREVAANQELNNLLAQDRKYQNQEAMLKEMRKARMKLAKEKREQTKQKNKQKKDDKAEAWKDTQQQQIVYLGEGVSGGLNEIESAIESLQRFNLPVFENLSDFASALGTDLSALRYLLYQRKVSRINHYHAFQIPKKSGGKRTITAPKQKLKRLQLWVLENVLNRIQINHHVHGFIKERSIVSNARPHLQKDIVINVDLKDFFPSISYKRVKGFFHKLGYSEQLSTIFALICTYAETEKVEMDGVNYYVQKGNRFLPQGSPASPAISNLIAYKLDKKIQGLAAKFNFTYTRYADDLTFSTSKENEKNIASLLFFLKKIIEVEGFAIHPAKTHIMRKGNLQKVTGIVVNQKLNVQRVQLRKFRALLHQIEKEGWKDQKWGNAKYLINAIEGYINFVKMVNESKAMVFKAQLTSILAKHGHPPVEQAVVEEESKIIAEEKATEVKIETPLKTDTEAKQYDWWNVL

SEQ ID NO: 5943 - protein, 509 aa, unidentified
  source 1..509: note = Related to NZ_CP042171.1; note = Pedobacter sp.
MSEKLSRQQIYDRIRATSKESYILEEMQRLGFWESSDTPGLPEVLIHRELVANQELNNLLAQDRKYQNQEAMLKEMRKARMKLAKEKREKTRQKNKQKKEDQAANWANIQQQQIIYLGDGVSGGLNQTESDVETLQKFNLPVFNQIVDFASAIGVDLSTLRYLLYQRKVSRINHYHTFEIPKKTGGKRLISAPKSRLKALQLWVLENILNHIEINDHVHGFIKERSIISNAQPHLEKDIVINVDLKDFFPSISYKRVKGLFNKLGYSEQLATVFGLICTYAETEHVEMDGVSYYVQKGNRVLPQGSPASPAISNLIAFKLDKKIKGLASKFNFIYTRYADDLSFSTSKENEKNIASLLFFLKKIIEAEGFTMHPEKTHIMRKGNLQKVTGIVVNEKLNVQRDRLRKFRALLHNIESNGWKDQKWGNAKNLINAVEGYINFVKMVNKSKAAAFKAQLENIVAKHGYPVIVEEVVEVKTETIVAEIVPEVKLENPIKPSSDAKQYDWWNIL

SEQ ID NO: 5944 - protein, 508 aa, unidentified
  source 1..508: note = Related to NZ_SJCY01000003.1; note = Pedobacter changchengzhani
MEEKLSRQQIYDRIRSTSKESYILEEMQRLGFWESSETPSLSELLIKQETTATQELTKLLEQDKKYNDREAMVKEMRKARMKLAKEKRSETKNRNKEKSIDKAQKWKETQERQIIYLGEGVSAGLNHTESDKLNLQKLNLPAFDQVTDLASAIGLSLAELRYLLYQRKVSKINHYHTFEIPKKSGGKRVISAPKSRLKALQLWVLEHVLNNISINDVAHGFIKNRSIVTNATPHLATDIVINVDLKDFFPTINYKRVKGLFHKFGYSEQLATLFALICTYAETEVVEMDGVSYYVQKGNRFLPQGSPASPAISNLIAYRLDKKIQGLASKFNFTYTRYADDLSFSTSNENEKNIASLLFFVKKLIEAEGFTLHPEKTHIMRKGALQKVTGIVVNEKLNIQRSQLQKFRALLHNIETNGWKNQKWGKAKNLINAIEGYINFISMVNAEKGAKFKLQLKDIVAKFGYPIVEQETAEVKIETAKQEIVEPPKSKLETPETASKQFDWWNIL

SEQ ID NO: 5945 - protein, 520 aa, unidentified
  source 1..520: note = Related to QVMJ01000008.1; note = Bacteroides sp.
MSEKSTRQQIYDRIRMTSKDSYILEEMKRLGFWDSSDVPSLSETLIKRESEVNKELTSLLEKDRKYRNQEALLREMRKERMKKAKEKREETKLRNKKKRLDKAAKWKSMQEHQVIYLGKDVSAGLNNTETNEALLNKNNLPVFKSLTDLGQSMQLELSNLRYLLFQRKVSRQTHYYNFEIPKKSGGKRKISAPKRRMKALQLWVLNNILDRIAIGEQAHGFIKQRSIVTNAGPHTGKDIVINIDLKDFFPSIDYKRVKGLFHKLGYSEQMATIFALICTQAETETVAMDGVTYYVQKGKRILPQGSPASPAISNLIAYKLDKKVKGLADKLGFRYTRYADDLSFSTDKGNEKNIASLLHFVGKIIKSEGLTINPEKTHIMRSGAQQKVTGIVVNEKLNVERKQLHNFRALLHNIETNGWNGQKWGRADNVMHSIEGYIHFIKMVNPEKSIRFGEQLTRIVEKHGLPLVEEKTCTKQDIAPKQVVQVEEPLKPEPTIQPGQKQEDSNKKTSSTDDWWNIFS

SEQ ID NO: 5946 - protein, 512 aa, unidentified
  source 1..512: note = Related to JAJQFD010000060.1; note = Bacteroides sp.
MSERSTRQQIYDRIRAAFTKDSYILEEMKRLGFWDSNVDAPTLPERLIQREAEINQELNKLLAQDRKFRNQEAMLAEMRKARMKQAREKRVLTLEKNKQKRLDRAARWRSLQQEQIIYLGKGVSAGLNNTDTNVQSLQKYNLPVFSSLTELANSMNLDLAKLRYLIFQRQVSRHTHYHTFEIPKKSGGKRKISAPKRQMKALQRWILDTILSPISMDEHAHGFIKNRSILTNAQPHTGKEIVINVDLKDFFPSIDFKRVKGLFHKLGYSEQMAIIFALICTQAETETVEMDGVRYYVQRGKRILPQGSPASPAISNLVAYKLDKKVNGLAEKLGFTYTRYADDLSFSTFRRNEKNVARLLHFLGKIIESEGLVMHPDKTQVMRNGGLQKVTGIVVNEKLNVQREQLRKFRALLHNIEVNGWKDQRWGHAHNLIHSIEGYIQFVKMVNPRKGDKFRKQLDQIIKKHGCPPIDETTFYKKTVETSQPSQPITSQTIEPEKHATPKGNDWWNIFS

SEQ ID NO: 5947 - protein, 506 aa, unidentified
  source 1..506: note = Related to NZ_CP034930.1; note = Apibacter raozihei
MSEKLTKQQIYDRIRATSKDSYILEEMQRLGFWEKADSPQIPEIFIENETRLLQELNQLLDKNKQYSDQLSMLKSMRKVRMKNAKEKREVTRQNNKLKALEKAERWLKLQQEQVLFLGKEVSKGLNNTEPNVNSLKKFNLPVFHSVVEFAGYMETDLPSLRYLLYQRKVSTINHYHTFELPKKSGGKRKISAPKSRIKALQLQVLDKILKNIPVNDYVHGFIQGKSIVSNAQPHVNKDIVINMDLKDFFPSIEYKRVKGLFYKLGYSEQISTMLALVCTQSDTYEVNMDGVTYHVQKGARFLPQGSPASPAISNLIAYKLDKRIKGLAERLNFTYTRYADDLSFSTTNENQKNIRQLLFFVNQIVVEEGFKVHPEKTHIMRKGNLQMVTGIVVNRKLNIERKKLRNFRALLHNLNLNGWKDQKWGNAVHLIHAVEGYIRFVKMVNPEKGKEFAEKLATIIKKQGYPEISCQKYNSNDTTEKTTASITKPETNQKEENDSQDWWDIF

SEQ ID NO: 5948 - protein, 504 aa, Flavobacterium sp.
  source 1..504: note = Related to PRDM01000004.1
MSEKLSKQQIYDRIKATSKDSYILEEMQRLGFWQSGGQPTLSEILIKQEAAIEKELNELLAQDRKFSNREAMVLEMRKARMKAAKEKRVETKLKREQKRLDKAENWKLLQEKQILYLGEEVSKGLHYKEAAVNLLEKYNLPVFEDALALAKSMNIDLKALQYLAYNRKVSKINHYHTFELEKKSGGKRKISAPKPKLKEIQTWILENILHQIPYTIEAHGFVKERSIVTNAQPHVNKDIVVNVDLKDFFPTITYKRVKGLFCKLGYSEEVATILSLLCTYSEINETTLDGVTYYVQSGERKLPQGSPASPAISNLIVYKLDKKINGLAQKLNCSYTRYADDMSFSTTQENSSNISKLLYFTKKIIASEGFIVHPEKIHVMRKGMQQKVTGIVVNNKLNIDRNQLRKFRALLHNIEKNGWKDQKWGKAVHVINAIEGYINYVNMVNPEKGTLFKENLKNIIKLHGLPHIEKIIIPEKVTPIAVSLPEEKEETTVKQQSENWWNIF

SEQ ID NO: 5949 - protein, 504 aa, Flavobacterium sp.
  source 1..504: note = Related to NZ_QJHK01000001.1; note = Flavobacterium cheongpyeongense
MSEQLSKQQIYDRIRATSKDSYILEEMQRLGFWQSGAEPTLSEILIKQEAKIEKELNDLLAQDRKYSNRESMILEMRKARMKAAKEKRAETKLNNEKKRREKAENWQLLQQQQILYLGEEVSKGLYYKESNLTLLEKYKLPFYKDALALAKSMQIDLKALQYLAYNRKVSKINHYHTFELEKKSGGKRKISAPKPKLKEIQNWILENILQKIPYTTEAHGFIKERSIVTNAQPHINKDIVVNIDLKDFFPTVTYKRVKGLFHKMGYSEEVAVILGLLCTHSEINETILDGVTYYVQSGERKLPQGSPASPAISNLIVYKMDKKINGLAKKLNFNYTRYADDMSFSTTQENSKNVSRLLYFTKKIIETEGFVIHPDKIHVMRKGIQQKVTGIVVNKKPNIDRNQLRKFRALLHNIEKNGWKDQKWGKAIHVINAIEGYINYVRMVNPEKGIVFRQNLKDIIKQHGLPYVEKISIPEKITPIVIPVPDETKEIPIEKKPENWWDIF

SEQ ID NO: 5950 - protein, 505 aa, Flavobacterium sp.
  source 1..505: note = Related to NZ_JASY01000021.1; note = Flavobacterium chungangense
MSEQLSKQQIYDRIRATSKDSYILEEMQRLGFWQSATEPTLSEILINQEAKIEQELNELLARDRKFSNREAMVLEMRKARMKAAKEKRGETKLNQEKKRLEKAENWKQLQEKQILYLGETVSKGLNSKETDSKILEKYNLPVFEDLLALAKSMQLDLKALQYLAYNRKVSKISHYHTFEVEKKSGGKRKISAPKSKLKEIQTWILENILHKIPHTIEAHGFIKERSIVTNAQPHINKDIVVNIDLKDFFPTVTYKRVKGLFHKIGYSEQIATVLSLLCTYSEMNETSLDGITYYVQSGERKLPQGSPASPAISNMIVYKLDKKINGLAKKLNFSYTRYADDMTFSANEKNSKNVSRLLYYTKKIIESEGFVIHPNKIHIMRKGMQQKVTGVVVNKKLNIDRNELRKFRALLHNIEKNGWQDQKWGKAIRVINAIEGYINYVYMVNPEKGTTLKQNLKNIITKHGQPTITKLSIPEQTVPIPASVPEKKKETIVPDEKPGNWWNIF

SEQ ID NO: 5951 - protein, 504 aa, Flavobacterium sp.
  source 1..504: note = Related to NZ_CP091285.1; note = Flavobacterium jumunjinense
MSEKLSKQQIYDRIKATSKDSYILEEMQRLGFWQSGAEPSLSEILIQQETTIQKELNALLAQDKKFQNKEAMLVEMRKARMKAAKERRVETLQKREQLKIEKAQKWKLTQEKEIIYLGDQVSKGLNIQETNAALLDNYNLPVFEDVLALAQSMQIDLKALQYLAYHRSVSKIHHYHTFEVSKKSGGKRKISTPKPKLKELQNWILENILHKIPHTDEAHGFIKKRSIVTNAKPHLEKDIVINIDLKDFFPTITHKRVKGLFHKMGYSEQIATILSLLCTYSEVDEIDLDGVTYYVQSGERKLPQGAPTSPAISNMIVYKMDKKISGLAKKLNFTYTRYADDMTFSTSNENALNVSRLLYFIKKIITSEGFIIHPDKIHIMRNGMQKKVTGVVVNKKLNVDRLQLRKFRAVLHNINQNGWKDQQWGKAIHLINAVEGYINYVAMVNPEKGAQFKKSLVAIISKHGKPEIEKPTPIEKEKLIVPPVLEEPKTIVEDQKPGNWWNIF

SEQ ID NO: 5952 - protein, 337 aa, unidentified
  source 1..337: note = Related to DQAM01000521.1; note = Dysgonomonas sp.
MSGNLTRQQIYDRIRAASKDSYILEEMQRLGFWDNSDVPTLSETLIRREVEVNKELNELLAKDRKFRNQEAMLSEMRRERMKKAKEKREQTKQKNKQIRLDKAARWKKAQLEQILYLGKGVSEGLNNTDYDAELLQKYNLPVFDSVKALAENMGVELASLRYLLYQRRVSKNTHYYTFEIPKKSGGKRKISAPKHRMKELQMWVLQNVLDNIPHCDTSHGFIREKSILTNAEPHVGKDIVINVDLKDFFPTISYKRVKGLFRNFGYSEQTAIIFALICTQAETETVEMDGVTYYVQKGERFLPQGSPASPAISNIIAYKLDKKVQGLAKKFGFTYTR

SEQ ID NO: 5953 - protein, 463 aa, unidentified
  source 1..463: note = Related to JAFKHH010000015.1; note = Filimonas sp.
MIKKEASLSQELNTLVAKDRKFSNQEAMLKEMRKARMKLAKEKREQTKQKNKQKKLDKATSWQQTQLENIIYLGPGVSAGLNNTVSDSTILQQFGLPVFPNIPSLANAMQVDLATLRYLLYQRKVSRTNHYHVFEVPKKSGGKRRISAPKKQLKKLQLWVLNNVLCHLPNETVAHGFIRQRSIVTNAAPHVGKDIIVNVDLKDFFPTITYARVKGVFKKLGYSEQQAIIFALICTQAETEEVEMDGVKYYVQNGKRCLPQGSPASPAISNIIAYKLDKKIQGLAAKLNFAYTRYADDLTFSTTNDNAKQITKLLYLIKKIVTAEGFEVHPGKTHIMRKGGQQKVTGIVVNKQLNVERSQLRKFRALLHNLQMNGWKDQQWGNAKHLVNAVEGYINFVNMVNPVKAKLYKTQLEKIVATHGYPLVDNTMPKPTVTTVVAEVKETLIPTVAKEKSADKTDWWSVF

SEQ ID NO: 5954 - protein, 510 aa, unidentified
  source 1..510: note = Related to NZ_OEPV01000013.1; note = Dysgonomonas sp.
MTLKLTRQQIYLRIKSSSKDSYVLEEMKRLGFWDKEQPTLPENLIKRETEINKELTELQKLDKKFKNQEALLAEMRKDRMKKAKEKRLQTKEANKKKRLEKAANWKLLQENQIIYLGKDVSYGLDNTKSDVESLTKYKLPIYKNILHLAQSMEISLSEIRYLLYHRKVSKKTHYHTFSIPKKSGGTRIISAPKSKLKRLQYWVLHNILEVIPPGEHAHGFIAGKSIQTNALPHVGKDVVINIDLQNFFPTITFKRIKGLFSKLGYSEQLATIFALICTETPCDKVQMDGVDYYVQNSERVLPQGSPASPAISNLIAWRLDKKIQGLASKYDFTYTRYADDLTFSAAAKAEKNIAGLLYFLEKIIRSEGLTINPEKTSIMRKGRQQRVTGIVVNEKLNIPRDNYRRFRALLHNIEANGWKDQHWSHSKNLPLSVKGYISFVKMINPDKGLKFEEQLTRIISKHGFPEMEVKKTISSIQEQNQSIELEKPIQEVKSSKEDKQTEDNNWWNIL

SEQ ID NO: 5955 - protein, 504 aa, unidentified
  source 1..504: note = Related to JAKVIP010000001.1; note = Chryseobacterium sp.
MSQNLSRQQIYDRIKESSKDSYILEEMKRLGFWQETSTPSLPEQLIKREAVLQQELQELLAKDRKYGNQEAMLREMRKQRMQEAKAKREITKQKSEKKQQEKADYWKNLQQQQIIYLGENVSKGLHKSDSDTAKLLQFSLPVFENVLDFSQKSGFSLSVIKYLAFHRNVSKKSHYHVFEIPKKSGGKRKISAPKPQLRYLQHWILENILNKIPVGEMVHGFAIEKSIVTNAEPHLKKDIVINIDLQDFFPSISYKRVKGLFSKLGYSEQLSTIFALVCTQAHTEEVLLDNVKYFVHKGERFLPQGSPASPAISNIITYKLDKRLQGLSKKYGFTYTRYADDLTFSAAQDNEHNINTLLYFVKQVINHEDFTIHPDKLHIMKRKHQQKVTGIVVNEKLNVERKKLRKFRALLHNIEVNGWQNQTWGKAFHLINAIEGYINFVNMVNPPKALAFKEKLNTIIAKHGKPVVEIRKTAPEIAETIKVSEDQEEIITPAEEKTDWWNIF

SEQ ID NO: 5956 - protein, 504 aa, unidentified
  source 1..504: note = Related to NZ_FQUT01000024.1; note = Chryseobacterium arachidis
MSQNLSRQQIYDRIKASSKDSYILEEMKRLGFWQETSTPSLPEQLIQKEVVLQKELQELLAKDRKYGNQEAMLREMRKKRMQEAKAKREVTKQKNEQKRKDKADHWKKLQQEQIIYVGEDVSKGLHCTDSDVEKLLEFSLPAFESISDFSQKSGFGLPLIKYLAFHRKVSNKTHYHIFEIPKKSGGKRRISAPKPQLRYFQQWILENILNKISVGEVVHGFTAKKSIVTNAELHLGKDIIINIDLQDFFPSISYRRVKGLFSKFGYSEQLSTIFALVCTQAHTEEILLDDVKYFVHKGERFLPQGSPASPAISNIIAYKLDKRLKGLAQKLGFTYTRYADDLTFSANQDKEQNINKLLYFVKQIINDENFTIHPDKLHIMRGRHQQKVTGIVVNEKLNVERKKLRKFRALLHNIEVNGWQNQTWGKAFHLINAVEGYINFVNMVNPVKALVFREKLNTIIAKHGKPIVEVKEVVQEIVETVAVTEIQEEMLAPKEEKTDWWNIF

SEQ ID NO: 5957 - protein, 504 aa, unidentified
  source 1..504: note = Related to NZ_FTOV01000003.1; note = Chryseobacterium gambrini
MSQNLSRQQIYDRIKASSKDSYILEEMKRLGFWQETSTPSLPEQLIQKEVVLQKELQELLAKDRKYGNQEAMLREMRKKRMQEAKAKREVTRQKNEKKRQEKADHWKELQQEQIIYLGENVSKGLHQMQSDTEKLDQFSLPVFENILDFSQKSGFSLSQIRYLAFNRNVSEKSHYHTFEVSKKSGGKRKISAPKPKLKLFQQWILENILNRISVGEVVHGFTPNKSIVTNAAPHLGKDIVINIDLQDFFPSISYKRVKGLFSKFGYSEQLSTIFALICTQANTEEVLLDGVKYFVHKGERFLPQGSPASPAISNSIAYKLDKRLQGLAKKFGFAYTRYADDLTFSAGQNSEQNINRLLYFVKKIIKDENFTIHPDKLHIMRRKHQQKVTGIVVNEKLNVERTKLRKFRALLHNIEVNGWQNQTWGKAYHLINAIEGYINFVNMVNPSKASVFKEKLKTIVAKHGVPFVEVQKVIPDVVELPEVLEPEQDAVTPKEEKTDWWNIF

SEQ ID NO: 5958 - protein, 504 aa, unidentified
  source 1..504: note = Related to NZ_JPRO01000015.1; note = Chryseobacterium luteum
MSQNLSRQQIYDRIKASSKDSYILDEMKRLGFWQETSTPSVPEQLIQREAVLQQELQELLAKDRKYGNQEAMLREMRKKRMNDAKAKREITKQKSEQKRQDKADYWKNLQQQQIIYLGENVSKGLHKSDSDTEKLLQFSLPVFENVLDFSQKSGFGLSVIKYLAFHRSVSKKSHYHVFEIPKKSGGKRKISAPKPQLRHFQHWILENILNKIPVGEVVHGFTIKKSIVTNAESHLKKDIIINIDLQDFFPSISYKRVKGLFSKLGYSEQLSTIFALVCTQAHTEEVLLDDVKYFVHKGERFLPQGSPASPAISNIIAYKLDKRLQGLAAKYGFTYTRYADDLTFSAGQDNEQNINKLLYFVKQVINAEDFTIHPDKLHIMRRKHQQKVTGIVVNEKLNVERKKLRKFRALLHNIEVNGWQNQTWGKAFHLINAVEGYINFVNMVNPSKALVFKEKLSAIIAKHGKPIVEVRTTIPEIAETIKVSEDKEEIIAPKEEKTDWWNIF

SEQ ID NO: 5959 - protein, 504 aa, Flavobacterium sp.
  source 1..504: note = Related to NZ_PJQW01000010.1
MSEQLTRQQLYDRIKSSSKDSYILEEMKRLGFWKSKGQPTLEETLIEKEASLQQELSTLVAKERKFQNQELLLKEIHKQRMQKAKAKREETKEKRAKEKQEKAARWEALRTTEIIYLGEGVSKGLQPTASNGTLLAQYNLPYFDTVAQLADAMGISTKMLTYWAYHRPVSLTSHYYTFEIAKKSGGKRKIAAPKKGLKKLQNWILTSILSKIALQDEVHGFTSKRSIVSNAQPHIGKAVVVNIDLKDFFPSVHYKRVKGLFSTLGYSEQIASILALLCTQAETKQVTLDNVLYYVQQGNRVLPQGSPASPAISNLIAYKLDKRMKGLAKRYGFTYTRYADDLTFSSHTATDKDIAALLHFAKKISTSEDFTVHPDKVHVMKQSRQQKVTGVVVNEKPNIDRNRLRQFRALLHQIKNKGWQDKQWGKSNNVYAAIEGYILFVHMVAPEKALVFRKQLEDIVAIHGTPPPTEVQPVPQPVTEEKTIVPENNSKANEEDTTNWWTTF

SEQ ID NO: 5960 - protein, 501 aa, Flavobacterium sp.
  source 1..501: note = Related to NZ_CP090145.1; note = Flavobacterium sediminilitoris
MSEQLTRQQLYDRIKESSKDGYILEEMKRLGFWKSQGEPTLEETLIQREANLNKELTALVAKERKFQNQEMLLKEIHKQRMQKAKAKREETKQKREQKKQDQAARWQEIQEKEIIYLGDDVSKGLQQTESNKDLLLQNNLPFFENVLHLAESIGTSTKKLTYWCYHRKVSTNSHYYTFEIPKKSGGKRKISAPKTGLKNLQKWLLDTLLSKITMAEEVHGFTANRSIVSNAKSHIGKEVVINIDLKDFFPSIHFKRVKGLFKALGYSEQIASIFALISTQAETKEVLLDGVKYYVQSGNRILPQGSPASPAISNLIAYKLDKRLKGLAQRYGFTYTRYADDLTFSSEENNAKNSAALLYFAKKIITSEDFTVHPDKIHLMKKSRQQKVTGIVVNEKPNIDRNRLRQFRALLHNISCNGWKDQKWGKAKNIYNAIDGYILFIHMVQPEKAIVFRKKLEEIVVKHGKPITKCSTPLPVETQKKEETLSEKENSSSPSNWWSNF

SEQ ID NO: 5961 - protein, 503 aa, unidentified
  source 1..503: note = Related to JAIBAX010000003.1; note = Chitinophagales bacterium
MSKVLSRQEIYDRIRNSSKDYYILEEMKRLGFWKESSVPTVAESLIQREALLNKELQELIAKDKKYQNQELMLREMRKKRMKEAKEKREETKQKNERARIERSEKWKKIHAAQIIYLGDDYSAGLNNSAPINSINALLPTFSDVQDLAAKMGIDLSTLRFLSFHRKVSKNCHYHSYEIKKKSGGTRNISVPKGKLKKAQHWVLQNILNKIEINDSAHGFIKGKSIVTNAQQHVNKAVIINLDLKDFFPTIHYKRVKGLFIKLGYPEQLAIIFSLLCTHAHTEEVFLDGIRYYVQNGERFLPQGSPASPAISNLICYKLDKRLDGLAKKYGAVYSRYADDITFSLDDNENISKLLFYAHKIIEGEDLQINKAKTHIMRKNAQQKVTGIVVNQQPTVERRILRKFRALLHNILKNGWQEQKWGNGSNLLHSIEGYINYIHMVHPTKAQSYRVSLKTILEKHGTPEIKVNIPINIVPPPQIASTEEDPKDSAPEQKKEETDWWNLF

SEQ ID NO: 5962 - protein, 503 aa, Flavobacterium sp.
  source 1..503: note = Related to NC_016001.1; note = Flavobacterium branchiophilum
MALTRQQIYDRIKSSSKDSYILEEMKRIGFWENSEIPSVPEQLIAEETALQKTLNQLLAQDKKYSDQEAMLRAMRKQRMQESKQKRDINKQKRAQKIIEKSEKWQQVNQKQMIYLGESVSKGLQNEQQNPILLSKFNLDFFENSYDFSVQSGFDLPTLKYLAYNRKVSKSTHYHVFEIPKKSGGTRKITAPKTKLKAFQLWILEHILNKIVVAPMVHGFVQNRSIVSNANQHVQKNVVLNLDLKDFFPSISYKRVKGLFRIFGYSESMATLLALACTTCDIEKIQIDGETYYVQKGPRYLPQGSPASPAISNLIAYKLDKRLHGLASKYGFTYTRYADDLTFSGNEEAAQYMGKFLCFVKKTIKSEDFEVNNDKTSIMRPSNQQKVTGIVVNKKLNIDRKRLRQFRALLHNIDQNGWQNQTWGKAIHLINAVEGYIQFVKMVDAAKGAKFHQTLLNIIAKHGRPIIESKIMQVSKAAIPEAPIVEKTISKATTDKQTDWWNLF

SEQ ID NO: 5963 - protein, 487 aa, unidentified
  source 1..487: note = Tannerellaceae bacterium; note = Related to JAJQES010000108.1
MGERATRENTPGRSVPVEKQPLEEMKRLGFWEQPLPAFPEELNQREDDLARELNELLAKTGKENKEKGEMLLRQRARQKKLEKAARRKLARPETIPYLGEEVSTGLRETETNTALLQKYNLPVCTSFRELGEQMNCDLPTLQYLLYNRKVTSSTHYYTFKFPKKSGEMRTISAPKQKLKRLQYWVTENILNRLPVCDQVHGFAKERSILTNASPHLGKDIVVNLDLKDFFPSISYKRVKGLFRKFGYSEQLSILLALICTEAQTRQVELNGQTWYVQTNRRSLPQGSPASPAISNLIAYTLDKRLEGVAKKYNFTYTRYADDLTFSAYKEQERNITKLLYFIRKVIREERFTVHPEKTQIMRKNRQQRVTGIVVNQRPNIDRQQLRRFRALLHHIEVNGWQQQQWGHPSGYLPHSIEGYINFIRMVHPHKAKKFEEQLMKIVFKHGYPAGPASSPETRIDKSGEKKEPDSPSTSSFEVDWWGLPLTT

SEQ ID NO: 5964 - protein, 499 aa, unidentified
  source 1..499: note = Related to LJIE01000001.1; note = bacterium 336/3
MAEQLTRQQLYDRIRETSKDAYILEEMKRLGFWENSSQPTLSEALIQREATLQKELNELLDKQRKYNSREQLLRDMRKQKLKLSKEKQAETKKRQEEKRQLKAQKWVESKQKEIVYLGESVSGGLNEKTSNQALLAKYQLSDFASVLGLAEAMKVSLAQLRFLAFHRAVSKTSHYHFYSVPKKSGGKRLISAPKPLLKKCQHWILESILYKITPSEHVHGFVPKKSIVTNAKPHLQKDIVVNLDLKDFFPSISYKRVKGLFVNLGYSEQLATVLALISTHYEMDKVNVDGDVYYVQKGERVLPQGSPASPAITTLIAYTMDRRLQGLAKKLGFTYTRYADDLTFSTDASNEGNIATLLYFTKQVVEDEGFTVHPDKTHVMRKGSQQKVTGVVVNDKLGVDRTILRKFRAFLHQVSQFGWGKNKWGNGDNPRQSALAFASFVMMVDKEKGTKLMNQIKAIADSSVVTEKKKTVSQEPQKQVPEEKTNTSTPASQDWWDIF

SEQ ID NO: 5965 - protein, 532 aa, unidentified
  source 1..532: note = Related to NC_018018.1; note = Bernardetia litoralis
MSMTRQELYDRIRTTSKEAYILEEMKRLGFWGDSEKPTLAEELINKQARLQKELSELNQKQRQYNSREAMLKEVRLERMKASKEKQKETKARNEEKVRLKAEKWAETQKTNIIYLGQEVSEGLNNTTSDKEKLEKLKLPYFENIVEFSEKINKPISELRFLAFQRSVSKVNQYHNYYVPKKSGGKRLISAPKPKLKHTQNWIKTNVLDKIEINENVHGFVKERSILTNAEPHQNKNLVISLDLKDFFPSISYKRVKGLFLKFGYSEQLSTLFGLLTTHNETDKLNVDGEIYYAQKVDKETGKTNRFLPQGSPASPAITTLIAYKMDKRLEGLAKKMGFTYTRYADDLTFSSDLDLKKDTKATNKIIGSLLYFVKKVVTSEGFEIHPDKTHIMRKGNQQKVTGIIVNQNTENKLGIDRQTLRKFRAFLHQTAKTGWKVDKNAKDKKWGIHPDPKQAALGFASFIKMVDAEKGEKFIQKIKSIPTAEDYLQTDDTTLVSQKTEEKTLKQVETKSKESEQEIEKQSDESDWWDIF

SEQ ID NO: 5966 - protein, 511 aa, unidentified
  source 1..511: note = Related to NZ_AUMD01000019.1; note = Eisenibacter elegans
MSQHPTRQQLYDRIRASSKDSVILAEMKRLGFWEDSPQPTLPETLIAREATLQKELNDLLTTERRFQNSEQVLVDMRKDRMRKSKEKQAENKARRLEERRQKAEQWQQTKTQDIIYLGEGVSAGLQAAPSDLERLQSLGLPIFENVLDLAQQMGIPLPKLRFLAFERKIAKVCHYSYFQLPKKSGGLRRIAAPKPLLKQAQQWIMTHILYQIPNKDCVHGFVPERSILSNAQPHLGQEVVINLDLKDFFPSISYARVKGLFVKLGYSEQLATILALLCTHAETKAVTVDGEQFFVQEGERRLVQGSPASPALSNLIAHKLDKRLEGLAAKYGFTYTRYADDLTFSAPKADEPAISALLAYVKRVVREEGFALHPDKTHLMRKGAQHKVTGVVVNEKPSVDRKQLHKFRALLHQIDQTGWEGKQWGNTPNIVHSVQGYANFVAMVNPEKGQKFVAMVKALIAKHPAPPLVLRYTPAPEQPPADETHSTQPAAPTSPASPQKPESDWWDVLDL

SEQ ID NO: 5967 - protein, 504 aa, unidentified
  source 1..504: note = Related to RDZE01000015.1; note = Cytophagales bacterium
MSTQLTRQQLYDRIRTTSKDQFVLEEMQRLGFWEKKEQPTLSETLIKREADLQKELNELLTKQNKYNKREAMLLEMRKAKMKASKEKQAATKLRNEQKRKDKAKKWQESQQNDIVYLGEGVSAALIQKENNLENLQKYELPLFENMLQLAEAMQIPLSKLRFLAYHRKVSKITHYNHFTIPKKSGGLRTISAPMPDLKKVQQWILEHILYKIKPKAQVHGFVPERSILSNATPHIGKDIVINLDLKDFFPSISYKRVKGLFVKLGYSEQIALTLALLCTYHETEKLNVDNEIYYLHKGERYLPQGSPASPAITTLIAHKMDSRLQGLATKYGFTYTRYADDLTFSANKDAEENINKMLLFVKKVIESEDFELHPDKTKIMRKGSQQKVTGIVVNQKPNVDRQQFRKFRALLHQIEQTGWENKKWGNKDAHIVYAVKGFAEFVHMINPTKGEQLKKKIAEILTKYPATVPAKPQKEVASQTKEETPNIQTNTNIQPTEWWDIFEN

SEQ ID NO: 5968 - protein, 459 aa, unidentified
  source 1..459: note = Related to JAAAKT010000013.1; note = Emticicia sp.
MANQPSREDIRKRVAESTKDAVILEEMKRFGFWKEEFSPELEDILQKQKETETELNTLVRKQTRYRNPETLRKEMLKERMKASKQKRQEAKERKEQKRLARAETWKKRKETEVLYLGEDVSSRLSETEPNLEFLAKWNLPNIENPLALANALSLELSQLRFLTYNRKVSLVNHYKRFYIPKKMGGKRLISAPMPLIKSAQLWILNNILYLIPHTDQAHGFIPQRSIVSNAAQHVGKELVLNLDLKDFFPSISFSRVKGLFQSFGYSGQISTLLALLCTEAEVEQVAIDGKKYFVSIGERTLPQGSPCSPAISNLIAYKLDRRLQGIANKWGFVYTRYADDLSFSCGSDNLDNFQQLLWSVQEVVKSEGFTVHPEKIHIMRKGSRQEVTGLIVNRQIGIERKELHRFRALLQQIEKNGPAGKTWNGNPNLENSMRGYASFVMMVKPELGIRFMKKIDSIF

SEQ ID NO: 5969 - protein, 506 aa, unidentified
  source 1..506: note = Related to JAFMYU010000001.1; note = Fibrella aquatilis
MTRQEIYNRIQELGSKQSYIAAEMTRLGFWNQGGEPTIPAELTQQATALQTELNQLMERQRRYQSRQAMLQEMRQARMAAAKQRRLETKVRREAARLARAETWKNKLATTVPYLGDEVSAGLKNTTSDPARLAYFGLPHFDSPLALAQAMSLPLSELRFLAYNRAVSTVSHYKRFYLAKKSGGKRLISAPMPRLKKAQLWVLEHILHKVQPTEFAHGFVTDRSILTNATPHVGQDVVINVDLKNFFPTIGYPRVKGLLTKLGYSEAIATILALLCTEPDTEAVQMDGKTYHVGNGERTLPQGAPTSPAITNLLAYRLDRRLQGMAARFGYAYTRYADDLTFSATGAAAGKANQVLWAVEQIVQSEGFTVHPDKVTVMRKGDQQRVTGIVVNQKPSIDRATLRQFRALLHQIGQSGWESKTWGNPNPTADIQNVVIGYANFVMMVKPDLGRQLRATIAGLISKPPTSSSASSMPTIADDLSPVSAPITTPLVPPTAPPASKDWWDVL

SEQ ID NO: 5970 - protein, 499 aa, unidentified
  source 1..499: note = Related to NC_020054.1; note = Fibrella aestuarina
MTRQEIQKRIEELGSKQQFIIAEMTRLGFWTQHGEPIPAELVAQDAALQKELSQLLDRQRRFQSRDAMLKEMRQARMAAAKQRRIETKQRREAARKARADAWQATLATDVPYLGEGTPAALANHTADPDRLRQVGLPQFESPLALARAMGLSLSELRFLAYNRAVSTVSHYKRFHLIKKSGGKRLISAPMPRLKKAQLWVLENILSKVQPTEQAHGFRAERSILTNAQPHVGKDVVINIDLKNFFPTVSYGRVKGLLAKLGYSEALATVLALLCTEPDTQALQVDGKTYYVGNGSRYLPQGAPTSPALTNLLAYRLDRRLNGLAQAFGYVYTRYADDLTFSASGSGAGKANQLIWAVEQIVQGEGFVVHPDKISVRRKGQQQRVTGIVVNQKASIDRATLRRFRALLHQIGQTGWEGKTWGNPAPEADIQQVVLGYAHFVQMVKPELGRSLVASIRALIQSRPDAALAQPVEPVPATVSSTATNSAPVARPVKEWWDVL

SEQ ID NO: 5971 - protein, 349 aa, unidentified
  source 1..349: note = Cytophagaceae bacterium; note = Related to SEBH01000648.1
HRPVSTVNHYKSFYLPKKSGGKRLISAPMPRLKKAQLWILEHLLQKITPTEQAHGFTTGRSIVSNAQPHVGQEVVINVDLKDFFPTISFPRVKGLFMALGFSEQLATLLALLCTELPTYAVSLDGRTYYVATDERRLPQGAPTSPAISNLIAYRLDRRLQGMATRFGYAYTRYADDLTFSASDTAVKQVEQVLWSVNQIVESEGFTVHPDKISVMRKGSQQRVTGVVVNDKPGVDRATLRRFRALLHQISLTGWAGKSWGGTATNHQADLRNVVMGYANFVAMVKPEQGQALREQINKLIGGTNLSVNPLLSEQPAPDNAPVVTGESTLGTLSQKPPILSQNKDWWDVL

SEQ ID NO: 5972 - protein, 495 aa, unidentified
  source 1..495: note = Related to NZ_PVTE01000003.1; note = Spirosoma oryzae
MTRQEIYDRIRGLGSKDSFVLAEMKRLGFWEPTTDMPGLPEQLIERQGQLQRELNELLEKQRRYENRKAMLAEMRKTRMAESKRKQQETKQRNEQKRQERAAQWKRQQEQTIVYLGENVSGGLQSGTANNDQLRRFGLPDFDSPLALAQAVGVTLSRLRFLAYDRPVSTVSHYKRFYLLKKSGGKRLISAPMPYLKTVQYWILEHILRKIQPTEHAHGFTIDRSIVTNAQPHTGKDVVVNLDLKNFFPSISYRRVKGLFVMIGYAETIATILALLCTEPDSDMIELDGKTYYVAKGSRVLPQGAPTSPALTNMIAYRLDHRLRGVANKFGYIYTRYADDLTFSASDEAAGRVGQLLWSIRQVIDGEGFVLHPDKLQVMRKGSQQRVTGLVVNDQLGIDRTTLRKFRALLHQIEQSGWQGKTWGKGQIQNTVLGYANFVAMVKPEQGKRLVETVKRLMLPAVESAGELPRQEPSTNGQINQPPKDTNLSTDWWDVL

SEQ ID NO: 5973 - protein, 521 aa, unidentified
  source 1..521: note = Related to JAGHZS010000007.1; note = Chitinophaga sp.
MSLTRQQLYDQIRASSKEEYILEEMTRLGFWPNNVGQPAPAVTLIRKEGELNRQLNELLAEKQKYRNKRKMLEDMRKDRMAKAKLKRAETKKRREEERVKRAAEWAATKNLQIVYLGEDVSAGLNKVTPDTAQLTRFGLPVLSDAVALANAMNITIGKLRYLSFSRKIGHHTHYQRFQVPKKSGGTRVISAPMPQLKAAQHWILENILYKIKNNDAAHGFVPGKSIVTNATPHIGQDIVINLDLKDFFPSVAYKRVKGLFCKLGYAEQVATILGLICTEPEVDEVLLDGRKYYVAKTERHLPQGAPTSPAITNLICYKLDQRFAGLANKYGYAYTRYADDMTFSAKGDAADKAGQLLRAIKMFVKEEGFTLHPEKLKVMRRGDKQEVTGIVVNEKLSLDRTTLRKFRALLHQIGHTGLSGKSWGKGKNIISSMEGYANFVYMVKPDLGAKLKSSLTALLQREDIKAEARSIWAGEQAPTTPSVAGVHINTTPQATPAAEVPPVNPSTDKPAAPDKPWWDVL

SEQ ID NO: 5974 - protein, 530 aa, unidentified
  source 1..530: note = Related to NZ_JAGTXB010000010.1; note = Chitinophaga hostae
MSLTRQQLYDQIRASSKEEYILEEMTRLGFWPKSVGQPTPAVTLIRKEGELRRSLNELIAEKQRYRNKRAMLEDMRKARMAKAKQKRAETKKRREEERVKRAAEWAAEKNLHIVYLGEGVSAGLNKVNPDTAQLEKFGLPVWADAIALANAMGITIGKLRYLSFNRKVGHHTHYQRFQIPKKSGGTRVISAPMPQLKAAQHWILENILYKIKNNEAAHGFVPGKSIVTNAAPHIGQDIVINIDLRDFFPSIEYKRVKGLFCKLGYAEQVATILALICTEPEVDELLLDGRKYYVTKTARHLPQGAPTSPAITNLICYKLDRRFAGLATKYGYAYTRYADDMTFSAKGPAAGKAGQLLRAVKMFVKEEGFTIHPDKLKIMRRGDRREVTGIVVNEKLSLDRTTLRKFRALLHQVGQTGLANKTWGKGKNIISSMEGYANFVYMVKPELGAKLKATLAALLQRADIKAEARSIWTGEALPQKESNTAISGNTETITTPVSTATNGNGAASAARGNTGTDKPAAADKPWWDVL

SEQ ID NO: 5975 - protein, 509 aa, unidentified
  source 1..509: note = Related to NZ_FOJG01000002.1; note = Chitinophaga arvensicola
MSLTRQLLYDRIRASSKEELILQEMTRLGFWAENLAQPSPAASLIQQETEVRRQLNDLINERQKYRNKRMMLEDMRKARMAKAKLKREETKQRRETARKERAAAWAITKDQQIVYLGEEVSAGLNKVVPDLVQLQKFGLPVFADANALATAMGITLGKLRYLSFNRKVGHHTHYQRFQIPKKSGGSRTISAPMPQLKAAQHWILENILYKIKNDVAAHGFVPGKSIVTNAAPHTGQDIVINIDLRDFFPSIAYKRVKGLFCKLGYAEQVATILALICTEPEVDEILLDGRKYYVAKTARHLPQGAPTSPAITNLICFKLDRRFTGLAEKYGYAYTRYADDMTFSAKGPAADKAGQLLRAVKMFVKEEGFTIHPDKLKVMRKGDKHEVTGIVVNEKLSLDRTTLRKFRALLHQVEKTGLANKSWGKGKNIISSMEGYANFVYMVKPELGAKLKATLAALLQRPDIKSEARGLWTGEVKEKKVSDTPVAPTAPVNPPPSSASSEKPWWDVL

SEQ ID NO: 5976 - protein, 535 aa, unidentified
  source 1..535: note = Related to NZ_VIWO01000002.1; note = Chitinophaga polysaccharea
MAESLTRQQLYDRIRASSKEEFILEEMIRLGFWARNTAQPSPSETLIRREGELRRELNDLLAEKQRYQNKVKMLADMRKDRMAKSKLKIAETKKRREEERKARAEAWAVAKDQQILYLGEEVSAGLNKVNPDTAQLAKFNLPVFADATALANAMGITLGKLRYLAFNRKVGHHTHYQRFQVPKKSGGTRVISAPMPQLKAAQHWILEHILYKVSHSNAAHGFVPGKSIVTNAAPHVGQDIVINIDLRDFFPSIAYKRVKGLFCKLGYAEQVATILALICTEPEVDEVLLDGRKYYVAKTARHLPQGAPTSPALTNLICFKLDRRFAGLAEKYGYAYTRYADDMTFSAKGAAADKAGQLLRAVKMFVKEEGFTIHPDKLQVMRKGDRHTVTGIVVNEKLSIDRTTLRKFRALLHNIEKTGLSGKRWGKGKNIISSIEGYANFVYMVKPEWGARLKEKLAALLQRPDIKAEAHAIWTGNSSQPVTTEAISASSHPAGYTSSDTTTPAATTDSSTTIPGRITPPEPPAATDKPWWDVV

SEQ ID NO: 5977 - protein, 507 aa, unidentified
  source 1..507: note = Related to NZ_FRBL01000014.1; note = Chitinophaga jiangningensis
MPEGLTRQQLYDRIRETSKEEYILEEMVRLGFWSRDTDKPSIPEALIKQEGELNRQLNQLLSERSKYRDKKRLLVEMRKQRMAQAKAKRAETKKRNEQKRIERAAAWAEKKQQDIIYLGENVSAGLNKNQSDTAQLQKYNLPVWHSATDLAAAMQLPLGKLRFLAFNRSVAHQTHYQRFAIPKKSGGTRIISAPMPQLKAAQHWILENVLYKVSNSGSANGFVPGKSIVTNAIPHVGKDLVINIDLKDFFPSVAYNRVKGLFCKLGYSEQVATILGLICTEPEVDEVLLDGRKYFVAKTARVLPQGAPTSPAITNLICYKMDRRFEGLSAKYGYAYTRYADDMTFSAKGEAAAKAGQLLWAVKKVVAEEGFVLHPDKLKVMRKGDRHEVTGIVVNQKLSIDRTTLRKFRALLHQVELTGLAGKSWGKGNIIASMEGYANFVMMVKPEQGRALKTKLAAILSRADIKAEAQAMWKNEPPAEQPAMPPANPVAPPAPEKKTDDPWWKVV

SEQ ID NO: 5978 - protein, 512 aa, unidentified
  source 1..512: note = Related to NZ_QLMA01000005.1; note = Chitinophaga dinghuensis
MPEGLTRQQLYDRIRQSSKEEFILEEMTRLGFWARDVNKPSVPETLIQQEGGLQRQLNELLQEKAKYRNKQRLLTDMRKERMAKAKAKRAETKQRNEQKRIERAAAWAEKKQQDIIYLGEAVSAGLNKNTSNEAQLQHFGLPVYHNAQQLADAMQLALGKLRFLAFNRSVATTTHYQRFQLPKKSGGVRTISAPMPQLKAAQHWILENILYKVSNSDAANGFVRGRSIVTNAQPHIGKDVVVNIDLKDFFPGIAYKRVKGLFCKLGYSEQVATILGLICTEPEVDEIILDGRKYFVAKTDRVLPQGAPTSPAITNLICFKMDRRFEGLSKKYGYAYTRYADDMTFSAKGDAAAKVGQLLWAVKKVVAEEGFVLHPDKLKVMRKGDRHEVTGIVVNEKLSIDRTTLRKFRALLHNVELTGLSGKKWGKGSIIASMEGYANFVAMVKPEQGKKLKAQLAALFSRADIKAEAQAIWKNEEQPQQDSSVSPQTPNTQDTPTPPKPSGPEKPWWKVV

SEQ ID NO: 5979 - protein, 514 aa, unidentified
  source 1..514: note = Related to VWWO01000002.1; note = Chitinophaga sp.
MPEGLTRQQLYDKIRESSKEEYILEEMVRLGFWQRDTEKPSVPEVLIKQEGALNKELNQLLQEKYRYRNKQLMLTEMRKARMARAKAKRAETKKRNEEKRIARAAAWAEQKQQDIVYLGENVSAGLNKKVSDEAQLRKFNLPVWHTAQDLANAMQLSLGKLRFLAFNRTVGHQTHYQRFQIPKKSGGTRVISAPMPQLKAAQHWILENVLYKITNSTSANGFVPGKSIVTNAIPHIGKDVVVNIDLKDFFPSIAYKRVKGMFCKLGYSEQVATILGLICTEPDVDEVMLDNRKFFVAKTERRLPQGAPTSPAITNIICFKLDRRFEGLSAKYGYAYTRYADDMTFSAKGEPAAKIGQLLWAAKKIVAEEGFVLHPDKLKVMRKGDRHEVTGIVVNEKLSLDRTTLRKFRALLHQIELTGLANKTWGKGNIISSMEGYANFVAMVKPEQGTKLKNQLNALLQRNDIKAEAQAMWKGEEVASAKPAEHLPEKENKKDNTSNNNKTPDNDKPWWNIL

SEQ ID NO: 5980 - protein, 515 aa, unidentified
  source 1..515: note = Related to NZ_PYAW01000007.1; note = Chitinophaga niastensis
MAEGLTRQQLYDRIRASSKEELILEEMTRLGFWANNTSQPSPSESLIRQEGVLRRELDELIKEKQKYRNKEKMLQDMRKERMAKAKLKRAETKKRREEERKARAIAWAAEKNQSIVYLGEDVSAGLNKVVSNTEQLAKFGLPVWHDAVALANAMGVTLGKLRYLSFNRKVGHHTHYQRFQIPKKSGGTRVISAPMPQLKAAQHWILENILYKIKNSEAAHGFVPGKSIVTNAAPHVGQDIVINIDLRDFFPSIAYKRVKGLFCKLGYSEQVATILGLICTEPEVEEITLDNRKYYVAATARHLPQGAPTSPAITNLICYKLDKRFEGLSAKYGYAYTRYADDMTFSAKGAAADKAGQLLWAIKLVVKEEGFTIHPDKLKVMRKGDKREVTGIVVNDKLSLDRVTLRKFRALLHQISTTGLSNKSWGKGKNIISSIEGYANYVYMVKPEQGAKLKATLAALLQREDIKAASRSIWTGETLAAAPVVTTVTAETPASKPIIKETPPASKDKPWWDVL

SEQ ID NO: 5981 - protein, 526 aa, unidentified
  source 1..526: note = Related to NZ_CP051205.1; note = Chitinophaga oryzae
MAEGLTRQQLYDRIRASSKEEFILEEMTRLGFWAKNTSQPSLPETLIRREGELRRELNELLAEKQKYRNKERMLADMRKERMAKAKLKRAETKKRNEEKRKARAAAWAEKKNLDITYLGEEVSAGLNKVTPDEAQLAKFGLPVFKDATALAAAMGVTLGKLRFLAFNRQVANTSHYQRFEIPKKSGGTRVISAPMPQLKAAQHWILENILYKINNSAAAHGFVPGKSIVTNAVPHVGQDIVINIDLRDFFPSVPYKRVKGLFCKLGYAEQVATILGLLCTEPEVDEILLDNRKYYVAKTERHLPQGAPTSPALTNLICFKLDRRFEGLAAKYGYAYTRYADDMTFSAKGDAADKAGQVLWAVKQVVKEEGFTIHPDKLKVMRRGDKREVTGIVVNEKISLDRETLRKFRALLHQISKTGLAGKRWGKGRNIISSMEGFANYVYMVKPEQGAKLKETLAALLQREDIKAEAHNLWTTGTTEGTAAETTTETPSAPQSSAPQHPEGVHIAKDTPTATNKPDKPWWDVL

SEQ ID NO: 5982 - protein, 525 aa, unidentified
  source 1..525: note = Related to NZ_QFFJ01000003.1; note = Chitinophaga flava
MAEGLTRQQLYDRIRASSKEEYILEEMTRLGFWAQNSSQPSLPETLIRKEGELRRELNELLAERQKYRNKEKMLADMRKERMAKAKQKRAETKKRNEEERIARAAAWAEKKQQDILYLGEEVSAGLNKVTPDEAQLTKFGLPVFKDATALANAMGITLGKLRFLAFNRKVSNSSHYQRFQIPKKSGGTRVISAPMPQLKAAQHWILENILYKIKNSDAAHGFVPGKSIVTNAAPHIGQDIVINIDLRDFFPSIPYKRVKGLFCKLGYAEQVASILGLICTEPEVDEILLDNRRYFVAKTERHLPQGAPTSPAITNLICFKLDRRFEGLAAKYGYAYTRYADDMTFSAKAAVADKAGQVLWAIKQVVKEEGFTIHPDKLKVMRKGDKREVTGIVVNEKLSLDRETLRRFRALLHQISKTGLAGKSWGKGKNIISSIEGYANYVYMVKPEQGAKLKATLTALLQREDIKAQARSLWTGEQAPAQQQAGPASQADTTKTTDTTATTQAPPASNPSSSAKTEKPWWDIL

SEQ ID NO: 5983 - protein, 517 aa, unidentified
  source 1..517: note = Related to NZ_RIAR02000001.1; note = Chitinophaga solisilvae
MAEGLTRQQLYDRIRASSKEEYILEEMTRLGFWARNTTQPSPSETLIRKEGELRRELNELLAEKQKYRNRERMLADMRKERMQKAKDKRAETKKRNEEKRREKAAAWVVQKNLNIVYLGEEVSAGLNKNVSDEAQLKKFCLPVFNDAVALANAMGITIGKLRFLAFNRKVATGTHYQRFAIPKKSGGTRVISAPMPQLKAAQHWILEHILYKIENGKAAHGFVPGKSIVTNAAPHVGQDLVINMDLRDFFPSIPYKRVKGLFCKLGYSEQVATILALICTEPEVDEVMLDNRKYYVAKTDRHLPQGAPTSPAITNLICFKLDRRFEGLAAKYGYVYTRYADDMTFSVKGDAADKAGQVIWAVKQVVKEEGFTLHPDKLKVMRKGDKREVTGIVVNEKLSIDRDTLHKFRALLHQISKTGLAGKHWGKGNIISSMEGFANYVYMVKPEQGAKLKATLATLLQREDIKAEARSIWTGEATAVAAAPADTIADTTASVTPVTPKPEGKATGAEKPWWDIL

SEQ ID NO: 5984 - protein, 478 aa, unidentified
  source 1..478: note = Related to JACMJX010000348.1; note = Chitinophagaceae bacterium
MAQGLTRQQLYDKIRLSSKDEVILQEMTRLGFWSKDSASASPSALLIEREDTLRKELTDLLKEKQKYANQEKLLAEMRAVRMEKALKKRQETKLRKEEQRKERAEEWAEQKNNSILYLGENVSAGLHKIVSDVTQLQKYGLPVWHDVNAMAAEMGLGLGEIRFLAFNRKVAHCSHYQHFYLPKKSGGKRLISAPMPRLKAVQNWILHNILYRIKNSDAAHGFVPGRSIVTNATPHVGKELVINIDLRDFFPSVAYKRVKGLFVKLGYSEQLATILGLLCTEPDVDEIVLDNRKYYVAKTERHLPQGAQSSPAITNLICYKLDKRFEGLAARHGYSYTRYADDMTFSANGEGIEKAGQLMAFVKKVIKEEGFTIHPEKLRVMRKGDKREVTGVVVNDKLSIDRETLRKFRALLHQISKTGLSQKQWGNGNIVSSLQGYANYVAMVKPGAGAKLKASINELFNRPEIKREAVSILGDKKE

SEQ ID NO: 5985 - protein, 510 aa, unidentified
  source 1..510: note = Related to NZ_CP077769.1; note = Chitinophaga sp.
MAEGLTRQQLYDRIRSSSKEEYILNEMVRLGFWAHQTATPTLPESILNRERELRKELGDLLAEKQKYRDKERLLAEMRKQRMEAAKQKRAATKQRREEERQSRAAAWTLQKAHSVVYLGEDVSAGLNKAVSDTVQLAKYGLPLFHNGEALATAMGVSLGTLRFLAFNRNVGYISHYKRFKLPKKSGGHRTISAPMPQLKAAQHWILEHILYKVPHSPAAHGFVPERSIVTNAAPHVGQDIVINIDLKDFFPSIAYKRVKGLFCKLGYSEQVATILGLLCTEPEVDEVSLDNRTYYVAKTARHLPQGAPTSPAITNLICFKLDRRFEGLAARLGYTYTRYADDMTFSTKGAAAEKPGQLIWSVKQVVKEEGFTIHPDKLKVMRKGDQRAVTGIVVNEQLSLDRATLRKFRALLHQISQTGLANKSWGKGNIISSMEGYANYVAMVKPALGAQFKQTLANLLARDDIKQAARAMWTGTPVSPVPIPAPTPTASPAKEETPPPAGDKPWWDVL

SEQ ID NO: 5986 - protein, 501 aa, unidentified
  source 1..501: note = Related to NZ_JAICCF010000004.1; note = Chitinophaga rhizophila
MAEGLTRQQLYDRIRASSKEEFILEEMTRLGFWTKNTAMPSPSEMLIRREGELRRELNKLMEEKHRYRHREQMLNEIRKQRMEAAKAKRAATKLRNEEKRKEKAAKWAIEKEKNIVYLGEEVSAGLNKVLSDEAKLRAAGLPIYHDGAALAEAMGITLGKLRFLSFDRKVATVTHYKRFYIPKKSGGRRLISAPMPQLKAAQYWILENILYKVKHSDAAHGFVPGKSIVTNAANHVGQDIVINIDLRDFFPTVAYNRVKGMFCNLGYSEQVSTILGLLCTEPEMEPVNLDGKDYHVATSARHLPQGAPCSPAITNIICYKLDRRFEGLARRFNYTYTRYADDMTFSAKEAAANDAGKLIWGVKQVVKEEGFVVHPDKLKVMRKGDKREVTGVVVNEKLSIDRETLRKFRALLHQISVSGIEGKQWGKGNIVSSIEGYINYVQMVKPEAGQQLKTKWQVLLGRTDIKSQTRASSTGQIVIPPVVPPAQDSGETGEKPWWDVM

SEQ ID NO: 5987 - protein, 501 aa, unidentified
  source 1..501: note = Related to NZ_CP048113.1; note = Chitinophaga sp.
MAEGLTRQQLYDRIRSSTKEEVILEEMTRLGFWTRNQAMPAPSEVLIRRESELRRELNKLVEEQQRYRNKEKILSDLRQQRMAAAKARRAETKLRKEEKRKERAAQWAIEKEKNIVYLGEDVSAGLNKVVSDEEKLKAAGLPVYHDGLALAAAMGITIGKLRFLSFNRKVANVSHYKRFYIPKKSGGKRLISAPMPQLKAAQYWILENILYKVKLSESAHGFVPGRSIVTNATHHVGQDIVINIDLKDFFPTIAYKRVKGLFSKFGYSEQVATILALLCTEPEVEQVALDGREYHVATTERHLPQGAPCSPAITNIICYKLDRRFEGLARRFGYAYTRYADDMTFSAKEAAGDNAGKLIWGVKQIVKEEGFVIHPDKLKVMRKGDKREVTGVVVNEKLSIDRETLRKFRALLHQISVSGLEGKQWGKGSLVNSIEGYINYVQMVKPEAGQQLKAKWQLLLGREDVKTQVRAAATAAPILIPPVAPAQEEPKDGEKPWWDVM

SEQ ID NO: 5988 - protein, 502 aa, unidentified
  source 1..502: note = Related to NZ_PYGK01000009.1; note = Chitinophaga ginsengisoli
MAEGLTRQQLYDRIRASTRDEVILEEMTRLGFWKKNTLMPSPSEVLIHREADLTRELNKLMEEKRRYQNREKMLIEMRKQRMAAAKAKRAETKLRNEEKRKEKAAQWAEQKEKQIVYLGEDVSQGLNKTVSDTERLTATGLPVFHDGVALAAAMGISIGKLRFLAFNRKVGHITHYKRFYIPKKSGGKRLISAPMPQLKATQHWILENILYKVPNSDAAHGFVPGRSIVTNAVHHVAQDIVINIDLRDFFPTIEYKRVKGMFCKLGYSEQVATILALLCTEPEVDQVALDGKDYYVANTNRHLPQGAPCSPAITNIICFRLDRRFEGLARRFNYTYTRYADDMTFSAKEPAADDAGKLIWGVKQVVKEEGFVIHPDKLKVMRKGDKREVTGIVVNDKLSLDRETLRKFRALLHQISVSGLTGKQWGKGNIVSSVEGYINYVLMVKPEAGKQLKDKWRLLLNRDDIKTQVRAAATQSDAPPAPSSSNENNTTNDGEKPWWDIL

SEQ ID NO: 5989 - protein, 495 aa, unidentified
  source 1..495: note = Related to WRXN01000012.1; note = Chitinophaga tropicalis
MMTGLTRQELYDRIRSSTRDEVILEEMKRLGFWARSTGAPSLSETLIRKESELRRELNKLMEEKARYRNKEKILNDLRKKRMMDAKAKRAETKQRNEEKRREKAAAWAAEKERSVVYLGEDVSAGLNKTFSDITRLSAAGLPILHDGVGLAAAMGITLGKLRFLSYNRKVEEVSHYKRFYLPKKSGGRRLISAPMPQLKAAQYWVLQNILYKIPGSQSAHGFIPGRSIVTNAQQHVGKDVVINIDLRDFFPTIVYKRVKGMFCKLGYSEQIATILALLCTEPERDQVMLDGKEYHVANTNRHLPQGAPCSPAITNIICYRLDKRFEGLAKKFNYTYTRYADDMTFSTSGETAGKAGQLLWAVKKVVKEEGFTIHPDKLKVMRKGDKKEVTGIVVNEKMSLDRTTLRKFRALLHQVSVSGFAGKKWGNGNIVSSMEGYINYVQMVKPETGKQLKDKFRLLLNRKDIKADLPEAPKEVLPDTSLPDQNNDKPWWDVV

SEQ ID NO: 5990 - protein, 509 aa, unidentified
  source 1..509: note = Related to NZ_QTJV01000007.1; note = Chitinophaga silvisoli
MSAGLTRQELYDKIRASSKEEVILEEMVRLGFWAKNESVPSVPETFIRKEGELRRELNELLSEQARYRNKQQVLTDMRKARMAAAKAKRAETKKRNEEKRLQRAAAWKEEKEKTIVYLGEDVSAGLNKTTSDAEQLQKFGLPLLNDGAQLAAAMGISLGKLRFLAFNRKVGTVSHYKRFYLPKKSGGRRLISAPMPQLKAAQYWVLENILYKVPNSESAHGFVPGKSIVTNASNHVGQEVVINIDLKDFFPTIEYKRVKGLFIKLGYSEQIATILGLLCTEPEVDQVALDGKEYFVANTPRHLPQGAPGSPAITNLICYGLDKRFEGLAKRFGYTYSRYADDMTFSTKGEAADKIGQLLWSVKQVVKEEGFHLHPDKLKVMRKGDKREVTGIVVNDKLSLDRETLRKFRALLHQIDKTGLANKQWGNGNIISSVEGFANYVAMVKPEAGRQLKDKIKVLFNREDIKAQARAMMSGAAVNGAGSTGSIGGAAAKDEHIPKKEDGNWWDVV

SEQ ID NO: 5991 - protein, 468 aa, unidentified
  source 1..468: note = Related to MTKN01000036.1; note = Flexibacter sp.
MLFNYRYSGSTQVYSNATSAGISFSPDTRREPTFFNEYRNKQQVLTDMRKARMAAAKAKRAETKKRNEEKRQQRAAVWAEEKSKSIVYLGEDVSAGLNKTSSNTELLQRFGLPLLHDAVQLSAAMGITLGKLRFLAFDRKVGTISHYKRFYLPKKSGGRRLISAPMPQLKAAQYWVLENILYKVPNSEAAHGFVPGKSIVTNATNHVGQDVVINIDLKDFFPTIEYKRVKGLFIKLGYSEQLATILCLLCTEPEVDQVALDGQEYFVANTPRHLPQGAPSSPAITNLICYGLDKRFEGLAKKFGYTYSRYADDMTFSTKGEPADKIGQLLWSVKQVVKEEGFHLHPDKLKVMRKGGKREVTGIVVNEKLSLDRDTLRKFRALLHQISVSGLANKKWGNGNIISSIEGFANYVAMVKPETGRLLKDKIRLLLNRDDIKSQARTLMTGAPAPASEKNPPQKGDDNWWNVV

SEQ ID NO: 5992 - protein, 500 aa, unidentified
  source 1..500: note = Related to NZ_SEWF01000012.1; note = Emticicia agri
MTERLTRQEIYDRIRATSRDEFILSEMKKLGFWPSDEEKPSVSEQLIKHEGELSRELQELSQKQRKFDNQQAMLAEMRKARMAAAKKKRVETKEKNEQKRKDKAEQWKQQKQNEIVYLGEDVSHELNNTEADTAKLAQFGLPHFADALALATAMNISLGKLRFLAYNRKVSTTTHYKRFYLAKKTGGKRLISAPMPKLKEAQYWILDNILYKLKNTDSAHGFVPQRSILTNASNHIGQDVVINIDLKDFFPSIDYKRIKGLFAALGYSKQIASILALVCAEPDVDMIDIDKKTYYVAHTERKLPQGAPTSPAITNLICYKLDHRFEGIARKFNFNYSRYADDITFSAKGDGKKLVGQVLWAIRQIIESEGFQIHPDKLAVMRKGRQQEVTGIVVNDKPGIDRKELRRFRALLHQIELNGTEGKSWRNGVDLENSMRGYASFVGMVKPEQGIQFKAQLDQIFGVRAKVKPVPAPEIKIVPPTIQDTPPKPDNDEKPWWEII

SEQ ID NO: 5993 - protein, 500 aa, unidentified
  source 1..500: note = Related to QVMT01000016.1; note = Emticicia sp.
MSERLTRQEIYDRIRATSRDEFILSEMIKLGFWQSDEDQPKVTEQLIRREGELHRELNELTQKQRRYDNQQAMLADMRKARMEAAKKRRIETKEKNEQKRKDKAEQWKKTQQSTIVYLGEAVSGNLNDTLADTAKLTQFGLPHFEDALGLANAMNMSLGKLRFLAYNRKVSTTTHYKRFYLAKKSGGKRLISAPMPKLKEAQYWILENILYKLKSTDSAHGFVPQRSILTNARNHIGQDVVINVDLKDFFPSIDYKRIKGLFAKLGYSQQIASVLALICSEPDVDIVDIDRKTYYVASTERKLPQGAPTSPAITNLICYKLDHRFEGIAQKFNFRYSRYADDITFSAKGEGAKLAGQVLWAVRQVIEDEGFQIHPDKLAVMRKGSQHAVTGIVVNEKPGIDRKELHRFRALLHQIELTGTEGKSWRNGVNLENSMRGYANFVTMVKPEQGNKFKAQLDRIFGIRTKSQSLPVVETSIIPPAIQATPPKPENNEKPWWEII

SEQ ID NO: 5994 - protein, 503 aa, unidentified
  source 1..503: note = Related to NZ_QGGO01000002.1; note = Arcicella aurantiaca
MSERLSRQQLYDRIRETSKDEYILSEMKKLGFWKSNETEPQISEQLIQREGDLHRELNDLSQQQRRYDNQQAMIADMRKSRMEASKKKQLETKQRNQQKRIEKAEKWKTQQQNSIVYLGEEVSGGLNSTQTDIAKLNSFGLPHFTDVLALAQAMKLTLGRLRFLAYNRKVSTVSHYKRFYLPKKSGGKRLISAPMPMLKDAQYWILEHILYKVSPTDLAHGFVPNRSIMTNAQKHIGQDVVINLDLKDFFPTIDYKRVKGLFNKFGYSEQIATILALICSEPDVELLEIDGKQYYTAKSERKLPQGAPTSPAITNLICYRLDCRFEGIAKKFGFQYSRYADDLTFSAKGEGKKLVGQLLWSVKQVITNEGFTLHPDKIAVMRKGSQQKVTGIVVNDKAGIDHKELHKFRALIHQIGKTGIAGKTWRQGVNLENSMRGYAEFVSMVKPEQGQKFKIALDKVFGVKVKSDKQDIPQNPIIENKLPEEKPKNINKNEDGKSWWEVI

SEQ ID NO: 5995 - protein, 497 aa, unidentified
  source 1..497: note = Related to NZ_AUIF01000010.1; note = Runella zeae
MSERLTRQQIYDRIRQTSRDEFILSEMKRLGFWQTDANQPKLSEALIDKERELYQELNELSQKQRRYANKQAMLAEMRKSRLEASKKRRQETKAKNEQRRQQKAEAWKVHQQYSIGYLGEGVSGGLNQTQSNPQQLALLGLPDFRSPFQLAQAMGVSLGHLRFLAFNRTVSKISHYKRFYLPKKSGGKRLISAPMPLLKKAQYWILENILYKIPSSEAAHGFVPKKSILSNAQNHTGQDIVVNIDLKDFFPTITYHRVKGLYHKLGYSEQIATILALICTEPEVDIVKIDSQIYYTAKSIRKLPQGAPTSPAITNLICHRLDLRFQGLAQKLGFNYSRYADDLSFSGASEGSKLVGQLLWSIHKIVKDEGFVVHPEKIAVMRKGTQQRVTGIIVNEKVGIDRQMLRKFRALIHHIEQSGVQGKTWNNSKNLEASMRGYVNFVSMIKPEQGAKFKMKLDAIFGQKEKTSTSRPIKDIPPPSPPFQDSNDDDKAWWEVV

SEQ ID NO: 5996 - protein, 505 aa, unidentified
  source 1..505: note = Related to JAGIBF010000018.1; note = Niastella sp.
MADKQPTRQQLYDRIRESTKDAVVLEEMKRLGFWPKGEQSPSVPELLINQEAELNKEFNQLFNQQRRYQNKEAVLQEMRMKRMADAKAKREANKKKRELQRLEKAEAWKKRKTTEIIYLGEDVSVGLNNIEANVAALQKYQLPAFANETELAQAMGITLPDLRFLAFSRKVSNISHYRKFYLPKKSGGKRLISAPMPRLKKTQYWVLENILNKVAVHTAVHGFTLNRSILSNALPHVGKKVVLNIDVKDFFPSIHYKRVKGLLQQLGYSEKIATILSLLCTEAVTEEVEIDGKNYFVQKGNRVLPQGAPTSPAITNILCYKLDLRLQGLAAKHQCQYTRYADDVTFSWNSSDINAQQMVWRIKKILSDEGFTVHPDKIRVMHQGARQEVTGIVVNEKPGIDRNKLRKFRALLHQLQTKDAAVLLPGAESPANVVIGYANFVRQVKPALGAFFAKQIDQLFQTGRLQYVVKETPPAGTNNDTPPAKPGNDKEPPKGDDDKPWWNVV

SEQ ID NO: 5997 - protein, 502 aa, unidentified
  source 1..502: note = Related to NZ_JAARML010000006.1; note = Paraflavitalea devenefica
MFDSKPTRQQLYDRIRESSKDAVVLEEMKRLGFWSKNDQSPTIPELLIKQEVELNKEFQQLFNRHRQYQNKEAVLKEMRLKRMAEAKAKREANKKKREQQRFEKAEAWRKQKETEIIYLGEEVSIGLNHTESNVAALQKHQLPVFVNENELALAMGVTLKELRFLAFSRKVSTVSHYRKFYLPKKSGGKRLISAPMPRLKKTQYWILENILNKVAVHQAVHGFTLNRSILSNAQLHVGKKVVLNIDVKDFFPSIHFKRVKGLLQQLGYAEKIATILALLCTEAVTEAVEIDGKDYFVQKGNRVLPQGAPTSPAITNILCYKLDKRLQGLATKHQCHYTRYADDVTFSWNSNDVNAQQMVWRIKNILQDEGFTVHPDKVRIMHTGTRQEVTGIVVNEKLGIDRNKLRRFRALLHQLQTKDAAELMPGVESPANVVIGYANFVKMVKPAQGAAFSKQIDQLFQSGRLQYLVKETPPSPGNNGVPPTPPSQQAGKDDDKPWWNVV

SEQ ID NO: 5998 - protein, 505 aa, unidentified
  source 1..505: note = Related to NZ_CP032157.1; note = Paraflavitalea soli
MADNKLTRQQLYDRIRESSKDAVVLEEMKRLGFWPKGDESPTIPELLINKEAALNKEFRELFEKHRQYQNKEAVLKEMRLKRMAAAKAKREETKKKREQQRFEKAAAWKKRKETEILYLGEDVSIGLNNMAGNADALHKHHLPAFANENELAAAMGIELKALRFLAFSRKVSTVSHYRKFYLPKKSGGKRLISAPMPRLKKVQYWILENILNKVAVHQAVHGFTLNRSIISNAQLHVGKKVVLNLDVKDFFPSIHFKRVKGLLQQLGYSEKIATILSLLCTEAVTEEVALDGGNYFVQKGNRVLPQGAPTSPAITNILCFKLDKRLQGLATRHQCHYTRYADDVTFSWNSTDINPQQMVWRIKKILADEGFAVHPDKIRIMHQGARQEVTGIIVNEKLGIDRNKLRQFRALLHQLQTKDASELMPGQVSPANAVIGYANFVKMVKPAQGAAFAKAIDKLFQTGRLQYLVKDAPPVLNGNPAPSPSPTSNPPANKGDDKPWWNVTG

SEQ ID NO: 5999 - protein, 502 aa, unidentified
  source 1..502: note = Related to NZ_LVYD01000013.1; note = Niastella vici
MADNRNIRQELYDRIRESSKDEVVLEEMKRMGFWAKDENGPTIPELLIKKEVELNRELNKLYEEKRKYQNREAVLKEMRLKRMAESRLKREENKKKKELAHLERAEAWKKKKDTAIIYLGEGVSVGLNNTDNNLAALQKHNLPVFNNENELANAIGIPLKELRFLSFNRKVSTVSHYRKFYIPKKSGGKRLISAPMPRLKQVQYWLLENIFNKIAVHPAVHGFALHRSIISNAQPHVGKSVVVNIDVKDFFPSIHYKRVKGLLQQLGFAEKIAVIMALLCTEAVTEEVEIDGRNYFVQKGNRVLPQGAPTSPAITNILCYKLDKRLQGLATQTQCSFTRYADDITFSFNNETTNAQQLVWRIKKVLADEGFTVHPDKVRIMRKGACQEVTGVVVNEKLGISRKKLRQFRAVLHQLKTKDAAELKWGHGNLASAVTGYANFVKMIKPVQGAALQNTIVTLLQTNRLQYPLAVTSSKKNIQTPPAQNNDPSAKKDDDKPWWNVV

SEQ ID NO: 6000 - protein, 501 aa, unidentified
  source 1..501: note = Related to NZ_LWBP01000254.1; note = Niastella populi
MAHKNIRQELYDRIRESSKDEVVLEEMKRMGFWSKNEGGPAVPELLIKKESELNKELNKLYEEKRRYQNREAVLKEMRQKRMAEARLKREENKKKKEQERFNKAEAWKEQKKKEIIYLGEGVSVGLNNIDNNLAALQKHNLPVFNNENDLANAIGIPLKELRFLSYNRSVSTVSHYRKFYIPKKSGGKRLISAPMPRLKQVQYWILENILNKVAVHAAVHGFALQRSIISNAQPHVGKEVVLNVDVKDFFPSIHYKRVKGLLQHLGYSEKIAVILALLCTEAVTEEVAIDGRNYFVQKGNRVLPQGAPTSPAITNILCYQLDKRLQGLANKGQCSFTRYADDITFSFNDPGTNAQQLVWRIKKVLADEGFTVHPEKIRIMRKGTHQEVTGVVVNEKLGLNRKQLRRFRAVLHQLKTKDAAELKWGNDNLASAVTGYANFVKMVKPAQGAALQNRIAALLQTNRLQYASTVTGAPKKKDPTPPANNSADPKKEDDKPWWNVV

SEQ ID NO: 6001 - protein, 489 aa, unidentified
  source 1..489: note = Related to JAKLTR010000008.1; note = Terrimonas sp.
MFDNQQTRQQLYDRIRESSRDEVILEEMKRMGFWGKKDAEPSLPEQLIKQETALSKELNALVAQQRKFQDKEKMLKEMRIKRMAEAKQKRAENKKKREQQRFEKAEAWRKRRGGEILFLGEMVSTGLNNTTNNTESLSKFGLPVFHNENDLAIAMGISLSALRFLAFSRKVSTVSHYRKFYLAKKSGGKRLISAPMPKLKGVQYWILQNILQRVNVHPSVHGFIANHSILTNAQPHIGKEVVLNIDVKDFFPSIHFKRVKGMLQQLGYAEKIATILALLCTEAVTEEVAIDGKTYFVQKGNRVLPQGAPTSPAITTILCYKLDKRLQGLADRHQCNYTRYADDVTFSTSRTELNMQQMVWRIKKILADEGFTVHPDKISIMRKGAQQQVTGIVVNQKLSVNREKRRKLRALLHNLETKPGFVPVWGQNSSAAAILGYAHFVKMVDAEKGEKFKDKVRSLIAQGKLSLTQSNNDRSGGNAGSDKPWWNVT

SEQ ID NO: 6002 - protein, 487 aa, Citrobacter sp.
  source 1..487: note = Related to QFQQ01000068.1; note = Citrobacter freundii
MSDNQKTRQELYDRIRESSRAEVTLEEMKRLGFWSKNDKEPTLPEQLIKQEAALVKELNALNAQKQRFQNKEAMLKEMRIKRMAEAKKKREENKKKREQQRFERAEAWRKRKTSEIIYLGELVSTGLNDVTNDTAKLSTYNLPVFNNENDLAAAMGITLSQLKFLAFSRKVSTVSHYRKFYLSKKSGGKRLISAPMPRLKTAQYWILQNILQRVPAHPAVHGFIQQHSILTNAAPHVGKEVVLNIDVKDFFPSIHFKRVKGLLQQLGYAEKFAAILALLCTEAVTEEIFMDGKNYFVQKGNRVLPQGAPTSPAITTLLCYKLDKRLQGLADKHQCAYTRYADDITFSTSNAQFNAQQMVWRIKKVLADEGFEVHPDKIAIMRKSTRQHVTGIVVNKKIAVSRDKRRKFRALLHNLETKPGFVPTWSNNSSGFAILGYANFMKMVDPVKASNALQKLQSLIASGKLPLIAAVKPAREQGDDKPWWNVT

SEQ ID NO: 6003 - protein, 547 aa, unidentified
  source 1..547: note = Chitinophagales bacterium; note = Related to JAFLBL010000017.1
MAYTYQCTFPGAGTWCHNGTLVRVCLALINLVRGRHEGAATLCQNMNFFSPIMADTHLTRQQIYDRIRESSKDEYILEEMKRLGFWKSKESSSIVPELMIKKETGLQQELNRLFEQKRKYQNKEAVLKEMRQKRMEEAKRKREETKKKREQQRADKAAAWQKKKETSILYAGENVSAGMNSTETKPDILQRYGLPLFTDELSLAAGLGITINELRFLSFSRIVSTVSHYRKFYLPKKSGGKRLIAAPMQRLKEAQYHVLEQVLNKVVLHDAANGFVKKRSIVTNAQQHVGKTLLLNLDIKDFFPTVDYKRVKGVFRKLGYAEKISTLLALICTEAPTDEVSIDGKNYFVQKGNRVLPQGAPTSPALTNILFYKCDKRLQGLAAKTGCTYTRYADDISFSTNSNTLNPQQLIWRIKRILTDEGFTVHPEKIRVMRQSSKQEVTGVVVNKKLNIDRKKMRQFRALIHTLKTKGPDAIHWGQSHPAYAIPGYLQFITMVNPEKGALLKNALTPLLDKIPKPVRITQSPQPGKPDTSGEAPKEGGDWWNVV

SEQ ID NO: 6004 - protein, 507 aa, unidentified
  source 1..507: note = Related to AP017422.1; note = Filimonas lacunae
MADNRLTRQQIYDRIRSSSKESYILSEMKRLGFWSVKDGASAVSEALINKEASLEKELNQLLAQNRKFNNREAVLKEMRLKRMAEARQKREENKKKREQKRYEKAEAWRARKQQEILYLGEGVSAGLHYTDTNEALLCEKELPVITTEKQLAEYMGIALQELHFLAFSRRVSTVNHYRKFYLPKKSGGKRLIAAPMPRLKNSQYWILNNILARIPVHAAANGFVADKSIVTNARPHLDKEVVINIDVKDFFPSIHFARVKGVFVKLGYSEKIATVLSLLCTEPVTQEISIDGRNYFVQKGQRVLPQGAPGSPVITNILCHHLDQRMQGVAAKHQYTYTRYADDITFSGSENTLHAQALLWRIKKIVQEEGFTVHPDKVHVMRKGARQEVTGVVVNKQLGIQREKLRQFRALLHNIKVKGWENAQWGNGNIISSILGYINYIKMIDPAKAAVFQQQVNVLFQQPGFSAIQQQVQPQASAAATTHDPTTNPQPAPGKGTEGDENWWKVV

SEQ ID NO: 6005 - protein, 504 aa, unidentified
  source 1..504: note = Related to NZ_BMIB01000004.1; note = Filimonas zeae
MADNRLTRQQIYDRIRSSSKEEYVRSEMLRLGFWTAKSGNTQITEVLLQQEATLTKELNQLMQERTRYRNKEAVLKEMRMKRMAEARRKREETKQKRELQRLEKAEAWRKRKQDEIVYLGETVSAGLQPGQSNEALLLQRGLPVFHTEKELAAAAGVDLRELRFLCYHRKVSAVNHYRKFLLPKKSGGHRLISAPMPRIKKVQYWVLHQILNKVPLHAAANGFATGRSIVTNAQPHVGRQVVINADVKDFFPSIHFKRVKGVFEKLGYNERIATILALLCTEAVTQEVVIDGKTYFVQKGCRVLPQGAPGSPAITNILCYQLDKRLQGVAGKHQYQYTRYADDISFSGSETTLAAEAMVWRIRKILQEEGFTVHPDKVRIMRKGARQEVTGIVVNKQPGIPREKLRRFRALLHRIKTKGWEGVQWGEGNIVSAMLGYVNFIKMVDPVKAARFEKEIALLGQLPGFTEAQKQVPLTPAPEALQKPSDTNPPSAPNTGEGDWWKVV

SEQ ID NO: 6006 - protein, 507 aa, unidentified
  source 1..507: note = Related to NZ_VVIP01000043.1; note = Proposed Foetidibacter luteolus
MADNRLTRQQIYDRIRETSRDDFILEEMKRLGFWGRGQDDPSVSELLIKKEVELGKELDKLLAEQRKYDNKQAVLKEMRMKRMAEAKQKRADNKKKREEQRFNKAEAWRQKKETEIFYLGQGVSGGLNHTENNVVLLQQKGLPVFYDEQELASAAGIELKELKFLSFSRSVSTVNHYRKFYLPKKSGGKRLISAPMPRLKKLQYWILHNVLQKVTLHTAVHGFTGKRSIVTNAQQHIAKDVVINADVKDFFPSIHIKRVKGIFKALGYSEKTATILALVCTEPVTEEVMIDGKNYFIQKGERVLPQGAPTSPALTNIICYHLDKRLQGVASKHQYTYTRYADDITFSATGQQLKEEALLWRVKKILKEEGFNIHPDKIRIMHKGTRQEVTGVVVNKKLSLSRQKLRNFRAMLHNLKTKGYADIKTGNKDIAAVILGYLNYIKMIDPVKALQFQQQVNQLFQQPSFHQLLKEQAAARAAVKPVEKSAMPSPESTTPQQGNGNWWNVTE

SEQ ID NO: 6007 - protein, 508 aa, unidentified
  source 1..508: note = Related to JAHBTJ010000009.1; note = Chitinophagaceae bacterium
MADNRLTRQQIYDRIRESSKEEYILEDMKRLGFWQRNEEGPSVPELLIKRESTLNKELNSLLAEKRKYQNKEAVLKEMRMKRMAEAKQKREENKKKREQQRYEKAQAWRAKRETEIFFLGEGVSAGLHYTESNLEELQKKALPVFENEMQLANAMGIALKELSFLSYSRRVSAVSHYQKFYLPKKSSGKRLISAPMPRLKKAQHWILQHILYKVPVHAQANGFVPGKSIVSNATPHIGKNVVVNADVKDFFPSITFKRVKALFGKLGYADKIATILSLLCTESVTEEVMLDGKKYFVQKGERVLPQGAPTSPAVTNILCFRLDKRLSGVAKKFGCGYTRYADDITFSGTLNNSDASKIVWHIKKILSEEGLTIHPDKIRVMQKSERQEVTGVVVNRQLSVSREKLRNFRALLHQLKKNGHENAKWSEGSLSNAIAGYASFIRMVNPAKAEKFIKEISDIRQSQTWQHLLLSEAAAIAKKLNQQTLPSTPAPPPANNNRKEDGEWYNVV

SEQ ID NO: 6008 - protein, 402 aa, unidentified
  source 1..402: note = Related to LUKG01000006.1; note = Flavihumibacter sp.
MADNHLTRQQIYDRIRESSRDEYILEEMKRLGFWNKNESSPTLPELLIKKESNLHKELNALLAEKQKFQNREALLKEMRLKRMEATKLKREDNKKKKEKERFEKTTAWRKKQETEIFYLGEEVSAGLHYAENNHPLLNQKALPVFENEQQLALAMNCTVKELAFLAFSRRVSELTHYQKFYLPKKSGGKRLISAPMPRLKKAQHWILQTILYKIPLHTSANGFVPTKSIVSNAWPHTGKQVVINMDIKDFFPSISFRRVRALFKNLGYSDKIATILALLCTEAPTEQVELDGKKYFVQKGERVLPQGAPSSPAITNILCYRLDKRLVGVANKFNGTYTRYADDITISGSFAHNTATRIVWQIKKILSEEGFILHPEKIRIMQQSQRQEVTGIVVNQEMSVNR

SEQ ID NO: 6009 - protein, 480 aa, Flavobacterium sp.
  source 1..480: note = Related to SEBO01000011.1
MQRLGFWPKNDNAPTLPEQLIKKEGELQRELSTLLQEKRKFEDKEAMLAQMRKKRMEEAKKKREQTKQKREAKRIEKAEKWKASKEKEIIYLGEKVSGGLNAKESDVPALDSKGLPTFTEETELAQAMGITISQLRFFCYHRSVATTTHYKRFGIKKKSGGMRIISAPMPRLKAAQYWVFHNVLNKLRHHEAAHGFVRERSILSNAKEHLNKEVVVNIDLKDFFPSIHFKRVKGLFHKLGYSEKIATIFSLLCTEPDVEEVELDAKTYFVAKGKRALPQGAPTSPAITNLLCYKLDCRLHGVAKAMGLSYTRYADDMTFSGDGEAAAKVQQLLWRLHRIIKDEGFTIHPKKIHVMRKGARQEVTGIVVNKQPGINRQTLHRFRALLNKIEKKGIEGKRWRGGNVIAEIAGYAEFVSMVKPAQGVKFKDQVRRILQQPDVIEHLQKAPLQAVHASHASKPIKDTHSNSDRNESSKPWWDVL

SEQ ID NO: 6010 - protein, 521 aa, unidentified
  source 1..521: note = Related to NZ_JACYFG010000060.1; note = Pelagicoccus enzymogenes
MNQSQPATRQELYERIRESSKNEVIRSEMERLGFWNPNAPEPKVADDWLKEYDRLTKELRELRGKQERMNNRDTLLADIRKKRMAESRERQKETKLRRERERIEKAERWKKLKEEDILYLGEDVSTQLNKKEPRPDLLAERQLPNFVNAKALAASMEVPIGELKFLAYNRKVSKVSHYKRFFMKKKSGGQRLISAPMPRLKRLQYWILHSILYKIPVHECVHGFVPDRSIKTNAAPHVGQDVVVNIDLKDFFPTVSQSRVQGLFNALGYSNQISTIFSLLCTEPEVQQAKLDGESWFIHQGERHLPQGAPTSPAITNLICYRLDCRIKGATDKLGFNYTRYADDITLSASGEAVSDICRLIWQVRKIIEEEGFNFHPDKFRVMRKGRRQEVTGLVVNETLSINRNTLRRFRALLHQIEKSGIEGKSWQGNSVNLLNSIQGYADFVAMVRPEKGQLLQARVKAIRMVQKHKRRAKPEAKPKIPAPLVPINKANELSHAGSDQTPKSSSGPKPFWKKLLFWLD

SEQ ID NO: 6011 - protein, 515 aa, unidentified
  source 1..515: note = Related to JAGROY010000010.1; note = Verrucomicrobiae bacterium
MADPDPSQPFRPLSRQEIYDAIKATSKQEFILDDMIRLGFWMPEQGNPAVPDAIIRRRGELNRELNELLHKQRRFENREAALAAHRKKRMAESKVRQKETKERNARLRQEKAERWRERKQREILYLGEGVSGGLSELQSVPERLSRHQLPDFANAETLASAMGITLGELSFLAFHREVSKTTHYRRFAIPKKSGGERIISAPMPRLKAAQTWILENLLQKVSVHDAAHGFVPDRSIITNASNHIGRDIVINVDLQNFFPSVTQARTKGLFKSLGYSEHIATILSLLCTEPEMDTLELDGQIWHVAMGGRFLPQGSPASPAITNILCRKFDARLSGMARKLGFTYTRYADDVTFSAGGETVEKYKTLLWRAKAIIHEEGFIVHPDKLRIMRLGSRQEVTGLIVNKAIGIPREDLRRFRAVLRQVEQDGPAGKRWHGSGHNILAVLGGYVNFIHMVTPEKAAPLRERVLALQSKHGWQREIRHRPRALAPEAGNPAARSADGGGFFKSILRKLGFGK

SEQ ID NO: 6012 - protein, 500 aa, unidentified
  source 1..500: note = Related to NZ_CP025791.1; note = Flavivirga eckloniae
MRNSTERRQEIYDKIKASSKQEYILSEMRRLGFWNEEDLDFEAVNLFFKQESELSAKLQKLLREKRVIEDPEAFLAKKHQERKIASKASQKETKERREKTRLEKAEKWRVSKAKDIVYLGENYSHQLNDKTSDASRLKAQSLPVMHHAEDLALAMKISIGELRFLSYSRKNSKISHYKRFQVAKKTGGYRLISAPMPKLKKTQHWILENILNNVPVHENAHGCVIGKSIKTNAIPHVGKDVVINQDFKNFFPSVTYNRIKGVFKSLGYSNQVATILSLLCSEPKILDISLLGEDYYAQQGERFLPQGSPCSPAITNILCKKLDHRLSGLAKKYGFEYTRYVDDITFSSNNNNFKKITPLLKYSRYIVNSENFKLHPEKLRVMKRNAKQEVTGVVVNEKANISKKSLKRFRTLLFQIEKDGIEGKFWNKSGNVLAQIDGYANFIYQIDQDKGVVYKKRVNAILETYKYKENHRSKYISNTNKGSASSFGRFVKKIASLFRK

SEQ ID NO: 6013 - protein, 506 aa, unidentified
  source 1..506: note = Related to SORL01000014.1; note = Algibacter lectus
MRNNSTERRQEIYDKIKASSKQEYILSEMKRLGFWNEGELDFKAVNTFFNEERELSQKLQKLLKEKKVIEDPEAFLAKKHQERKLASKQSQKATKERREKERLEKTERWRVSKEKDIIYLGENYSHQLNEQISNTERLKSKNLPVLHTAEDLAKAMNISIGELRFLSFSRKNSKISHYKRFQMAKKSGGYRLISAPMPKLKKAQHWVLESVLNIVSVHSNAHGCVIGRSIKTNAEPHVGKAVVINQDFKNFFPSVTYARIKGVFLALGYSNQVATIFSLLCSEPKILDVSLLGEDYYAQRGERFLPQGAPTSPAITNILCEKLDFRLTGLANKYGFTYTRYVDDITFSGTHDSFDKITPLLKYSRYVVNSENFNLHPEKLRIMKRNAKQEVTGVVVNEKTNIPKGDLKRFRALLFQIEKDGIEGKYWTKGGNVLAQIDGYANYIFQIEPEKGVLYKKRVNVILEKYNYKEKHKATYVPKVLDKREKANKPDSVGGIFNKIMSFFRK

SEQ ID NO: 6014 - protein, 500 aa, unidentified
  source 1..500: note = Related to NZ_LIQG01000027.1; note = Lacinutrix mariniflava
MKNSTERRQEIYDKIKASSKQEYILSEMKRLGFWNQEELDFESVNAFFKEETELSKKLQGLLKEKRVIEDPEAFLAKKHQERKLASKQSQKETKERREKERLEKAARWKTSKEKDIVYLGSGYSNNLNKKESDVTRLKTQQLPVLNTAEDLASALGITVGELRFLSFTRKNSKISHYKRFQMPKKSGGYRLISAPMPKLKKAQHWILEHILNNVKVHDNAHGCVIGKSIKTNAVPHIGKAVVVNQDFKNFFPSVTYNRIKGVFMSLGYSNQVATILALLCSEPKILDVSLLGEDYYAQRGERFLPQGSPCSPAITNVLCRKLDFRLSGLAKKYDFDYTRYVDDITFSGDKKSLPKITALLKYSGKIVRDENFMLHPEKLRVMKRNAKQEVTGVVVNEKANIAKTSLKRFRALLHLIEKEGIEGKYWNKGGNVLAQIDGYANFIFQIDEVKGAIYKERVNAILVKYNYKEEHIKQYAPNAKKGTSGLLSGFIKKVSSFFKK

SEQ ID NO: 6015 - protein, 500 aa, unidentified
  source 1..500: note = Related to NZ_VSDQ01000163.1; note = Seonamhaeicola marinus
MRNSTERRQEIYDKIKGSSKQEYILSEMKRLGFWNEGDVDFEAANAYFKEEAELSKKLQELLKEKRIVGDPDAFIARKHKERKLASKQSQKETKERREKERLEKAKRWKAIKEKDIIYLGTSYSNNLNKKISNVEKLRSQNLPVLQTALDLASAMNITIGELRFLAFSRKNSKTNHYKRFKVPKKTGGYRLISAPMPKLKRAQHWILEHILNHVVIHKNAHGGVLKKSIKSNAIPHVEKAVVINQDFKNFFPTVTFNRIKGVFVSFGYSSQVSTILALLCSEPKILDVELLGEKYFAQRGERFLPQGSPCSPAITNILCKKLDYRLTGLAKKYGFDYTRYVDDITFSGDKHSLSKITPLLKYSRFIVNEENFKLHPEKLRVMKRNSKQEVTGVVVNEKPNISKKSLKRFKALLFQIEKDGIEGKFWNKGGNVLAQIDGYANFIYQIDSEKGMLYKKRVKAILDSYNYKENHRKAYVLNSQKTGISVGRLFKKITSFFKKS

SEQ ID NO: 6016 - protein, 502 aa, unidentified
  source 1..502: note = Related to WTCE01000070.1; note = Crocinitomix sp.
MTDSKERRQAIYDKIKESSKNEFILSEMKRLGFWSDENVDFGAVTKFFKDEGELSKKIQEKLRDKNILDNPEVFIAQKHKERKLASKQRQKETKEKREKVRQEKAAKWQESKKSDIIYLGDQYSHQLNQKLSLVERLKSQGLPVIQTAAELAKNMGVSVGELRFLTYSRKNSKISHYKRFKVPKKSGGYRLISAPMPRLKQAQTWILEEVLNKVKVHESAHGCVTGKSIKTNAEPHVAKAVVINQDVKNFFPSITYNRIKGVFLSLGYSHQVAVIFALLCSEPKIVDIDLLGEDYFAQKGERFLPQGSPCSPAITNILCRRLDFRLTGLAKKYNLSYTRYVDDLTFSSTEYPDHSVVTKVLKYSRLIVKDENFRLHPDKLRVMKKGARQEVTGVVVNEKPNVSKKTLKRFRALLFQIEKDGIEGKQWNRPGNVLAQIDGFANFIYQINPEKGARYKAQVAVILVTHNYKELHKKAFPPKSNPTNETPQNRLWSRVKSFFKKN

SEQ ID NO: 6017 - protein, 503 aa, unidentified
  source 1..503: note = Flavobacteriaceae bacterium; note = Related to NVRM01000058.1
MKNSQERRQEIYDKIKESSKQEYILSEMKRLGFWDDQQVDFKEAEAFFKLESGLSKELQVLIKEKNLIDDPAAFLAKKHQKRKLKSKQKQRETKEKRELLRLEKAEKWQLSKKEDIRYLGDGFSHQLNDQTSQVDRLKSLDLPLLNNAKELAQAMDIPIGELRFLSFSRKNARLSHYKRFKMKKKSGGFRLISAPMPRLKNAQYWILEEILNKIAVHPLAHGCVIGKSIKTNAEPHLQKAVVINQDFKNFFPSITHNRIKGIFKSFGYSEQLATIFSLLCSEPKIVEVSMLGEDYFAQRGTRFLPQGAPTSPAITNIICKQLDLRLHGLAKHYGFDYTRYVDDITFSGNQEQLPKIAAILKYSKKIVEDENFTLHPEKLRIMKRSDRQEVTGVVVNEKTNIPKKNLKRFRALLFQIEKDGIQGKVWNKKGNILAQIDGYANFIYQIDTEKGIAYKKRVGLILKAHGYKEAHQSKFGRRSKDSSTSWFTSLVSKVKDIFGSGGK

SEQ ID NO: 6018 - protein, 483 aa, unidentified
  source 1..483: note = Related to NZ_OENB01000038.1; note = Tenacibaculum dicentrarchi
MDNSATRKQEIYDKIKESSKHEFILSEMKRLGFWGDDNVNFDKVNDFLKEENALSGDLSKLLKKERLIKDTDAFIANKHKERKKLSKEKQKETKLKREQIRKEKAEKWQQTKKEDITYLGAGYSHQLNDTQIDEVRLKEAGLPIYHSVKDLAEAMKITVNELRFLAFSRKNSQIEHYKRFKVAKKSGGYRLISAPMPRLKRAQHFILENILNKVIVHNKAHGCVKERSIISNAMPHLNKAVVINQDLKNFFPSVTYKRIKGVFKSLGYSEQLAVIFSLLCSESKILDISLLGENYFSKRGERFLPQGSPCSPAITNILCRKMDYRLDGLAKKYGFDYSRYVDDTTFSGNHEQFKHITAILKYSKKIISEENFNLHPDKLKIMKRNQRQEVTGIVVNEKLNIDKKSLKRFRALLYQIEKEGIAGKTWNGGLNVLAEIDGYANYIYQVDKEKGAKYKSQVADILKAHSYKESKGIFNKINSLFKR

SEQ ID NO: 6019 - protein, 501 aa, unidentified
  source 1..501: note = Related to NZ_AUMF01000009.1; note = Tenacibaculum ovolyticum
MDNSATRRQEIYDKIKESSKDEFILSEMKRLGFWGDNEVDFEKANAFLKEERELSNNLTALVKKERAIEDTEAFIANKHKERKKLSKEKQKETALKRALIRKEKAAKWQQTKKEEIVYIGDGYSHQLNDTETNVARLKENDLPIYESAKELAEAMKITVNELRFLAFSRKNSKIHHYKRFKVAKKSGGYRLISAPMPRLKRAQHFILENILNKVTVHKKAHGCVKERSIVSNAEIHVNKAVVINQDLQNFFPSVTYKRIKGVFKSLGYSEQLAVIFSLLCSESKILDLSLLGENYFTQRGDRFLPQGSPCSPAITNILCRKMDYRLDGLATKYGFTYSRYVDDTTFSGNQEQFKYITAILKYSKKIIKEENFKLHPDKLRIMKRNERQEVTGIVVNEKLNINKKSLKRFRALLFQIEKEGIQGKTWNGGLNVLAEIDGYANYIYQVDKIKGVKYKSQVSAILKAHSYKENHVAKYASNSTEAANEHKVPSFFKKIISFFKK

SEQ ID NO: 6020 - protein, 526 aa, unidentified
  source 1..526: note = Related to NZ_CP053348.1; note = Winogradskyella forsetii
MVPISLELFNSVFRVVRRELKYILLLPFFVFMSNSTERRQEIYDKIRQSSKHEYILSEMKRLGFWGEDNVDFEQVNKFFNDESELSKQLNDLLRKEKSIEDTEAFIAAKHLERKRISKEKQKETKEKREQQRLEKAKQWQLSKLEDIVYLGEGYSHQLNDKTTADDLLKRQGLPILHSAKDVAKAMNITVAELRFLAYSRKNSKTCHYKRFKVAKKSGGFRLISAPMPRLKKAQHFILEHILNKVTMHPKAHGCVLEKSILTNALPHVNKDVVINQDLKNFFPSITYKRIKGVFKSMGYSEQVSVIFALLCSEPKILDVTLLGENYFAQQGDRFLPQGSPCSPALSNIICKKLDYRLDGLASKYGFIYSRYVDDITFSGPKAQFSKIPALLKYSNKVVKAENFILHPEKLRLMKRHQRQEVTGVVVNEKPNINKKSLKRFRALIYQIEKDGIEGKTWNGGLNVLAEIDGYANFIYQINKEKGKPYKERVASILVAHNYKEAHKQKYVKAPPKKEGFIKKLFSWFKL

SEQ ID NO: 6021 - protein, 504 aa, unidentified
  source 1..504: note = Related to NZ_CP009976.1; note = Cellulophaga baltica
MSNSTERRQEIYDKIRQSSKQEYIISEMKRLGFWGEDNVDFDKVDRFFKKESELSKQLHDLLKKEKSVEDTEAFIAAKHIERKRISKEKQKETKEKRALERIEKAKRWQLLKNEDIIYLGEGYSHQLNDKNTATDLLKAQGLPVLESANDIAKAMKISLGELRFLAYSRKNSKTSHYKRFKVAKKSGGHRLISAPMPRLKKAQHYILEHILNKITMHPKAHGCVLEKSILSNALPHVNKDVVINQDLKNFFPSITYTRIKGVFKAMGYSEQVSIIFALLCSEPKILDISLLGEHYFAQQGHRFLPQGSPCSPAITNIICKKMDYRLDGLGSKYGFTYSRYVDDITFSGDKNQFSKITALLKYSKKIVTSENFTLHPDKLRIMKRHQRQEVTGVVVNEKPNINKVSLKRFRALIYQIEKDGIKGKTWNGGANVLAEIEGYANFIFQIDQEKGRGFKERVAKILAQHNYIEKHIVTYAKEKVVVATSSDAKPKDTFLKKLFSIFKK

SEQ ID NO: 6022 - protein, 513 aa, unidentified
  source 1..513: note = Related to BMWS01000013.1; note = Aquimarina muelleri
MYEGNKIHLIATFFIPYTMADSATRRQEIYDKIKESSKDQYILEEMKRLGFWNEGQVDFETVNQYFKEESELSQQLQKLLREKRLVENPEAFLAQKHKERKLASKQSQKETKEKREKLRQEKADRWKESKEKDILFLGAGYSHTLHDKSTKQDRLQQEKLPVLQNAEDVAKAMDISIGQLRFLSFSRKNSKINHYKRFQIPKKTGGFRYISAPQPKLKKAQHWILENILNKVTMHPQAHGCVIGKSIKTNAIPHVAKDVVINQDLKNFFPSIVYPRIKGVFQSLGYSDQVATIFALLCSEPKIVEISVLGEDYYAQRGERFLPQGSPCSPAITNIICRKLDYRLDGLARKYGFSYTRYVDDLTFSGEKDQYAHITNMLKYSRRVVKEENFTLHPDKLRVMKKGVRQEVTGVVVNEKPNIDKKSLKRFRALLYQIEKDGLKDKVWTGKADLLSQIHGYANFINQIDQEKGKKYKEKVNIILERYNYKDNHRKQYVKTFVKPKGLMSKLRSFFRK

SEQ ID NO: 6023 - protein, 498 aa, unidentified
  source 1..498: note = Related to NZ_QMFY01000006.1; note = Chryseolinea flava
MADIRQQLYDRIKASTKESVILEEMKRLGFWKQETGVPSLPEQLILQEADLTKELQSLLEQQRKYQNKEQALKEMRKARLEKSKLKREENKKLRKQKREEKAARWKATQETDIIYLGEDVSKGLNNKETDVAKINTHQLPGITTVEELAKAMNISVGTVRYLSYNRIISKTTHYKRFYIPKKTGGKRLISTPMPKLKRAQYWILENILEKIAIQDSAHGFVKKKSIVSNALPHVKAEVVVNIDMKDFFPTITYPRVKGVFQSFGYSEQIATILALMCTEAECDQIDLDGITYYAAGLERFLPQGAPTSPALTNIICRKLDARLKGIATKFNFNYTRYADDLTFSASGEATAHLKTLMGFIKRIIKEENLHIHPDKVRVLRKGARKEVTGIVVNDRPAVNAKELDRFRALLFQIEKDGLDGKHWKGSNNLLASIKGYANFVLMVDPIKGKPLMERVSKILSTHEFKHVIRHKPKSLLANEPEKPKNTEEQSKKPWWRFW

SEQ ID NO: 6024 - protein, 495 aa, unidentified
  source 1..495: note = Related to JAIOAO010000004.1; note = Fulvivirgaceae bacterium QH1ED-6-2
MADIRQQLYDRIKASTKDSVILEEMKRLGFWKRDVGMPSLSEQIILKEADLTKELNALLEQQRRYQNKEQALKEMRKSRLEQSRAKREENKKRRKQKREEKAARWKASKETDIIYLGDNVSQGLNNKETDPAKLTQHQQPLVTTVEDLAKAMNVSVGTLRYLAYNRIISKTTHYKRFYIPKKTGGKRLISTPMPKLKQAQYWLLENMLNKVATHDAAHGFVRQRSIVSNALPHVGAEVVINIDMKDFFPTITYPRVKGVFRSFGYSEQIATILALICTEPDVDQIELDGQTYYAAGSERLLPQGAPTSPALTNIICRKLDARLKGIATKLGFNYTRYADDLTFSASGEAVTHVKTLMGFVKKVVKEEKLVIHPDKIRILRKGARKEVTGIVVNDKPAVNAKELDRFRALLFQIEKDGPQGKHWNNSPNLLASIKGFANFVAQVDPVKGKPLVERVNAILVTHQFKHTIKHKSKAQQAKQEAEQKQKSKKPWWKFW

SEQ ID NO: 6025 - protein, 500 aa, unidentified
  source 1..500: note = Related to JAERRB010000002.1; note = Chryseolinea sp.
MADIRQQLYDRIKASTKESVILEEMKRLGFWKKEEGIPSLSEQLIVKEADLTKELKELLEQQRKYENREAALKEMRKARMAQSRAKREENKQLRKQKREAKAARWKDSKEKDILYLGEDVSKGLNNKESDLTKLATYGLPVIHHAEALAQAMQTTIGNLRHLAYHRIISKTTHYKRFYIPKKTGGKRLISTPMPKLKQAQYWILENILNKVTLHDAAHGFVKTRSIVSNAQPHVKADVVINIDLKDFFPSITYVRAKGVFKSFGYSEQVATIFALLCTEPECDQIAIDGVTYYAASMERFLPQGAPTSPAITNIICRKLDARLRGIATKLNFTYTRYADDLTFSASGDAAAGTRTLLGFVKKIIKEEKLNIHPDKFRVLRKGARKEVTGIVVNEKPAVNAKELDRFRALLFQIEKDGIAGKHWNNSTNLLASMKGYASFVAMVDAAKGKPLVERVNAILAANQFKHVIRHKSKAMRDKETAQAPKGSGSSDAKKPWWKFW

SEQ ID NO: 6026 - protein, 503 aa, unidentified
  source 1..503: note = Related to QFQN01000037.1; note = Azospira oryzae
MVGSQNTRQQLYDRIKASTKEAVILEEMKRLGFWKSEEGMPSLPELIIEKEAVLIKEVRELVEQQRKYKNKEEALKEVRKLRLEKSKLKREENKKTRKQKREEKAAHWKERKEKDILYLGEKVSKGLNNKESDLAKLTSLQLPVLQNAEDIALAMGIPVGQVRFLSFHRIVSKTTHYRHFYIPKKTGGKRLISTPMPRLKSAQYWVLTNVLDKILIHDAAHGFVRKRSIVSNALPHIKAEVVINIDLKDFFPSISYIRVKGLFQSFGYSEQVATILGLICTEPESDEIELDGETYFAANGERFLPQGAPTSPAITNIICRKLDVRLKGIASKLNFNYTRYADDLTFSASGESAASTKTLLGFVKKIIKEENLNIHPDKLRVLRKGARKEVTGIVVNDKPSVNAKELDRFRALLFQIEKDGIGGKHWKNSNNLLASMKGYASFVAMVNPEKGNPIKERVNKILAANQFTHVIKHKSKAMIAKDAAKNTNTASTSEVKKPWWKFW

SEQ ID NO: 6027 - protein, 523 aa, unidentified
  source 1..523: note = Related to NZ_KE384560.1; note = Sporocytophaga myxococcoides
MTKNILYTTIFYTPMANTENSQPTRQQLYERIKSSGRNAVILEEMQRLGFWKSDEGASVIPEMLIHKEADLIKELNKLLQQQRIYQNREEALKKVRQARLEQSRKKREENKILRKQKREAKAARWKELRDKNIIYLGEKVSKGLNNQISENSKLLKYQLPVLQTAEELSAAMKITIGELRFLSYNRTISKINHYKRFYIPKKTGGKRLISTPMPRLKKAQHWILENILNKIDPTESAHGFVKKKSIVSNALPHVKADVVVNIDLKDFFPSINYRRVKGLFIALGYSEQISTIFALICTEPDCDQVELDGETYYAAGSDRFLPQGAPTSPAITNLICRKLDLRLKGIASKLNFNYTRYADDLTFSASGVATSNTSTLLGFVKKIIKDEKLYINPDKLRVQRKGARKEVTGIVVNDKPSVCRKELDKFRALLHQIEKEGTIKGKHWNNSNNLLASIKGYANFVKMVNPEKGKPLEERVKKILEAHRFKHVIKHKPKKQSATTNVVDSKPANQPEAENKKPWWKFW

SEQ ID NO: 6028 - protein, 498 aa, unidentified
  source 1..498: note = Related to JAJTHV010000105.1; note = Flammeovirgaceae bacterium
MADSQSTRQQLYDRIKNSSKDAVVLEEMKRLGFWAKNESAPSLPEILIQKEAALVQELRQLTEQQQKLKDKQQLLKEVRKARLEKSRAKREENKKLRKEAREAKAARWKEKKEKDIVYLGANVSGGLSHTASDATLLGKHQLPIWNSVEELARDMKVKVGELRFLGFNRAVSKVNHYKRFYIPKKTGGKRLISAPMPRLKTAQTWILETILNKVAPSEQAHGFVLKRSIVSNALPHVKADVVINIDLKDFFPSIHYPRVKGVFQSLGYSEQLATLFGLICTEPDCDTVELDGTTYYVSNSERFLPQGAPTSPAITNILCRKLDARLKGISTKLNFTYTRYADDLTFSTSGEHVNKTKTLLGFIKKIIREEGLVIHPDKLRVQRKGARKEVTGLVVNDKPSIAAKELDKFRALIYQIEKDKTLQGKHWKNSPHLLASMKGYANFVAMVDPAKGKPLVLRVNKILDEHGYKHVIKHKPKPKVVAASEQPVPAKKPWWKFW

SEQ ID NO: 6029 - protein, 504 aa, unidentified
  source 1..504: note = Related to NZ_FUZU01000002.1; note = Ohtaekwangia koreensis
MADNSQVTRQQLYDRIKASTRDSVILEEMKRLGFWKKDDGIPSLPEILITKESILTQELHVLLDQQRKYKNKEEALKEIRKARLEQSRLKREENKKLRKQKREAKAAQWKERKEKDIIYLGEDVSKGLNNKASDLTKLATYQLPEMHMADELANAMGITVGELRFLAYNRTVSKINHYKRFYIPKKTGGKRLISTPMPRLKKAQHWILENILNKVSIDDHAHGFVMKRSIVTNALPHVKAEVVINIDLKDFFPTISYQRVKGLYRSLGYSEQLSTIFGLISTESECDQIELDGEIYYAAGIDRFLPQGAPTSPAITNIICRKLDARLKGIASKLNFAYTRYADDLTFSASGENVNNTKTLLGFIKRIIKEENLTIHPDKFRVLRKGARKEVTGVIVNDKPAVNAKELDRFRALLFQIEKDGTLEGKHWKNSPNLLASIKGYASFVAMVDPIKGKPFVERTNKILETHGFKHIIKHKPKPPQTAAAVQTEEQAAQKKKPWWKFWA

SEQ ID NO: 6030 - protein, 501 aa, unidentified
  source 1..501: note = Related to NZ_JAFEWE010000006.1; note = Pedobacter sp.
MSNQPNRQQLYDRIKASTRDAVILEEMKRFGFWKKDEAQSIVPETLIEKEAALTRELRDLLEKQQRFQNREQALIEVRRARLEASKKKRAENKLLRKQQKEQKAARWKEKKEKEIIYLGEDVSPGLNNVSANPDNLNKQKLPVIANAEELAKAMKTTVAELRFLAYHRTVSKTTHYQRFYIPKKTGGKRLISTPMPRLKSAQHWVLENILELPEIKDTAHGFVKKRSIVSNAVPHLKAEVVINVDLKDFFPSIDYKRVKGLFISLGYSEQIAIILGLLCTEPESDQIELDGQKYYVAGTERFLPQGAPTSPAITNLICRKLDARLIGISKKLGFTYTRYADDLTFSASGEAVKSVKTLMGFIRKIVKDENLNIHPDKLRILRKGSRKEVTGIVVNDKPAINSKELDRFRALLFQIEKDGIAGKHWKNSPHLLPSIKGYVNFISMVDQEKGKALKVRVDAILQKHGYKHEIRHKSKQQIAKEQERIEAEAVHQKKKPWWKFW

SEQ ID NO: 6031 - protein, 503 aa, unidentified
  source 1..503: note = Bacteroidetes bacterium; note = Related to JAJNDK010000004.1
MTRQEIYDRIKNSTKDAVILEEMKKLGFWKEDGAAASVPEQLILREASLRKDLNELLQKQRNYQNRDLALKDMRAARMEASRKKQAENKLLRKEKAEKKAAAWKEKKQKDITYLGEAVSTGLNNAEANTEKLQKSGLPLIESAEKLAALMQISISELRFVAYNRVVSEITHYKKFQLPKKTGGFRTISAPLPRLKSAQHWILQEILNKLPVHAAAHGFVTKRSIVSNAKEHLQNNLLINIDLKDFFPSIHYPRVKGFFKAIGYSEQVATIFALICTESEVDEIELDKKTYYVKSGDRSLPQGAPTSPAITNLLCRRLDARFAGLAKKYGFVYTRYADDLSFSAPEEKKEEFKKFIGFVKKTIKAENFTLHPDKFKVLRKGARREVTGIVVNQKLSVSSDKVKKFRALLFQIEKDGIAGKHWNGSTTLLASIKGYASFIYQVDPVKGKPMLERVNKILVANAFKHIIVHKSKAQKEKEAPKKQAGIGASTKTTSDTKKPWWKIW

SEQ ID NO: 6032 - protein, 478 aa, unidentified
  source 1..478: note = Related to JAFDXR010000011.1; note = Bacteroidetes bacterium
MKKFGFWNETEGQSSLPEQLIMQEARLSKELYDLLEKQRKYQDREKALKEMRTARLQKSREKIAENKRLRKEKKEQRAQDWKNSKQKDIIYLGPTVSKGLQQTADGESDKLKQKQLPLIHTAEELASQMGIGIGELRFLSYNRPVSTVSHYRQFQMPKKTGGFRKISAPMPKLKEAQHWILHYILNKLPVHENAHGFTLRKSIVTNAQPHLQKVLLINIDLKDFFPSIHYPRVKGMFRGMGYNEKIATLLALICTESETDEVELDGKKYFVKSGNRALPQGAPTSPAITNYLCRRLDARLSGLARKYHFTYTRYADDMTFSFSADQQDSIKTCIGFIKKTIRTENFNIHPDKFKVLRKGARHEVTGVVVNNKLSVDSKKLKKFRATLYQIEKHGLQGKHWNHSHNLLASLKGYANFINQVDPVKGKIYTERVRKILDQYQYRHEIIFKPKPKPSPLKEIPNPIPAPEAKTRKPWWKFW

SEQ ID NO: 6033 - protein, 431 aa, unidentified
  source 1..431: note = Bacteroidia bacterium; note = Related to JACMLS010000980.1
IARKEKIEAAAKAWARKKEKEIVYLGENVSAGLNNLQDSDAERLKKNNLTDIASAEQLAALMKIEMGQLRFLSYHRAVSRVSHYKKFTIPKKTGGVRTISAPMPKLKTAQHWILENILDKILLHDAAHGFVNKKSIVTNATPHLKSEVVINIDLKDFFPSVHYPRVKGMFRKLGYNEAISTIFSLICTEAEQDEVEIDGVKYYVKDGNRKLPQGAPTSPAITNIICRKMDARFTGLSKKYGFAYTRYADDLTFSASGDALLKLKQFIALVKKVISSERFTLHPDKFKVMRKGARKEVTGIVVNEKPAIEKKKLKKFRALLFQIEKEGSIAGKKWGNSKNLLAAIKGYSNFINMVDPVKGKSLIDRANKILEQHKFAHVIVHKAKPKVEPVVIQKTTSTVSQSQYVSTTTAATQQVAPEKTDSKKPWWKFWS

SEQ ID NO: 6034 - protein, 501 aa, unidentified
  source 1..501: note = Related to CP004371.1; note = Flammeovirgaceae bacterium 311
MANQSKPTRQQLYDRIRQSSRDEVVLEEMKKLGFWPDGEGAPSLPEQVIRREGELSRELGDMLVQQRRYSDREQMLKEIRQQRMEASRQKQKENKERRRQERQQRAEQWKARQEKEILYLGEGVSAGLGESDNDAAKLRLNGLPDFIDIESLARAMEIDVASLRFLAYSRQVSKVSHYKRFYIQKKTGGRRMISAPMPRLKQAQQWILLHILENVKVNGAAHGFVLNRSIVTNALPHLQPDLLVNLDLKDFFPTVTYKRIKGVFRSLGYSEKVASIFGLICTEPDITEAEMDGRTYFIASGERFLPQGAPTSPALTNILCRRLDVRLKGLARKYGFTYTRYADDLSFSARGEGKENLTKLLGNVRRIIKDEGFVIHPDKLRVMRKGSRQEVTGVVVNQKLNVCRKKVRNFKALLFQIEKDGIEGKSWQGSSDNLLAVIKGYAHYIAMVNPVQGKPLAERVEAILKKHHYRHIIKHPAKKPFMQAAAEEEPQPKKKPWWKFW

SEQ ID NO: 6035 - protein, 513 aa, unidentified
  source 1..513: note = Related to nan
MADSSLNRRQELYDRIRSSSKDQVILEEMQKMGFWPDDSEEPSVPALYFKRELELSQELRDLVIKHRRFDDQAKMLEHIRRERMAESRKKQKETKQRRRQERLARAEAWKQRKASEILYLGEGVSQGLQGATPNRARLTQHGLTDIASVEALALAMGMTVGKLRFLAYNREISRVSHYIRFHLPKKRGGTRLISAPKPGLKSAQYWVLQHILDRIELHDAAHGFRKARSIVTNAKPHLGADLVVNIDLKDFFPTVNYRRVKGLFGGLGYSERISTVLGLLCTEPDVDVVELDGETWYVAKGERHLPQGAPCSPAITNIMCRRLDARMRGLAQKYGFVYSRYADDMTFSASGDSRKLLMTLLGNVRRILKDENFKLHPDKLRIMRKGAQKEVTGIIVNEKLNVSRKKLKKFRALIFQIEKDGPEGKTWEGARDLLPAIWGYANFIKMVNPDKGAEFVARVKAIFDHLGETPPVKPVVAQPDGSEVEVEILQGSDEDEAPGATGNDPDKPWWKIW

SEQ ID NO: 6036 - protein, 485 aa, unidentified
  source 1..485: note = Candidatus Moduliflexus flocculans; note = Related to DF820455.1
MFEGFRDSHFPLNDMSNTENSQDSRLSRQQIYDRIRATSKQEYILSEMVRLGFWPDSQDAPTLPEQLIRREGELTRELTELLEKQRKFDNREQMFKEMRKKRLEESHQKQAETKERRQRERDERARRWKELKAQDIGYLGDGVSGGLQNKEHSAERLAQNNLPAFASVAELVQAMGISVGELRFLTFQRDVSKVSHYKRFYMPKKSGGMRLISAPMPRLKAAQHWVLEHLLQTVPLHPAARGFRSGESIVTNAAPHVGRDVVINLDVKDFFPTVSYPRVKGVFRGLGYSEQLATIFALLCTEPDVDALELDGETYYVVASGRHLPQGAPTSPALTNILCRRLDSRLSGMAQKMGFAYTRYADDMTFSGTEDTLQNLTKLLWRAKKIISDEGFVVHPGKLRIMRSGSRQEVTGIVVNEQMTLERGTLRNFRALLFQIEKDGLRGKTWKGRELTPASLRGLAHYIVMVNPQKGRPLLERVNALLRQA

SEQ ID NO: 6037 - protein, 466 aa, unidentified
  source 1..466: note = Related to PDSK01000128.1; note = candidate division KSB3 bacterium
MNDSEDSRAVRQQIYDRIRQSSHDEYILDEMIRLGFWSSDKDAPSVPEQLIRKEAELSRELRDLLKKQRRFENRKKMLKEMRTKRLAESRKKQQETKERKKRERDEKARQWQQKKATAIFYLGEGVSAGLNQKELLTERLNQYNLPVFTSVEALAQAMEISVGELRFLTFHRKVSKTTHYQRFYMPKKSGGVRLISAPMPRLKHAQYWVFHNILQQIPLHSAGHGFRPAHSIVSNAEPHQGQDIVINMDLRDFFPSISYKRIKGLFHALGYSEQIATILGLLCTEPEIDQVELDGETYYVANSERHLPQGAPTSPALTSILCRRLDSRLQGMADKLGFAYTRYADDLTFSASGETARQFTQLLWQARKIIEDEGFVLHPEKLRIMRKGSRQEVTGIVVNEKLSVNRKTLKNFRALLFHIEKDGLDGKHWKGQPVSLAFLKGFANYVKMVDPDKGRPLLDRINKLIV

SEQ ID NO: 6038 - protein, 504 aa, unidentified
  source 1..504: note = Related to NZ_BEXT01000001.1; note = Desulfonema ishimotonii
MTDTDTSRLTRQQLYDRIRESSKDEYILEEMIRIGFWPSGKDAPTLPEQVIRREGELTRELDDLLRKQRRYENKELMLREMRKARMAESRRKQAETKARREEERQARAERWQDIKTREILWLGHGVSGGLNRRTSDVGKLAQNGLPHYDDVKALAKAIGIPVGELRFLAFSRKTSKISHYRRFFIPKKRGGRRLISAPMPRLKALQYFVLENILAKIPPHKAAHGFLPGHSIVTNAVPHVGKDVVINLDLKDFFPTISYPRVKGLFRSLGYSEQQATLFGLICTEPDTDAVELDGETYFVARSERHLPQGAPTSPAISNLIFRKADRRLQGVADQLGFAYTRYADDLTFSASGDAAEALTRLLWGVRQIVKDEGFVLHPDKLRVMKKGARQEVTGIVVNEKLNISRKSLRNFRALLFQIEKDGFEGKRWNGAKNLPPVIWGYANYVAMVNPEKGKPLVAQTDRIFRKYRIRKSDIRPDLARKAALAKKGETSGADEEKPWWKFW

SEQ ID NO: 6039 - protein, 605 aa, unidentified
  source 1..605: note = Related to NZ_JHZA01000001.1; note = Enterovibrio calviensis
MSNEQQNDSPIQDPSPKLTRQELYDRVRRVGKDEYILSEMIRLGFWKRDANKPSLTDTFLQKRSALQSRLRELSKENALYSDPEKALKALHEERKKAALEKRELTKIERNTARYQRAFAWYTKQQTSFTYLGDNVSAGLEDKTSDEEKLVSQALPVFDNAGAVADAMGISTSELRFLCYQKDVSTISHYQDFTINKKSGGVRTISAPMPRMKRSQYWLLDNVLNKLAIHDAAHGFVSGKSIVSNAQPHVKKQVVINLDMKDFFPSVSYKRVKGMFINLGYSEELATTFALLATKRETQALEMDGKTWHVAVGERVLPQGSPCSPAITNVLCRRLDARLLGMAEKLGFTYTRYADDLTFSSDDASKVQALLWRSKQIVSSEGFVIHPDKTRVMRRHQKQEVTGVVVNDGLSVERKTLKRFRAVLRHVEMDGPENKHWGSGELFQSLAGYANFVAMVNPEKGIPLQKAVVHLKRQHNIPTPAGKISALNKKLFRIKAAKGEAPRETWWQPMIKPAPELEFTPAQIQHKKREAMAEQRQLSDASSGTQTEDVDNTASESGKKKRGIGFWIFAVIFSPIILLVAISRTSTTAKIALAASILFWMYYFFM

SEQ ID NO: 6040 - protein, 605 aa, unidentified
  source 1..605: note = Related to NZ_SCHN01000009.1; note = Enterovibrio sp.
MSNEHQSDSPIQDPSPKLTRQELYDRVRRVGKDEYILNEMIRLGFWKKNTDKPNLTDTFMEKRASLRARLRELSAENALYSDPEKALKALHDERKKAALEKRELTKLKKNTARYKKAFSWYMKQQDTFTYLGENVSAGLDDKTSDEEKLISQEIPVFENAGAVADAMGVSTSELRFLCYQKDVSTISHYQDFAITKKSGGVRTISAPMPRMKRAQYWLLDNVLNKLAVHDAAHGFVSSRSIVSNAEPHTKKRVVINLDMKDFFPSVSYKRVKGMFKQLGYSEELATTFALLTTKPATEALDMDGKTWHVAVGERTLPQGSPCSPAITNVLCRRLDARLKGMAEKLGFTYTRYADDLTFSNDDDSQVQALLWRCKQIVSSEGFVIHPDKTRVMRRHQKQEVTGVVVNDGLSVERKTLKRFRAVLKHVELDGPENKHWGSGELFQSMAGYANFVAMVNPEKGIPLQKAVIHLKRQYDIPTPSGKISALNKKLFRMKAAKGETPRDTWWQPPIKPAPELELTPAQLEHKKREAIAEQKRHSGTPTDSKTETQNSDATDSEKKKRGIGFWIFAIVFSPIILIVAMARASTTAKIAFAASLFFWVYYFFM

SEQ ID NO: 6041 - protein, 605 aa, unidentified
  source 1..605: note = Related to NZ_JMIB01000006.1; note = Photobacterium galatheae
MSNSHSNPQTHEPTQDPSPKLTRQQIYDRIRESSKDEYILSEMTRLGFWKPGDSKPSLAEQFVNKRASLMARLHGLSQLDKRYSDPEKALAEMHKARKLAALEKREQTRIARNRAAFEQALAWYQRQKKQFTFLGESVSAGLSQKASDPLRLSTRHLIHFQSVEDVARQMDISTAELRFLCYRKEVSTVTHYQEFELPKKSGGTRVISAPMPRMKRAQYWLLDYVLNLLPVHDAAHGFVPGRSIVTNAQPHVGKAVVINLDLKDFFPSITYRRVKGLFGKLGYSEELATTFALLATKPVTQAVEMDGRTWHVAQGEHVLPQGSPCSPMITNVLCRRMDARLQGMADKLGFTYTRYADDLTFSSQDAGKVQSLLWRCKQIVTDEGFVVHPEKTRVIRRHQRQEVTGVVVNDRLSVDRATLKRFRAVLQQVALDGPEGKTWGAGELFQSLAGYANFVAMVNPEKGLPLQKQVLHLKRQYGFTVPKGKIGELNKRLFRLKVARGQKPRTHWWQPEEKPMPVLALTPKQRQEELEQKRAVVPKKEASVSDVEPEETEAASDEVKLSPFAWVMVVAVMPFALLWMFIKAPIKSKLWVLGIGAVIYWLFFS

SEQ ID NO: 6042 - protein, 603 aa, unidentified
  source 1..603: note = Related to NZ_CP073578.1; note = Photobacterium sp.
MSDSNKHQSAETVQDPSPKLTRQQIYDRIRQSSKDDYILREMIRLGFWKSDKDQPSLTERFVAKRTALITRLRTLTQLDRLYSDPEKALAAMHKARKKAALEKREQTRIARNQTRFEKALAWYQRQREAFTFLGESVSGGLARKTSDPLRLSRYQLMHFQSVAEVAGSMAIPMSELRFLCYRKEVSPVSHYQDFEVAKKSGGTRIISAPMPRMKRAQYWLLDAVLTRIPVHDAAHGFVPERSIVSNARPHVGKAVVINLDLKDFFPTISYRRVKGMFHQLGYSEELATTFALIATKPVTQAVEMDGKIWHVAQGEHVLPQGSPCSPAISNLLCRRMDARLQGMADKLGFTYTRYADDLTFSSDDVSKVQSLLWRCKQIVADEGFVVHPEKTRVMRRHQRQEVTGVVVNDGLSVERKTLKQFRAVLRQVELDGPAGKQWGKGELFQSLAGYANFVAMVNPEKGIPLQKQVVRLKRQYGFSVPKGKMGELNKRLFRLKVARGESPRSRWWQPHEKPAPELALTQQQKAAQRQAAKADSVSPQVVTPAATSETDSETDPTAFSPMMWVMMMLTLPFALLWMLVTASWKTKLWVLSLGYVLYWLFFG

SEQ ID NO: 6043 - protein, 607 aa, unidentified
  source 1..607: note = Related to BMYC01000011.1; note = Photobacterium aphoticum
MRNSDPSQNNSNNNNNSVLPPEPSPKLTRQQIYDRIRQSSKDEYILSEMIRLGFWQKDRTKPSIAEKFIEKRSALLSRLRELTRLNRLYQDPEKALLALHKTRKKAALEKREQIRINHNLARYEKALRWHKKQQTHFTYLGDAGYGDKALTAGLQQTTCDTARLTAHGLPAFSHVGELADAMGISTSELRFLCYQKDVSTVSHYQHFALSKKTGGTRLISAPMPRMKRAQYWLLDNVLNLLPIHDAAHGFIQGRSIVTNAKPHTNKQVVINLDLKDFFPSITYPRVKGIFKQSGYSEALATTFALIATKSDTQAVEMDGQTYHIANGKRELPQGSPCSPAITNVLCRRLDARLQGMAHKLGFTYTRYADDLTFSSDETDKIQYVLWRCQRIVTDEGFTLHPDKTRVMRKHQKQEVTGIVVNDGLSVDRPTLKRFRAVVRQIELDGHYGKHWGTGELFQSLTGYANFVAMVAPEKGIPLQKQVAHLKRQYNIPVAAGKITALNKRLFRLKAAKGEAPREAWWQPAEKPAPVLALTQQQMDAQKQQARQAAKANQANTHSAHPEMAPDHTNPAFISGGNETNTASPNRFGSPVVWTVVVVLLLLKIFVY

SEQ ID NO: 6044 - protein, 632 aa, Vibrio sp.
  source 1..632: note = Related to PIZL01000001.1
MSDSSSQSTSRSNSSNASHQEASVTDSAPKLTRQQIYDRIRESSKDEYILQEMIRLGFWNKDDEQPSLTQEFIERRSELTRKLRELSDLDSLYADPEKALEALHKERKKAALEKREQTRQALNQKRYDRALAWYNQQKETFTWLGDDVSLGLKNKENDDGRLEERELPTFENIAALAGAMGISVSELRFLAYQKDVSNVSHYQRFSIAKKTGGLRHISAPMPRLKRAQYWLLDNILAKLSVHDAAHGFVTGRSIVSNAQPHVGKAVVINMDLKDFFPSISYKRVKGLFQSQGYSEELATVFGLLTTESETQELEMDGQTWFVAQGERRLPQGSPCSPAITNVMCRRLDARLQGMADKLGFAYTRYADDLTFSTDSAEKAQALLWRAKQIVVSEGFTLHPDKTRVMRRHQKQEVTGVVVNEKLSIDRKTLKRFRATLKQIELDGPDGKHWGAGELFASMEGYANFVAMVDAEKGIPLQKTLVHLKRQHGVTTKHGKVTELNKRLLRVKAANGENPKEGWWQPEEKPAPELELTPNQIAERKRAIKRQRNQEQRENQGANSEWQDADFNQDNEANQGDGWSDLESDAKKKWTTREYILGLLFLPIVLVMLFFKAPWNIKCIVVGVLWLLYLYLN

SEQ ID NO: 6045 - protein, 616 aa, Vibrio sp.
  source 1..616: note = Related to CAOA01000064.1; note = Vibrio nigripulchritudo
MSDTSHHSSQSDSQEATLSDSAPKLTRQEIYDRIRETSKDEYILQEMIRLGFWDKDEEQPNLTQEFIERRAELMRKMRELSQLDSLYSDPEKALEALHKERKKAALEKREQTRQARNQERYERALAWYHKQKESFTWLGDDVSLGLVNKESDAGKLENQDLPHFENIASLAQAMGISVSELRFLAYQKDVSNVSHYQRFTIAKKSGGERHISAPMPRLKRAQYWLLDNVLEKLTVHQAAHGFVSGKSIVTNAQPHVGKAVVINMDLKDFFPSISYKRVKGLFRAQGYSEELATVFGLLTTEPEVQELEMDGKTWFVAQGERRLPQGSPCSPAITNALCRRLDARLQGMADKLGFTYSRYADDLTFSTDEPDKVQSLLWRAKQIVSDEGFTLHPEKTRVMRRHQKQEVTGVVVNDKLSVDRKTLKRFRAVLKQIELDGPEGKTWGAGDLFRSLEGYANFVAMVDPEKGIPLQKTLVHLKRQYGIQTKHGKVTALNKRLLRAKAAKGEASRENWWQPEEKPEPELELTPNQKAEQKRAEQSARRAEQRANTESQNVESEQGDGWDELDSDANKVWTPREYVLVTLMLPLVLIHLFFRAPWNVKCIVVGVLWLLYLYLT

SEQ ID NO: 6046 - protein, 592 aa, unidentified
  source 1..592: note = Related to NZ_JAIMJA010000004.1; note = Motilimonas cestriensis
MSESSTKLTRQEIYDKIRKSSKEEYILDEMKRLGFWRNDEEQPNLTQEFVEKRAQLMAQLRELSSQDELYSDPEKALAHLHQERKKAALEKREQVRQTRNKTRYENALNWYQKQQKEITYLGEKFSAGLSEKISDKSKLTSQGLPYFADSQALAQGMGISIGELRFLCYQKEVSQTSHYKKFAIEKKTGGKRHISAPMPRLKRAQYWLLENVLAPVKLHSAAHGFVPGRSILSNALPHINKGVVVNFDLKDFFPSISYARVKGLFCKQGYSEELGTLFALLATEPDTEAVAMDGQIWHIDQGPRILPQGAPCSPAITNILCRRLDARLAGMAEKLGFAYTRYADDLSFSSDEPNKVQSLLWRVKQIVTSEGFLLHPDKTKVMRRHQKQEVTGVVVNEKASVDRKTLKRFRAILHQIDLYGPEGKSWGPGALFPSLEGYANFVAMLDAQKGIPLQKQLVHIKRKYGVKTRSSKVTQLNKRLMRVKAGLGEAPRENWWQPAEKPEPILELTPKQQAAQKQARKVTGPVEQEYAESASEQNPQSEAEEDTKLSTKDYIFIGLFMPIALAQMIYKASWKTKIKLMVVGTIIWLLFG

SEQ ID NO: 6047 - protein, 569 aa, Citrobacter sp.
  source 1..569: note = Related to NZ_CP057483.1
MSESPKLTRQQLYERIRETSKEEVILAEMIRLGFWDGEQKKPDLTAEFIAQRAALEKRLAELGQQQQLYSDPQKALRELHKARKKAALEKREQTRIARNQARYERAQQWHQKQQSEISWLGEGFSFGLSDTTQNEARLKQQNLPLLADSQTLATLMGITINELRFLCFQKDVSRINHYRRFSLLKKSGGERLISAPMPRLKRAQYWILENILNRVKLHDAAHGFVAGRSILTNALPHVGRAVVINLDMENFFPTVSYRRVKGLFRQLGYGEQIATELALLTTEPETEQVVLDGENWFVQQGERFLPQGAPSSPAISNIICRRLDSRLHAMAHKLGFAYTRYADDMTFSCADNRGNVQQLLWRCKQIVQDEGFRVHPQKTRVMRKPQQQQVTGIVVNEKPSLDRKTLKRFRALLFQIAKDGMEGKRWGPGELMASIEGYANFVALVAPGKGIPLQKQVTDIKRQYGYATQPGRITALNKKLFRAKAARGESPRDSWWQAQGPSAPELEQTALQKQALRRAASAAEDVPSAAKNASVPDDFAETPPERPKKSSRLWWWFLAFVVYLIFRWA

SEQ ID NO: 6048 - protein, 567 aa, Citrobacter sp.
  source 1..567: note = Related to NZ_CP011132.1; note = Citrobacter amalonaticus
MSETPKLTRQQIYERIRETSKEEYIQAEMIRLGFWDATQEKPDLTTEFITRRAALEKQLAELGRKQQLYSDPQKALRELHKARKKAALEKREQTRIARNKARYERAQQWHEKQRSEITYLGAGYSFGLDETTHDDARLQQHHLPQLANSQALATAMGITLNELRFLCFQKEVSRINHYRRFSLMKKNGGQRLISAPMPRLKRAQYWILENILNRVPLHDAAHGFVTGRSILSNALPHVNQAIVVNLDMENFFPTVNYRRVKGVFRQLGYSEQIATELALLTTEPEAEQVVLDGENWFVQQGERFLPQGAPSSPALSNIICRRLDSRMHGMANKLGFTYTRYADDMTFSCADKSANVQQLLWRCKQIVQDEGFRLHSEKTRVMRKPQKQEVTGIVVNEKPSLDRKTLKRFRALLFQIAKDGIEGKRWGAGELMASLEGYANFVAQVAPDKGIPLQKQVTDLKRRFGYATRPGRITALNKTLFRAKAARGEAPRDNWWQAQGPSAPVLELTMQQKQAMRRPVSVTSPTSPNNDTPRTVNADAPAHQPARTSVKWWIILIAIILYFLMRK

SEQ ID NO: 6049 - protein, 536 aa, unidentified
  source 1..536: note = Related to NZ_HE578945.1; note = Phytobacter massiliensis
MSESPKLTRQQIYERIRETSKEEYILAEMIRLGFWDASQEKPDLTAEFIAERAALQKKLASLGERQRLYDDPQKALRELHKTRKKAALEKREQTRIARNQARYERAQRWHQTQQSTITWLGEGYSFGLDDTTHNEARLAQQNLPPLADSQALASAMGITLNELRFLCFQKAVSRVNHYRRFSIAKKSGGERFISAPMPRMKRAQYWILENILNRVALHDAAHGFVAGRSILTNALPHVNRAIVVNLDMENFFPTVSYRRVKGLFRQLGYAEQLATELALLTTEPEAEQVALDGENWFIQQGERTLPQGAPSSPAISNIICRRLDSRLHAMAQKLGFTYTRYADDMTFSSADKTANVQQLLWRCKQIVNDEGFRLHPEKTRVMRKPQKQEVTGIVVNEKPSVDRKTLKRFRALLFQIAKDGTQGKRWGAGELMASLEGYANFVALIAPEKGIPLQKQVTDLKRQYGYVTQPGRITALNKKLFRARAARGEAPREKWWQAQGPAAPVLEQTPQQKQPAPQPAPVSSQPEPQSFAARRG

SEQ ID NO: 6050 - protein, 566 aa, unidentified
  source 1..566: note = Related to NZ_CP051548.1; note = Phytobacter diazotrophicus
MSESSKLTRQQIYERIRETSKEEYILAEMIRLGFWDETQDKPALTAEFIAQRAALQKQLAELGQKQRLYDDPQKALRELHKTRKKAALEKREQTRIARNEARYARALQWHQKQQAEITWLGEGVSFGLADTAHNEARLQAQKLPLLADSQALASAMGITINELRFLCFQKNVSRVNHYRRFSLAKKNGGERLISAPMPRMKRAQYWILENILNRVKLHEAAHGFVTGRSILSNALPHVNQAIVVNLDMENFFPTVNYRRVKGLFRQLGYAEQLATELALLTTEPEVTQVALDGETWFVQEDARFLPQGAPTSPAISNIICRRLDSRLQAMAQKLGFVYTRYADDMTFSCAQPSANVQQLLWRCKQIVQDEGFKIHPEKTRVMRKPQKQEVTGIVVNEKPSVDRKTLKRFRALLFQIAKDGMEGKRWGSGELMASLEGYANFVAMVAPEKGIVLQKQVTDLKRQYGYTTQPGRITALNKQLFRAKAARGESPRDNWWQAQEAPPPVLEQTAQQQATQKATSSATEALHFDAQPETHAGQVPDKSRSPLRFFWVLILVLLIMILARMF

SEQ ID NO: 6051 - protein, 587 aa, unidentified
  source 1..587: note = Related to NC_007645.1; note = Hahella chejuensis
MSEEKKLTRQEIYQRIRETSKDEYILSEMVRLGFWPDNSEKPTLSEAFIKKRTELQAALRELGQQQMLYSDPEKALKEMHKQRKQAALAKREETRRKRNEERFQRAQHWREVQAHQITYLGEGVSGGLEDATADEARLRSQNLPIINAAEELATAMGVTLNELRFLAYSKEVSKLSHYQQFAIAKKTGGVREISAPMPRMKRAQYWVLDNILAPLTLHEAAHGFVVERSIVSNAQPHVGKDVVINLDLKDFFPTVSYARIKGAFRHLGYSEQIATILGLLCSQPKTQEVEMDGQKWFVSEGERFLPQGAPTSPAISNVICRKLDRRLQSMAAKLGFTYTRYADDVTFSADGKSDDDVKRLLWRCRSIIKDEGFVVHPDKTRIMRKHRRQEVTGVVVNDKASVERKQLKRFRALLFQIDRDGPAGKSWGRGELFAAIDGFANYVAMVNPVKGVPLQQKVAQLKLKYGVKVKPSRVLALNKKRMRLKAAKGEAPREDWWQAQASAAPELEKTAEQVKEERKAEKAEQQTQAVPAASSADPAPVRTSTPVQSQQQAQPSAPAPEGESHAKTGWIMLAIGILIYLAMKMLG

SEQ ID NO: 6052 - protein, 575 aa, unidentified
  source 1..575: note = Related to NZ_CP020038.1; note = Agarilytica rhodophyticola
MSDGNKLTRQQLYQRIRETSKDEYILSEMKRLGFWPEDSDKPSLAEEFINEKSEISKKLRELGQKQGLYSDPEAALKELHKQRKKQALERREQKRQERNQARYDRASRWYTTQQKLITYVGDHFSKSLNNVESHEDKLKQQGLPVLHSSKDLAGAMGITLNELRFLAYQKDVSAVNHYQHFEILKKTGGSRLISAPMPRLKRAQYWVLANVLEPLSIHDAAHGFVPKRSIVSNAIPHVGKDIVINLDLKDFFPTVTYPRIKGVFHTLGYSEHLATILGLLCTQSNIQEVELDGQTWFVGNGERYLPQGAPTSPNLTNILCRKLDARLNGMAEKLGFTYTRYADDLTFSSDSKDEQQVKKLLWRCRKIVQDEGFVIHPKKTRIMRRHKKQEVTGITVNDKMGVDKKTLKRFRAVLFQIDKDGPDGKTWGNGDIFCAIDGYANYVAMVSPDKGIALQQQVAHIKRKYGVNVKKGKVLSLNKKLLRLKAAAGEHPRQEWWQALPPAKPEKEKTAEEIKQSKVTDQQEKSKDRDNKNHWTQANTNLSQDDKKVSSTGYNMLKIFLFVTALAIAYSFLKN

SEQ ID NO: 6053 - protein, 574 aa, unidentified
  source 1..574: note = Related to NZ_ML660163.1; note = Aliikangiella coralliicola
MSASSPGKLTRQQLYDLIRESSKDEYILSEMIRLGYWNEDSGKPSLPAELIARKGELEREFQALLKKQQQYQDPQKALKELHKQRKAEALKRREETKQNNNEARYQRAVNWHNKNQAEITYLGEDFSAGLQGSFTDRERLTNQELPVIDSSLALAKAMGISINELRFLSFGRKTSKTTHYQQFLIEKKTGGTRRISAPMPRLKRLQYWILGNILEKLPLHDTAHGFVAQRSIVTNAKPHVGADVVVNMDLKDFFPTVTYKRIKGLFCKLGYSEQVATVLALLCSEPEIDEVELDGETFYVARGERYLPQGAPTSPAISNLLCRNLDRRVFGASKKLDFTYTRYADDLTFSGTRKSAHQLRKLLWRVEQIVIDEGFVVHPDKTRIMRKNARQEVTGLVVNQKLSVDRKTLKQFRALLFQIEKDGIEGKVWGKGQLIPSIEGYANFVAMVNPEKGLALQKRVTQIKKQYGFEVKPGKLAALNKKIMRVKATRGEAPREDWWQAEPKPSPVKENTAEQLKAQKKAKAIEKKEAEQSLPEHSTNEQREIENTEDTNNIGTLMIYIAIGLLLIVIFLGS

SEQ ID NO: 6054 - protein, 567 aa, unidentified
  source 1..567: note = Related to JALJPK010000085.1; note = Pseudomonadales bacterium
MQTSAPGKLTRQQLYDLIKQSSKDGYILKEMIRLGFWNETTGKPSLTQEFITRKGELEKQYSQLLSLHHKYQSTESLLKDFHKQRKAKALLNREETKLKNKQIKFEKAQNWFKRNLTEILYLGENVSAGLNGKFTDHDKLKSNSLPVIENFETLAQSIGVSVSEIRFLSYDRKVSKVSHYQQFLIAKKTGGTRKISAPMPRLKHVQYWILTNILEKVAIHDSAHGFVTGKSIVTNAKPHVGADVVINMDLENFFPTVNYKRIKGVFCNLGYSEKISTVLALLCSESDNCEVVLDGQTYYRNQGERVLPQGAPTSPALTNILCRKLDRRMLGMSDKLGFKYTRYADDLTFSSSQQTAHNLQKLFWRVNQIIPDEGFILHPDKTRVMRRNNKQEVTGVVVNEKLSVDRKTLKKFRALLFQINKDGVGDKTWGKGALIPSIEGYANFVYMVNPIKGVALQKAVVLIKQKYGMPVKPHKLSLLNKKLMRLKAKEGLLPKKDWWIPKQKTTPLVELTQKQNEEAKIEHKQQITDDNRNVNILTPQSDKPKSYGYVFYVIAVVIFILFQIFNK

SEQ ID NO: 6055 - protein, 593 aa, unidentified
  source 1..593: note = Related to NZ_CP048878.1; note = Spartinivicinus ruber
MSDQQSTPASPSRLTRQQLYDRIRESSKDEYILAEMKRLGFWDASEDRPSLSESLIIKQGELERELRELLAKQRQLKNPEKALKAMHKQRMKEARDKREVTRQHQAEERYQRSLAWYNKSQQTLSYLGEKVSSRLDSVEAQQARLLDNHLPIIKSYLQLATMMGVSLAELRFLAFSRNVSQVSHYQHFLLPKKNGGTRLISAPMPRLKRVQYWVQANILESVALHDAAHGFVTKRSIVSNAEPHVGKAVVINMDLADFFPTISYPRVKGVFSHLGYGEGIATVLALITTAQTVTPVELDGKQYFVGQGVRHLPQGAPSSPALTNIICRRLDKRILGTAQKLGFAYTRYADDLSFSSEQGEPAKVRQLLWRIKRIVKEEGFAVHPNKTRVMYRHKRQEVTGVVVNDKPSVDRRTLKRFRALLFQIEKDGITGKSWGTKSGKESAALIPSIDGYANYVAMVSPEKGVKLQQQVAKIKQQQGFQVSPKRVMALNRKLFKQKAMKGEAPRDSWWQPAEKQPPVKELTSLQLEAEKQQEKVECSAEQQADKKQPLVEQVQPPVQIHTKPKTQQFQFDKHHYWVIFWIGLLLLLLMIFN

SEQ ID NO: 6056 - protein, 589 aa, unidentified
  source 1..589: note = Related to NZ_SUNB01000001.1; note = Pleionea sediminis
MSEISPGKLTRQQLYDRIRESSKDEYILEEMKRLGFWDESEQPPEAEELIKEKARLRKELNKLLRNKRLMDDPEKALELMHKERKKKALEKRKETKKERIKSAYERALNWFKLNQKEITYLGENTKIEISQTETNEQKLNQQNLPKFVESSELAEAMGLCLSELRFLTYTRDVSKVTHYQRFSLVKKSGGVRHISAPMPRLKRIQYWVKTNILDTLPLHDCAHGFVKERSIVSNAAPHIGQSIVINMDLKDFFPTITYKRVKGLFQQLGYNEKISILFALLTTEPHCDELSLDTETYYVAQGKRLLPQGAPTSPAIANLICRRLDRRISDCAKKLGFEYTRYADDLTFSIKDNDSDKVRKLLWRVKAIIKDEGFNLHPEKTRIMRSHQQQEVTGIVVNEKINLSRKKLKRLRATLFQIEKDGFSGKNWDDSKDILRSLTGFVNYYAMVDPAKSVKYKEQLKRIIQKHPYEISKTPFIGKLKKSVFIEKSKQGLSPWDDWWQPVEKTEPELILPKENEKQDSRRKATDSIESTSSSQSNRGSTRNRSSELPELIGKGFFTVTLIIIAVALAKVSPLILLLAGYLIYRLWK

SEQ ID NO: 6057 - protein, 580 aa, unidentified
  source 1..580: note = Related to CP059265.1; note = Candidatus Thiothrix singaporensis
MSQLTRQQLYDQIKAXPKDEYILSEMKRLGYWKEAEQPTLAESIIQRRGELQRQINALSSQASDPAAALKAIHQERMAAARQQRIDTKVKRETARYQRALAWHERRQQHIHYLGDAAGFQPSAAADVADAERLRSLNLPVLSNAAELAAAMGVTLNELRFLTYSNQVARICHYQHFAIQXKSGGVRLISAPMPRLKRLQYWVLDNILQPLELTEQAHGFVKGRSIVSNARPHVGXKVVINMDLQDFFPTVTYPRILGTFAQLGYNREVAALLALLCSEPDTQIVEMDGKRYYLNQSTRRLPQGAPTSPALSNVICRRLDRRLQGLAHKHGFTYTRYADDLTFSGDDSTAIRALLHWRATVTEEGFNPHPDKTRIMQQGRRQEVTGIVVNQQLSLERQALKRFRALLFQIEKDGYAGKSWGNGCNLLASIKSYAHYVRMVHPEKGERFLAQIAVIQQKHGKPDGNGRAWGRTTDTFRARSAQGQAPLDGLRVAPVRPAPQLEQLIQHRDVLPQVQAALGLQPVAEATSTDISPSASTEGQAAGESSGGLVSTLLSFYGGDKHAIDPAHNPAFSGRLFRQSL

SEQ ID NO: 6058 - protein, 556 aa, unidentified
  source 1..556: note = Related to NZ_FNQP01000009.1; note = Thiothrix caldifontis
MSQLTRQQLYDKIKETSKDEYILSEMQRLGYWKEDAQPTLAASLIKRRGDLQRQINALSSQITDPQAALKAIHQERMAAARQQRIDTKVKREVDRYHRAQAWHEKQQNHIHYLGDAAGFKPSAAADVSDAERLNSLGLPVYSNAAELAAGMGITLNELRFLTYSNQVSRVCHYQHFAMQKKSGGTRLISAPMPRLKRLQYWVLDNILQPLELTEQAHGFVTGRSIVSNAQPHLAQKVVINMDLKDFFPTVTYPRIKGTFAQLGYNNEVASLLALLCSEADTQTVEMDGQRYYLNSTSRRLPQGAPTSPALSNVICRTLDKRLQGLATKHGFAYTRYADDLTFSGTDTAAVPALLYGAKATVTAEGFNVHPDKTRIMKQGSKQEVTGIVVNQHLSVDNKKLKQFRALLFQIDKDGYGDKSWGNGYNILASIKSYAHYVRMVNPEKGSQFLQQIAAIQQKHGKPNVAMKFSTTQFRERAAQGKLPLDAMHVAPIKPAPTLDDTIQHRDVLPQVEAALGLSVPEAVETEPESTPATTPETPNQPQGLVSTLMSLLRGKS

SEQ ID NO: 6059 - protein, 559 aa, unidentified
  source 1..559: note = Related to SSFA01000023.1; note = Thiothrix sp.
MTNLTRQQIYDQIKATSKEQFILSEMQRLGYWPNPEAPTLHSELIKRKTQLQQGIRELSQQVDDPQAALKQLHKTRMAEALAKREQTKINRELKRYEKALSWHERRQNQLDYLGDAAGYKPSPNPQDSHSQTLLHYHLPVCSTGKELAALMGVTLNELRFLTYTNQVSTVQHYQQFALAKKTGGTRLISAPMPRLKRLQYWILEQVLQPLALTDQAHGFVQGRSIVTNARPHLGQAVVINLDLKDFFPTITYPRIKGVFEQLGYNHEIATLFALLCSEPITQTVELDGQRYYLAQNPRRLPQGAPTSPYLSNLITRQLDKRLQGLAQKYGFVYTRYADDLTFSSASTEAPTCGLLHWIKAIVQEEGFQLHPDKTRIMHKGRRQEVTGLVVNQQLNIERQTLKQFRALLFQIQKDGYVGKSWGKNRNLLASIKSYAHYVRMVNPVKGEQFLQQIAVIQQTHGVPAQTLKYSTQDFRQRSAQGQLPLATMQIAQASHKPQLEDIIQYSEVIEQIRAELKLAPPQTSLNTETSPPYPPPISEPASLIHNVISLFSGLFRGKL

SEQ ID NO: 6060 - protein, 576 aa, unidentified
  source 1..576: note = Methylococcaceae bacterium; note = Related to JAKIVF010000151.1
MTQLSRQELYDKIKETSKDEYILSEMQRLGYWKEGEKPSVAETLIKKKAELQTEINKLSREIKDPKEALKAIHKQRMAEARQRRIDTKVKQELKRFKSAEEWHKRKQNKIEYLGNACSTNSKSDETAKNTNSDKLRLHQLPTCSTAIQLAEAIAITLNELRFLCYTNEVSKITHYQRFGIHKKTGGVRLISAPMPRLKRLQYWVLDNILQKIPLSNNAHGFVPLRSIVTNAQPHVGKKVVINMDLKDFFPTVGYPRIKGLFANQGYGEEVSILLALICSEPDTQTVEMDGQRYYIHSKERFLPQGAPTSPAISNIICYRMDKRLQGLAKKYGFVYTRYADDLTFSSQDIDKIMPLLNWVKATVTEEGFVVHPEKTRIMHQGVRQEVTGIVVNEQLSVNRKHLKQFRALLFQIKKDGYGNKKWGKGGSLLPTLKGYAHFVKMVNPLKGQQFLTQIQEIIQLHGYPNETPKQGRSTSDFRKAAAQGKLPLGSMQVAQPTLPPDINKMIQHRDVLDLVREELGLPALEDPKQKKETGSSDKPMVQPLTAEDENRSHVNENDINSSGFFSRIKSLFGGDK

SEQ ID NO: 6061 - protein, 562 aa, unidentified
  source 1..562: note = Aquificaceae bacterium; note = Related to QOAQ01000092.1
MTQLSRQELYDKIKETSKDEYILSEMKRLGYWKEGDKPSVAATLIKRKTELQTEIYKLSREIKDPKAALQAIHKQRMAEARQRRVDTKVAYELRRYQRATDWYQRKLSTIDYLGSACVLTQEKKQKIKVLDTAKLARYQLPNISTAKELAEQMGVTLNELRFLCYTNEVSKITHYQRFGIHKKTGGTRMISAPMPRLKRLQYWVLDNLLQKIPLAEQAHGFVPSKSIVTNAKPHIGKKVVINMDLKNFFPTVSYPRIKGVFLSQGYNDEVATLFALICSEPETQTVEMDGQRYYIHSKQRYLPQGAPTSPNISNIICYKLDKRLQGLANKYGFVYTRYADDMTFSSNDASKVKALLNWVKATVTEEGFIIHPEKTRIMHQGARQEVTGLVVNEKLSVSRKQLKQFRALLYQIKKDGYDGKQWGKGGSLLPTIKGFAHFVKMVNAEKGEKFLANIKEIIDLHGYPDADKKQNKTSDDFRKAAAQGKLPLNSMRIATAPPPPDINTMIQNTDVLDLVRKELGLSENNPETTNDTAISSAQSEDNREEGSAGFLARLKTFLGGEK

SEQ ID NO: 6062 - protein, 528 aa, unidentified
  source 1..528: note = Related to JADMKE010000002.1; note = Candidatus Sericytochromatia bacterium
MGLSRQELYEQIKASSKEGYILAEMQRLGFWTESEPQPARELIARKAEIQQEIASLSAKIKDPEAALKLIHKQRMAAALEKRLQTRIKRELKRFQSAHLHHQNKQKKLITLGDAAHFGPKQQATQSEKLQAYKLPEIDTALELAEHAGITLNELRFLTYSRRVSKLSHYQRFEMAKKTGGTRLISAPMPRLKRLQYWILEHILNPLPVTPAAHGFVPQKGILSNARPHIGKKVVINLDLKDFFPTISYPRVKGLFLSLGYGNEVATLLSLLCTEAESQQVEIDGQRYFIAADQRRLPQGSPCSPAISNQICKRLDKRLAGLAQKWNFAYTRYADDLTFSADSSQYLGALFKGLRQILKAEGFVLHPDKTRIMHQGARQEVTGLVVNQGLSVSASTLKRFRALLFQLDKDGLNGKTWAGHSSTEPGFLERLQGFAQYIRMVQPEKGQKLCAHLQAIRQKYPDTGLLSAHSTLPKGKKTAFRQKSANAELPLPGQRVAPVPPPPRLAETILDRGILAEVEAAWQAQGGQV

SEQ ID NO: 6063 - protein, 554 aa, unidentified
  source 1..554: note = Related to CP002831.1; note = Saprospira grandis
MQLLSILDQLGFGLSSPKLKVVFFCLNLLPMSDHRMTRQQIYDRIRQTSKEEYILEEMKRLGFWDTTEEAPKISEELIQKKGALRRELRELMEKQRMFRDKERMLAEMRKKRMADALARREETKERRKAEKEARAKAWQEKKERSIVFLGKDYSAGLSEEEADLAKLAALNLPAFKDIKELAEAMDISVGRLRYLCFQRKLSTVSHYERFYLAKKTGGKRLISAPRPMLKNAQYWLLENVLARLEMHEAAHGFVPERSIVSNAKLHEKKELVINMDLKDFFPTVTYPRVKGMFKGLGYSEQQSIIFALLTTEPEVDQVEIDGQLYYAQKGERYLPQGAPTSPAITNWLCRRMDRRFEGVAKKLGWTYSRYADDLSFSANDTSNISRIIWQAQQIIQDEGFVIHPKKLKIMRKGRRQEVTGLTVNEQVAVDRKTLKKFRACLHTIETKGYQAAEWGQGFILASIKGFANYVRMVQAEKGQALCEQVDRILAKEENKQAWKAYFANPSRKKYAYEAQKQQATIEANAVDFGSSGLAESLTPVDPQQKDEEQWWSLW

SEQ ID NO: 6064 - protein, 500 aa, unidentified
  source 1..500: note = Related to JABWAJ010000099.1; note = Saprospiraceae bacterium
MTRQEIWDRIKELGGRDEFILHEMKRLGFWDVSEGVPQLSESLREQRKSLEGELKEALQQQAVYKNKKKMLRDMRQKRMAEAKARRVETKERRERQRAEKAAAWAEAQQQDIGWLGPAVSAGLQQKESNVPQLESFGLPVFNGVKGLAEAMNLPLNELRFLAFDRQVSRTCHYQRFKVAKKTGGFREISAPAPRLKKAQHWILDHLLYKLQLHEAAHGFVPQRSILSNALPHVGAQVVINMDVKDFFPSVSYRRVKGVFQSLGYSEQLATILGLICTEPQTDEVTLDGQRFFVAKGDRRLPQGAPTSPAITNILCRGLDRRFEGMAKALGWTYTRYADDLTFSKKATDARDVNRVLWQARQIVENEGFVLHPDKIKVMRKGTRQEVTGVVVNEKPNVSRAKLKQFRAVLHRIETQGLSAADFGKGQVLESIQGFANYVWMINPEKGAALKAQVKNILAKPELQQVLAQKNTYPEKGKVAIFTPYKDKEVQPLSTDWWRLW

SEQ ID NO: 6065 - protein, 517 aa, unidentified
  source 1..517: note = Related to CACVAP010000086.1; note = Sulfurovum sp.
MTRQELYDEIKKTSKDSYILSEMKRLGFWDSAKPKVAQELIEKKTALQKELNGLSTKIRNPEAVIKDIHKQRMADALLRREETKAKKEKIFQENLAKRQEKKNSELGFIGHAFMADLDEKESNQKLLNENNLFLIKDAKDLASKMGITLKELRFLTHTQKLSNRTDYVHFKMVKKSGGFREISAPKPQLKRLQYWILENILNKVAVSNEAHGFVAKRSIVSNAKPHLQKALVINCDLENFFPTLSYARVKGLFKSLGYSVELATILAILTTEAEQKEVLLDGEKLYLYTGKRYLPQGSPASPMITNLICRKLDKRMSGISKSLDFNYTRYADDMTFSSDTYLNINKMMFWIKGIVKEEGFILHPKKTKIMKKGARHEVTGIVVNEKLSVNRKNLKKFRALLYQIEESGLEGKRWQGKSENLMASVWGYANFINMVDPEKGAKYKKQVEVLLEKYPLGNLGSSSGEFRAKSAKGEQPWESKVQEIEAKTLEPEMQVKEVAEQKETPSFVNNILSMFRK

SEQ ID NO: 6066 - protein, 520 aa, unidentified
  source 1..520: note = Related to CACVAX010000056.1; note = Sulfurovum sp.
MTRQELYDEIKKTSKDSYILTEMKRLGFWDNAKPKMPEELIEKKTELQHELNQLSTKIKNPASVIKEIHKQRMADALVRREETKAKREAQAQKKAKERAEKKENKLGFIGHSFIHDDETSAKLELLVTNNLFLIKDAKDLANKMGIDLKALRFLTYTQKLSRQSNYVHFKMAKKTGGFREISAPKPQLKRLQYWILENILNKVAVHEKAHGFVTNKSIMSNAQPHIGKAVVINCDLENFFPTLDYGRVKGLFKSLGYSAEVATILAILTTEAQQKEVTLDGEKLYLYTGKRYLPQGSPASPMITNLICRKLDKRMSGIADSLAFTYTRYADDMTFSATAYQNINKMMFWIKKVTKEEGFILHSKKTKIMKKGACHEVTGIVVNEKLSVNRKELKKFRALLYQIEQHGLEGKSWQGKTENLMASVLGYANFINMVDPVKGADYLKRVKALLQKYPMPSLGLSDKTFRIKSAEGKQPWESKPVFLVTEETRVVSSKELGEEASKTTLENPSFLNNILDMFRK

SEQ ID NO: 6067 - protein, 521 aa, unidentified
  source 1..521: note = Campylobacterales bacterium; note = Related to DQOI01000098.1
MTRQELYDEIKKTSKDSYILSEMKRLGFWNNSKPKVATELIEKKTKLQQELNQLSTKIKNPEAVIKDIHKQRMADALVRREETKAKREAKEQEAIKNRREKKENNIGFIGGSFISDINEQEANTELLKSNNLFLIKDSRDLANKMGINLKQLRFLTYTQKLSNRTDYVRFKMAKKTGGFREISAPKPKLKRLQYWILDNILNKVEVSEQTHGFVVKRSIISNATPHINRAVVINCDLQNFFPTLSYPRVKGLFKSLGYSAEIATILAILTTEAEQKEVVLDGEKLYLYTGKRYLPQGSPASPMITNLICRKMDKRMQGIATTLNFTYTRYADDMTFSANEYPNINKMLYWVKGITKEEGFTLHPEKTRIMKKGSCQEVTGVVVNEKASVNKKELKKFRALLYQIEQTGIEGKSWHGKSENLVAVIWGYANFIKMVDSEKGAKYMAQVKAIMEKYPSLNITSTTNEFRVKSAKGEQPWEDEIIEEIEEVTEVVTDQTKTNVQEKEVPTTPSYINNILNMFRK

SEQ ID NO: 6068 - protein, 629 aa, unidentified
  source 1..629: note = Related to NZ_QGKL01000042.1; note = Leucothrix arctica
MFNSAPGQLTRQELYDKIRETSKDEYILAEMKRLGFWESDDDKPEVPETIIKRRGELQRQLNDLLKQQRLYSDPEEALKALRKERMQAALQKRVETRKKKADERHERALTWHEKQQHTISWLGEAVSLGLTAPTADSNASHQGSTTSLSSDQAVSAHGANTQNEAVNNASGMKHQDLPTFDNHKALAESIGITLNELRFLSFQRSTSKVSHYQHFQIAKKTGGFREISAPMPRLKRAQYWVLDNILCHVPLHEAAHGFVAGRSILTNAKPHVGQAVVVNLDLQNFFPTISYRRIKGLFHKMGYDESIATVLALLCSEADTQKMELDGEQWFVQQGEQHLPQGAPTSPTISNIICRSLDVRLQGLAKKHGFNYSRYADDMTFSGDKTARESLRKLLWGVQAIVADEGFILHPDKTRIMNKGQQQEVTGIVVNDYPSIDRKTLRRFRALLHQVEQTGIQGKSWNGVSEPEHLLRSMLGFSNFVAMVLPEKGEAFKQQAKALYEKHSNKVGTKTIGQLRKAEFRKRAAAGQAPWESWKEAPVKIAPVREKTVDELQEERNQVLAERREAKKIEKEQQDRQRSRRGGFPGASRSDSRREDDRWNLPEDSSGDNGPNVIIRFLGFIGSLFTGKK

SEQ ID NO: 6069 - protein, 559 aa, unidentified
  source 1..559: note = Proteobacteria bacterium; note = Related to PDPH01000009.1
MSNSNSRQQWYDRIRASSKDAVILAEMKRLGFWQDTDVPTLSETIIQRRSELQSELSRLYHQKNLYQHPEQALKAMRKQRMQKAREQRALTQRKQAELRQQRARNWYEQHQNGIVWLGEGISAGLQDLSSDIERLQAHDLPVLHSPKMLAEAMGITLNELRFLAYQRKTSRINHYQRFQIVKKTGGLRDIAAPMPRLKRVQYWLLDNILHKLALHNAAHGFVLGRSIISNAQPHTAKALVINLDLENFFPSIRYARVKGLFKSLGYSESLATVLGLLCTEAAVDEIILDGETWFVMRGERHLPQGAPTSPMISNLLTRSLDRRLQGIATKYGYAYTRYADDLSFSCEKPYTANVTRLLWAVRQTVQEEGFKLHPDKTRLMHQGRRQEVTGLVVNQHLSLERKTLRRFRALLQQIEHTGWQGKHWNGVTDPIRLQQFVWGYAHFVAMVLPDKGAQFKAQLNRIQHIHFGGVVNKKYQSAQNSKAQFRVLSAKAQAPLVSWKQAQARPLVLLETIQQPLAQTQHEPVEQAASGIIEQQSAVTEVKQAPLAGLVAWLRSLLR

SEQ ID NO: 6070 - protein, 634 aa, unidentified
  source 1..634: note = Related to PTEU01000001.1; note = Ideonella sp.
MSERTPTRAELLARIAQSSKDAVVLAEMQRLGFWPKDTTQPTLEAALIEREAELAQALNGLQEELRVKGDPQAALKAMRQERMARAREQREAHAQAREQQRYERALRWHQARTQQAGFLGLGVSGGLQAEADPAACAARLERHGLPVLNTALELAEAMGLSVPELKFLCFHREVATTTHYRRFNLPKKTGGVRTISAPMPRLKRAQYWVLDQVLAKVACHEAAHGFVPGRSIVSNAAPHCGQAVVINLDLKDFFPSIHFPRIKGVFKGLGYGEAVASMLALLCSENACDELEVDGERFFVGGKGRDRVLPQGAPTSPMLTNILCRKLDRRLQGLAQKLGFTYTRYADDLTFSASDEGAARVGSLLRQVHHVLRSEGFTPHPDKQRVMRQGARQEVTGVVVNAKPSVSRTERRKLRAALHRANTQGLGAATWQGQPATNEVLTGYARFVRMVSAQQGQPLLQQALALPSAKTAATAARGNSFRQRATQGQAPLRQQGGEWWQVIPPPVPQLALTAGQIKAARQERLNAERAARQSALQAQRLADGNSSASRPSAASTGASAAEHTEHQNTAAPVAWWRFFFQLFIIIKLAASFKSALVLMLGALILGQALMTRSLGWGRFALTVIVLALVGSLLR

SEQ ID NO: 6071 - protein, 633 aa, unidentified
  source 1..633: note = Related to NZ_JAGQDG010000004.1; note = Ideonella paludis
MTERTPTRAELLARIALSSKDAVVLAEMQRLGFWPKDAAQPTLESALIQREAELQQALNELQDELRVKGDPQAALQAMRQARMARAREQREAHAQVREKARYERALRWHQARDTEVGFLGLGVSGGLQADADPAGTTARLVRSGLPALSTPLELAQAMGLGLPELKFLCFHREVARTTHYRRFDLPKKTGGVRTISAPMPRLKRAQYWVLDQILVKVPCHDAAHGFMPGRSIVSNAAPHCAQAVVINLDLKDFFPSIHFPRIKGVFQGLGYGEAVASLLALLCSENVCDELEVDGERFFVGGKGRERVLPQGAPTSPMLTNILCRKLDRRLQGLADKLGFTYTRYADDLTFSASEEGATRVGSLLRQVHHVLRSEGFTPHPDKQRVMRQGARQEVTGVVVNAKPSVSRTERRKLRAALHRAKTQGLAAATWQGQAASRDVLVGYARFVRMVSAPQGQALLQQALALPGTAPSAAAARADAFRVMAAKGQAPQRRQGAWWQPTPPPLPQLALTAQQVKTARQERLNAERAARQAAKRPAAPAQGRDANTQAPGMSHTQGHTPDAPTTSAPPVSWWRFFLQLFILIRVAVGLKSALFLMLGALCLGHALMTRRQGWIRFALTLVILAVLSSFTKL

SEQ ID NO: 6072 - protein, 634 aa, unidentified
  source 1..634: note = Related to NZ_QUSW01000004.1; note = Proposed Albitalea terrae
MSERVPTRAELLARIALSSKDAVVLSEMQRLGFWPQNATQPTIEAALIEREVELQKALSELQDELRVKGDPQAALQAMRKERMARAREQREANAQARERQRHERAMRWHEARKTEAGYLGDGVSGGLQVDAEAAAVKARLQSRNLPALSTPLELAQAMGLTLPELKFLCFHREVARTTHYRRFSLPKKTGGVRTISAPMPRLKRAQYWVLDNLLAKVPCHDAAHGFLPGRSIVTNAAPHCAKAVVINLDLKDFFPSIHFPRIKGVFQGLGYGESVASLLALLCSENACDELEVDGERFFVGGKGRDRVLPQGAPTSPMLTNILCRKLDRRLQGLASKLGFAYTRYADDLTFSAPAESADKVGRLLRQVHHVLHDEGFTPHPDKQRVMRRGARQEVTGVVVNAKPSVSREERRKLRAALHRAGQQGVEAATWQGHAATRDVLVGYARFVKMVDARQGQPLLQQALALPGANASLAAGKPDVFRIQAAKGEAPARKQGAWWQPAPSPEPQLALTAMQIKTARQERLNAERAARNEAKRQEQIARGEAPAPRRPQPSAEAMASAAQMTGAVHKPIAWWRYAIQLVIVIRLAVGLKSPLVFMLGMLWVGYAVMTRQLGWWRFAIAILGIAILGSVLNV

SEQ ID NO: 6073 - protein, 628 aa, unidentified
  source 1..628: note = Burkholderiales bacterium; note = Related to RXJW01000018.1
MSERMPTRAELLARIAASSKEDVVLAEMRRLGYWPGEAGQPVIQAALLEREAELQQALSALQEELRVKGDPQAALQAMRRERMAQAREQREARAQARERERYERALRWHERRKMEAGYLGPGVSGGLGAEVDPEAVKARLAAAGLPALTTPSELAQAMGLSLPELRFLCFHREVARTTHYRRFQLPKKTGGVRTISSPMPRLKRAQYWVLDNLLAKVPSHAAAHGFLPGRSIVSNAAPHCGQDVVINLDLKDFFPSIHFPRIKGVFRGLGYGDAVASLLALLCSENVCDELSVDGERFFVGGKGRERVLPQGAPTSPMLTNLLCRKLDRRLQGLALKLGFSYTRYADDLSFSAAGDAAQRVGRLLRQVHHVLRDEGFTPHPDKQRVMRRGARQEVTGVVVNDKPSVSRAARRQLRAALHRAGRQGVQAATWQGEAATRDVLVGYARFVHMVNAAQGQPLLKQALALPGASSHAPRPDAFRAQAVKGVAPARRSGPWWEVVPAPEPQLALTAGQMQAARQARLNAERAQRSGKPAVAPSAQPATATPGARPVARPAPVAEQPVPWKRYGLQVFGYAFMALVLHSAAFLFLALIWHSQSLKKRDLGWGRFGLGVFVLSIVAVMLKGLLAR

SEQ ID NO: 6074 - protein, 638 aa, unidentified
  source 1..638: note = Related to SCTF01000217.1; note = Aquabacterium sp.
MSDRIPTRAELIARIMLSSKDAVVLAEMQRLGFWPADAGKPTLESALIQREVELEQALQGLYAQLRVKGDPEAALKAMREERMARAREQREATAQARERRRFERALRWHEARKTDIGYLGAGVSGGLQPPPAAAPARTLQPGLPPLASPLELAQAMGIALGELKFLGFHREVARSTHYRRFTLPKKTGGERTISAPMPRLKRAQYWVLDNILAKVPCHDAAHGFLPGRSIVTNAAPHCARAVVINLDLKDFFPSIGYPRIKGVFQGLGYDERVAGVLALLCSENACDELEVDGERFFVGGKGRDRVLPQGAPTSPMLTNILCRKLDRRLQGLADKMGYTYTRYADDLTFSAPPEAADRVGRLLRQVDHVLHDEGFTPHPDKQRVMRAGSRQEVTGVVVNQKPSVSRDERRRLRAALHNAQRNGIEAATWQGRPATRETLVGYARFVQMVDAHQGAGLFAQALALPGGAHAARPARAGAFRRSAAQGQAPALARGAWWQPAERPAPRLAQTAGQMKAARQERLNAERAERNAAAKPARDAAREEARRHEQQERRAAQRAAAETARQSLRQQPALTWRHWLQYAIQLYIVIRVATGMKSAVVFAAGMAWVGYSMMTRKTGWLRFIVAMVVIALVGAMIRL

SEQ ID NO: 6075 - protein, 628 aa, unidentified
  source 1..628: note = Related to VOBQ01000016.1; note = Caenimonas sp.
MSAPQPTRAELLERLRKSSKDAVILEEMQRLGFWPAGSGAPTVEEAMIQREVELAKALEQVRSQLGTRTDPESALKQMRKERMAEARARREANAQAREQRRLDNALRWHERSGQEIAYLGDQVSAGLYPGHAAVRPERLARHGLPLFETPLQLATAMGVPLAELKFLGFHREVARTSHYRRFRLPKKTGGERTISAPMPRLKRAQYWVLDNILARVPVHAAAHGFVPGRSITSNAAPHCGQAVVINLDLKDFFPGVAFPRIRGVFRGLGYGEDVATVLALLCSENPADELVVDGELFFVGRKGRDRTLPQGAPTSPMLTNVLCRKLDRRLQGLAGRFGFAYTRYADDLTFSAPPEGSASVGRLLRQVHHILHDEGFTPHPDKQRVMRSGARQEVTGVVVNREPSVARSSRRRLRAALHRAQKSGVAQAHWEGAPANAGQLQGHAQFVRSVNARQGAPLVAQARMLVRSPHTLAAAGSGAAFRQRAAAGQAPMRPGDRAWWSPAAKAAPQLQLTQEQKKAERAERRARRRDEARAAAQPARGERAAGAGPGPFTTPPEIPISWWRFGFQLFFVLWFASATRSSLVFMGGAAWFGWSLAQRRQGWPRFLLGMLIVFLASVVIQGFWRHRY

SEQ ID NO: 6076 - protein, 621 aa, unidentified
  source 1..621: note = Related to CP015118.1; note = Rhizobacter gummiphilus
MSERVPTRAELLARIQASSKDAVVLAEMQRLGFWPAGSGTPTLEAALIEREVELTKALDGLHAELRVKGDPEAALLAMRKERMAQARERREATAQAREQRRFERAQRWHEARKTDAGYLGAGVSAGLQAPAAEGRALAPGLPPLASPLALAQAMGIALPELKFLCFHREVARTTHYRRFTLPKKTGGERTISAPMPRLKRAQYWVLDNVLAKVPLHGAAHGFVPGRSIVSNAAPHTGKAVVINLDLKDFFPSVTYPRIKGVFRALGYGEHVATTLALLCSENAADELEVDGERFFVGGKGRDRVLPQGAPTSPMLTNILCRRLDRRLKGLAAKLGFTYTRYADDLTFSAAPEGTTQVGQLLRRVHHVLRDEGFTPHPDKQRVMRASSRQEVTGIVVNEKPSVSRTERRRLRAALHTAQRKGLEAATWQGQPATRDTLVGYARFVQMVDARQGAALLPRALALPGSAAAVSPFPSRFRRQAAKGEAPTLASGTWWQPAEPAAPTLALTAGQVKAARQERLNAERAARRADAEAEVERMSATEDVAHGEDADDTPTTAQPPIRWWSLAIQFFLVVQLASGAKSAIVFTLGIAWLVFSLVTRKTGWWRFVFAMMCILAIVAGLK

SEQ ID NO: 6077 - protein, 657 aa, unidentified
  source 1..657: note = Related to NIOE01000004.1; note = Mitsuaria noduli
MSDRVLTRAEIIERIRASSKDAVVLEEMQRMGFWPAGDGKPGIEAALIEREIELTRALDEVQATLRTHSDPEAAMKAMREQRMAESRARREATAQAREQRRHERALRWHAARRTDAGYLGAGVSGGLQSPAADAIHTTDATGVTGEPGAKPRALLDGLPALATPLDLAGAMGLTLPELKFLCFHREVARTTHYRRFLLPKKTGGQRTISAPMPRLKRAQYWVLDQLLAKVPCHAAAHGFLPGRGIVSNAAPHTGRAVVINLDIQDFFPTITFPRIKGVFRGLGYDERVATMLALLCSENPCDELEVDGERFFVGGKGRDRVLPQGAPTSPMLTNVLCRKMDRRLQGLADKLGFTYTRYADDLTFSASGEGAAKVGTLLRQARHVLLDEGFTPHPDKQRVMRAGSRQEVTGVVVNEKPSVSREERRKLRAALHKATRDGVEAATWHGHPATREVLVGYGRFVAMVDRQQGATLLKQALALPGGSAKKRSAFGALFRKKAAEGEAPTLARGAWWQPADRPEPVLQQTAAQIRAARQERINAARTERRGGAAPKPDQYQQRRQEQSNRAAENAARWSAATSAASGAAPRAGHPINWGLYARQFGVMTLAAFLIASWLVFFGGLAHLALRIKTRSTGWGEFWIGLILLIAAAVKFFPHSTA

SEQ ID NO: 6078 - protein, 638 aa, unidentified
  source 1..638: note = Related to JACHYU010000002.1; note = Mitsuaria sp.
MSDRVPTRAEIVERIRASSKDAFVLEEMQRLGFWPAGEGKPSIEAALIQRELELMKALEDMQQELRSHSDPEAALKRMREERLAQARAKREATAQAREQRRHERALRWHEARKTDAGYLGEGVSGGLRPAAAGAPARPLADGLPTLATPLELARAMGLTLPELKFLCFHREVARTSHYRRFLLPKKTGGQRTISAPMPRLKRAQYWVLDQVLAKVPSHAAAHGFLPGRSIVTNATPHAGREVVINLDIQDFFPTITFPRIKGVFRGLGYDERVATMLALLCSENPCDELEVDGERFFVGGKGRDRVLPQGAPTSPMLTNVLCRKMDRRLQGIADKLGFAYTRYADDLTFSASGEGAGQVGTLLRQVRHVLKDEGFTPHPDKQRVMRAGSRQEVTGVVVNDKPSVSREERRKLRAALHKASREGVEAATWQGQPATREVLVGYGRFVAMVDREQGAPLLKQALALPGGAAKRRSAFGALFRQKAAAGEAPVLARGAWWQPAEPPEPVLQQTAGQIKAARQARLNDERTARRGGKPPAPSRADQRRAEQAQRLADHEAQRAARRSAGAAPGAAGADRPWLLYVKQFALLLGIAAGLKSELILYAGVIHLLLRIKSRDRGWWEFWLGIGLLVLVNALLFRR

SEQ ID NO: 6079 - protein, 647 aa, unidentified
  source 1..647: note = Related to NZ_JACHXO010000001.1; note = Roseateles terrae
MTERMPTRADLIERIRTSSKDAVVLQEMQRLGFWPQGEAQPTLEAALIEREAEVTQALQGLQERLRVIQNPEAALQAMRKQRMQESLIRREAAAQLREQRRHERALRWHEARKTQVPYLGAGVSGGLSLPTAQAPARALQAGLPSLDTPMALAQAMGLTLPELKFLTFHREVARTHHYRRFLLPKKTGGHRTISAPMPRLKRAQYWVLDNVLAQVPCHAAAHGFLPGRSILTNAKPHVGQDVVINLDIQNFFPTITFPRIKGVFQGLGYPEPVATMLALLCSENPCDELVVDGEAFFVGGKGRDRVLPQGAPTSPMLTNVLCRRMDRRLQGLAHKLGFTYTRYADDLTFSGSGEAAALVGKLLRQVRHVLKDEGFTPHPAKQHVMRAGARQQVTGVVVNDQPSVSRQERRKLRAALHRARHQGMEAATWHDQPATREVLLGYSRFVAMVDAAQGAPLIAQAMRLPGPAAPPRSGDAAAFRTKSAEGQAPQLKRGSWWQPAERPAPVLQLTDAQRKDARRDKRAAALGQPSPAAVGGAPSRAAVASAGLAGTPVPGATGGASAASARGAADAAHPANATKLPPPPWAQYGFQSSLLLFLWIAGVSSFVVVGGFAHMAFRFKKREGGWNGFWTGLGVLLLIQWLVRALT

SEQ ID NO: 6080 - protein, 623 aa, unidentified
  source 1..623: note = Related to LMDI01000056.1; note = Rhizobacter sp.
MTARQPTRAELIERIAASSKDAVVLDEMRRFGFWPADAGKPSVEAALIEREAELVQALNRLQAVVRERGDPVAALKAMRKARMAQARERRETTAQAREQKRHERALRWHAARASHAGYLGQGVSGGLQAPTDAEAALARLREGGLPLLATPQALAEAMGLSVPELKFLSFHREVARVTHYRRFALPKKTGGERIISAPMPRLKRAQYWVLDNVLAKVPCHAAAHGFLPGRSIVTNAAPHAGQGVVINLDLKDFFPGVAYPRIKGVFAALGYPEAVATVLALLCSENVSDTLEVDGEPFHVGGTARERVLPQGAPTSPMLTNILCRRLDRRLQGLAAKLGFRYTRYADDLTFSASGDGEALVGRLLRQVHHVLKDEGFTPHPDKQHVMRRGARQEVTGVVVNDGPSVSRTQRRALRAALHRAGTAGGGQATWNGTPASRDTLLGQAQFVRMVNATQGGKLVTAARALPVGGEAVRPRAADTFRQRSARGEAPLRAEGAWWVPAPRPVPQLQLTAGQIQAQRQAARQARQQAARATEPAPAATETATETATAEGDTPVLTPPQVAVPWVTFGIQAGLMMLVAARSGSALALLLASGWLGYALLRRKFGWLRYAVALAVLTRLTLG

SEQ ID NO: 6081 - protein, 640 aa, unidentified
  source 1..640: note = Related to NZ_JAJNKD010000004.1; note = Ideonella azotifigens
MSGERQPTRAELIARIAASSKDAVVLKEMQRSGFWPADAAAPTVEAALIQREAELVQVLNKLQAELREKGDPQGALKAMRQQRMAEARERREATAQKLERERYERAVQWRERSRHEIGYLGQGVSAGLQARADNAGSHEKLQREGLPLLDTPQALADAMGVPVAELRFLAFHREVARTQHYRRFSLPKKTGGVRTISAPMPRLKRAQYWVLDNLLAKVPVHAAAHGFLPGKSIVSNAAPHVGQAVVINLDLKDFFPSVSFPRIKGVFRALGYGEATATLLALLCSENVCDELQVDGERFFVGRTARERVLPQGAPTSPMLTNILCRTLDKRLQGIATKLGFTYTRYADDLSFSASGNAAGLTGRLLRQVHHILKAEGFTPHPDKQHVMHAGRRQEVTGVVVNQQPAVSREQRRALRAALHRAKHKGLDAATWQGEPAARNVLLGYAQFVAMVNARHGAPLLAQAKALPSAATPAAKVPPSQFRQHAAAGKAPPRANGLWWQPAPKPEPVLLKTAGQIKAERRAHLAAQRAERDAARKAAEIASSPRRALRAAMQAAAAAPAPEGGAPQETHAPLLPLIRWPLVIAQAALLVYLSVKLKSPGLFLAGGLWLGWRVMRRKFGWPSYFLALFVIGFVAGILHL

SEQ ID NO: 6082 - protein, 630 aa, unidentified
  source 1..630: note = Related to nan
MSDRQPTRAELIARIAASTKDAVVLQEMQRLGFWPQGSGEPGIEAALIEREAALVQRLNALQAELKIVGDPQAALQAMRRERMAAAKARREATAQAREQRRHERALQWLERSRDAIGHLGHGVSAGLSPQPLEADDRRRLEATGLPCIDTPLALAQAMGIGVAELKFLCFHREVARTQHYRRFGIPKKTGGVRTISAPMPRLKRAQYWVLDALLAKVPLHAAAHGFVPGRSIVSNAAPHAGRDLVINLDLKDFFPSITFARIKGVFRRLGYPEQIATLLGLLCSENVCDELQVDGERFYVGRTARERVLPQGAPTSPMLTNILCRRLDRRLQGVAAKLGFTYTRYADDLTFSACGEAAGRSDRLLRQVHFILRDEGFTPHPDKQRVMRAASRQEVTGIVVNERPGVSREQRRALRAALHRAQQKGMEAATWQGQPARKDVLVGFAQFVAMVQPAQGQALLARAKALPATGTKAAAAAPSRFREFAGQGKAPPRAAGPWWEPAPKPLPVLQKTAGQLREERRARLAEARALREGRPPRTAATPTAPSASGSPPSSATAPTGPNAKAGPVNWDAWLLQLGMMVLMSVRLHSAVFFLLGAIWMGSRLVRRRFGWPSFIAVLLAVGLAAEWLKP

SEQ ID NO: 6083 - protein, 671 aa, unidentified
  source 1..671: note = Related to NZ_CP049905.1; note = Diaphorobacter sp.
MSNPQPTRAEIFERIKQSSKQEVILEEMQRLGFWPRSEGQPEVAADLIQREGELQRELAELNKKLAVKRNPERALREMRKQRMKDARDKREVTKRAQAQQRYDKALLWHEKRASHVAYLGPGVSASLHENSSATQEQGDKGKPKRARDRAVPDLQRLTLNGLPALISAAQLAESMGVSVAELRFLSFHREVARTNHYHSFTLPKKTGGERLISAPMPRLKRAQYWVLDNVLAKMPAHDAAHGFLAGRSIISNAKPHAGQDVVINLDVKDFFPSIAFGRIKGVFRQLGYGESIATVFALLCSENRAQAWQVDGERLFVGGKARERVLPQGAPTSPMLTNLLCRRMDRRLLGLAKQLGFVYTRYADDLTFSASGEPARDNVGKLLSRVRWILRDEGFTPHPDKERVMRKGRRQEVTGLVVNSDTPSVSRETRRRLRAALHRASQPDAASKPAHWQGHTAQPSQLLGLATFVHQIDPKQGKTLLADAQQLMRSPIDRANDAAKSASRADAAQQSFRVLAAAGKPPVLADGKNWWQPAPPATPVLEKTDQQRREERQATRRQQAAAAAPPPSSTRRNERPQQAAHEQQGDAQPQNEAPPRFDPDQYAPPPRNVMTYWAQIAISFFLGSILHNRLITIFAMVAVIALYYMRRQRWDVFMGILVVATLLGYLVRGMG

SEQ ID NO: 6084 - protein, 673 aa, unidentified
  source 1..673: note = Related to NZ_CP049910.1; note = Diaphorobacter sp.
MSNPQPTRAEIYERISQSSKQEVILEEMQRLGFWAKDSGQPQLAEELIRREGELQRELSELHKQLAVRRDPERALREMRKQRMKDARDKREVTKRAQAQQRYEKALAWHDKRATHVGYLGPGVSASLQDADEPIAQSDKKPKRARDRAVPDLTRLAVNGLPALTSAAQLAQSMGVSVAELRFLSFHREVARSHHYHSFTLPKKTGGERLISAPMPRLKRAQYWVLDNVLAKMPAHDAAHGFLAGRSIISNAKPHAGQDVVINLDVKDFFPSIAFGRIKGVFRQLGYGEKIATVFALLCSENRAQVWQVDGEKLFVGGKARERVLPQGAPTSPMLTNLLCRRMDRRLQGLAAQLGFVYTRYADDLTFSASGEAAHDNVGRLLGRVRWILRDEGFTPHPDKERVMRKGRRQEVTGLVVNGDTPSVSRETRRRLRAALHRASQPGAAAKPAHWEGHAAQPSQLLGLATFVHQIDARQGKPLLASAQQLMRNPIDRANDALLAASRADRATTTNAGDFRRLSAAGHPPVRADGKTWWQPAEPSAPVLEKTDQQRREDRKAARQSAQPQPQLQLQPQTGGNANGTARTSQSGNRQQNASQTAPQSDPPKERGTRNMMVYWAQIAITFFLGSILHNRLITIFAMVAVIALYYMRKQRWDVFMGILVVATLLGYLVRGVG

SEQ ID NO: 6085 - protein, 678 aa, unidentified
  source 1..678: note = Related to NZ_CP060783.1; note = Diaphorobacter aerolatus
MSNPQPTRAEIYERIAQSSKQEVILDEMQRLGFWPKAEGQPQLAAELIHREGELQRELSELNQQLGVRRDPERALREMRKQRMKNAREKRETTKREQAKKRHERALAWHARRASHVGYLGPGVSAALVDGPLTQQEQEQTSRRTRDRAIPDLPRLARHGLPALSSAAQLAESMGVSVAELRFLSFHREVARTHHYHSFTLPKKTGGERLISAPMPRLKRAQYWVLDNVLNKIPAHEAAHGFLAGRSIISNAAPHAGQDVVINLDVKDFFPSIAFARIKGVFRQLGYGEGVATVLALLCSENRAQAWQVDGERLFVGGKARERVLPQGAPTSPMVTNLLCRRMDRRLQGLARQLGFVYTRYADDLTFSASGEAARDHVGKLLGRVRWILRDEGFTPHPDKERVMRKGRRQEVTGLVVNGPSPSVSRKTRRRLRAALHRASRSAADASTSTQAHWQGQQAQPSQLLGLAQFVHQINARQGRQLLADAQQLMRSPLDRANDALLAASRQDQRSASSSSPASFRALAAAGRAPVRTNGEPWWQPAAALEPVLEQTDLQRREARQLARHGASSASGASSNRRSSSDSHFGRGPQSGSSRQEDQGNASGRFSFDDAAGRDDQGASKDKPAGRLGTYWMQMVICFVMGSILHNRLITIFAMIAVIVLYYMRRQRWDVFMGVLVGL

SEQ ID NO: 6086 - protein, 673 aa, unidentified
  source 1..673: note = Related to NZ_CP060714.1; note = Diaphorobacter sp.
MSAPQPTRAEIYDRIKTSSKQEVILEEMQRMGFWPQGEGEPQVAADLIQREGELQREMSELREQLAVRRNPERALREMRKQRMKQARDQREETRRRHAQERHDKALAWHGTRASHMGYLGPGVSAALHAPGQDGSADGASGRKPARERSAPDLRRLALNGLPALTSGAQLAEAMGVSVAELRFLSFHREVARTHHYHSFTLPKKTGGERQISAPMPRLKRAQYWVLDNVLAKMPAHDAAHGFLAGRSIVSNARPHAGQDVVINLDVKDFFPSIAFGRIKGVFRQLGYGEGIATVLALLCSENRAQAWSVDGERLFVGGKARERVLPQGAPTSPMLTNLLCRRLDRRLQGLAAQLGFAYTRYADDLTFSASGDAARDHVGKLLSRVRWILHDEGFTPHPDKERVMRKGRRQEVTGLVVNGSQPGVSRQMRRKLRAALHRASHAAPGDAPAAHWQGQAAQPSQLLGLAQFVQQVDAQQGKALLASARQLVRDPVARVNDALREAAAEDRLAAASEAAVSFRQAAASGRSPVRANGEGWWQPEQKAAPVLEQTDQQRREARQQARRQSLAAASPASPETAPGNGARRVQGVPAEGVSPAQPGKAPEASGLPPVRRMLRYWSQMGLCFLLGSILHNRLITIFAMVMVIALYYMRKQRWDLFAGVLVIATLLGYLVRS

SEQ ID NO: 6087 - protein, 669 aa, unidentified
  source 1..669: note = Related to CP065748.1; note = Delftia lacustris
MSQPQPTRAEIYERIKASSKQEVILEEMQRLGFWPKDEGQPQLAAAHIQREGELQRELAELRQQIAVRQNPERALRQMRKERMQKALAQREETKRRQAQERHDKALAWHARRSTHVGYLGPGVSAALQDAARDGTERRQADPQRLARHGLPQLADAAQLAQAMGITVAELRFLGFHREVARTHHYHSFTLPKKTGGERLISAPMPRLKRAQYWVLDNILAKVPAHDAAHGFLAGRSIVSNAAPHAGHDVVINLDVKDFFPSIAFGRIKGVFRHLGYGEAMATLLALLCSENRAQAWQVDGEKLFVGGKARERVLPQGAPTSPMLTNLLCRRLDRRLLGLARQLGFVYTRYADDLTFSASGEAARDNVGRLLGRVRWILRDEGFTPHPDKERVMRKGRRQEVTGLVVNADKPGVSRQTRRRLRAALHRATQAGTGLPGQSVQPAQVPHWQGQPAHASQLLGMAQFVHQVDPVQGGPLLAQARQLTRSPVDRANDALLEASRQDRAAARAKPPANATFRRLAAGGQAPALASGKPWWQPAAPAAPVLEKTDQQRREQRQEERQAARQAAGPAPGAASTLPAASTSPSPSPSPAAPDPNPPASKRPPMAGLLTYWAQIVICFLLGTVFQARLITLIGIVLVVILRYRRIQRWDVFGAAMVVAVLVGLGLRLS

SEQ ID NO: 6088 - protein, 631 aa, unidentified
  source 1..631: note = Related to NZ_CP069318.1; note = Delftia lacustris
MSQPQPTRAEIYERIKASSKQEVILEEMQRLGFWPKGEGQPQLAAAHIQREGELQRELAELRQQIAVRQNPERALRQMRKERMQKALAQREETKRRQAQERHDKALAWHARRSTHVGYLGPGVSAALQDAARDGTERRQADPQRLARHGLPQLADAAQLAQAMGITVAELRFLGFHREVARTHHYHSFTLPKKTGGERLISAPMPRLKRAQYWVLDNILAKVPAHDAAHGFLAGRSIVSNAAPHAGHDVVINLDVKDFFPSIAFGRIKGVFRHLGYGEAMATLLALLCSENRAQAWQVDGEKLFVGGKARERVLPQGAPTSPMLTNLLCRRLDRRLLGLARQLGFVYTRYADDLTFSASGEAARDNVGRLLGRVRWILRDEGFTPHPDKERVMRKGRRQEVTGLVVNADKPGVSRQTRRRLRAALHRATQAGTGLPGLPGQSVQPAQAPHWQGQPAHASQLLGMAQFVHQVDPVQGGPLLAQARQLTRSPVDRANDALLEASRQDRAAARAKPPQTPRSGAWQPAGRHLRWPAASHGGSRPHPQRPCWRRPTSSGASSARRNGRPPGRRLALPPASQAPCPRHRPLHRHRHHRPHRTRIRPHRKGRRWPACSPTGRRSRSASCWAPCSRPG

SEQ ID NO: 6089 - protein, 660 aa, unidentified
  source 1..660: note = Related to NZ_LR813084.1; note = Delftia tsuruhatensis
MSQPQPTRAEIYERIKASSKQEVILEEMQRLGFWPKGEGQPQLAAAHIQREGELHRELAELRRQLAVRQDPERALRQMRKERMQKALARREETRRRQARERHDKALAWHARRDTHVGYLGPGVSAGLHEPRDEAQQPAARDRRQADPQRLARHGLPELADAAQLATAMGITVAELRFLGFHREVARTHHYHSFTLPKKTGGQRLISAPMPRLKRAQYWVLDNILAKVPAHDAAHGFLAGRSIVSNAAPHAGHDVVINLDVKDFFPSIAFGRIKGVFRQLGYGEAMATLLALLCSENRAQAWQVDGEKLFVGGKARERVLPQGAPTSPMLTNLLCRRLDRRLLGLARQLGFTYTRYADDLTFSASGQAAQDHVGRLLGRVRWILRDEGFTPHPDKERVMRRGRRQEVTGLVVNGEQPGVSRETRRRLRAALHRAAQAVPGQRPHWQGHAAQPSQLLGLAQFVHQVRPAQGGALLRQARQLLRSPLERANEALIEASRQDRARAPEAQAFRQRAAAGQAPALASGKPWWQPAAPAAPVLEKTDQQRREERQEQRQQQRQEQQQAARAQAHAAAAPAPQAASAPALPQEPAPPPPAKSALPGLLTYWAQIIICFVLGTVFQTRLVTLIGIVLTVILKWRRLQRWDVFAGAMVIAVLLGLVLKP

SEQ ID NO: 6090 - protein, 690 aa, unidentified
  source 1..690: note = Related to NZ_AUCQ01000016.1; note = Comamonas composti
MRCSTFWRLLIGSTAAATKEGRMSQQSTSRALTRAEIYERIKASSRQEVILEEMQRLGFWPKADGEPRLAAEHIEREAHLQRELAELRAQIAVRENPERALRQMRKQRMQQALAQREETKRQQARLRHEKALDWHARRATHVGYLGPGVSAALSPAASQGSPARKAALTDAPKLIGSGLPVLESAAQMAQAMGVTVAELRFLSFHREVARSHHYHSFTLPKKTGGQRLISAPMPRLKRAQYWVLDNILGRVPAHEAAHGFLAGRSILSNALPHLGRDVVINLDVRDFFPSISFARIKGVFVRLGYGEAVATVLALLCSENRAQAWQVDGERLFIGGKARERVLPQGAPTSPMLTNLLCRRLDRRLQGLASQLGFAYTRYADDLTFSASGEAARDNVGRLLGRVRWILRDEGFTPHPEKERVMRKGRRQEVTGVVVNNAQPGSSRQMRKQLRAALHQAARHGAGASDKPAHWQGQTAQVSQLLGLAQFVHQINPRQGLALVEQARSLGKGPLESANQALTQAAREDRERKAASAGFRRSAAQGQAPVRANGQPWWQPAPAEPPVLEQTDQQRRELRQQARREMHSLQAGSSAQAASGERAMAEGPTPAPAVQSQAAHETAPPTSGPALRRLLTYWAQIVVCFVLGNLLHTRVVTLVGIALVVVLYYRRKQGWGLFFAAMVLAVLVGMVFKQ

SEQ ID NO: 6091 - protein, 674 aa, unidentified
  source 1..674: note = Related to NZ_SSWX01000040.1; note = Lampropedia aestuarii
MSTPQPSRAQIYERIKASSKQEVVLEEMQRMGFWPKDAGQPQPAAELIQREGELQRELQTLRNQFAARKDPERALREMRKQRMQAARTQREATKRKQAQQRHDKALAWHRERATHIGYLGPGISAGLQTPAQDEAAVKSTSERQRRGPDMARLARHGLPELTSGAQLAEAMGVSVAELRFLSFHREVARSHHYHSFTLPKKTGGERLISAPMPRLKRAQYWVLDQVLAKIPAHDAAHGFLAGRSIISNAQPHTGQDVVINLDVKDFFPSIAFGRIKGVFRQLGYGESVASVLALLCSENRAQAWLVDGERLFVGGKARERVLPQGAPTSPMLTNLLCRRLDRRLQGLAAQLGFAYTRYADDLTFSASGEAAQERVGALLRRVRWILRDEGFTPHPDKERVMRKGRRQEVTGLVVNGAAPSVSRQTRRQLRAALHQATQAGSASAAVAPHWQGQAVQPSQLLGLAQFVHQVDAKQGQALLASAQQLAAVPGARVNQDLADAAARDRRAATRPLPFRQAAAAAQAPVRANGQAWWQPEEKAAPVLEHTDQQRKEQRQQLRREAAAAQTPDAAWGRAEPHNRSAERNSSQEPASHVAPNRASSRANKGKPATPRSLPRLGMHILLGIAQGMSLNKPLITVFALALAITLYYMKKQRWGIFIGLVLVVSWLVIGFTAY

SEQ ID NO: 6092 - protein, 665 aa, unidentified
  source 1..665: note = Related to NZ_CAKAKO010000003.1; note = Xenophilus sp.
MAAPAPTRAELLERIRASSKDAVVLAEMQRLGFWPRDEARPAPATELIEREAALMRELGELQAELHLRGDPEKALRAMRQERLAAARAQRDSRARERAQRQYERAQQWHAQRQQRIGYLGAGVSAGLERPADRPAAHVPLRAGRSERLARHGLPALDSPQALARAMGVALGELRFLSFHREVGRHTHYRRFTLPKKSGGERLISAPMPRLKRAQYWVLDNILAKVPAHDAAHGFLPGRSVVGNAQPHCGQEVVVNLDVKDFFPSIGFGRIKGVFTHLGYAEPVATVLALLCSENRADELQVDGERWFVGGAAGQRVLPQGAPTSPMLTNLLCRRLDRRLAGLARTLGFAYTRYADDLSFSASGEAAQRVGPLLRRVRWILRDEGFEPHPDKERVMRKGARQEVTGIVVNAAQPGVSRQSRRALRAALHRARTAGAGPAHWQGEPASRERLLGYAHFVQGVNEAQGRALVRAAEALPLASRAAASPAAAPGTAAGDFRIRAAQGEAPVRAQGPWWQPASPPAPVRQRTDGEIREARAAQRQAAAEARRAAQAGAAVAAPAGRSGNGSPARSGAPASVDTARQARNARAAGRGRKADASPRSRKTYWLQLFVVWLAGTLSGSGFVTVFGLIYLLGAYWARHQRWSHFSLAMLAILVLVPVLRSIGIL

SEQ ID NO: 6093 - protein, 708 aa, unidentified
  source 1..708: note = Comamonadaceae bacterium; note = Related to SEAX01000108.1
MAAPQPTRAELIERIRASSKDAVVLAEMQRLGFWPGGESQPEPAAELIEREAALIRELGELQAELQLKGDPDKALRAMRQERLAAARAQRESKARERAQRQYERALQWHAQRQQRIGYLGAGVSAGLERPDGQAAHAPLRPARPERLAQHGLPALEHPQALALAMGIELGELRFLSFHREVARHTHYRRFTLPKKSGGERQISAPMPRLKRAQYWVLDNILAKVPTHDAAHGFLPGRSIVGNALPHCAQDVVINLDVKDFFPSIGFGRIKGVFMRLGYGEPVATVLALLCSENRADELQVDGERWFVGGTAGQRLLPQGAPTSPMLTNLLCRRLDRRLTGLAQALGFNYTRYADDLSFSASGDAAQRVGSLLRRVRWTLRDEGFEPHPDKERVMRKGARQEVTGIVVNAPQPGVSRQSRRALRAALHRSHAEGPDQAHWQGQSASRERLLGYAHFVQGVNEDQGRALVMAAEALPLASRAADGVGAAADVDAVGADAAAAATDATTPAAAVGGSRALDAAAAAAGTTMAIGLFKAGKADFRARAAQGLAPVRVDGPWWQPAPPPQPVRQRTDGEIREARAARRQAAAEARRAAQPGAAAPANARHPTQAGARAQATVDAARQARRGGPTAPGADDRTADAAKPPRSAKTYWMQLFVVWLAGSFTRNGLVTVLGLIYLLGTYWMRHQRWSHFAIAMAAIVALATLMRSL

SEQ ID NO: 6094 - protein, 709 aa, unidentified
  source 1..709: note = Related to NZ_CP021455.1; note = Comamonas serinivorans
MSAPQPTRAELLERIRASSKDAVVLAEMQRLGFWPQGEGEPRLAAELIEREAELSQQLNALRQEAAQYADPEQALRRMRRERMAAARAQREATRRQRHEARHERALAWHAERDRHIGWLGEGVSAALQPVARLPADPAPRSAQPSADQADPSANAEHAAEPAGQARAATADRGGAARASTPRTDRLARHDLPLLTDAPALADAMGIGVRELRFLATHREVSRSTHYQRFTVPKKTGGERLISAPMPRLKRAQYWVLDNILAKVPVHAAAHGFLPGHGIVGNARPHADQDVVINLDLQDFFPSVGLPRVKGVFQHLGYGEAVATVLALLCTEARADTLRIDGETVHIAGRARDRVLPQGAPSSPQLTNILCRRLDRRLAALAATLGFAYTRYADDLSFSASGEAADRVGELLRRARWIVRDEGFTPHPTKQAVMRRGRQQTVTGLVVNGAAPSVSRRQRRRLRAALHRAHTQGLAQAHWQQQPVTRAQLIGWAQFVHQVQPAQAGALLSQAQALLPAAHEASAATVNALAQAASARPAGGGRLSFRAAAAQGQTPPLASGRWWQIAPRPTPVRVLTDQERREQRQARRAAQAAAAEPATTAAGVGPAGARPGQGGRRLSDPRTEDAGRAGVPAPDGHAPQSRTRRRLGTYVLQLMAAWGLGNVVFHDRLFTQVALVMLVFLYLMRRQSWALWGGTMLLAALVAWSLRFLG

SEQ ID NO: 6095 - protein, 640 aa, unidentified
  source 1..640: note = Related to CP028324.1; note = Massilia armeniaca
MLAFRVRLPAGSLPMSAPPPTSMTRQELYERLRTATREEVTLSEMQRLGFWPKDDPGVTAAQALIQREAELSRALRELSSELRGTEDPALALKAMRKERMAKARARREETKQRSARERFERASAWHHRHAGEILYLGEEVSAGLNEARSDGDKLARAALPALHDARELAQAMGLSLQELRFLAFDRRASRISHYRRFAMPKKTGGERIISAPMPRLKRSQYWVLDNVLARAPVHPAAHGFLKGRSIVSNAAPHVAQAVVINVDLKDFFPSIDMRRVAGVFGQLGYSKQVATTLALLCTEAATEQVSVDGETFFVARGARVLPQGAPTSPALTNILCRRLDARLQGAAAKLGFSYTRYADDLTFSGPEATRKLAGKLLWRVRQIVADEGFTPHPHKQHVMRASQRQSVTGIVVNEKPTIERDTLRRFRATLFQVEKDGPAGRQWNGNPNVLAALEGYAQFIRMVDPAKGAPLLARVRAARERWSDAPAASLPGPARRGGDFRALSAQGKAPWEGFWQAAPPAPPVLEQTQEQVTLAKKETRRWASVAPVVEPSAAAADVATDAVEDGPQVRAPWRALLSQFLIALVLALTYRTPLPVAGILLLSRTSRRDGRPHWTRFICAMVLLVALADVLHRWDLGLLS

SEQ ID NO: 6096 - protein, 614 aa, unidentified
  source 1..614: note = Related to NZ_CP038026.1; note = Massilia plicata
MNAKSPASMSRQDLYERLRTSSREEVTLAEMQRLGFWPANAAGRPDVEELIRREAELSSALRELGSELRAVEDPAVALRAMRKERMAKAKARRETRQRRARERFERASAWHQRHASEILYLGEGVSAGLNDTHSDGDRLARAALPPLNDARELAQAMGLTLQELRFLAFDRRVSRISHYRRFAMPKKTGGERIISAPMPRLKRSQYWVLDNVLARAPVHPAAHGFLAGRSIVSNAAPHAGRAVVVNVDLKDFFPSIDMRRVAGVFGQLGYSKQVATTLALLCTESATEEVSVDGETFHVAYGPRVLPQGAPTSPALTNILCRRLDARLQGAAAKLGFAYTRYADDLTFSGTGESRKLAGKLLWRVRQIVIDEGFTPHPDKQHVMRDSQRQSVTGIVVNEKPTIDRPTLRRFRATLFQVEKDGPDGKAWNGNTNVLAALEGYAQFVRMVDPAKGGPLLQRVRAARERWSTPAGTPAATHSTGDFRALSAQGKAPWPGFWQAGPAPAPVVEKTQVQVTLAKKAVQQEQKERVAALADAQPDTMLEAPPQALLPWRALLPQFVTAFLLALTYRTPLPLAGMLLLARKSRRDGRLGWGRFLGVMVAVVVLHGLLRRWN

SEQ ID NO: 6097 - protein, 612 aa, unidentified
  source 1..612: note = Related to CP040017.1; note = Massilia umbonata
MSDNTPAPMTRAALYARLRTQSREEVTLAEMQRLGFWPENDPGKAVAEQLIQRESELVRALRELGSDLRVAEDPALALKAMHKERKAKARARREETRERRARERFERANAWHQRRAGEILYLGQGVSAGLGEARSDADKLARAALPAMHDAKDLAQAMGLSLPELRFLAFDRRVSRISHYRRFAVPKKTGGERIISAPMPRLKRGQYWVLDNLLARAAVHPAAHGFRAGRSIVTNAGPHVGRAVVINVDLKDFFPSIGMQRVAGVFRQLGYSKQIATILALLCTESATEQVSIDGETFHVAHGPRVLPQGAPTSPALTNILCRRLDARLEGAAAKLGFAYTRYADDLTFSGGEETRRLAGKLLWRVRQIVADEGFTPHPDKQHVMRDSQRQGVTGIVVNEKPAVDRTTLRRFRATLFQVERDGPAGKAWNGNANVLAALEGYAQFIRMVDPAKGTPLLARVRAARERWSDTGSPAVTVAKAISAGNFRALSAQGKAPWPGFWQAGMAPAPVLEKTQEQVVAMKKEARQLARSHAATSPTPGGKARNARSLWHALLLQILIACFLAIAFRSPWPIIAMLALFYLSRRDRSAYWTRFIGIQTLAVAGMLALMKH

SEQ ID NO: 6098 - protein, 623 aa, unidentified
  source 1..623: note = Related to WSES01000020.1; note = Massilia sp.
MSDYPTSTREALYARIRASSRTEVTLEEMKRLGFWPEDDTSLAEAEQLIKREAELQQALSALGRELREVEDPALALKRMRKERMARAKAKREETRQRRARERHERALAWHARRAKELLYLGAGVSAGLNEARSDADRLARLSLPSMHDAQDLANAMGLSLEELRFLAFERRVSRISHYRRFAMPKKAGGVRIISAPMPRLKRAQYWVLDNVLARAPVHPAAHGFLAGRSIVSNAAPHVGQAVVINVDLKDFFPSIALPRVRGVFRQLGYGKQVATTLALLCTESATETVQVDGETFHVAHGPRVLPQGAPTSPALTNILCRRLDARLQGAAARLGFRYTRYADDLTFSGDESVRKLAAKLLWRVRQIVIDEGFTPHPDKQHVMRSHARQSVTGIVVNEKPAVDRDTLRRFRAVLFQVEKDGPAGKQWNGNDNVLAALEGYAHFIRMVDVEKGAPLLARVRAARARWNGDAAAPDAVARRAGGQFRMLAAQGKAPWPGFWQAGTPPAPVLEKTQEQVKTERTLAREEARPRKAAASPVPADDAIARRAERTARRNPLLIGGGRMTWYAVALQGVVALLLSRKLDSNTPILAMLALYWLSVRYRRMLWVPFIVVMLLIWAVLAPR

SEQ ID NO: 6099 - protein, 603 aa, unidentified
  source 1..603: note = Related to BMKG01000047.1; note = Massilia buxea
MYERVRASSREEVTLAEMQRLGFWPANDPGLAAAEELIRREAELSQALRALGTDVRIAEDPVLALKAMRKERMAKARARREETRQRRARERFERASAWHRRQACEILYLGEGVSAGLNESRSNVDKLARAALPALDDAQDLARAMGLTLQELRFLAFDRRVSRITHYRRFALPKKTGGERIISAPMPRLKRAQYWVLDKLLAHAPVHPAAHGFLRGRSIVSNAAPHVGQAVVINLDLKDFFPSIGMPRIRGVFTQLGYSKQVATTLALLCTEAATEEVSVDGETFHVAHGPRVLPQGAPSSPALTNLLCRRLDARLQGAAAKLGFAYTRYADDLTFSGGEATRKLAGKLLWRVKQIVIDEGFTPHPDKQHVMRDSQRQSVTGLVVNAKPSLERDTLRRFRATLFQVEKDGPDGKAWNGNTNVLAALEGYANFVRMVDPAKGTPLLARVRAARERWTGVPQAHRAPSLSKRSSDFRALSAQGKAPWEGFWQAAAPPPPELERTAEQLAQDKKAARRQRPASPAAEPSGDLGVVDVPATPGLPPVPWSAIGVQLGLALAYGIDQGKLLPLAFTVGLAFMAWRDRDPHWLRFGGVIVLMVLLSVLR

SEQ ID NO: 6100 - protein, 642 aa, unidentified
  source 1..642: note = Related to NZ_CP024608.1; note = Massilia violaceinigra
MTSPTPSPSELTRAQLYERIRASSKEEVVLTEMQRLGFWPADSGKPSVESALIRREAELTQALQRLGSELHHLQNPEAALRMLRKERMAKAKARREETRQKRALVRFEKAQAWRQRREHEVLYLGAGVSGGLSRADSDAGKLAGLAMPVLHKADDLAQAMGITLSELRFLAFERRVSRISHYRRFAMPKKTGGERIISAPMPRLKRAQYWVLDNVLARAPLHQAAHGFVPGRSIVSNAAPHVGQAVVINLDLKDFFPSIGMPRIKGVFAQLGYSEQLATVLALLCTEAPTDKVRIDGERFFVAHGSRALPQGAPSSPALTNILCRRLDARLQACAAKLGFKYTRYADDLTFSGDADARKLAGKLLWRAKQIVIDEGFTPHPDKQHVMRDAQRQMVTGIVVNQKPSLERETLRRFRATLFQLEKDGPEGKQWNGNTNVIDALEGYAQFIRMVDPVKGLPLLVRVRAARARWGAAGIDMKLMQSKRSSAFRALSAQGKAPWDGWWQATLASAPVLEKTAAQLAVEKKERKAAEAPTVPPAPVNMKKPAAAQTPVATPAAAVHAPPASDATANPAPGAKPDGDNNFQVAIAVQVALICAFALATQRVLPSACMAVIVLQSAMLRKPRWGWFLFIILIWSAVTLKW

SEQ ID NO: 6101 - protein, 631 aa, unidentified
  source 1..631: note = Related to NZ_AUDI01000031.1; note = Pseudoduganella violaceinigra
MSATESKPITTRAELMERLRSSSRQEVVLGEMQRLGFWPANKGEPTELEEVVRREAELSSTLNRLSQELRTIQDPEAALKAMRKERLAKARQRREETRLRRAQERFDRATAWHRRRSTELLYLGEGVSAGLNQAESDAGKLARWSLPVMNNASELAAAMGVTLPELRFLSFERRVSRISHYRRFAMPKKTGGERIISAPMPRVKRLQYWVLDNILAKVPLHSAAHGFVPGRSIVSNAQPHVGKAVVINLDLKNFFPSIALPRIKGVFRELGYSDQLATTLGLICTETPTEEVSVDGEKFFVATGERALPQGAPSSPALTNILCRRLDARVQSCAAKLGFIYTRYADDLTFSGDAAARKLAGKLLWRVKQIIADEGFTPHPEKQHVMSLSQCQSVTGIVVNKKLSLDRDTLRRFRATLFQVEKDGPAGKQWNGNENVIDALVGYAQFIKMVDAERGAPLLQKARMVRQKWNTEAPVVSEAAARASSGFRKLSAQGKEPWAGFWQAAGSPAPVLEKTQQQLKEEKLAKREKPAEKPKAAAHADGQAARQQGVTASPGTQAPAQGGRGMFAGRPWVSIIIQVYFAFTLCLNFRTPLPLVVAIVLGYQAWRDYSGHWLRYFGAMAVAVVLGLWLR

SEQ ID NO: 6102 - protein, 625 aa, unidentified
  source 1..625: note = Related to LMFZ01000021.1; note = Duganella sp.
MSATESKPITTRAELMERLRNSSRQEVVLGEMQRLGFWPANTGQPTELEEVVKREAELSGALQRLGQELRTIQDPEQALKAMRKERLSKARQRREETRLKRARERFERATAWHRRQSTELLYLGEGVSAGLNHAESNAEKLARWSLPAMNNASELATAMGITLPELRFLSFERRVSRISHYRRFAMPKKTGGERIISAPMPRVKRLQYWVLDNILAKVPLHPAAHGFIPGRSIVSNAQPHVGKAVVINLDLKNFFPSVNLPRIKGVFRELGYSEQLASTLGLICTETPVEEVSVDGEKFFVATGERALPQGAPSSPALTNILCRRLDARAQSCAAKLGFTYTRYADDLTFSGDAAARKLAGKLLWRVKQIIADEGFTPHPEKQHVMSDAHCQSVTGIVVNKKLSLDRGTLRRFRATLFQVEKDGPAGKQWNGNDNVIDALEGYAQFIKMVDADKGAPLLQQVRAARAKWISPAPAASVTAVRRSSGFRALSAQGKEPWAGFWQAAAAPAPMLEKTQQQLALEKAGAGRKAAAPASAPSRPAARAAAEAPASAPVQGGRGTFTGRPWVAVIIQVYFAITLCLNFRTPLPFVVAVVLAVLAWRNYSAKWPRYFGAMFAAVLAGVLLR

SEQ ID NO: 6103 - protein, 637 aa, unidentified
  source 1..637: note = Related to NZ_WWCJ01000033.1; note = Massilia guangdongensis
MSATESKPITTRAELMERLRTSSRQEVVLEEMQRLGFWPSGTGQPSELEQLVQREAELSSALLKLGQELRTVQDPEAALKAMRKERLTKARARREETRQRRARERFERATAWHQRRSTELLYLGEGVSAGLNQAEGDAEKLARWSLPALHNAQELASAMGVTLPELRFLSFERRVSRISHYRRFAMPKKSGGERIISAPMPRVKRLQYWVLDNILAKVPLHPAAHGFVPGRSIVSNAQPHVGKAVVVNLDLKNFFPSIGLPRIKGIFRELGYSEQLATTLGLLCTETPSEEVSVDGEKFFVATGERALPQGAPSSPALTNILCRRLDARVQSCAAKLGFTYTRYADDLTFSGDAAARKLAGKLLWRVKQIIADEGFTPHPEKQHVMGAGHCQSVTGIVVNQKLSLERETLRRFRATLFQVEKDGPAGKQWNGNANVIDALEGYAQFIRMVDAEKGAPLLQRVRAARARWIAQAQDGGEQAARRSSGFRALSAQGKEPWAGFWQAQAPAAPELEKTQQQVKQEKLEHRQAQKAKPASGRPAVAAGAGPSARATRRQAPEAPPAEQEEPYKFSDRPWLGILIQLYLAFSLCRLYHTPLPLVFAVMLAIPAWRNYRAYWLRYFSYMCLAVLLGIVLRKLL

SEQ ID NO: 6104 - protein, 555 aa, unidentified
  source 1..555: note = Related to NZ_NSJF01000005.1; note = Vandammella animalimorsus
MRRQRLQAARQRREATRQARAQARYERARSWHERRQHSVLYLGQGVSGGLQHSDNQPERLARWQLPQPANPQQLAQLMGVSVAELRFLAYDRAVARVSHYRSFDLPKKSGGLRRISAPMPRLKRLQYWLLDNILSKVPVHDAAHGFRPGRSICSNAQPHVGKAVVINLDLQDFFPSIAYPRIKGVFRALGYSEQLASIMGLLCTQRPTQAVQLDGQTYHIATGARHLPQGAPSSPALTNILCRRLDRRLHGMAAKLGFAYTRYADDLSFSADAPAQHLVGKLLWRARQIIADEGFTLHPDKLHVMRSARRQQVTGLVVNAKPSIDRSTFKRFRATVFQVEKDGPQGKSWNGNDNVLDALLGYAHFLHMVDPQRGQPWLQRVQALRVAAQAPAQSQPSPEPQQILELESAAKASQAGRGRSAFRRASAQGQAPWAHWWQPAQPPAPVLEPTEAQRQAQRQAQRRQQAQAALPTAAQPQRQGALEPQQPPEEAQHASQRNPRMLLEQTLALLVLLFMLRKPSLLLLGLLIHLAYHLLHRSSWWLFLPLLLASLLVPF

SEQ ID NO: 6105 - protein, 627 aa, unidentified
  source 1..627: note = Related to NZ_VIRW01000011.1; note = Chitinibacter sp.
MSQPSQSNPNQSNSAQPPNSREAILQRMRNSSKDEVILEEMRRQGFWPKDEPSPEQAAALALIEREGELVRALHDLSQQLHQVEEPQAALKAMRKERMRLAREKREVTRRQQAQRRYDRALAWHTQQQNDITYLGEDVSQGLADPRSDEARLASKGLPHFSSVAALAQAMGVTVAELRFLSFSRNVTRISHYRRFTVPKKTGGVRLISAPMPRLKRLQYWILEQILLKLPVHAAAQGFVAGRSIVSNATPHTGQAVVVNFDLQDFFPSIHWQRVSGLFQSMGYSKQLATILALICSETPCDEVAVDGAHYFVQTGVRRLPQGAPSSPALTNLLCRRLDTRLSALAQRLGFRYTRYADDMTFSAADDSQLPRLLWQAKRVIREEGFTLHPDKQKVMRRHARQEVTGIVVNQRPAVCRETLRRFRAVLFQVEQTGPTGKHWNGNENVLAALAGYAQFIVMVDAEKGRPLLARVHAAQLKWSAPEAARSSYYRDFRTASSKGIAPKGITQMAQRAIPIIELTQEQHQQAKQSAQQPNSQRAVIPADPDVVLLEQQQAPPLAAHANTPVSIYLQIAAAFLALMLIGLLSSNYLLSAGSIVWVWYCMQKRKFSWWGFVLVLIVCRWLWQQIE

SEQ ID NO: 6106 - protein, 638 aa, unidentified
  source 1..638: note = Related to NZ_SCOH01000042.1; note = Chitinivorax sp.
MSNATQTSREAVLARIQASSKDSVILEEMQRLGFWPAGSGTPDQQRATELISQEQALLSELRELNQKLSIAKDPVAALKALNKQRMAEAKARREQTRLAAAQRRYEKAAAWHARRALDIGYLGEGVSQSLSDARTDPHRLAARELPVLDSPKVLADAMGITVEELRFLTFHRSVSRISHYRRFGIPKKTGGLRMISAPMPRLKRAQYWVLDRVLAKLPVHDAAHGFVPGRSIVSNATPHAGQAVVVNFDLKDFFPSISYQRVRGLFQTFGYSRQLATLFAMICTELPTDEVSIDGLHFHVQNGERHLPQGAPCSPTITNLLCRRLDTRLAGLAKRLGFIYTRYADDMTFSADAASAGNLPRLLWQVKRIIAEEGFTLHPDKQRIMRNSARQEVTGVVVNHHPTVCRETLRRFRATLYQVEKDGPQGKAWNGNGDVLNALAGYARFVKMVDPAKGGPLCAKVAAVQAKWGDNASQPRGQYYRLFREASVAGKALPSHQWQAKRQPAPTLEKTATQLQQEKQATRQAESDQAAAVAAETIASAAALPTTHTQSGELIERNAVSADAIPPNVHEDVPASVYLQLAMQFVLMLVSGLLTGNVLMAMASVGWMWFGFKRRRANWWLWLGVYFACRLLWRLTTA

SEQ ID NO: 6107 - protein, 624 aa, unidentified
  source 1..624: note = Related to JAEUND010000226.1; note = Chitinimonas sp.
MSDAAQTSREAVIARIRNSSKDAVVLEEMRRLGFWPQGQASPGEGEVAALIEQEAALIQELQQINRNLARVRDPQAALLEMKKERMAAAKRRREETRQRHAQLRYQRATAWHARMQQDIVYLGAGVSAGLDDARHDTARLASKQLPLLDGPQALAAAMGVPLAELRFLAYHRSVSRISHYRRFGIAKKTGGVRLISAPMPRLKRAQYWVLDRILARLPLHEAAHGFVPGRSIVGNALPHVGRAVVLNLDLQNFFPSIAYPRVRGLFQSFGYSRQMATLLALICTETPSEEVELDGNRYHVQTGERCLPQGAPSSPAITNLLCRRLDKRLTATAAKLGFSYTRYADDMTFSADAPQADGLARLLWRVKRIIADEGFTLHPDKQRIMRAASRQEVTGVVVNRQPAICRDTLRRFRATMFQVEKDGPLGKQWNGNSNVIAALEGYARFIAMVDPAKGEPLCQRAALLRAKWGSVLPAPASTGYRRAFRAASAEGRQTPGRIWLPAERPVPQLEQTDQQQREQRAAAREAAQPSPVPQTTASRANATPPAAQPQGANPAAIGWVQQYYGLLAVGQFMALLAIGVLGRFWLLPLCGLVLMLYALRTRHISGWHFALALVVGILFDGVLH

SEQ ID NO: 6108 - protein, 635 aa, unidentified
  source 1..635: note = Related to NZ_KB892857.1; note = Uliginosibacterium gangwonense
MSYQETPELQALRERIRASTKDAVVLEEMRRLGYWPKDEAIPDSRDAASEIGQIIQREGELVGELHKMAQDLHRLSDPQQALQEMRKQRMAAARAKREETRRRHAEERHQRAAAWHAQRQKSIAWLGEEVSTGLADVRTDAARLHAKSLPVIESIGELARLMGVPLAELRFLGYQRSVSRINHYHRFGIAKKTGGVRVISAPMPRMKRAQYWVLDKLLVSQPVSASAHGFVPGKSIVDNARVHAGHDVVINFDLKDFFPSIHYPRVKGLFSSFGYSDSVATLLALLCTEAPTETVEMDGQRYHVQTGPRCLPQGAPTSPAITNLLCRKLDRRLEGSAKKLGFSYTRYADDMTFSAPAEARSKLGQMLWCAKQIIADEGFILHPDKQRVMHAGRRQEVTGLVVNERPAVPRETLRRFRATLFQVEKDGPEGKSWNGNGNVIAALDGYARFIYMVDADKGAPLLARIAQLKERWSGAPVRKAPGLLSGPAFRRAAGEGKAPRENWWTPAEQAAPVVEKTDQQRAEDRAAAKAAIRLQKAEAQATAAPASSEQAETAPPPASLAPEEAAKARALSASDSIQILIQSIVMVLAGLVTHNYLVLLGAVVWFFLSMSKRKRYNWLIWAVVYIACRILGGVH

SEQ ID NO: 6109 - protein, 667 aa, unidentified
  source 1..667: note = Related to NZ_JACOGF010000004.1; note = Undibacterium hunanense
MTQNKQSASVTSPPLSQMTRDELYAHVRTTTKDAVVLQEMRRLGFWPADTGKPSVTEELIQREAQLSSMLRELTSQLQHVHDPKAALRDMRKQRMAAAKEKREQTRQKHAQLRHAKALAWQEKRQNDIGYLGEAVSSGLNYTTTDIEKLARYQLPVLQKAPELATALGIPLAELRFMSFQRKVSQVSHYQRFSIPKKTGGLRYISAPMPRLKRCQYWVLDHILSKVPCHPAAHGFLPQHSILSNALPHVGQAVVINLDLKDFFPSIEYARVKGVFKSLGYGDQIATLLGLLCTEQASEEVRVDTQRYFVAGKKRSLPQGAPSSPMITNILCHGLDKRLHAAASKLGFVYTRYADDLTFSSKQKERPPVGKLLWRVKQIIADEGFTLHPDKQRIMRHSQKQEVTGIVVNHSPTIDARTLHRFRATLHKVEKNGPAGYHWNGNTDVLSALEGYARYICMVNPAKGQPWLQRVKQLRVVYAAPTSVPAHSARPPRLSLRQQVAAGNTPLRANGKDWWQVKEAAVPVLELTAQQLAEQKQAEKQAEKQALKEAKQGKDTQAKAPVRENQTQSYAQRQVVTPQPVRANASKRNRDDAAPVSDEQPVVFKLRPIPWWSILLQFVACIMVTISLRSIFPVTLGLSLLAISIITRRSMMVWVMVVLVLSVLLINS

SEQ ID NO: 6110 - protein, 658 aa, unidentified
  source 1..658: note = Related to JAKZHX010000005.1; note = Undibacterium sp.
MTQQQQSAPVKPLSQMTRDELYAHLRTTTKDAVVLQEMRRLGFWPADTGKPTLTDEIITREAELSTTLRALSEQLHRVQDPKAALREMRRQRMAAAKEKREQTRQKHAQLRYAKALAWQEKRKTDIVYLGEGVSGGLNYTATNTDKLARHQLPLLQSASELATAIGIPLAELRFMSFQRQVSQVSHYQRFAIPKKTGGQRIISAPMPRLKRCQYWVLDHILAKVPCHPAAHGFLPQHSILSNATPHVGQAVVINLDLKDFFPSIDYQRVKGVFKSLGYGDHIATVLGLLCTEQASEEVRVDRQKYYVAGKKRSLPQGAPSSPMITNILCHTLDKRLHAAATKLGFVYTRYADDLTFSSKQKERPPVGKLLWRVKQIIADEGFTLHPDKQRIMRYSQKQEVTGIVVNHSPTIDAKTLHRFRATVHQVEKKGPAGLHWNGNTDVLAALEGYARYICMVNPAKGQPWLQKIKQLRAQHAAPAVTRPTRPSLRQQLAEGKTPERANGQDWWQIKEPAAPVLELTTQQVAEAKKALKQEAVQATKAAKASRQGTATPDYGRQQTAGRTAPVNLNVSAGNTRPGQADDGNQTYNATEQSKLNNKRNARLFAILFQLFLCVFFTLQLKSLYPVILGLPLLALSIISGRSKFMWIMLVLVACVLFR

SEQ ID NO: 6111 - protein, 651 aa, unidentified
  source 1..651: note = Related to NZ_QJKB01000012.1; note = Undibacterium pigrum
MTQQQQPSAQSASDKPLSQMTRDELYAHLRTTTKDAVVLQEMRRLGFWPADSGKPSVTDELITRESQLINELNTLTDKLRRVQDPKAALRDMRKQRMAAAKEKRELTKQKHAQLRHARALAWQEKRQNDIGYLGEGVSTGLNYTSTNTDKLARYQLPALQKSLDLATAIGIPLAELRFMSFQRKVSQVSHYQRFAIPKKTGGQRFISAPMPRLKRCQYWVLDHILAKVPCHPAAHGFLPQHSILSNALPHVGQAVVINLDLKDFFPSIEYPRVKGVFKSLGYGDQIATLLGLLCTEQATEEVRVDKQKYFVAGKKRSLPQGAPSSPMITNILCHTLDKRLHTAATKLGFVYTRYADDLTFSSKQKERPPVGKLLWRVKQIIADEGFILHPDKQHIMRHSQKQEVTGIVVNHSPTIDAKTLHRFRATLHQVEKNGPAGYHWNGNTDVLGALEGYARYVCMVNPVKGQPWLQRIKALRARYAPQYATQSATHPARPTLRQQVASGKTPQRANGKDWWQVQEAAAPVLEQTAQQIAEEKKVVRQAEKEEKKAAAMPQSVQPDVAGNTGNQAANTANPANTENLTAAEKNKLNKRLYGTLGRVFQVLLCAIFSASLHSLYPLTFGIALVALSLISGRSSLVWVMVMLVLSVVLLS

SEQ ID NO: 6112 - protein, 641 aa, unidentified
  source 1..641: note = Related to NZ_RXFT01000001.1; note = Variovorax guangxiensis
MTMQSPASSSSIPDSALTREELYERIRKSSKQEVVLEEMQRLGFWPRDAAQPTVEEQLIRREGELQTALSKLGSELRGIEDRDRALKIMRKERMARARERREETRQRAAQGRHARAVAWHERRQRELLYVGDGVSGGLNDAHSDSQALARNALPALDHVSDLAQAMGIGLGELRFLAWHREVSSVSHYQRFTMPKKSGGERHISAPMPRLKRAQYWVLDNILAKMPVHEAAHGFMPGRSILTNAAPHVGRDVVINLDLKDFFPSIGMRRVRGVFRQLGYSSQVASLLALVCTEAPTDEVQLDGNRYFVARGDRVLPQGAPTSPMITNLLCRRLDARLSASAAKLGFRYTRYADDLTFSAGPEHSRDTAKLLWRAKQIVASEGLTLHPDKQQVMRKHRQQHVTGIVVNDKLSVDRDTLRRFRAVLHQAERNGLQGLQWNGNSDVIGALRGYANFIAMTDAARGEPYLQRVRALAAKHEGGAAPKTQASQRRLGAGEFRKQSAAGKAPWPAWWQPAEAAAPVLEKTAEQIAEEKKAQREAARPQPVAASPAPARAPATAQPAAAPAAKQAPGALSQIGWVASMMLQALYVVSVFLSGTSPLIWLMTGGVAIGNFVQRKSGWLRFIVAIFISSALASLVHSMKN

SEQ ID NO: 6113 - protein, 659 aa, unidentified
  source 1..659: note = Related to NZ_CP060295.1; note = Variovorax sp.
MQPPASSSSVPDSALTREQLYERLRGSSKQEVILEEMQRLGFWPQDAAQPTVESQLIRRESELQTALGKLGEELRGISDRDKALKMMRKERMAKARERREETRQRLAQGRHARALAWHERHQRELLYVGDGVSGGLNEAQSDSQALARNALPALNHAGDLAGAMGIDLGELRFLAWHREVANVSHYQRFTIAKKSGGERHISAPMPRLKRAQYWVLDNILAKMPVHEAVHGFLPGRSILTNAVPHVGQDVVINLDLKDFFPSIGMRRVRGVFRQLGYSSQVASLLALVCTEAPTDEVQLDGRRYFVARGERVLPQGAPTSPMLTNLLCRRLDARLAASAAKLGFRYTRYADDLSFSADSQHSRDTGKLLWRVKQIVASEGLTVHPDKQQVMRKHQQQHVTGIVVNDKLSLDRDTLRRFRAVLHLAERQGPQGLQWNGNVDVIGALRGYANFIAMTDAARGAPYLQRVRALAAKHKGSAMTTPIAPASPVASQQPQRQVAPDQFRKQSAAGQAPWPAWWQPAQASAPVLEKTAEQLAAEKKAKRDAERAEAAAKAAAATAASAPVPRAAAAPAVAPSSPEAPTPEAPKRLESQFVLTVSLMLQSAYVVMSLLTSRSLVVLLPVGAIVIGNWIQRKSGWMRFLIVLIAASGLSGLVRHLTQ

SEQ ID NO: 6114 - protein, 646 aa, unidentified
  source 1..646: note = Related to NZ_CP091716.1; note = Variovorax paradoxus
MQSPPASSIPDSALTREQLYERIRKGSKQEVILEEMQRLGFWPQEAAQPTVEVQLIRREGELQAALSKLGDELRGIEDRDKALKTMRKERMAKARERREETRQRLAQDRHARAIAWHERRQRELLYVGEGVSGGLGEAQSDAEVLARNALPALHHAGDLAQAMGIGLGELRFLAWHRDVANVSHYQRFTIAKKSGGERHISAPMPRMKRAQYWVLDNILAKMPVHDAVHGFLPGRSILTNAAPHVGQDVVINLDLKDFFPSIGMRRVRGVFRQLGYSSQVASLLALVCTEAPTDEVQLDGRRYFVARGERVLPQGAPTSPMLTNLLCRRLDARLAASAAKLGFRYTRYADDLSFSAGPAHSRDTAKLLWRVKQIVASEGLTVHPDKQQVMRRHRQQHVTGIVVNDKLSLDRDTMRRFRAVLHQAESRGPQGLRWNGNSDVIGALRGYANFIAMTDAARGAPYVERVRALAAKHGDGKATAPAVQQTQPSQRSLPAGQFRKQSAAGQAPWPEWWQPAQAPAPILEKTAEQIAEEKKAQREAARAQAAPPAVARPAQTQQAPAAQPAATTSTPAAPGALSHIGWIASMMFQALYVVTTFLAGSSPLIWLLTGGVFISNFLRRKSGWGGFLAAVVVSSAVASLVHSMRK

SEQ ID NO: 6115 - protein, 642 aa, unidentified
  source 1..642: note = Related to CP063166.1; note = Variovorax paradoxus
MTPPSPSSVPDSALTREQLYERIRASSKQEVVLEEMQRLGFWPRDTAQPTVEAQLIRREGELQTALRDLGDELRGIEDRETALKSMRKERMARARERREETRQRLAQQRHARALDWHGRRQRELLYLGEGVSGGLNEARSDEQSLARHALPALHDATDLARAMGLELGELRFLAWHREVARVSHYQRFTVPKKTGGERRISAPMPRLKRAQYWVLDNVLAKVPVHEAVHGFLPGRSILSNAAPHVGQAVVVNLDLQDFFPSIGLRRVRGVFRQLGYSPQVATLFALLATEAPTDEVELDGERYVVARGERVLPQGAPTSPMLTNVLCRRLDARLAACAARLGFRYTRYADDLSFSADAEHGRDVGKLLWRAKQIVASEGFVVHPDKQQVMRRHQQQHVTGIVVNDKLSTDRDTLRRFRAVLHQAERHGPQGLHWNGQHDLVAALRGYANFIAMADPARAEPYLRRVKALAAKHASAPATAATPARAPLPAGHFRRQSAAGLAPLPTWWQPARAPEPVLEKTPEQIAAEKKAKREAERERQRAQEEPQRVEQAPPRTAEPAAAPQTAKPRSTLSLLGLWVSIAIQGTYVLGFLLSLRDAWLIGLMTGAIWVANIYQRKAGWMRFFIALIAGSGLSAVLRKMWS

SEQ ID NO: 6116 - protein, 635 aa, unidentified
  source 1..635: note = Related to NZ_JAGSPN010000003.1; note = Undibacterium luofuense
MLTMTANSTTPAKPLSQMTRDELYAHVRSQGKDLIVLREMQRLGYWPQSTDIPAPEEELLEREKFLTQRLLDMQSELAKISDPEKALRLLQRERMDAARERREQTRREKIKQRYEKAQAFWQRRQTGIDYIGEDLSAGLVQQQSNVQRLQQYGLPEFHDAAGLASFLNISLPELRFLSFQRKVSRYSHYQYFSLKKKTGGLREIAAPMPRIKRVQYRILDALLQKVPVHDAAHGFVGGKSVLSNAIPHTGQAIVINLDVKDFFPSVGWRRVKGIFRQLGYSEQAATLLSMLCTELPVSPVKIDGQQWLVARADRRLPQGAPTSPALTNLLCFGMDKRLQQLAQRLGFRYTRYADDLTFSAAEPKAPVGKLLWRVSKLMTAEGFTLHPDKQRVMRAHQRQEVTGIVVNQHPSLNRDTLHRFRSLLNKLEKQGPAGLHWNGNTDVLRAAEGFARYLMMVQPSKGAVALQRVHRLKKQWSGAPAFTGGNVWRKTAADGGVPLRKNGAQWWKASTTPAPVQEKTDLQRREQRMQEKHAQLAPDASNDAALPENRQAAPVNHTTQNAGANQSVSKLPPVISAGTMIADLIAGLTLSILMGVATPLLLTLLSFYATFRFRRNFRPLLLGVLILLLILHVMK

SEQ ID NO: 6117 - protein, 638 aa, unidentified
  source 1..638: note = Related to NZ_BMYU01000002.1; note = Undibacterium squillarum
MTANSTSSAKPLSQMTRDELYAHVSAQGKDLVVLREMQRLGYWPQQQDIPAPEQALLEREQVLTKRLRDMQSELAQISDPEKALRMLQRERMQAAREQREQTKRQHAQRRFEKAHAVWQRRQTDIDYIGDNLSAGLLQRTSDTQRLQRHGLPEIHDAAGLAAFLGISLHELRFLSFQRRVSRYSHYQYFSLKKKTGGLREIAAPMPRIKRVQYRILDALLQKVPVHDAAHGFVYGKSVLSNAQPHTGKAVVINLDVKDFFPSVGWRRVKGIFRQLGYSEQVATLLSMLCTELPVSPVDIDGQRWLVARADRRLPQGAPTSPALTNLLCFGMDQRLQKLAQRLGFQYSRYADDLTFSAADPKAPVGKLLWRVQQRMTAEGFTLHPEKQRVMRAHQRQEVTGIVVNQHPALNRETLHRFRALLNKLEKHGPAGLHWNGNSDVLRAAEGFARYLMMVQPSKGAPALQRIHRMKQQWGAAAAGTANVLWRKIAADGGVPPRSEGQAWWSAALPPEPVPELTDLQRREQRRQPAGTEKISEPVSQSRSGTDYDAGSPDAAPAQVFPENAEQTSMNLSKLPPSVSAGTMLTDLIAGLVLSILLKGALPLMMSLLSLYASFRWKRSFRPLLALAFVLLWLWHLSR

SEQ ID NO: 6118 - protein, 606 aa, unidentified
  source 1..606: note = Related to JAFGZG010000009.1; note = Methylobacterium goesingense
MTVRPGSLTRQQLYDRIRESSKDEVVLEEMIRLGYWPDGVDQPNLPDDLIRRRGEITREISDLHRREALWRDPEAALKAMHKRRKKAALVRRAETRLRGARDRHERALAWHERRKTEILYLGEGVSAGLSAQEAAPVSPANGLPPLASPAALARAIGISLGELRFLAYDRALTSVSHYQRFTIPKKTGGVRAISAPMPRLKRAQYWVLDVVLAQVPVHEAAHGFVPGRSILTNAAAHVGRDVVVNLDLKDFFPSLDYRRIKGKFRGLGYAEPVATVLALLCTEPDVDAVEIDGQQLYAARGPRRLPQGAPTSPALTNLVCTRLDARLSGLARSLGFAYTRYADDMTFSASGEAAAKVGPLLKYVHEIVAKEGFTVHPDKTRVMRRGRHQEVTGLTVNERVAVPRETLRRFRALLHGIERHGPIGRRWGRSADGAVLGAALGFARFVRMVTPEVGTPLVARARSLAERHGTQPEQARPRVAAFRERSAQGVPPREGGWVPAEPPVPHPDPLLVQAEAAQAEAARRAEGAADRRVVPPIGRQPPAPQPVSGQATDDADAAGMRPWMVVVGVFVLFQAAALLHPGLGLFVLAAALTIGLRRWLRRRRGK

SEQ ID NO: 6119 - protein, 602 aa, unidentified
  source 1..602: note = Related to BPQF01000021.1; note = Methylobacterium bullatum
MSVQPGSLTRQQLYDRIRESSKDEVVLEEMIRLGYWPAGKDQPNLPEEVIRRRGELARELTELHRSAALWTNPDAALKAMHKRRKKAALERRRETKLNGARGRHERALAWHGRRNREILYLGEGVSAGLSGGDAGASRADGLPELASPGAVAEAMGIGLGELRFLAYDRALATVSHYQRFTIPKKTGGLRAISAPMPRLKRAQYWILDAVLAHAGIHDAAHGFVPGRSILTNAALHVGRDVVVNLDLKDFFPTLDYRRIKGKFRGLGYAEPVATVLALLCTEPDVDEVEIDGQRLYAARGPRRLPQGAPTSPALTNLVCTRLDARLTGLAASLGFTYTRYADDMTFSASGEAAGKTGALLKYVHEIVAGEGFTVHPDKTRVMRRGRHQEVTGLTVNERVAVPRETLRRFRALLHGIEGHGPAGRRWGRSEGQAVLGAALGFARFVRMVTPEAGAPLVAQARRLAETHGAPQQSAQPRITPFRAQSARGVPPREGWWSPAERPPPQPDPILLEAERPAISAPGRSGLPSIGRRPAPPPDQPRPGSPPGGDIEEDTPLKPWMAVLGVFVLFQAGAIVHPVIGLLVLAAALVIAIRRWLRRRRRR

SEQ ID NO: 6120 - protein, 606 aa, unidentified
  source 1..606: note = Related to JACHWM010000004.1; note = Methylobacterium sp.
MSAQPGSLTRQQLYDRIRESSKDEVVLEEMIRLGYWPEGADQPNLPEDLIRRRGEISRAITDLHRREALWRNPDAALKEMHRRRKKAALKRRRETKLRNAQGRHERALAWHARRDDELLYLGEGVSAGLSRPAHPAREPTPGLPALASPKVLAQAMGISLNELRFLAYDRALATVSHYQRFTIPKKAGGLRTISAPMPRLKRAQYWVLDALLARAPVHEAAHGFVPGRSIVTNAGAHVGRDVVVNLDLKDFFPSLDYRRIKGKFRGLGYAEPVATVLALICTEPDVDAVEIDGQTLYAARGPRRLPQGAPTSPALTNLVCTRLDARLSGLARSLGFTYTRYADDLTFSASGEASGKVGALLKYVHEIVAAEGFTVHPDKTRVMRRGRHQEVTGLTVNERVAVPRETLRRFRALLHGLERHGPTGRRWGGSGENGVLRAALGFAHFVRMVTPDAGAPLVARAQALAEPNGVQVPAARPRMSEFRARAARGVEPLPRWWESAARPVPEPDPILAQAAAEAAAPARRATPSGRSFVPVIGRSSAPSSVDPAPAPQVDPEAAPMKPWMVALGVFVLFQAGVVIHPVIGILVLAAALLIGLRRWLRRRRDQ

SEQ ID NO: 6121 - protein, 632 aa, unidentified
  source 1..632: note = Related to CP001001.1; note = Methylobacterium radiotolerans
MSQQPGSLTRQQLYDRIRESSKDEVILEEMIRLGFWPDGEAQPNPPDDLIRRRGEIARALADLHRREAAWRDPEAALKEMHRRRKTAALERRRETRLRNARDRHARAQAWHARREAEILHLGDGVSAGLSAGLAHAAPDAGTPARGPAPGLPPLASPKALAEAMGIGLGELRFLAYDRALSTVSHYRRFTIPKKAGGLRRISAPMPRLKRAQYWILDALLAHAPVHPAAHGFVPGRSIVTNAAAHVGRDVVVNLDLKDFFPSLDYRRIKGKFRGLGYAEPVATVLALLCTEPDVDAVEIDGARLYAARGPRRLPQGAPTSPALTNLVCTRLDARLSGLAGSLGFTYTRYADDLTFSASGEAAGKVGALLKYVHAIVAGEGFTVHPDKTRVMRRGRHQEVTGLTVNERVGVPRETLRRFRALLHGLERHGPVGRRWGAAGEAGVLRAAVGFAQFVRMVTPETGAPLLARARALADRHADRPSARPGARPLPDFRARSARGEVPLARWWAPAPRPAPEPDPILAEAEAAAAREAEEAAARAAARAAAPVPGRSGVPVSGRPRLGAPEPTARAEVAPDTGAEPDDAPMKPWKVILGIFVLFQAAALLHPALGLLVLAVALLLGLRRLLRRWRRRR

SEQ ID NO: 6122 - protein, 604 aa, unidentified
  source 1..604: note = Related to NZ_JACJIM010000008.1; note = Methylobacterium fujisawaense
MSPQPGSLTRQQLYDRIRESSKDEVILEEMIRLGFWPDGAEQPNPPEDLIRRRGEIARALADLHRREAAWRDPEAALKEMHRRRKTAALERRRETKLRNARDRHARAQAWHARREAEILHLGGGVSAGLANADAPARGPAPGLPALASPKALAEAMGIGLGELRFLAYDRALSAVSHYRCFTIPKKAGGLRRISAPMPRLKRAQYWILDALLAHVPVHGAAHGFVPGRSIVTNAAAHVGRDVVVNLDLKDFFPSLDYRRIKGKFRGLGYAEPVATVLALLCTEPDVDAVEIDGARLYAARGPRRLPQGAPTSPALTNLVCTRLDARLTGLAASLGFTYTRYADDLTFSASGAAAGKVGALLKYVHAIVAGEGFTVHPDKTRVMRRGRHQEVTGLTVNERVGVPRETLRRFRALLHGLDRHGPAGRRWGAAGEGDVLRAAVGFAQFVRMVTPETGAPLVAQARALADRHGLRPAVRPQPDFRARSARGAMPLARWWAPAPRPAPEPDPILAEAEAAAAPVPGRSGVPASGRPRFGTPEPVAPAQAAPGTVAEADDAPMKPWKVVLGVFVLFQAGALLHPALGLLVLVVALVLGLRRLLRRWRRRR

SEQ ID NO: 6123 - protein, 601 aa, unidentified
  source 1..601: note = Related to NZ_FOPM01000031.1; note = Methylobacterium gossipiicola
MSAQPGSLTRQQLYDRIRESSKDEVVLEEMIRLGYWPDGADQPNLSDDLIRRRGEITRALGDLHRREALWRDPDAALKEMHRRRKKAALERRRETKLCNARDRHARALAWHARRDDELLYLGEDVSAGLSAAAEGREPLAGLPVLADPKAVAQAMGISMAELRFLAYDRALATVSHYRRFTIPKKTGGLRTISAPMPRLKRAQYWVLDAVLTHAPTHEAAHGFVPGRSIVTNASAHVGQDVVVNLDLKDFFPSLDYRRIKGKFRGLGYAEPVATVLALICTEPDVDAVELDGQSLYAARGPRRLPQGAPSSPALTNLICTRLDARLSGLGRNLGFTYTRYADDLTFSASGAAAAKVGALLAHVHEIVAAEGFTVHPDKTRVMRRGRHQEVTGLTVNERVGVPRETLRRFRALLHGLERHGPAGRAWGRSGEDGVLRAALGFARFVRMVTPEVGAPLVARAKALAERDGVPATAIRPRVSPFRERAARGVAPLPNWWEPAARPAPEPDPILAEAAARLASGAPTGRSGVPAIGRTTAAPANEPVPAPKDDPDAAPMKPWMVVVGLFVLFNAGAVIHPALGFTTLAVALVIGLVRWLKRRRTR

SEQ ID NO: 6124 - protein, 613 aa, unidentified
  source 1..613: note = Related to NZ_CABFVH010000047.1; note = Methylobacterium dankookense
MTLRPGSLTRQQLYDRIREGSKDEVVLEEMIRLGYWPDGAEQPNPPAELIRRRGEISRAIADLHRREALWRDPDAALKEMHRRRKKAALERRRETKLRGARGRHERALAWHARRDAEILHLGEGVSAGLSGTDADPRALKAGLPALANPKAVAEAMGISLGELRFLAYDRPLSTVSHYRRFTIPKKTGGERTISAPMPRLKRAQYWVLDALLARAPLHEAAHGFVPGRSIVTNAAAHVGRDVVVNLDLKDFFPTLDYRRIKGKFRGLGYAEPVATVLALICTEPDVDAVEIDGQRLYAARGPRRLPQGAPTSPALTNLVCTRLDARLAGLAASLGFAYTRYADDLTFSASGEAAGKVGPLLKYVHAIVAAEGFTVHPDKTRVMRRGRHQEVTGLTVNERVAVPRETLRRFRALLHGIERHGPAGRRWGKGGDGTVLQAALGFARFVRMVTPEAGAPLVAQVRALAERHGARQAPAQPRIATFRARSADGVAPLARWWIPAARPLPAPDPIIAEAEAAEAEARRKRQDGPGRVPGRSGLPAVGLRPAPAPEPARQADPVQGDRDGTPMKPWMAVLGVFVLFQAAAVLHPGLGLLVLVAALAIGLRRWLRRRRGR

SEQ ID NO: 6125 - protein, 601 aa, unidentified
  source 1..601: note = Related to NZ_CAKLBV010000001.1; note = Methylobacterium sp.
MSAQPGSLTRQQLYDRIRETSKDEVILEEMVRLGFWPDGAERPNLPDALIRRRGEIVRTLGELHLREALWSDPDAALKEMHRRRKKAALERRRETKLRNARGRHERALAWHARRDEDLFHLGEGVSAGLSAPDAAGHAPAPGLPALASPKALADAMGIGMGELRFLAYDRALTAVSHYRRFTIPKKAGGERLISAPMPRLKRAQYWVLDALLAHAPVHEAAQGFVPGRSILTNARAHVGRDVVVNLDLKDFFPTLDYRRVKGKFRGLGYAEPVATVLALLCTEPDVDAVEIDGQRLYAARGPRRLPQGAPTSPALTNLICTRLDQRLSGLGRSLGFTYTRYADDLTFSASGEAAGRVGPLLKYVGEIVASEGFTVHPDKTRVMRRGRHQEVTGLTVNEQVAVPRETLRRFRALLHALERHGPTGRRWGRSADAGVPRAALGFARFVAMITPEAGAPLVAQARRLAERHRAGAAMARPVIPVFRSRAAQGAAPWEPWWRPAKPQAPTPDPILIEAEAEAAALRETEGDRPRRRTSARSWLPSIGRSTDTALAGTGRAPMKPWMIALGVFVLVQAATVIHPALGGLVLIAALGVVLWRWFRRR

SEQ ID NO: 6126 - protein, 611 aa, unidentified
  source 1..611: note = Related to NZ_JACHOP010000028.1; note = Methylorubrum rhodinum
MSTQPGSLTRQQLYDRIRESSKDEVILEEMIRLGFWPDGADRPNVPADLIRRRGEISRELADLHRREALWRDPEAALKEMHRRRKKAALERRRETKLRNARTRHERALAWHARRNEDVLHLGEGVSAGLLAPDETGREPGPGLPRLANPKALAQAMGIPMGELRFLAYDRALATVSHYRRFTIPKKTGGTRLISAPMPRLKRAQYWVLDALLAHAPVHESAHGFVPGRSIVTNASAHVGRDVVVNLDLKDFFPTLDYRRVKGKFRGLGYAEPVATVLALLCTEPDTDDIEIDGQRLHAARGPRRLPQGAPTSPALTNLICIRLDRRLTGLARNLGFTYTRYADDLTFSASGTAAEKVGPLLKYVGEIVAAEGFTVHPDKTRVMRRGRHQEVTGLTVNERVAVPRETLRRFRALLHALDRNGPAGRSWGRSADHAVLRAALGFAHFVRMVTPEAGAPLVAQTRRLAERHGVGVGEARPRIPSFRQRSAEGAVPLARWWSPAEPSAPRPDPILAEAEAEAAKAAEHARRPAAPGRSGLPSIGRAGPSGAARPLGDPEPPSGSGADGGTMKPWMVVLGVFVLFQAGAVVHPVIGLLVLVAAVVIGLRRWFRRRR

SEQ ID NO: 6127 - protein, 598 aa, unidentified
  source 1..598: note = Related to NC_011894.1; note = Methylobacterium nodulans
MTAQPGALTRQQLYDRIRETSKDEVILEEMIRLGFWPQGETQPSPPEELIRRRGEIARELAALHTAEARWRDPEAALKEMHKRRKKAALERRKETKRRGAEQRHARALAWHERRAEELVFLGDGVSAGLRADAAAPPAPRPGLPVLATPKALADAIGIPLAELRFLAYDRALSRISHYWRFTIPKKAGGVRLISAPMPRLKRAQYWILDNLLAHAPVHDAAHGFVPGRSIVTNAAAHVGRAVVVNLDLKDFFPTLSFRRVKGKFRGLGYAEPVATVLALLCTEPDVDEVEIDGERLFAARGPRRLPQGAPTSPLFTNLICARLDARLSGLARSMGFTYTRYADDLTFSGAAAEKIGALIGLVGEIVAAEGFVVHPDKTRIMRRGSRQEVTGLTVNERVAVPRDVLRRFRALLHQIEATGPAGKSWGQTRDVMAAARGFACFVRMVTPEAGEPLVATVRRLGERHGLTGTAPAPAAFRAKAAAGEPPLARWWIPAAPPAPEPEAVLREPAPPQPAKPMRSALDLASLRADLRDRAAPPAGPAQDPGEPAMKPWVAVIGVLVLWSAASAINPALGTIVLIAAIVIATRWLIRRWRRRRRR

SEQ ID NO: 6128 - protein, 606 aa, unidentified
  source 1..606: note = Related to NZ_JAFBCY010000002.1; note = Methylopila capsulata
MSAQPGELTRQQLYDRIRESSKDEVILEEMIRLGFWPRNANKPDVPEALIRRRGEIDRELAALHAQEARWRDPDAALKEMHKRRKKAAMERRKETKRGHAQTRYERAVAWRERRATEILYLGEGVSGGLGGTDPARPLKAGLPEITSPKALADAIGVPLAELRFLAYDRKLSRISHYQRFAIAKKTGGVRQISAPMPRLKRAQYWILDALLGHAAVHDAAHGFVRGRSIVTNAARHVGRDVVVNLDLKDFFPTLDFRRVKGKFRGLGYAEPVATVLALICTEPDVDEIEIDGERLFAARGPRRLPQGAPTSPLLTNLICARLDARLTGLAASLGFVYTRYADDMTFSASGEAAAKVGAMLKFVNEIVAAEGFVVHPDKTRVMRRGGRQEVTGLVVNERVAVPRDVLRRFRALLHQIEATGPAGKRWGKARDVMDAATGFACFVRMVTPEIGEELLATVRRLDARHGAARAGAAPSKSPHGDFRGKAAAGVAPLARWWTPAEPPPPEPEPILREPEAAPEPDPPTSPQRPRSALDIAGLRAEMRDRAASAPEPQPDETEMKPWVAAIGIFVLLNVAFGIHPLLGLIALVATVVMVIRRALRRRRRRR

SEQ ID NO: 6129 - protein, 610 aa, unidentified
  source 1..610: note = Related to NZ_JACIDN010000003.1; note = Methylobacterium brachythecii
MTVQPGSLTRQQLYDRIRESSKDEVILEEMIRLGFWPGDEAQPNLPAELIKRRGDIHREISELHKKERLWSDPETALKEMHKRRKKEALARRKETKLRNARGRHDRALAWHERRKSDVLYLGEGVSAGLHSDGVAKPLKPGLPALGSPKALAEAMGIPLAELRFLAFDRALSRISHYQRFTIPKKTGGERLISAPMPRLKRAQYWVLDAILDKVAVHEAAHGFVPGRSILTNAGAHVGREVVVNLDLKDFFPSLTFKRVKGKFRGLGYPEPVATVLALLCTEPDVDELELDGERLFAAKGPRRLPQGAPTSPMLTNLVCIRLDKRLAALAASLGFTYTRYADDMTFSASGEGAAKVSALLKYVGEIVTAEGFTVHPDKTRVMRRGRHQEVTGLTVNERVAVPRETLRRFRALLHQIGKNGPEGRHWGKARDVFDAALGFSFFVRMVSPAIGDPLIAEVRSLAARHGHAPKAVPEPTAFRAKSARGEAPLARWWIPAERPAPEPEAILIEPPKPAPRPAQANAPRSAIGAAAGMRARMQQEGPSGAWNQGSGRQTVEDGSIGSAFRRLPRRTYKILGILMLFGLVASVSPRLAALGLIFLIGYVIAERKKR

SEQ ID NO: 6130 - protein, 599 aa, unidentified
  source 1..599: note = Related to NZ_LABY01000112.1; note = Methylobacterium variabile
MTVRPGSLTRQQLYDRIRESSKDEVVLEEMIRLGFWPGDAAQPDLPAALIKRRGEIHREIADLHAEERLWRDPETALKAMHKRRKTEALARRRETRLRHAQGRHDRALAWHARRGSEVLFLGPEVSAGLHSHAARRPLLPGLPDLATPKALADAMGLPLAELRFLAYDRALARISHYQRFTIPKKTGGERLISAPMPRLKRAQYWVLDAILAKVPVHEAAHGFVPGRSILTNAGAHVGRDVVVNLDLENFFPTLTFRRVKGKFRGLGYPESVATVLALLCTEPDVDELELDGERLFAARGPRRLPQGAPTSPMLTNLVCTRLDRRLAALAASLGFTYTRYADDMTFSASGEGAAKVSVLLRGVGTVVAAEGFTLHPDKTRVMRRGRRQEVTGLTVNERVAVPRDTLRRFRALLHQIDRSGPAGKRWGVARHVFDAAFGFACFVRMVSPATGDPLVSEVRRLSARHGTAQRAVPEASAFRARAARGETPLARWWSPAERPPPTPEPILLESPDPAPSTVPQSAIGAAAGAQTADRDGVWGRMPDDLPPGKAGLSRIVSGLLTLAGGLVLFVALLRISPPLALLGALVLAGLYAAGFFRRR

SEQ ID NO: 6131 - protein, 609 aa, unidentified
  source 1..609: note = Related to NZ_SNZR01000011.1; note = Enterovirga rhinocerotis
MTVQPGSLTRQQLYDRIRESSKDEVVLEEMIRLGFWPGNEKQPNLPADLIKRRGEIQREIGELYRQQRLWRDPESALKEMHKRRKKEALLRRKETRRRNAAARHERALAWHERRKTEILYLGAGVSGGLGANEPELGRSPRDGLPEVATPKALADAMGIPLGELRFLAYDRALSRVSHYQRFTIPKKTGGERLISAPMPRLKRAQYWVLDNLLAKAPLHEAAHGFVPGRSILTNAGVHVGREVVVNLDLKDFFPSLTFRRVKGKFRGLGYPEAVATVLALLCTEPDVDELDLDGERLFAARGPRRLPQGAPTSPALTNLVCIRLDKRLTALAGSLGFAYTRYADDMTFSASGEGAAKVAVLLKMVGEIVADEGFTVHPDKTRVMRRGRRQEVTGLTVNERVAVPRDTLRRFRALLHGIDKQGPEGKSWGVARDVFDGALGFAFFVRMVTPEIGEPLVAQVRALAARHGGRDVAAPAISAFRAKAARGEAPLDRWWQPAERPAPKPEPVLAGAAPAPAPNGIRSAPGAAAGTGRPSPEATSVWGPGPARSAPESGSPSVTGSLWRLSIGLLKLAALLMLFSAGMVFAPRLAILGVFALIGVLAYRFIRRG

SEQ ID NO: 6132 - protein, 595 aa, unidentified
  source 1..595: note = Related to VOHA01000021.1; note = Reyranella sp.
MTEPGTLTRQQLYDRIRESSKDEVILEEMIRLGFWPPGADQPDVPADLIRRRADLQREIADLHRQEALWRDPEAALKEMHKRRKKAALQRRAETKLRNAKGRHERALAWHERRQQELLYLGDGVSTGLHQTGTAMAPKAGLPSIASPKALAEAIGVSLSELRFLAYDRAVTRVSHYQRFTIPKKAGGERLISAPMPRLKRAQYWVLDNLLAKAVVHDAAHGFVPGRSILTNATPHVGRDVVVNLDLKDFFPTLTFRRVKGKFRGLGYSEAVATVLALICTEPDVDELEVDGERLFATRGPRRVPQGAPTSPVLTNVICFKLDARLSGLARALGFTYTRYADDMTFSASGEAAKKVGALLKYVREIVTAEGFVVHPDKTRVMRRGAHQEVTGLTVNERVAVPRDTLRRFRALLHQIETSGPVGKTWGAARDVLDAALGFAFFVRMVTPSSGEVLVTQVRALAARHGATPVPAVAPRDFRVKAARGETPLGRWWIPRERPAPAPEPVIVAHEAAAQAAAAPGTSRATSAGQAQLPPAFTPAPAAPAAKRGGTLATIGKWILGLLVFIVLMGIHPVLGGLFIAAVVGYMATRKRGGRD

SEQ ID NO: 6133 - protein, 523 aa, unidentified
  source 1..523: note = Related to NZ_LLXZ01000195.1; note = Bradyrhizobium jicamae
MTETVSPGTMTRQELYDRIRQSSRDEVILEEMIRLGFWPDEGAPAPAAETIRERAEAMRELSELQRQNATLADPVRALKEMHKRRKAEAMARRQETKRRNAEARQTRAFAWFERRKRDVLYLGEDVSPGLHSRTTTIPLHDGLPPLADAKALADAIGVPLGELRFLAFNRKVASVNHYQRFTIPKKSGGERLISAPMPRLKRAQYWVLDNILARVPLHDAAHGFAPQRSILTNARNHVGRDVVINLDLKDFFPTLTYARVKGLFEALGYAEAVAIPLALLCTEPVVDEVTLDGERHFIADGPRLLPQGAPTSPAITNLICRRLDRRLMGLARTLGFVYSRYADDLTFSASGEAVKKIGTLLKAVHGIVEAEGFKVHPDKTRVMRRSTRQEVTGLTVNEALAVPRDLLRRYRAVLQQVERHGPDGKHFGPGKDVIRSLLGFGHFAVMVDPESGTPLLQRAQRLAAQYAPTRSERLPTRAAFRKAASAGQTPPGRQWTPAERPPPAPDPVLVALARQEEKTRAAQ

SEQ ID NO: 6134 - protein, 604 aa, unidentified
  source 1..604: note = Related to NZ_LFLZ01000017.1; note = Bradyrhizobium tropiciagri
MNETVAPGTLTRQELYDRIRQSSKDEVILEEMIRLGFWPDGEDAPAPAADAIRGRAEAMRELTELQRQNATLADPERALKEMHKRRKAEAMARRQETKRRNAEARQSRAFAWYDRRKRDVLYLGEDVSLGLHTRTTTTPLRDGLPPLADAKALADAMGVPLGELRFLAFNRKVASVNHYQRFTIPKKSGGERLISAPMPRLKRAQYWVLDNILARVPLHEAAHGFAAQRSILTNARNHVGRDVVINLDLKDFFPTLTYARVKGLFEALGYAEAVAIPLALLCTEPMVDEVALDGERHFVADGPRLLPQGAPTSPAITNLICRKLDRRLVGLARTLGFVYSRYADDLTFSGSGEAVRKIGTLLKAVHGIVAAEGFTVHPDKTRVMRRSSRQEVTGLTVNEAVAVPRDLLRRYRAVLQQVERHGPAGKHFGPGKDVIRSLLGFGHFAVMVDPESGAPLLQRALRLAPQHAPARSARRPTRAAFRKAAAAGQTPPGRQWTPAERPPPAPDPVLVALARQDAKKRAAQARAAAPSPSRPPNVPPPPPGVTRPDGPPPAARPATAPSGKRPWFVTALVILLALALLPLPGGPAMAGALLFLYFSRWWKR

SEQ ID NO: 6135 - protein, 474 aa, unidentified
  source 1..474: note = Related to CP069300.1; note = Bradyrhizobium sp.
MIRLGFWPDGEDAPAPAADVIRARADAMRELTELQRQNAMLGDPQRALKEMHKRRKAEAMARRQETKRRNAEARQSRAFAWYDRRKRDVLYLGEDVSRGLHARTTATLLRDGLPPLADAKALADAMGVPLGELRFLAFNRKVASVNHYQRFTIPKKSGGERLISAPMPRLKRAQYWVLENILARVPLHDAAHGFAPQRSILTNARNHVGRDVVINLDLKDFFPTLTYARVKGLFEALGYAEAVAIPLALLCTEPMVDQVALDGERHFIADGPRLLPQGAPTSPAITNLICRKLDKRLVRLSRVLGFVYSRCADDLTFSGSGEAVKKIGTLIKAVHGIVAAEGFNVHPDKTRVMRRSSRQEVTGLTVNEAVAVPRDLLVALARQDEKKRAAHARVTAPIPSRVPNVPSPPADATRAAGPQAAPATGPATAPSKKRQPWFVTALVILVALAFLPLPGGPAIAGAMLFLYFSRWWRR

SEQ ID NO: 6136 - protein, 611 aa, unidentified
  source 1..611: note = Related to NZ_CP043489.1; note = Labrys sp.
MNQTVAPGTLTRQELYDRIRESSKDEVILEEMIRLGFWPDGTAAPSPAAAAIRERGEAMRELGELQRQNALWSDPERAIKEMHKRRKAEALAQRTETRRRHAQARQDRAEAWHIRRQREVLYLGEGVSAGLSADPIRRSLLPGLPDIADAKALADGIGIPLSELRFLTYSRKVSSVSHYQRFRIPKKTGGERLISAPMPRLKRAQYWVLDNILARVGLHEAAHGFVPQRSILTNARNHVGKDVVVNLDLKDFFPTLTYARVKGMFRSLGYAEKAAIPLALLCTEAKVDEVHLDGERHFVGDGRRLLPQGAPTSPTITNLICRYLDRRLDGLANELGFTYSRYADDLTFSGSGEAVRKIGTLLKAVQSIVTAEGFTIHPDKTRIMRRSGHQEVTGLTVNERVAVPRPLLRRYRAVLQQVEKHGPAGRHFGPGKDVVRSLLGFGQFAAMIDPDKGRALLERARRLASQSTANSKLSRSGGQAAFRAAAAAGRAPAGCHWTPTERTAPALDPVLAALEREEAKKAEQAQRKAHASQQAMAQSALRRPSAEPAGQARGQAQGSSGQPARKKLRFTPKRLLMIAAIVIFPTLIPGVGPFIAGLLLYLYLRWMWKQG

SEQ ID NO: 6137 - protein, 544 aa, unidentified
  source 1..544: note = Verrucomicrobia bacterium; note = Related to JACMJA010000359.1
MSILPENTQPRTRQELYDLIRQTSRDEFVLNEMIRLGFWKKNEGQPSLPEQLIRQETQLHQELKTLVSEKKRLDDQQKMLKEMRKKRMLESRLKREETKKRRELERQQKAENWKNKKTTEIGYLGENVSSGLNFTASNPEKLSRYNIPFFTNAVSLAQALNISVGELRFLAFSREVSKVNHYHRFQIPKKTGGQRLISAPMPRLKKVQTWILENVLEKIELHTSAHGFVASRSIVSNAIPHLKAETVVNLDLKNFFPTLTYARIKGLFLGLGYSEAMATLLGLLCTEPETDAVILDKETWFVASGERFLPQGSPASPALTNIICATLDKRLQGLAQKLGFVYTRYADDLTFSATGEGTKNIHKIISLTQKIVEDEGFSVHPDKTRIMRKGSKKEVTGIVVNEKPSVDRTTLRKFRALLHQMEKEGFAGKSWGHTPDVLAAVEGYANFVKMVDAEKGDKFKQQIKGIIAKWGDSIPTPVRKVYPKKEKQTVSPVFETMTILPTSETQISENQVVIPQVTIPETANKDTSNEKPEEKKTFWKTWKK

SEQ ID NO: 6138 - protein, 525 aa, unidentified
  source 1..525: note = Related to NZ_FNFO01000004.1; note = Catalinimonas alkaloidigena
MAEETPPQPRTRQELYDQVRQSSREAVTLREMARMGFWPKGQGIPPIPQALLEKQQALQQELQPLVEQSRKMEDRVRMLKELRKKRMAESRQKRKETKERRERERQARQAAWEQRKTHEILYLGEGVSGGLSQTDDDAQKLQHYQLPRFENAKALAEDMGITVNALRFLAYNRPVSTLTHYQRFTMPKKTGGQRLISAPMPRLKDAQYWVLHHLLQLLPVHEAVHGFCAGRSIVSNARPHVGRQVVLNFDLKDFFPTLTYTRIKGLFCALGYAEAIATPLALLCTEPDTDEVTLDGQTYYVANGERYLPQGAPTSPALTNLICLRLDRRLTGLATKLGFTYTRYADDLTFSADAEGMKHINTLRVMLHRIVEEEGFQVHPDKSRVMRKGSKQEVTGIVVNEKPGVDRATLRRFRALLFQIEKDGIAGKRWGTSPDVVAAIHGYANFVAMVDPEKGKALQERVARIIATVAPHFKKRPRKTYPARSGKWLQTASSEASSSEASTDSGNVNAIPEPPAAKKPWWKFW

SEQ ID NO: 6139 - protein, 542 aa, unidentified
  source 1..542: note = Related to CADCTQ010000349.1; note = Cytophagales bacterium
MAEQSNLPEGTRPADRQELYDLIRRTSKDDFILRDMKRLGFWPDDAGQPTLPEQVIFRETDLNRELSALLTEKRRLEEQEAMLKELRKQRLAESRLKREETKQKREQARKDKAADWQRKKQSGILYLGEGVSGGLNETAADPGKLAGLNLPVLTDAASVALAMQVPVGQLRFLAFSRQVSRTTHYQRFYVPKKTGGERLISAPMPRLKAAQAWILANILDRVPSHEAVHGFLPGRSIVTNAAPHVGAGVVINLDLKDFFPSITYRRVKGVFRALGYSESVATILGLLCTEPQVDQAELDGETWYVATGERHLPQGSPASPAITNILCATLDRRLQGLARKRGFSYTRYADDLTFSASGEGTKNINILKNAVKAIIESEDLTLHPDKTRIMRMGSRKEVTGVVVNDKPGVDRTTLRRFRALLHQIELKGPQGKKWGHSADLLAAIEGYANFVLMVDAEKGKKLKAQVKAIAQKYGDAMPRRPRKVYPKKEKPAAPTPATATVAALPPTPPPPPVPAQPPVPGPDASAPESAEPKKTWWKLWKK

SEQ ID NO: 6140 - protein, 535 aa, unidentified
  source 1..535: note = Related to JACMKY010000311.1; note = Ferruginibacter sp.
MSSDSEPLRPATRQELYDRLRQAGTRDAFLLEEMKRLGFWPSNHEVPNVSEQFILREADLARELRALYSEHRRLEDEAAMLRELRKQRLAESRQRREVTKLRRERERKDRADQRKKRQESEIGYLGEGVSGGLNHPEADEARLARFHLPVLTDAQSVAGSLGVSVGELRFLAFSRAVSRTNHYQRFYLPKKTGGRRLISAPMPRLKAAQYWILENILRLVPVHDAAHGFVGGRSIVSNARPHVGAQVVINLDLKDFFPTVTYPRVRGVFRKLGYSEAAATILALLCTEPDVDQAELDGETWFIADGERHLPQGAPTSPALTNLLCTRLDRRLAGLAAKLGFAYTRYADDLTFSASGERTKNVNKLRSLVHLIVEGEDFRVHPDKTRVMRPGSRKEVTGIIVNDKPGVDRTTLRKFRALLHQIEQEGIAGKRWGHTDDVLAAIQGYARFVAMVDAQKGQVLTARVKAIIDQIEPAFAKRPRKTYPQGARRWIKKMVVAETPTASGVPANPSAPTPNPEKPQGIVWKLLGKLGGKKK

SEQ ID NO: 6141 - protein, 516 aa, unidentified
  source 1..516: note = Saprospiraceae bacterium; note = Related to JADLDL010000134.1
MAEQSNLPDGARPTTRQELYDLLRRDGLNRDSFVLQDMKRLGFWPDTKDQPSVPEQFLNRESQLYRELNALVTEKRRVEDREQLLKELRKQRMAESRRKREETKKRRIEAARLRAENWEKRKETEINYLGEGVSGGLNDTATDTERLALAQLPVLSDPAAIAAAMNIRVSELRFLAFSRAVSKTSHYRRFLIPKKTGGFRQISAPMYRLKDAQYWILQQILDKVPLHEAAHGFVPARSIVSNARPHVGAGVVINADLQNFFPSITYPRVKGVFRKLGYSDAAASTLGLLCTEPAIDEVVLDGENWFVAAGERFLPQGAPTSPAITNILCRQMDRRLQGLAQKLGFTYTRYADDLTFSASGEGEKKVNLLLKFVRQIIENEGFVLHPDKTRVMRTGRRKEVTGIVVNEKPGVDRKTLRRFRALLHQLETEGPAGKTWGHTPNLLAAIEGYANYVFMVDPEKGAALKAQVRQVAGALTRAPRKRYPARKKLAGSAPLPETPTAAPTEQESAKPWWKFW

SEQ ID NO: 6142 - protein, 467 aa, unidentified
  source 1..467: note = Candidatus Entotheonella factor; note = Related to KI932172.1
MPDEQPQTRQALYDRIRESSKWEVILEEMIRFGFWPAEGTLPDDPADEIRQRGELERELKALRTEQARLKNQAMMLREMRRRRLEASRLKQKENRERRERERQERAAAWQERKSREIGYLGPGVSGGLQAVESDTDRLESFGLPVLHTPAQLAEAMGLRVGALRFLAFSRDVSRTSHYVRFKMPKKTGGERLISALMPRLKQAQRWILDHLLVRLTPHDASHGFRHGRSIVSNARPHTGCAVVVNMDMKDFFPTVDYPRVKGFYRALGYSEAVSTVLALLCTEAETEEVVLDGITWYVTLGERHLPQGAPTSPAISNLICRRLDQRLSGIAGTLGLTYTRYADDLTFSAEAADAPMIGKLLRQTRFVVEAEGFELHPAKTRVMRRHQRQDVTGVVVNQQPAVARKTLKRFRALLHQIETTGPDGKHWGGNPNVLHSIQGFANYVYMVDPDKGAVLKQRVQRILASQR

SEQ ID NO: 6143 - protein, 467 aa, unidentified
  source 1..467: note = Related to PPXO01000342.1; note = Candidatus Entotheonella serta
MSEEQPQTRQALYDRIRESSLGEVILGEMIRHGFWPAENKIPEDPPEEAQQRGELERELKALRTEQARLKNQAAMLRELRRRRLQASRLKQQENRERHERERQARAAAWQERKARDISYLGSGVSGGLHGTESPAARLEQLGLPVFHTPSQLAEAMGLRVGTLRFLAFHRDVSRTSHYIRFKLPKKTGGERLISAPMPRLKQAQHWVLSNLLVKLTSHDASHEFRHARSLVTNAQPHTGQAVVINMDMKDFFPTVSYPRVKGFFQALGYSEAVGTVLGLICTEAETEEVVLDDTSWYVALGERHLPQGAPTSPAISNLICRRLDQRLHGIARKFGMIYTRYADDLTFSAEAEAPAAIGKLLRQTRFVVEAEGSQLHPTKTRVMRHHQRQDVTGGVVNQQPAVARKTLKRFRALLHQIETTGPDGKQWGGNPNVLHSIQGFANYVYMVDPDKGTALKQRVQRILAMQS

SEQ ID NO: 6144 - protein, 347 aa, unidentified
  source 1..347: note = Related to NC_019695.1; note = Chroococcidiopsis thermalis
MVVKHQATIPRLTEGSIEQLRKRGLPECNTDEEIALAMGISVEKLHFLAGDRSISSTSLYSRFQISKKTGAARTITAPTPELKAAQRWILKHILDKIEIHDAAHGFCRDRSIVTNATPHVGRDVIVKLDLQNFFQLITYKRVKELFHGFGYSETAATIFGLICTIATTNNSNKTSCKNIEKRHLPEGAPTSPAISNLVCDRLDTHLTKLANNLGFRYTRYADDLTFSCYGAAHKVDKLIQESKSIVTQESFTVNSDKTQVLSKSVQQIVTGIVVNQQLNLSRKTLKAFRATLYQIEREGLSGKKWGNSNNLIATITGFANYVAMVNPSKGAEFLASVERIKQKCDRS

SEQ ID NO: 6145 - protein, 348 aa, Scytonema sp.
  source 1..348: note = Related to JTJC03000001.1; note = Scytonema millei
MVVKHQATIPRLIEGSIEQLRKKGFPECNTDEEIAMAMRISVEKLRFLAGDRNLSSNSLYSRFQIFKKTGEARTISAPTPELKAAQRWILKQILEKIEIHDAAHGFCRDRSIVTNASPHVGKDVIVKLDLQNFFQSILYKRVKELFCSFGYSETAATIFSLICTVTKIDINGKNSCNDIEKRHLPQGSPTSPAISNLVCDRLDTHLTKLAHNFGFCYTRYADDLTFSSFEKTSRQVNNLIHGSKLIITEEGFTVNPDKIKVLSKSVQQEITGIIVNQQLNLSRKTLKAFRATLYQIEQEGLSGKKWGNSNNLIAAITGFANYVAMVNPSKGAEFLASVERIKQKCDRS

SEQ ID NO: 6146 - protein, 348 aa, unidentified
  source 1..348: note = cyanobacterium TDX16; note = Related to NDGV01000134.1
MNIQPQVTISRLTEGSIEQLRKRGLPECNTDEEIALAMGIGVEKLYFLTNKYPTSSTSHYFRFQISKKTGETRTISAPSPELKAIQKWILKHILEKIEIHDAAHGFCRNRSIVTNARPHVGRDVIVKLDLQNFFQSILYKRVKELFCSFGYFETAATIFSLICTVAEINVNNKINYKDTEKRHLPQGSPTSPAISNLVCDRLDTYLTKLANNLGFCYTRYADDLTFSGFENASHKINNLIHESQLIITEEGFTINPDKIKVLNKSVQQEITGIIVNQQLNLSRKTLKAFRTTLYQIEQEGLSGKKWGNSTDLIAAITGFANYVAMVNPSKGAEFLASVERIKQKCDRP

SEQ ID NO: 6147 - protein, 354 aa, unidentified
  source 1..354: note = Related to JAHHHA010000036.1; note = Cyanosarcina radialis
MSPSDEGDLNRLWSKGLPECNSEAEIALVMEMSIEKLRSLAFNYPTSSTTNYHRFQILKKPGESRAISAPMSDLKVAQKWISTRILEKIQVHDAAHGFRRNRSIVTNAKPHVSADIIVKIDLQDFFRSISYQRVKKLFLDVDYSETAARIFGLICTVNETEEIEIDGKINYKTIGKRHLPQGSPASPAISNIICYDLDRRLSQVAQELGFCYTRYADDLTFSGSRDVKSKISKLISETRTLIESEGFTINPNKTQILGTSVQQKVTGVVINKKLNVAKKTLKAFRATLYQIEREGLAGKRWGNSTDIMAAITGFANYVAMVNPNKGVELLTSIKRIEQKYAPPESPRFTIEEEF

SEQ ID NO: 6148 - protein, 317 aa, Chondrocystis sp.
  source 1..317: note = Related to NZ_AP018281.1
MYNTEAELALSMNISVKQLRWLAFKPFTYPVIHYSRFQIAKKTGETRTIYAPKPYLKTAQIYILKNILDNLAVHDAAHGFRRHRSIITNAQPHVGADIIIKLDLENFFSSITYKHVQKLFLSLGYSQSIGTLLSLICTIKDVETCHPRCLPSGSPASPTISNLVCYNLDQNLSQIASDLGFTYTRYADDLTFSGKRDRANISTLIKQLLAVIAQFGFKINPNKIQILPKSVRQEVTGIVVNHKLNISQTKLKAFRATLHQIEQDGLSGKKWGNSPNLIASITGFSNYVAMINPEKGGELLESVERIKQKHILNTPVL

SEQ ID NO: 6149 - protein, 354 aa, Oscillatoria nigro-viridis
  source 1..354: note = Related to NC_019729.1
MASKATYKLHVTSVSAEGHPKNLQLHGLAECNTAEEIALAMGISRGKLRFLTLNSPASTITHYTRFKISKKTGEERSIVAPGPNLKSAQRWILDNILEKLEVHSAAHGFCKKRSTVTNAKPHVGADILVKIDLQNFFQSISYKRVKGLFSGLGYSETAANIFGLICTAFEIKEIEKEGQINYTASGDRHLPQGSPASPAISNLICRHLDSRIAIVAKNLGFCYTRYADDLTFSGCGEAARRISNLMKEIKLIIAAEGFSINRDKTKIMGRSVQQEVTGIVVNTQLNISKKTLKAFRATLYQIEQEGLSGKKWGNSTNLIASIAGFANYVSMVDPSKGAELQLRVARIKQKYEGK

SEQ ID NO: 6150 - protein, 357 aa, Nostoc sp.
  source 1..357: note = Related to LWTK01000036.1
MYGTNLITIPLAMDGNSERLETDKSVVLRSHGLAEYNTVTEIACAMGITPGQLRFLTSSFSGSQVKHYVHFQISKKTGGERLISAPKPNLKAAQKWILQNILEKLEVHNSAHGFCKNRSIVTNAQPHVGNDVIVNIDLQNFFEAITYKRVKELFSGFGYSETAAKIFAVICTTSEIEIHGQANDITSGNRHLPQGSPASPAISNLICYHLDSRIAAMAENLGFCYTRYADDLTFSASGQASHKIYNLIKNVKLIINSEGFTVNFHKTNILSKSVQQEVTGVVVNTKLNISKKTLKAFRATLYQIEQEGLSGKHWGNSTNIIAAITGFANYVAMINPDKGAELRSRVERIKQKYECQE

SEQ ID NO: 6151 - protein, 349 aa, Nostoc sp.
  source 1..349: note = Related to LAHB01000047.1; note = Nostoc linckia
MYATNLTTTPLAIEGNSAVLRSHGLAEYHSAAEIACAMGINPGQLRFLTSSFPGSEVKHYVHFKISKKTGGERLISAPKPHLKAAQRWILENILEKLEVHHAAHGFCKNRSIVTNAQPHVGADVIVHIDLQNFFQSITYKRVKELFSGCGYSGIAANIFALICTTSEIEIHEQAHNISIENRHLPQGSPTSPVISNLICYHLDRRMVKMAENLEFSYTRYADDLTFSASGQASERRYKLIKNAKLIINSEGFTVNSHKTNILGKSVQQQVTGVVVNTQLNISKKTLKAFRATLYQIEQEGLSGKHWGNSPNIIAAITGFANYVAMINPNKGAELRSRVERIKEKYESQE

SEQ ID NO: 6152 - protein, 361 aa, Nostoc sp.
  source 1..361: note = Related to NC_010628.1; note = Nostoc punctiforme
MYSQNLTTIPLATESNLERLETDNLALLRSHGLAEYNTAEEIAFAMVISLEKLHFLTTSTSLTRHYLPFKISKKTGGKRIISAPKPELKAAQRWILENILEKLEVHNAAHGFCKNRSIVTNAKPHVGANVIVNIDLQNFFQSISYKRIKELFSGFGYSESTATIFGLICTTAEIAINGQINHTASENRHLPQGSPASPAISNLVCRNLDIRLAAIAENLGFCYTRYADDLTFSTSEDASSKISNLIKNTKFIIHGENFTVNDNKTKISSKSVQQEVTGVIVNTQLNISKKTLKAFRATLYQIEQEGLSGKSWGKSTNLIAAITGFANYVAMINPDKGAEFKSSVERIKQKYGGSQTDEVRF

SEQ ID NO: 6153 - protein, 346 aa, Nostoc sp.
  source 1..346: note = Related to NZ_CP012036.1; note = Nostoc piscinale
MSCQNYTQNNIEQLKKCNLDVYNNAEQIAAAMEISIDKLRFLTFTSKTSQISHYIYFKTAKKLAGDRIISAPMPDLKRAQYWILQNILQKIAIHDAAHGFCGDRSIITNANPHVGAEIIMNIDLQDFFSAITYQRVKGLFQSFGYASSVATIFGLLCTAPVVEERNLDGKTDFVEFKQRHLPQGSPASPAITNIICRNLDQRLCAIAEKFGFTYTRYVDDLTFSASGENLQHTKNIIKQVQSIISDEGFAINPDKTRILRNSQQQEVTGIIVNQKINISRKKLKSFRATLHQIENEGLEGKHWGNSSNLIASITGFANFVAMVNPEKGAEFQQQIQRIQEKYGKNK

SEQ ID NO: 6154 - protein, 346 aa, Nostoc sp.
  source 1..346: note = Related to AP018318.1
MNFQNHNQNNIEQLKKYNLDVYNNAEQIAASIEISIARLHFLAFNSQTSHISHYIHFKTAKKIAGTRIISAPLPDLKRAQYWILHNILQKIAIHNAAHGFCGDRSIITNATPHIGAEVIINIDLQDFFSAITYPRVKGLFQSFGYSSYVATIFGLLCTAPVVEERNVDGEINFVELKQRHLPQGSPASPAITNIICRSLDERLSAIATQFGFTYTRYVDDLTFSASGEQIKHTSSFIKQAQSIISDEGFAINPDKTRILRNSQQQKVTGIIVNQKINISRKKLKSFRATLHQIENEGLEGKYWGKSSNLVASITGFANFVAMVNPEKGAEFQQQIQRIQKKYGKKN

SEQ ID NO: 6155 - protein, 347 aa, Nostoc sp.
  source 1..347: note = Related to JAIVFW010000047.1
MDLQNNTQENIEQLKKYGLDAYNTAEEIAAAMEISFDRLRFLVFNSKNSTVSHYIHFKTAKKTEGERIISAPLPDLKRTQHWILKNILQKIGIHDAAHGFCRDRSIVTNATPHVGAEVIINIDLQDFFSAISYQRVKGLFQSFGYSSSIATIFSLLCTTPAVAERDLDGKADFVKLKQRLLPQGSPASPAITNIICGSLDDLLSAIAQKSGFTYTRYVDDLTFSTSGESIKYISNIIQQTQSIVSDEGFTINSEKTRILRNSQQQEVTGIIVNEKINISRKKLKNFRATLYQIEHEGLEGKHWGNSPNLIASITGFANFVAVYRRLVTGKNPGLSATTPSPWVKAPC

SEQ ID NO: 6156 - protein, 351 aa, Nostoc sp.
  source 1..351: note = Related to MTAV01000048.1
MGLQSNKQGNIDYLNNYGLDAYNTAEQIAAAMEISVDKLRFLAFNGKTSTVSHYIHFKTAKKNVGQRIISAPLPDLKRAQHWILKSILQKIEIHDAAHGFCCDRSIVTNATPHVGAEVVIKFDLQDFFSRISYQRVKGLFQSFGYSPAVAAIFGLLCITAAVEERELDGKTYFVELKHRQLPQGSPASPAITNIICRNLDRRLMAIADKYGFTYTRYVDDLTFSASAENVKHISNIIKQTQSIVADEGFAINQEKTRILRNSQQQEVTGIVVNEKINISRKTLKSFRATLYQIENEGFEGKHWGNSGKLIASITGFANYVAMVNPQKGAEFQEQIKRIQKKYEIKHSSENQ

SEQ ID NO: 6157 - protein, 469 aa, Calothrix parasitica
  source 1..469: note = Related to NZ_AP018227.1
MSEQPRTRQELYEQVRKVGKEEFILEEMIRYGFWSPQGTIPEDPADEIRRASQIRKELQELRRESSRLHNEQQLRKDALKRRLAESRKKQQETKERRERERLERAEAWKQRKQREIIYLGEEVSAGLNHAESNLERLRNNNLPLCNTAEEIAVAMGINIGKLRFLAFNRKTSTVSHYIRFKMPKKTGGERFISAPMPNLKQAQHWILTNILDKLNVHEAAHGFCRQRSIITNATPHVEKDVVINFDLKDFFPSISYKRVKGLFHSFGYSETAATIFALLCTSADVEKLQLDARTYYVAVGDRYLPQGSPASPAISNLLCRRLDKRLTGMAEKLGFTYTRYADDLTFSADGESLRHICNILKRTESIVTHEGLRINQDKTRVLRNTRQQEVTGIVVNEKLSVCRKTLRKFRATLFQIEKEGLEGKKWGNSTNLIAAITGYANFVAMVNPERGQEFQKQVKRIKAKYLGNW

SEQ ID NO: 6158 - protein, 466 aa, Calothrix sp.
  source 1..466: note = Related to NZ_VLKB01000009.1; note = Calothrix desertica
MSDQPRTRQELYDRIRQTGKDEFILEEMIRFGFWAPQGTIPEDPADEIRRQGEIRRELETLRQQSSQLRNEKELRKQMLKQRLEESRRKQKETKERREQERLERAAAWQEKRQKDIIYLGEDVSGGLNNTEANIERLQSHNLPLCNTALEIAEAMGVTIGKLRFLAFNRKTSTISHYIRFKVPKKTGGERLISAPMPNLKQAQYWILENILNKLEVHDAAHGFRENRSIITNATPHVGADVIINFDLKDFFPSISYKRVKGLFQSFGYSEAAATIFGLICTAADIEQVELDGKTYYVALDDRHLPQGSPASPAITNLLCRRLDRRLQGMAENIGFTYSRYADDLTFSAKTENRRHICNIMRRTESIVTHEGFNINHDKTRVLRNTNQQEVTGIIVNNKLNISKKVLKKFRATLHQIEQEGLQGKHWGNSHDTLAAITGFANFVAMVNPEKGAEFQQQVQRIKKKRK

SEQ ID NO: 6159 - protein, 469 aa, unidentified
  source 1..469: note = Related to JAHHIC010000071.1; note = Scytonematopsis contorta
MTDQPRTRQELYDRIRTMGREEFILEEMIRYGFWPAEGTMPEDPADEIRHRGELERELRELRQENNRLHNEQAFKKEMLKQRLEESRRKRQETKERRERERQERAEAWKQKKQKEITYLGEEVSAGLNNTQSNEERLRSNKLPLCNTSEELATLMGISLGKLRFLAFNRKTSTVSHYIRFRMPKKTGGERIISAPMPSLKAAQHWILENILQKLQIHDAAHGFTKERSIVTNATPHVGADVIINLDLKDFFPSISYKRVKGLFTSFGYSEATATILALICTAAQVEELELDGKTYYVALGDRQLPQGSPASPAITNLLCRRLDKRLTTMSGQLGFTYTRYADDLTFSGSGDSLRHICNILRRTESIVTHEGFTVNQEKTRVLRKSRQQEVTGVVVNQKLSVCKKTLKQFRATLYQIEKEGLEGKHWGGSPDLLAAITGYANFVAMVNPEKGLELQKQVQQIKKKYRRPR

SEQ ID NO: 6160 - protein, 469 aa, Calothrix sp.
  source 1..469: note = Related to NZ_VLKB01000007.1; note = Calothrix desertica
MSDQPRNREELYQYISKVGREKFILEDMQRYGFWQGDSPQGSEEDTRRQLEIQREINELGRQSSKLQNEKLLRELSLKKRLEESRRRRQETKERQERERQERAEAWRQRKEKEILYLGEDVSGDLNNTEGNEERLNSLSLPVCNTAEQIAAAMEITVGKLRFLAFNRKTSTVSHYIRFKMPKKTGGERIISAPMPQLKQAQHWILASILEKLELHDAAHGFRRERSIVSNATPHVGAEVIINFDLKDFFPSISYKRVKGLFRSFGYSGAAATIFALICTAAEVEELELDGQNYYVAVGDRFLPQGSPASPAISNLLCRRLDRRLTEMAEKLGFAYTRYADDLTFSASGDSLNSICNILRRTESIVTHEGFTINQDKTRIQRKYNQQEVTGVVVNEKPSVCRKTLNRFRATLYQIEKSGIEGKHWGNTSNTIAAITGFADFVAMVNPEKGAEFQEQVKRIKEKLKQNTLS

SEQ ID NO: 6161 - protein, 469 aa, Calothrix sp.
  source 1..469: note = Related to NZ_AP018172.1
MSDQRRSREELSKLIREVGKEEFILEEMLRYGFWKGESLRELDAEIHRQEEIRRELETLRQQSLQLQDEQLLRQQSLKKRLEESRRKRQETKERRERERQERAEAWKQKKEKEIVYLGEAVSADLNNTQGNQEKLNSLGLPVCNTAEEIATAMGVTVGKLRFLAFNRNTSTVSHYIRFKMPKKTGGERIIFAPMPNLKQAQHWILENILQKLEIHDAAHGFRRERSIVTNATPHVGAEVIINFDLKDFFPSISYKRVKGLFRSFGYSGAAATIFALLCTAAEVEELELDGQNYYVAVGERHLPQGSPASPAISNLLCRRLDSRLTAMAEKLEFIYTRYADDLTFSVSGESRRYICNILRRTESIVIHEGFTINQEKTRILRKSSQQEVTGLVVNNKLSISKKTLNRFRATLYQIETEGLEGKHWGNSSNLIAAITGFANFVAMVNPEKGAEFLERIKRIKKKFRRNNIE

SEQ ID NO: 6162 - protein, 470 aa, Chlorogloeopsis fritschii
  source 1..470: note = Related to JACYLT010000232.1
MTDQPRTREELYDRIRKMGREEFILEEMIRYGFWPAQGTIPQDPADEIRRAGEIRRELEQLRRESSRLQNEKALRKQMLKQRLEESRRKQQETKERRERERQERAQAWNQKKQQEIIYLGEGVSAGLNNSQGNEERLRSLGLPLCNTAEEIAAAMEISVGKLRFLAFDRKTATVSHYIRFKIPKKTGGERLISAPMPNLKQAQHWILENILQKLQVHDAAHGFRIQRSIVTNATSHVGADVIINFDLKDFFPAISYKRVKGLFLSFGYSEAAATIFGLLCTAAEVEELELDGKTYYVALGERHLPQGSPASPAITNLLCRRLDRKLTTMAESLGFNYTRYADDITFSASGDSLRHICNIIKRTESIVTYEGFAINQDKTRILRKSRQQEVTGVVVNNKLNVSKKILKQFRATLYQIEKDGLEGKHWGNSPNLIAAISGFANFVAMVNPEKGAEFQQQVQRIKKKYARRKN

SEQ ID NO: 6163 - protein, 470 aa, Chlorogloeopsis fritschii
  source 1..470: note = Related to RSCJ01000007.1
MTDQPRTREELYDRIRKMGREEFILEEMIRYGFWPAQGSMPQDPADEIRRAGEIRRELEQLRRESSRLQNEKALRKQMLKQRLEESRRKQQETKERRERERQERAQAWNRKKQQEIIYLGEGVSAGLNNSQGNEERLRLLNLPLCNTAEEIAAAMEISVGKLRFLAFDRKTATVSHYIRFKIPKKTGGERLISAPMPNLKQVQHWILENILQKLQVHDAAHGFRIQRSIVTNATPHVGADVIINFDLKDFFPAISYKRVKGLFLSFGYSEAAATIFSLLCTAAEVEELELDGKTYYVALGERHLPQGSPASPAITNLLCRRLDRKLTIMAGSLGFNYTRYADDITFSTSGDSLRHICNLLKRTESIVTYEGFAINQDKTRILRKSRQQEVTGVVVNNKLNVSKKILKQFRATLYQIEKDGLEGKHWGNSPNLIAAISGFANFVAMVNPEKGAEFQQQVQRIKKKYARRKK

SEQ ID NO: 6164 - protein, 469 aa, Tolypothrix sp.
  source 1..469: note = Related to NZ_JHEG04000001.1; note = Tolypothrix bouteillei
MTDQPRTRQELYERIRQIGREEFILEEMIRYGFWPAEGTIPQDPADEIRRVGEIRRELEELRQESSRLHNEKELRKEMLKQRLAESRRKRQETKERRERERQERAEAWKQKKQQEIVYLGEGVSAGLNETEGDSERLQSYGLPLCNTANEIATAMGINVGKLRFLAFDRKTSTVSHYIRFKMPKKTGGERLISAPLPSLKQAQHWILGNILQKLEVHEAAHGFRCDRSIVTNATPHVGADVIINFDLKDFFPSISYKRVKGLFRSFGYSEAAATIFSLLCTAAEVEELELDGKTYYVALEERHLPQGSPASPAITNLLCRRLDKRLTAIAQELGFSYTRYADDLTFSASGDSLRHICNLLKRTESAVIYEGFAINQEKTRILRKSSQQEVTGVVVNDKLNISKKTLKQFRATLYQIEKDGLEGKSWGNSSDVLAAVSGFANFVVMVNPEKGAEFQQQIQRIRKKYKQKK

SEQ ID NO: 6165 - protein, 470 aa, unidentified
  source 1..470: note = Related to NZ_JTCM02000014.1; note = Hassallia byssoidea
MSDQPRTRQELYDRIRQVGTEEFILEEMIRYGFWSAQGEMPQDPADEIRRAGEIRRELNELRQESRKLQDEKELRKRLLKQRLEESKRKRQETKERREQERRSRAEVWKQKQQQDIIYLGEDVSAGLNNTQGNEERLHSYNLPLCNNAEQIAAAMGITVGKLRFLAFDRKTSTVSHYIRFRMPKKTGGERIISAPMPNLKQAQHWILANILEKLELHDAAHGFRRDRSIVTNATPHVGADVIINFDLKDFFPSISYKRVKGLFHSFGYSEAAATIFGLVSTAAEVESLEIDGKTYYVAVDERHLPQGSPASPAITNLLCRRLDRRLTAMAEKLGFTYTRYADDLTFSASGDSLRHICNILKRTESIVTHEGFTINQEKTRILRKSRQQEVTGVVVNDKPNVDNKTLKRFRATLFQIEKDGLEGKHWGNANLIAAIAGFANFVAMVNPEKGAEFQQQVQRIKNKYVRNGRS

SEQ ID NO: 6166 - protein, 478 aa, unidentified
  source 1..478: note = Related to NZ_JAAKGC010000016.1; note = Aetokthonos hydrillicola
MTDQPRTRQELYDRVRQVGKEEFILEEMIRYGFWFAQGELPQDPADEIRRAGEIQRELQQLRQENNRLHNEKALRKQMLKQRLEESRRKRQENKERREKQRKEKSEAWNQKKQHEIIYLGEGVSGGLNNTEGNQERLQSYGLPLGDTPEQIAAMMGISMGKLRFLAFNRKVSTVSHYIRFKIPKKTGGERLISAPMPSLKRVQHWILENILNQLEVDDAAHGFRRDRSIVTNATPHVGADVIINFDLKDFFPSISYKRVKGLFHSFGYSEAAATIFALLCTTAEFEEVELDGKTYYIALDERHLPQGSPASPAITNLLCRRLDRRLTGMAKNLGFTYTRYADDLTLSGCGNSLRHICNILRRTDSIVAHEGFTINQEKTRILRNCHQQEVTGVVVNDKPNVSKKTLKQFRATLYQIEKDGLEGKSWGNSHDIIAAITGFANFVAMVNPQKGAEFQQQVKRIKQGVRSQNTGVRNQESE

SEQ ID NO: 6167 - protein, 568 aa, unidentified
  source 1..568: note = Related to JAGHZQ010000069.1; note = Cyanobacteria bacterium SBLK
MSQQPRTRQELYDLIRSRGGKREFVLEEMIRLGFWPQQGTLPEDPADEIRQEGEIRRELSELRRESSRLHSEKQLRKQALKQRWSESRRKQKETRERRERERQERAEAWQQQKQREIIYLGEEVSGGLNNQDGDRDRLQSRGLPMVNNAEEIAAAMGITVGELRFLAFNRKVSSLSHYIRFKIPKKRGGERLISAPMPRLKRVQHWILREVLEKIEVHEAVHGFRRDRSILTNARPHVGADVAINFDLKDFFPTISYKRVKGLFRSFGYSEAAATILGLLSTEADLEEVELDGKTYFVASGDRHLPQGSPASPAISNIICRRLDRRLSGMATSLGFTYTRYADDLTFSASGENNLRSLCNLLRRTESIVTHEGFIINDEKTRIMRRKSSQLEVTGIIVNERPTIDSKTLRRFRATLYHLEKDGIQGKYWGNSRDVGIMLAVQGFANFVNMVHPEKGKVFLEQIDRIREKWTLKETKKSSPTPSISLPVIEEKTPEAIPEQSLPDGIILECYKQGSKLKVRVISQGYNSSWNVQIPRNLMAEGARYRVEELRESAVGGFYRTVGSIQKL

SEQ ID NO: 6168 - protein, 565 aa, Spirulina major
  source 1..565: note = Related to NZ_JACSWA010000397.1
MSEQPRTRQELYDLIRSKGSKPAFVIEEMIRLGFWPAEGTLPDDPADEIRREGELLRELSELRRESSRLHSEKQLRKEALKQRLQESRRKQQEIKERREQERRDRTEAWQKRKEREIIYLGEGVSGGLNHQDGNIERLQSYGLPILNDAEQIAVAMGISVGELRFLAFDRKTATLSHYIRFKIPKKTGGERLISAPMPRLKKVQHWLLHEILDKVEVHEAVHGFRGDRSILTNAVPHIGADVVINFDLKDFFPTISYKRVKGLFRALGYSEAVGTILALLSTEADVEEVELDGKTYFVALGDRHLPQGSPASPALSNIICRRLDKRLSGMAANLGFTYTRYADDLTFSASGENLRYICNLLRRTESIIEHEGFAINAEKTRILRRKSSQLEVTGIVVNEYPNIDRKTMKRFRATLYQIEQEGIQGKQWGQSNNIMLSVQGFANFVKMVNPQKGQVFLEQIDRIREKWRLGESKARSVSPPPISPPIIEQEISQEILLDSIILECYKQGSKLKVRVISEGYNPTWNVQIPRNLMEEGARYRVTEISESAVGGFYRIAGTIEKLSPS

SEQ ID NO: 6169 - protein, 542 aa, Oscillatoria sp.
  source 1..542: note = Related to JACJSM010000006.1
MSDQPRTRQELYDRVRAMGKEQFILEEMIRFGFWPAEGEMPEDPADEIRRKAQIQQELTQLRQQNRSLQDEAAARKRLLQERLAESRRKRQETKERRERERQERAAAWRERQQQDIGYLGEGVSAGLNERDCREERLQARGLPILKNAAQIAEAMGISVGQLRFLAFNRKTSKISHYVCFNIPKKTGGVRRISAPMPKLKAAQHWVFVNILERVEVGEAAHGFLRDRSIVTNAQPHVGAEVIINFDLKDFFPSISYKRVKGLFRAIGYSEAAATIFALLCTEADTVAVELDGTTYYVATGDRHLPQGSPASPALSNVLCRRLDKRLSAMAAECGFTYTRYADDLTFSASGESLRHLCNIMRRTEAIVTHEGFAINPEKTRILRRKSSQMEVTGVVVNEFPNCDRATLKRFRATLFHIERDGIEGKHWGNSNNVLAAIQGFASFVAMVNPEKGREFQAQIQRIKAQIQPQSVTPTGIIVECYKKGSQLKVRVVSPGYNSDWNVQFPRNLREEGARFIVEELQEDVRGGFYRAGGKIERMNSEL

SEQ ID NO: 6170 - protein, 540 aa, unidentified
  source 1..540: note = Related to NZ_JADEWZ010000014.1; note = Lusitaniella coriacea
MSDSPRTRQELYDRVRQVGREQFVLEEMIRFGFWPAQGEIPNDPADEIRRKSELRQELNKLRQESRTLQDEQAARRRLLKQRLAESRRKRQEAKERRERERQERAEAWQERQEREIVYLGEGVSAGLNDCEENSERLASRGLPSLPTAEHIAAAMGISIGQLRFLAFNRKTSTHTHYIRFKIPKKTGGERLISSPMPKLKAVQHWILSHILERVEVDDAAHGFRRDRSIVTNAQPHVGADVVINRDLKDFFPTISYKRVKGIFRSFGYAEATATILALLCTEADTTAVELDGKTYYVALGERHLPQGSPASPAISNILCRRLDKRLRAMANELEFTYTRYADDLTFSASGESLRYICNVLRRSESIVTHEGFAIHPEKTRVLRRKSSQLEVTGIVVNEFLNCDRATLKRFRATLFQIERDGFEGKHWGNSTDALASVQGFANFVAMVNPEKGKKFQEQIQRIKTKWLTPEPSTTTGIIVECYKQGSKLKVRVVSPGYNPDWNVQFPRNLREEGARFRVEEIRETAKGGFYRVVGDIEKID

SEQ ID NO: 6171 - protein, 467 aa, Merismopedia glauca
  source 1..467: note = Related to NZ_PVWJ01000029.1
MTEQPRTRQELYDRIRQTGKEEFILQEMIRYGFWPAQGEIPQDPADEIRRLGELNRELQQLHQQNRQLHNEAALRKQLLKERLAESKRKQQETKERRERERKERAEAWKARKEQDILFLGQGVSGGLDRREPNLERLQNQKLPVFTTPESLASAMGVTIGQLRFLAFHRQVAKTCHYIRFYISKKTGGQRLISAPMPRLKQLQHWILRYILNPIAVNDAAHGFRQGHSILTNATPHVGADVVVNFDLKDFFPSISYKRVKGLFQALGYGEAIATILGLLCTYPDVEEVELDGSTYYVATGDRHLPQGSPASPAISNILCRRLDRRLLQMAQELGFTYTRYADDLTFSASGDNLRNICNLLKRTEAIALHEGFALNPSKTRIMRKNSQQEVTGIVVNQFPNISKSTLKRFRATLFQIERDGIAGKKWGNSTDTMAAIQGFAHFVAMVNPEVGTKFVEQVKQIQAQNRN

SEQ ID NO: 6172 - protein, 469 aa, unidentified
  source 1..469: note = Related to MLAW01000010.1; note = Roseofilum reptotaenium
MSDQPRTRQELYDRIRKMGREAFILEEMIRYGFWPEQGELPQDPADEIRRRSELYRQLTELRQKNRQLQDEQAIRRQLRKQRLAESRRKREETKQRREEERQARAQAWQERQQQEIVYLGEEVSGGLGEQQSNPSELDRHGLPQLATAADIAQEMGITLGELRFFAFDRKTATVSHYIRFKMPKKTGGERLISVPMPRLKRAQYWILSQILEKIPVHEAAHGFCRDRSIITNASHHVGAEVVINLDLKDFFPSISYRRVKGLFRSLGYSEAVATILALICTAPDVEEVSLDGQTYYIALNQRHLPQGSPASPAISNLICRRLDKRLTQMADELGFTYTRYADDLTFSASGDVLRNICRILRRTESLINYESFTLHPEKTRILRRKSCQLDVTGIVVNEGLNIDRKTLKKFRATLHQIETQGLEGKHWGHSRNVLASIQGFANFVAMVNPEKGAQFQEQVGRIRQKYGRN

SEQ ID NO: 6173 - protein, 471 aa, unidentified
  source 1..471: note = Related to JACJRA010000002.1; note = Desertifilum sp.
MSDRPRTRQELYERIRTMGREAFILEEMIRYGFWPAEGTIADDPADEIRRQGELQQELERLRQENRRLYDEKALRREALKQRLAESRRKQQETQERRERQRLERAQAWQQRQQQEIVYLGEGVSGGLSESQSHQERLQSYGLPIYETAADLAAAMGMSIGQLRFLAFNRKTSKVCHYIRFTIPKKTGGERLISAPMPRLKQAQSWIYQQILAKIPLEAAAHGFRCDRSILTNAHPHLEADVIINLDLKDFFPSISYKRVKGLFRSFGYCEAVATLLGLICTEADLTSVELDGVTYYVATTERLLPQGSPASPAISNLICRRLDRRLTQMAQDLGFTYTRYADDLTFSAHEPYLQGICNILRRTEAIVAHEGLTINDQKTRILRKKSSQLDVTGIVVNGDRPSLDRKTLKRFRATLHQIEQNGPTGQHWGHTENVMSAIAGYANYVASVLPEKGAKFQEQVRHIHQKWQRLP

SEQ ID NO: 6174 - protein, 539 aa, Oscillatoria sp.
  source 1..539: note = Related to NZ_JAAHBQ010000037.1; note = Oscillatoria salina
MTNQPRSRQELYDLVRQVGKQEFILQEMIRYGFWSPEQETQEDVSEELRQRKQLQQELSQLRQENRLRQDEQALRKHLLKQRLAESRRKRRETKERREKERRERAEAWQEQKKRDLVYLGEGVSAGLNNTEANLARLQSNKLPVLSTAAEIATAMEITVGQLRFLAFSRRTSQISHYIRFKIPKKTGGERLISAPMPRLKQAQHWILTKILEKIEPHAAAHGFRQERSIMTNAQPHVGAEIVINFDLKDFFPSISYKRVKGLFRSFGYSEAAATIFALLCTQPEIEEVELDGKTYYVAQTERHLPQGSPASPAITNLLCRRLDRRLTRMAQELDFVYTRYADDLTFSCGSDNPRICNLLRRVESIVAHEGLTINQEKTRILRKSRQQEVTGIVVNEYPNIDRKTLKRFRATLFQMEKDGIAGKKWGNSDDVLLAIAGFANFVKMVNPEKGAAFQAQIQRIRQKWLGEIPDTTDTSPQGIIVECFKQGSKLRMRVISPGYNPDWKVQFPKALREEGARFLVEEIQESNGFYRTVGEIRKL

SEQ ID NO: 6175 - protein, 473 aa, Phormidium ambiguum
  source 1..473: note = Related to NZ_MRCE01000029.1
MTEQQPRTRQELYDRIRQTSREEVILEEMIRLGFWPAEGEIPADPADEIRRRGEIERELSELYRQNRQLHNETYLKKQVYLQRLEESKRKRQENKERRERERQERAEAWRQRKEQEIVYLGDRVSAGLNDTEYNQERLESYSLPAYNTAQEIADAMGISIGELRFLAFSRKTSLITHYVRFKIPKKKTGDRLISAPMPRLKKAQHWILNNILEKIPLHNAAHGFRPGHSIVTNAQPHIGAEVIINFDLKDFFPSISYKRVKGLFQSLGYSDIAATIFGLICTEPEVVEVELDGKNYYVALSERHLPQGAPTSPAITNIMCRRLDRRLEQMAQKLGFVYTRYADDLTFSTSGEFRRHICNILRRTESIVDHEGFVINEEKTRIMRNTNQQDVTGVVVNSKLNVDKKTLKRFRATLYQIEKDGLEGKHWGHSGNLLASIQGFVNYVAMINPEKGAEFQAQIERIKEKHGRGKKSV

SEQ ID NO: 6176 - protein, 466 aa, unidentified
  source 1..466: note = Related to JACJPW010000041.1; note = Planktothrix sp.
MTDQPRTRQELYDRIRETSREEVILEEMIRLGFWPAQGEIPQDPADEIRRRGELQKELNDLYKQNRQLNDENLLKKQLYKQRLAESRRKRQETKERRERERLERAEAWRQKKQQDIVYLGDRVSGGLNYTDCDEQRLQSYGLPIYGTAEQIATAMGITMGQLRFLAFSRKTSPISHYIRFRIPKKTGGDRIISAPMPRLKKAQHWILNNILEKVELHNAAHGFRPGRSIVSNAQPHIGAEVVINFDLKNFFPSISYQRVKGLFISLGYSEAAATIFSLLSTEPDIEEVELDGKTYYVALSDRHLPQGAPTSPAITNILCRRLDRRLTQMAENLGFTYTRYADDLTFSASGDNRRHICNVLRRTESIVEHEGFVINEEKTRILRNSRQQDVTGVIVNDKPNVDKKTLKRFRATLYQIEKDGLEGKRWGNSSDLIASIQGFANFVAMVNPELGAEFKEQVKRIREKYK

SEQ ID NO: 6177 - protein, 470 aa, unidentified
  source 1..470: note = Cyanobacteria bacterium UBA11371; note = Related to DNGJ01000185.1
MSDLPQPRTRQELYDRIRQTSREEVILEEMIRLGFWPAEGTVPEDPADEIRLRGEIWRELSDLYKQNRTLHNEAELKKQVYQQRLAESRRKRQETKERRERERLLRGEAWRQKKQQDIVYLGDRVSGGLNYTECDRQRLQSYNLPEYGTAEQIAAAMGITIGQLRFLAFDRKTSTVSHYVRFKIPKKTGGDRIISAPMPRLKQAQYWILSNILEKVELHDAAHGFRPGRSIVSNAQPHVGAEVVINFDLKDFFPSISYQRIKGVFRSFGYSEAAATIFGLLCTKPDIEEVELDGKTYYVALSERHLPQGAPTSPAITNILCRRLDRRLSGMAENIGFVYTRYADDLTFSASGDNLRHICNILRRTESIVAHEGLAINEEKTRILRKSGQQEVTGVVVNEKPNVDRKILKRFRATLYQIEKDGLEGKHWGNSPDLIASIQGFANFVAMIDPQQGAAFQQQVRRIREKYRST

SEQ ID NO: 6178 - protein, 467 aa, unidentified
  source 1..467: note = Related to NZ_JACJTV010000005.1; note = Coleofasciculus sp.
MSDQPRTRQELYDRIRQMGKEEFILEEMIRYGFWPAQGEIPQDPADDIRRMGEIRRELDELRQQSSRLHNEKELRKQLLKQRLAESRRKRQETKERRERERQERAEDWRQRKEREILYLGEDVSGGLNYTECDEERLRSYGLPLCGTPYEIAAAMGITVGQLRFLAFSRKTSTISHYIRFKIPKKTGGERLISAPMPRLKQAQHWILGNILEKLELHDAAHGFRRDRSIVSNAQPHVKRDVIINFDLKDFFPSISYKRVKGLFHSFGYSEAAATIFGLLCTQPDIEEVELDGKTYYVALTERHLPQGSPASPAITNLMCRRLDRRLTSMADELGFVYTRYADDLTFSASGDSLRNICNILKRTQSIVAHEGFTINEQKTRILRKNRQQEVTGVVVNDYPNISKKELKRFRATLFQIEKDGLEGKHWGNSNNVMSSIQGYANFVAMVNPQKGVEFQEQIRRIRDKYRC

SEQ ID NO: 6179 - protein, 470 aa, unidentified
  source 1..470: note = Related to JACVRI010000092.1; note = Coleofasciculus sp.
MSDQPRTRQELYDRVRQIGKEQFILEEMIRYGFWPAQGEIPQDPADEIRRRGELQQELNALKSENRQLHNEQALRKQMLKQRLEESRRKRQETKERRERERIARTEAWRQRKQQEIPYLGDGVSGGLNYTDCDEERLQAYGLPVCQTPEQIASAMGISVGQLRFLAFSRDTSTISHYIRFKIPKKTGGERLISAPMPRLKNAQHWILVNILEKLELHDAAHGFRRDRSIVSNAQPHVGADVIINFDLKDFFPSISYKRVKGLLQSFGYSEAAATIFGLLCTQAQVEEVELDGKTYYVATTDRHLPQGSPASPAISNLLCRRLDRRLMGMAEQLGFVYTRYADDLTFSASGESLCNICNVLRRTESIVAHEGFAINEQKTRILRGKSSQLEVTGIVVNERPNISKKELKRFRATLYQIEKDGPEGKHWGNSSDVMASIQGFANFVAMVNPEKGAEFQEQVQRIKEKYGRRR

SEQ ID NO: 6180 - protein, 469 aa, unidentified
  source 1..469: note = Related to DOIX01000137.1; note = Cyanobacteria bacterium UBA11153
MSDQPRTRQELYDRIRQIGREEFILEEMIRYGFWPAQGTIPEDPADEIRRRGELQRELGKLREESRILHNEEALRKRLLQERLAESRRKRQETKERREKERQQRADAWREKKAQEITYLGEGVSGGLNNTDGDEERLQSYGLPICGKTAQIATAMGITVGELRFLAFSRQTSTITHYIRFKIPKKTGGERLISAPMPRLKNAQHWILNNILEKLELHDTAHGFRHNRSIVSNAQPHVGSDVIINFDLKDFFPSISYKRVKGLFHSFGYSEAAATIFGLLCTEPEIAAVELDGKTYYVALTHRHLPQGSPASPAITNLLCRRLDRRLSEMAENLGFVYTRYADDLTFSASGDSLRHICNILRRTESIVTHEGFAINPEKTRILRKNRQQEVTGIVVNEKPTIAKKELKRFRATLYQIEKDGIAGKQWGNSDDVMASIQGYANFVAMVNPEKGAEFQEKVRRIKERYGANS

SEQ ID NO: 6181 - protein, 466 aa, unidentified
  source 1..466: note = Related to NZ_KB235904.1; note = Kamptonema formosum
MTDQPRTRQELYDRIREIGREEFILEEMIRYGFWPAQGEIPQDPADEIRREGEIRRELNELQQQSRQLQNEKTLRKQALQQRLAESRRKQQETKERRERERQQKAENWQQRKQQEILYLGDGISGGLNNFNAEIERLQSYGLPICNTAEQIAAAININIGELRFLAFSRKTSTISHYIRFKIPKKTGGDRLISAPMPRLKKVQHWILDNILEKMELHTAAHGFRPHHSIVTNALPHVKAEVIINFDLKDFFPSISYKRVKGLFQSFGYAEAAATIFGLLCTEPEIEQVELDGKTYFVALTERHLPQGSPASPAITNLLCRRLDNRLTTMAEDMGFVYTRYADDLTFSASGDSLRYICNILKRTESIVAHEGFTINQQKTRILRKNRQQEVTGIVVNDRPSISKKELKRFRATLYQIEKDGPEGKHWGNSSDVIASIQGFANFVAMVDPEKGREFQKQVKQIKEKLR

SEQ ID NO: 6182 - protein, 465 aa, unidentified
  source 1..465: note = Related to NZ_NXIB02000033.1; note = Tychonema bourrellyi
MTDQPRTRQELYDRIRSTSKEEFILEEMIRFGFWPAQGEIPEDPADEIRRMGEIRRELDELRRENSLLHNEQALRKEMLKQRLIQSRQKQQETKERREKERQERAENWQQRKQQEICYLGDGVSAGLNNTNCNEERLQNYQLPLCNTAAEIAAAMEISVGQLRFLAFDRKTSHISHYIRFKIPKKTGGERLISAPMPRLKAAQHWILVNILEKLELHNCAHGFRSSHSIVTNAQPHVGSEVIINFDLKNFFPSISYKRVKGLFQSFGYSEAAATIFGLLCTEPEIEEVELDSKTYFVAVTERHLPQGSPASPAITNILCRRLDQRLDRMASELGFVYTRYADDLTFSASGDSLQNICNILRHTESIVAHEGFVINEEKTRILRKNRQQEVTGIVVNEHLSISKKVLKRFRATLFQIEKDGPDGKRWGNSEDVIASIQGFANFVAMVNPEKGAEFLEQVQRIKNKR

SEQ ID NO: 6183 - protein, 467 aa, Oscillatoria sp.
  source 1..467: note = Related to NZ_KB235948.1
MTDQPRTRQELYERIWQIGREEVILEEMIRYGFWPAQGEIPQDPADEIRRKGEIRRELDELRRETSRLQNEQALRKQMLKQRLAESRRKRQETKERRERERQERAQAWREKKQKEIIYLGEDVSGGLNRTEGNLERLQSNSLPPCQTAEDIAGAMGISVGELRFLAFDRKTSTTSHYIRFKIPKKTGGERLISAPMPRLKRAQHWILSNILEKLELHDAAHGFRRERSILTNAQPHVAADVIINFDLKDFFPSISYRRVKGLFQSFGYSESAGTIFALLCTEPEIEEVELDGKTYFVAISNRHLPQGSPASPAITNLLCRRLDRRLVQMAQELGFTYTRYADDLTFSGAGESLRHICNILRRTESIVAHEGFAINEQKTRILRKNRQQEVTGIVVNSHPNISRETLKRFRATLYQIERDGLEGKHWGNSDTLLASLQGFANFVAMVNPQKGAEFLEQIQRIKEKYML

SEQ ID NO: 6184 - protein, 471 aa, unidentified
  source 1..471: note = Related to JAHHHA010000047.1; note = Cyanosarcina radialis
MTDQPRTRQELYDRIRQVGREEFILEEMIRYGFWPAQGEMPEDPADEIRQRGEIQRELNQLRYQNRNLHNEQALRKQMLKERLAESRRKQQETKERRERERQERAAAWQQRKQQEILFLGEGVSGGLNQTEANRERLQSYGLPAWETVEQMAAAMGVSVGELRFLAFSRPAAKISHYIRFKIPKKTGGERLISAPMPRLKKVQHGILDRILSKIELHDAVHGFRRTRSIVSNARPHVGAEAIVNFDLKDFFPSISYQRVKGLFRSFGYAEATATILALLCTQPEIEEVQLDGQIYCVAIGNRHLPQGSPASPAISNLLCRRLDRRLMGMATGFGFTYTRYADDLTFSASGENLRHICRILRRTESIVAHEGFTINAEKTRIMRKQRQQEVTGVVVNSQPNIAKETLKRFRATLYQMEKDGPEGKHWGNSTDAIASIQGFANFVAMVNPSKGAKLQAQVKRIKEKYGRKSAP

SEQ ID NO: 6185 - protein, 466 aa, Synechocystis sp.
  source 1..466: note = Related to NZ_ALVU02000001.1
MSEQPRTRQELYDRLRQSSKQEFILEEMIRLGFWATAEQIAIDPTDEMRRLGEITRELQQLRQENARLGNEKKLRQELLKQRLAESKRKQQETKERRERERIEKAQKWQEQKQTGISYLGAEVSGGLNNTESNAERLSNYGLPRLENAGQIAAAMGISVGQLRFLAFSRKTSTICHYIRFTIPKKTGGSRSISAPMPKLKESQKWILVNILNKLELHEAAHGFRRDRSIVSNALPHVKQDVIINFDLKDFFPSISYRRVKGLFQSLGYSEAAATIFGLLCTELEVEAVELDGKTYYVANSDRHLPQGSPASPAITNLLCRRLDRRLTLMAENLGFTYTRYADDLTFSATGSNLRHICNVLKRTEDIVNHEDLTINQQKTRIIRKSRQQEVTGVVVNSHPNIARETLKRFRATLYQIEKDGLEGKHWGNTTDVMAAIQGYANFVKMVNPAKGAEFIAQVERIKHKYP

SEQ ID NO: 6186 - protein, 470 aa, unidentified
  source 1..470: note = Related to NZ_MKZS01000001.1; note = Moorena bouillonii
MSDQPRTRQELYDRIREIGKEEFVLEEMIRYGFWPAEGEMPEDPADEIRRRGELQRELAQLRQESQKLQNEQAVRKRLLKERLAQSRLKRQETKERREQQRLERAQAWAIRQQKEILYLGEQVSPGLNHTESDRIRLQTYKLPLLSTAQDIAQAMGIALGQLRFLAFNRKTATISHYIRFKIPKKTGGERLISAPKPKLKQAQHWILSNILEKLELDNAAHGFRRDRSIVTNAQPHVGADVIINIDLKNFFPSISYPRVKGLFRSFGYSEAAATVFGLLCTEADIEEVELDSKTYYVATSDRHLPQGSPASPAITNILCRRLDHRLTTVATDLGFIYTRYADDLTFSASGESLRFIGKLLKRTSSVVAHEGFTINQQKTRILRKSQQQEVTGIVVNHHLNISRKQLKRFRATLYQIEKDGPDSKHWGNSSNVIAAIQGYANFIAMVNPEKAAPFQAQIQRIKDKWLSNQH

SEQ ID NO: 6187 - protein, 585 aa, Aphanizomenon sp.
  source 1..585: note = Related to LTEC02000002.1
MNTNHLITIGISLYQENKYSEAIDCFNQIIANNPNSATAYHYRGLVRRRQRDDQGAIADLQKADTLVADKEYTKLCEKIQNLIGRDYPHKYNNDDNQEFDYIEYEDNWYADEDEIAAADPNYIPSSEFLSCAEEVYQLISYELNQFENFLSNRLKTIDLLRKKRAENSRFNQERLESKNLPIYNSHEEIAQAMGISVKGLRFLTFSRKGYHYIRFQIPKKPSGYRQISAPKKLLKKAQNWILDNILEKLELHDAAHGFRLKHSIVTNAQIHVGKEVIINIDLKDFFPSISYKRVKGLFKSFGYSETASTIFALICTEPKIKEVEINGQINSLLSWTDRYLPQGAPSSPAITNILCRRLDRRLNFMAKQYGFDYTRYADDLTFSASGESLVNVNNILKLTNLIVKKEDFEINENKTRVVRNYRKQEVTGIIVNEKLNISRDKLKTFRAVLYKIEKDGLQNYTWGQSQDIIAAIEGFANFVAMVNPEKGGKFIEQIHRIKEKYVRKREKIVLVHQEFLTQSNIIKQINEKLREVRFNKIEKRQYLQETYNKKYLQELTAEELLEFLHYLITLQPEQFSFGDTDDLPF

SEQ ID NO: 6188 - protein, 564 aa, Anabaena sp.
  source 1..564: note = Related to VILD01000004.1
MDNYQLITIGISLYKENKYSEAIDCFNQIIAQDQNSSTAYHYRGLICRKQRDDQGAITDLQKADTLVADQEYTNICQKIQNLIGKDYSHSSNNKNNDEFSDIEYEGTWHLEQEIYDLISSELNKFENFLSSRLETIELLRKKRGENSQFNQEKLESKHLPIYNSHEEIAQAMGISVKGLRFLAFSRKDNHYIRFQIPKKPSGYRQISAPKKLLKKAQNWILDNILEKLELHNAAHGFRLKYSIVTNAQIHVGKEVIINIDLKDFFPSISYKRIKGLFKSFGYSETASTIFALICTEPKIKEVEINGQINSLLSWTDRYLPQGAPSSPAITNILCRRLDRRLNFMAKQYGFDYSRYADDLTFSASGESLVNINNILKLTNLIVKKEDFEINENKTRVVRNYRRQEVTGLIVNEKLNISRDKLKTFRAVLYKIEKDGLQNYTWGQSQDIIAAIEGFANFVAMVNPEKGGKFIEQIHRIKEKYVRKREKVVLVYQEFLTQSNILKQINDKLRAVRFNKIKKRQYLQETYNKKYLQELAAEELLDFLHFLINWQPEQFSFDDTDDPPF

SEQ ID NO: 6189 - protein, 599 aa, Anabaena sphaerica
  source 1..599: note = Related to NZ_JACJQU010000001.1
MDLFNEPRKKSNVLIYNRKYHVINILLINLQSVAFTNNMNTNHLITIGISLYQENKYSEAIDCFNKIISTDSNCCQAYHYRGLVLRKQRDDQGAIADLKKADTLIADQEYTNIFQKLQNLIGKDYSHFSKNNDNDEFSYIEYKGTWHLEQEIYDLISSELNKLENFLSSRLQTIELLRKKRAENSQFNQERLENKNLPTYNSHEEIAQAMGISVKGLRFLSFSRKNDHYIRFQIPKKPSGYRQISAPKKLLKKAQNWILDNILEKLELHDAAHGFRLKHSIVTNAQIHVGKEVIINIDLKDFFPSISYKRVKGLFKSFGYSETASTIFALICTEAKIKEVEINGEINSLLSWTDRYLPQGAPSSPAITNILCRRLDRKLTFMAKQYGFDYTRYADDLTFSASGESLVNVNNILKLTNLIVKKEDFEINENKTRVVRNYRRQEVTGVIVNEKLNIPRDKLKTFRAVLYKIEKDGLQNYTWGQSKDIIAAIEGFANFVSMVNPEKGGKFIEQIHRIKEKYGIKKDKISDYSPVIRTQSYIINQIYYKLSKLSYSKTKRRMYLTKTYNKRSLQELTEEQLVEFLNYLKNLQSSFDDLDEPPF

SEQ ID NO: 6190 - protein, 567 aa, unidentified
  source 1..567: note = Related to NZ_LUFH02000071.1; note = Sphaerospermopsis aphanizomenoides
MDFNDILNRGIDLYKSQKYIEALECFNQIISQDPNSYQAYHYRGLIRRKQRDDQGAIADLKTANTLIFDGEYTNIFEKIQDLIGKDYPHHSNNESNDNADFIYIEYGGTWYIEKEIYEWISADLKKLESFLSKRLEKIDLLREKHRQNSQFNQQKLESKNLPIYNYHEEIAQAMGISIKGLRFLAFSRKHYHYNRFQIPKKPSGYRQISAPKKLLKKAQNWILHNILEKIELHVAAHGFCLQRSIVTNAQIHVGKEVIINMDLKDFFPSISYKRVKGLFKSFGYSETASTIFALICTEPKIKEVEINEEPKYILSWTDRYLPQGAPSSPAITNILCRRLDRRLTFMAKEYGFDYTRYADDLTFSAAGESLVHINNILKLTNLIVKKEDFEINENKTRVVRNYHRQEVTGIIINEKLNISKEKLKTFRAVLYKIEKDGLQNYTWGKSQDIIAAIEGFANFVVMVNPEKGAKFIELIKRIKEKYLRKREKSVLVNQEFITQYHIVKQINYELKELRFNKTKKRQHLQENYHKASLQQLTEAELLEFLHYLTNWQPEEFCFSDTDDPVPF

SEQ ID NO: 6191 - protein, 485 aa, unidentified
  source 1..485: note = Related to JADEWT010000004.1; note = Tychonema sp.
MSSCDINCIIQDIEGSIEGEFEQLEGRLSRRLKHSQVLQKKRINNAKFDPERLQSNNLPLCNSHEAIALAMEISVKGLRFLAFSRKKHHYIRFQIPKKTGGNRKISAPTHLLKKAQKWILENILENIQLHEAAHGFRLKHSIATNAEHHIGKEVIINIDLKDFFPSISYIRVKGLFKSFGYSETASTIFGLICTEPKMKEIEANGKTAFLLSWTERYLPQGAPTSPAITNVLCRRLDRRLHSMAKQYGFDYTRYADDLTFSTSGESLRNICNIFQNTRFIVEQEDFEINEQKTRVIRRYQQQEVTGIVVNDKLNVSREKLKNFRAVLYQIEKDGLEGHNWGQSEDIIASIEGFANFVSMVHPEKGAKFKEQIDRIKEKYGRKKNPKVPNVSQPLLSRSDIVALIDTKFQELKFSKIYTDIYLNKIYKKQSLKQLTEAELLELLRDLTSSPSEDDDRTQLNFVKRLKALIAQRIRYYTRATKDSDF

SEQ ID NO: 6192 - protein, 623 aa, Oscillatoria nigro-viridis
  source 1..623: note = Related to NC_019729.1
MAEAKIEDSRNNMDINELIVRGISYYMQGKYGEALECFNQAICHDLNCVQAYHYRGLIRRRQTDKQEAIEDLQQAARLLNDKEYTTISNNLQIFIEQNCFKKTENVKSDDSDQNLIFHNENWYECYDDLVDAFPDEFMSYWEIESLRQECESIVEEEFEKLERWLSRQLKDSQVLQKKRINNAKFDRERLQSNNLPLCNSHEAIAQAMGVSVKGLRFLAFSRKKSHYIRFQIPKKTGGNRKISAPTHLLKKTQKWILENILEKIQLHDAAHGFRLKHSIVTNAEHHVGKEVIINIDLKDFFPSISYIRVKGLFKSFGYSETASTIFGLICTEPKIKEIEVNGKIEFLLSWTERYLPQGAPTSPAITNVLCSRLDRRLHSMAKQYSFDYTRYADDLTFSASGESLDNICKIFQNTRLIVEQEDFEINEQKTRVIRRYQQQDVTGIVVNDKLNVSREKLKNFRAVLYQIEKDGLEDRNWGQSEDIIASIEGFANFVSMVNPEKGAKFKEQIERIKEKYGRKKEAKINNISQPIMNQSDIVALIYTKLKELRCSKKVKQIYLNKIYNKQSLQQLTDEELLEVLRDLTTWSSGESGRRQINFVKKYRALSCEYIRHDTPDREDVNEF

SEQ ID NO: 6193 - protein, 610 aa, Microcoleus sp.
  source 1..610: note = Related to JAEQCY010000049.1
MDINELIFQGVSYFKQRNYDEALECFNQAISCDLNCVQAYHYRCLIHRRQQNKQEALENLQQATKLLNDKEYTTISNNLQILIEQDCFKTSENVQSDNSDHNLIFYNENWYECYDDLVDAFPNEFMSYWEIESLRQECESIVEDQFLRRECWLSRQLKQSQILQEKRINNAKFDSERLQSQNLPLCNSQESIAQAMGVSVKGLRFLAFSRKKYHYIRFQIPKKTGGNRKISAPTHLLKKTQKWILENILEKIQLHDAAHGFRLKHSIVTNAEPHVGKDVIINIDLKDFFPSISYRRVKGLFKSFGYSETASTIFGLICTEPKIQEIELNGKTELLLSWTKRYLPQGAPTSPAITNILCHKLDRRLYSMAKQYGFGYTRYADDLTFSASGESLGHIFNIFQNTRCIVEQEDFDINEQKTRVIRRYQQQEVTGIVVNEKLNVSREKLKNFRAVLYQIEKDGLEGHNWGHSGDIIASIEGFANFVSMVNPEKGAKFKEQIDRIKEKYGRKNQAKVPNVSQPILNQSDIVAQIHTQLKEFRFSKRIKQIYLNKIYNKQSLQQLTDEELLELLRDLTTWSSVGHGRKMVNFQLKYIGLSCEIRSDTPNEEDVNQF

SEQ ID NO: 6194 - protein, 576 aa, Microcoleus sp.
  source 1..576: note = Related to JAAUPI010000036.1
MDINELIVKGVSYYTQRNYDEAIECFNQAISRDINCVQAYHYRCLIHRRQQNKQEALENLQQAARLLNDKEYTTISNNLQIFIGQYCFKKTENIKSDNSEQNMSSWERDLVRDAENCAEAYIEEKFYELERWLSKRLEHSQILQKKRINNAKFEPERLQSNNLPLCNSHEDIAQAMGVSVKGLRFLAFSRKKSHYIRFQIPKKTGGNRKISAPTHLLKKSQKWILENILENIQLHEAAHGFRLKHSIVTNAEHHVGKEVIINIDLKDFFPSISYRRVKGLFKSFGYSETASTIFGLICTEPKIKEVEVNGKIEFLLSWTERYLPQGAPTSPAITNILCSRLDRRLHSMAKQYGFDYTRYADDLTFSASGESLDNICNIFQNTRFIVEQEDFEINEQKTRVIRKFRQQEVTGIVVNEKLNISREKLKNFRAVLYQIEKDGLEGHNWGQSEDIIASIEGFANFVSMVNPEKGAKFKEQIDRIKEKYGCKKKAAVPNVSQPLLGRSDIVAQINTKLKEVGCSSGYTQIYLTKIYKKRSLKQLTETELLEVLRDLTSSQAGDSGRTETNFVKRWRALIYS

SEQ ID NO: 6195 - protein, 579 aa, unidentified
  source 1..579: note = Related to BLZO01000072.1; note = Okeania sp.
MDLDEILKNGIEYYWEKSYEQAIECFNQIISFNPNYAKAYHYRALVRRRQRDDKGAREDLVQAASLLGDREYTAMSQKMLKLIGCDYRHKSPPREDDFDFIFYDENWYSDYDELSEMFPEEFPPSWEYEVDILDGIAYAGEELDRLETWLFKKLERACYIQKKRAINAKFDEKRLRENNLPLCNSHEEIAAAIGISIAGLRWLAYSQKKYHYTHFKIPKKTGGERNISTPIPLLKKAQNWILNNILIKIQPHDAAHGFCTERSIVTNAQLHLGKEVIINIDLKDFFPSISYKRVKGVFQSFGYSKTASIIFGLICTAPKLKEIKLDEKLHQLLSWKERYLPQGSPSSPAISNLVCRRLDSRLTEIAVKYGFNYTRYADDLTFSASGDSLRNISHILKDTRLIVRLQDFEINENKTRIMRKSRRQEVTGIVVNSELNISRETLKRFRATLYNLEKDGLENRHWRNSQGGDIIASIEGFANFVSMVNPQKGAKFQQQVTRIKEKYKPKKTQNSLAPQLITKSDIIALINDDIRKLHWSNRDRRIYLRQVYGKQSLQQFTEEELLKVQNHFCSFLDALSQKI

SEQ ID NO: 6196 - protein, 644 aa, unidentified
  source 1..644: note = Related to DMPE01000239.1; note = Planktothrix sp.
MDNLDLQQILNRGIDNYQEKNYEQALEDFNQVISINPLFAKAYHYRGWIYRILEKKEEAIQNFQQAASLFKDREYRVLCEQLAELLESLFPSKLKKQQSSEINDDIYSEYRNLFWIDEDGNWYDDPPDYECDFYDIGDWEDYINQKLITIKNRLFKRLEKIEYLQIKREKNAQFDQRKLEDNGLPICNSHQDIAKLMKIRVKRLRFLAFSRNKSHYTCFKIPKKIGGDRHISAPMPFLKKAQLWILHNILEKIKIHDAAHGFILNHSIVTNAQPHIGKDIIINFDLKDFFPSISYPRVKGLFKSLGYSETASIIWGLLCTEPTLKQIELDGEIHSLRSWTERHLPQGAPSSPAITNLLCRRLDQRLTQMAQKYGFVYTRYADDLTFSASGNSLTNLSNIFNETGFIVKTEGFNLNQDKTRIMRKSQQQEVTGMIVNNKVNIPRETLKRFRATLYQIEKEGLIGKHWGNSKNQELMVSLEGFANFVFMVNPEKGSQFRDQVKRIKHKYYCQSKTRRSIISQEILNQSNIIGLIYAELNRLYCKNGKRRCYLMQTYGKPCLQELTEENLLEFLTDLKSHVENSPFLDSNFIRVLDFVNRLSLTPNHLRQYLIKTYGKQSLLQIKTEELKNFYSLFKKTPSNRFLWF

SEQ ID NO: 6197 - protein, 598 aa, unidentified
  source 1..598: note = Related to JAGHZN010000053.1; note = Roseofilum sp.
MNINDLLKTGIECYKAKDYETALLAFNSAISVNPNLASAYHYCGSIYLALNQKENAIKNFRKAEAILKDKEYSKLCNKLEEILVELFPSKTLDCPENHNNDALDFREYQNLFWIDEDGNWYDDPPDHDLYVGYDSDANDYYCDLLSKLTSIKDYLFSRLKKIQTLELKRSQNSEFDRKKLLSQNLPLCSSHLDIARLMGFSVGYLRCLAFSRNKYHYQSFEIPKKIGGKRKISAPNQMLKKAQKWIQNNILDKIKVHDAAHGFKIEHSILTNARPHVNQDIIISFDLKDFFPTISYRRVKKLFKSLGYSETASIVFGLLCTEPIIKNIELDGQAYELVCWTKRCLPQGAPSSPGITNLLCCNLDQRLSQMANKYGFIYTRYADDLSFSASGESLDYITNIFKGVRSIVRSEGFTLHESKTRVMRKHQQQKITGIVVNQKLNISRKTLKRFRALLYQIEQEGFFGKHWGHYRNYDLLRFIEGFSNFVYMVNPDKGVLFVEQVKRIKEKHPVNINKISQSSIITLIYSEFQRIDCSPSTRRKYLKETYGKQSLQDLTEENLLELLDHLKSTEAVYSLTNKEINYFVNINDPTSISKEDLF

SEQ ID NO: 6198 - protein, 743 aa, unidentified
  source 1..743: note = Related to JACJTF010000019.1; note = Planktothricoides sp.
MFSQSKKLDKLINQGIDYYKQSQYEAALECFNQAIALNPNCARAYHYRGWLHLANNNPGELLNDLQTVCRLLNDKYYERLVNKIEKIIPQLFYREDSLSWIYCEEDDSWYESYSDIPGGDIYIGIIGDIEAELMEQRSQEFYWLRNWLFARIEEINNLQLKRNKNAKFNQEKLIRYQLPLCNSHSEIAAAIGLSVNGLRYLAFSRNKLHYTRFNIPKKTGGKREISAPLPLLKKAQNWILHNILEKLEIHPAAHGFCRQKSIVTNALPHVGKDVIINIDLKDFFPSISYPQVKGLFKSLGYSETAAVVFGLICTEPRVQKLEIDGESCLVNLKERRLTQGAPSSPAISNLLCKKLDHRLSNMAKKMGFMYTRYADDLTFSGSIDSRENIGRLFKVTNLIVQEEGLAINPDKTKVRWKNRQQDVTGLVVNHKINISRKTLKKFRATLYHIEQDGFRGKHWGQTNTNDLMASIEGFANFVCMVNPEKGAKFKQQVQRIKDTYKKTDQKAHQANHESPKTSAQIYDVVFLIFSALFWLGWTYKKKLEYLRQTYGNTAIKQLRPNQQWEFLNYLLEAIVSQEIKTHLSLADLQSKEIHNFKQVLCCLDYYKGRKCKSYAIPSFIINNTPIWEDKMADYLDFLCRIYREYLRLGWTDNQRENSAAKTYLQEIYHVLSPLALTLKQLQDFLEYLKLQPTPEVCSNSQPDSYEYDFSDSYEYDFSDSYEYDFSDSYEYDFSDSCEYEPPY

SEQ ID NO: 6199 - protein, 515 aa, Phormidium ambiguum
  source 1..515: note = Related to NZ_MRCE01000004.1
MGVYDDYDDNDYTDDANEEYYQEYLEWATYFSQGLVDSSDQGWFSSDPSYESNGYQNIDRIVDKLYESGEDFEFDDWDKEDEYPLDFNAKREEDEKFKLAEALKIREEKQRFNKERLQENGLPLCCSHSAIAKAMGISVNKLRFLAFSRKRYHYRNFQIPKKTGAKRDISAPMPYLQQAQYWIQHNILKKLELHNAAHGFCRERSIITNAQPHVGSEVIINIDFKDFFPTISYKRVKGLFKSFGYSEEASIIFALICTEPMLKEVELNEKTNLFLSWTDRRLPQGSPTSPTISNLLCRRLDRRLTQMTEPLGFIYTRYADDLTFSASGESVRNICNVFNRMRSIIKYEGFEINEDKTRVIRKSRQQEVTGVVVNSKLNVSKETLKRFRATLYRIEKDGFQGRYWGQSNDLIASLQGFANFVYMINPEKGAKFQEQIRHIKQKYKQGPNQSVPESKLLNLSDIIALTNIELRRLNWSIQERRRYLKKTYGKQSRQQLKDEELLEFLNYLKSLPKPK

SEQ ID NO: 6200 - protein, 435 aa, Nostoc sp.
  source 1..435: note = Related to NZ_CP091913.1
MSVNQGESSDDSYEIDEDIEQQLNRWWREANDLENDYWYRQKQLQGKNTRNKQGKEKLLEKYYLPQCNSFREISKLINIDLADLRLLVFSPKQDAATKHHYILFYIPKKTGGERIISAPSQNLKNVQYWILKNILKKLEPSLHDAAHGFRNSEIIKEKHTINIKFFITQILKAKYISIFYKFRLILKLIIYAIALPELIQYPKFGKRRSIVTNAEPHVGADVIINVDIKDFFHSISYKRVKGLFRSFGYSESASTIFALLCTVTFVNHRSYLPQGAPTSPMITNLICRRLDRRLTHMAESFGFRYTRYADDLTFSSSDESVCNIGKVLRHTEGIVKHEGFEINRDKTQIMRKSNRLEVTGIVVNSKPSISREKLKRFRATLYQIEKDGLEGKFWGNSTDVMSSIQGFANFVYMVDPQKGAKFRDQIRIIKEKYKC

SEQ ID NO: 6201 - protein, 435 aa, Nostoc sp.
  source 1..435: note = Related to AP018318.1
MPVYQSESSDDSYEIDEDVEAQLSRGWRETNNLENNYWYEQRQLQGKTKRNKQGNKELLEKYCLPQCNSFRAISNLININLEELRLLVFSPKQDAATKHHYIRFYLPKKTGGERIISAPNQHLKNVQYWILENILKKLDPSIHDAAHGFRNSRIIEIENNKLDINLLPIKTLNTRYSILYKFWIIVKQIIYVDASHRLTQYPRFGKRRSILTNAEPHVGADIIINVDLKDFFHSISYKRVKGLFISFGYSESASTIFALLCTVTFVNHRSYLPQGAPTSPMITNLICRRLDRRLTEMAERLGFRYTRYADDLTFSASNENGCNIGKVLRHTQGIVKHEGFEINQDKTRIMRKSNRLEVTGIVVNTKPSISREKLKRFRATLYQIEKDGLGGKFWGESEDIMSSIQGFANFVYMVDPQKGAKFREQIRIIKEKYRY

SEQ ID NO: 6202 - protein, 321 aa, Scytonema sp.
  source 1..321: note = Related to NZ_AP018194.1
MSAPTRRLKDAQYWILNNILKKLDSSLHDAAHGFRSSRVIKTETNGKNDFLRSLQHLEPRHFGNLFNFWRRIKSTIYLLTLSLSSSKIKFGKRRSIVTNAEPHVGADVLINIDIKDFFPSISYRRVKGLFKSFGYSESASTIFGLLCTVTFVNHRSYLPQGAPTSPMITNLICRRLDRRLTQMGERFGFRYTRYADDLTFSASNESLCNICNILRQTESIVRHEGFEINKDKTRILRKCNRLEVTGIVVNSKLSISRQKLKRFRATLYQIEKDGLEGKHWGKSEDLIASIQGFANFVYMVDPEKGAKFREQIRIIKEKHGC

SEQ ID NO: 6203 - protein, 515 aa, unidentified
  source 1..515: note = Blastocatellia bacterium; note = Related to JAEUQL010000156.1
MSEKRRTREEIFQRMRETSRDEVILEEMIRHGFWPREGRLAEDPADEIRRKGEIERELQQLRAQNRSLQNEAALLREMRKRRFAESRKKRQETKERREKQRQERAEAWQQKKAEEITFLGTGVSVGLSNKKSNEELLKKYNLPVYRSPEEIAAAMAVTISTLRFLAFSRKTSTVSHYIRFKIPKKTGGQRLISAPMPRLKEAQTWILATILEKIPVHQAAHGFRAGHSIVTNAEPHLGKEVILNVDLKDFFPSVSYRRVKGLFSSFGYSEAVATLFALLCTEPDIEKVELDGKTYYVTQTRRHLPQGAPTSPAITNLLCRNLDYKLYCFAEKLGFTYTRYADDLTFSASNEAVKKVGYILKKLEEIVKKEGFEVNQEKTRILRYSRQQEVTGVIVNEKLNVSRKVLRNFRATLYQIEKDGLEGKRWGQAQDLVAALQGFANYVYMVNPEQGSLLRTRVQAIIEKTKWKAAARPVKPSKMEEVATLQTESAVEEVEIEQKKQDKDYDSSKKWWKLW

SEQ ID NO: 6204 - protein, 482 aa, unidentified
  source 1..482: note = Related to JAGGDU010000219.1; note = Trichodesmium erythraeum
MTDQPSSRKELYARIREIGREEFLLEEMTRYGFWPEGEEMPLDPVDEIQRRGELEQQLKKLRQENAHLFNLKKLGQEAYKQRLVESRRKQQETKELRERERQERAKAWQEKKENDIIYLGEEISGGLNNVEGNIFRLEIYNLPILNTAQDIANAMDITVGELRFLAFSRPTSTVSHYIRFKIPKKTGGERQISAPMPRLKNVQTWILDNILCNVPLHEAVHGFRAGHSILTNAEPHVAKDVIINFDLKNFFPSICYKRVKGLFFSLGYSEAAATIFALLCTEPNVVVVELDGQVYYVAQSDRHLPQGSPASPAITNIMCRRLDKRLSEMAAKLDFVYTRYADDLTFSSSGDSLRHICNVFRRTESIVSHEGFTVNREKTRLLRGKSSQLEVTGVVVNEFPNISRKELKRFRATLYQIEKDGPQGKRWGHSDNVIAAIEGFANFVAMVNPEKGRELVRRVKQIKEKYTGRRRRSTKILEHDGT

SEQ ID NO: 6205 - protein, 466 aa, unidentified
  source 1..466: note = Related to JACMLN010000050.1; note = Anaerolineae bacterium
MTEQPRTRQELYDRIRQTSKDEFILEEMIRLGFWPRQGTLPEDPAEEIRRQGELQRELEALRSESRKLNNEEHLRKAARKLRLQESRQKQQQNKERREQERIARAQVWEQRKQHEILYLGEGVSGGLSATECDHERLASYGLPALGSAEQIASAMGISVGQLRFLAFSRRTSKVSHYIRFTIPKKSGGERLISAPLPRLKHIQHWLLANLLTNIPLHEAAHGFRTGHSIVTNARPHVGADVVVNLDLKNFFPTITYKRVKGLFRALGYSEAAATIFGLLCTEPEVAALSLDQTTYYVSQGTRHLPQGAPTSPAITNLLCRRFDRRLTAMATALGSQYTRYADDLTFSASGENLRHICTLLRRIESIVTHEGFVINEAKTRILRGGSQQEVTGIVVNNKLSVCRKTLRRFRALLFQIERDGPSGKHWEGAPNLFAAMQGFANFVYMVDPERGLPLRQKVRHLRSLHG

SEQ ID NO: 6206 - protein, 478 aa, Pseudanabaena sp.
  source 1..478: note = Related to NZ_ALWB01000094.1
MTNQPRTRQELYDRIRRSSRDEVILEEMIRLGFWPAAGEMPKDPADEIRRKGEIMRELEDLRAQNRQLHNEEALKKEALAQRLAESKRKQQETKERRERERQERLEIWELKKQQEIVFLGEGVSAGLNKTECDRDRLQSYGLPEYGTSGEIAAAMGISLGELRFLAFSRRASNVSHYIRFKIAKKTGGERLISAPMPRLKQAQTWILYHILEKVNLHEAAHGFCRGRSIVTNAAPHVGADVVINLDLQDFFPSISYKRVKGLFISLGYSEAAATIFGLICTDAAVEAVELDGKTYYVSLGDRHLPQGAPSSPAITNLICRRLDLRLTKMAASLGFVYTRYADDLTFSGSGENLRQICNVLKRTEAIATHEGFTIHPQKTRVLHRSQHQEVTGIVVNEKLNVDRETLKRFRATLFHIEKDGLAGKHWGNYPDLIQSIEGFANFVAMVNPEKGGKLKEQVQRIKAKYRPKRVKRIRRKSN

SEQ ID NO: 6207 - protein, 472 aa, unidentified
  source 1..472: note = Related to MQTZ01000030.1; note = Leptolyngbya sp.
MSEPSPPRTREELWDRIRQTSREEIILEEMIRLGFWPAQGELPQDPADEIRRRGEIHRELRELKREDRRLQDEKILRKQMLEKRLAESRRKQQETKERRERERQERSAAWEQRRQQEILYLGEGVSGGLNQTEGLSDRLQQHRLPLCLTAEQLATAMGLTIAALRFLAFARRTSPTSHYVRFQIPKKTGGLRLISAPMPRLKQVQYWILDNILDRLTPHDAAHGFCRGRSIVTNALPHLGADVVINLDLQDFFPTISYRRVKGLFRSFGYSEAVATILALLCTEPEVETVDLDGQTYYVALTDRRLPQGAPTSPTIANLICRRLDRRLTEMATTLGFTYTRYADDLTFSGSGDALRQICNLLQRSVAILTHEGFTVHDQKTRVLRNSRQQEVTGIVVNHKLNVDRETLKRFRAILYQIEKDGPAGKQWGHSRDLMASIHGFANYVAMVNPEKGQKLLAQVKRIKQKYKRKRR

SEQ ID NO: 6208 - protein, 476 aa, Pseudanabaena sp.
  source 1..476: note = Related to NZ_KB235911.1
MTEPAQPRTRQELWDRIRQTSRDEVILEEMIRLGFWPAQGQIPQDPADEIRRRGEIDRELKELRKEDRQLQDEKVLKKRLLEQRLAESRRKQQENKERRERERQAKSEAWQARKTQEILFLGDGVSQGLHHQQGDEQRLRSLDLPICHTPAELAAAMEISIGELRFLAFDRHVSFVSHYVRFQIPKKTGGTRLISAPMPRLKRSQYWILKHILTRISPHDAAHGFRQEFSIVTNAQPHVGADVIINFDLQDFFPSISYKRVKGLFRSLGYSEAVATILGLLCTEPEVEAIEMDGKTYYVALTERHLPQGAPTSPAISNLLCRRLDRRLSEMAENAGFIYTRYADDLTFSSAGDAQRQICNVLKRTESIVTHEGFTINPQKTRVLRSSQQQEVTGIVVNDKLNVDKATLKRFRATLYQIEKDGLEGKQWGNSQNLLSAIHGFANFVAMVNPERGKIFLEQVQRIKQKYGKKKRRDRP

SEQ ID NO: 6209 - protein, 470 aa, Calothrix sp.
  source 1..470: note = Related to JAAUPE010000002.1
MTEQPRTRQELYDLIRQTSKQEFILSEMIRLGFWDENSNNPEDPAEEIRRQGELQRQLQELQQQNRQLHNEKALKKQLLKQRLEESKRKRQETKERNERKRQERSQAWQEKQAHEITYLGEDVSSGLNNLENNCDRLQKNNLPVFQTIEELAAAMGMTVGQLRFLAFDRKTSTVSHYIRFKIAKKTGGERLISAPMPRMKSTQDWILDRILEKIPMHSAAHGFRRGRSIVTNATPHVGTDVVVNLDLQDFFPSISYKRVKGLFQALGYSEAIATVLALVCTEATTEEVELDGKSYFIATSDRHLPQGAPTSPAITNLLCRRLDKRLANMAVSQGFIYTRYADDLTFSTSGDAIRNLCNILKHTENIVSHEGFTIHPNKTRVLRKSQQQEVTGIVVNEKLNVDRATLKKFRATLHHIEKDGLAGKHWGSGNDLMAEIEGFANYVMMVNPEKGEPLVKQVKLIKKKYGLRKR

SEQ ID NO: 6210 - protein, 471 aa, Chamaesiphon minutus
  source 1..471: note = Related to NC_019697.1
MTEQPRTRQDLYDRIRQSSKEEFILDEMIRLGFWSANGEIPNDPADEIRRRGEIQRELETLRAENRRLHNEEALKKEALKLRMAESRRKQQETRERRERERQERAIAWQTRQEREITYLGAGVSAGLNLTESNLARLQQHRLPILHAAADLANAMGITVGQLRFLAFSRRIATVSHYVRFQIPKKTGGFRAISAPLPRLKQAQQWILDNILEGVVLHPTAHGFRRGRSIVTNAEPHVGALVVINMDLQDFFPSISYARVKGIFRSLGYSEAIATILGLICTESDVTEIELDGRSYYIAQELRHLPQGAPTSPALTNLLCRRLDRRLDRMAKSRGFIYTRYADDLTFSTTDRERLRDIGNILKGTHGIVTHEGLTIHPDKTRVLRQSQQQEVTGIVVNQKLNVDRTTLRRFRATLYQIEKDGLAGKQWGQGADLLQSIAGFANYVAMVDPHKGREFLASVQRIQKKYGRRKR

SEQ ID NO: 6211 - protein, 495 aa, unidentified
  source 1..495: note = Synechococcales cyanobacterium CRU_2_2; note = Related to JAAUOP010000014.1
MTSQPETRQALYDRIRQSSKDEVILNEMIRLGFWPTAGTLPEDPAEEIRRQAEIQQELADLRTESRKLNDEKALKKKLLKQRMEASKQKQQETKIRRDRERQERAAAWKSRQAQDTRLPWEGVSAGLSQTGCDRDRLQQYHLPELGTAADIAQAMGLPLGQLRFLSFSRRISHISHYVRFRIAKKTGGDRLISAPMPRLKAAQYWIVANILEPLKVHDAAHGFCRNRSIVTNATPHVGADVVVNLDLKDFFPSISYARIKGLFRALGYSEAAATIFALLCTEADVEEVELDGRTYYVAQSARRLPQGAPTSPGLTNILCRRLDRRLTGLAQELGYTYTRYADDLTFSASGAAAGQVGRLLRQVKDIVTHEGFEVHPKKTRVLRQSRQQEVTGVVVNEKLNVDRKTLKRFRATLHHIEKDGFKGKTWGHQSDVQTNVQANVQANVQESDIQGSNLLSAVQGFANYVYMVNPEKGGPFLDQVKRIKQKYKLDRKPKR

SEQ ID NO: 6212 - protein, 475 aa, unidentified
  source 1..475: note = filamentous cyanobacterium LEGE 11480; note = Related to JADEXQ010000025.1
MNQQPQTRQALYDRIRQSSKDEVILTEMIRLGFWPSSGELPNDPAEEIQRQGEIQRELSELRAENRKLNDEKALKKRLLKERLVASLQKRQETKARREQERQERAAAWKARQAQDITYLGEGVSSGLNHVECDVERLQRHNLPELGTAAAIAAAMGISVGELRWLAFSRRTSQVSHYIRFRIPKKTGGERLISAPAPRLKKAQYWIEANILQLIEIHDAAHGFCRQRSIVTNAQPHVGADIVTNLDLQDFFPSVSYRRVKGMFRALGYSEAAATIFALICTEPEVEMVELDGRTYYVAQSDRRLPQGAPTSPSITNILCHRLDRRLTGLAQEFDYAYTRYADDLTFSASGAATEQVGRLLRQVTQIVSHEGFQVHPQKTRVLRKSRQQEVTGIVVNDKLNVDRKTLKRFRATLYQIEQDGLAGKVWGHSADLMGAIEGFANYVYMVNPDKGSHFLAQIKRIKQKHRPKRHQPRKS

SEQ ID NO: 6213 - protein, 476 aa, unidentified
  source 1..476: note = Related to NC_009925.1; note = Acaryochloris marina
MSNQPRTRQELYDRVRQSSRDEVILEEMVRLGFWPAEGEMPQDPTDEIRRKGEIQRELAALRAENRKLHNEAAIKKQLYKERLAASKKKRQETKERREQERQSRAAAWRDRKARDIVYLGTGVSGGLNQTECDRTRLQQYGLPAYGTAEEIAKAMQISVGQLRFLAFSRRTAQISHYVRFKIPKKTGGERLISAPMPRLKQAQYWIAEKLLAAIPLHEAAHGFCSGRSIVTNATPHLGADVVINLDLQDFFPSISYPRIKGLFRSFGYSEAAATIFALLCTEPDVVEVGLDGQHYYVAQSQRHLPQGAPTSPILTNLLCRRLDRRLTAMAAELGYRYTRYADDLTFSATGQPQQQVGKLLRRTHAIVTHEGFTIHPQKTRVLRSGRQQEVTGVVVNEKLNVDRKTLKRFRALLHQIEQSGYDDQHWGGQPVSFAQIQGYANFVEMVNPERGAQFQAQVKRIKRKYPPRVQAFKPAS

SEQ ID NO: 6214 - protein, 514 aa, unidentified
  source 1..514: note = Blastocatellia bacterium; note = Related to JADJPF010000004.1
MSNQRPRTRQELYERIRQTSREEFILEEMIRFGFWPAQGEIPQDPADEIRRRGELQRQLGELNSQERNLRNEEKMLKELRKRRMEESKRKRQETKERRERQRQERAKAWQEKKKQDITYLGEGVSAGLNNKEVNSSRLNQHNLLSYSNASEIASAMNISINALRFLAFTRKTSTTSHYVRFKIPKKTGGERIISAPMPRLKAAQNWILHNILEKVTLHDAAHGFCQKHSIVTNAKHHIGAEVIVNIDLKDFFPSISYKRIKGLFLSLGYSEAAATIFGLICTEPIVEQVILDGKTYYVATSERHLPQGAPTSPALTNILCRRLDKRLSKMASNLGFTYTRYADDLTFSAKSEASRNVCNILAKTDNIVKHEGLTINSEKTRVLRKGRQQEVTGIVVNKQLSISKKTLKRFRATLFQIEKDGPDNKHWGHSKDVIASIQGFANFVYMVSPEKGRLLKTKVRAIIKKYNWKAAQRKRLPLPLTTVPPTVQEIQKVPETVIEKPQEQKTNKKWWKLF

SEQ ID NO: 6215 - protein, 518 aa, unidentified
  source 1..518: note = Related to JACQZQ010000027.1; note = Acidobacteria bacterium
MSERPRTRQELYERIRKTSKEEFILEEMIRFGFWPAEGQIPQDPADEIRRRGEISRQLNELHTQNRHLGNEEKMLKELRKKRMEESKRKRQETKERHERERKERAEAWKEKKKQDIIYLGQGVSSGLNNKESNEERLKSYNLPKYSNASEIATAMSISIGALRFLAFSRKTSTKTHYVRFKIPKKTGGERTISAPMPRLKSAQNWILHNILEKVKLHDAAHGFCTQHSIVSNAKPHIGAEVLVNIDLKDFFPSISYKRIKGLFKSLGYSELAATIFALICTEPTVEEVSLDNQTYYVATSARHLPQGAPTSPALTNILCRRLDKRLTEAAKELGFTYTRYADDLTFSTKGEFSRNICNILNKAHDIVKHEGLTVNSEKTRVLRKGRQQEVTGVVVNKKLNISKKTLKKFRATLYQIEKDGPEGKRWGHTPDVIAAIQGFANFVFMVNPEKGRLLKSKVKSIIQKYNWVPEWKRKLSSPSEVQPNVSTLSTLPVTSTENKVETQKTTENKTNKKWWKLF

SEQ ID NO: 6216 - protein, 524 aa, unidentified
  source 1..524: note = Related to JAIBAN010000080.1; note = Blastocatellia bacterium
MDRPRTRQELYEQIRRTSRQEFILDEMIRLGFWPAAGVMPHDPADEIRRETEIRREIAEVHQQNRHLYNEEALKREMRKRRIEESRRKQLENKQRRELARQQRAAAWNEKKQKEIGFLGETVSGGLNQTECNQGRLEKFSLPRFTTPEEIAKGMNLSVPRLRFLAFDRKTSRVSHYVRFQIPKKTGGVRIISAPKPYLKAAQEWVLQTILERVPVHPAAHGFLAGHSIVTNAQPHLKADLILNVDLKDFFPSVHYQRVKGLFKSLGYSEAAATVFGLLCTERDTQEVELDGERYFVGLSERRLPQGAPTSPAITNLLCRKLDARLHKLAMKHGFAYTRYADDLTFSASGPNTRNLCNVLKGLAAIVTHEGFTINPSKTRVLRKGDQQEVTGIIVNEKLNLAREVLKKFRAILFQIEKDGPEGKRWGTSPDVIGSVVGFANYVRMVNPEKGAQFQAQVRRIIEKYGWKRVRMTPAKPAEIAFDPAPTMILTSAPPPPEPEEKPPVAPQAPPSSADGKSKKWWKMF

SEQ ID NO: 6217 - protein, 517 aa, unidentified
  source 1..517: note = Acidobacteria bacterium; note = Related to JACQXX010000070.1
MMDQPRTRQELYERIRRTSREEFILEEMIRLGFWPREGQTPSDPADEIRRRGELSRELTKLRTENARLYNEQALIQEMRKRRLAESRQKQQETKARHERERQERAQKWREKKQHEIVFLGEKVSGGLNYTECDEARLNQNGLSAFSTAEDIAAAMGISLSDLRFLAFDRKTSTVSHYVRFKIPKKTGGERLISAPKPHLKAAQEWILHTILEKVTLHEAAHGFRTGRSIVSNARPHLKAEVIINIDLKDFFPSIAYPRVKGLFRSLGYSEQAATIFGLICTEPDVEEVELDGKTYFVALSTRHLPQGAPTSPALTNILCRRLDRRLTKLAENRGFVYSRYADDLTFSASGNAKQNICNVLRGVESITAHEGLAINTEKTRILRHSRQQEVTGVVVNEKLNVSREELKRFRAVLFQIEKDGPEGKRWGNSKDVIASIQGFANYVAMVNPEKGAEFQAQVKAIIQKYGWQRPASHRRSMASSESQYPGPASAPEPEVTSPATPESESSKSNDKKWWKLF

SEQ ID NO: 6218 - protein, 507 aa, unidentified
  source 1..507: note = Acidobacteria bacterium; note = Related to JAFDVL010000054.1
MTTQPRTREELYQRIRQTSRQEFILSDMIRLGFWPDAGVMPEDPADEIRRRGELQRQLDELRAQNRKLHNEQALLKELRKKRLLESKQKQKETKERRERERLERAEKWQQRKAKEIGYLGKEVSIGLSYAECNAERLSQYGLPHFENAEQIAAAMGITVSELRFLSFSRKTSNVNHYVRFKLPKKTGGERLISAPMPRLKHAQQWILTNLLEKVQLHDAAHGFRAAHSIVSNAKPHLGAEVIINRDLKDFFPSISYKRVKGVFKSLGYSDAAATIFGLLCTEPDVEKVELDGRIYYVATGERHLPQGAPTSPAITNILCRRLDRRMQKIADECGFVYTRYADDLTFSTSGESKQNICNVLRRSESVVAHEGLELHPDKTRVLRKSRQQEVTGIVVNEKLSIDRKELKRFRAVLFQVEKDGPDGKHWGKSPDVIASLKGFANYLQMVDPEKAAEYQKRVHALIEKHGLQPSQFTYRNPAAPVDAAPARPDLPKEETKPKPEKKRWKLW

SEQ ID NO: 6219 - protein, 504 aa, unidentified
  source 1..504: note = Acidobacteria bacterium; note = Related to JAFAZX010000026.1
MSTERPQTREELYERIRDGRKEEFVLEDMIRLGFWPARGEMPHDPADEIRRRAELQRELGELRAQHRNLYNEEALIKELRRRRLEESRRKRQETKERRERERRERAEAWRQRQGQEIVYLGEAVSGGLNHTECDAARLQSYGLPPLGTAAEIAGALGVSVGELRFLAFDRKTSTVSHYVNFQVPKKTGGLRQISAPMPRLKAAQHWVLRNVLEKVEAHECAHGFRAGRSIVSNARPHVGAEAVVNLDLQDFFPSIGYRRVKGLFRAFGYSEAAATIFGLLCTQPGTEEVELDGRRYFVATGERHLPQGAPTSPAVTNILCRRLDRRLLKVADELGFVYTRYADDLSFSASGESLRHLGNLLERVKAVVRHEGFNVHPDKTRVLRRSRQQEVTGVVVNDKPNVSRSELKRFRATLYQVEKDGPAGKRWGRSPDVIASLLGYANFVYMVNPAKGAELQRRTRALADKYGHEPVKVERPSRRRQPEPQAAAPSPEPQPTQKKWWKLW

SEQ ID NO: 6220 - protein, 502 aa, unidentified
  source 1..502: note = Related to JABFSD010000364.1; note = Acidobacteria bacterium
MSALAVKPLTRQELYERMAETSRDEVILEEMIRFGFWPAQGEVPFDPADEIRRRGELHRALDELRAEQRKLGDEAKLRKEARKKRLLESRRKQQETIVRRETERIERATQWQEKKSKEIGYLGAGVSAGLDNKEANVERLQRYNLPRFDDAASLAQAMGLTVGALRFLSFARKTSKTTHYVRFALPKKTGGVRVISAPMPRLKAAQHWVLQNILQPVELHEAAHGFRPQRSIVSNARPHVASSVVINLDLKDFFPTLDYRRIKGVFRALGYAEATATILGLLCTEPEVEKVELDGETYYVATSARHLPQGAPTSPALTNILCRRLDRRLLKVAEEMGFVYTRYADDMTFSTKQEQDSKQIGRLLHRVESIVAHEGFCIHPTKTRIMRSASKQDVTGIIVNDKPSIDKATMKRFRAVLFQVEKDGPIGKQWNHSRDVLASLRGFANFIFMVDPAKGAAYQRRVGALIDKYDWKPQPLPYQKKTKPVEPPAPQPVAQRPWWKLW

SEQ ID NO: 6221 - protein, 501 aa, unidentified
  source 1..501: note = Acidobacteria bacterium; note = Related to JAFDVJ010000081.1
MSEQPRTRQELYEEIRRQGGRDVYVLEEMIRLGFWRESTGLPDDPAEEIRRAAELQAELDRLRADNRKLYDEQAMLNELRKKRLAESREKQKETRARRERERQEKAENWRRRKETEILYLGAEVSGGLNNNETDRERLERGGLPVFSNVEELARAMNLTVGKIRFLAYDRRTSETTHYVNFKLPKKTGGHRLISAPMPALKAAQTWILENILGRVAVSDAAHGFLPAKNIVSNARLHVGAQTLVNLDLENFFPSIGYRRVKGIFRAFGYGEALATVFALLTTAPDTEEIELDGKTYFVATGERHLPQGSPASPALSNIAARRLDKGLAKLAAAHGCKYTRYADDLTFSTEDRDAAIGRLLAQVRFVVEKQGFKVNEKKTRVLRRGRQQEVTGIVVNDKLSIDRKTLRKFRAVLFQAETKGLENLRWGNSPDLVAALKGYANFVFMVDKEKGYAFQQQVRRIAEKYDWQPAPPRFPPKKKVEPEEPAPEKPAKDEKPWWKLW

SEQ ID NO: 6222 - protein, 501 aa, unidentified
  source 1..501: note = Pyrinomonadaceae bacterium; note = Related to JAIBCC010000010.1
MEQPRTRQELYEYVRQHGGRDAFVAEQMIRLGFWKSSDLPNDPVEEIKRIHDLQEELNKVRNENRKLFNEQALLKELRQRRLAESKQKQKETKLRREQERKERAEAWQKRKETEIVYLGEKVSGGLNNFEENAERLTANDLPSFANIEQLAKAMNLTVGKLRFLAFNRQTSETKHYIHFQLPKKTGGFRLISAPMPQLKTAQHWILHNILQKVSVHEAAHGFLPEKNIVSNAQPHVGAKIVVNFDLKDFFPSINFPRVKGVFRSFGYSEAIATIFSLICTAPETEEVEIDGKTYFVAIGERHLPQGAPTSPFLTNILCKRLDKGLQTLAKNYDFTYTRYADDLTFSTKNDGEKLTDFINKIRYVVEKQGLTINESKTRILRKGRQQEVTGIVVNDKISVNRKTLRKFRAVLHQAETKGLEGLRWGNSNDLIASLDGFANFVLMVDAEKGKMYKAQVGRIAEKHGWKSSRSGKFTPQELREVVEKKEEKPNDNQGKDWWKVF

SEQ ID NO: 6223 - protein, 528 aa, unidentified
  source 1..528: note = Related to NZ_JAFREP010000006.1; note = Acanthopleuribacter pedis
MNQARQALYDRIRESSKDEVILEEMIALGFWDPAQPGKEAAAELIGKTAELEREMSALRSEMARIDNQEAMLKALRKRNMEQAKARRVETKKRREAERQARAEAWRLKKQQDILYLGEGYSHSLGEQGACDAAALDENGALPAYENAAALAAAMGISIGELRWLAFGRKVSQTTHYQRFQVPKKSGGLRLISAPMPRLKEIQSWILREILEKVPIRSAARGFVRGKSIVDNARPHVGADVVINVDIKDFFPTVTYPRVKGVFRKLGYRGQVATILAMLTTEPEMVALEMDGQRYWMAKGERRLPQGAPSSPALTNIICRGLDAELEELALVNEYEYTRYADDITFSTRGREANRRIGGVLRKIEQHVGAHGFTLHPDKTKVLRNNARQEVTGIVVNEKLSVDRKTLRRFRAVMFQVEQDGPEGKHWGQAEHVIAGLTGYAHFLKMVDPARAQPFLEQLARIVEKHGNPVYPERRAARAPSWRRYQPDSDQAEATDAAPAANEAPAHPSGSEGEAATPVLEKKPWWKFW

SEQ ID NO: 6224 - protein, 532 aa, unidentified
  source 1..532: note = Related to NZ_CP071793.1; note = Proposed Sulfidibacter corallicola
MNNARQELYDRIRESSKKEVILEEMVSLGFWNEADPAFQKAQGAIERTGELEREMRALHTELSRLENKEAMIRAIRKRNMAQAKERRAETKARRLAARKARAEKWRREKQRDILYLGDGHSQTLQDRESDAARLGRTGDLPVLHDAAQLASAMEISVGELRWLAFGRKVSKVAHYQRFYVPKKTGGLRLIAAPMPRLKEMQRWVLREILEKVPLHEAATGFRNGISIVDNARRHVGSDVVINMDLKDFFPTLSYRRVKGVYRKLGYSGQVATILAMLTTEPEMDRVEMDGTLYWVARGERRLPQGAPSSPALTNIACRRLDRRLAALAEEWGYRYSRYADDLTFSANGEAASRAGKILRGARFIVEQEGFVVHPDKTRVLRRGRRQEVTGIVVNDKLSVDRKTLRRFRATLHQVERHGPQGRTWGHSPDVIAALTGYATFVKMVDSERAEPFLAQLERIREKWGYEPPAWDPGPIREPSWQRYQPEPEPAESDIATEATAEAGGAAGSEAEARAPGEAESAENHKKPWWKFW

SEQ ID NO: 6225 - protein, 524 aa, unidentified
  source 1..524: note = Related to JAGNHB010000094.1; note = Acidobacteria bacterium
MSRPAAPSQPTRENLYQRIRETSKAEVVLEEMIRLGFWPAGEGIPKGPEAEDRRTGELENELAALRTEMSRLQNEAAMRRALYQKRLEEARQKRQETRRRQEEARRARAAAWKQAKEREIGYLGEGISAGLNHQLSDATRLAQHGLPLLSTALDVASAMDISVGELRFLTFVRRVSKHTHYRRFFIPKKTGGQRLISTPMPRLKQAQYWVLGNILERIPIHSCAHGFVAKHSIVTNASMHTGTDVVVNCDLENFFPTISYRRVRGLFRALGYSEQVATILALLCTEPEVDRVECDGETYHLCTSERHLPQGAPSSPMLTNILCRRLDRRLSNLAETLGFSYSRYADDLTFSGSGEARGKVGKLLRKTEGIVSHEGFRINRDKTRVQRRGRRQEVTGIVVNERPAVNRENLRRMRAVLFRLEKDGLRGQHWGRGGEVISALEGYAHFVAQVDPAKGGRFLEQLVAIKAKLGWQRPKHLRRPKRTPSWKRSATAPAATPADVMPAVAQPAKPEPATPPKKPWWKFW

SEQ ID NO: 6226 - protein, 420 aa, unidentified
  source 1..420: note = Related to NZ_CP071793.1; note = Proposed Sulfidibacter corallicola
MPTVDSQDQVVDRDLCLDPLRTELEQRLGDEARRRLRRERNLAARRRSRTPRPTPPRVPTQTLTYLGDRLSGGLQDRRSRLDRLADHPQLPVLHDADDLAAAMGIEISELRFLAFAPTHSRVNHYQRFLLPKKTGGHRQISAPMPRLKAAQHWIYQRILAQVPVHRAAKGFLPGHSIVDNARPHVGADVVINMDLENFFPTITFARVKGLFRTLGYSEQVATILGLLCTEPEVETYEWLGERYHVARGPRFLPQGAPSSPPVTNLLCRRLDRRLDGLARSLGFHYTRYADDLTFSGSGEATDRVGKLLGKARDIIEHEGFRPHPKKTRVLRAGRQQEVTGIVVNRKLSLDRKTLRRFRAVLFQVELDGPAGKRWGNGGDLLASLEGYAHFVHMVDAEKGRAFLDRVEAIKARYGSDSIEL

SEQ ID NO: 6227 - protein, 501 aa, unidentified
  source 1..501: note = Related to JACKEM010000004.1; note = Deltaproteobacteria bacterium
MSDRRQEIYQRIRESSKDEVVLDEMVRLGFWPQQGVLPEDPAEEIKRQAALRDELASLTARLQKLGNQEALRQELKRRRLLESRRRRQETKLRRVHARELRAFEWKQKQRASITYLGEEVSRGLSNTASDEARLRALGLPVFHEASDIARAAQIEVSHLRHLAFHRVVSRRSHYVRFYLPKKTGGTRLISAPKPKLKWIQHWILRHVLEPLKAEDVAHGFVKARSIVSNASAHVGQDIVINVDLKDFFPTLTYRRVWGFFRKLGYSGHVATIFALLTTEPAVDELELDGSRYFVATGERFLPQGAPTSPALTNVICRKMDRRLAGLARTFGLTYTRYADDFTFSGPGETNVGRFFGALTRVVTEEGFSIHPGKTRIFRRGRRQEVTGLVVNSGKPTVPRATLRRFRALLFQIEKDGPEGKVWKPGVDVVRSIQGFARFVAMVDSEKGRALEARVQKIVAERGPASLASTRTVAKAKSHWYPPLKPLGEQPQLNLPHAQQDT

SEQ ID NO: 6228 - protein, 520 aa, unidentified
  source 1..520: note = Related to JAGQSB010000027.1; note = Acidobacteria bacterium
MQLLEKNKKILEEMVRLGFWPESQPLPGLNPEEQTRYETLSNELAAIRTELTRLKNREAMLKAIRAQRLADAKRKRLETKARNEEKRLERARTWKQIQAKQITYLGMGVSAGLSEQVGQSERLKTQGLPSWSTPAELAKAMNISVGELRFLTFHRRVVKHSHYIRFHMPKKTGGTRLISAPMPRLKELQHWVLEHVLEKIPIHDSAHGFRKHHSIVTNAQPHVGQPMLINLDLKDFFPTLTYRRVKGLFRQLGYSESIATVLGLLCTEPEMDQVKLDGQPFLIAKGDRHLPQGAPSSPMITNLICRRMDQRLAKLAASFGFIYSRYADDLSFSGAELDSRETGRLLKRIQNIVNHEGFVVHPHKTKICRSGQRKEVTGIVVNSFCSVDRKTRKKIRAILHHIEKDGPSGKNFGANPDVLEALLSYAQFMAMVNPEQGLPVLNKVKALANQIGYKRKTYRRLASSSKRFKRFVPDPALFAKPEPAPSLQKETAEQRPTPLPKQDLKTNAEAPAKKPWWKFW

SEQ ID NO: 6229 - protein, 465 aa, unidentified
  source 1..465: note = Related to PBIH01000081.1; note = Deltaproteobacteria bacterium
MNTQPATRQELYDRVRASSLQEVILEEMVRYGYWPKEGEIPEDPAEDIKREGELVRELGKLRSELEKLHDMEKLIKAARRKRMLESRERQKENRLRRIREREERAAAWKERKQHEILYLGEGHSGTLSSQVSDEERLAAHHLPIFHTPEDLALAMGLSIGALRFLCFSRKVSKTSHYQRFYLPKKSGGKRLISAPMQRLKSAQHWLLEHVLEQVAIHPSAHGFRKEHSIVTNAEAHVGAHVVVNIDIENFFPTFHYPRVWGCFRALGYSPAVSTCMTLLCTEPEILEIELDGELWFVQQGSRALPQGAPTSPTLTNILCRRLDKRLAGLARVHEFTYSRYADDMTFSGNDNVDVGKLLASLRSVLHQEGLKIHPNKTAVYRRGRRREVTGIVVNEKLSVSRKTLRRFRATLFQIEKDGPEGKTWGNGGDLFASIQGYANFVHMVDPEKGRAFLQRVQRIINLHSR

SEQ ID NO: 6230 - protein, 358 aa, unidentified
  source 1..358: note = Deltaproteobacteria bacterium; note = Related to JACCQV010000612.1
VELTYLGPRVSGGLGPTGDRRTSDGARLSAAGLPVVHTAAELATAAGLALGQLRFLAFAREVSTTTHYRQFTIPKRSGGDRVISAPMARLKKLQHWILEHMLNKLPLAPPAHGFRPGRSTVSNALPHLQSAIVINVDLKEFFPTVTYPRVKGLFRKLGYSEEVSTVLGLVCTEPDIVETVLDGITYYVARGPRRLPQGAPTSPAITNALCRRLDKRIAGFAAKHALTFTRYADDLTLSTKDPAGRVGACLKFLRKVAVDEGFTVHPEKVRVVRTGRRQEVTGVVVNEKPGVVRAELRRFRALLFQIEKDGPAGKKWGTPGTDVLTSALGFASYVAMVDPVKGAALRTQVLALRARFPT

SEQ ID NO: 6231 - protein, 479 aa, unidentified
  source 1..479: note = Deltaproteobacteria bacterium; note = Related to JAHBVW010000058.1
MSNLPPPRDRKELYERIALGGKDDVIAEEMTRLGFWSGEQAQLVDPPVEAARKAELRERLGKLREQAARMRNLVTLEADLKKQRMAASRKKREETKQRRLGERAAAKERTKATKARELGYLGPGVSAGLGPEHRASDVARLQAQRLPVVHTAAELAAAIGVSLGELRFLAFAREVSTTTHYRRFTIPKRSGGERVISAPRKRLKRVQHWVLAKVLEPLLGDPAASDPAHGFRSGRSTVSNAVPHVGAAVLVNVDLRDFFPTVTYRRVKGLFAKLGYGEEVATVLALACTEPDIAETQLDGLTYYVARGPRRLPQGAPTSPAITNALCRRLDRRVLGWADKHGFAYTRYADDLTLSSKDPAARVGACLGFLRQVAGAEGFTVHPEKVRVVRRGGRQEVTGVVVNERPSVPRVELRKFRALLHHIDMDGPAGKTWGRTDGADGGDVLAAALGFASYVAMVDPAKGTALRARVLALRAKYPG

SEQ ID NO: 6232 - protein, 473 aa, unidentified
  source 1..473: note = Kofleriaceae bacterium; note = Related to JABFXX010000347.1
MADLTPPKNRKELYERIARGGKEEVIVDEMVRLGFWPNTQPPPGDPPDEIRRMAELRTRLAQLRQQAQGLRNLAQLEIDLKKQRLAESKRRRELNKQKLLGERAAAKAATQEKKTRELTYLGKDVSAGLGPTLDRRTSDAPKLTTQKLPIANTAAELAAAMKVSLGQLRFLAFSREVSTTSHYHRFTIPKKTGGERVISAPHKRLKAVQHWILEHVLEPLALAEPAHGFVPGRSTVSNAVPHVGAAIVVNVDLKDFFPTVTYRRVKGLYKKLGYSEEVATVLGLLCSEPDIAQTELDGTTYFVARGPRRLPQGAPTSPAITNALCRRLDRRINGWAKKHGFIYTRYADDLTVSTRDRNAPVGKMLAFLRRVVTAEGFAVHPDKVRVVRRGRRQEVTGVVVNDRPGVPRDDLRRFRALLFQIEKDGPAGKRWGHNEGNVLEAALGYASYVAMVDPAKGEVLRAKVLALRAKYKQ

SEQ ID NO: 6233 - protein, 474 aa, unidentified
  source 1..474: note = Kofleriaceae bacterium; note = Related to JAGPDK010000426.1
MSEKAPANRKELFERIARGSKDAIILDEMQRLGFWPSQQSLPNEPPDEVTRLAAARARLAELHRNASRLRNLVELEREAKKQRMAESRARRVATKQKRLGERAVKRTATQQRKTIELRYLGATVSAGLQPGVGAITDGAAATIAQLGLPAWQTAADIARAMQVSIGTLRHLAYAREVSTINHYHRFSIAKKSGGVRVISAPQVKLKAAQRFILDELLAKFPLSNAAHGFAAGRSIVSNAAPHVAAAILINVDLRDFFPTVTYRRVKGLFRTIGYNEEVAIVLALLCTEPEITETQLDGVTYYVARGERKLPQGAPTSPAISNALCRRLDARLGGWCAKHGFAFTRYADDLTLSSHDRNANVGEALAVARRLVAAEGFVVHADKVRVVRQGGRQEVTGVVVNQKLSVPRDELRRFRALLFQLEHDGPTEKSWHGVGADGTGDVVQSARGYASYVHMVDPAKGAILLARLDALTKR

SEQ ID NO: 6234 - protein, 508 aa, unidentified
  source 1..508: note = Related to JABFRG010000606.1; note = Polyangiaceae bacterium
MSNRRQELYDRIRSTSKDEVVLEEMIRLGFWPRQGSMPLDPGDEVRRRGEIERELAALRTEQTRLGNLEALKKEALKRRLAESKEKQKETKARRERERVARAAAWAQKKAGEIGFLGTGVSGGLGHTETDEPKLVAQSLPALRSGTDIARAMGITVGELRFLAFDRRTSETSHYVRFTIPKKAGGERLISAPMPRLKSAQAWILENLLGKVALHDAAHGFRAARSIVTNARPHVGAPLVINVDLKDFFPTLTLGRIKGAFRALGYGDHVATVLGLLCSEPDVDQVVLDGKTFYVANGKRRLPQGAPTSPAITNIVCRRLDRRLASAAQKHGFVYTRYADDLTLSSIDPAANPARVLGVLRWIVAGEGFVVHPKKTRILRKGARREVTGVVVNEKLSVSREQRRKFRAFLFQLDKDGPQGKQWGASPDVFASALGYAAYLAMVDPERGKPVLAQARAIAKKHGWKGKPRPVKAVQAAPMPPVAPPVAEPMAPTSPEAPAEPKKKWWKLF

SEQ ID NO: 6235 - protein, 527 aa, unidentified
  source 1..527: note = Myxococcales bacterium; note = Related to JAGQIK010000716.1
MTYRRYSTQPSSRQELYDRIRDSSKDEVILEEMIRLGFWPAAGTMPDDPADEIRRRGELEAELRALRTERSRLHNIEALKKEARKRRMAESRRKRQETKERRLQQRVERAAVWAERKKSELLYLGEEVSAGLGEAEPDAQRLARHGLPSFSDAAQLARAMGLSLGALRQMCFDRATSRTTNYIRFVIPKRTGGVREISAPRPRLKEAQRWVLDNILSKIALHDAAHGFRDKRSIVSNAHPHVQPAVLVNVDLKDFFPTVTYRRVKGMFRKLGYSESLSTVLGLLCSEPRATELSLDGVTYYVALQERALPQGAPTSPAVTNIICRGLDARLCAIASKLGFVYTRYADDLTFSSKDKTVNVGRLLRQLRKIVDDEGFVVHPDKTRVLRAGRRQEVTGIVVNHTPNVTRDVLRKFRATLYQIEKDGPQGKTWGHSDDVIAAVEGFANYVAMVNPDKGRPLVERARALVKKHGKKPTPPKKAKKPAASTAPPPQARSEAPAATAAQSEPPETDGDDGGGKKKKKKWWKIF

SEQ ID NO: 6236 - protein, 528 aa, unidentified
  source 1..528: note = Deltaproteobacteria bacterium; note = Related to JAFCZD010000018.1
MSRPSSRQELYDRIRESSKDSVILEEMIRLGFWPQAGVLPEDPADEIRRRGELEGRLRSLRTEQSRLSNVDALKREARKRRMVESRRKQKETKERRLRERRERAEAWKERKGREIVYLGEGISAGLSDIKLDATKLAGQGLPSFADAAAVAQTMGLSMGELRRFAFTRTTSKTTNYMRFSIPKRTGGERHISAPLPRLKEAQRWILDHVLAKVPLHEAAHGFVGGRSIVSNATGHLQPTVLVNLDLENFFPTVSYRRVKGLFRSLGYSEQVATIFGLLCTEPEVTELELDGATYYVALEERLLPQGAPTSPAITNLICRALDARLTSIATALGFHYTRYADDLSFSAQGADADAGRLLRRVRHVVAEEGFVVHPKKTRVLRRGRRQEVTGIVVNGDRPSLARDVLRRFRATLFQLEKDGPAGKRWGRAVADEGDDVIAAVEGFANYVVMVDPEKGQLLQERTRKLVARYGKKPTPPRGGSGGSGGGGGPRPAAEAPAAAAQAPVVEAPPTAPTEAPSKKKKEKWWKVF

SEQ ID NO: 6237 - protein, 544 aa, unidentified
  source 1..544: note = Myxococcales bacterium; note = Related to JAEUJZ010000010.1
MAEPPRTRQELYERIVATSKDEVVLQEMIRLGFWPAAGTLPEDPADEVRRRAELQRQLDRLHEQNRHLYNEQALIKELRLRRLAESKRKQQETKERRERERLARAEAWKQEKTRSIVYVGEGVSAGLGKREAKPERLKEHGLPNFTSAADLASAMKISVGALRFLCFARKTSSVSHYVRFRIPKKSGGERLISAPMPRLKAAQSWVLHEILEKLALHTAAHGFVRGRSIVSNARPHVGHALIVNVDLKNFFPTVGYPRVKGLFASLGYSEEVATLLGLLCTEPDVEELVLDGQRYFVARSERHLPQGAPTSPAITNLLCRRLDRRLQKMADELGFVYTRYADDLTFSAKSEDVGQAAEVLRRLRNIVAHEGFVVHPEKTRVLRRGRRQEVTGVVVNHKPGVPRDVLHRFRATLFQIEKDGPSGKRWGACKDVLASIRGFASYVRMVDPARGTPLCARVDAIVAKYSGKPSPPAPSGAPAKKPDVPKPDAAKPGAAGSVPAATKTAEALAKAAPTPASVVSDAKEPSSPASDAKTPTGKKWWKVF

SEQ ID NO: 6238 - protein, 558 aa, unidentified
  source 1..558: note = Related to AFWT01000002.1; note = Thiorhodococcus sp.
MLAPCGSPPSKRLVFLGASRTLEQWLAVRPPQMHANRPEPSRAMSQPSSRQALYDRIRKSSKDSVIVEEMIRLGFWPAAGTMPEDPADEIRRRAELEAQLRALRTEQTRLHNIEALKREVRKRRMAEARERRKETKARKLAERQARAETWKAKKETDIGFLGEGVSAGLGHKGCDAERLAEHGLPELADAAAVAAAMGIDLGTLRFLAYACTTSRVSHYVHFFIPKRTGGKRAISAPMPKLKHAQHWILANVLDPVALDEHAHGFRHGRSILTNAQPHLGSRVVVNCDLQNFFPTVSYRRTKGLFQSLGYGEQVASIFGLICTAPETQEVELDGQRYFVALGDRVLPQGSPASPAITNLICRGLDRALEKTARQLGFRYTRYADDLSFSSDDANADVGRLLGRVRWLVQRHGFVVHPDKTRVLRQSRRQEVTGIVVNERPAVPRETLRRFRATLFQIEKDGPAGKRWGRATGDNGVDLMAAIEGFANYVAMVDPAKGRPLKAQVAALIARYPKQATPFKGRRRPSQSTDSPTSEPKRDATAPEVVDGTKKKKNWWKLF

SEQ ID NO: 6239 - protein, 417 aa, unidentified
  source 1..417: note = Related to JAEUKG010000966.1; note = Myxococcales bacterium
MSGDRPRTRQELYDRIRETSKDEVILEDMVRLGFWPRTGEIPQDPADEIRRRGDLERQIAALRTEQARLSNVEALRKELKRRRLLESKEKQKATKERRERERLARAAAWAEEKKRAIVHLGAGVSGGLSKGAPPNLEKLTALGLPRLATAAEVAAAMGIAVPELRFLAYARKVSQKTHYVRFTIPKKTGGARLISAPMPRLKRAQRWILDAVLAKVALEGPAHGFVVDRSIVTNARPHLGSQVVVNLDLRDFFPSLGFRRVKGMFEGLGYGEEVSTIFALLTTEPEIDEVELDGQTYFVATTARKLPQGSPASPAITNVVCRRLDKRLAGMARALGFTYTRYADDLTFSSKDRAADVGKLLRRVRWIVKQEGFAEHEKKTRVLRRGRCQEVTGVVVNDKPSVPREALKRFRALLFQL

SEQ ID NO: 6240 - protein, 519 aa, unidentified
  source 1..519: note = Kofleriaceae bacterium; note = Related to JAESTW010000014.1
MSKQPTTRKALYERIAKSSLDEVILEEMIRLGFWPSSSDAPSDPAEEIRRRGHLQRRLNEIRTEQLGLQNEAKLKEEARKKRMSDARERRLQNRERRLRERSERRAQWHQKKQEEIGYLGDGFSAGLGKRECDDKRLQAQGIPVLGDAMSLSNAMGISLGQLRFLAFSRKTSRYSHYQRFSIPKKDGGVRMISAPMPRLKAAQTWILETILNPLPMHDAAHGFRPGRSIVSNATPHIGADVVVNLDLENFFPSVGYRRVKGLFGHFGYSEEVATILALLSTEPELTQIKLDGDTYYVAKGERFLPQGAPSSPAITNLLCRRLDRRLEGICNKLDFRYTRYADDLSFSARGEPAKLVGKLLSQVEWLVAEEGFKIHPDKTRVFRRGRRQEVTGLVVNDGLSVPRAVLRRFRTLLFQIEKDGTDGKRWGASDDVLASAMGFANFVAMVQPEKGASLQTQVRKLLKTYGKAKAPRAQSAESKGTESKGAESKGTGRGPTPTSDETDKKTEDLAPKKKWWKLF

SEQ ID NO: 6241 - protein, 525 aa, unidentified
  source 1..525: note = Related to NZ_JAHXBG010000009.1; note = Cystobacter gracilis
MAQQPPRNRQELYERIQSISKEEFVLEDMVRLGFWPARSGVPGDPRDEVHRKAELEKQIRALTSEQARLGNLEKLKKELRKKRLAESKARQKETKERRERERVARAEAWKARKAREILFLGRGVSGGLNHRTPEAPKLERQGLPRLETPEALAQALGLSVGQLRALCYARTVSTKTNYVRFALPKKTGGLRLISAPLPRLKAAQHWVLKNLLEKVPMHEAAHGFRPGRSIVSNARPHVGAAVVVNLDLKDFFPTVVYPRVKGFFVKLGYSEATATALSLLCTEPDMEEVELDGQRYFVAQGGRRLPQGAPTSPALTNLLCRRLDRRLKGAAGKLGFTYTRYADDLTFSVPRGGTGDVGKMLRLARFVIRHEGFFPHPEKTRVLRRGGQQEVTGVVVNDKPGVDRETLRRFRALLHQLEKSGPEGKKWNGSTDVIASVVGFANYVAMVDPTKGKAFQDKARALERKYGRKTVLPPRPKAPAAAQPGTATVAPTPPSSGTAAPGGPPKPEEPQEPNEPPKKKWWKLF

SEQ ID NO: 6242 - protein, 520 aa, unidentified
  source 1..520: note = Myxococcaceae bacterium; note = Related to JAFGNZ010000091.1
MAQQPPRNRQELYDRIRETSKEEVIFEEMVRLGFWPARSGVPGDPADELHRKADLRAQLRALTTEQSRLGNLERLKKELRKKRLAESRRKQQETKERRERERVARAEAWKARKAKELLFLGRGVSGGLSHRTPDVAKLERQGLPKLETPEVLAQALGMTVGQLRGLCFARTVSTRTNYVRFALRKKTGGLRIISAPLPRLKAAQHWVLENLLEKLPMHEAAHGFRPGRSIVTNALPHVGAAAVVNLDLKDFFPTVVYPRVKGFFVKLGYSEATATALALLCTEPDLEEVELDGQRYYVAQGGRRLPQGAPTSPALTNLLCQRLDRRLKGVGRKLGFTYTRYADDLTFSLPPGGPGDVGKLLRLVRFVIQKEGFVPHPEKTRVLRRGRQQEVTGIVVNDKPGVDRETLRRFRALLHQLEKSGPEGRTWNGSTDVIASAVGFANYVMMVDPTKGRVFLEQARALEKKYGRKAVVPPRRKAAPPAQAGTAAAPPSGARLGEEPKSGEPASPGAPAKKKWWKLF

SEQ ID NO: 6243 - protein, 533 aa, unidentified
  source 1..533: note = Related to CP011509.1; note = Archangium gephyra
MSSQPPRNRQELYDRIRAGSKDEVVLEEMVRLGFWPARSGLPGDPADVVHRRNELQGEIRALTSEQSRLGNLEAMKRELRKRRLEESRRKQQETKERRERERLARAAAWKERKGKELLFLGRGVSGGLSERTPDEAKLTRLGLPVLATPEVLAQTLGLSVGKLRALCFTRTASTTSNYVRFQLPKKTGGTRLISAPLPRLKAAQTWVLENILEKVPVHDAAHGFRAGRSIVTNARPHVGAGVVVNLDLKDFFPSVLYPRVKGVFVKLGYSEATATVLALLCTEPDVEEVELDGQRFFVAQGGRRLPQGAPTSPALTNILCRRLDRRLAGAARKLGFVYTRYADDLTFSAHGPGPHDAGELLRFVRWLVGEEDFTPHPEKTRVLRRGRQQEVTGVVVNDKPGVDRETLKRFRALLHQLEKSGPEGKRWGNSGDVIASAVGYANYVAMVDPVKGKALQQKARALEARYGRRPSPPPRAKAAKGAAQAGSSAPVSSAAPPAQAPETPAAAPAAPAATPDSGQKPAEPPKKKWWKLF

SEQ ID NO: 6244 - protein, 515 aa, unidentified
  source 1..515: note = Related to NZ_JADWYI010000001.1; note = Archangium sp.
MSSQPPRTRQELYDRIRATSREEVILEDMVRLGFWPARTEQPGDPAEVIHRRNDLMGQLRALTTEQHRLGNLEAMKRELRKRRLVESKRKQQETRERRERERVAKAAAWRERKGKELLFLGRGVSGGLSARETDEARLTRLGLPVLTSPEALAEALGLRVGQLRALCFTRTASTTHHYVRFLLPKKTGGTRLISAPLPRLKAAQAWVLTQVLEKVPVHEAAHGFRPGRSIVTNARPHVGAAVVVNLDLKDFFPSVGYRRVKFAFMHLGYSEATATVLALLCTEPDVDEVELDGRRYYVSQGTRRLPQGAPSSPAITNLLCRRLDARLTGTARALGFVYTRYADDLTFSATGPGHHDPGTLLRRVRWLVKQEDFTPHPDKTRVLRRGRQQEVTGVVVNDKPGVDRQTLKRFRALLHQLDKTGPEGKRWGAGADVLSSAVGYAHFVAMVDPLKGRALELKARELERRYGRRPPPAPPTPPPAATAAPAPEPTPPPAPPTEPTPASPEAPKKKWWKLF

SEQ ID NO: 6245 - protein, 542 aa, unidentified
  source 1..542: note = Myxococcales bacterium; note = Related to JADIZX010000005.1
MDRRQQLYDRIRSTSKDEVVLEEMIRLGFWPARGTLPSDPGDEIRDLAEAQRELAALRTEQSRLHNLEALKKELFKRRLAESKARQAETKARRERERVARAEAWKNEKTRAIVFLGRGVSGGLADTTCDEARLQKQGLPVLRTAEDLARAAGVTVPELRFLAYARTTTAARVSHYRRFQIPKKTGGVRIISAPMRRLKALQRWLLDAVLARVEVHDAAHGFRAERSIVTNAGPHVGARVVVNLDLKDFFPTVTLPRIRGVFRSLGYGEHLATIFALLASEPDTVRVALDGAEYDVAQGPRRLPQGAPTSPAITNVLCRRLDRRLFHAAKKLGFAYSRYADDLTFSSTSKEENAGQLLKQVRFIVAAEGFVPHPDKTRVLRKGRQQEVTGVVVNDKLGVDRVTLRRFRALLHALDKDGANGKRWGSSPDVFASACGFASYVAMVDPVKGRALLARAREIAARHGWKGPPRGPDRSGGPSGPGGAPKPPAPATPSERAPAPVAGLPGEPLAAPPTPEPPAPEPPAPASPPTPETPAKKKWWKLF

SEQ ID NO: 6246 - protein, 528 aa, unidentified
  source 1..528: note = Related to JADJQX010000001.1; note = Myxococcales bacterium
MAQDKRQALYDRIRATSRDEVVLEEMIRLGFWPARGEVPHDPADEIRARTEMQRELSALRTEQSRLGNLEALKKELYKRRLAASKAKQAETRARRERERLARAEGWKIRKAGDIVFLGREVSGGLSDTTCDEAKLTKQGLPVLRTAVDVARAAGVGVPELRFLSYARTTSRISHYRRFAIPKKAGGVRVISAPMPRLKRLQRWLLDSVLSHVEVHDAAHGFREGRSIVSNAKAHVGARVVVNMDLSDFFPGVLFPRVKGMFRALGYGDFVASVLALVATEPDMQKVVLDGRTFHVAEGPRRLPQGAPTSPAVTNVLCRRLDRRLFLAARKLGFVYTRYADDLTFSAHDDASAGRTGQLLAQARFIVEEEGFTPHPKKTRVLRRGRRQEVTGIVVNDGLGVEREKLRKFRALLHSIRATGIEGKTWGDSPDVLASARGFASYVAMVSPEKGRALLGQVAELEARYGAARPPRASKEGMHAKAAPTSAGHATPVATSEAPRPENVPPEAPKPEAPKPEAEAPKKKWWKLF

SEQ ID NO: 6247 - protein, 468 aa, unidentified
  source 1..468: note = Related to JAIOQA010000029.1; note = Deltaproteobacteria bacterium
MSDRRQALYDRIRASSKDEVILEEMIRFGFWPAAGLPGDPAEEVRRQGELQQRLTALRAERDKLANVNELRREARKQRLRASKDKRRETKARRLRERAARAAAWRARQALELTFLGAEVSGGMQDTTCDRARLAAQGLPAFATAAEVAQAMGITVGELRFLAFARRASRISHYRRFTMPKKSGGVRAISAPMPRLKRAQHWLLAQILAKVPTHDAAHGFCAGRSIVTNARPHVGAAVVVNLDLQDFFPTVELPRVKGLFRALGYGEQVATAFALLATEPVTEAVELDGQVWHVAASAAARRLPQGSPASPAITNLLCRRLDRRLRGAATALGFTYTRYADDLTFSATAPAAVERAGKLLTQVRWLVGQEGFVVHPDKTRVLRRGRRQEVTGLVVNERLGVPRDQLRRFRALLHHLDRRGLEGARWGASGDVLTSAAGFASYVAMIDPVRGAPLVAEVARLAARLAPAR

SEQ ID NO: 6248 - protein, 548 aa, unidentified
  source 1..548: note = Related to JAGPCY010000008.1; note = Kofleriaceae bacterium
MPDKRQELYERIRASSKDEVILEEMIRLGFWPAQGHLPDDPADEIRQRAALEQQLAALRTEQARLHNIEALKKALRKQRLEASKAKQRETKERRERERVARAAAWREHNQRAIGYLGRGVSGGLNQTAADRAALTRHGAPVLETAAELAAAMGLTIPQLRFLAFARATSTVNHYQRFAIPKKTGGLRRISAPMPRLKAAQRWILDHVLAGVALHDAAHGFRPARSIVTNAAPHVGRDVVVNLDLKDFFPTLTYPRIRGVFRGLGYGPAVATILALLTSEPDIDTVELDGQTFHVASGERKLPQGAPTSPMITNIVCRRFDARLAGAARKLGFTYTRYADDLTFSGPRTADAGALLSAVRMIATAEGFAEHPDKTRVLRRGRQQEVTGVVVNQRLAVDRATLRRFRALLFQIDKDGPAGKTWNDAPDLFAAIIGYAHFVHMVDATKGAALVAQAKALAARHGWRPARRPPPKTRGGSGGGGGGPGGSGPGGSGSRPGEAERTATSTGPTPSTEPAQPAQPGPPDAPSPPDAPSPDAPPPAKKKKWWQIF

SEQ ID NO: 6249 - protein, 514 aa, unidentified
  source 1..514: note = Related to NZ_NETK01000001.1; note = Nannocystis exedens
MAGQPTSREALYERIRSTSKEEVILEEMIRLGFWPAQGTVPHDPAEEIRRRGELERQLAELREKSRKLYNEKVLIAEQRKARLAESRRKQKETKARRERERQERAQKWAARKAGEILHLGEDVSGGMSHKTSDPELLKGEGLPVLASAEELAKAMGLEVNALRFLAYNRKVSRVSHYHRFLLPKKTGGFRLISAPMPRLKRAQTWALEHIFAKLRVDSAAHGFVAGRSIVSNAKPHVGADVVVNFDLKDFFPTVTFPRVKGAIRRLGYSESLATALALVCTEPDLEEVALDGVTWFVARGPRHLPQGSPCSPAITNLLCRRLDRRLGGLAQALGFVYTRYADDLTFSGRGEAAESKRVGKLLRGVADIVAHEGFVVHPEKTRVMRRGRRQEVTGIVVNDRPSVPRDELRKFRATLFQIEKDGPAGKRWGNGGDVLAAVHGYACFVAMVDPARGQPLLARARALLAKHGGPSKSPGGSVPRVPSPNPQSVNAPEAPKPAAPASPAAPAKKGWKLF

SEQ ID NO: 6250 - protein, 520 aa, unidentified
  source 1..520: note = Myxococcales bacterium; note = Related to JAEUJW010000075.1
MASQPSTREALYQRIRESSKDEVILEEMIRLGFWPAAGDVPNDPADEIRRRGELQRQLDELREKGRRLYNEKALINEARKARMAESRRKQAETKARRERERGEKASAWAKRKSGEILYLGEGESGGLSQKTSDPSKLAHFGLPKLDTAEQLAAAMGIEIKALRFLAYNRRTSKVSHYRRFFIPKKTGGQRLISAPMRRLKTAQTWVLTNILDKVTLHEAAHGFRQGRSIVTNARPHVGSAVVLNLDLKDFFPTVTVRRIKGVFRALGYSEAVATALALVCSEPEVDEVALDGETYYVARGPRHLPQGSPASPGITNLLCRRLDRRIEGLAQSLGFVYTRYADDLTFSARADRAGSVNVGKLLRAVKDIVEHEGFNVHPDKTRVMRRGRRQEVTGVVVNDRMGAPRAMLRKFRATLYQIEKDGPMGKKWGNGGDLLAAIHGYACFVAQVDADKGKALMAQVDRIFNKYGKPRRPGGGGGKGPGGGGGKTPDAARPATGATTQKPAEPAPEAPKKKPAWKLF

SEQ ID NO: 6251 - protein, 528 aa, unidentified
  source 1..528: note = Related to JADKFZ010000012.1; note = Nannocystis sp.
MAAGQPSTREALYERIRASSKDEYILEEMIRLGFWPASGAAPNDPADEIRRRGELQRQLDELREKGRRLYNEKALIAEARKLRMAESKRKQKETKERREGQRIARAQLWAQRKAKELLYLGEGVSGGLSDRVSDAGKLKTHGQPHIDSVEQLAQAMGVELKALRFLAYSRRTSRVNHYRRFLLPKKTGGHRLISAPMPRLKKAQRWVLERVLDKVALHDAAHGFRTGRSIVSNARPHVGADVLVNLDLKDFFPTVSLPRVKGVFKSLGYSEAVATALALVCTEPEIDEVVLDGITYFVARGQRHLPQGSPASPGITNLLCRRLDRRLAGLAASLGFVYTRYADDLSFSARRPAVGSIKVGKLLRAVADIIRHEGFTVHPDKTRVMRKGSKQEVTGVVVNDRLSVDRATIRKFRATLYQVEKDGPAGKRWGAPGGDLLASLHGYACFVAQVDPQRAAPLLAQVRRIFEKHGRPLRGGPGPGKPPGGGGGKPPEAQVAGKPGPQAEAPRTESKPEAESTAPKKKPFWKLF

SEQ ID NO: 6252 - protein, 519 aa, unidentified
  source 1..519: note = Myxococcales bacterium; note = Related to JAGQIT010000589.1
MSAKPNRRQELYDRIRNSSKDEVILEEMIRLGFWPRAGEIPADPGDEIRRRGELQRQLDELRRKASRLYNEASLIREARKQRLADARRKKQETRERRERERQERAAAWAARKQHEVVYLGEGVSSGLAEHTSDVGRLQAAGLPLFADPGALAQAMGVPLGELRFLAFHRRVATLTHYRRFQIAKKSGGTRLISAPMPRLKRAQAWVLRNVLDKVALHEAAHGFRGGRSIVSNAAPHVGADVVINLDVENFFPTITLPRVKGVFRALGYSEAIATILALLCTEPETTEVELDGRTYYVGLGDRVLPQGSPASPAVTNALCRRLDRRLDGLAEQLGFEYTRYADDLTFSRRGDIRSTEVGELLGKAADIVRHEGFRVHPDKTRVMRRGRQMEVTGVVVNDKLSVDRKTLRRFRAALFQVEKDGPAGKRWGDGPRLLASMHGYASFVTMVDRARGEPLLRRVQALIERYGVGASNASAAPGEGKAAAPTATGEAPSAAQTDAPEPEPTPPAPQPKKKKWRLW

SEQ ID NO: 6253 - protein, 508 aa, unidentified
  source 1..508: note = Related to JACKDU010000005.1; note = Myxococcales bacterium
MSQRPTTRQELYERIRASSKDEVILEEMIRLGFWPAQGEMPTDPAEDIRRRGEIERQLEELRRKASRLYNEKSLIQDARKRRMAESKRKKEETRLRREQARRERAAAWRERKQNELVYLGEGVSGGLGQHEGHPERLAAAGLPAIADARELARLMGVSVGDLRFLAFHRAVATITHYRRFQIPKKSGGTRLISAPMPRLKAAQGWVLRSILDRVDLHAAAHGFRPGRSIVSNAQPHVGAAVVVNLDLQGFFPTITLPRVKGVFAALGYSESVATILALLCTEPETFEVELDGRTYHVGLGPRVLPQGSPASPAITNVLCRRLDRRLQGLADQLGFTYTRYADDLTFSRKKGASSAEVGEMIRKAVDIVGHEGFTVHPDKTRVMRRGNHQEVTGVVVNDKASVDRRTLRRFRATLFQVEKDGLAGKRWGAGGDLLASMHGYASFVAMVDRERGAPLLARVKRLMALHGRGPSGGGGGGGSAGPRPAATTPEPAQAPAPAPEKKKRWKLW

SEQ ID NO: 6254 - protein, 523 aa, unidentified
  source 1..523: note = Related to JACKDW010000029.1; note = Myxococcales bacterium
MSRQPSTREELYERIRNSSKDEVILEEMVRLGFWPAASGQPGDPGDEIRRRGELQRKLNDLRTKVSRLYNEQQLISDQRKQRLAESRRKRQETKERRERERQQKAELWRQRKEREVLYLGDGVSGGLLERKTDQARLVGGGLPVLAGPEAVAASMGITVGALRFLAYSRRVSRISHYRRFSIPKKTGGRRLISAPMPRLKAAQRWILENILERVPVHEAAHGFLERRSIVTNAVPHVGADVVINLDLKDFFPTVTYERVKGLFVSLGYSESVATVLALLSTEPEVAELELDGNSYYAAQGPRHLPQGSPASPAITNLLCRRLDRRLQGLARKHGYQYTRYADDLTFSARGMVSTRSSEVGRLLRGVADIVTHEGFEVHPEKTRVMRRGRRLEVTGIVINDKLSVDRKTLRRFRATLFQVERDGPEGKRWGESKDLMAALLGYASFVAMVDPQRGRPLISRVRAVHRAHGYQPAAPKRRAAPPTAASTAPSSPARDTTASVPTPDRDPDPTPPPGKKKKKWKLW

SEQ ID NO: 6255 - protein, 326 aa, unidentified
  source 1..326: note = Related to JAGQQJ010001302.1; note = Planctomycetaceae bacterium
KKTGGIRKISAPMPRLKRLQEWILSNILEKVPLQDAAHGFRRGRSIVTNAAPHVGQDVVLNMDLENFFPTIDFPRIRGVFRKLGYSGQISTVFALICSEPEIEEVQLDGQAYFVATTDRRLPQGAPTSPAITNIICRGLDARLTGVAQRFGFTYTRYADDITFSGSGGALQQIGKILRQCKYIIEQEDFKVHPQKSRVFRKSSRQEVTGLSVNERLGINRQLLRRFRALLFQIDRDGPSGKHWGHSTDVMTSIEGFANFIAMVNPDQGQIFQQRVRQLHEKHGRGQRMYNQRNRWNDQEVVTHLPDSSEKPELPAEMKKKPWWKFW

SEQ ID NO: 6256 - protein, 518 aa, unidentified
  source 1..518: note = Related to JAGQQQ010000127.1; note = Planctomycetaceae bacterium
MPTRQELYDRIRESSRQEVILEEMIQLGFWPSGSQVPYDPKEDLRRERELQQELQQLATKDRNLQNIDYVRAQARKQRLAESRQKQKETKERRLREKQERASAWQARKVSEILYLGEGVSNSLNQRESNHEKLSSAGLPRFDGVEDLAQLMGVTVGELRFLAYDRAASQVTHYRRFGLKKKTGGIREISAPMPRLKRAQEWILKQILEKVEVHDSAHGFRPGRSILTNARPHVGQDVVINLDLENFFPTVTFPRIRGVFRSLGYSGQLATLLALICSEPEKSEVILDGQHYHVARSERRLPQGAPSSPALTNIICRGLDARLAALASRLEMTYTRYADDITFSGSGEATQTIGKVLRQARYIIASEDFRIHPSKTRILRKGSRQEVTGLIVNEQLGVNRELLRRFRALLYQIEVSGPAGKHWGGKHDVMTSITGFANFVQMVDPDKGRPLQEKVASLQKKHGIGQRRYASRTPWNPSTVAPDQPSKPGGEEVAYPDSGPRDRFRNGTPEPKKPWWKFW

SEQ ID NO: 6257 - protein, 524 aa, unidentified
  source 1..524: note = Related to DLZC01000224.1; note = Planctomycetaceae bacterium
MTTRQEIYDRIRESSRDEVILEEMIRLGFWSRDTDKPEDPAEDIRRQGELEREQRRLTQEAARLRNIEALHEEARRKRMEEFRRRRQETKERREQERVQRAAAWQESKQKEIVYLGDSVSTTLNQQTTDEDRLRSNALPNLQSIVEVAEAMEISVGELRWLAFHRRTAEITHYRKFAVPKKTGGVREISAPKPRLKRIQHWILHHILDQVEVHDAAHGFRRDRSIVTNAQQHTSSGVVVNVDIQDFFPTVTFRRIRGVFKSLGYSGQISTVFALLCSEPERREVALDGRTFHVARTERRLPQGAPTSPALTNVICRGLDARLHTLSQKNGFTYTRYADDMTFSASGEATQNVGRVLRQVKHAVSQESFQLHPDKTRIQRASRRQEVTGLTVNSGVSVPRETLRRFRAVLFQIDRDGPGGKRWGASQNVMVSIEGFANFVAMVDPERGAKLQQTVAELQDRHGRGRGTVTVRQRWTFQRPEPVSSPPGPSETAVSNPLQAAASPPGADQSAPKPRKPWWMWWKFW

SEQ ID NO: 6258 - protein, 532 aa, unidentified
  source 1..532: note = Related to NZ_CP036281.1; note = Polystyrenella longa
MRSRQEILDQIRETSRDEFILDEMIRRGFWPKEGELPEDPADEIRQREELRRKLHSLTTEDRKLSDVEKLKREARRQRLAESRLKRQETKERRLRERAEKAEAWREQYTRDIVYLGSDVSGGLNQQKIEIEELQKRGLPELHSVEELAEAMETTVAELRFLAFDRRTSTTTHYQRFAIPKKTGGIRNISAPMPRLKRAQEWILWNILDKIELHPAAHGFRTGRSIVTNAEPHVKAEVVINVDLENFFPTVTWRRVRGLFRKFGYSEQLATVLALICSEPEVTEVQLDQKTYYVQQSERRLPQGAPSSPAITNILCRGLDARLTGLAEKLGFTYTRYADDLTFSHAGQGSAAVGRMLRQVSYVVEQEGFQLHPEKTRIFRKGSRQEVTGLVVNERVNIPRKKLRQFRATLYQIEKDGPEGKHWGNSPNVLEAIEGYANFVAMVDPEKGREFQLQVRTIIEKEGRTQRNDVQRDRWNPNLASEEISEIPATGAVPPSVSSLLTTQEIEPVAPAAGEVFESKSKPWWMFWARWFN

SEQ ID NO: 6259 - protein, 521 aa, unidentified
  source 1..521: note = Candidatus Nealsonbacteria bacterium; note = Related to JABMRB010000852.1
MDSQPTSRQELYDRIRESSKDEVILEEMIRLGFWRDAEAVEGDPADEIRRKGELERQLKALSTERARLQNVEALKRALRKQRLEDSRSNRKETKERRLRERQERARAWQQRKTREIVYLGDGVSAGLAEHELQREKLQAAGLPVVATPDELAHAMGVSLGELRFLAFSRRTSTTTHYKRFFVPKKTGGQRLISAPMPRLKRSQEWILQNILEKVPLHDAAHGFRRGRSIVSNARPHVESDVVVNLDLKDFFPTVTYRRIKGMFRNLGYSEAIAVVLALICSEPDVDEVELDGRTYYVARQQRLLPQGAPTSPAITNIICRGLDGRLARTAEMLGFCYTRYADDITFSGSGDAAANVGRALRRIGYAVEKEGFEVHPDKTRVLRRGRRQEVTGLVVNDRLNVSRKLLRRFRATLFQIHRDGPAGKRWGNSNDVIASIEGFANFVAMVDPEKGAGFQRKVREIIKSHGRGGGRAYPQRSRWVPKTPPAEGLAMEEEPLTAETVQGRVSRVQKPREKKPWWKFW

SEQ ID NO: 6260 - protein, 509 aa, unidentified
  source 1..509: note = Related to JABMRP010000303.1; note = Planctomycetes bacterium
MASQPTTRQELYDRIRESSKNEVILEEMIRLGFWPRGDTIPEDPADEIRRRGELERQLRSLVTERARLGNVEALKKALRKQRLDQSRQKQKETKERRLRERAERAEAWKKRKAHEIGYLGEGVSAGLDNHQGDHEKLTAAGLPVFDTPEQLARAMGIGVGELRFLAFNRRTSTTSHYRRFLLPKKTGGHRKISAPMPRLKRAQEWVLATILEKVALHDAAHGFRRGRSIVTNARPHVGADVVMNLDLKDFFPTVVYRRIKGVFRNLGYSESVATVLGLLCSEPEVDEVRLDGRTYYTARSKRFLPQGAPTSPALTNIICRGFDARLSRTAADLGFAYTRYADDVTFSGPGLPAENIGRALRRIEHIAGAEGFEVHPGKTRVLRSCSRQEVTGLVVNQRVNVSRKMLRRFRATLFQIERDGPAGKHWGHTDDVIAAIEGFANFVAMVDAEKGKGFKRQVERIIQKHGRGGGRVRVQRSRWVSSPPPVAAVVDTVESPPEPEKKKPWWKFW

SEQ ID NO: 6261 - protein, 509 aa, unidentified
  source 1..509: note = Related to NZ_CP036433.1; note = Lignipirellula cremea
MTDPPRTRQELYDLIRETSREEFILEEMIRLGFWSESTAPENPANEIRRQAELQRELQSLLTENRRLVDLDKAKKALRRERMAESRRRQKETKERREAERQARAAAWQAEQERSLAYLGEGVSAGLMRYEVDDRRLARNGLAGNPLATPLALAQAMQISLGELRFLAFSRRTSQTTHYQRFQIPKKTGGLRSISAPMPRLKRAQEWILRNVLENVPMHPAAHGFRTGRSIITNAQPHVGAAIVANVDLQDFFPSVGYPRIKGLFRTLGLSEATSTVLALLCSEPEIDEVVLDGQTYYTARSERRLPQGAPTSPAITNLLCRGLDARLQSNAEKLGFVYTRYADDITFSSQNAQADVGRALRRIRHVVASEGFTVHPDKTRILRRGSRQEVTGLTVNDRLGVSRELLRRFRAVVHSVEKTGPAGKRWGESPHLMSSLAGFANFIAMVDPEKGKPWQARVAALIEQHGRGPDLRSQRKRWVSPVPAAAAAPSTETASKPSESSNRPWWKIW

SEQ ID NO: 6262 - protein, 505 aa, unidentified
  source 1..505: note = Related to nan
MSRRPSTRQELYDRIRQSSKDEVIIEEMIRYGFWPKQSNLPNDPAEELRRIGELERRISALATEASRLNNVDAMRREARKRRMAEARARREETKRRHEAQRRARAEAWAAKKREEIVYLGEGFSGGLGQREGQSLPGLPDLQGAGALARAMEIEVGQLRWLAFHRRVSATTHYVRFQIPKKTGGVRNISAPMPRLKRAQRWIKEQILDKIELHEAAHGFVPGRSIVTNASAHVGRRVVINLDLQDFFPTLSFSRIYGVFRSFGYSPEASTLLALLCTEPEVAEVELDGRTWYVHTSERRLPQGAPSSPALTNIVARRLDRRLAGLAAHLSFTYTRYADDLTFSSDAADASIHRLIRAVEGIVSGEGFVVHPGKTRVMRRASRQEVTGLVVNDRLGVPRRLVRRWRATLFQVRRDGPGGKRFGLGSDVFASLSGFAAFVHMVDEARGARMLSEVAEVAAAHGWAPPPRRSTETRATEASSEASSEAPGVPASPSAGWGGPTWEWPL

SEQ ID NO: 6263 - protein, 554 aa, unidentified
  source 1..554: note = Myxococcales bacterium; note = Related to JAHQVJ010000249.1
MSERPQDRQELYDRIRESSKDEVILEEMIRYGFWTQEGRPDDPAEEIQRKGELERTVAALATEASRLRDVDAMKRAARKQRMQEAKARRIETKERREAQRQAKAKAWAERKTRELLYLGAGVSNGLGQQAEQIQPGLPSVPSAPDLASAMGISLGELRWLAFHRKVSTTSHYARFQIPKKTGGTRLISAPMPRLKKAQHWIRAEILERVEVHEAAHGFVRGRSIVSNAAAHVGQRVVINLDLRDFFPSVHYPRVFGLFRSLGFSPETSTVLSLLCTEAEVEEVQLDGRRWFVHASERRLPQGSPCSPALTNLVCRRLDRRLTGLATQLGFTYTRYADDLTFSSTRDNAQVNRLIRAVEHIVDDESFTVHPDKTRIMRRGRRQEVTGLVVNDRLGVPRRLLKQWRATVHQIRRDGPAGKRFGLGPDVMAGLTGFAAFVNMVDAAKGQAMLQQMAELAVSRPAPPAPQPRPTPPAAAPLPPPMPVAEPAPTDEPVRLTESSAPVLRRTRTLDEPEPPLTHQETAKTLIDESRSEVPEVVRPRRRWWQFWKWFSRRG

SEQ ID NO: 6264 - protein, 546 aa, unidentified
  source 1..546: note = Myxococcota bacterium; note = Related to JAHJCH010000337.1
MTQPRTRQELYDIISQTSKAEFILEEMVRLGFWGDRPVDPGGAHKRRGEILKRLSALQSEAARTQNREAVLKAIRRERMAESRRKREENKQARIEAKRARAEAWRQRKAKEILYLGEGVSFDLSKTANNMDAWLGAEPEPEDYRERLEGLSASALPQLKSPPDLARALGISLGELRFLAFQRVVSSQSHYRQFRIAKKTGGLRTISAPMPRLKRVQRWILDEIINKIDDIGLHDAAHGFRAGRGILSNAAPHVGQAVVINMDLADFFPTITFSRTRGLFASMGYSPSVAVILALLTTEADIEAVELDGRTWYVRGGERRLPQGAPSSPGITNLICRRLDARLSGYAAQHGWTYTRYADDLTFSGEGQDLNQLLWVARRIIEDEGLRINEDKTRILRRGRRQEVTGLIVNDQLGVPRRALRRFRALLHQVRLDGPKGKRWGQGEDLFASMMGFADFVYMVDPAKGAPLRAEVRALQARYPWRAALDEAPLSLSKPSAPLIAATPEDAPTPEDAPTPPEAAQEIEEVEEASPTQEAQPDPNRPWWRLF

SEQ ID NO: 6265 - protein, 508 aa, unidentified
  source 1..508: note = Related to NZ_CP042468.1; note = Persicimonas caeni
MTRPSREELYRRIRESSKDSVILDEMLRLGFWDSEEGANDVPEELIRREAELRQELRKLTAQQRRYENRDAALKAMRKERLRESREKRAANKQRRKEERLARAMAWDETQKTHIVYLGEDVSTHLEKLDYDAEKLAKHALPDFPDHVALADALGVSMAELRFLAYHREVSTVTHYRRFQMPKKRGGFRNISAPMPRLKRAQTWILENILDHVPLRDEAHGFRPSRSIVSNARPHVGQDVVINMDVKDFFPTVTLWRVFGVFESLGYSPSVATILALLCTELPVEELELDGKTWYVATGERCLPQGGPTSPAITNILCRRMDARLAGIADKHGFVYTRYADDLTFSASGEAAEAVTKLLWHVKTVVQEEGFELHPDKQRIMRSGRRQEVTGLVVNDRLSVPRDDVRAFRALLHRVKTAGLERAHWKGESDNLLDRIHGFASFVHMVDAERYAELRAEAKEVLDAHGYAPQPVPPKPKSERQDASAEGDGAAKPKKGLWAKIKGFFAGAD

SEQ ID NO: 6266 - protein, 418 aa, unidentified
  source 1..418: note = Related to NZ_JAFREP010000009.1; note = Acanthopleuribacter pedis
MGEREKPGARQGAGTPSLEDREQECRAIEQAALAALDRDLAEKRLDEGLKREHWYEHLIAARPRRGKRRFPWKRNRKPRPVFSAEEHRVKFDCPPLPRLEDVAHLLDIPLAELQFLAFGDRRLEISHYRRFAISKKSGGQRQIAAPMPRLKRVQRMLYEQLFQQIPLHPVCMGFRPGRSIVDNARPHVGADVVVNLDLQNFFPGIPYARVRGFLRAMGYNAAVATCLARLVTEPSVSRLQWRGRSFTVETGPRRLPQGAPTSPAVANAIAYRLDCRLMGLAKAMGWRYSRYADDLSFSAVGEPAFVVGDLLARVRSIIGEEGFTVHPDKTRIQRKGRRQEVTGLVVNRVVSVPRDELRRFRALLHQIERSGFEGKQWGRGGDLHAAIEGYLNYLAMVDEIRAEPYKKQWRRIKGAATD

SEQ ID NO: 6267 - protein, 392 aa, unidentified
  source 1..392: note = Myxococcales bacterium; note = Related to SECR01000885.1
MADSSYTKRQALYERIRQSSKDEVILEEMIRLGFWKEKTLPGQPTTDLERLRDLRAELSTVSQKLARTANLAALRQEVHARRLRESRERQQQNKERRERERREKTERWRERSRRELLYLGAGVSGGLGSPTGDEARLRERGLPIFTDAADMARQMGLTLGELRFLAFHRQVSTVHHYVRFALPKKAGGERMISAPRPRLKKAQHWVLTELLDRVPVHDAAHGFRAGRSIVSNAEPHLRSAVVINLDLQDFFPSIHYRRIRGLFRSLGYGEAFATVLALLCSEADVDALDLDGTTYYVARGPRRLPQGAPTSPALTNILCSRLDRRLTAVAHRSGFRYTRYADDLTFSAPSLTTNAVAAAPVVGAAVASAPAAGAAVASAPVTAAADATPDVG

SEQ ID NO: 6268 - protein, 338 aa, unidentified
  source 1..338: note = Related to JAGQVA010000789.1; note = Bacteroidetes bacterium
MASNSDQNRRENIRREIAQTSKDEFILKEMKRLGFWPNEEGKPRVEENLIKRQGELSREIADLSKKARIYQDREALLNKHRKERMHKSREKQKANKEKREAERLTKKEAWKEKQAKDIIYLGDKYSAGLKNKTNDLALLKKHQLPQIQNVLELAKCLKTNVSELRYLSYYRPVTKVSHYIRYALPKKNGGNRQISAPMPRLKTVQRAILDELLVKVPISQYANGFAPGRSIVTNASPHVNADLIVNMDLKDFFPTISYKRVWGMFKKLGFSDQNATVLALICTEPVEEKVEVDGEIYYISEGERVLPQGAPTSPAITNIICRRMDQRMAGIAKKLDFT

SEQ ID NO: 6269 - protein, 590 aa, unidentified
  source 1..590: note = Related to JAFEUL010000003.1; note = Actibacterium sp.
MRSNRRQELYDRIRESSMDEVTLQEMIRHGFWAEDDAMPSLPAEMIKRRGELRREISELAQDARLYRSQEQALRAIMKQKMREAKDRRIETKKRQIQARNDRAAAWHRKKTEGIVHLGDTVSGALQNRDSNAERLISQGLPDFPDLGDIADAMGITLGELRFLAYDRAVSKVSHYHRFQIPKKSGGTRILSAPMPRLKRAQYWLLDNIVNQIEPHDAAHGFRAGRSILTNAKPHMRQAVVVNYDLKDFFPSIGYRRVKGLFAALGYAEAQAAIFALLATEADRTEVVLDGQTWHVAGGERVLPQGAPTSPAITNLLCRQLDRRLTGTARKLGATYTRYADDLTFSFATDDTTALRSLDWAVGEIVLDEGFNLNDAKTRTMRRHTRQEVTGITVNDGLTISRKERRRFRAYLHNVEQGRDMGSFGSGHPKNSALGYAQFLTMVHGDGVSDLVAHARTLFGDQTSVPPEDPNHFRQMSARGEAPKADWWQPAEPAQPVPEALPQPPGTAEGRSTNIPTVGKRRARDWGAARAQPSQSGPARPRQGKKGLVGWSGFQKTAITVLALIALIPFPFSPVLMGATIYFIWFHRYRK

SEQ ID NO: 6270 - protein, 642 aa, unidentified
  source 1..642: note = Related to JAKRGB010000012.1; note = Ruegeria sp.
MSSVSNLRSRISDSSLDQVVLEEMIRHGFWGRDAEVGEMPAEFFERRAALQAEIADILARDRRLSDPDKALQAVMKERMRRARLKRVETKRKAIEARNARAAAFDARKRAEVISLGDVSSAPLQSREANNDRLTAQGLPVIEGAIALSEAMGIGLPELKFLAHDRKVARVTHYQSFEIPKKTGGVRVISAPKPRMKRAQYWVLDNILACIEPHDAAHGFRTGRSILTNAAPHVGQELVINMDLQDFFPTITYGRVKGLFAAMGYAEADAAVLALIATEAPRDTINVDGTVWHVATGPRATPQGAPTSPAIANLVARKLDRRLLGLARRFGFSYTRYADDMTFSGPFPGDQGLKIFHAAVRAITTEEGFTLHRDKTRFMRRGGRQEVTGLTVNDKVSVPRAERRKFRAWLHQAEQSGTPQRPFRTGNPVTTGQGYASFLYMVGGTEGLALAERAWLLLGRQTGASSENIEQAQAFRTASAEGRLPTPDWWQPAEPPPFEPIPLPAYDRKDQETRDVQTSIPKAGERQLRRAQIERPGADARSRAALSRSNRAWGGQASGTSPSGQSSWAKWIMSFFAFFLQVLPYIGVPLAVFAFYHIWKPQAGYLGATTVWHKLLVAAKFLFVLLGIDFALVMILAVFSGIG

SEQ ID NO: 6271 - protein, 503 aa, unidentified
  source 1..503: note = Proteobacteria bacterium; note = Related to PBMT01000060.1
MSAKKWTSIPDDFDIVRASREEVRKLRWSPVWQDFLLREVVRMGFYEPEDDTEQSYYINRSKELRAELQKLNIEIEELKEEESSLVDQRKAIAKATQRQKEAHRVRLDESRAQRQVRKQQRIEQRKAKKELWSIRKQQELLYIGAGVSRILKERNSDTAKLKSLGCPVVLTDLELLSLLQQPASEDDSIELSMAHLRRFAFRRRISQHTNYTQFTIPKKTGGERLITAPTMALKTVQRRIVKHILSTIPTHSAAHGFVEGRSIRSNAEPHTQSAIVVNMDLKDFFPTITGHRVRGLFQSFGYSPAISAILAFICTRPDVSVFELDGQNWYFYEGKDVLPQGSPASPMISNLICRKLDRRLEGLAQSTGFTYTRYADDLTFSSSDPDASVGALLHATRAIVADEQFEVHPSKTRIMRNGSCKEVTGVVVNEYPNISRARLRRFRALLHQLKTKGLENAHWEETTGPALLNKALGFAAHIKSVSQPKGAEIFEETLEIINDLKGQ

SEQ ID NO: 6272 - protein, 462 aa, unidentified
  source 1..462: note = Related to MLAY01000020.1; note = marine bacterium AO1-C
MADTNQTTNWRQELKQVGKQYFEIQEMIRMGFLKMPPEELELLKQKYTELNKVNAQLRKLSKELEGFQDITPLIKEIRKNRIERVRAARAIKKAEKAQKEKARKAEIAQRKKDTPYYLGEGVSAGLKFEGTEEAKLQEAGLPIVHNVKDLAEQMNMPQSDILWLSYHRKAASIDHYSRFQIPKRKGGFRTIASPKPKMRVAQQWILDNVLSKVPTHEAAMAFQAGKSIADNANLHLNAEILIRIDLKDFFPSIKFGRVKGLFKSFGYNEGIATVLGLICTDALRLSAKLENKQYFVALGDRYLPQGACTSPTITNLICRKMDNRLSKLSDTLSWKYTRYADDMVFSTPQKEAELKHVLGLSKKIIGEENFEIHPDKTMVMRGHQRQTVTGVVVNNDEIRISRRDIRNFRAFLHQYEQNGAEAMTKKLGKDATAYGRGYLAFVHMINPGQAAKFVEKYGWLKK

SEQ ID NO: 6273 - protein, 462 aa, unidentified
  source 1..462: note = Related to NZ_AAWS01000028.1; note = Microscilla marina
MANQTTTNWRAELRSVGKQYFEIQEMIRMGFLKLDPAELDMLKQRYTELNKVNKELNKLSKELEGLEDITPLIKEIRKNRIERVKAARAIRKVEKAQKEKERKAEIAQRKKDTPYYLGDGVSAGLKFEGGNEAQLKEAGLPVVNNVRDLSELMAMPQSDILWLSYHRKAASMDHYSRFQIPKRKGGFRSIASPKPKTRKAQQWILENILSKIDCHEAAMAFRPGKSIADNAHFHLQAEVLIRIDLKDFFPSLKFGRVKGLFKSFGYNEGVASVLALMCTDALRLSAKLEGKQYFVALGERYLPQGACTSPAITNLICRKLDNRLSKLGDKLDWKYTRYADDMVFSSSNKETDLKHILGLSKKIIGEENFVIHPDKTMVMRGHQRQTVTGVVVNNDEIRISRRDMRNFRAFLHQYEQKGAAEMTKQLGKDATAYGKGYLAFVQMINPAQAEKFKAKHGWLSQA

SEQ ID NO: 6274 - protein, 461 aa, unidentified
  source 1..461: note = Cytophagales bacterium; note = Related to REBB01000084.1
MANYDKIQELRQEIQTLGKEYYIMQEMLRTGFLKMSEVDLVRMKANLNELSKINQELSVLSKELKDIPDITPIIAEIRKNRIEKVKSERLIRRIEKEKLIIQRKEKLKEKKKNTPHYLGEIARGLEFKASDEEKLKQKNIPSLPDLQALADLSGLTREQLLWLSYHRKTAKIDHYTRFQIPKRSGGMRTIASPKSKLRVIQHWILENILQKLSIHEAAKAFAQGASVVKNAVPHLNAYVVIKVDVKDFFPSIKFNRVVGFFKSLGYSRGMSSVLGLLCTDAMRLNAEFEGEKFFVAIGERYLPQGASTSPMLTNLICKKLDARLSKLAEKYGFQYTRYADDMTFSHPEKEANVKAILGWTKKILAEESFELKKEKTSVMKKHQRQTVTGVLVNHQETKISRTDIRKFRAFLHQYTLIGAEKMSEKLGKDATSYGKGYFSYLKMVNETQAEKFKKEYAWLAS

SEQ ID NO: 6275 - protein, 460 aa, unidentified
  source 1..460: note = Bacteroidetes bacterium; note = Related to RDXZ01000042.1
MTNYDKMQEIRQEVAMLGKEYYIMREMLRTGFLKMSEADLATMKANLGELTKINQELNELSKELKDIPDITPIIAEIRKNRIEKVKTERLIKRVEKEKLLAQRKERLAQKKKNTPQYLGDIAKGLKFQNQNEEKLKEKNLPLLKDLQDLSTLSQLTREQLQWLSYHRKTAKIDHYTRFQIPKRTGGLRTIASPKPKLRVAQQWILENILAKLSIHEAAMAFNVGASVVKNATPHLNSEVVIKIDVKDFFPSIKFNRVVGFFKSLGYSQGISSILGLLCTDSMRLNVSFEGEKFFVAIGERYLPQGACTSPMLTNLICKKLDARLSKLAEKYGFAYTRYADDMTFSHKQKDANIKAVLGWTKKILAEENFELKKEKTSVMRKYQRQTVTGVLVNHEETKISRKDIKKFRAFLHQYTLIGAEKMSEKLGKDATAYGKGYFSYLKMVNKTQAEKFKQTYSWLG

SEQ ID NO: 6276 - protein, 464 aa, unidentified
  source 1..464: note = Related to NZ_JADPIB010000005.1; note = Aureivirga marina
MSEDKNWKERIKEVGKEAFEIEDMIRLGFLQMDKETMAEILDKQKAYNKLSNRFFKINRELDSDIDITPYIKIIREKRIKESREKRALRKIEKAKKEAERKQKIAEKQEKMPSYLGDEISAGLKYEGTNEERLTSTSLPVISDLKELEVKSNITAKHWQWLAFYKKVSNIDHYNRFTIPKKNGDVRKISAPKKRLRVAQEWIQNEILSKIELHEKAYAYRKNISIVDNAKLHQNAKVVVRIDLKDFFPSIKFNRVKGLFKSFGYSEALATIFASVCTDSVMVKAQMSEKVYHVSMGNKFLPQGACTSPALTNIICKKMDKRIENFTKKNGIRYTRYADDLVFSTEDENINLKSFFSWIHRIIKEEGFQINNEKTRVMRPNQRQAVTGIIINEGGDIRISRKDIRKFRAFIHNFKLKGEEEARKQIGKNPNHYLEGYLSFIRMVNKDQFEKMKAYAESKLEMEII

SEQ ID NO: 6277 - protein, 461 aa, unidentified
  source 1..461: note = Bacteroidetes bacterium; note = Related to RDXI01000002.1
MANQNDSENWREELKRLGKEYFIIQEMLRTGFLKLTPEDIALYKTKIKELNDVNGEIYRLSHELRGIEDITPLIEEIRKNRIARVKAERIIKKAERAKTLEEHKRTISEKQKSKPNFLGEKFASKLKFEGGDAGKLQASGLPTLNDLHDLSQATGISRERLQWLCYHRQAATIDHYTRFQIPKRKGGMRSISSPKPQMRLAQSWVLDNILSKLPIHDSAVAFREGKSIVDNANFHAGNALLVRLDLKDFFPSVRFHRIKGLFTSFGYNYGIATVFALLCTDAARIGAKLNDKQYFVALGDRYLPQGACTSPMLTNLICRGLDNRLTKLCASLGWRYTRYADDLVFSHEDEQADLKKLLGLVKKIIKEETFEVNEEKTLVMRPHQRQTVTGIVINDGKLRLSRRDVRNFRAFLHQYTLKGAEAMSQRLGKDATQYAKGYLAFMRMVNPEQADKFVQEYAWLA

SEQ ID NO: 6278 - protein, 461 aa, unidentified
  source 1..461: note = Related to DMHB01000192.1; note = Microscillaceae bacterium
MAQENPDNWRDQLKALGKEYYTLQEMLRLGFLKMSEQDLAFYQAKVADLNKVSTELHSMRKSLEGVKDITPLLKEIRKNRIERVRVARSLRKIAKEQAFAEAKTNRRARQMATPTYLGKGVSKHLKFEGTQAERLALFDLPRVENMAELAEAMQLTPEKLHWLCFHREASKIDHYTRFQIPKRKGGLRSIASPKRTLRVAQQWVLENILRKIAPHSAATAFEPRASIVENAKKHLNQALFIRIDLKDFFPSLKFHRVKGLFQSLGYNAGMATVLGLLCTDSARIGAKLGEDQFFVALGDRYLPQGACTSPTLTNLICRKLDKRLAQFCAKQGWIYTRYADDLMFSHAESQTDLKPMMGLVKKIVAEEGFVINPEKTLVMRPHQRQMVTGLVVNDGELRVSKQDLKRFRAFLHQFDLDGKDKLSERLGKDAEAFGKGYWAFIRMINPTQAEKFTEKYKWLAH

SEQ ID NO: 6279 - protein, 467 aa, unidentified
  source 1..467: note = Related to NZ_CP048222.1; note = Rhodocytophaga sp.
MQLTPSTTENWRARLQRLGRDYFVIEEMIRLGFLDLSQQQYKTLQDSYTRLNEINGELQKLNIELKGTEDITPLLKEIRKNRIERVRAKRAIRKVEKARVSQAKKAEIALQKQKTPYHLGEGVSKGLRFDETDTEKLSQAGLPVLHTLEDLAQFSKLEMKQWVWLSYHRRVAGIDHYTRFQIPKKKGGLRNIASPKKTLRIAQQWILENILNKRPIHPNAMAFLPGKNIRHNAEKHTGKHTVVRVDLKDFFPSVKFPRVKGLFKSWGYSEGIATVLALVCTDATRIGASLDGKAYFVALGERFLPQGACTSPAITNILCGDTGYLDHRLTRLGEKLDWTYTRYADDLVFSTNITEDNLKSLLGLMNKIIKDEGFEINQEKTSVMRQHQRQTVTGAVVNGTEPRVSREDIRRFRAFLHQMEKNGSAAMSQKLGKDAERYAQGYWAFIHMVQPTQAEKFLNQYSWLKKK

SEQ ID NO: 6280 - protein, 467 aa, unidentified
  source 1..467: note = Related to JACVSL010000462.1; note = Cytophagales bacterium
MQLPATPTESWQSRLKHLGREYFIVEEMIRLGFLEITPEQYQLLVDGYARLNAINGELQRLGQELKGTEDITPLLKEIRKNRIERVRAKRALRRVEKARARQSRREEVIRRKRQTPFYLGEGVSAGLHFTGTDEAKLAAAGLPVLHTLDDLAQASGLEARQWIWLSYHRRVARIDHYTRFEIPKKKGGTRPIAAPKRTLRQAQQWILEHLLNGRTIHPNAMAFLPGKNIRHNAEKHTGKAVVVRVDLKDFFPSVKYPRIKGLFRHFGYNEGIATVLALVCTDALRVAARLDGQDYFVALSERFLPQGACTSPALTNILCGDVGYLDHRLTCLADKGNWQYSRYADDLVFSTTDPAADLKSLLGPVRKIVADEGFVVNPEKTRVMRPHQRQAVTGVLVNEARPRVGRQELRRFRAFLHQMGQIGVPAMSVKLGKDARRYAQGYWAFVKMVEPDQASSLLGKHPWLRAQ

SEQ ID NO: 6281 - protein, 470 aa, unidentified
  source 1..470: note = Related to JACMJS010000225.1; note = Rhizobacter sp.
METTEQNTSSSKNNAWREKLKNLGKENFIISEMTRLGFLSVAPENLQVLRDGFDRLEVIQKELAAIRKELQGTEDITPLLKEIRQNRIERVRAQRTIKKAERAEAAAAARKKFLAEKQTKPFYLGDGVSKGLKFAASDASKLSDNGLPVLHTLDDVAAASGLDASKWQWLAYHRKAATLDHYTRFQIPKKKGGLRSIASPKATLRKAQAWVLAEILSKRADASSSDASFAFQKGKSIVQNAAKHLNKAVVVRMDLKDFFPSIKFRRVKGLFNKLGYNEGLATVFALVCTDSVRIEAALDGKRYFVALGERFVPQGACTSPALTNMLARDLDMRLMRFSEKYLWTYTRYADDLTFSTDHPTPDLRQLLGVAAKIIRDEGFEINAAKTLVMRSHQRQSVTGVVVNNAEAKVSRRDAKRFRAVLHHIETEGEETVSKKLGKSATAYAKGYIAYLSMINPQQAEKFKAKHKWLA

SEQ ID NO: 6282 - protein, 337 aa, unidentified
  source 1..337: note = Related to JABHVB010000067.1; note = Rhodospirillaceae bacterium
MSDELSLNPHWRKRVQEIGRMNFSREEILRLGFFSDLDDAERQQLKTFLDEAYPRLAELRKELKKVSTTIEEADDLQSLLREVRRARIERVRRERAQRKNKKERQEVERQQAWATKKSKTPPFLGVGVSGRLQFSGEDDKRLLSQGLPVPKDAEELASLMGIKSSELLWLCYERAAASVDHYTRFEIPKQSGGKRLISSPKPKMRSAQRWILDEVLAKLSPSNAATAFRPGASIIKNAEPHLNAAILVRIDFKDFFPSITFPRIRGFFEALGYNPGVSTLLSLISTDAPRVKAVLDEKTNFVAMDERSLPQGACTSPALANLIAWKLDARIGGLCKV

SEQ ID NO: 6283 - protein, 357 aa, unidentified
  source 1..357: note = Planctomycetaceae bacterium; note = Related to DTSG01000200.1
AAWLEKKSKNPPFLGIGVSSRLRFQGGDTKILTANELPTPKDAEELALLLNISTSELFWLSYERAATSLDHYTRFEIPKRSGGKRLISSPKPKLRTAQRWIAENILDKLSPAAQATAFRSGASIIKNAEPHLNAAIVVRIDFRDFFPSITYPRVRGYFESLGFNPGVATLLALISTDAPRVKVSFDGKTQYVAMGGRSLPQGACTSPALANLITRKLDARIAGLCQASTDQWTYTRYADDLTFSTQARDANVGRLLGSVQNIVSDEGFRINREKTAVMRAPGRRIVTGLIVEDEIRLSRRDLRRLRAFLHRCDKDGLARVSEEIGKDALAVAHGRLAYVQMVMPEHAGRIRGKYSWL

SEQ ID NO: 6284 - protein, 469 aa, unidentified
  source 1..469: note = Fimbriimonadaceae bacterium; note = Related to JAIBBE010000228.1
MASQDLALNPDWKERIAQIGKQNFVREEMLRLGFVSKKLGEEERARIQGFLDQAYPRLKELRKDLAEIRSQIEGINDIESLLKEVRRERIERVKREREERKVRKAEEQERRRQALAEEMRKTPRFLGHGVSAHLSFAGGDAVNLAARGLPQPEDVEQLAELMQLDPSEVLWLSYERAATTVDHYTRFEIPKKSGGRRLISSPKPKMRVAQSWIAENVLDLLSPSRHAMAFRPGTSIVDNASPHLNAAIVVKLDLKDFFPSIGFTRVRGYFEYLGFNPGIATILALICTDAPRVKVTLDGAAKYVAMGERGLPQGACTSPALANLIATPLDSRLAGLCTALESTWTYTRYADDLTFSCLDERADVGRLLKAIERIVGDEGFRINAAKTAVMRAPGRQVVTGLLVGDQIRLSRRDLRCLRAFLHRCDKEGVEAVSRAIGKDALSVARGHLAYVTMVMPGHAADIKRRYAWL

SEQ ID NO: 6285 - protein, 567 aa, unidentified
  source 1..567: note = Related to JAGQTY010000032.1; note = Actinomycetia bacterium
MSESGLPADWRTRLERLGQRNFEIREMLRLGFLSAADPLRPGETNAALLAKIAELEQLQAELDEVDDVVASASRIETLLEEIRRERLASSALRKAERRRAREEQARQKQLAWATQRCERPPYLGAGVSTRLQYTGGDDDALASAGLPEVHTVLELADDMDTTTSEVQWLSYHRSVTTIDHYNRFTTPKRSGGTRTISSPKPRMRQAQTYIKTHILDQLSPASPATGFRTGLSIVSNAEPHVGAAVVIRMDIKDFFPTITFPRVRGYYESLGYNPGIATVLALLCTDSPRTAFRFEGDRYYAASGPRALPQGACTSPSLANLVARGLDERLIAWAAGRPESWTYTRYADDMVFSSNDANSDVASLIATVHTIVQDEGFSVNERKTAVMRAPHRQMVTGLVVNDVVRISRRQMRRLRAFLHQCEVRGLNAMTESLGTDARCAATGHLAYVNMVNHDQALKLLQRHPWIQREPLSPPGVRSRSRPGRTPSSTQSAVTPVTAGVTRLELADPPDGGKFWEVWVDGATLYRRYGPLGAPGTTSEKAFSTPEAAQSAAEQLIQNKLSGGYRPA

SEQ ID NO: 6286 - protein, 470 aa, unidentified
  source 1..470: note = Related to PBFI01000001.1; note = Gammaproteobacteria bacterium
MSKEVKKLDPNWRDRIEKVGKSTFQRQEMLRLGFWEPKDIPTDELASLQNKLNETVNLLGEKRTQLGEVNKKIKEAQDVKKLLAEIRKRRIQKSLKEREIRKAETKERKQDKTTQDRQRRKVTPPYLGEGVSGRLTFLEGEQEKLKELDLPLLNNLTDLSKLLLIDEGKIAWLAYHRVATNCDHYHRFLIPKRTGAPRLIASPKPELREAQGWVKREILSKLEPELEAKAFKKETNIKDNAQIHSGKGLVIRVDLSDFFFSITFPRVRGFFISLGYNPGISTVLALLCTESDRTKVTYKNEDWFIAQGDRRLPQGACTSPALSNLIARRLDRRIRNYLASMDEEWSYTRYADDLAISHSKSDAEVKKVLKALQKIDPDEGFSINEKKTAIMRSPHRQMITGLILNDQEPRIPRPYLKKVRAMVHQADQLYKRGAIPENLYEIKGKLSFIKMIMPQHVEKIVNKYSWLNPS

SEQ ID NO: 6287 - protein, 473 aa, unidentified
  source 1..473: note = Related to VGQQ01000059.1; note = Cyanobacteria bacterium K_DeepCast_35m_m1_288
MANTDGVLDPRWRKRIDEVGKNAFEIEEMVRLGFLDADELEKRLNANGQSFKAYQSALADLAEASAALSATSREIEALGTVEAALAAIRSRRIARVKEVREERRVRKQAERQQREEAIRRQRREVPTFLGRGVSNRLNYSGGNDDMISQLGLPRLNSFTDIASALSLEPQQLQWLVYERGDSRVDHYIRFTIPKRSGGSRLISRPRPSLQQAQQWMHDSILRRQPLHPAAMAFRPGVSIVDNARLHVGARIVVRLDLKEFFPTITFARVRGLFESFGYNPGVATVLALLCTDSPRVMVRLDERSHVVPVGERALPQGACTSPTLANLVSRSLDRRIQGYASKAGWTYSRYADDLVFSTNQETASPHSLIRGICAVITDEGFVVNGEKTRVMRAPNRQTVTGLLVNRDVGLTRRDQRRIRAFLHKCTCQGLEVVSAEIGKDAESVARGYLAYVQMISAETAQKLRSRCAWLDQI

SEQ ID NO: 6288 - protein, 472 aa, unidentified
  source 1..472: note = Related to JABMNF010000410.1
MANPDGVLDPRWRKRIKEVGKNAFEIEEMVRLGFLETDDLQKYLSSNGLSFKSYQSALAELTEATAELTATSLEIESLGTVEAALAAIRSRRIARVKEERNERRARKEAERLVREEAIRRQRREEPTFLGRGVSNRLHYNGGNDDMLNQLGLPQLHSFSDIASALCLEPQQLQWLVYERGDSHVDHYIRFTIPKRSGGSRLISRPRPSLQQAQQWVQSTILHNQPLHPAAMAFRRGVSIVDNARLHSGKKIVVRLDLKDFFPSITFARVRGLFESFGYNPGVSTVLSLLCTDSPRVLLSLDNQSHVVPVGERALPQGACTSPALANLVSRSLDRRIQGYANKAGWVYTRYADDLVLSTIQETDSPHRLIRGISAVTRDEGFVVNEEKTRVMRAPNRQTVTGLLVNHDVGLTRKDLRRVRAFLHRCSSQGLEVVSAEIGKDAESVARGHLAYVQMISAASFEKLISKHAWLQH

SEQ ID NO: 6289 - protein, 482 aa, unidentified
  source 1..482: note = Related to CP000111.1; note = Prochlorococcus marinus
MSEQDADQSNSLNNQWKKRLQEIGQGAFEFEEMLRLGFIDLDTIKRFDKEMTIEESKEVFEQLTKTSAILSEVDKEINSINRIEELLAEIRSRRIKRVKEAAKEKKIKKQEEKIKRSKEIKERKINSPTFLGRGVSNRLSFEKVKKVDFKSNKIPELNSFVDVANALEVTPSKLQWLIYERGASNIDHYLRYEIPKKSGGKRLISSPKKDMKKAQKWILENILINLDVDKAAMAFQKGLSIIDNASLHVKSKIIVRIDIKDFFPTITFPRVRGFFESLGYNPGVATVFALICTDSPKVILKQEAIDGDKNNKDYPHFIAISERSLPQGACTSPSLANLICRKIDSRLNGYSSKSGWKYSRYADDLIFSTTSEDSYPHRLIKSISSIISEEGFKVNQSKTRLMRAPNRQTVTGLVVNNEVTLSRRDLKRMRAFFHQCSSKGLDFMSEKIGKDALSVARGYISYVEMVSPTIAEKFLSTNSWIK

SEQ ID NO: 6290 - protein, 472 aa, unidentified
  source 1..472: note = Related to AE017126.1; note = Prochlorococcus marinus
MSKEERSINQNWRKRLDEIGQAAYEFEEMSRLGFLSNKKIAKMIEASGISLEEYEQAKSKLSDISNFIRATNEEIESIDSVEVALEKIRSERIKRVKQKNEDRKQKKESQRKERSKLAYEQRIKSPTFLGRDVSNRLNFTGGNTEKLELNGLPVITTFAELSSTLETTPNSLQWLTYERDSQKIDHYTRFEIPKKSGGSRLISSPKPALRNAQKWILESILNKLDIHSAATAFRPGKSILDNAKLHANSKVVLRLDLKDFFPSITFIRIRGLFESLGYNPGISTVFSLLCTDSPRIILKYHGETHFVKVGPRNLPQGACTSPALANLIAHKLDRRLQKYTEKIGWIYSRYADDLVFSSNAEEMPAYRLVKAASKIVASEGFRINKHKTNIMRHPHRQTVTGLVVNKDVRISRNDLRKFRAFLHHCETKGLEFVSKDIGKNAIAVARGYLSYINMVSPELATTLSSKHLWISK

SEQ ID NO: 6291 - protein, 475 aa, unidentified
  source 1..475: note = Related to NZ_NIGF01000009.1; note = Abditibacterium utsteinense
MSEETTEIPADWRARIKEQGKEAFQLDELRRLGFWPPSAGLQEQVARAEEEVKRLDREMAPLRAQLRKIEGDISRAADVQSALDEIRKARIGRVKAAREAKKIARAMEKIDRETLWKEKRASDPQFLGRGVSVGLQFEGGDLEKLTKNEVPQLQTTAEIALAIGIETRELTWLCYHRGASTIDHYHRFQIPKKRGGMRNVSAPKTKLRRAQRFVLEQILANLPVHEAAMAFCTGVSTLDNARKHAGKRIVARLDLKDFFPSIDFSRVKRFFQSLGYNEGCATIFALLCTEAPRAQISLDGQRRYVAIGERRLPQGACTSPALSNLLCRRLDARLSGLAGKRGFKYTRYADDLVFSSDEARPDIGALLVLSQKIVEDEKFVVNSEKTLVMKTQNRQSVTGLVVNAQSRATPRVSRDDLRRFRAFLHGFETLGREAMTEKLGQDALFYARGYLAYIAMSDPLRAGKLRVMHPFLARD

SEQ ID NO: 6292 - protein, 487 aa, unidentified
  source 1..487: note = Abditibacteriota bacterium; note = Related to AP024152.1
MANKNSTPEPEPEVAPKDWRARMRAQGKEAFQLEEMRRLGFWPPAEGVEAQIEVAEREVARIDRELAPLRVELAAVETEITRLGDVQSAIDDVRKNRIARVKRERGERRARQELEKARRIEAAKVRAKNELPFLGHRVSSGLAKTESDVQKLALLDLPLFHSALDVADAMGMSAPHLAFLTFHRGAATVDHYHRFQIPKRRGGMRNVSAPKTKLRAAQNFVLEQVLTKVPVHEAVAAFAPGTSTVQNAARHMGAQVVVRLDLKDFFPSIDFARVRNAFSSLGYSGAVSTVLSLLCTESPRVQMSLDGETRHVAIGERVLPQGACTSPALSNWICRRLDARLSGLAKRFGWTYSRYADDLIFSSSELTPDIKTLISCARSIIRDEKLVVNDEKTRIMRPNARQCVTGLVINAQDANAPRPARTDQRRFRAFLHAYETHGRDEMTQKMGRDALAHARGMISYLHMSQPGKASALIEKHPWLALESETAS

SEQ ID NO: 6293 - protein, 301 aa, unidentified
  source 1..301: note = unidentified bacterium; note = Related to SDZA01000028.1
SYHRGASFVDHYHRFQIPKKRGGLRNVSAPKTKLRRAQNWVLANILTPLPVHEAAVAFRPGISTAQNAARHAGKEVVVRLDLKDFFPSISFTRVKRLFQSFGYNEGCATVFALLCTEAPRVELALDGQKRHVAVGDRVLPQGACTSPAITNLLCRRLDARLTGVAAKEGFTYSRYADDLIFSSDTKRADVGWIFTFAQRIVTDEKFVVNAEKTMVMKPQNRQSVTGLVVNSQDGLGPRVSRDDLRKFRAFLHGYEIKGREAMTEKIGQDALHYAKGYLAYINMSDPAKAAKLRAAHSFLGS

SEQ ID NO: 6294 - protein, 509 aa, unidentified
  source 1..509: note = Related to JAFAZH010000051.1; note = Abitibacteriaceae bacterium
MAAETPPSVPENDLFPKDWRQQVKLYGGRKGFIRKELKRLGFWPPAPGSKYKHVTASEEAELEQLYNQLIELRAPLLEQLDAVDARIRDAKKQLGNIGNEAILAKKIETLIAEIRLKRIERVRQERAARKAQRAEAAAAKAQKDKAWRAATLPHLGRAVSAGLSYAGGDEDKLGAQGLPNLSSAGEVAAAMGITTAQLAWLTYHRGAAALDHYQHFTIPKKSGGRRAISSPKAKLREAQSWLLENVLEKIAVHEAAMAFRPALNIAHNAARHAGASVIVRLDLKDFFPSITFKRVKRMFQRLGFNEGVATLFALLATEAPRVQLTLDGQQHFVAVTERFLPQGACTSPAITNILCRSLDARLSGAACKLGFTYTRYADDLVFSARGDKLKGIAMRELATKIIADEKFVVNEAKTAVLRPHSRQTVTGLVVNAQSTGEGTGTPRVSRRDIRNFRAFLHQYELRGREAMTEQRGQDALSYARGYLSFVHMVSPAQAAALQQKHPWLERYTL

SEQ ID NO: 6295 - protein, 472 aa, unidentified
  source 1..472: note = Cytophagales bacterium; note = Related to JACMJB010000482.1
MNAEQRTRFKELGKSAFIREEMTRLGYWPPSSEIANQSALAESKLKPLYEELIRVRKEFDTVSAEIAVSGDIPTLLAEVRKRRIERVRAERAVKKAEREQARSEAKTADAAWRRKTLPYLGVGVSGGLAYSDGDSAKISERALPSLTTAAQVAAAIGIGENELAFLCYERAVSGVDHYARFAIPKKKGGVRVLSSPKRRLRVAQSWLLKNVLEPLPVHSAAMAFRPGKSVVDNAAPHAGQAIVVKTDLKDFFPSLGLRRIKGLFEGLGYNEGVATLFALLATETPRIAVMFDGKRRFVAVSKQRGLPQGACTSPALTNLLCRNFDARLAGAAAAFGFRYTRYADDLTFSHASDKAPVGVLLALIRKIVADENLTVNEEKTQVLRLSDRQSITGLVVNGSETPRVSREDLRRFRAILHQCERDGFEAVTARLGKDAQAYAGGYLSFVHMARPDIAGKIAAAHPWLAKWRQANI

SEQ ID NO: 6296 - protein, 451 aa, unidentified
  source 1..451: note = Related to NZ_JACHGW010000004.1; note = Armatimonas rosea
MTAAERQRLKEIGKDAFIREEMVRLGFWPPSPEIAEQSAEAERKLRPLYDELVGVRRELDGVEKAIRESGDVPALLAEIRRKRIERVRAARVVKKVEREAARVKKQEQDALWRRTALPHLGRGVSGGLTFVEGEIEKLCAAMGLTERELAWLCYQRPASKTGHYSLFTIPKKRGGKRVLASPKSKLRQAQRWILSEILANQAPHAAAMAFSPGASVVKNAEPHTGKSVVVKVDLQDFFPSLGVKRVKNYFEHLGHSEGVATVLALLCTDCPRVAVEFDGEKKFVAVGPRGVPQGALTSPALSNLLVEKLDKRLTGAAQKLGFVYTRYADDLTFSHADGSAPVGLLLTLVRQIVADEKLTVNEKKTQVLRSSDRQIITGLVVNGEQGVRLSRDDVRRFRAILHHCDTEGFDKVSERLGRSAQAYCQGYLAFIKMVRPELADKLVTAHSWLVR

SEQ ID NO: 6297 - protein, 471 aa, unidentified
  source 1..471: note = Related to NZ_BHFQ01000005.1; note = Capsulimonas corticalis
MNSEQRKQLAAIGKSAFVREEMVRLGFWPPSPEVAELAAGAEKELRVYYDEMIALRTELNGVEAKIAEAGNIPALLAEVRRKRIERVRAERIARRERRAQEKIESHAKDTEWRKRALPYLGHGVSDALVYKGGDPEKTATLGLPALTTASDVAAAIGISESDLAWLTYHRGAATIDHYSRFTIPKKRGGVRVISSPKRRLRTAQSWVLESVLSPVPVHDAAMAFRPARSVADNARRHQGQAVVIRIDLKDFFPSITLPRVRTLFRSLGYNGGVATLLALLTTEAPRVAATLDGARRFVAVGGRSLPQGACTSPAVTNLLCRKLDARLTGAAEAMGFVYTRYADDLVFSHAKPDAPVGMLLDLTRRIIADEGLTVNEEKTSVQRGQHRQTVTGLVVNGGAPRLSRENLRRFRAMLHQCERDGLPAVSERLGQNAQAYAAGYVAFIHMVDPEKARQIVAAHPWIARWKRAGGA

SEQ ID NO: 6298 - protein, 441 aa, unidentified
  source 1..441: note = Related to JACMIS010000372.1; note = Fibrella sp.
PPSPEVAAKSVEAEAILRPMYEELAILRTELTGIEKEIALIGDIPNLLAEVRRKRIERVRAARVVKKAAREKEQGERKASDIAWRRSTLPFLGHGISAGLRYAGGDPAKLTASGLPVLVTAGDLAAGIGIGTRDLAFLTYHRGVAMLDHYSRFTIPKKRGGVRVISSPKRRLRVAQQYVLEKVLALLPVHDAAAAFRPGLSIVDNAAKHAGKPVVIRIDLKDFFPSVPFPRVKRLFESFGYNPGIATLFGLLCTEAPRAAVTLDGSAKRFVAVGERCLPQGACTSPTLTNLLCRRLDARLSGLADAAGFTYTRYADDLVFSHAEAGAAVGALLRAVRQIITETGFVVNEEKTVVLRPHHRQSVTGLVTNTETPRVSRQDLRRFRAFLHQFETKGAEAVTQQIGKDALAYAGGYLSFIHMVSPEQAEKIAAKHPWLSRWKKL

SEQ ID NO: 6299 - protein, 471 aa, unidentified
  source 1..471: note = Related to VGYZ01000107.1; note = Planctomycetes bacterium
MSSISKRDLDQVDEMIARGFYTPSGDVRRALDALRENQGQIDRIEQELARLRAELADGPSLAELIKQARARRIERVREERARRRALREAEQSERRAAFAARKRRAPLFLGEGVSAGLRFDGGDAARLAERGLPALTDAAALATAIGLPVKPARGMPTFTEGADQLAWLCYHRRVVDHDHYSRFRIPKRSGGYRQLASPKPLLRKAQQWVLDHLTSRLEPHARIATAWRKGRSVVDNARPHVGKAVVIRVDIQDFFPSISWRRVRRVFMDLGYSEGVGTMLALLTTDTDRVAVRLDGELRFVARGKRGLPQGACTSPSLANFVALRLDKRVDGLCRSLGFDYTRYADDLTFSHAQPRANVAVLLQQVYAILRDEGFEPNERKTAVMRAGGRQMVTGLMVQDAIRVSRRDVRRFRAIAHQCKLHGFETISQRLEKDARSYLDGFLAWVRMANEEQAQKLEMWLESLGLPRRDM

SEQ ID NO: 6300 - protein, 526 aa, unidentified
  source 1..526: note = unidentified bacterium; note = Related to RFQH01000103.1
MHLRHVSARRHDPRALHPHRGGDHVHAVAGTRRRGTRGGTCRAGRGPGIRAMSGDITSLRARVAKVGRGQAVYEEMIRSGWWTVRPEDTQLLAEASKRVTDILVALDPLVLERQRIDEELLTLANIDVKAVLEEIRAERIAESRARRAAAKEERRRRREAAAAAHAARVRKTPLHLGHGVSSRLAFTEAPNPELDRAGLPRVCNAEELAAAIGIDAGRLQWLCYHRQVSAVDHYNRFTIPKRSGGSRPIAAPKKSLRVAQRWVFEHIVEKLVPNMAVTMAFRPGVSIVDNARLHAGRAVVMRIDIRNFFPSVTFPRVRGLFESIGYSPGVATLLGLVCTEAPRRVADLHGRRYAVATGPRGLPQGACTSPGLANFACRRLDARIRGYARKLGFRYTRYADDLVFSHEDADAPVDGMRRAVYRILRAEGFEPNEAKTCVMRRHQLQVVTGIAVNTVPRVSREAVRRFRAIAHQCRTRGVEAVTADIGRDALAYLNGYLSFVRMVNPAQADRLAALVPESGSEKGPQA

SEQ ID NO: 6301 - protein, 483 aa, unidentified
  source 1..483: note = Related to AP024152.1; note = Abditibacteriota bacterium
MSNWQDEIKRLGKREFELREMERLGFWPPATVGDVPQTFDDMRAKIAPINHELRDIAEQTRPLRLRQSEVERELAQTGDIEARLTLIRQQRIERVKIARAERKERRAREREERLATDKVRRRELLPHLGRGVSSRLHFCIPSDAEKLARFQLPVWNEPADLANSLGISREQLAWLCYHREVAPIDHYSHFSIPKRSGGTRAISAPRPYLKAAQAQILTGVLNQVEVHEAAAAFLPGRNIANNAQKHAHCAEGGPSVVLRVDLKDFFPSITFARVAGVFASLGYNAGISTLLALICTESPRIEATFDGQKSFVALGDRFVPQGAPTSPALTNLLCRRLDARLTGLAKHYNFTYTRYADDLVFSSPRSDARVISLQRGIFKILDSEQFTVNPDKVAIMRRGSRQSVTGLVVNSDLGPRLSRRDLRRFRAILHDIETDGADTVSEKMGKSALHYARGYLAFVHMVNPETATKLRLKHTWLNTNGPV

SEQ ID NO: 6302 - protein, 481 aa, unidentified
  source 1..481: note = Related to SDZD01000020.1; note = unidentified bacterium
MSNWRDEIKKLGKREFERREMERLGFWPPASSGDEAQTVEALRAKIAPLNDELREITEKTRPLRLRQTEVERELAATGDIEAQLAEIRKQRIERVKAARVERKERRAREREARLAADGERRHALLPHLGRGVSRRLHFDVASDNEKLARFQLPAWNEPADLAAFLEITREQLAWLCYHREVAPLDHYSHFSIPKRSGGTRAISAPRPYLKTAQAKILEGVLKQVEVHQAAAAFLPGLNIGDNAHKHTHTEAGGPAVVMRIDLKDFFPSINFNRVAGVFVSLGYNAGISTLLALICTESPRIEATFDGQKSFVALGERFVPQGAPTSPALTNLLCRRLDSRLSGMAKHYGFTYTRYADDLVFSSPHSDARVISLQRGVFKILEAEQFIVNPDKVAIMRRGARQSVTGLVVNNNLGPRISRRDLKRFRAILHDIETNGAESVSQKMGKSALHYARGYLAFIHMVNPETATKFRTKHTWLAASE

SEQ ID NO: 6303 - protein, 489 aa, unidentified
  source 1..489: note = Related to NZ_PZZP01000001.1; note = Desmospora activa
MAEEDIKQEAGPLTREEWIAKVRSQGRDNTIREEMIRLGFWSNDELSSEEQRQQATEDEEYQQLLKELNKLKAESAKLSNLNELLKIARKKRIEESKRKRAERKARREREQAEAAQRWQAHKQTHVIHAGRGVSGGLQSTVYDEAKLIENNLPLIRSSLELAEAMEIPVGRLKWLTYHRKTATLNHYQRFTIPKKSGGRREISAPKKSLRAAQQWVKTHILDALTVHPAARGFVSGKSTLDHAEPHLQQAAVVKMDLKDFFPTIRFRRVKGFFHYLGYSEAVSTIFALLCTEPPRKEIQFNGTRYYVAMDERQLPQGACTSPALSNLICRRLDQRLRGLAEKHGFHYTRYADDLAFSCGEDGLNEIGAIINTSRDIIRFEGFAVNEEKTRILRASNRQNITGIVVNQKPNIRRKDLRAFRALLYSVEKNGLEQENRHNHPHFWDYIKGYASYIRMVRPDLEEKLAPRLLRISQKHGLHAPDWCKQVAAK

SEQ ID NO: 6304 - protein, 488 aa, unidentified
  source 1..488: note = Related to NZ_FXTI01000004.1; note = Melghirimyces algeriensis
MAEEETRPLTREEWRKRVQSEGRMETIRKEMIRLGFWNDAQLSPEEKQQQALEDEEYERLQKELNKLKMESAKLSNLKQLLKEARKKRIEESKRKRAERKAQREKEKAEAKKRWQEYKETHVIHAGEGVSGGLQNTEYEEAKLRKNGLPVIGSALQLAEEMNIPLQRLKWLTYHRNTATLCHYHRFTIPKRSGGKREISAPKRSLRQAQEWVKHQLLDRLPIHPAACGFVPGKSTLVNARQHLGQSVVVKMDLKDFFPSITFRRVKGLFQSSFGYSESVSTLLALLCTEPPRKEVEFDGTYYYVAMGDRQLPQGACTSPTLTNILCRRLDRRLQGLASKFGFQYSRYADDLTFSCSKHDAEKLGGLINGARSIIQSEGFKTNEKKTRILRDTNRQTVTGIVVNQKPNIRRKELRRFRALLHRVEINGLNEENRDNHPNFWEYISGTAGYIRMVRPDLEARLASSLIGIGEKYNLHIPPWCKQATVADR

SEQ ID NO: 6305 - protein, 486 aa, unidentified
  source 1..486: note = Related to nan
MAEGENRPLTREEWIARVREEGREETIRSEMIRLGFWSNDSLPEEERRQQALEDEEYRRLRQKLAELQRESAKLENIDQLLKEARRKRIEESKKKRAERKERRERERAEAKKRWESYRQHHIVHAGVGVSGGLQETEWDEEKLRQHQLPLIRTAEELAEAMGITLSRLKWLTYHRQTATVCHYYRFTIPKKSGGRREISSPKKALREAQSWIKEQILDRIPPHPAACGFVPGKSTLDHARQHLRQHVVVKMDLKDFFPSITFYRVKGLFQSFGYSELISTLLALLCTEPPRKEVTFDGKVYHVAIGERQLPQGACTSPAITNLICRSLDRRLEGLAKAKGFRYSRYADDLAFSGGIDGEQQIGSLLNMARRIIRDERFEVQEEKTRVMRSSNRQKITGIVVNEKLNLRRRELRAFRALLHSVEKNGLAQENRHHHPDFWGYIKGMANYIRMVRPDWEARLAKQLVRIGKKHELPVPKWCQQAVVKG

SEQ ID NO: 6306 - protein, 487 aa, unidentified
  source 1..487: note = Related to QJKK01000010.1; note = Thermoflavimicrobium daqui
MGGEAMAEEQNHPLTREEWLERLQQEGRTEVIKKEMIRLGFWSEEPLTPEEEEQLAIENRERQQLEKELQRLKEESEKLPNIQEKINEVRKKRIEESKRKRAERKAQRELARQEAKKRWEEHQATHIVHVGEGYSAGLTSIHYDEEKLITHQLPLIRSAMELAEAMEMPLSRLKWLTYHRDTATLCHYARFTIPKKSGGVREISAPKKELRQAQAWVKEHLLDPIPVHSAAYGFVQGRSTVDNAKQHLQQAVVIKMDLKDFFPTIDFYRVRGVFQSFGYSEAISTLFGLLCTEPPRSEVEFDGRYYYVAMGKRQLPQGACTSPALTNIICRRLDQRLSRLADTHGFYYTRYADDLTFSCKEASMSRIGLLLKKIRDIVSSEGFMINEAKTRILRASRRQRVTGIVVNEKPNLSRKELKAFRALLHNVEKNGLEKENRSNHPHFWEYIKGYVNYIRMVRPDLGEKFTQQLVRIAGKYRLNLSLPVNNL

SEQ ID NO: 6307 - protein, 481 aa, unidentified
  source 1..481: note = Related to NZ_FORR01000019.1; note = Thermoflavimicrobium dichotomicum
MSEEQFQPMTREEWIERIKKEGREEVIKKEMIRLGFWKEEPVDPATAEQIAKEQEERKQLVEELNQLKKESEKLPNIKEKLKEAREKRIEESKRKRAERKAEREKERQEAKKRWEEYKATHVIHVGDSFSAGLQNFDHDEEKLIRLGLPLIRSAMEMAEVMHLPLSRLKWLTYHRNTATLCHYARFTIPKKNGGVREISAPKKELRQAQAWVKERILDRIPVHQAAYGFVPGRSTVDHAKQHLKQAAVIKMDLKDFFPTINFWRVKGVFRSFGYSEAISTLFALLCTEPPRTEVEFDGKYYYIAMGERQLPQGACTSPALTNIICRRLDHRLSRLAETLGFTYTRYADDLAFSCDESALCRIGALMTKARDIIDSEGFMVNEEKTRVLRSSQRQKVTGIVVNEKPNISRKELKKFRALLHNVERNGLEKENRQNHPRFWEYIQGYVSYIRMVRPDLGEKFSEQLVRIARKYQLRLSAPVSK

SEQ ID NO: 6308 - protein, 473 aa, unidentified
  source 1..473: note = Related to NZ_FQVL01000006.1; note = Seinonella peptonophila
MSEETQPLTKEEWRERIQREGKEETIKQEMIRLGFWTDKPLTPEEMASVEADDQAEAALKSELNKLRSESRKWSDTDQLIKKARQKRIEESKQRRAERKKARAIERKQQEERWAEYRQNHLVHLGNGVSGGLEQSTTNQERLKQLDLPLIETPQQLASEMGITLGRLKWLTYHRDLATLSHYYPFTIPKKNGGIREISAPKKELRAAQAWVKQSLLDQLSTHPAAYGFVQGRNTVDHAKQHLNQAIVVKMDLADFFPTITFYRVRGLFASFGYSQQMSTVFALLCTEPPRKRVRFDGTYYYVAMGERQLPQGASTSPAITNLICQRLDQRLSGLAEKENFIYSRYADDLTFSTSDQQDRRVGALLQTVRQIIHFEGFQPNEAKTRILRKSRRQRVTGIVVNEKANLSRQDQRRFRAILHNVGKNGFDIENRDHHDDFLAYLQGYISYAHMVRPDLAETWQNQLDRAIAAHLKD

SEQ ID NO: 6309 - protein, 487 aa, unidentified
  source 1..487: note = Related to NZ_PZZP01000001.1; note = Desmospora activa
MSEEQSQETQQLTREEWIQRIREETKGEVIKKEMIRLGFWSEEPLPPEEKEQQEQEDREFARLQKELQALQQESEKLEDTDTLIREARKKRIEESKRKRAERKAEREQRLAEAKKRWEEYQANHVVHAGIGVSAGLQNHTMNGYQLEQLGLPILTSPAIMAAEMGIELSRLKWLTYHRDTAALSHYHRFTIPKKSGGRRIISAPKPELRHAQEWVKTYIVDRVPVHEAAYGFIPKRSTVDNAQHHLQRAAVIKMDLKDFFPSITFQRVKGLFQSFGYSEAVSTLLALLTTEPPREKVSFDGKFYYVAVGKRQLPQGACTSPGITNLICRRLDARLTELAEKMGFTYTRYADDLTFSCDQDGLEQLGVLLRGVRDIVRFEGLQVNEKKTRVLRASRRQRVTGIVVNDKPSLPRQELRTFRALLHNVEKNGLEAENRENRPHFWEYIQGYVSYVRMVRPDLGEQFGEQLQRIAAKYGLKLNAAREREAK

SEQ ID NO: 6310 - protein, 480 aa, unidentified
  source 1..480: note = Related to NZ_CP048104.1; note = Kroppenstedtia pulmonis
MAEEEKQPLTREEWIQRIQEESRDEVIKKEMIRLGFWIEKPLDPEDEKQQAQENEEYARLQKELNQLKQESAKLSNVDALIREARKKRIEESKRKRAERKAQRERERSEAKKRWETYRSQNIIHAGIGVSGGLQYHESDEEKLKSLQLPLLSSPAVLADEMGMDLSRLRWLTYHRDNATLCHYHRFTIPKKGGGERLISAPKQELRKAQNWVKEHILDRIPLHDAAYGFVPGRSTVDNASCHLGQEAVIKMDLQDFFPSITFRRVKGVFGSFGYSEAISTLLALLTTEPPREEVMFDGKYYYVAIGERQLPQGACTSPGITNIICRRLDQKLEELARGLNFYYTRYADDLTFSCGKESTQHIGILLRGVREQVRFEGLRVNEGKTRILRSSRRQRVTGIVVNEKPNLTRKELRRFRALLHNVEANGLEAENRDDHPRFWSFIQGYVSYIQMVRPDVAAKMSDQLNRIAEKHGLHRTIRTS

SEQ ID NO: 6311 - protein, 486 aa, unidentified
  source 1..486: note = Related to NZ_JAECVR010000023.1; note = Paenactinomyces guangxiensis
MAEENQQETQPLSREEWIERVMQEGKDEVIRQEMIRMGFWSEKPIPPEEKAKQEQEDEEYALLTEELNRLKQESEKLGDIESMIRERRKQRIEESKRKRAERKAERERLRAEARKRWEEYKSKNVIHVGAGFSKDLQSFDMDEEKLRLNKLPVIRTAEELAGKMGISLSELKWLTYHRDTATICHYHRFTIPKKSGGMREISAPKPKLRRAQEWVKTHILGGSEVHPSAYGFIPGRSTVDNAKCHLKRAAVIKMDLKDFFPSITFWRVKGLFQSFGYSAAISTLLALLCTEPPRKQVQFDGKFYYVAIGERQLPQGACTSPGITNLLCRRLDLRLTGLGEANGFTYSRYADDLTFSCDEEGLPQMGGVINTARHIIRFEGFRVNEEKTRVLRSSRRQKVTGIVLNEKVNISRKELRAFRALLHNVEKTGPEKQNIYHHPDFWGYIKGYASYIRMVRPDLNETLEQQLNRINRKYNLEKSAVAEAKG

SEQ ID NO: 6312 - protein, 487 aa, unidentified
  source 1..487: note = Related to NZ_LN812102.1; note = Risungbinella massiliensis
MSANNPSEEVQPLSREEWVQKMREEGGKGNLVRKEMIRLGFWTEKTLTVEEYQKKRELDQEYQELSQQLEKFQQENAKLEDVKTLVRQARAKRIKESKERRAKRKAEREEALAQRQRKWQEYRDTHILHVGENVSSHLEDQEYEEEKLISQQLPILRGSLHLAEEMGVSLSRLKWLTYHRKTATISHYHRFTIPKKSGGKREISSPKSELRQAQSWIKQEILDHLKVHSQAYGFVPSKSTVDNALPHVGKQVVVKLDLQDFFPSITFPRVRGLFRSFGYSGEVSTVLALLCTEPPHREIEFQGKKYYISIEERQLPQGACTSPAITNLLCLRLDERLAQLASKRGFTYSRYADDLTFSCSGDSEQQIGKMLGTIRKIVQAEGFQVNEKKTRVLRSSGRQRVTGVVVNEKPSLDRKRLRNFRALLHNVEKKGLDAENRENHPNFWQYILGNASYIQMVRPDLKEEISQKLAKIAEKYGQNYSLQSVNK

SEQ ID NO: 6313 - protein, 485 aa, unidentified
  source 1..485: note = Related to NZ_SLXV01000034.1; note = Baia soyae
MSNETNYEQHQPLTKEEFQARMKEMGKSQFIREEMLRLGFWTEETLTPEEQAERSQDLSELQIVQKELDELRSEARKLGDIKEQLKIARQKRIEESKRKRDEKKAQMEQASAEAQKQWTKYKKIHIPHVGNRYSIGLEHTGMDKEKLEAWRLPVLQTAKELACAMEIELNRLQWLTYHRDTATLCHYHRFSIPKKSGGTREISAPKPELRQAQQWVKEHILDLLPIHPTAYGFVKGKSTVDNARVHIQKRIVVKMDLQDFFPTITFWRVRGLFEWMGYSRQISTLLALLTTEPPHQQVKYDGKYYYIAIGERQLPQGACTSPAITNLITWGMDQQLHAWTEKMGYAYSRYADDLTFSSETLSSSQQVGVLLKRVRSTVKLHGFQVNEEKTRILRHTRRQRVTGIVVNEKPNLTRRRLRQFRALLHDVELHGLEAANRQNHPNLWAYINGYISYMAMVRPDLSHKYNEQASRISQKYGLSYVGIPV

SEQ ID NO: 6314 - protein, 482 aa, unidentified
  source 1..482: note = Related to JAKWBN010000001.1; note = Shimazuella sp.
MSEENKVLTREEWINKIRSEGKAETIRSEMIRLGFWEAPNLSEEEREQQAKEDEEYKEVRKELQELQKKSKQLKDIDFLLKEARKRRMEESKKRRAERKAVRKKAQAEAKEKWRKYRQNHVIHVGDGVSAGLASTETNEQKLMQHQLPLIRSALQLAHDMNITLSELKWLTYHRNTATINHYQHFTIPKKSGGKREISAPKSKLRSAQSWIKANILDKLAVHDAAYGFVTGKSTVDNAKHHIGKDAVVKFDLKDFFPSISFVRVRGLFESLGYSRAISTLFALICTEPPRQEVEFNGKMYYVAINERQLPQGACTSPTLTNLLCRRLDEKLTHLAKEKGFTYTRYADDLTFSGNEEALKQIGSLMGSVRSVVDFEGFIINEAKTRVLRNGRRQRVTGIVVNEKPNLTRKDIRSFRALLHNVEHHGLEQENHRNHPHFWEYINGYVSYVQMVRPDIGKKFAIQVQRIADKYGLPIRVYIEKLG

SEQ ID NO: 6315 - protein, 482 aa, unidentified
  source 1..482: note = Related to NZ_ATZF01000012.1; note = Shimazuella kribbensis
MSEENKMLTREEWIAKIRSEGKHETIRGEMIRLGFWEAPNLTDEEIEQQAKEDEEYTEVRKELLALQKESKQLKDIDFLLKEARKRRIEESKQRRAERKAQREKSQAEAKEKWKQHRETHVIHVGDGVSAGLASKETNETKLMERQLPLIRSALQLAEEMGITLSELKWLTYHRNTATINHYTRFTIPKKNGGQREISAPKAKLRTAQTWIKETILDNLTVHPAAHGFVTGKSTVDNAKHHIGKDAVVKFDLKDFFPSISFVRVRGLFESLGYSRAISTLFALICTEAPRKEVEFNGKIYYVAMKERQLPQGACTSPTITNLLCRRLDEKLTQLARDKGFTYSRYADDLTLSGNGDTLQQIGSIMNSIRNIVSFEGFVVNEEKTRVLRAGRRQRVTGIVVNEKTNLTRKDIRSFRALLHNVEQKGLEEENHKNHPYFWEYINGYVSYVQMVRPDIGQKFATQVLRIAEKYGLPIRVHAKKLG

SEQ ID NO: 6316 - protein, 485 aa, unidentified
  source 1..485: note = Related to JACXAG020000009.1; note = Hazenella sp.
MSEDSKPLTRAEWYERIKQEGKYETIRSDMLRLGFYQEPEVSPQKKEQWKQEDEAYQQLLQELQQVQLEAGKLPKINDLLAEARQKRIAASRQKRVERKAVRLKEKEEQQAHWQQYKADHIIHLGRGVSAGLQQQETDETQLNKLGLPVLTSSKQIATQIGLSLSELKWLTYHRNTATISHYHHFTIPKKNGEKRVISSPKPLLRIAQSWIKEAILDHIDVSPHALGFLPQKNIMDNARPHVKKDLIAKMDLKDFFPTITFWRVRGLFQSFGYSEAISTLLALVCTEPPRKKVSFAGKVYHVALGERQLPQGACTSPSLTNIICRRLDSRMNGLADSLNMTYTRYADDLTFSGTKVKNHHIRTLLSKSRSIITFEGFHINEEKTRILRATQRQKVTGIVVNKKLNISRQELRSFRALLHNVKRSGLVEENRDQHPYFWGYIIGYAGYIRMVRPDLTQRIASELIEIAQKYQQEIPAWVHQTSKSE

SEQ ID NO: 6317 - protein, 484 aa, unidentified
  source 1..484: note = Related to NZ_SMAG01000003.1; note = Hazenella coriacea
MTEEQNQEEVKQLTREEWIERIKSEGRTEAIKKEMLRLGFWIEKPLTPEEKREQAEDELKLKQLQAELQELQKESAKISNLNKILKQARAKRIEESKKKRADRKAAIEKREADRKARWQDYKESHIVHVGDGLSAGLQSFETDEKKLMEQRLPLIRSAVQCADEMGITLSQLKWLTYHRDTATINHYYRFTIPKKNGGEREISSPKPLLRQAQAWIKAHILDQIQVHSAAYGFVPQINTVDNAKQHVNQAAVIKMDLKDFFPSITFWRVRGLFHSFGYSEAISTLFACLCTEPPRKEASFNGKIYHVALGERQLPQGACTSPSITNILCRRLDERLTGLAQTNGFIYTRYADDLTFSCQESSLSKIGTLLNSVRNIVKFEGFTVNEEKTRVLRASRRQRVTGIVVNEKPNLTRQDLRRFRALLHNVEKNGLEAENRSNHPNFWAYIQGTTSYIRMVRPELGEKLGEQVERIAIKYHLAGSVVSK

SEQ ID NO: 6318 - protein, 485 aa, unidentified
  source 1..485: note = Related to NZ_BMEX01000001.1; note = Kroppenstedtia guangzhouensis
MQGKNDGEVQPLSREEWLERVMQEGRDEVIRREMIRMGFWSEEPLPPEELEKQKQEEKELAQLKEELESLEEKTRKLGDLEAMIRRRRQERIEESRRRRAQRKEERIRRRAEAQAKWKEYREQHVVHVGEGFSGDLELLNSDEERLRESGLPLIHTPQELAEAMEIPLGRLKWLTYHRDTATISHYHHFTIPKKNGGKRILSAPKKHLRQAQEWIRAHLLNRVEVHPCAYGFVRGKSIVDNAAHHVGKAAVIKMDLKDFFPSVHYPRVKGMYQSFGYSPAVSTLLALLCTEPPRRKVEFDGRIYHVAVGDRHLPQGAPTSPAITNILCRRLDERLLGLADSHGFAYTRYADDLTFSCWPSGEKRIGALLGTARGIVRYEGFEVNEEKTRVLRRSRRQAVTGIIVNEKTNLNRGELRAFRALLHQVEQKGLKGQNIHNHPNFWEYIKGYTSYIEMVRGEAAAPYREQVKRIARKYGLDPKVASDHA

SEQ ID NO: 6319 - protein, 484 aa, unidentified
  source 1..484: note = Related to PVTZ01000010.1; note = Laceyella sediminis
MSEEKRPLTREEWIQKVSANGREATIREEMIRMGFWSNDSLTEEEKKQQQAEDEERARLAAELQRLQSKGMSMPKVQQLLQEVRQKRIEASRKRREEQKAEREQKRREAKAAWEQHRARHVVYAGEGVSGGLENKETQTEMLRQAGLPIVTTAEELAEAIGISVSKLKWLTYHRNTATLSHYFRFTIPKQNGEEREISAPKQTLRQAQAWIKTHLLDRLPVHSAAQGFVPGKSIVDNAKQHVGQAAVIKMDLRDFFPSIHFYRVRGLFQSFGYSEMISTLLALLCTEPPRRAVTLGGRVYHVAIGERQLPQGACTSPAITNLLCRRLDERLSGLAQKYGFQYSRYADDMTFSCSEAGIGQIGAVINQVRRIVAFEGFTVNEDKTRVLKRTNRQTVTGIVVNEKINVNRREWKQFRALLHNVEKNGLEAENRKGHPHYWDYIKGYANFVRMVRPDLEEKLIRQLRAIAVKHRLSLPGWARKTVQS

SEQ ID NO: 6320 - protein, 489 aa, unidentified
  source 1..489: note = Related to NZ_CP034118.1; note = Staphylospora marina
MSDERMEEKRPRTLEEWVEQVRRLGREHAIRTEMIRLGMWEEKELTPEEKAQQQREDAEYQKLAEESMRLQRELTKLGNLQHLLAEARKKRIEESRRRREERKKEIAKREAERKRRWAEHLEMHIVHAGAGVSGGLNAFEHQEEKLMAAGLPLIRSARELAELMDMPISRLRWLTYHRNAATVCHYHRFTVPKRGGGLREISSPKPELRRAQEWIKREILDRFPVHSAATGFLPGKSVLDNAAPHLGQAAVIKLDLKDFFPGITFHRVKGLFRSFGYSEAIATLLALLTTEPPRRPVEFDGKMYHVALGERQLPQGACTSPAITNLLCRKLDARLEGLARKHGFRYSRYADDLTFSCPAERTDAIPVLLGTARAVIRHEGFEVNAEKTRVLRSSTRQQVTGVVVNEKPNISRNELRRFRAILHRVWQNGPEAENRDGHPRFWEFIQGYAAWIRMVRPDLEGKLAVQLARIAEKHRLPVAGWVKETAVRG

SEQ ID NO: 6321 - protein, 464 aa, unidentified
  source 1..464: note = Related to NZ_CP036426.1; note = Tautonia plasticadhaerens
MNEDEKARLYREVTRSASESAVLRRMHALGFWPHGEGLPPDPPEEHAERARIEAELADLRRTHARVEDPEAALVEERRRRWEESKARRAEARARRLQEQQVRREEWDRHRSSTMVHAGIGVSAGLQDARSDEEALSRRGLPVLHRAEDLAGQIGIELGALRWLTYHRRSASVVHYHRYEIAKKTGGVRCISAPKPALAFAQRWVFDQILRRLDPEPQAHGFVPGRSIVTNASTHAGRAVVVNLDMKDFFPSVTFRRVKGLFRAIGYSEHLATVLALLCTEPPRVPATLDGKTTHIALGDRVLPQGACTSPSITNALCRRLDRRLDGLARRHGFTYTRYADDLTFSGDRPAVVGRLLRSVRSILAAEGFVEHPSKTRIMRRGGRQEVTGVTVNDRPNVSRRELRTLRAILHNAARLGLESQNREDHPDFASHLRGRVEFACMVDPSRAGTYRDALSRALQGPGAP

SEQ ID NO: 6322 - protein, 464 aa, unidentified
  source 1..464: note = Related to NZ_RYZH01000020.1; note = Tautonia sociabilis
MNQDEKARLYRRVRHLASDSVVLRRMQTLGFWPKGEGLPPDPPEEAAERARIEAELADLRQKFAKVSDPEAALAEERRRRWEASKARRLEAKRRRAEEQRNRRAGWDQTRSATVVHAGIGVSAGLQGRQSDSEALRRRGLPILHQAEDLADRIGIELKALRWLTYHRRGATVVHYRRYEIAKKSGGVRCISAPKPALAWAQRWILDEILRRLEPEPQAHGFVSGRSIVSNAEPHSGKAVVINLDVKEFFPTITFRRVKGLFGSLGYGEHIATVLALLCTEPPRVAATLDGKTYHVALGDRVLPQGACTSPALTNAICRSLDRRLDGLARRHGFTYTRYADDLTFSGNRTAASGRLLRSVRIILVDEGLIEHPTKTRVMRRGGRQEVTGLTVNDRPAVSREELRTLRAILHSASRFGLDSQNRDGHPDFASHLRGRVEFACMVDPSRTPALREALDRALRGPSGS

SEQ ID NO: 6323 - protein, 780 aa, unidentified
  source 1..780: note = Related to JAGQQD010000063.1; note = Planctomycetaceae bacterium
MSDNEKAQLYKRLIQQTNDWFVLERMRELGFWPEDQPLPTVPQEEAVERTELEAEIAKLRQQNSKVANPEAALAEERKRRWEASKARRAEAKIQKEKERQARREAHEAHKETTIVHAGLGVSGGLQGTGSNPVALKSRWLPVLHRAEELAAEMGIELNTLRWLTYHRRGAAVVHYHRYELPKKTGGSRAISAPKAALDQAQRWILVNILNRLNVESQAHGFVSGRSIVTNATEHVGREVVINLDLKDFFPTITFRRVKGLFVALGYGEHIATVLGLLCTEPPRVAAEFAGTTYHVALGDRVLPQGACTSPAITNAICRRLDRRLAGLAKKHGFNYTRYADDLTFSGDAPRRVGRLLKSVRAILVDEGLTEHPSKTRIMRKSSRQEVTGVTVNEKPSLSRMEFRKLRAILHNAAKFGLESQNHEQHPNFENHLRGKVAFAAMVDPSKSAALWDAFHKAITEPQMTFSSVQEGSVDDRRRGTLIGLAVGDALGAAVEFKPPGTFEPVTNYRAGGPHRLNPGEWTDDTSMALALADSIAKAGWDLDDQARRYCDWWRDGKYSVNGRCFDIGITCRSSLGQFHLTGDARKAASTDEYSSGNGSIMRLAPVSIQFASLFPDRIDELAHLAEESSLTTHASAQCLSACRYFALILAGLISGRSREEVLSPDWEPLSQLRELKPLAEPVEDVALGSFRRLNPPEIKGSGYVVKSLEAALWAFHDARDFEEAVLKAVNLGDDADTTGAVCGQLAGAYWGESGIPARWRNYLARTDLLEAALKGMIEKD

SEQ ID NO: 6324 - protein, 461 aa, unidentified
  source 1..461: note = Related to JADJAE010000011.1; note = Deltaproteobacteria bacterium
MATDHKAALYRRLVREASDAAAIERMRVNGFWPWGQGIPRDPPDELKERAQIEAEIAKIQAQSTKSVDPDKALAQERKRRWEESKKRRAAKRLERASLLKKRRDDFIRYRKANVLHLGVGVSAGLQDTRPDTGELTRRGLPSLTNGSDLAMMMGVPLASLRWLCFHRRGAALMHYHRFGIPKKSGGTRSISAPKPRLANAQRWVLQNILERLDTAPPAHGFVRHRSILTNATPHARRAVVMNFDLKDFFPSITFRRVKGLFRKLGYNEHVATILGLLCTEPPRARVEVDGRVIYLALGDRVLPQGACTSPAITNALCKRLDARLLALASRHGFTYTRYADDLTFSGDDGALVGRLRRSVVSVVSSEGFTENTAKTRIMRQGSRQEVTGLTVNDRPTMPRDEFRQLRAMLHNAAKHGLESQNRTQHPAFAQHLAGRVEFACWADPTRAEKLRSALAAALARG

SEQ ID NO: 6325 - protein, 461 aa, unidentified
  source 1..461: note = Gemmataceae bacterium; note = Related to JAIEMG010000089.1
MPDNEKARLYKRIVQQTNEHTLLERMRIHGFWPAREGLPQGPAEEAAERTRIEAELAELRKAHSAVKNPEKALADERKRRWEESKKRRAANKAKREEEAKQRREAWAAVRQESVVHAGAGVSDRLHQTTSDVAELTRRHLPILHQSADVAKQLGIGLPALRWLTYHRRGATLVHYHRYSIAKKTGGARCISAPKPALAKAQHWVLENILDRLDVDPAAHGFIRGCSIVSNAIPHANRGVVVNLDMKDFFPSITFRRVQGLFRKLGYSGHVATLLALLCTEPPRIATELDGKVYHVALGERILPQGACTSPAITNALCRRLDRRLDGLARKNGCAYTRYADDLTFSGDDPGVVGHVLRNVRYILKGEGFVPHPNKTRVMQRASRQEVTGVTVNVRPTLARQEMRTLRAILHNAAKHGLESQNRDGRPNFAAYLRGRVAFACMVDPTRAEALRAALALALRPV

SEQ ID NO: 6326 - protein, 460 aa, unidentified
  source 1..460: note = Planctomycetia bacterium; note = Related to JAEUIF010001171.1
MANDEKAQLYRRIVQQNSEQQLLERMRIHGFWPQRAGLPQDPPAEAAERARIEAELEELRRTQSAVKNPESALHAERKRRWEESKKRRAERKAQKLQEQHKRREAYEALRQTTIVHAGAGVSGRLQETISNEAELRRRQLPVLHIAADLAREMGMPLSKLRWLTYHRRSATLVHYHRYEIEKKTGGVRCISAPRPALKQAQGWVLEHILGKLTVEPQAHGFVPGRSIVTNALPHVGRAAVINLDLKDFFPTITFRRVQGLFRKLGYSGHLATLLALLCTEPPRVPAELDDKVYHVALGQRVLPQGACTSPAITNALCRRLDRRLDALARRHGFAYTRYADDLTLSGDNTEMIGHVLRNVRYILKAEGFTLHPTKSRLMRRGQRQEVTGVTVNVRPGVSRQEVRTLRAILHNAARHGLESQNREKRPNFAAYLKGRVEFVRMVDPQRGRVLRAALQAVLRG

SEQ ID NO: 6327 - protein, 470 aa, unidentified
  source 1..470: note = Related to nan
MADDEKAKLYQQIVSRADEQRIVERMRLHGFWPADKPLPKDPPDEVRERQQVEAELAHLRREHSTVRDPEKALAQERIRRWQESKKRRADRKVQKLQEQVRRREAWKKTRDANIVHTGEGFSAGLQQKNSDAAALQARGLPVANDSPELANLIGIKLSTLRWLTYHRKGATVVHYHRYSISKKTGGLRYISAPKAALRQAQEWVLQNILSRLPVEPQAHGFVLERSVVSNALPHVNKNVVINLDLKDFFPSITFRRVKGLFRQVGYGEHVATVLALLCTEPPRVATELDGKVYHVALGQRVLPQGACTSPAITNLLCRRLDRRLAGLAKRHDFAYTRYADDLTFSGENGKAVGRLLRSVRSILTSEGFAEHPRKTKVMRRASRQEVTGLTVNVRPTVSRKEVRQLRAIIHNVARHGLESQNRSDHPDFEGHLRGRVQFVRMVDPQRGEPLLAALHRALGTSAGDGTANIS

SEQ ID NO: 6328 - protein, 461 aa, unidentified
  source 1..461: note = Related to JADLFP010000276.1; note = Acidobacteria bacterium
MNEKARLYQRITSEMNEETVLARMRMHGFWPASAGVPPDPPEEVKDRQRIEKEIARLAGERKKAADPEKALAQERNRRIEESRKRRAELKEKRAAEREARQKEWAAFRERSVVHAGTGVSAGLETPGRSSLEELVRRGLPMMHDGQDLARWLGITIGKLRWLTYHRNAAALVHYHRFGIPKKSGGIRAISAPKASLAVAQRWILTRILSRLTPDDAAHGFVHGRSIVSNAAPHAGRRVVINMDMKDFFPTVTFRRVKGLFRRLGYNEPVAVLLALLCTEPPRVAAELGGKAYFIALSSRTLPQGACTSPAITNAVCHRLDRRLTGLAARHGFTYTRYADDLTFSGDDATAVGRLLRSIQSIAGSEGFVPHPEKTRVMRRGERQEVTGVTVNDKVGVSRREVRELRAILCNAARLGLATQNREAHPDFAGYLRGRVAYVAMVDPSKKSKLEAALARALEART

SEQ ID NO: 6329 - protein, 461 aa, unidentified
  source 1..461: note = Related to MGST01000139.1; note = Deltaproteobacteria bacterium RIFOXYA12_FULL_58_15
MDEGEKRNLYRRIVASVPEDMLLGRMRVYGYWPTGVPIPADPADEVAQRKEIEREIAKLQSAHSTAKDPDKALAEERKRRWDESKKRRAENKKKREAENKQRREAWDIYRKKTVVHAGEGVSSGLQDVLSDTDALVARGLPVMHCAADVAVMLGLPLPTLRWLTFHRRATALVHYHRFDIPKKTGGRRLISAPKATLKKAQQVVLDNILSRLPTEPEAHGFVAQHSIVTNAACHAGKAVVINVDLKDFFPSIGFRRVRGLFQRLGYSGQVATMLGLLCTEPPRIKAELDGKVFHVALGERVLPQGACTSPAITNTICRRLDRRLVGLASKHGFTYSRYADDLTFSGNVPKKAGRLLRSVRAILENEGFAENGKKTRVMRQSRRQEVTGLTVNDKPRVSREQRRELRAILHNAAKSGLESQNREGRSNFASYLRGRVAYLSMVEPERAALLKATLERALAKR

SEQ ID NO: 6330 - protein, 460 aa, unidentified
  source 1..460: note = Related to JAIOJK010002653.1; note = Sandaracinaceae bacterium
MSDDKAKLYKLITSQLSEHQVLWRMRELGFWPEGQPIPDEPLDAQEERAKLTKELEQLRKQGAKIANPEKALAQERIRRWQESKKRRAIAKAERAASAKERSEKWKAHKAVALVHAGEEHSAGLQDRESDAAKLASRSLPVLHDAPDLAKAMGIELSALRWLTYHRRAAALVHYHRYTIPKKAGGTRAISAPKPALAKAQEWVLGAILDRLVPEPEAHGFVAEHSVLTNAAPHAKKKIVVNLDLRDFFPSLGFRRVKGLFRKLGYSEHIATLLSLLCTEPPRVEAELDGKVWHVALGERVLPQGACTSPAITNAVCRRLDRRLRGLAGRHGFAYTRYADDLTFSGDDRKKVARLLKSVRAILQSEGFVEHPRKTRVMGSGSRQEVTGLTVNAGVKLGRGDKRRLRAILHNAAKHGLASQNRRDHRDFAAHLAGLVSYASMVEPERAADWKARLDRALSSS

SEQ ID NO: 6331 - protein, 461 aa, unidentified
  source 1..461: note = Related to JACRDB010000039.1; note = Deltaproteobacteria bacterium
MADDEKARLYKRLTTTWNEFEVLARLRHNGFWPAGVGIPQDPPKELKERATLTKELASLRASQLAVKDPEKALSEERTRRFKASLERRKAARARRLADEKTRRERWLKARKDSVVNLGEGVSAGLQDVSCDKAQLQARGLPVLGDAVALAGALGVKLSVLRWLTFHRRGATLVHYHRYAIPKKTGGQRAISAPRRKLAGCQCWVLTQVLEKLHAEPPAHGFVRHRSVVTNATPHVGRRVVVNLDLRDFFPSVTFRRVKGLFRKVGYGEQVATVLALLCTEPPRVPVTFDDKRFYVALGQRVLPQGASTSPAITNALCRRLDRRLQGLARRHGFTYTRYADDLTFSGDEPPRVGRLLKSVKAVVVDEGFQVHPTKTRVMRSTRRQEVTGVVVNHRVGVPRDELRALRATLHNCARHGLQSQNREHHADFAAHLRGKVSWVCMVDPARGPALRAALERALASP

SEQ ID NO: 6332 - protein, 461 aa, unidentified
  source 1..461: note = Related to JAEUKH010000004.1; note = Myxococcales bacterium
MAYDDKARLYRRLVTGTSDATVLARMRLHGFWPLGRGLPADPPDELKKRLDLEQKLVILRDAEVVATQSPEKLLEAERKRRWAALKQRRAEKKAARAKAVQARRDAFAKLRRSSVLHAGIGVSKLLNDTKSDHAALRARGLPVLDAGPDLAMMLGIPLGVLRWLTFHRRGATLVHYHRFSLPKKTGGQRAISAPKPRLKTAQAWVGQNVLGPLALSPHAHGFVPGRSTVTNAALHVGKKVVVNLDVRDFFPTFGFRRVRGLFRHLGYSGQVATLLALLCTEPPRLEASVDGTRVWVALGHRVLPQGASTSPALTNLLCHRLDQRLAGLARRHGFAFSRYADDLTFSGDHPERLGRLLKSARAILAAEGLVEHPDKTKVMRASQQQEVTGIVVNTQLGLPRDTMRRLRATLHNCARHGLDSQNREGHPNFRGYLEGMVAYASMVNPEKAAPLRAALTLALGG

SEQ ID NO: 6333 - protein, 463 aa, unidentified
  source 1..463: note = Related to JAIBCE010000260.1; note = Sandaracinaceae bacterium
MSDTKDDPLKKLKAQLSALPDATVRERMIALGFWPPGEPLPADPIDEANARAALESGRARLLAQAGTAENPEKALRRERIRRLRESQKRRTLRKLERENEKKARRAAWDAEKAGRIVDAGEGVSAGLAQTGSNADQLTGLGLPVVHDASELAERLGLSLSQLRFLTYHRRGATLVHYHRFGIPKKTGGIRAISAPKPALARAQRWVLAQVLDKLEVRAPAHGFVRHRSIVTNAAPHVGRRVVLNLDLESFFPTVGFRRVKGLFRKLGYAEQVATLLALLCTEPPRVEARLDGKRLWIALGQRVLPQGACTSPAITNAICRRLDARLSGLAKHFGFTYTRYADDLTFSGDDRGRVGRLLGCVRKVVTSEGFREHGDKTHVMGSGRRQEVTGVVVNQKLSTARDERRALRAMLHNVARRGLAAENRDGHADFASYLRGRVAFACMVDPSLEPVLRPALDRALARG

SEQ ID NO: 6334 - protein, 468 aa, unidentified
  source 1..468: note = Related to NZ_CP011125.1; note = Sandaracinus amylolyticus
MSDEKDPQKAALVKAVLASLDDATALSRMKTLGFWPVHEPVPGDPPGEIVERAELDAELATLVKIASDGEKPEKALQRERIRRWKESRERRKAKKAERIAEAKQRADAWRAQRAERLVYAGLGVSAGLHDVESDVATLEACGLPIWRDARDVASALGISIAKLRWLTFHRRGATLVHYHRYGIPKKTGGIRAISAPKPALAEAQQNVQSLVLQRIAPSDEAHGFVRERSVVSNARPHVGRAVVVNLDLRDFFPTISFRRVKGLFAKLGYSEQVATVLALLCTEPPRVPAELDGQRYHVALGARVLPQGACTSPAITNLICRRLDARLRGIARALGFTYTRYADDLTFSGDDPTKLASLFGMVRKVIASEGFAEHEGKTRVMRRGARQEVTGVVVNRAVRLPRDEKRALRALLYNCARFGMESQNRDGRPSFASYLRGRVAWAVMVEPALGPRLFPALERALEGRRSDL

SEQ ID NO: 6335 - protein, 467 aa, unidentified
  source 1..467: note = Deltaproteobacteria bacterium; note = Related to JACOUT010000011.1
MPDDAKPKPEKSEKQKLWERISARPDWIVVERMRVNGFWPAGETLPEDPPDEVKERAALEVERARLLKSALAVQHPEQALKAENQRRIEVSRKKKAERKVLREAAARERREAFIKKKRATLVHLGLGVSGGLEKTGADEARLQAFELPVLRDGNDVAAAIGIPLGELRWLTYHRRGAPLVHYHRYDIPKKTGGARHISAPKGKLARAQQWVLDAVLDKVPASAHAHGFVRGRSVVTNARPHVKCKSVVNLDLKDFFPTITYRRAKGLFEHLGYGEHVATVLALLCTEPPRVLVEHDERRTHVAIGERVLPQGACTSPAITNLLCRRLDARLAGLARRLGLAYTRYADDLTFSGDTVDERALLGAVRRVIAAEGFVVHPDKTRVMRKGRRQEVTGVVVNAKPSIAREQWRSLRAVLHNCAKHGLASQNREQHPDFAGHLAGKVAWVRMVDPRRGAQLGLLLQRALARP

SEQ ID NO: 6336 - protein, 467 aa, unidentified
  source 1..467: note = Related to JADZDY010000308.1; note = Deltaproteobacteria bacterium
MADDAKTKSEKSEKQKLWERVSSRPDWVVVERMRVNGFWPQGEKLPEDPPDEVKERTALEADRTKLLKSALAVQDPERALKEENERRILESRKKKAERKVLRDKARRERREAWVKKKQAALVHLGLGVSAGLEHVESDVARLQTLGLPVLNDGTQLAASMGIALAELRWLSYHRRGAPLVHYHRYDIPKKTGGARHISAPKARLARAQQWVLANILDKLPVSEHAHGFVRDHSVVTNARPHVKRACVVNLDLKDFFPTISFRRCKGLFGKMGYSEHVATVLALLCTEPPRVLVELDDKRTHVALGERVLPQGACTSPALTNLLCRRLDKRLAGLARRHGLAYTRYADDLTFSGDSLDESALLGSVRRVVEAEGFRVHPDKTRVMRKGRRQEVTGVVVNTRPSIAREDWRQLRAILHNAAKQGLQSQNRDQRPDFAAHLAGRVAWVRMVDPRRGAQLGLLLQRALARG

SEQ ID NO: 6337 - protein, 461 aa, unidentified
  source 1..461: note = Related to nan
MADDEKAKLYKEIVRRTSDAFLLDRMRTHGFWPEKEPLPKDPPDELSERAKIEAELQKLKQTSLAVKDPEKALAEEQKRRWEESKKRRKEAKEKREAEQKARSEAWAKVRKQKVVHLGLGVSKGLEDTKSDAEKLLENGLPVLHTSADVASMLGVSLPVLRWLTYHRKSVALVHYHRYGIPKKTGGIRNISAPKKSLSAAQEKVLVLILEKIAPEPQAHGFVAGRSILTNAAPHAGRKVVMNLDLRDFFPTITFRRVKGLFHKLGYSEHAATVLALLCTEPARAKAELSGRVYHVALGERFLPQGTCTSPAITNLLCRRLDKRLSGLAQKAGFLYTRYADDLTFSGDDTGEVGRLLRAIRKVITSEGFEEHAKKTRVMRRGRRQEVTGLIVNSRPAVPREEIRRLRAILHNAARSGLDAQNRENVPDFAAHLRGRVAFVEMVDKERGEKLRAALNRVLAGR

SEQ ID NO: 6338 - protein, 461 aa, unidentified
  source 1..461: note = Related to JAEUKD010000148.1; note = Myxococcales bacterium
MAKQDDKARLYHRITQVHHGIVLDRMRVNGFWPMNQGLPPDPAPEAQERKLLEADLAVLKQDAAMSPGDVEKALKAERMRRWEESKKKRAEKKKLREARAAARRAAWVERRKGLVFHAGEGHSGGLQHATSDEAALTKRALPVLHTAHDLAVALGISLARLRWLTYHREGATLVHYHRYSIPKKTGGIRGISAPKPALAKAQKWVFDSVVQKLVIEPEAHGFVVDRSIVTNAKLHVGKRVVTNMDLKDFFPSVTYKRTKGLFVSFGYSEQVATLMALLCTEPPRVAASVDGKPVNIAIGERRLPQGACTSPGLTNAVCRALDRRLGGLAQKLGFTYTRYADDLTFSGNDDKRLGLLLRSVRSIVKDEGFLEHPTKTRVMRRGRRQEVTGVVVNDRPTIAREELRELRAILHNAMRQGLEAQNRKGHPRFIDHLQGRVAYVAMVDPVRGEKLEQALARVLGR

SEQ ID NO: 6339 - protein, 461 aa, unidentified
  source 1..461: note = Related to JAHBWD010000079.1; note = Labilithrix sp.
MDADEKAKLYRRISSANIHLVLERMRVHGFWPQGQGLPPDPADEVAARAAIEKEIGQLQGAAVAGGLAAIEEALREERRRRWEASKKKRAERKKIRQAQDAERRAQWREEKKSRVVHAGVGVSAGLEDRQSNEEELQRRGLPVLHTAADVAASAGVAFPKLRWLTFHRRGAALVHYHRYSIPKKTGGMRAISAPKSALADLQLWVLSRILTPLHVEPEAHGFVPERSIVTNAKPHVRQRVVVNLDLKDFFPSVTFRRVKGLFQKVGYSEHVATLLALICTEPPRIPVEIDGKKLYVALGERMLPQGACTSPAITNLVCRRLDRRLAGLGHRWGYTYTRYADDLTFSGDGKQGLALLLKGVRGIVSDEGFAEHPTKTRVMRPGRRQEVTGVVVNDKLGVARKDVRQLRAILHNAKVHGLASQNRDNHPNFEAHLRGRIAFVHMIDEAKGKKLLDLLKEAIHG

SEQ ID NO: 6340 - protein, 462 aa, unidentified
  source 1..462: note = Related to PABA01000151.1; note = Sandaracinus sp.
MADDPKEKKKALYQQLVESADEELVLARMRELGFWPSSEPLPEDPDDEVKETLELEYELAQLRKKATVVADPQKALEQERVRRWKESKERRAKAKIERELEAKQRREAWETAKKERVWHAGEGVSAGLESHTPSPDGVRFGAPPIATPKALAEAMGIDLPKLRWLTYHRRAAALVHYHRFSVPKKTGGLRHISAPKKDLRRAQEWILVHVLERVGPQPTVHGFQRGRSVKSNATPHVSKRVVVNLDLEDFFPTLGFRRVKGVFRSVFGYPESVATVMALLCTEPPRVEAELDGKVFHVALGERVLPQGACTSPMLTNIACYALDRRLGGLAGSLGFAYTRYADDLTFSSDDPRKTGRLLKAVRDVVKNEGFVVNEAKTRVMRRGGRQEVTGVTVNRKANVSRKERRRLRALLHNAKKTGLAAQNRTKHPRFREHLRGRIAWIGMLDAAQGAKLRAMLDACPD

SEQ ID NO: 6341 - protein, 492 aa, unidentified
  source 1..492: note = Related to NZ_OKRA01000001.1; note = Clostridium sp.
MMENQENNRKDYREAVNAMGKKEFTLIKMQEYGFWPQNLPTPYERQENETSEQYENRKNLLEKYEKVIDEIANLYEEKDKINSKLIELQKKYDETWDYEKIRLDVSKTIMEESIARRAERKKQRELEKRQRSEEWKKEKEDKIVFIGKGYSSLLKDKETHKEKLLAQDLPIINDDKELASFLGIEYKKLRFLVYHRDVVSVDHYYRYTIPKKRGGVRNIAAPKSVLKNSQRKILDDILLKIPTSDEAHGFLKGKSVVSAAESHFKQPELLINIDLEDFFPTITFERVRGLFKSFGYSGYIASMLAMICTYCERMKIEIRGEEKYIKTSNRILPQGSPASPMITNIICIKLDKRLKGLSSKYNFTYTRYADDMSFSFNGDDYELNIGRFIGLVSKIVKEEGFNINKDKTKFLKKNNCQCITGIVINNEEIGVPKKWVKKLRAAIYNANKARNSGEVLSSKVINEISGMTSWIKSVNEKRYKAIIDSAMELINS

SEQ ID NO: 6342 - protein, 495 aa, unidentified
  source 1..495: note = Related to NZ_JAHXPT010000003.1; note = Clostridium weizhouense
MMENQENNMNNRKNYREAVNTMGKKEFTLIKMQEYGFWPKNLPTPYERQESETEEQYKERKCLLEKYEKVIDEISKLYEEKDKINLKLRELQKKYDETWDYERIRLDVSKTIMQESIERRAERKRQRELEKEQRSEEWKKEKENKIVFIGKGYSSLLYDKETDENKLLLQELPIIKDDKELANFLGIEYKKLRFLVYHRDVISVDNYHRYTIPKKKGGVRNIAAPKSILKNSQRIILEEILSKIPTSNYSHGFLKGKSVVSAAKVHVKKPDLLINIDLEDFFPTITFERVRGMFKSFGYSGYVASMLAMICTYCERMKVEVRGEEKYVKISDRILPQGSPASPMITNIICVKLDKRLNGLSTKYDFIYTRYADDMSFSFTGDINELSVGSFMGLVSKIVKEEGFNINKDKTKFLRKNNRQCITGIVINNEEIGVPKKWIKILRAAIYNANKVKNSGEILSNKVINEISGMTSWVKSVNEERYKDIINDAMNLINN

SEQ ID NO: 6343 - protein, 497 aa, unidentified
  source 1..497: note = Related to NZ_FOMG01000001.1; note = Clostridium uliginosum
MMENHENNMNNRQNYRETVNKMGKKEFTLIKMQEYGFWPKNLPTPYEKQENETKEQYAQRKDLLEKYQKIIDEIANLYEEKDKINERLREFQKKYDETWDYEKIRLDVSKIIMEESIARRAERKKQREFEKRQRSEAWEKEKADKIVFIGKGYSSLLQDTETDDEKLLSQELPLIKDDKELANFLGIEYKKLRFLVYHRDVVSVDHYNRYTIPKKKGGVRNIAAPKSILKNSQRKILEEILSKIPTSNYAHGFLKGRSVVSGAKAHTKQPELLINMDLEDFFPTITFERVRGMFKSFGYSGYVASMIAMICTYCERMKVEVRGEEKYVKTSNRILPQGSPASPMITNIICVKLDKRLSGLASKYSFVYTRYADDMSFSFMNDNSDLNIGKFMGLVSKIIEEEGFNINKNKTKFLRKNNRQCITGIVINNEEIGVPRKWIKRLRAAIYNANKVKNNGDLPSSKVINEISGMTSWIKSVNARRYEDIINDAMDLINSQL

SEQ ID NO: 6344 - protein, 385 aa, unidentified
  source 1..385: note = Related to AE015927.1; note = Clostridium tetani
MEESIKRRAKRKKQREFEKQQRSEAWKRTKEDKIVFIGKGYSGSLQDVETNIEKLKAQKLPIIKDDKELAKFLGIEYKKLRFLVYHRDVVSVDNYHRYTIPKKKGGVRNIAAPKSLLKNAQRKILEEILSKLPVSEYAHGFLKEKSVVSGAKAHKNKPELLINIDLEDFFPTITFERVRGMFKGFGYSGYVASLLSMICTYCERMEVEVRGEIKYVKTSHRILPQGSPASPMITNIICRKLDKRLSGLASKYSFTYTRYADDMSFSFINENTDLTYGRLIGLISKIVKEEGFNINKNKTKFLRQNNRQCITGIVINNEEIGVPKKWIKNLRAAIYNANKLKNNEQIPSSKTINEISGMTSWIKSVNSEKYKNIIDDAMNLINSLE

SEQ ID NO: 6345 - protein, 501 aa, unidentified
  source 1..501: note = Related to CP016086.1; note = Clostridium saccharobutylicum
MIESQENSKNNRQEYRKQVNELGKKEFTLIKMQEYGFWPKNLPTPYEKQENETKEEYLERKNLTKEYEKIINAITDLYDEKDEINAKLRDLNKKYNETWDYEKIRQDVSKAIMEESIARRKERKEKRELEKRQKSEAWQKEKADRIVFIGRGYSSLLYDKEDNEEKLLNQGLPVIKDDRALADFFGIEYKKLRFLVYHRDVVLVDHYNRYTIPKKKGGERNIAAPKLILKNVQRKILEEILSKIQVSDYTHGFLKGKSVVSGAKSHIADKASGENTALLINMDLEDFFPTITFERVRGMFKAFGYSGYISSLLAMLCTYCERMPIEVKGKVKYVKTSDRILPQGSPASPMITNIICVKLDKRLSGLSSKYNCVYTRYADDMSFSFMEESSDLNLGKFMGLISKIVNEEGFNINKSKTRFLRKNNRQSITGVVINNDEIGVSKKWIKTLRAAIYNANKLKNSGEKIPQSTINEISGMVSWVRSVNEKRYADIIESGMNLINT

SEQ ID NO: 6346 - protein, 526 aa, unidentified
  source 1..526: note = Related to NZ_QXDJ01000001.1; note = Clostridium chromiireducens
MMENQETSKNKRQDYREIVNQMGKKEFTLLKMQEYGFWPKNLPTPYERQENETQEEYAHRKSLIKKYEKIIKQISDLYNEKDKINQKLRELKKRYNETWDYEKIRSDVAKAIMEESIARRKERKEKRALEKEQKSEDWKKEKERRIVFIGKGYSNSLFDKESDTERLLSLGLPIIEDDKELSELFEIEYTKLRFLAFHRDVVTLDHYHRYTIPKKKGGERNIAAPKSILKNVQRKILEKILSKIPVSHYAHGFLRGRSVVSGAKAHAIDEKHVIIEDSRISKNIDTERSAQERVPLLINIDIEDFFGTITFERVRGMFKSFGYSGYVSSLLAMLCTYCERMPIEVRGEIKYVKTSNRILPQGSPASPMITNIICGKLDKRLSGMALKNNCGYTRYADDMSFSFKQEINKQELRNFIGLTSKIVMEEGFKINHKKTHFLRNNNRQCITGIVINNHEIGVPKKWIKTLRAAIYNSKKLIKSGEKVPMSTINEISGMVSWIKSVNEERYVNIIEEGTNLIKELTYTPYS

SEQ ID NO: 6347 - protein, 520 aa, unidentified
  source 1..520: note = Related to NZ_AP024849.1; note = Clostridium sp.
MIENQETLKNKRQDYREKVNQIGKKEFTLLKMQEYGFWPKNLPTPYEKQENETKEEYAQRKNLIKEYEKIINEISDLYGEKDKINEKLRELKKKYDETWDYEKIRIDVSKTIMEESIARRKERKEQRELEKRQKSEAWVKEKAKGIVFIGKGYSNLLYDKQNDEDKLLSQELPLIEDDKALAEFLGIEYKKLRFLVYHRDVVTVDHYHRFSIPKKKGGERNIAAPKSILKNAQRKILEEILSKVPVSDYAHGFLKGKSVVSGAKAHVAAKADLGEKASGVEKTHDEEKVSGEKTQLLINMDLENFFPTITFERVRGMFKAFGYSGYIASLLAMICTYCERMPIEVRGEIKYVKASNRILPQGSPASPMITNIICVKLDKRLSGLAPKYNCTYTRYADDMSFSFCEENSDLNLGRFMGLVSKIINEEGLKVNKKKTRFLRKNNRQCITGIVINNHEVGVPKKWIKTLRAAIYNANKLTRNGEVVPAKTINEISGMVSWVKSVNGERYSGIIEDGMNLINNI

SEQ ID NO: 6348 - protein, 525 aa, unidentified
  source 1..525: note = Related to NZ_LZZM01000063.1; note = Clostridium puniceum
MIENQENTKNKRQDYREIVNQMGKKEFTLLKMQEYGFWPKNLPTPYERQENETKEEYAQRKSLIKEYEKIINQISELYEGKDKINQKLHELKKKYDETWDYEKIRVDVAKAIMAESIARRKERKEKRALEKRQKGEAWEKRKSESIVFIGKGYSSLLNDKENDNDKLLLQGLPIIKDDKALAEFLGIEYKKLRFLIYHRDVVSVDHYHRFTIPKKKGGERNIAAPKSILKNAQRKVLEDILSKMPVSNYAHGFLKGKSVVSGAKAHVAEKGYLSEETDMVEKAFVVEKVHGTDKVSSENTQLLINMDLENFFPTITFERVRGMFKAFGYSGYISSLLAMICTYCERMAIEVRGEIKYVKTSNRILPQGSPASPMITNIICAKLDKRLSGLAYKHNCTYTRYADDMSFSFKEESSDLNIGRFMGLVSKIVSEEGLNINKKKTRFLRENNRQCITGIVINNDEIGVPKKWIKTLRAAIYNANKLKNNGKEVPVKTINEISGMVSWVKGVNTERYAGIIREGMELIDS

SEQ ID NO: 6349 - protein, 451 aa, unidentified
  source 1..451: note = Related to DPOH01000092.1; note = Clostridium sp.
MMDNNVNNIDRKQNYREAVSVMGKKEFTLLKMQEYGFWPKDLPTPYERQKSETQEEYENRKALLEKYHKVINQINDLCKDKEDINNKLKGLQKKYDDTWDYEKIRKDVAQTIMKESIERRKEVKILREIEKKEKSDAWKKNKSENIVYIGKGYSKWLYLKDTDEEKLKEHEIPIIKDDKELAQFLGIEYRQLRFLTYHRDVVKFDNYTRYTIPKKKGGVRNIAAPKKILKDSQRKILDEILCKIEVSESANGFIQGKSVVSGAESHIDNKVELLINMDLENFFPTITFERVRGMFQKLGYSGYVSSLLAMICTYCERMEMEIKGEKVYVKTTDRILPQGAPSSPMITNIICSKLDKRLKGLADKYGLVYSRYADDMSFSFGEGNIILNAINKYINLNTDKENNQDDLNVGKIIGIISKIIKEEGFNINNQKTKFLRKNNRQSITGIVINND

SEQ ID NO: 6350 - protein, 325 aa, unidentified
  source 1..325: note = Related to FPBY01000301.1; note = Clostridium sp.
MLISSIEYKQLRYLTYHRDVVKFDNYNRYTIPKKKGGVRNIAAPKKVLKGVQRKILDEILKNKIKISDSANGFIKGRSIVSGAEKHKDSNVELLINMDLENFFPTITFERVRGMFMKFGYSGYVSSLLAMICTYCERMEMEVKGENVYVKTSERILPQGSPASPMITNIVCSKLDNRLNGLASKYEFTYSRYADDMSFSFNKGNKVLDDAKDSLNVGKILGIISKIIKEEGFSINEEKTKFLRKNNRQAITGIVINNGEIGVPKKWVKNLRAAVFNGSKLIENGSILPCDLVSEIKGKSSWLSCVNRERYLKIIEECEKIIRFKG

SEQ ID NO: 6351 - protein, 502 aa, unidentified
  source 1..502: note = Related to NZ_CP013238.1; note = Clostridium butyricum
MIENNRNNIDNKQNYRSAVNTMGKKEFTLLKMQEYGFWPENLPTPYEKQSNESPEEFKKRKELLEKYEKIINDINDLYKEKDVINNKLTELKKKYDDTWDYEKIRKDVSQIIMKESIERRKEIKTLRALEKKNKSEAWRKKKSENIVYIGNGYSKGLYKKDTNEEKLLKIGLPIIKDDKELSELLNIEYRQLRFLTYHRDVVKFDNYTRYTIPKKKGGERNIAAPKMILKNAQRKILEEILYKIQISEDAHGFVKGKSIVSGASVHTKNSDIELLINMDLENFFPTITFERVRGMFQNFGYSGYIASLLAMICTYCERMEMKVKGETVYVKTSDRILPQGSPASPMITNIICSRLDKRLNGLALKYDFIYSRYADDMSFSFNKGNMVMEENEHINVDKILGIISKIIREEGFAVNNKKTKFLRNNNRQSITGIVINGTEIGVPKKWVKNLRAAIYNASKLKECGSNIPSDVINEIKGMTAWLECVNKDRYYKIIMKSKELFE

SEQ ID NO: 6352 - protein, 488 aa, unidentified
  source 1..488: note = Related to KB822566.1; note = Clostridium sp.
MDTKSEYRKLINEMGKKEFTFLKMQEYGFWPSHLPTPYERQQNETEQDFQNRKKLLDEFQKLSEQIAQAYKEKREIEIKLSSLQKQYQDTWDYEKIRAVVSQEIMKASIARRAERKAERQRQKQLKTEQWQKRKSENILFIGRGYSNILHKKQTDIQKLKQNNLPILETDKDIAQLLQIEYSTLRYLAYHRDVVTFDNYYRFDVPKKSGGMRHIAAPKTQLKTAQKQILEKILEKTEISDVAHGFIKSKSVLTGAKAHQTSPDLLINIDLENFFPTITFERVRGLFQYLGYSGYISSILAMICTYCERMAVEIKGETKYIKTSERILPQGSPASPMITNMICKRMDKRINGLCQKLGVIYTRYADDMSFSYTGELENFAIGSFLNSIQKIIEAEGFHINKQKTHILRKHNRQYITGIVINNAEIGVTRNWIKILRASIHNAQKLKNAGEAIPKQTKQEISGKIAWLKSVNETRYQKIIQQGKQLLQNS

SEQ ID NO: 6353 - protein, 487 aa, unidentified
  source 1..487: note = Related to nan
MDTRSEYRKLVSEKGKKEFTFLKMQEYGFWPSHLPTPYERQQNETEEDFENRKKLLDEFQKLSDVISKAYTEKNEIEKKLFSLQKEYQNTWDYEKVRAVVAQEIMKESIARRAERKAERERQKQLKTEAWQKRKAENILFIGRGYSNILHKKETDVAKLEQQKLPIIQTDRELANTLGIEYNTLRYLAYHRDVVTFDNYYRFDIPKKSGGTRHIAAPKIQLKMAQRQILEKILQKVEISDVAHGFVKSKSVLTGAKVHHTSPDLLINMDLENFFPTITFERVRGLYQHLGYSGYIASLLAMICTYCERMPVEIKGETKYIKTSERILPQGSPASPMITNIICHRMDKRIYGLCQKLGVTYTRYADDMSFSYIGELENFAIGSFLNSIQKIIESEGFHINKQKTNILRKHNRQYITGIVINNDEIGVARKWVKILRASIHNAQKLKNAGEAIPHKTKMEIAGKIAWLKSVNEKRYHKMIQQGMELLKS

SEQ ID NO: 6354 - protein, 489 aa, unidentified
  source 1..489: note = Lachnospiraceae bacterium; note = Related to DNJX01000261.1
MDRKAEYRNLVKNMGKKEFTFLKMQEYGFWPENLPTPYERQQNETEQDFENRKKLLDEFQKLSEKISGVYQEKSEIERKLSQLKKEYQGTWDYERIRAAVAQEIMKESIARRAERKAERERQKQLKSEAWKKRKAENIIFIGKGYSNLLGKKETDVQKLKENQMPVIETDRELARFLQIEYNTLRYLVYHRDVVTFDNYYRFDIPKKSGGMRHIAAPKTHLKTAQRQILDQILQKAGISDLSHGFIKSRSVLTGARAHSTSPDLLINIDLEDFFPTITFERVRGLYQSFGYSGYIASLLAMICTYCERMPLEIKGETKYIKTSGRILPQGSPASPMITNIICRNMDKRINGLCKKLGITYTRYADDMSFSYIGDTSGFAIGSFLNSINTIIEAEGFHMKKEKTHILRRNNRQYITGIVINNEEIGVPKKWVKILKASIHNAQKLKASGGCVSNKTINEISGKIAWLKSVNAKRYQKVIDQGTEFLKSLT

SEQ ID NO: 6355 - protein, 489 aa, unidentified
  source 1..489: note = Lachnospiraceae bacterium A2; note = Related to KE159636.1
MDTKAEYRELVNNMGKKEFTFQKMQEYGFWPSHLPTPYERQQHETQEDFEKRQKLLGEFQELSEKIAGAYREKTEIEKKLSHLKKAYEGTWDYEKIRAAVAQDIMKESIARRAERKAERERQKQLKSEAWNKRKAEQILFIGKGYSSLLGKKETDTEKLKALQMPVIETDRELANALGIEYSALRYLAYHRDVVAFDNYYRFEIPKKSGGTRQIAAPKTQLKAAQKQILTQILQKAEISDKSHGFVPSRSVLTSAKTHSTSPDVLINIDLENFFPTITFARVRGLFQSFGYSGYTASLLAMICTYCERMPLEVKGEMKYIKTSGRILPQGSPASPMITNIICRNMDKRISGLCQKLGVTYTRYADDMSFSYTGSEDGLAIGSFLNSLTKIIEAEGFHIKQEKTHILRKNNRQYITGIVINSEEIGVPRKWVKILKASIHNAQKLKESGGSVPNKTIYEISGKIAWLKSVNAKRYEKIIRQGTEFLKTLA

SEQ ID NO: 6356 - protein, 487 aa, unidentified
  source 1..487: note = Candidatus Coprocola pullicola; note = Related to DVLQ01000214.1
MDTKSEYRKQVNEMGKKEFTFLKMQEYGFWPSHLPTPYERQQNESAEDFENRKQLLDAFEKLSEQIAQAYQKKQEIEKKLSSLKKQYQNTLDYEKIRSIVAQEIMKQSIAKRAERKAEREKQKQLKSEAWQKKKAETIVFIGKEYSSLLAKKETDIQKLEKNHLPIIQTDKDLADLLQIEYKTLRYLVYHRDVITFDNYYRFDIPKKSGGTRHIAAPKTHLKTAQRQVLEQILQKVEVSDAAHGFIKSKSVLTGAKMHPTSPDLLINIDLEDFFPTITFERVRGMYQSLGYSGYIASLLAMLCTYCERMPLEIKGEIKYIKTSQRILPQGSPASPMITNIICQKMDKRIHGLCKKLGFTYTRYADDMSFSYTGQTDNLAIGSFLNSIHKIIESEGFHIKKEKTHILKKNNRQYITGVVINHKEIGVPRKWVKILRASIYNAQKLKNAGTAVPTKTKQEIAGKIAWLKTVNETRYQKMIQQGTELLKH

SEQ ID NO: 6357 - protein, 487 aa, unidentified
  source 1..487: note = Related to NFLT01000012.1; note = Proposed Tyzzerella sp.
MDTRTEYREQVNKMGKKEFTFQKMQEYGFWPSHLPTPYERQQNETEEDFENRKKLLDEFNKLSEQISEVYKEKREIDIKLSSLKKEYQDTWDYEKIRAVVCQEIMKESIARRAERKAERERQKQLKSEAWNKKKAENIIFIGRGYSGLLSQKETNIEKLEKNNLPIIENDKDLATLLQVEYKTLRYLTYHRDVVTFDNYYRFDIPKKSGGKRHIAAPKTELKKAQRQILEEILEKIEVSEFAHGFIKSKSVVTGAKFHKSGPDLLINMDLENFFPTITFERVRGLFQSLGYSGYISSLLAMICTYCERIPVEIKGETKYIKTSERILPQGSPASPMITNIICNKMDKRINGLCKKLGFTYTRYADDMSFSYIGDTENLAVGSFLNSIKKIIEDEGFNIKKEKTHILRKNNRQYITGIVINNEEIGVPRKWVDILRASIHNAEKLKNSGESIPKETKMEIKGRIAWLKSVNEERYKKIIDKGLKLLEN

SEQ ID NO: 6358 - protein, 495 aa, unidentified
  source 1..495: note = Related to NC_015275.1; note = Cellulosilyticum lentocellum
MIDQTHSQNQRQSYRSEVSQKGKKEFTLLKMQEYGFWPKNLPTPYEKQKAETKEDYEKRKALLKEYDKLSNDLANLYGEKEAINLKLQELKKKYTATWDYEKIRQDIAKTIMAESIARRAERKKEREVAQAEKSAAWQKAKTENIVFIGKGYSSGLQDKLTHTSKLESLGLPLIETDHQLASFLGLTYTELRFLTYHRDVVTSDHYYRYEIPKKKGGFRQIAAPKPLLKQVQRKILVEILEKLPIAEEAHGFIKNRSVVSSAEAHIKAPTLLITMDLENFFPTLTFERVRGMYKSFGYSGYIASLLAMLCTYCERMTIEVSGTTKYVKTSPRILPQGSPASPMITNIICKNLDHRLKGLSATYQLTYSRYADDMSFSYNEAEENLKLGQFLGLVSLIVEDEGFHIKASKTKILRPHNRQCLTGIVINNEEIGVPKKWVKNLRAAIHHAKLLNQTGQPIPTSLSQEIQGKTSWLKSVNPERYKTIIEAGLSVIAHF

SEQ ID NO: 6359 - protein, 504 aa, unidentified
  source 1..504: note = Related to NZ_FQZB01000006.1; note = Clostridium cavendishii
MMDSSSAKRENYRDMVGKLGKKEFTLLKMQEYGFWPKDLPTPYEIQKNESPESYAKRKKLLKEYEKIIDNIAKVYEEKDTINDKLKELKKKYDETWDYEKIRLDVAQQIFKESIERRENRKRLKEEERIKRSNIWKQKKSENIVFIGKGYSNLLKDKESNKDKLLKNGLPIIEDDKALAEFLRLDYSQLRFLAYHRDVTTCDNYYRYIVPKRNGKLRNIAAPKSVLKFSQKRILEDILGKLEVSKNAHGFLKEKSVITGALAHGTGIDLLINMDLEDFFQTITFERVRGMFKSFGYSGYISSLLAILCTYCERMEIEVKGEKKYVATSRRVLPQGSPASPMITNILCLRLDKRLEGLASKYGFLYTRYADDMSFSLEDKSKLLLFKEEKVDKESENKEINKFLGLASKIIIEEGFKINKSKTKFLRKNNRQYITGIVINNKEIGVPKKWVRNLRATIHNASKLKINGDIPDELVNEISGKVAWLRSVNGERYKAIIEKAMEVIK

SEQ ID NO: 6360 - protein, 496 aa, unidentified
  source 1..496: note = Clostridiales bacterium; note = Related to JAAYMT010000202.1
MIENRHQSTANYRKSIEIMGKREFTLLKMQEYGFWPKNLPTPYERQANESEEEFEARQKLTKKYEKLGEDIAKLYEEKEKIEEKLRQLKKEYNDTWDLDKIRKDVARKIMEESKARRAERKRQRELEKKQRSEAWNKRKQEEIVFIGKGYSQLLQQRESDDDKLSKLTLPIVKTDRELAELLGIEYAQLRFITYHRDVVTEDHYHRYAVPKRKGGYRNIAAPKPILRKAQRKILDEILCKIPVSDCAHGFIKGKSVVSSASEHIGSPALVINMDLEDFFPTITFERVRGMFKSFGYSGYIASLLAMICTYCERMPMEVKGEKRYVRTSPRILPQGSPASSMISNILCIKLDKRLSGLAKKNNFTYTRYADDMSFSLKGEEKIKLGSFCGLVSKIASEEGFKINKSKTRFLRANNRQSITGIVVNNEKLAVPKKWVKVLRAAIHNAKKEKEKGELAPQTIRKISGMAAWLKSVNEEKYKKIISEANELINRCQKSDV

SEQ ID NO: 6361 - protein, 493 aa, unidentified
  source 1..493: note = Clostridiaceae bacterium; note = Related to JACMJL010000131.1
MTENNELLQNKKADYRESVNNMGKKEFTLLKMQEYGFWPKDLPTPYERQDDETPEQHKERQTLLKEYQKIIDNIAKLYEQKDEINKRFQELRKEYDETWDVDKIRLDISKKIMEESITRRSERKKRKELEKQQQAEIWQKKRAEEILFIGKGYSQLLQDRSSDDNKLSTQGLPLIKTDKELAEFLGVEYKQLRFLVYHRDVISVDHYHRYTVPKRRGGVRNIAAPKPMLKTIQRKILEEILSKLTVSEYAHGFLKGKSVVSGAQAHIGQHTLLINMDLENFFPTITFERVRGMFMAFGYSGYISSLLAMLCTYCERMAIEVRGEIRYVKTSPRILPQGSPASPMITNIICVKLDRRLSGLAERTGYIYTRYADDMSFSLKEENYMDEGKLCGLVSKIVNEEGFKLNKTKTRFLRKNNRQCITGIVINSEQLGVPRKWIRAFRAAVHNANKLKLTGTVPSKVKNEISGMAAWAKSVNAERYKEVIAAAIAVIQD

SEQ ID NO: 6362 - protein, 512 aa, unidentified
  source 1..512: note = Related to NZ_LGTC01000001.1; note = Pseudobacteroides cellulosolvens
MMDNNIERDRRAEYRDNVQSMGKKEFTIYKMIEYGFWPKGLPTPFERQANETPEQYQERQRLFSEYKKIADEIAKVYKEKSEIDTKLRELKTQYNGSWDEERIRKDIAQRIMKESKERREQRKKQLELAKEQKSSAWKKKKEDSIVYIGNGYSSMLHYKSGNQDRLVANGLPIINTDRELADFLGVEYRALRFLVYHRDVVTMDHYHHYKVPKRKGGTRNIAAPKKVLKNVQKKILEGILEKLACQDNDCLGNNRFSNACSDNAHGFIKGRSVVTGADIHVKSPALLINMDIEDFFPTITFQRVRGMFVGFGYSGYIASLLAMLCTYCERMEIEVNGKRKFVATTGRILPQGSPASPMITNILCRSLDKRLNGLASKFGFIYTRYADDMSFSTKETVLADAGKLCGLVTKIISDEGFKLNFKKTRFLKKNNCQSITGVVVNSHQLGVSKKWVKTLRAAIYNARKAMAKGKVPYEIVSEISGMAAWLKCVNEERYKSIITDAYDLIRDINKII

SEQ ID NO: 6363 - protein, 494 aa, unidentified
  source 1..494: note = Related to MWAJ01001053.1; note = Firmicutes bacterium ADurb.Bin419
MIENNRVPKDKKANYRELVNQMGKKEFTLLKMQEYGFWPKDLPTPYEIQKNETPERYAKRQGLLKEYQRLIDQIAKLYEEKDDINKKLWELKKEYDDTWDLEKIRLDISQKIMRESIERRAERKKQRELEKQKRSLDWQQKKSEQIVFIGRGYSSLMNDTQIDEEKLKTQELPIIKTDRDLAEVLGIDYPSLRFLTYHREVVSVDHYHHFKIPKKKGGERSISAPKSKLKTAQRAILEKILSKLNISDQAHGFLKGRSVVSGAQTHISQPALLINMDLEDFFPTLTFERVLGMFRAFGYSGYISSLIAMLCTYCERMEIEVKGKPKYVATSKRILPQGSPASPMITNIICRDLDKRLNGLAKSFGFIYTRYADDMSFSINEVSDLNEGRFCGLVSKIVSEEGFKINKAKTRYLRKNNCQSVTGIVVNNDQLAVRKKWVKRFRAAIYNARKQKAAGELSNATKNEISGMAAWLKSVNEEKYRDMIGAVMDIVKED

SEQ ID NO: 6364 - protein, 486 aa, unidentified
  source 1..486: note = Candidatus Lokiarchaeota archaeon; note = Related to JAFGGO010000116.1
MTENTKQDYRTLINQMGKKEFTIMKMQEYGFWPKDLPTPYEKQLNETPEQYSKRKALVEDYKSIIERISKLYKEKQEINDKLRDLRKKYDETWDIERIRKDIAQTIMKESIARRTEKKKQRELEKHAKSEAWKKKKAEQIIFIGKGYSSFLYDNETDQPKLELQGLPVIKSDIDLANFLEIDYKKLRFLSYHRDVVTVDHYHRYTIPKRKGGMRNIAAPKPILKSVQRKILEDILNKFSLSQQAHGFIKERSILSGALAHNIQPALVINMDIENFFPTISFERVRGMFKSAGYSGFISSLLAMLCTYCERVSIEVKNKTRFIATTKRILPQGSPASPMITNIICRRLDQRLNGLASKFGFTYTRYADDMSFSINDETNVKVGRFYGLVSKIVKDEGFEINKEKTRFLRKNNRQSITGVVVNNEKLGVNRMWMRRFRAAIHNASKLRSNGDLPIEVKRELSGMASWVRSVNPERYKKLIETAMEVIK

SEQ ID NO: 6365 - protein, 496 aa, unidentified
  source 1..496: note = Related to SHMU01000007.1; note = Candidatus Lokiarchaeota archaeon
MTESNDIQKRTKSDYREMINKMGKKEFTLMKMQEYGFWPKDLPTPYERQENETKEHYEARKQLLKKYKGIVDQIADLYQEKADINKKLRDLQKQYDETWDIEKIRKDVAKQILKESVTRRAERKRQKELEKQRRSEAWKKKKAETIVFLGKGYSSFLNHFETDESALQSFQLPIIKTDKDLAEFLNIDYKKLRFITYHRDVVDIDHYFRYTIPKASGGKRLIAAPKNILKSAQRTILNDILTNIPIDEHAHGFLQGKSIITGAKSHPIQPELLINMDLEEFFPSITFERVRGMFHSFGYCGHVSTLLAMICTYCERIPLEIKDKEKYVAVSKRILPQGSPASPMITNIICYKLDRRLSGLAKTFNLTYSRYADDMSFSLKDKNEAEVNISRFLGLAMIIIKDEGFKINHNKTRFLRQNNRQAITGIVINKDRIGVPRKWIKQFRAAIYNAEQLQTNGGLPGEIKREIAGMASWVKSVNPERYKKYLTRAHNLLSEK

SEQ ID NO: 6366 - protein, 449 aa, unidentified
  source 1..449: note = Related to NZ_JAALJI010000007.1; note = Paludisphaera sp.
MAIQRQTDPSDLWRAIIQAGGIQPYIDAQLAERGFLVARRETDGLSERELADYKKSLKAEAQERARLRREAWAAYRAEHIVHLGDGVYWNDEPGPDKWDLPNAEERAAENELPPLDSPRQLADALGLTIPQLRWLAFHREAATRIHYRRFTIPKRDGSERAIWAPMPRLKRAQHWILRNVAEKLPVHGAVHGFVAGRSILSNASAHHDPKVAVRIDLKDFFPTVTLRRVKGLFRKAGYREHVATLLALICTESPREIVQNEGATYYVALGPRCLPQGAPTSPALTNALCLRLDRRLSGLARRQGWRYTRYADDLTFSRPSDFGGPPAIGKLLGSVRRIVEAEGFAVHDGKTAIRRRGGRQAITGLVVNGDRPPRATREFKRNLRAAIHNLESGRATPEAEPPQVLVGRAAFVAMSDPALGLSLLDRLSRATERDGSGDDSRSEPPRPES

SEQ ID NO: 6367 - protein, 437 aa, unidentified
  source 1..437: note = Related to NZ_JAHPZK010000021.1; note = Paludisphaera sp.
MAMQRQTNPFDLWRSIVQAGGIQPYINAQLSERGFLVARRETDGMSERELADYKKSLKAEAAERRRLRREAWAAFRAEHIVHLGDGVYWSDEPGPDRWDQPNAEVRAAENELPPLDSPRQLAEALGLTIPQLRWLAFHRDAARRIHYRRFTIPKRDGSERAIWAPMPRLKRAQHWILRNIAEKLPVHGAAHGFLPGRSILSNAAPHCDSKVVVRIDLKDFFPTVTLRRVKGLFRKAGYREHVATLLALICTESPREIVEQDGETYYVALGPRCLPQGAPTSPAITNALCLRLDQRLSGVARSQGWRYTRYADDLTFSRPADSKEAPGIGRLLGTVRRVVGDEGFTIHDKKTAVGHNGGRQRVTGLIVNGDRTPRAPREFRRNLRAAIHNLVTGKESPSAEPPSVLAGRAAFVAMTDPSLGRAMLERLSQAVERSPEA

SEQ ID NO: 6368 - protein, 434 aa, unidentified
  source 1..434: note = Related to CP003364.1; note = Singulisphaera acidiphila
MSRTTSRTNDPMTLWRAIEQAGGTQAYVEAQLAERGFLVKRRETDKMSERELDAYKKSLKAEAKEKRALQADAWRAYKTSHIVYLGEGIFWKDDPGGPDKWDLPHAEERAAENELPPLDSPRQLAEALELSLSELRWLAFHRDAATRIHYRRFTIPKRDGSERAIWAPMPKLKSAQHWILRNIAEKLLVHGSVHGFLPGRSTLTNAAAHANPKVVVKMDIKDFFPTVTLPRVRGIFRKAGYREQVATLLALICTESPREVVEHDGQTYYIALGPRCLPQGAPTSPALTNTLCLRMDQRLSALAKRFGWRYTRYADDLTFSLPHDHKDQPRLGALVGTVRRVVEAEGFTIHPSKTRVARSGARQTITGLVVNGDQAPRAPRKFRRELRAAIHNSRNGKPLHEGESPTTLAGSAAYVYMTDPELGAKLLDAIKQEA

SEQ ID NO: 6369 - protein, 439 aa, unidentified
  source 1..439: note = Related to NZ_WEZF01000007.1; note = Tautonia sp.
MSRATDLLSLWRAIEHAGGIDAYVNTQLAERGFLVARRDVDTMSDRERTAYKKQLKEEAAHRRELKREAWKAYRARHIVHLGEGIYWNDQATKDPWDAPDAEERAAENELPPLDSPRDLAEALGLTISQLRWLAFHRDAATSIHYRRFTIPKRDGSERAIWAPLPTLKAAQHWILRNIAEKLPVHGAAHGFLAGRSILSNASNHVDSALVVKMDLKDFFPSVTFRRVKGIFRRAGYREQVATLLALICTEAPREIVEQGKTTYYVALGPRALPQGAPTSPALTNTLCLRLDRRLDGLAQSLGYRYTRYADDLTFSLPRSHEGDPKLGTLLGKARRVVESEGFTVRLEKTRVARPGARQQVTGLVVNGAASPRTPRTLRRQLRAAVHNLQTGKPRPDADTPERLAGLISYVAMTDPTLGQALQAQWTNPSKPTSSDDSPS

SEQ ID NO: 6370 - protein, 431 aa, unidentified
  source 1..431: note = Related to NZ_CP036426.1; note = Tautonia plasticadhaerens
MSRTTDLTSLWRAIERAGGIDSYVNGQLSERGFLVERREIDTLSDREREAYKKQLKEEAARRLELRREAWQAYKARHIVHLGEGIFWDDHATEDKWDAPDAEERAAENELPPLDGPRDLAEALGLTIPQLRWLAFHRDAATSIHYARFTVAKRDGSERAIWAPMPTLKAAQRWILRNISEKLPIHGASHGFLPGRSIKSNAQEHVGSKLVLKMDLADFFPSVTYPRVRGIFRRAGYREQVSTLLALICTEAPREVVEEGGTTYYVALGPRCLPQGAPTSPSLTNTLCLRLDRRLSGLARSLGWRYTRYADDLTFSLPASHGGEPRLGALLGGARRVVESEGFAVRLDKTRVARAGARQQVTGLVVNGEGPARVPRRLRRQLRAAAHNLEVGRAGPDADPVDRLAGLASFVCMTDPALGAALLGRLRGGSAG

SEQ ID NO: 6371 - protein, 302 aa, unidentified
  source 1..302: note = Related to JAIENG010000522.1; note = Gemmataceae bacterium
RWLAYHRDAATKLHYRRFVIPKRGGGERAIWAPMPLLKAAQHWILRNVAERLPVHGAAHGFLAGRSILSNAAAHPDARIILKMDIKEFFPTVSLTRVKGIFRKAGYREQVATLMALICTEAPREVVERDGKTWYVSLGPRCLPQGAPTSPALTNTLCLRLDRRLAGLAAKLGWRYTRYADDLTFSLPDGHKDEPKTGPLMGFVKRIVAAEGFAVHPDKTSVRRKGGRQQVTGLVVNGGGPPRVTRDLKRRLRAAAHNLARGKGLKEGETPARLEGFAAYVHMTDEKLGGKLLAAFRGGVRQG

SEQ ID NO: 6372 - protein, 466 aa, unidentified
  source 1..466: note = Related to JAHJCH010000128.1; note = Myxococcota bacterium
MNQTNQDPRPSVDLGALWRAIEQAGSIQAYVNQQLSARGYLIERRDTARMSAAELKRYKQQLKDEAVEKRRLKAEAWAAYKAAHIVHLGEGIFFNEENDFDRFDLREPEARAAENELPTLDKPAQLAEALGLSVSELRWLTFHREAAESIHYQRFTIPKRRGGEREIWAPMPKLKAAQRWVMREIVEHLPVHGAAHGFIAGRSILTNAQVHLNAEILVNFDLQDFFPTVTWRRVKGVFRKAGYREQVATLLALLCTEPPREVIEHEGKRYYIALGQRCLPQGAPTSPAITNALCLRLDRRLSGLARSLGWRYTRYADDLTFSLPASEAKPKAKKGKAKPTKAKPTKAKKAQGALTGEAALARLMGGVKAIVAAEGFALNPDKTAIKRPSGRQGVTGLVVNGDGSPRVPREVRRRLRAALHNLERGQPLREGESYAHLAGLAAFVYMTDPALGGALLKRIGALARQG

SEQ ID NO: 6373 - protein, 433 aa, unidentified
  source 1..433: note = Myxococcales bacterium; note = Related to JACKDP010000006.1
MATRPNLVTQWVELWGAIARAGGIDAYITAQLTERGYLAKRRSTDGMSAAELKRYKAELKREAAERRKLKADAWQAYRASHIVHLGEGVFFNDDLDFDAFDLAEPEARAAENELPKLDKPQQVADALGMTLAELRWLSFHREAATGVHYRRFEIRKRSGGMRAIWAPLPRLKAAQRWILREIVEHLPVHGAAHGFLAGRSILTNAQAHTGSKLILNVDLKDFFPSVTWRRVKGLFRKAGYRDQVATLLALLCTEAPREIVEHEGEKLFIALGPRCLPQGAPTSPAITNALCMRLDRRLAGLARSLGWRYTRYADDLTFSLPADHKGAPGLSKLLGALHAVVAAEGFAVNPAKTRVSRPGARQKVTGLVVNGDAAPRVPRALRRKLRAAAHNLAQGKPLPAGESVAQLAGYAAFVHMTDPVLGAALLGKFGEHR

SEQ ID NO: 6374 - protein, 436 aa, unidentified
  source 1..436: note = Myxococcales bacterium; note = Related to JACKDL010000029.1
MATRPNDRQALWAAIARAGGIDAYVQAQLVAGGFAAERKPTDGMSKRELARYKAELKAEAAEKKRLKAEAWAAYKATHIVHLGEGVYFNDADDFDRFDLAEPEARLAENGLPRIDDPQALAEALALSVPTLRWLTFHRDAATMLHYRRFTIPKKSGGERAIWAPMDTLKSAQRWVLRHIVEPLPVHGAAHGFVPGRGIVSNAQAHSEARILINVDLKDFFPTVTVRRVKGVFRKAGYREQVATLLAMLCTEAPREVVRHGETDYFIALGPRCLPQGAPTSPALTNTLCLRLDRRLSGLARQRGWRYTRYADDLTFSLPVKAAKGADGNVGTLLGAVRAIVEAEGFALNPKKTRICRPGGRQKVTGLIVNGAEPPRAPRALRRMLRAAVHNLEQGKPLPEGETVARLAGYAAFIYQTNPQEGAELLRRFAAFAGEQA

SEQ ID NO: 6375 - protein, 433 aa, unidentified
  source 1..433: note = Myxococcales bacterium; note = Related to JAHQVJ010000095.1
MSTRTTDLAALWLAIAEAGGIDNYVQNQLVEHGFLVERRETDTMSKAELKRYKAQLKREAAERRELRKAAWAAYRETHIVHLGDGVYYNDAATMDRWDLDEPEARAAANELPRLDGPDDLAKELGITVAQLRWLAVHRDAATRIHYTRFTIPKRDGSERAIWAPLPRLKAAQRWILRNVVEHLPVHGAAHGFLAGRSVVTNAAAHVGSKLIVNIDLKDFFPTITWRRARGMFRKAGYREQVATLLAMICTEAPREVVEWEGQSYFVALGPRCLPQGAPTSPAITNTICLRLDRRLSGLARRFGYTYTRYADDLTFSLPLAHTGEPRVGALIGAVGHIVRAEGFQVHPSKTRVQHTGRRQQVTGLVVNGREQPRVPRSLKRQLRAAVYNLRRGRPLPAGERFERLIGYAAWIHQAEPELGSELLAALGGLNPTA

SEQ ID NO: 6376 - protein, 370 aa, unidentified
  source 1..370: note = Proteobacteria bacterium; note = Related to JABGPD010002235.1
MAALWRGIDEAGSCENWVQQQLVEHGFIVSRRDTDNMSKRELANYKKQLKREAAEKKALKKKAWEAYKANHILHLGEGDWWNDAATFDKWDLPEPEARAAENELPQLDSPDDLAEALGLTIKELRWLSFHRDAAKTIHYRRFTIPKRNGSKRPIWAPLPKLKEAQRWILHNIVEHLPVHGAAHGFLTGRGIVTNARPHGGSALLLNIDLKEFFPTVTWRRVRGVFRKAGYREQVATLLALICTEAPREVVEFNGETWYVALGPRCLPQGAPTSPALTNTICLRLDRRLSGLAKKNGYTYTRYADDLTFSLPHGFTGPPKTGMLIGAVKKIVVAEGFAVNPDKTRVLRSGGRQQVTGLVVNGPRGPRVPRK

SEQ ID NO: 6377 - protein, 439 aa, unidentified
  source 1..439: note = Gemmataceae bacterium; note = Related to LR594586.1
MTTAPVAPAPSADPQVLWRLIVQAGGMKAYIDGQLKEKGFLVTRRDADSMSDREKDGYKKALKQEADERRKLRRETWGAYKANHIVHLGEGVFWSDDLAPDKWDTPNSEERAAENELPAIDRPEQLAELLGVTIPQLKGLAYHRDAATSLHYVRFTIPKRDGTERPIWAPKKRLKAAQRWILHNIVERLPVHGAAQGFLVGRSILSNAAVHANAKAILKMDIKEFFPTVTVRRVKGVFRRAGYRDGISTLLALICTEAPREVVEVEGETYYVSLGPRCLPQGAPTSPSLTNALCMRLDRRLEGLAKKLGWRYTRYADDLTFSLPAEHKGKPRLGTMIGCVTRIVAAEGFEVKAEKTRVHRTGGRQSVTGLVVNGDGPPRVSRTVRRQLRSAVHKLKTGKPLKEGESLARLSGYAAFVYMTNPDLGKKLLADINGATGAG

SEQ ID NO: 6378 - protein, 442 aa, unidentified
  source 1..442: note = Related to NZ_JAGKQQ010000001.1; note = Gemmata sp.
MSTTTPAPSPDAQTLWRLIVQAGGMKAYIDGQLRERGFLVTRRDADAMSDREKDAYKKALKQEAEERRKLRRETWGAYRANHIVHLGEGVFWTDEPKEDKWDTPNSEERAAENELPALDKAEQLAEALGVTIPQLKGMAYHRDAATSLHYVRFTIPKRDGTERPIWAPKKRLKAAQRWILHHIVERLPVHGAAQGFLVGRSILSNALVHENPKILLKMDIKEFFPTVTVKRVKGVFRRAGYRDGISTLLAQICTEAPREIVNVEGKTYYVSLGPRCLPQGAPTSPAITNALCLRLDRRLAGLAKRYGWRYTRYADDLTFSLPMEHKGQPKLGSMLGCARRIVEAEGFEVKTEKTRVHRTGGRQSVTGLVVNGDNTPRTPRKLRRQLRSALHKLKTGKPLKDGESLARLTGYAAFVYMTNQELGRKMLADLHGFEDKPEGPAV

SEQ ID NO: 6379 - protein, 437 aa, unidentified
  source 1..437: note = Related to PNKH01000078.1; note = Isosphaera sp.
MTTAAPAPPPTAPDLATLWRLIVQAGGMKAYVDARLEERGFLVVRRDADAMSDREKDAYKKELKQEAEERRKLRREAWAAYKANHVVHLGEGVFWTDEVREDKWDTPNSEERAAENELPALDKPEQLAEALGVTVPQLRGMAYHRDAATSLHYVRFTIPKRDGTERPIWAPKKRLKAAQRWILQNIVERLPVHGAAQGFLAGRSILTNAAVHVNAKIILKMDIKEFFPTVTVRRVKGVFRRAGYRDGIATLLSQICTEAPREVVELDGKTYYVSLGPRCLPQGAPTSPALTNALCLRLDRRLAGLAKRYGWRYTRYADDMTFSLPAEHAGPPKLGAVMGCVRRIVAAEGFEVKDDKTRVHRTGGRQAVTGLVVNGDGEPRASRTLRRQLRSAIHKLKTGKPLKEGETVARLHGYAAFVYMTDPKLGKKLLADLNGVE

SEQ ID NO: 6380 - protein, 434 aa, unidentified
  source 1..434: note = Related to NZ_JH636447.1; note = Zavarzinella formosa
MATTTTDPIALWQSILQAGGVRAYIDGQLKERGFLVERRDTDAMSDREKDQYKKALKQEAAERKKLKKEAWAAYKTAHIVHLGDGVYWSDESKPDKWDTPNSEERAAENELPALDSPKQLAEALGLTIPQLRGMCHHRDAATKLHYVRFTIPKRDGKPRPIWAPLPKLKAAQRWILHNIVERLPVHGSAQGFLVGRSTLSNAAVHTNAKILLKMDVTDFFPTVTWRRVRGVFRRAGYREQIATLLALICTEAPREIVQHDGKTYYVSLGARCLPQGAPTSPSLTNALCLRLDRRLTALAAKLGWRYSRYADDMTFSLPADHAGKPQLGKLLGCVKRVVTAEGFEVKDEKTRVHRKGGNQSVTGLVVNGDGTPRTPRKVRRELRAAIHNLEKGKPLKEGETLPRLMGMAAYVYMTDAKRGKELLTALRRFAAGES

SEQ ID NO: 6381 - protein, 431 aa, unidentified
  source 1..431: note = Related to NZ_NIDE01000001.1; note = Fimbriiglobus ruber
MNSTRPDPLTLWRQITQAGGTQAYVTEQLRERGFLVERRDVEGMSDREKDQYKKALKQEAIETKKLRREAWAAYKAAHVVHLGEGVFWTDGAKPDKWDTPNGPERAAENELPPLDTPEQLAEALGITLAQLRGLCYHRDAATSIHYVRFAIPKRDGSERPIWAPLPRLKAAQRWILHNIVERLPVHGAAHGFLAGRSIATNAAAHASAKMILKMDVKEFFPTVTWRRVRGVFRRAGYNESIATLLALICTEAPREVVDLEGTTYYVSLGPRCLPQGAPTSPALTNALCLRLDRRLTGLAAKLGWRYTRYADDMTFSLPAAHAGPPKLGALLGCVKRVVEGEGFRVHADKTRVARSGGRQTVTGLVVNGTSQPRVSRKLKREMRAAVHNLGKGKPLPEGESVARLLGYAAYIYMTDPETGRKLLADLNAIPD

SEQ ID NO: 6382 - protein, 428 aa, unidentified
  source 1..428: note = Related to NZ_CP036273.1; note = Urbifossiella limnaea
MTTPRTDPLTLWRQIDQAGGVRAFVDAQLRERGFLVERRDADKMSDREKDQYKTALKQEAAERKTLAREAWKAYQAAHIVHLGDGIYWSDDATPDKWDTPNSEERAAENELPPLDSPAQLAEALGVTVAQLRGLTYHRDAATSLHYCRFAIPKRDGSERPIWAPLPRLKAAQAWVLHNVVERLPVHGAAHGFLAGRSTLTNAAVHTNANLVLKMDVKEFFPTVTWRRVKGVFRRAGYRERVATLLALLCTESPREVVQLDGTTYYVSLGPRCLPQGAPTSPALTNALCLRLDRRLTGLAAKLGWRYTRYADDLTFSLPAAHVGPPRLGAMIGCVTRVVETEGFRIHPEKTRVARPGGRQAVTGLVVNGDAAPRAPRALRRQLRAALHNRKVGKPRPDGDTEAQLHGLAAYIYMTDPVLGRKLLAEIDG

SEQ ID NO: 6383 - protein, 434 aa, unidentified
  source 1..434: note = Related to JAEUIF010000535.1; note = Planctomycetia bacterium
MTMTRIADPLTLWRNVVQAGGRQAYIAAQLEQRGFLVARRETDGMSERELAQYKQSLKAEAAERRKLRQEAWLAYRANHIVHLGDGVYWHDEATKDRWDLPYAEERAAENELPALDSPQQLADALGLTVAQLRWLVFHREAATRIHYHRFTIAKRDGSERPIWAPCKKLKAAQRWVLRNIVEKLLIHGAAHGFTAGCSVLSNARQHTNSRIVVKLDIRGFFPTVTLPRVRGVFRRAGYRDQLATLLALLCTEAPREVVEQNGQTYYIALGPRCLPQGAPTSPALTNALCLRLDRRLTGLAHQLGWRYTRYADDMTFSLPAGHTGAPRLGTLLGIVQRIVEEEGFRLHPDKTHVARASSRQKVTGLVVNGDGVPRVSRKLRRELRAAAHRLKHGKPLKEGESLARLAGYAAYIHMSDPQRGAALLAAFKSAAPAT

SEQ ID NO: 6384 - protein, 435 aa, unidentified
  source 1..435: note = Related to CP016211.1; note = Minicystis rosea
MMTTRSDYQRLFDLWRAIGQAGGVNAYVQQQLRERGFVLERKKTDGMSKAELSAYKKSLKEEAAERRRLKKEAWQAYRATHIVHLGEGIFWNDESDLDKWDHPHAAERAAENELPPIDSPQKLAEAMGLSLPDLRFLSFHREAAESIHYRRFTIPKRNGSERAIWAPLPKLKAAQHWILRNVVERLAVHGASHGFLADRSIATNAAAHTGAKIVVKVDLKDFFPTVTLRRVKGIFRRAGYRDQIATLLALICTEAPREIVEHEGKQYYVALGPRCLPQGAPTSPALTNTLCQRLDRRLAGLAKRLGWRYTRYADDLTFSLPESHKDKPKLGVLLGSVGRIANDEGFQVHPDKTNVARKGSRQKVTGLVVNGTGAPRVPRALKRQIRAAIHNAGRGKPLQAGESLSRLAGYAAYIHMTDPKLGAKLLQQLAAIEAK

SEQ ID NO: 6385 - protein, 433 aa, unidentified
  source 1..433: note = Related to JACKED010000003.1; note = Sandaracinus sp.
MTRSEHQRLVDLWRAIGNAGGVDAYVRGQLRERGFVLERKDTAQMSKAQLAAYKKSLKEEAAERRRLKKEAWVAYRATHLVHLGEGIHWSDEADVDRFDHPRAEERAAENELPPFDKPEQLAEALGLSIPELRWLAFHRDAAEKIHYRRFTIPKRDGSERAIWAPLPKLKAAQRWILRNVLEPIPIHGASHGFVPNRSILSNASRHTGAKLVVKIDLKDFFPTISFRRVKGVFRQAGYRDRIATLLALLCTEAPREIVQDGDKELFVALGPRCLPQGAPTSPAITNIVCFRLDRRLTGLAKKLGWRYTRYADDLTFSLPAEHVGAPKLGLLLGSVGRVVADEGFRVHPRKTRVARSGGRQAVTGLVVNGAASPRVPREIRREIRAVLHNLKHGKPLRDGENLHRIAGYVAYVHMTNPELGKSLRKQLEALDAV

SEQ ID NO: 6386 - protein, 445 aa, unidentified
  source 1..445: note = Related to nan
MATSTDYSRLVDLWQGIDRAGGIDNYVQKQLKERGYVVERKATDEMSRVELSRYKKALKAEAAERRNLQKESWLAYRATHIVHLGEGIFWNDDLDFDRWDLRNPEERARENELPELEDPKALASALGLSIAALRWFAFHRDDATFVHYHRFTIPKRDGSARAIWAPSPRLKAVQRWILRQIVERLPVHGASHGFMAGRSIKSNASVHTGAKIVVKVDLKDFFPTVTLPRVKGIFRRAGYREQVATLLALLCTEAPREVVEIKGKTHFVALGPRCLPQGAPTSPGLTNTLCLRLDRRLAGLAAKLGWRYTRYADDLTFSLPKAKKTRKKKGTKAKKEPPHVGALLGGIAKIAASEGFVVHPNKTRVARSGGRQQITGLVVNGDGPPRVPRALRRQVRATLHNLGQGKPMRSGETLSQLAGYIAYIQMADPKLGTKLRAQLLALDLS

SEQ ID NO: 6387 - protein, 357 aa, unidentified
  source 1..357: note = Related to JAGQIR010000020.1; note = Myxococcales bacterium
MATQIDYTRLLDLWRAIEQAGGTDKYVQQQLQERGYLVERKATDDMSKADLERYKKALKAEAAERRKIKKDAWLAYRASHIVHLGEGVFWNDDLDFDRWDLRNPEERANENELPALDNPKQLAEALGASIAELRWLAFHRDDATFVHYHAFTIPKRDGSMRQIWAPNRKLKAAQRWINREIVERLPVHGASHGFLAGRSIKSNAAAHTGAEIVVKIDLKDFFPTVTMPRVKGIFRKAGYREQVATLLALLCTEAPRHVVDIKGKVHYLALGPRCLPQGAPTSPGLTNTLCLRLDRRLAGLAAKLGWRYTRYADDLTFSRKKGASSAEVGEMIRKAVDIVGHEGFTVHPDKTRVMRRG

SEQ ID NO: 6388 - protein, 431 aa, unidentified
  source 1..431: note = Related to JADJRG010000001.1; note = Nannocystis sp.
MAFRIDTTRLLDLWRSIEQAGGRDRFIQQQLTERGFLVERKPTEGMSKAELERYKKSLKEEAAERRKLAREAWLAYRASHLVHLGEGVFWSDDHDFDRWDLRNPEERAAENELPKLEHPKALAEALGLSIAELRWYAFHREDATFLHYHAFTIPKRSGGLRSIWAPNRRLKQIQRWIHREVVERLPVHGAAHGFLAGRSIKSNAAVHAGATTIVKVDLKDFFPTVTYARVRGVFRKAGYREQVATLLALLCTEAPRRVLEIDGKTHYLALGPRCLPQGAPTSPGLTNTLCQRLDRRLVGLAKKYGWRYTRYADDLTFSLPATHQGPPRLGALLGGVAMIAAGEGFVVHPDKTRVSRAGGRQQVTGLVVNGEQGPRVARETKRQIRAALHNLARGKPLQEGETLSRIAGFIAYIQMSEPELGKRLRAQLAAL

SEQ ID NO: 6389 - protein, 435 aa, unidentified
  source 1..435: note = Related to JADKFZ010000002.1; note = Nannocystis sp.
MATTFRIDYTRLLDLWRAIETAGGRDKYISAQLKEKGYLIERKPTDSMSKAELDRYKKTLKEEAAERRKLAKEAWQAYKAAHLVHLGEGVFWNDDLDHDKWDLPDAEERQAENELPKLDKPKQLAEALKVSMAELRVLAYHRDAATKLNYYRFTIPKRDGSKRAIWAPHRRLKAAQRWILREVVERLPVHGAAHGFMHGRSIASNAAAHTNASTVLKVDLKDFFPTVTLTRVKGVFRKAGYREQIATLLALLCTEAPRQVSEVDGKVYYLALGPRCLPQGAPTSPGLTNTLCMRLDRRLQGAAHKLGWRYTRYADDLTFSLPVGHKGKPQLGKLLGCISAIAVGEGFVVHPDKTKVSRSGGRQRVTGLVVNGQGAPRVPRELKREVRAALHNLSKGKPLRDGETLSRLAGMVAFITMTDRKLGQKLRAELDKLGA

SEQ ID NO: 6390 - protein, 433 aa, unidentified
  source 1..433: note = Related to NZ_JAIRAU010000043.1; note = Nannocystis pusilla
MATTNRIDYNRMLETWRAVESAGGRDKYIEAQLKEKGYLVERKPTESMSKAELERYKKSLKDEAAEKRRLAKESWLAYKAAHLVHLGEGVFWNDQLDHDKWDLPGAEERQAENELPKLDKPKELAEALGVSIAELRRLAYHRDAATKLNYYRFEIPKRDGSKRAIWAPHRTLKAAQRWILREVVERLPVHGAAHGFLHGRSTASNAAVHRDSQILLKVDLKDFFPTVTLPRVKGVFRKAGYREQIATLLALLCTEAPRHVAEVEGTTYYLSLGPRCLPQGAPTSPAITNTLCLRLDRRLQGLAKKHGWRYTRYADDLTFSLPNDHKGKPHVGSLLGGISMIAAAEGFTVHPDKTRVHRSGGRQQVTGLVVNGGQGPRAPREFKREVRAAVHNLAHGKPLKEGETLSSLAGRIAYIYMTDKKLGKQLLAALSRV

SEQ ID NO: 6391 - protein, 458 aa, unidentified
  source 1..458: note = Related to JAGQIN010000580.1; note = Myxococcales bacterium
MTRARPTSSASPSSSLTGTWTRPRGEPMTTRSERLRDLWRSIEQAGGAEKYIQAQLRERGFVVERKPTDKMGKAELARYKQQLKAEAAERKRLAKEAWEARREHRVIHLGEGVFWNDQTDFDRWDLEGAEERAAENELPQLDNPAQLAEALGVTIPQLRWLAFHRDAATHVHYYRFTIPKRTGGERAIWAPHRRLKGAQRWILRNIVERLPVHGAAHGFLPGRSIASNAAHHTDAAAVVKIDLKDFFPTVTLPRVKGVFRKAGYREQIATLLALLCTEAPREVVEQDGKTYYLSLGPRCLPQGAPTSPGLTNTLCMRLDRRLLGLSRKLGWRYTRYADDLTFSLPKTHQGPPKLGALLSTVARIAADEGFTVHPEKTRIAKRGARQRVTGLVVNDAHGPRVPRTLRRRVRAMIHNLARGKPLREGETLGQLAGQIAFIHMTDPALGKRLAAQLSAIDG

SEQ ID NO: 6392 - protein, 434 aa, unidentified
  source 1..434: note = Myxococcales bacterium; note = Related to JACKDW010000002.1
MATDSQATRLRDLWRAVEQAGGVDKYIQSQLQERGFLVERRETDKMSKAELQRYKQQLKAEAAERRALKRDAWAAYREQHVVHLGEGVFWNDQSDLDRWDLRDADERAAENELPQLENPGQLAAALGLEIPQLRWMAYHRDAATKLHYYRFTIPKRSGGERPIWAPHKQLKAAQRWILRNIVERLPVHGAAHGFLPGRSIASNAAQHADSKIIVKVDLKDFFPTVTLPRVKGVFRKAGYREQIATLLALLCTEAPREIVESGGRTYYLSLGPRCLPQGAPTSPGLTNTLCLRLDRRLQGLASKLGWRYTRYADDLTFSLPGGHSGAPRVGTLLGSIARIAADEGFAVHPDKTRVARKGARQRVTGLVVNGDGTPRVPRTIKRQLRAAIHNLSQGKPLKEGETLSKLTGWIAYVHMTDPKLGKQLQAQLDAVGRG

SEQ ID NO: 6393 - protein, 434 aa, unidentified
  source 1..434: note = Alphaproteobacteria bacterium; note = Related to JACKEV010000022.1
MSTDPIALWRAIANAGGIDAYVSAQLVEKGFLVKRRPTDNMSKRDLARYKQQLKDEAAERRRLKKEAWLAYKANHIVHLGEGVYWNDAADADRFDHPKAEERLAENGLPVLDKPQQLADALEVPLTELRWLTWHRDAAARVHYRRFTIPKRSGGERAIWAPLPKLKAAQRWVLREIVEKLPVHGAAHGFVAGRSIATNAAVHADARVVVKVDLKDFFPTVTLPRVKGVFRKAGYREQVATLLALLCTESPREVVEEDGKTWFLSLGPRCLPQGAPTSPALTNTLCLRLDRRLTGLAQALGWRYTRYADDLTFSLPRPQGRKKPKPPQTAKLLGGIKTIVADEGFTVHPDKTRFARSGGRQQITGMVINDDHGPRAPRELRRQLRAAIHNLNQGKPLPEGESIDRLRGYVAYIRMTQPELGESLSAQLDAALSGA

SEQ ID NO: 6394 - protein, 464 aa, unidentified
  source 1..464: note = Deltaproteobacteria bacterium; note = Related to JADKFE010000004.1
MSDLTTLWLAVRTAGSVDNYVRQQLEAKGFLVKRRPTDGMSPKELEKYKQELKREAAEARSLRAAAWKAHKANHIVHVGEGVYWNDADDLDRFDVPQPEERQAENGLPPLDSPKKLAEALGLSIIELRWLSWHRDLATGVHYRRFTIPKRSGGERAIWAPMPKLKKAQRWILREIVEKLPVHGAAHGFLAGRSIATNAAAHNGALVVLKLDLKDFFPTLTLPRVKGLFRRAGYREQVATLLALLCTESPREIVEQDGKRLFVALGPRCLPQGAPTSPAITNAVCMRLDRRLAGAAAKLGWRYTRYADDLTFSRVRPAEAPVVEAAAPAAKPAKGKKATAAAETTPAPSQAPAARLSKLLGVVHEVVKDEGFIVHPDKTRVARSGGRQAVTGLIINGDQGPRPPRELRRRVRAALHHLAQGKPLPEGETVERVAGLIAYIRMTMPQEGERLYAELQKVTGAVAPA

SEQ ID NO: 6395 - protein, 432 aa, unidentified
  source 1..432: note = Alphaproteobacteria bacterium; note = Related to JACKEX010000021.1
MADDLMTLWRAVRSAGGRDAYVRAQLEEKGFLVRRRETDGMSKRELAKYKKELKAEAAERKRLAKEAWDAYKAAHIVHLGEGVYWNDAADFDRFDHPRAEERVAELGLPALDDPDALAEALGLGVAELRWLTYHRDAAKAIHYRRFTIPKSSGGERAIWAPLPKLKEAQRWVLREIVERLPVHGAAHGFVPGRSTATNAAAHADAEILVKVDLKDFFPTVTLPRVRGVFRQAGYREQVATLLALLCTESPREVVERGGETWYLALGPRCLPQGAPTSPALTNALSMRLDRRLTGLAKKLGWRYTRYADDLSFSLPVSKKKRKAAPNIGSLLGGVRIIVESEGFTVNEKKTQVAPPGARQKVTGLVINDGLGPRVPRADRRRIRAALHRLRLGKPLPEGESIERIEGWIAYIQMSQPELGERLAAELAEVRGG

SEQ ID NO: 6396 - protein, 432 aa, unidentified
  source 1..432: note = Planctomycetales bacterium; note = Related to JAGQPF010000572.1
MARQRTDIATLLRGIEQAGGIDAYVDAQLREHGFLVQRKPTDNMSQRELARYKKELKDEAAERRKLRKEAREAYETQHIVYLGEGVFWNDAYDYDKWDLEDAEERAAENELPALDKPVQLADALGITVPQLRHLAYHRDCAEMVHYRRFTIPKRNGGERAIWAPLPRLKGVQRWVLRAIVERLLIHGAAHGFVPGRGIHTNARIHRDASIVLKMDIKDFFPSVTFPRVRGVFRKAGYREQIATLLALICTEAPREIVEEDGKRWFVSLGPRCLPQGAPTSPALTNVVCLKLDRRLTGLAEKLGWRYSRYADDMTFSRPRGAKGPPNFATLRSRARQIVMDEGFRVHPDKTHVARRGARQTVTGLVTNGDLPPRVPRRNRRQIRAAIHNLGQGKPLHDGETVDTLAGYIAYIAMTDRAAADRLRQELSAALGG

SEQ ID NO: 6397 - protein, 430 aa, unidentified
  source 1..430: note = Related to PFUG01000414.1; note = Deltaproteobacteria bacterium CG_4_9_14_3_um_filter_63_12
MATTTPNYDDLWRSIAQAGGIDAYVTQQLKERGFLTERSDASQMSKNELKRYKASLKAEAAEKLRLKKEAWLAYRSQHIVHLGEGMYWNDAADIDGFDLAEPEARASENELPQLDNPKQLADALSLTVADVRWLSYHRDAARSLHYRRFTIPKKSGGERPIWAPMPKLKAAQRWIARHIVERLPVHGHAHAFLPARSINTNAKQHIGSKMVLQMDLVGFFPTVTFPRVKGIFRKAGYREQIATLLAAICTEAPREVLEHEGKTWFIAMGPRALPQGAPTSPGLTNTLCLRLDRRLTALAAKLGWNYTRYADDLTFSLLKSHKGKPNLGALMGCIKKVVTDEGFVVNADKTRVSRKGGRQKVTGLVVNGVQPPRVPREFKRRLRAAIHRLENGGALFEGETLDTLKGQAAYVFMTDPELGRKMLERLAKLG

SEQ ID NO: 6398 - protein, 445 aa, unidentified
  source 1..445: note = Planctomycetes bacterium; note = Related to JACOUH010000096.1
MARKRTDPVYIWRAILQAGGIDAYIEAQLAERGVKVEKKETAGMSARELEQYKKQLRAEAEERKKLKKEAWKAYKANHIVHLGEGVYWNDEKRQDKWDVAHAEERAAENELPPLDTPPQLAEALGLTVPQLRWLAYHREAATKVHYYRFTIPKRNGSERPIWAPLPKLKAAQQWIRVHIVEKLIVHGAVHGFLPGHSTLSNASVHRNPKIVLKMDIKEFFPTVTLPRVKGVFRKAGYREQVATLLALLCTEAPREIVHHGGKDYYVALGPRCLPQGAPTSPGLTNTLCLRLDQRLAGLAKKYGWRYTRYADDLTFSLPKAHDGDPHVGTLIGLVRRIVEDEGFAVHPDKTRLARSGGRQKITGLVVNGDLKPRVPRKLRRQMRAALHNLQCGKPLKEGETFARLAGYAAYINMSDPNLGARMLETFKIGLAATVTTNGEQTAEDK

SEQ ID NO: 6399 - protein, 435 aa, unidentified
  source 1..435: note = Related to JAGQQD010001043.1; note = Planctomycetaceae bacterium
MARRRTNVADLWRAIEQAGSVQAYVDQQLRERGFFVERRDAGQMSKRELAAYKKQLKEEAAEKRKLKAEAWQAYKANHIVHLGEHVFWNDGLDWDKWDLEHAEERAAENELPALDSPGQLAKKLDVSVAELRWLAYHREAATMLHYRRFTIPKRDGSERAIWAPLPKLKSAQRWILRNIVEKLVVHGAAHGFLPGRSILSNAAQHTDSKILLKMDLQNFFPTITLPRVKGVFRKAGYREQVATLLALICTESPREIVEHSDKTYFVALGPRCLPQGAPTSPALTNTICLRLDRRLAGLAKKHGWRYTRYADDLTFSLPQDHKGPPNLGTVMGGVKVVVAGEGFRIHPEKTRVARVGGQQKVTGLVVNEDRPPRVSRKLKRQLRAAIHNLQQGKPLHEGETLESLKGHAAYIAMSEPELGQSLLEQIAAVSEPVSN

SEQ ID NO: 6400 - protein, 432 aa, unidentified
  source 1..432: note = Related to CP042914.1; note = Roseimaritima ulvae
MTERTTDLATIFRGIEQAGTIDAYVDGQLRERGFLVERRATDDMSQRELARYKKELKQEAAEKRKLRAVAWKAYKTQNIVFLGEGVFWNDALDWDKWDLENAEARAAENELPPLDKPQQLAEALQLTISQLRWLAYHRDVATSIHYRRFTIPKRDGSERAIWSPRPTLKAAQRWVLRNIVERLTVHGATHGFLAGRSIASNAAAHTDSQMIVKMDLKDFFPTVTYPRVRGIFRHAGYREQIATLLALLCTEAPREIVEEDGQTLYVSLGPRCLPQGAPTSPALTNVICVKMDRRISGLAQKLGWRYTRYADDMTFSLPSNTGKAKTKQDANPAPLIGWVKRIVADEGFRVHPDKTRVIRKGGRQAVTGLIVNGTGAPRVPRKTRRMLRAAMHNLSKGIPLRDDETLATLQGYIAFIAQTDPEQAQRLKEQLA

SEQ ID NO: 6401 - protein, 453 aa, unidentified
  source 1..453: note = Deltaproteobacteria bacterium; note = Related to NYTD01000225.1
MSTENQKALVALWNEIQHAGGRESYIRNELTRMGIEIPARVKITNIRNKEKKAAYIALRQKEEEARGFINKKVWAAYRATHIVDLGDGIFWKDPTKDFYDTHDRAQRREDNGIPELETVDQLVEALSEAYANGDSNIELDIPTLRWLCYHREVATTTHYKSFSIPKKTGGNRQIWAPMPRLKSVQKWISRNIAEKLVNHGAAHGFISGRSILSNASVHTNSKIVVSMDLQDFFPTFTFNRVKGIFRAAGYLEGIATLLALLCTEAPRKKIKFPDEKNPGKEKWVYVASGDRCLPQGSPASPSLTNAACLRLDRRLAGYATKYGWRYTRYADDLTFSFPADSAKSPKTDLLIKRVQEFVVSEGFIVHPNKTDKMGTGGQQKVTGLIVNGVGKPRVSKGFRDNLRAAIHNQEEGKELMYEEESLETLMGYASFIFSADPTKGTTLIEKLQALEEE

SEQ ID NO: 6402 - protein, 446 aa, unidentified
  source 1..446: note = Related to PBMT01000113.1; note = Proteobacteria bacterium
MSTENSNELVELWNEIQQVGGKEAYIRRELARMGIEVPERVKITNIRDKTKKAEYISLRQKEDKARAIINKKIWAAYRKTHIVDLGDGIFWKDPSKDFFDVHDREERRKDNGIPELETVDQLVEALRSVDSDIDVPTIRWMCYHREVATTTHYRAFKIPKKTGGERHIWAPMPRLKAIQKWISRNIAEKLATHGAAHGFIVGRSIVSNAMVHTDSKVVVSMDLKDFFPTFTFKRVKGIFRAAGYLDGIATLLALFCTEAPRVPMCLPDENDPSKEKWVYVASGERCLPQGSPASPALTNSACLRLDRRLAGYAQKYGWRYTRYADDLTFSFPSSDSRSANVDLLKKFVHDIVTSEGFVVHPDKTDVMGTGGQQKVTGLIVNGTGSPRVPREFRDKLRAAIHNQEQGQPLFEDETMSTLLGYASFVFSADPERGKTQLEQLQKLNEQ

SEQ ID NO: 6403 - protein, 441 aa, unidentified
  source 1..441: note = Deltaproteobacteria bacterium; note = Related to VGTA01000016.1
MIERLSEKLSGVEREALEAKAELWSAVEQAGGARRYVEAELRRRGVFVERQDVLAMGFDEKKAYVERVAAEQEVRRPLQSKVWAAYTALHITHLGEEVFWQGDVSVDFFDPDHLAARLEQKGLPPLERPEDLCEALGLTLSELRWLCYHREAATSLHYRTFEIPKKTGGVRRIWAPLPKLKAAQEWVLRSIAERLVVHGAAHGFVAGRSIYSNALEHLDSRLVVSMDLADFFPSFTFKRVKGIFRQAGYMDGIAALLALLCTEAPREVTEHEGQRYYLALGPRCLPQGSPASPALTNAACLRLDRRLAGWAAKAGWRYTRYADDLTFSVPASAAEEPSVSQLLGVVHAIVAEEGLVVRDDKTHVMRRGARHQVTGLVVNDATPPRPPRELRRRVRAMVHNVASGRGLREGESLSQLVGFVAYLHMCDPVEGRRLMEVLRGA

SEQ ID NO: 6404 - protein, 442 aa, unidentified
  source 1..442: note = Myxococcales bacterium; note = Related to NYWS01000115.1
MSEHLNDRTSHQEFWTEIVEAGGPRKYVETQLRERGVWVKRQDVLSMGAKAKQAYIEQIKAEDAIRKPLQEKVWKTYTALHIVHLGEDIFWQSDVSIDFFDPAHRQSRLKQRQLQDIESAEELSDQMGITLGELRWLCYHREAAKSIHYHRFSIPKKSGGERQIWAPMPKLKTAQTWVLRNIAERLTVHGAAHGFMAGRSIYSNALEHTNASVIVSMDLADFFPSFTFKRVKGIFRQAGYMDGIATILALLCTEAPREVVEDEGETYYVAMGPRCLPQGSPASPALTNAACLRLDRRLSQFAEKNQWRYTRYADDLTFSVPKAESKLSEEELSAKIKQLIGTVHAVVEDEGLQVRSDKTHVMRPGKRQKVTGLVVNGQDTPRTPRELRRRVRAMIHNLKVGKTLHEGESLNHLTGLIAFIYMSDPQQGQKLLEQLKQATAPS

SEQ ID NO: 6405 - protein, 437 aa, unidentified
  source 1..437: note = Proteobacteria bacterium; note = Related to PBMT01000009.1
MNKERVQELEKRWQKIQDQGGPQAYLEQQLRKAGVWRRYRPNMIEPGINKSDEIRASRLEREKRLELKKYIWEAYKATHISHLGLDVYWNDEVGEDFFDVHERLKRQEEQGLPSIETVEELVEALSQAVPEMTIPMLRWLCYHQDVATHLHYRHFEIEKKTGGFRQIWAPLPKLKAIQHWILQNIVEHMPIHGAAHGFVSGRSIFSNAEEHCNSDVVVGLDLKDFFPSFTFPRVKGIFRNYGYKSEISTLLALLCTEAPRRIVQIEGKTVYVATGSRALPQGSPVSPALTNVASMRLDRRLSGYALKHGWRYTRYADDLTFSAPTGQGRKNIKALLETVDTIVTEEGLKVHPKKTHVMGKGRRQEVTGLVVNGSESPRVPKERRKMLRAALNNAQKGKEVELGYALQQLMGHAAFVYAAQPELGRSLIEAFSELMNE

SEQ ID NO: 6406 - protein, 429 aa, unidentified
  source 1..429: note = Candidatus Uabimicrobium amorphum; note = Related to NZ_AP019860.1
MTDLLKLWQEIEAAGNIDNYIEQQLVKNGYLVERRDTDDMSKKELDRYKKQLKQEAKAKKELKKKTWLAYKASHIVHVGEGIFWNDGANFDQWDHLRAEEQTSANELPPLDSPKELAKTMGITIEELRWFTYHRDDAKKIHYRRFTIPKRSGGERNIWAPLPKLKELQRWILREIAEKLPIHGASHGFVAGRSILSNAAVHNNSHIVVRMDLKDFFPTLTFPRVKGIFRHAGYREQIATLLALICTEAPREVIQHEGELHYLSLGPRCLPQGAPTSPALSNVASLKLDRRLSGLAKKLGWRYTRYADDLTFSLPEKYKKGNSQLGALLKSVPNIVSDEGFEINRKKTWVARKGGRQCVTGLVVNGKEMPRVPRKKQREIRSAIHNLQQGKGLREGETIEQILGYVAFIYMSQPDKGKKLLEKIGNIKLQ

SEQ ID NO: 6407 - protein, 433 aa, unidentified
  source 1..433: note = Related to NZ_FUYB01000016.1; note = Thiothrix eikelboomii
MSEHKANRYEQIWQAIEQAGSVNAYVREQLQQHGFLVTRRPTDEMSKAELEKYRQALKKEAAEQNRLRQQAWQAYQAKHIVHLGEGIYWTDDSSEDQWDAPNANQRLLENQLPAITQVAQLCQALQLSVSELRWLCYQREVSTHSHYTRFEIPKRSGGIRAIWAPLPKLKQAQHWILHEILERLVVHGSAHGFITGRSIATNAAEHGDSQVLVKLDIENFFPTISWRRVKGVFRKAGYPEQIATLLALLCTESPRQLVEHEGKSVYVALAERCLPQGAPTSPALTNALCLRLDRRLTGFAHKAGWRYTRYADDLSFSLPATNQAPPELSRLLGTVKRVLGEEGFALNLSKTRVIRPAEVQTVTGLVVNGAQPPRVKRSLKRQMRAAVHNLNQGKALPAGESLSRLKGYAAYIAMTDRDLGFDLLNQLQPVGEI

SEQ ID NO: 6408 - protein, 429 aa, unidentified
  source 1..429: note = Related to NZ_AQVE01000007.1; note = Thiolinea disciformis
MSELSRYEQVWQAIEKAGSVNAYVREQMQKNGFMVARRPTDNMNKTELEKYRQELKKEAAEQRRLNKEAWQAYKAKHIVHLGEGIYWTDDSSEDQWDVPNANKRLLENQLPAITKVPQLCEALKLSVNELRWLCYQREVADKSHYTRFEIPKRSGGLRAIWAPLPKLKQAQHWILHEILDRLVVHGSAHGFIAGRSIATNAAEHTNSQVLVKVDIKDFFPSISWKRVKGVFRKAGYPEQIATLLALLCTESPREVVEHAGKQVYVALADRCLPQGAPTSPALTNVLCLRLDRRLTGFAQKAGWRYTRYADDLSFSLPATSKNPAEISRLLGTLKRVLGEEGFDLNDKKTRVIRQGAVQTVTGLVVNGEQSPRVSRVLKRQMRAAVHNLKQGKVLPEGESLQRLRGYAAYIAMTDRELGLGLLGQLQQEQ

SEQ ID NO: 6409 - protein, 428 aa, unidentified
  source 1..428: note = Related to PDPH01000052.1; note = Proteobacteria bacterium
MAKQTKLEKLWTEIEKAGSRDAYIQEQLRKNGFMVQRRSTDNLSKSELEKYKQELKKEAAEKRRLQQAAWAAYKTQHIVHLGEGIYWTDDTSADQWDLDNAHKRLLANQLPQLTRVKHLSDALGLSIAELRWLCYQRDAALKTHYTRFEIPKRSGGVRAIWAPLPKLKQAQRWILDHILDRLLVHGAAHGFLMGRSIASNAAEHSDSQILVKMDIADFFPSISWKRIKGVFRKAGYPEQIATLLALLCTESPREQVEHNGQSYYIAMADRCLPQGTPTSPALTNALCLKLDRRLAGFASKTAWRYTRYADDLTFSFPNHSTSKANISQLLGTVKRILGDEGFKLNNSKTRVIRQNTVHEVTGLVVNGTQAPRVKRTLKRQLRAAIHNLKQGKPLPEGESIQRLKGYAAYIAMTERELGLKMLAELDNV

SEQ ID NO: 6410 - protein, 427 aa, unidentified
  source 1..427: note = Related to NZ_KB904782.1; note = Thiofilum flexile
MATEWEERWAEIEKAGSINAYIQQQLVAKGFLVERRATDKMTPRELEQYKKSLKTEATEKAQLRKAAWQVYKANHMVYLGEGIYWSDDSSEDDFDLASAEKRLLDNQLPAITKVKQLAEQLKLTIPQLRQLCYHREAATDLNYTRFEIPKRSGGMRPIWAPRLLLKNTQRWILEHILERLLVHGAAHGFLMGRSIATNAAQHNNSEILIKLDIKDFFPSISWRRVKGVFRKAGYREQVATLLALLCTEAPREVVERQGKKHYVALGARCLPQGAPTSPALTNVLCLRLDRRLTGIATKFGWRYSRYADDMTFSLPVGHAGDPQIAKVLGSIQRVMGEEGFELNRAKTHIVRRGARQEVTGLVVNNEGLPRVKRSTKRQMRAALHNLKTGKGLKEGESLNRLKGYAAYMAMTERELGLRLLSELSEFG

SEQ ID NO: 6411 - protein, 304 aa, unidentified
  source 1..304: note = Related to CACVAT010000519.1; note = Thiotrichaceae bacterium
MANQQQNKIEKLWAAIEKAGSMDAYVRGQLRDKGFLVERRDTDDMSKRALNKYKQELKAEAEEKRKLTKKAWQAYKANHIVHLGEGIYWTDDTSEDRWDLDNAQKRLLENQLPNITRVKQLAEALELSISELRWLCYHREAATSSHYIRFEIPKRSGGQRAIWAPMPKLKKVQRWILGEILDRLLVHGSAHGFLAGRSIATNAAQHTDSRLIVKMDIEDFFPSVSWKRVKGVFRKAGYNEQIATLLALLCTESPREMVEHNGRTHYVALAERCLPQGAPTSPALTNVLCLKLDRRISGTAGKFN

SEQ ID NO: 6412 - protein, 428 aa, unidentified
  source 1..428: note = Thiotrichaceae bacterium; note = Related to DQVC01000057.1
MGRTSNKVEKLWADIEKAGSINRYVRQELDNKGFLVKRVNTDNLSVRELKQYKAALKKESAEKRALNKAAWEAYKAHHIVHLGDGIYWTDDTSTDQWDLDNATKRLLENQLPQITRVKALAEALGLTISQLRWLCYHREVATQSHYTRFEIPKRSGGVRTIWAPRPKLKKVQRWILNNILDSLLVHGSAHGFLAGRSIATNAIEHTDSQVLIKMDIENFFPTISWKRVKGVFRKAGYSEQIATLLALLCTESPREVINKDGQDLYIALADRCLPQGAPTSPAITNALCLSLDRRMTSMANKAGLRYTRYADDLTFSYAAKKKKAPEISQLIGGVKRILGDEGFKVNTKKTHVIRQGSTQEVTGLIVNGKGMPRVSRKLKRQMRAAIYNLKQGRELPEGESIQRLRGYAAYIAMTDRALGLGMLEALSD

SEQ ID NO: 6413 - protein, 425 aa, unidentified
  source 1..425: note = Related to nan
MSSTLESLWIVIEQAGGIDRYVDKELKAKGYLVERSDTASMSKRALGIYKKALKQESVEKRTLKKQAWAAYKQTHLVHLGEGIFWSDAEDEDKWDVENAHKRLLENQLPAITKSKQLAEALDISIAELRWLCYHREASTSSHYTRFEIPKRDGSSREIWAPRPLLKKVQTWILREILERLLVHGAAHGFLAGRSIATNASQHINSKILVKMDIEDFFPSISWKRVRGVFRKAGYQGHIATLLALLCTEAPRKIVEHRGKTTYVALGERCLPQGAPTSPALSNALCLSLDRRLTGVATKLGWRYSRYADDLAFSQVATKKQAPELTPLFGSIKRILGEEGFVVNQKKTHVVRQGARQEVTGLIVNGKGEPRVPRKLKRQLRAAVHNFKCGKPLRDGVSLMELKGYAAYIMMTDRRLGEEMKSVLVE

SEQ ID NO: 6414 - protein, 426 aa, unidentified
  source 1..426: note = Moraxellaceae bacterium AER2_44_116; note = Related to VIAD01000001.1
MSANWETLWDEIEKAGNVERYVQQQLELKGFVVKRRATDTLSTRELENYKKELKTEALEKRKLKKEAWQAYRATHIVHLGTSIYWSDDSSHDRWDLQDAEKRLLENQLPPLTQVKHLTTALNLSIPQLRSLCYQRDATTDTHYRRFEIPKRSGGLRAIWAPRPQLKKAQRWILREILDRMLVHGAAHGFLAGRSIVTNAAQHTNSQVIVKLDIKDFFPSISWRRVKGVFRKAGYREQIATLLALLCTESPREVVSHEDKTYYVALGERCLPQGAPTSPALTNILCLQLDRRLTGIAQKFGWCYSRYADDLTFSFPQDTAETSNISHLLGSIQRVMTDEGFSVNMKKTHVIRAGNVQEVTGLLVNGQHAPRVSRTKKRQMRAAIHNLQQQKPLPEGESRERLMGYAAFIAMTDRPLGQQMIHALMAL

SEQ ID NO: 6415 - protein, 485 aa, unidentified
  source 1..485: note = Related to AUSW01000035.1; note = Psychrobacter aquaticus
MSTVNSQQTDYISPAQTMTPAERQWQQLWQDIEEAGGRYQYIQQQMLQHGFIVERKPIDNMTAKERERYKKSLKKEAAEEKSLKKQAWQAYKAQHIVYLGRHIYWSDDTSMDKWDVKDASNRLIENKLPLISKHTQLAEAVNLTVPQLKGLCYQRDVATNIPYTHFTINKRNGTPRHIWSPIPRLKFVQRWILENILNNLMTHGAAHGFVRGKSIVTNAAVHSNSALLIKLDVKDFFPSVHWRRVKGVFRHAGYPEKIAILLALLCTESPRQVVQQNGTTYYVALSDRALPQGAPTSPALTNIVCLNLDRRLTGLADKVGLRYSRYADDLTFSLPVSSTSAENNVQANVQANVQPADHNQLIGQLLGSVQKILREEGFTLNNDKTRVIRTGNQHNVTGMVINGEGVPRVPRHIKRMLRAALHNLASGQPLREDETLETLSGYASWIASAEQELGQNYLAKIDTLREQAKVVETKSSAESTSLLNE

SEQ ID NO: 6416 - protein, 479 aa, unidentified
  source 1..479: note = Related to NZ_CAJHAL010000004.1; note = Psychrobacter nivimaris
MTTHTANHNDYISPEPVPTSFERQWQQLWQDIELAGGRYQYVQQQLVSQGFMVERQPVDNMSPKERDRYKKALKKEAAEEKSLKKAAWQAYKAHHMVYLGRHVYWTDDTSTDKWDIKDAANRLIENKLPLLRKHNELAEAVNLTIPQLKGLCYQREVATNLSYSHFTIAKRNGTARQIWSPIPRLKFVQRWILHNILNNLTTHGAAHGFVRGKSIVTNAAVHSNSELIIKLDVKDFFPSVSWRRVKGVFRHAGYPEQIATLLALLCTESPRQVVQQDGITYYVALGDRALPQGAPTSPALTNIVCLNLDRRLTGLAEKLGLRYSRYADDLTFSVPTIEDTKPKLKVKTTIKATTSTAKKQADTQHNKLIGQLLGSVHKILREEGFALNNDKTRVIRKGNQQQVTGMVVNGQGVPRVSRQIKRMLRAAVHNLEAGGTLRADETLNTLSGYAAWIASAEPELGHSYLDRIERLQVQQETSV

SEQ ID NO: 6417 - protein, 445 aa, unidentified
  source 1..445: note = Related to NZ_CAJGYT010000001.1; note = Psychrobacter aestuarii
MSSTSTQNLREHWQTLWQDIEQAGGRYQYVQQQLVTQGFVVERRPIDNMSKAERQRYKTMLKKEAAEEKNLKKDAWQAYKSQHMVYLGRHVYWSDDHSADKWDVTDGERRRVSNQLPTLTQPKELAAALNLSIAQLKGLCYQREVATCVPYTHFSIQKRRGGTREIWSPIPTLKTAQRWILHHILDQLPTHGAAHGFVSGRSIVTNAEVHRDSAVLIKLDLKNFFPTIHWRRAKGVFRQAGYPESIATLLALLCSESPRQMVQQNGVTYYVALADRALPQGAPTSPALSNIVCVNMDRRLTGLADKHGLRYSRYADDLTFSIPSSSAANSDAQNALIGLLLGSVYKIVKEEGFVLNTDKTSIVRTGQQQNVTGMVVNGESAPRVPRRIKRMLRAAIHNLQQGRALPEGESLATLSGYAAWITSAEPELGRHYLEQIEALAKATPA

SEQ ID NO: 6418 - protein, 506 aa, unidentified
  source 1..506: note = Related to NZ_VFYU01000031.1; note = Psychrobacter sp.
MSNRNNNSNNPNNAQQLSQYIHNNQAHHGNLINPNGNEKLNELQQLWQDIEQAGGRYQYVQQQLVKQGFLVERQPIDNMSPKERDRYKKQLKQEALEAKKLKQQAWQAYKAQHIVYLGRDIYWTDDTSPDQWDVKDASNRLIENQLPLIDKPQKLASSLNLTIPQLKGLCYQRDVATNLTYNHFTIAKRNGTPRQIWSPIPRLKYAQRWILDNILNNLPIHGSAHGFVQGKSIVSNACVHTDSELLIKLDIKDFFPSVHWRRVKGVFRHAGYHEQIATLLALLCTESPRQIVRQNGVTYYVALADRCLPQGAPTSPALTNIVCLNLDRRLTGLADKLGLRYSRYADDLTFSLPKTDTTTGKPSKKPNTKTAKTANDNSTNNNNEQNQLIGQLLGSVSKILTEEGFAINSDKTKIIRTGNQQNVTGLVVNGDGTPRVPRKTKRMLRAVIHNLQNGGKLRADENFNTLMGYASWIAMTDPELGASYLQQLGELSKEFAKKAEKEDKTE

SEQ ID NO: 6419 - protein, 451 aa, unidentified
  source 1..451: note = Related to NZ_CP047226.1; note = Moraxella osloensis
MTNNKHTSLPQQWEQRWHAIEQAGGRYQYIMQQMKEHGFLVERKPIDNMSPTERERYKKQLKQEAAEQHKIKKDAWQAYKANHIVYLGHGIYWSDDTSEDKWDATDGAKRLLENQLPTFKNVKALAEQLNLTISQLKGLCFHREVATRIPYSHFTIVKRSGGERQIWAPVPRLKYAQRWILDNVLNPMLIHGAAHGFVRGKSIVTNAENHTNSQLIIKMDIKDFFPSIGWRRVKGVFRQAGYPEQIATLFAMLCTESPRQLVKQGNVIYYVALADRCLPQGAPTSPALTNIISLNLDRRLTGLAEKHGLRYSRYADDLTFSLPAEATIDTKAKNTLISTLLGSVTKILTEEGFAINAKKTHIIHQGGVQRITGLVVNGDSVPRVPRNIKRMLRAAIHNLEQGKPFKEGESFNTLQGYAAWIAMAEPDVGEALLKKLRQLKNRPLQIEPVSD

SEQ ID NO: 6420 - protein, 428 aa, unidentified
  source 1..428: note = Related to NZ_NDXW01000001.1; note = Zooshikella ganghwensis
MTDFQQLWQDIQHAGSIDAYVNKQLQKKGYLVKRLDAKQLSAKELARYKQQLKQEAEAKQKLNQEAWQVYKQNNIVYLGDQVYWHDNDDWDKYDRENADKALVGYQLPVIHTPAELAEQLQLTIKELRWFTYHRNAAEYSHYQQFSIPKRSGGERSIWAPKPKLKAAQRWILLNIVERMLIHGAAHGFVGGRSILTNAQQHTQSELVVKFDLADFFPSISWRRVKGIFRKAGYKEQVATLLALLCTEAPRERIEHEHKTYFIALADRCLPQGAPTSPSLTNILCKSMDRRLTAFAEKNGWRYSRYADDLTFSWSGSQSKSNIKQLIGIVHQVVKDEGLNINSKKTRILRPGSCQQITGLVVNEHAQPRVPRATKREVRAMLHNLSKGKSLHEDETLSQLQGKINFIRMVEPELGASFLTQFQQIVQSA

SEQ ID NO: 6421 - protein, 432 aa, unidentified
  source 1..432: note = Related to NZ_CP048878.1; note = Spartinivicinus ruber
MKQQSKINQLWNAIEKAGSMNAYIDGQLREHGFLVKRRDTDNMSKRELDRYKKELKAEAAEKKRLKQVAWQAYKANHIVHLGDGIYWNDHDDFDRWDLNNAEERAAENELPPLDKPQQLAHALGITIPQLRWLAFHRDAATELHYRRFTIPKKDGSDRAIWAPKTLLKQAQYWINDNITRKLIVHGAAHGFIPGRSILSNAEVHTNSKIILKMDLENFFPTITLKRVKGLFRKAGYREQIATLLALLVTEAPREVVEDQNKTYFVSMGPRCLPQGAPTSPMITNALCLKLDRRLTGIAEKYGWRYSRYADDLTFSLPDGKDKQPNLGKLMHVIKQIVKDEGFIIHPEKTRITRKGGRQKITGLVVNGQGTPRVPQKTKRELRAAIHNLKNGKPLREGETLAHLEGLAAFICMTEPALGHKMLNQLKAVANTL

SEQ ID NO: 6422 - protein, 432 aa, unidentified
  source 1..432: note = Related to MABD01000042.1; note = Gammaproteobacteria bacterium 45_16_T64
MAQRSEIDKLWNAIEKAGSMDAYIDGQLREHGFLVKRRATDNMSRRELDKYKKELKGEAAERKRVKNTAWQAYKAKHIVHLGDGVYWNDNDDFDRWDLDNAEERAAENELPTLDKPQDLALALGITIPQLRWLAYHRDAATELHYTRFTIPKRDGSDRAIWAPKTLLKKAQYWINDNIVSQLIVHGAAHGFMAGRSILTNATVHTDSKTVLKMDLRNFFPTVTFRRVKGLFRKAGYREQISTLLALLVTEAPREVVEENNKTYFVSLGPRCLPQGAPTSPMITNVLCLQLDRRLTGIAEKYGWRYTRYADDLTFSLPNGPDKEPKLGALMHVVKQIVTDEGFVVHPEKTRVTRKGARQKVTGLVVNDKGAPRVPQKRKRQLRAAIHNLQNGKPLREDETLAQLEGLAAFIYMTDPKLGSSMLADLRNIANKI

SEQ ID NO: 6423 - protein, 434 aa, Vibrio sp.
  source 1..434: note = Related to NZ_CP018616.1; note = Vibrio azureus
MTKSIKQLALEIEKAGSPEAYVKQQMQKQGFTVTRKNVADLSKKELSAYKQALKKEASEKHKLQQEAWQGYKAYNIVHLGDDIYWNDQDVCDKFDCDDRHVRMQENAIPDFKNPQALAAWLGVSMPQLRGLTYHRECAESIKYRHFTIEKRSGGMRSIWAPNHELKQVQRQILDEILSSLLVHDASHGFMQGRSIFSNALRHTDAKIVVKMDLKDFFPTISFKRVKGLFRKAGYQEQIATLLALLCTEAPRKIIERDGKKYFIALGERCLPQGAPTSPAISNVVCLRLDRRLQGLAESLGYRYTRYADDLTFSQLNDCKKPMSIGALKAAIKNIIESEGFVLHTEKTRITYPHRSQQVTGLVVNGKGLPRVPRKTKRHLRAAIHNLQQGKPLQDGESLEQLKGYAAFIAMSDPKTGQEMLAKLNECQLSLPEST

SEQ ID NO: 6424 - protein, 447 aa, unidentified
  source 1..447: note = Related to SBHC01000028.1; note = Deltaproteobacteria bacterium
MSQADYTLPPIETSEERRELWSHIDEAGGVRAYIRQEIHRQDLAATGNPEHMNASQRQRYKQAKKLEAEFRTALRKRTWAAYRETHLVHLGDDIFYNDLIDIDAFDIDNREQRREANDIPSIETVDELATFLGLTIPELRWLSYHRNAEASPHYVQFSIPKADGSRRVISAPKPKLKACQTKIYHEILSLLPVHGAAHGFVPGRSIATHASLHAGGNIIVKMDIRHFFPTIVFPRVKGFFRKIGYPEQVATVMALLCTESPRQEMEHKGQVLHVALQERCLPQGAPTSPTLTNLMCVRLDRRVLGLARKLGWTYSRYADDLAFSWHQDSEPDLAQLLGCTKAIAGDEGFKIHPKKTQVMRAKSRQMVTGLVLNATGGDEPNHPRPVRRLVRQIRAAIHNRKNGKPGKAGESLLQLQGLAAFVCQTDPRRGEPLMEDIRALIAAELAE

SEQ ID NO: 6425 - protein, 446 aa, unidentified
  source 1..446: note = Related to PBIH01000019.1; note = Deltaproteobacteria bacterium
MSKIKVPPTETHEQRVELWEEIKKAGGIEPYIQQTLSAQGLAVHNNDTSRMNQKQKSAYKKSKRAEAEAEKVVRKATWKAYCATHLVHLGNGVFYNDLVDADKFDIENREQRISNNDLPNIEHVDALAEFLSLTLPEMRWLAYHRDATKNPHYKQFTIPKSDGSERVISAPRPKLKKAQHTILHKILDRMPIHGAAHGFVPGRSIASHADKHAGRKIVVKMDLKDFFPTLTFPRVKGLFRKIGYPEQVATVMALICTEPKRKEVEHDGEMYHVSLSHRSLPQGAPTSPTITNIVCMRLDRRMSGLAKKLGWSYSRYADDLVFSTNDTDINIGALLRLSEKVIRAEGFRRHPKKTHVMRQCNRQKVTGLIVNPTPSEEKTTSRVPRKVVRQVKAGIYNRLNGKPHKSGESLEQLRGLAAFINQTNPTLGRKFLDQIKTLVEREENEI

SEQ ID NO: 6426 - protein, 431 aa, unidentified
  source 1..431: note = Deltaproteobacteria bacterium; note = Related to JAHBVW010000060.1
MTEPALTWADVAAAGGIREWVDAEVARQGLASTGVPPNMTDAEKKLFKARRDEERRVRKELYKRAWSAYKRAHIVHLGPGVFWHDTADVDRFDADDPEKKRQDNALPKLADVEAFAKAVGVDIPRLRWLSYHREVDSGTHYRRWTVPKRDGTARLISAPKPDLKRIQRWITTEVTEHLPVHGAAHGFITGRSIVSNARVHAGAHVVVKLDIRGFYPTVTMRRVKGLLRRAGLGEQVATLMALLATESPREEVETHGKVHYVAIGPRSLPQGAPTSPSITNALCLRLDCRLAGLARKLGCRYTRYADDLTFSWHGDGKAAIGSLLRATTMIVRAEGFEIHTKKTRVMRKGARQKVTGLVVNEAQGRPTARVPRTTQRELRAAIRNRELGRPGKGESLEELKGMAAFIMMTDRERGRAFMERIDKLIAAREVK

SEQ ID NO: 6427 - protein, 398 aa, unidentified
  source 1..398: note = Deltaproteobacteria bacterium; note = Related to VBLP01000042.1
MTDAENKLYKARRDEERKVRRELYRRAWQAYRRAHVVHLGAGVFWHDTADVDRFDADDPEKRRQDSALPSLDDVAALAGALGLSIPRLRWLAYHRDVDTGTHYHRWWVPKRDGSKRLISAPKPELKAVQRWITREVTEHLPVHGAAHGFLVGRSIVSNARVHAGARVIVKLDIRGFYPTISMRRVKGLLRRAGLGEQVATVMALLATESPREQVATHGKTYFVATGPRSLPQGAPTSPSITNALCLRLDCRLSGLARKLGCRYTRYADDLTFSWHGDARPQVGALLRGVAMIVRAEGFEVHAKKTRVMRAGARQKVTGLVVNQAPAERPTTRVPRVTQRALRAAIKNRELGRSGKGETLEQLKGMAAFVMMTDAARGRALMARLDRLIAARDQAGGQP

SEQ ID NO: 6428 - protein, 434 aa, unidentified
  source 1..434: note = Related to JADJJK010000055.1; note = Myxococcales bacterium
MSEPVRPPVRWADIAATGGIREWVDAEITRQGLSDPGAGNLSDAEKKVYKARREEERRVRRELYKQAWAAYRQTHIVHLGRGVFWHDTADVDRFDADDPEKKRRDNALPELKDVEALSQALGLSVARLRWLAYHREVDTGTHYHRWRIPKRDGTPRLISAPKPQLKEAQRWITREITEHLPVHSAAHGFLVGRSIVSNARVHAGARVIVKMDIEGFYPTVTFPRVKGLLRKAGLGEQVATLLALLATESPREELVLEGKTVFVATGPRSLPQGAPTSPSITNALCLRLDCRLFGLARALGARYTRYADDLTFSFHGPAGEVDHVGTLLKAVTRIVAAEGFAIKPKKTRVMRSGARQRVTGLVVNAAPGRPLARVSRQQLRELRAAIKNRELGRPGKGESLDQLRGMAAFVMMTDRERGRMLLDRINRLAAPTEP

SEQ ID NO: 6429 - protein, 447 aa, unidentified
  source 1..447: note = Related to JADJUF010000001.1; note = Myxococcales bacterium
MTAGAKLAAVPWAEVAAAGGIRPWVDAALARQGLADPGVPSSMSDGEKKAYKARREEERRVRRELFRVAWAAYKAVHIVHVGAGVWWHDTPDVDRFDAAEPERKRADADLPALPDVEALAKALGLSIARLRWLSYHREVDTGTHYQRWTVPKRDGGVRPITAPKPTLKAAQRWIARSITEHLPVHGAAHGFLPGRSIATNAVVHAGAKIIVKLDIEGFYPTVTYRRVKGLLRKGAGLGEQVATLLALMATEAPREELLVRGRTCYVATGPRALPQGAPTSPSITNALCLRLDGRLTGLARSLGCRYTRYADDMTFSWHGGAAGQADRTNAIGKLLRAVEMIVAAEGFTIKRTKTRVMRGGGRQQVTGLVVNQADGRPPARVPRATQRNLRAAIKNRELGRPGRGESIEALRGMAAFVMMTDPARGRAFMARIDRLAERAGGAPAGSE

SEQ ID NO: 6430 - protein, 406 aa, unidentified
  source 1..406: note = Myxococcales bacterium; note = Related to JADJFN010000004.1
MSDAEKKAYKARRDEERRVRRELFRVAWAAYKAAHIVHLGPGVWWHDTADVDRFDAADPAKKQQDNALPALPDVEALAKALGLSIARLRWLSYHREVDTGTHYHRWTVPKRDGGLRPISAPKPELKAAQRWIARQVTEHLPVHGAAHGFLPGRSIATNAGVHAGAKIIVKLDIEGFYPTVTWRRVKGLLRKAGLGEQVATIMALVATEAPREELVVRGRPCFVATGPRALPQGAPTSPSITNALCLRLDCRLTGLARKLGARYTRYADDLTFSWHGDAARAADAGNAIGKLLRAVTEIVAAEGFTIKRTKTRVMRAGGRQQVTGLVVNQADGRPAARVPRATQRKLRAALKNRELGRPGHGETLEALRGMAAFIMMTDPERGRAFMARIDRLAQRAGEAPAGSERA

SEQ ID NO: 6431 - protein, 443 aa, unidentified
  source 1..443: note = Related to NZ_PVNL01000069.1; note = Enhygromyxa salina
MANDTQTPPVSAVPADLPKWADIEAAGNIRSWVDAELTRLGLFEPGVDTSTLSDKQRKAYKAKREQERKVRRELMAKAWFVYRQHHLVHVGVGVWYHDTADIDRWDIPDLEGRRQLNELPELENVHALAKSLGLAIPRLRWLVYHREVDTGTHYHRWTVPKRSGKGVRLISAPKPDLKRVQSWIARNITEHLPVHGAAHGFLAGRSTLSNARVHAGARVIVKFDVRDFYPTVVLRRVKGLFRKAGYGEQVATVLALLCTECPREEIELGGRPHYVATGPRSLPQGAPTSPSITNTLCLNLDARLTGLAAKLGFRYTRYADDLTFSFHGPAGHKIAVGRLQKAVVDIVADEGFIVHPHKTRVMRSGGRQKVTGLVVNTAPEGEPVARVPRKVVRELRAAIHNRAQGKPGKGETLEQLRGMAAYVHMCDPAKGAAFMQQINSLPG

SEQ ID NO: 6432 - protein, 435 aa, unidentified
  source 1..435: note = Related to JAGQIO010000454.1; note = Myxococcales bacterium
MANDNATTTTAGPAWSEIEAAGNLRNWVDAELERRGLRDPGVDTSRLNDKQRKAYKTKREEERKVRRELMAQAWKVYRQHHLVHIGVGVWYHDTADIDRWDIADLEGRRAINELPELKDVHALAKILELPIPRLRWLIYHREVDTGTHYHRWTVPKRSGKGRRLISAPKPDLKRCQTWVARNISEHLPVHGAAHGFLAGRSTLSNAKVHAGAKVVVKFDVRDFYPTVSYRRVKGLFRKAGYGEQVATVLALLCTECPREEIEIGGRVHYVATGVRSLPQGAPTSPSLTNALCVRLDARLTGLASKLGFRYTRYADDLTFSFHGEGKVPVARLRRAVVDIVAAEGFEVHPDKTRVMRSGGRQKVTGLVINGAPEGRPEARVPRKVIRELRAAIHNREQGKAGKGESLDQLRGLAAYVHMCDPEKGRAFMARIDKLA

SEQ ID NO: 6433 - protein, 448 aa, unidentified
  source 1..448: note = Related to JABJWV010000001.1; note = Pseudenhygromyxa sp.
MANDTSSTTATTADGPEWADIEAAGSIRNWVDAELDRRGLLDDGADTSRMSDKQRKAYKTKREEERVLRRKLMAQGWACYRQNKLVHVGVGVWYHDTADIDRWDIADLDGRRQLNELPELKDVHALAKVLELAMPRLRWLVYHREVDSGTHYHRWTVPKRSGKGVRLISAPKPELKRCQTWIARNISEHLPVHGAAHGFLAGRSTLTNAAAHAGAEVVVKFDVRDFYPTVTFRRVKGLFRKAGYGEQVAIVLALLCTECPRETIEIGGRTYHVATGPRSLPQGAPTSPSITNALCMRLDARLTGLARKLGFRYTRYADDLTFSYHRGEGGEGEQETGKIPVARLRKAVTEIVASEGFRVHEGKTRVMRSGGRQKVTGLVVNGAGEGVPTARVPRKLVRELRAAIRNRELGKPGKGESLEQLRGWAAYVHMCDPSKGRAFIARLEKLAE

SEQ ID NO: 6434 - protein, 437 aa, unidentified
  source 1..437: note = Related to NZ_ABCS01000226.1; note = Plesiocystis pacifica
MANDTTAEVEGTPPKWADIEAAGNIRNWVDAELERRGLRDPGVDTSRLSDKQRKAYKAKREEERRVRRVLQGQAWQVYRQNHLVHVGVGVWYHDTADIDRWDIAGIDERRELNELPELKDVHALAKALELPIPKLRWLVYHREVDTGTHYQRWTVPKRSGKGVRLISAPKPTLKRCQTWVARNITEHLPVHGAAHGFLTGRSTVTNAAVHAGARVVVKFDVKDFYPTVSFRRVKGMMRKAGYGEQVATVLALLTTECPRESIELHGRTHYVATGPRSLPQGAPTSPSITNALCLRLDSRLTGLARKLGFRYTRYADDLTFSFHGAGKIPVGRLQKAVADIVKDEGFIIHPHKTRVMRKGGRQKVTGLVINGAPEGAAKARVPRKVVRELRAAIRNRELGKPGKGESLEQLRGMAAYIHMCDPAKGKAFLDRINALSS

SEQ ID NO: 6435 - protein, 442 aa, unidentified
  source 1..442: note = Related to JAEPMI010000008.1; note = Deltaproteobacteria bacterium
MADSHDSTEVSLPEWKGIAEAGGIESWIHRELERRQLIEEVDYASLSKAEKKAYKARRDEERRVRRLLRKHAWQAYKKAHVVHLGRGVFYHDTPDYDRYDIDGREERLADNALPEIADASALAEALGITVPTMRWLAYHREVDSGTHYRRWTVPKRDGRRRLISEPKPQLKEAQRWIAREITDHLPVHGAAHGFLAGRSTVTNAAVHAGARIVVKLDLKDYYPTITTPRVKGMFRKAGYGEQVATLLAMLCTESPREEIELDGKTWYVATGPRSLPQGAPTSPSITNAISLRLDLRLAGLARKMGFRYTRYADDLTFSHHQRSEAPIGSLFRLVGQIVVEEGFEVHPKKTRVMRSGSRQKVTGLVVNGADGAPAARVPRSVRRKLRAAIKNRELGRPGEGESLAQLRGWAAYVYMTDPAKGRALLDRLAALGGESDEGGTDG

SEQ ID NO: 6436 - protein, 433 aa, unidentified
  source 1..433: note = Related to JACKEN010000012.1; note = Deltaproteobacteria bacterium
MTTAAEDKLPDWAGIAAEGGIDAWVRSELMRRDLIDDRDTTQLSEREKKQYKARREEERRVRRLLQKHAWGAYRAAHVVHVGVGVFYHDTPDIDRFDIDDPGARRVLNDLPELADATTLAARLELTIPRMRWLAYHREVDSGTHYHRWKVPKRSGGERLISAPKPELKRVQHWIAEHITEHLPVHAAAHGFMAGRSTVSNAAAHAGARCVVKMDLEDFYPTITTPRVKGMFRKAGYGEQVATLLALLVTESPREEVPIDGKTFHVAVGARSLPQGAPTSPSITNAICLRLDTRLMALCRVLGFTYTRYADDLTFSWHQEGDAPVGHLLRAVGGIVTDEGFRVHRKKTRVMRQGRRQKITGLVVNGAHDVPARVPRLVIRQLRAAIKNRELGREGRGESLAELRGMAAYVNMSDPTKGRAFLQRLAALSKRGES

SEQ ID NO: 6437 - protein, 445 aa, unidentified
  source 1..445: note = Related to JAFGRB010000173.1; note = Deltaproteobacteria bacterium
MSDSTADKQRTEWRSIAEAGGTDAWVHQELLRQGLIDEGVDTASMGDKERKAYKARREEERRVRKILRKDAWAAYRRAHLVHVGTGVFYHDTADIDRFDIDDPEQRRQQNDLPALATAQDLAQALDLPMPRLRWLVYHREVDTGSHYHFWTVPKRSGGERLISAPKPDLKKAQRWIAEHISERLPIHGAAHGFVAGRSTVTNARLHAGAAVVVKFDLEAFYPTITFPRVKGLFRKAGYGEQVATVLALLCTESPREQVALKGKLYYVAVGPRSLPQGAPTSPSITNAICLRLDARLAGLARAAGWRYSRYADDLTFSWHRRDAAAPVGRLMRMLGRIGSDEGFALHRKKTRVLRSGRRQKVCGLVVNAAGDGQPRARVPRKIVRELRAAIRNRELGREGWDESLAELAGMASYVHMADPKKGRAFLDRIAALQAAGQQSGGEVSS

SEQ ID NO: 6438 - protein, 450 aa, unidentified
  source 1..450: note = Related to JAHQVK010000212.1; note = Myxococcales bacterium
MTESSTPPSSEYIDLPEWTAIAAKGGIHYWIQEELAKKGLLDDQAPSSPSVREKKQYRARRDEERRVRRRLAQHAWAAYRRAHLVHVGLDVFYHDTPDIDRYDVVDPPARRATNSVPEIPDARRLAEILDLPMPRLRWLVFHREVDSGTHYHRWTIPKRDGSERLISAPKPELKRVQKWISQQITEHLPVHGAAHGFLAARSTVTCAQVHAGARVLVKTDLKDFYPTITFPRVKGIFRKAGYGEQVATLLALLCTECPRDKIVRANKTYYVAVGPRSLPQGAPTSPSLTNVTCFRLDDRLTGLAKKFGVCYTRYADDLTFSWHTPGEASVGLLLGIIRGIVTDEGFELHPNKTQILSSGRRQKVTGLVVNRSDADVSVRVPRKVVRQLRSAIKNRENDRDGPESLAQLKGMAAYIHMADPVKGRQFLERIAQLEARQTVAVGSEMADRVE

SEQ ID NO: 6439 - protein, 456 aa, unidentified
  source 1..456: note = Related to JACQYO010000157.1; note = Deltaproteobacteria bacterium
MTEPNQSTQNPTGSVGGGSSELSVRVPDWAAVVEAGGRDAFIERELLRLGLVDESTEPGKLSDSEKKAFKARREEERRVRRELDKATWASYRAAHILHLGAGVFYSEGIDIDRFDLDDPKARRDANGLPDIANAQALAKLLGISMFRLRQLTYHRDVDSGSNYIRWMIPKRSGGLRLISAPKKELKRIQRFVAKEIVEHLPMHGSSHGFVRGRSTRSNAIKHAKAEVIIKLDLSSFYPTITFPRVKGLFRKAGYQEKIATLLALLVTESPREERHVENRTYYVANGPRSLPQGAPTSPAITNTLCLRLDSRLDGLCAKWGLVYTRYADDLTFSAKKGSKVHVGKAIGAVKRIVSEEGFVVHPAKTRIMRGGRRQKVTGLVVNAAPGAPLARVPRKLVRRLRAAITNRERNKPLREGAETIEQLRGYAAYVAMTDPPKGKAFLDRINRLAEREPTAG

SEQ ID NO: 6440 - protein, 443 aa, unidentified
  source 1..443: note = Related to JACPFK010000066.1; note = Deltaproteobacteria bacterium
MSQTNDPLTGQALVAPLDWGAVKEAGGRENFIDKELARRGLTDSSDPSVLGDSEKKSFKARREEERRVRKELEKAVWAAYRAAHIVHLGSGVFFNDAIDIDKYDLEDPKGRREANDLPDIPSPAELAKVLGISMRRLRQLTFHRDVDSGTNYVRWTIPKRTGALRLISAPKKELKRAQRWINREIVEHLPVHGAAHGFVRGRSTLTNATPHARAEVIVKLDLSDFYPTITFPRVKGLFRKAGYQERIATLLALLVTESPRDTRVLSGRTYYVANGPRSLPQGAPTSPAITNALCLRLDARLDGLARKFKVEYTRYADDLTFSAQRGTTPDLGRFLGAVKRVVREEGFLVHPKKTRIMRGGRRQKVTGLVVNAAKGRPVARAPRKLVRALRAAITNRERGKQAGPETLEQLRGYAAYVSMTDPARGKAFLERILRLADRGGAER

SEQ ID NO: 6441 - protein, 469 aa, unidentified
  source 1..469: note = Related to JAGQIK010000702.1; note = Myxococcales bacterium
MSEQPQTHTPDGAEAAAPPPPPPPAPAASPPEAAPRLTWDVIAEDGGIRGWIDAELRRRDLVDDGVDTQSMSDKQRKRYKARREQERRVRRELRKQAWACYREAHLVHLGASVFYHDTPDVDRYDIAEPEERLRENDLPLLKDARALADALHLSVPRLRWLTFHREVDSGSHYVRWTIPKRSGGTRLISSPKRDLKDAQRFIARKISEHLPVHSAAHGFLGGRSTVTNARAHAGAEVVIKLDIKDFYPTVTMPRVKGMFRKAGYGEQVATVLALLCTDAPREAMLLRGQTRYVATGPRSLPQGAPTSPSITNAICLRMDSRLSGLARKLGFRYTRYADDLTFSWHDGKKPAPVGMLLGGVRKIVSSEGFVVHPNKTRVMRKGRAQRVTGLVVNAAGEGAAPARVPRKLVRRLRAAIHNRERGKAREGETLAQLAGWAAYLNMTDPERAQPMLARIHRLMRGERDSSSGE

SEQ ID NO: 6442 - protein, 435 aa, unidentified
  source 1..435: note = Related to JAIOJK010001035.1; note = Sandaracinaceae bacterium
MSAEIQTTTPATAEPIPPWASVREAGGIREWVEAELARRGLIESVDTSALSAEQKKQFKARRDEERRVRRLLRKAAWASYKRAHLVHLGAGIFHHDTADLDRFDADDPEARRKDNDLPELADAQALAAALGLPIPTLRWLAFHREVDTGTHYHRWTVPKRSGGARLISAPKKTLKTAQKWIATNIVEHLPVHGAAHGFLPGRSTKTNAEVHVGARLVVKLDLSDFYPTITLERVKGLFRKAGYGEQVATVLALLCTESPREAISLRGRTCYVALGPRSLPQGAPTSPSITNALCLRMDSRLSGLARKFGFRYSRYADDLAFSWHGEGEGPVGELLGAVHRIVRGEGFVVHPKKTRILRCGRRQKVTGLVVNGQGPPRVPRALVRKLRAAIHHREHGKQGKGETLAQLRGWAAYVHMCDPQKGRAFLERLAKLGEA

SEQ ID NO: 6443 - protein, 449 aa, unidentified
  source 1..449: note = Related to NC_013440.1; note = Haliangium ochraceum
MSDPSQQTATGTATGTDPVPPEWPQIAEAGGIHNWVQADLRRRGLIEEVDTASLSDKQRKAFRARRDEERRVRKLLYAQAWAAYKRAHLVHVGVGVFYHDVADYDRFDIAEPEQRRQENDLPALADTTALAEALELPIPRLRWLVYHREVDRHTHYHRWTVPKRSGGERLISAPKPELKRAQRWIARNITEHLPVHGAAHGFLPGRSTATNAAVHAGARVIIKFDIRDFYPSVTLPRVKGVFRKAGYGEQVATVMALLCTEPPREEMVLRDKKYYVAVGPRSLPQGAPTSPSITNALALGLDSRLAGLARSLACRYTRYADDLTFSWHGDSEAPIQRLKNAVARIVHGEGFRVHEGKTRIMRAGGRQKVTGLVVNAAAGEGAMPPARVPRDVVRRVRAAIHNRERGKPGGEETLEQLRGWAAYIYMTNPERGRQFLERLDALADDGSSS

SEQ ID NO: 6444 - protein, 475 aa, unidentified
  source 1..475: note = Related to JAESTW010000770.1; note = Kofleriaceae bacterium
MTASDTNQNPQTAKPQSAKPQSESPQAHSTSERVEWTVIAEAGGIHTWVYSELERQGLIDNVDTSTLTAAERKRYRKKRDEERVVRKILQKKAWKSYREAHIVHVGRGVFYHDTPDVDVYDVEDPKGRLESNDLPPIADALGLAKRLGIGIPKLRWLVFNREVDTGCHYHYWTVPKRDGGRRLISAPKPELKKAQAWIARTISEHLPIHGAAHGFVPGRSTVTNAAVHAGASVVFKFDIKDFFPSVTTNRVKGLLRKAGYGEQVATLMALLCTEFPREELMLRGRKHYVAIGARGLPQGAPTSPSLTNALCMRLDCRLTGLANSIGLKYSRYADDLTFSWHGEGKEAPVMRLRHAVRKIVSAEGFVIKDSKTRILRSGRRQRVTGLVVNKAESAEDARVPRFMLRQIRTAIYKLERGQEAKESLEQLRGWAAYVYMTDKKRGADMLSRLAAISSATTATTTSSASNSSTTTGAKI

SEQ ID NO: 6445 - protein, 442 aa, unidentified
  source 1..442: note = Related to PABA01000191.1; note = Sandaracinus sp.
MSEDTLESEEAPAAVDPAAPPTARWPDIAAAGGIQPWVLAELRRRDLVDEGVDTSRLSAKEKKRFKARREEERRVRRLLKKHAWAEYRRAHLVHVGVGVFHHDTADVDKYDLPDPDARRAENDLPPLKDQHALAEALAIDIPTLRWLCYHREVDTGTHYRRWTIPKRSGGERLISAPKPTLMRCQRWIAQHVTERLPIHGAAHGFVPGRGTLTNAAAHAGAKTVVKLDLKDFYPTLTLPRVKGLFRKAGYGEQTATLLALLCTEAPREEMVIRGERRYVAIGDRSLPQGAPTSPSITNAICLRLDARLTGLAKKLGFTYTRYADDLAFSSDRRKAAVGKLVDAVYRITADEGFRVHPKKTRVMREGRRQQITGLVVNGQGEGPPARVPRKLVRQLRAAIHHRENGRPGKGESLEQLRGWAAYVYMCDPDKGRAFLDRLAKLQ

SEQ ID NO: 6446 - protein, 445 aa, unidentified
  source 1..445: note = Related to JACKDV010000022.1; note = Myxococcales bacterium
MTDASPERALPPWAEIAEAGGIDAWVVAELKARGLWEEGVDTSSLGDRERKKFKARREEERRVRKQLRRHAWSEFRRNHLVHVGAGVFYHDTADVDRYDIGDPETRRQDNALPKLAHAGDLAKEIGLTVPRLRWLVFHREVDTGTHYHRWHVPKRDGSLRLISAPKPQLKAAQRWIARNITEHLPVHGAAHGFVPGRSTVTNAAVHAGAEVVIKLDLQGFYPTITMPRVKGLMRKAGYGEQVATILALLCTESPREIIELNGKAHHVAIGPRSLPQGAPTSPSITNALCLRLDRRMQGLATKLGFRYSRYADDLTFSWHQADADAPVGKLLHRVRSIVGAEGFAVHPAKTRVMRSGRRQKVTGLVVNGVSAAEGAPEVPPARVPRKLRRMLRAALHNRTQGKDGPESLDRLHGFAAYVYMTDPRQGQALLERAAALREGAAGGTT

SEQ ID NO: 6447 - protein, 338 aa, unidentified
  source 1..338: note = Related to JAGQIQ010001415.1; note = Myxococcales bacterium
MTDPAATRPLPPWSEIAEAGGVDAWIVAELRARGLWEEGVDTSTLSDRDRKKYKARREEERRVRRELRRHAWAEFRRNNLVHIGAGIFYHDTADVDRFDIKDPDARRQDNALPKLPDTAALAKALGLGMPRLRWLVFHRQVDRGTHYHRWHVPKRDGGLRLISAPKPDLKAAQRWIARNITEHLPVHGAAHGFVPGRSTVTNAQVHAGARVVIKLDLQNFYPTITQPRVKGLLRKAGYGEQVATVLSMLCTESPREVIELRGTPHHVAIGPRSLPQGAPTSPSITNALCLRLDRRMQGLAGTLGFRYSRYADDLTFSWHADGEAPVGKLLHRVRSIVG

SEQ ID NO: 6448 - protein, 485 aa, unidentified
  source 1..485: note = Related to NZ_RAVZ01000142.1; note = Corallococcus terminator
MTAKLESFVPAAPPQAVPEVPPAAAASNTAIASKREARRAAHDVLLARWKAITEAGGTEEWVQAQLLSKGALADEVDFSSLKEKEKNAWKEKKKAEAVERRALGRQAHEAWKATHINHLGVGIHWSEAPGPDRFDLEHREERARVNGLPALDTAEALAKALDISVSKLRGFAFHRDVDTGSNYVSWRIPKRDGSERTITSPKPELKEAQRWVLSNVVERLPVHGAAHGFVAGRSILTNALAHQGADVVVKVDLKDFFPTVTWRRVKGLLRKGGLPEGTSTLLALMSTEAPRELLSFRGKTLHVAKGPRALPQGAPTSPGITNALCLRMDKRLSALSRKLGFTYTRYADDLTFSWTKAKAPRARRAQGAPVAVLLARVKDVVEAEGFTVHPNKTRVARKGSRQRVTGLVVNEAKDGTPAARVPRDVVRRLRAAIHNRQKGKPGREGESLEQLKGMAAFLYMTDPVKGRAYLDQLAKLEATETPAQA

SEQ ID NO: 6449 - protein, 486 aa, unidentified
  source 1..486: note = Related to NZ_FOIB01000017.1; note = Myxococcus fulvus
MTARLESFVPAAAPQAVATPAPQAPSANTVAQREARRAAHEALLARWKAIVEAGGADEWAQAQLVSRGLAVGELDFSSASEKEKTAWKEKKKAEAAERRALGRQAHEAWKATHVGHLGAGVHWEEEGGSDKFDIAHREERARANGLPELGSAEVLAKALGLSVSKLRWFAFHREVDTGSHYISWGIPKRDGGTRTITSPKPELKEAQRWVLSNVVERLPVHGAAHGFVAGRSILTNALAHHSADVVVKVDLKDFFPSVTWRRVKGLLRKGGLPENTSTLLALMSTEAPREAVQFRGKTLYVAKGPRSLPQGAPTSPGITNALCLKLDKRLSALSKKLGFVYTRYADDLTFSWTKTKQPKARRAQGAPVAVLLARVKDVVESEGFRVHPEKTRVSRKGTRQQVTGLVVNRARDGVASARVPRDVVRRLRAAIHNRQKGKPGREGESLEQLKGMAAFVYMTDETKGRAFLKSLEQLEAREKEAAPKAP

SEQ ID NO: 6450 - protein, 484 aa, unidentified
  source 1..484: note = Related to NZ_CP012109.1; note = Myxococcus sp.
MTARLDPFVPAASPQAVPTPEPTPPAPDAAAKREARRLAHEALLARAKAIDEAGGADDWVQAQLVAKGLSVDDLDFSSASEKDKKAWKEKKKAEAVERRALKRQAHEAWKATHVGHLGAGVHWTEDRPADAFDVPNREERARANGLTELDSTEALAKALKLSVPKLRWFAFHREVDTATHYVSWTIPKRDGSKRTITSPKPELKEAQRWVLSNIVERLPVHSAAHGFVAGRSILTNALAHQGADVVVKVDLKDFFPSVTWRRVKGLLRKGGLAEGSATLLSLMSTEAPREAVQFRGKLLYVAKGPRSLPQGAPTSPGITNALCLKLDKRLSALAKRMGFTYTRYADDLTFSWTKAKQPKARRTQRPPVAMLLSRVQEVVEAEGFRVHPDKTRVARKGTRQRVTGLVVNTAGKNAPAARVPRDVVRQLRAAIHNRKKGKPGREDESLEQLKGMAAFIHMTDPAKGRAFLAQLAELESAAPATPAQ

SEQ ID NO: 6451 - protein, 485 aa, unidentified
  source 1..485: note = Related to JABBJJ010000287.1; note = Pyxidicoccus fallax
MTARLESFVPAASPQTVSTPAPAAPAANAASQREARRAAHEALLTRWKAIVESGGADSWVQGQLVSRGLAVGDLDFARASDKEKTAWKEKKKAEAAERRALERQAHEAWKATHVAHLGAGVHWEEDAAGDKFDIAAREERARANGLPELDSTDALAKALGLSVSKLRWFAFHREVDTGSHYVSWKIPKRDGGSRTITSPKPELKEAQRWVLANVVEKLPVHGAAHGFVAGRSILTNALAHQGADVVVKVDLKDFFPSVTWRRVKGLLRKGGLPESASTLLALMATEAPREAVQFRGKLLYVAKGPRSLPQGAPTSPGITNALCLRLDKRLSALSKRLGFTYTRYADDLTFSWTKAKQPKAKRSQRPPVAVLLSRVQSVVEAEGFRVHPDKTRVARKGTRQRVTGLVVNEAANGKPAARVPRDVVRRLRAAIHNREQGKPGREGESLDQLKGMAAFIHMTDPVKGRAFLEQLAKLEAKEQQSPPAA

SEQ ID NO: 6452 - protein, 486 aa, unidentified
  source 1..486: note = Related to NC_020126.1; note = Myxococcus stipitatus
MTGRLESFVPAAAPQTVPTPAPQAATATALVQREARRVAYEALVTRWKAIVEAGGADAWVQAQLVSRGLAVGDLESGVTEKEKTAWKEKKKAEATERRALLRQTHEAWKATHVGHLGPNIHWEEKDGGSDKFDIPHREERARANGMPELGSAEALAKALGLSISKLRGFAFHREVDTGSNYVSWGIPKRDGGTRTITSPKPELKEAQRWVLANVVERLPVHGAAHGFVAGRSILTNALAHQGADVVVKVDVKDFFPSVTWRRVKGLLRKGGLPENASTLLALMSTEAPRETVQFRGKTLHVAKGPRALPQGAPTSPGITNALCLKLDKRLSALSKRLGFTYTRYADDLTFSWTKAKQPKARRAQGAPVAVLLTRVKDVVEAEGFRLHPEKTRVSRKGTRQQVTGLVVNQARNGVPAARVPRDVVRRLRAAIHNREQGKPGREGESLEQLKGMAAFVFMTDAAKGRAFLDSLARLEARETPEAPKVT

SEQ ID NO: 6453 - protein, 483 aa, unidentified
  source 1..483: note = Related to NZ_JAHNZT010000021.1; note = Citreicoccus inhibens
MTAKLESFVPAAPPQAIATPTPVTPTAQALVQRETRQAARAAVLARWKAITEAGGQDEWVHQQLVARGALAEEVDFSSLKEKEKTAWKEKKKAEATERRALKRLAYEAWKATHIGHLGAGIHWNEEGGADAFDIPHREERAKSNGLPEFTSAEDVAKALGLGVSKLRWFAFHREVDTATHYTSWRIPKRDGGSRTITSPKTELKAAQRWVLSNIVERLPVHGAAHGFVAGRSILTNALAHRGADVVVKVDVKDFFPSVTWPRVKGLLRKGGLPENIATLLALLATEAPREAVSFRGKTLYVAQGPRALPQGAPTSPGITNALCLRLDKRLSALSRKLGFVYTRYADDLTFSWTKAKAPKARRAQGAPVAVLLARVQEVVEAEGFRLHPDKTRVARKGSRQRVTGLVVNDAGPKVPAARVPRDVVRRLRAALHNREQGKPGKEGESLEQLQGMAAFIHMTDPAKGRAFMERLEKLSARPATTAA

SEQ ID NO: 6454 - protein, 474 aa, unidentified
  source 1..474: note = Related to NZ_JPMI01000131.1; note = Archangium violaceum
MTAKLETFVPAAAPVVVPAPAPAAPSANVVARREVSQREEQARLARWKAIEEAGGQEAWVEAELKARGLAPEHEDPSGLSEKEKTAWKEKKKAEAAERRALKRLAWEAWRTAHINHLGAGVHWEEAGGPDTFDLKDREERARANGLPELESAQTLAKALGLSVSRLRWFAYHREVDTGTHYRSWEIPKRDGGKRTITSPKKELKEAQRWVLANVVERLPVHGAAHGFVAGRSIVTNAMAHKGADVVVKMDIKDFFPSVTWQRVKGLLRKGGLAEGTATLLALMATEAPREVVQFRGKTLYVAKGPRALPQGAPTSPGITNALCLRLDKRLSALSRRLGFAYTRYADDMTFSWKKSRGKTEAPVAVLIARVEKVLEAEGFRVHPDKTRVMRPGNRQVVTGLVVNEAAKGQPGARVPREVVRQLRAALHNREKGKPGKEGETLDQLKGMAAFIHMTDPAKGRAFLERLSALEKREA

SEQ ID NO: 6455 - protein, 481 aa, unidentified
  source 1..481: note = Related to NZ_JAHXBG010000001.1; note = Cystobacter gracilis
MTSKLESYVPAAPPQPATAPAPGSPSPATLAQREARRQQHEALLTRWKAIQEAGGADEWVRAQLVAKGAAAEEVDFEELSEKQKSAWKEKKKAEAVERRALERQAWEAWKATHINHLGTGVHWDEQGGPDKFDVPNREERAKANGMPELDSPEALAKALGVTVSRLRWFAFHREVDTGTHYQSWRIPKRDGGQRTITAPKKELKAAQRWVLANVVERLPVHGAAHGFVAGRSILTNALAHRGAEVLVKVDVKDFFPSVTWQRVKGLLRKGGLPEGAATLLSMLSTEAPREVMEFRGKTLYVAKGPRALPQGAPTSPALTNALCLKLDKRVSAMAKRLGFTYTRYADDLTFSWRRAKGAKGKAQADAPVAVLLARVKSILEAEGFTMHPEKTRVLRKGTQQRVTGLVVNEAPDGVPAARVPRDVVRRLRAAIHNREKGKPGKEGETLEQLKGMAAFIHMTDPAKGRAFLQRLEALEKLEPPK

SEQ ID NO: 6456 - protein, 475 aa, unidentified
  source 1..475: note = Related to NZ_FOAP01000003.1; note = Stigmatella aurantiaca
MTAKLEPHVPAAPPVPGEAPAPTRPDPAKQEARRAHHEALRLRWKAIEEAGGTDAWVRQQLVAKGVAADEVDFESLTDKQKAAWKEKKKAEATERRAQKRLAWEAWKATHIHHLGVGVHWDEAGGPDTFDVENREERAKANGLPETLDSAEALAKALGISLSRLRWFSFHREVDTGTHYQTWEIPKRDGGKRTLTSPKRELKAVQRWVLANVVERLPVHGAAHGFVAGRSILTNALAHRGADVVVKVDMKDFFPSVTWRRVKGLLRKGGLTENLATLLSLLATEAPREVVRFRGQTLYVAQGPRALPQGAPTSPALTNALCLRLDKRVSALSKRLGFTYTRYADDLTFSWRRTKAPGQADAPVALLLARVKGVLEAEGFTLHPDKTRVQRKGSRQRVTGLVVNEAPEGAPGARVPRDVVRKLRAAIHNREQGKPGPEGETLEQLKGLAAFVHMTDAEKGRAFLRRLEALEQRQAR

SEQ ID NO: 6457 - protein, 467 aa, unidentified
  source 1..467: note = Related to JACSRE010000153.1; note = Myxococcus sp.
MTNRIDDHVFAAPPVLTTRAPPRVKLTAAERAERERQRTAAEARWLEIEAKGGVDGWVRAKLIEAGHHPDVAGPASEDEKKTFKEKKTAERAERKALRALANEARRFGTVGFLGNTVHWDDLKGPDDFDLKDRAARAERNGLPPWETATELAAAMDLSLSELRWLTFHREVSTSTHYHSWKVPKRSGGERTITAPLPKLKALQRWALEHYFEKLPVHAAAHGFLPARSVLTNALAHVGADVVVKLDVKDFFPTVSWKRVKGLLRKAGATEQVATLLALLCTEAPRQLIEFREQTLHVATGPRVLPQGAPTSPAITNALCLRLDQRLSALARALGCTYTRYADDLTFSFKKTPERKRLALGILVETTKDILKSEGFALHAKKTQVLRRGAAQRVTGLTVNEAGPQVAKARVARDVVRRLRAAIHNRAKGKPYREGESHAHLQGLAAWVFMSDPKRGAQLLEQVAKLPQ

SEQ ID NO: 6458 - protein, 478 aa, unidentified
  source 1..478: note = Related to JAGNNG010000134.1; note = Deltaproteobacteria bacterium
MTARIDTYVKASPVSAAQPRQGQLSAAERAQREQERADRQARWLAIREAGGIDKWIDQQLASRGLASDGGDESALIERDKAGYKAKKKAEAEARRALRQKAWQAYHATHINHLGAGIHWEDDPDVDRFDVENRSERARDNGLPEISTPEQLAKAMGLSIPKLRQLTYHRETDTGSNYYSFTIPKRDGSPRSIFAPKRDLKAAQRWMLRQVAERLPVHSAAHGFLPDRSILTNALQHVGAHTLVKVDIRDFFPTVTWRRVRGLLRKGGLSEQAATLLSLLATEAPREVVQFRGKTLHVATGPRALPQGAPTSPALTNALCMRLDRRMSGLARLLGCRYTRYADDLTFSFCHADGHTGTGRAPVGALLRGVGQILTAEGFKLHPDKTRVVRVGERQRVTGLVINQVPKGVTAPGARVPRDVLRRLRAALHNREQGKPGKPGETLDQLSGMAAFVHMTDPARGRVLLDRLAALKAKQPEAT

SEQ ID NO: 6459 - protein, 479 aa, unidentified
  source 1..479: note = Related to NZ_ASRX01000060.1; note = Chondromyces apiculatus
MTAKIDPIVQAAQPAILPVTTAPSVKPAGTPEERQRAHEERVARWKAITEAGGIDAWVQAELTSRGLLVSGDPARMSERERSQWKERKKAEVKERRTLRRLAWKAYLGTHIAHLGQGVHWEDKKGADKFDVPQREERAKALGLPQLAGAEDLAAGMELSVARLRWLAFHREVDTGSHYRRWTIPKRDGSERLITAPKKELKRAQRWALRNVFEKLPVHGSAHGFLSARSIVTNAAVHAGADVVIKIDIKDFFPTVTWRRVRGLLRKAGLAEGPATLLALISTEAPREVVQFRGKTLYVASGPRVLPQGAPTSPAITNALCLRLDRRMAGLARKLGLRYTRYADDLTFSWKSPATGETSREVPRARAPIGPLLHGTREILGAEGFRLHPTKTAVMRRGDQQKVTGLVVNAAGPSVPPVRVPREKVRELRAAIRNRELGREGKGETLAQLKGLAAFVFMADPVRGRAFLDRLAALETRAGG

SEQ ID NO: 6460 - protein, 492 aa, unidentified
  source 1..492: note = Related to NZ_CP012159.1; note = Chondromyces crocatus
MTAKIDPIVQAAAPVVLPVTTAPAVKPTETAEERQRALEERVARWKAITEAGGIDSWVQAELSSRGLLVSGDPARMSDRERSQWKERKKAEVKERRTLRRQAWSAYLSSHIAHLGQGVHWEEKTGVDKFDVAQREERARALGLPAIASAEELAAKLEIPVARLRWLAFHREVDTGSHYKRWFIPKRDGTQRLITSPKRDLKRAQRWALRHVFEKLPVHGTAHGFLSARSIVTNAEAHAGADVVVKVDIKDFFPTVTWRRVRGLLRKAGLAEGPATLLSLLSTEAPRDVVQFRGKTLYVANGPRVLPQGAPTSPAITNALCLRLDRRMSGLARKLGMRYTRYADDLTFSWRAPAAAVASETGKKGKGKADAKAAEPRPQAPVGALLRAARDILGGEGFRLHPTKTTVMRRGDQQKVTGLVVNAAGSSVPAVRVPRERVRELRAAIRNRELGREGKGETLDQLKGLAAFVHMADPVRGRAFLERIAALESRSSG

SEQ ID NO: 6461 - protein, 500 aa, unidentified
  source 1..500: note = Related to NC_010162.1; note = Sorangium cellulosum
MTAKIDATVQARAPVVLPITTPPAPGGAAARFHAAAGAEARRLAHEERVARWKAIDEAGGIDAWVSAELTSKGALATGDPKAMSDRERAQWKERKKVEARERRSLRRLAWEAYVATHVNHLGAGVHWSDRVGPDRLDVPGLSERARAHGLPDLPGAAELASALGLSIPRLRWLAYHREVDTGTHYRRWHIPKRDGSARTISSPKRDLKRAQRWALRNLFEKLPVHAAAHGFLASRSIVTNAAAHAGADTIVKVDIKDFFPTITWRRVRGLLRKAGVAEGPATLVALLSTEAPRDVVQFRGQTLYVATGPRVLPQGAPTSPAITNAICLRLDRRASGLARKLGLRYTRYADDLTFSFRATEAPGLAGAARPRAPVGALLRGLREILSSEGFRLHPSKTVVMRKGSRQKVTGLVVNHASEGAPAARVPRERVRALRAAIRNRELGRPGKGETLAQLKGLAAFVYMTDPAKGRAFLGRIEALERNQPAPVGEAGPHDARPVLT

SEQ ID NO: 6462 - protein, 452 aa, unidentified
  source 1..452: note = Related to JADLAG010000095.1; note = Polyangiaceae bacterium
MTEAGGIDAWVSAQLAAKGLAVTGDPASMSDRERGQYKERKKAEAKERRALRKLAWEAYLETHVTHLGAGVHWEDDAGPDRFDAPNREERARLIGLPALETADALAGALEVPVAKLRWLAYHREVDTGSHYRRWQIPKRDGTARTITAPKRDLKRAQRWALRHVFDKLPVHGAAHGFLADRSIVTNAVAHAGADVVVKVDIKDFFPTITWRRVRGLLRKAGVAEAPATLIARLSTEPPREVVQFRGKTLHVATGPRVLPQGAPTSPAITNAICLRLDRRMSGLARKLGFRYTRYADDLTLSWRAGGPPAAPPAAAAPGPGSPGGARSQRPPIGSLLRGIKQILLSEGFRLHPSKTVVMRRGDRQKVTGLVVKGAGDWVPPARVPRERVRELRAAIKNRELGRPGKGETLQQLKGLAAFVYMTDPVRGRAFLDRLAALEALQVKSGGAGEPTG

SEQ ID NO: 6463 - protein, 484 aa, unidentified
  source 1..484: note = Polyangiaceae bacterium; note = Related to JABWBE010000187.1
MTAKIDTSVRAAPPVVLPITTTPPSPPRVSAEERARVLEERLSRWKAISEGGGIDQWVSAQLTAKGALVTGDPSRMSDKERAQYKERKKVEAKERRSLRKLAWEAYAATHISHLGAGIHWEDSTDADKFDIANREERAKTIGLPPLVGAVDLAKALDIPITRLRWMAFHREVDTGSHYRRWLIPKRDGSSRTITAPKRDLKRAQRWALRNVFDRLPVHGAAHGFLSARSIVTNAKAHAGADTVVKVDIKDFFPTVTWRRVRGLLRKAGMAEGPATLLALLSTEAPREIVQFRGKTLYVATGPRVLPQGAPTSPAITNAICLRLDRRVSGLAKKLGFRYTRYADDLTLSWRAPVKPDAGTSPRAPIGTLLRGLKEILQSEGFRMHPSKTAIMRAGMRQKVTGLVINKAGENIPDARVPRDTLRRLRAAIKNRELGRPGKGESLAQLKGLAAFVYMTDPVRGRSLLDRIDMLEARSEGGGSPTPAT

SEQ ID NO: 6464 - protein, 476 aa, unidentified
  source 1..476: note = Myxococcales bacterium; note = Related to SECR01001138.1
MDPWITAQLKAKGLLTEDLSDEEDEDEDESDDDDDEDSDDEDSNDEDSDDEDSDEDAPPRKAAAKKAVAKAAPKVKSDLGKREYKEKKQAEAVERRVLKRLARQAYTAAHIAHLGAGIFWRDDTRRPDAFDHPQRETRAQELKLELTDAKQLAGALGLTIPALRWLSFHREVDTGTHYRSWQIPKRDGKSTRTISSPKKQLKTAQRWLLRNVLEKLPVHGAAHGFLSARSIVTNAQVHAGAEVVIKVDIKDFFPSITWKRVKGLLRKHGLPEGVATLLSLLSTEAPRDVVQFRGKTLYVAKGPRALPQGAPTSPALTNAICLRLDRRLSGLARSLGFRYTRYADDLTFSWHPEPVLPGTSPQPGTGALLRGIGQILEGEGFSLNQAKTRIMRDGTRQAITGLIVNGAPGKATARVPRETLRQLRAAIHNREAGKPGRPGEGLEQLRGMAAFVHMTDAARGKALLARIDALAARDKG

SEQ ID NO: 6465 - protein, 470 aa, unidentified
  source 1..470: note = Related to JADJRH010000001.1; note = Polyangiaceae bacterium
MTAPFDPHLPADSPVRAEPRSTTRRSPEETAKLAAVRAERVALWKAIEEAGGIAAWVRAEIAKKGISTDGVDPSTLSDRQKSSFKDKKRAESEARRTFKRLAWDAYKETHITHLGGIYWDEDASPDKFDIDGREERAKDNILTDIQSPGALAQALGLTVAKLRWLTFHRDVDSGTHYRRWQIPKRDGSMRTITAPKLHMKTAQRWALRNVFDKLPVHGAAHGFLAARSIVTNASVHAGADVVVKIDIEEFFPTITFRRVKGLLRKAGLSEQAATLIALLCTEPPRESVNFRGKTVYVASGPRALPQGAPTSPAITNALCRRMDLRLSGLARLLGLKYTRYADDLTFSWKCPTPGAKAPLGVLLRGVTTILKSEGFRIHKKKTSIMRKGARQAVTGLIINSEVGAASARVPRDVIRNLRAAIKNRELGRPGKEGETLAQLQGLAAFVYMSDPVKGRTFLDRIAKLQAPTKT

SEQ ID NO: 6466 - protein, 468 aa, unidentified
  source 1..468: note = Myxococcales bacterium; note = Related to JAEUKI010000081.1
MASKLETMVSAAAPVEKEQPAPKSAPTEEQLAARAKAHEERVLRWKQVQEAGGADEWIRGELRKKGLLVESDPSRLGDREKGSFKEQKKAEAAERRALKKLVWDAYRATHVVHLGVGVHWSDHFEADRFDIERREDRLKANDLPEYKDAEGLAKAMGIDVPTLRWFSYHRDVDAGTHYRRWQIPKRTGGSRTITAPKRGLKAAQRWVLRNIAEKLPVHGAAHGFLSARSIVTNAQVHAGADVVVKVDVKDFFPTVTWRRVKGLFRKAGLNEATATMLAMVCTEAPRDVVEFRGRTLYVASGPRALPQGAPTSPAITNAICLRLDRRLSGLARVLGMVYTRYADDLTFSWRKSDDRAKAPVGALLGGVKKILRAEGFVLHPDKTTVMRDGDRQKVTGLVVNKAEGQPAARVPRETLRKLRAAIKNRELGRPGKGDETIDQLKGMAAFVFMCDAKKGQAFLDRIAKLEGK

SEQ ID NO: 6467 - protein, 434 aa, unidentified
  source 1..434: note = Related to NZ_CBTJ020000010.1; note = Candidatus Competibacter denitrificans Run_A_D11
MSETPPTWEEIAQVGDIERWVVAQLQQRGLLDEVADPAKLSGNALRQFKARREEERKVRKLLRQQAWAAYRKAHLVHLGADVFHHDTPDQDRYDLPDPETRRETNGLPALKDVQALAKALDLTIPQLRWLAFHREVDSGSHYQYWTIPKRDGGQRLISSPKPTLKKTQRWILRQMAERLPVHGAAHGFLPGRSIFSNAAVHAGARLLVKLDIRNFYPTVTWRRVKGLFRKGGYGEQVATVLALLCTEAPRELLQLDGKPYHVASGPRALPQGAPTSPALSNTVCLRLDCRLSGLSQKLGFRYTRYADDLTFSWHEHSPPPLGRLLRCARLILQTEGFVPHPEKTRILRRSRRQTVTGLVVNAAPDHSSPARVPRLKIRELRAALHNRLRGKPGKAGETLAQLRGWVAYLHMTDPDKAKPFLAQLNQLEARGADE

SEQ ID NO: 6468 - protein, 433 aa, unidentified
  source 1..433: note = Related to CP065007.1; note = Candidatus Competibacteraceae bacterium
MSETPPTWEDIAQVGDIERWVVTRLRQLDLLDEVTDPGKLTSAALHQYKARREEERRVRKQLRQQGWAAFRQAHLVYLGADVFHHDTPDQDRYDLPDPETRREVNALPALKDVQALAKALDLSIPRLRWLAFHREVDSGSHYQYWTIPKRDGGARLISAPKPTLKKTQRWILRQIAERLPVHGAAHGFLPGRSIFSNAAVHAGAHTIVKLDIRHFYPTVTWRRVKGLFRKGGYGEQVATVLALLCTEAPRELLPLDGQHVHVASGPRALPQGAPTSPALSNTVCLRLDCRLSGLSQKLGFRYTRYADDLTFSWHDSSPPPLGRLLRCVHAILKAEGFVPHPKKTRILRRGRRQTVTGLVVNETPAGSPARVPRAQVRRLRAALHNRLHGKPGKEGESLAQLRGWVAFLHMTDPERAKPFLAQLKQLEERGTDE

SEQ ID NO: 6469 - protein, 528 aa, unidentified
  source 1..528: note = Planctomycetes bacterium; note = Related to JAFKJJ010000105.1
MGLFDWMFRRGRKSDPEPIAPSPVSPPPPSEAPGRPAPKAEPQPEATGDPYAATEFLPVSRQEIVDAAKGGNLLSTAFQFGRQSIIPPASDPRTQLIDRAMVTHGLLSPEELNEIHRVGEEYDRVKPTDANLAAAAGLAGAAAVKAYRESKEREKERKKAESAARKKARADAIRHRRASDIIFLGRGVSGRLHLRMSDQQRLAAHELPVMHTPADVAGALGLSIKQLRWLAYHSEAATRTHYVKFQVPKKSGGMRTLAAPHKTLKGAQHWVLANVLNKLPVTEAAHGFVAGRGIVSNANPHVGKAVVVNLDLSDFFPTITFHRVRAVFERYGYSGSVASVLALLCTECPRATVTYAGTKYEAATGPRGLPQGAPTSPGLSNQVARKLDKRLLGVAAKLGLTYTRYADDLTFSGGPELAGKIGWLLAKVRNIAREEGFAVNEKKTRVMRRSTAQTVTGVVVNDKPSVSREELRRLRAILHRAKTEGLEAQNREGRPNFRSWLAGKIAFVNMVRPDAGAKLKAAFDALGR

SEQ ID NO: 6470 - protein, 523 aa, unidentified
  source 1..523: note = Related to VGZJ01000002.1; note = Planctomycetes bacterium
MGLFDWMFRRGRKVEPDPVAPPSTDASLRGAAKPAEPAPPPPPADQYAATDFLPITREEIVDAAKEHGRLLWTAFQFGRPSQIPPTSDPRTQIIDRALVTHGLLTPEDLTEIHTVGAEYDEVKPTEMAIAAAAGLAGNAAVQEYREAKEREKARKKAESAARKKARAAEVKRRRDTDIIFLGRGVSGRLHMRLSDEASLTARGLPVLHAPADVAKALGLTIKQLRWLAYHTEAATRTHYVKFEIPKKSGGMRTLAAPHKRLKAAQHWVLANVVNKLPTTDAAHGFVPGRGIVSNANPHVGKAVVVNLDLSDFFPTITFFRVRAVFERYGYSGSVASVLALLATECPRASVTYAGTKYEAATGPRGLPQGAPTSPGLSNQVARKLDKRLLGVATKLGLTYTRYADDLTFSGGPELAGKIGWLLAKVRHVAKEEGFAVNEKKTRVMRRSAAQMVTGVVVNDKPSVSRDELRRLRAILHRAKSEGLDAQNRENRPNFTEWLRGKIAFVSMVRPDTGAKLKAAFDAL

SEQ ID NO: 6471 - protein, 522 aa, unidentified
  source 1..522: note = Related to PNKH01000071.1; note = Isosphaera sp.
MSAFDWLFRRTRKPDPEPPAPPPPLPPPVADAPGSPSPPPPVADPYGSEFLPVTRGEIVAAAKSGNLLSTAFQFGRPSVIPPTSDPRTQLIDRAMVTAGLLSPEELAEIHRVGEEYEKAKPTEANLAAAAGLAGDAAVRAYRAEKERRKAQKKAESAARKKDRAEAVATRRATDIIFLGRCVSGKLHLRLSDETRLAEFGLPVLHTPADVAKALGLTITQLRWLAFHTDVATRTHYVKFQVSKKSGGTRTLAAPHKTLKAAQRWVLANVAAKFPVTEAAHGFVAGRGIVSNAGPHVGKAVVVNLDLSDFFPSVVFARVRAVFERYGYSGAVATVLALLCTECPRAAVTYAGTKYEAATGPRALPQGAPTSPALSNQVARKLDRRLLGVARKLGLTYTRYADDLTFSGGPELNEKVGWLLAKVRNVAREEGFAVNEPKTRVMRRSAAQTVTGVVVNDKPSVDRAELRRLRAILHRAKAEGLAAQNRDGRPDFRAWLVGKIAFVRMVRPDAGAKLKAALDALPG

SEQ ID NO: 6472 - protein, 532 aa, unidentified
  source 1..532: note = Related to NZ_JAGKQQ010000001.1; note = Gemmata sp.
MSMFDWIFRRKRDVTPSAESAPPSVPPPPDPRPQQQAPKAEPQAEAVGDPYSASEFLPISRQEIVDAAQKHGRLLATAFQFGRQSIIPPVSDPRTEIIDRALVTNGLLSPEELNEIHRVGEEYEKVRPTEQGMAAAAGLAGNAAVKAYREAKERAKARKKAESAERKKARAEAVRRRRATDVIFLGRGVSGRLHLRMSDEAKLTALGLPVLHAPADVAKALGLTIKQLRWLSFHTEVATRTHYVKFQVPKKSGGVRTLAAPHKKLKAAQHWILGNVINKFPVTEAAHGFVAGRGIVTNANPHVNKAVVVNLDLSDFFPSIAFFRVRAVYERYGYSGSVATVLALLCTECPRTAVTYAGTKYEAATGPRGLPQGAPTSPGLSNQVARKLDKRLLGVAAKLGLTYTRYADDLTFSGGAELAGKIGWLLAKVRNICREEGFAVNEKKTRVMRRSAAQVVTGVVVNDKPSVSRDEIRRLRAILHRAKSEGLDAQNREGRENFREWLAGKIAFVNMVRPDVGAKLKTALDSLGERPA

SEQ ID NO: 6473 - protein, 536 aa, unidentified
  source 1..536: note = Related to CP025958.1; note = Gemmata obscuriglobus
MSLFDWVFRRKRDADTPPAPPPAAPTAPASSDKAPSGNTTSGTPGANAPRSSEGSEDQYAANDFLPISRQEIVDAAKKHGRLLATAFQFGRQSIIPPVSDPRTEIIDRALVTHGLLTPEELNEIHRVGEEYEKVRPTEQGIAAAAGLAGTAAVQAYRAAKEAEKERKKREAELRKKVRAEAVWRRRTTDIIFLGRGVSGRLHLRLSDEGRLTELGLPVMHTPADVANALGLTVPRLRWLAFHTDVATRTHYVKFSVPKKSGGTRQLAAPHKSLKAAQHWILANVVNKLPVTEAAHGFVADRGIVTNANPHVCKAFVVNLDLSDFFPSIAFPRVRSAFERYGYSGCVATILALLCTECPRAAVTYAGTKYEAATGPRGLPQGAPTSPGLSNQVARKLDKRLLGVATKLGLTYTRYADDLTFSGDADAAAKIGWLLTKVRHIASEEGFAVNEKKTRVMRRSAAQMVTGVVVNDKPSVCRDELRRLRAILHRAKSEGLDAQNREKLPNFREWLRGKIAFVSMVRPDAGAKLKAQLDAVS

SEQ ID NO: 6474 - protein, 528 aa, unidentified
  source 1..528: note = Related to CP053452.2; note = Frigoriglobus tundricola
MSLFDWMFRRRRTSEPEPVQPPVPVEPPVPAVPPVTAAPETTKTEPAGDPYASAEFLPVSRQEIVDAARGGNLLSTAFQFGRSSTIPPASDPRTQLIDRAMVTHGLLSPEELNEIHRVGDEYDTVKPTDQSMAAAAGLAGAAAVRAFREAKEREKARKKAESAARQKARAEAVKRRRATEIIFLGRGVSGRLHLKLSDELRLVANGLPVLHSPTDVAHALGLTIKQLRWLAFHTEVATKTHYVTFQVPKKSGGMRTLAAPHKALKAAQHRLLETVVARLPVTEAAHGFVAGRGIVTNAGPHVGKEVVVNLDLSDFFPSITFPRVRAVFERYGYSGSVATVLALLCTECPRQAVTYAGTKYESATGPRGLPQGAPTSPGLSNQVARKLDKRLLGVAAKLGLTYTRYADDLTFSGGPELASKIGWLLAKVRHVAQEEGFAVNEKKTRVMRRSMAQTVTGVVVNDKPSIDRDELRRLRAILHRAKTEGLDAQNHEGRPNFRAWLAGKIAFVHMVRPDAGAKLKAALDALDS

SEQ ID NO: 6475 - protein, 528 aa, unidentified
  source 1..528: note = Gemmataceae bacterium; note = Related to LR594584.1
MSAFDWLFRRKRTPESEPPAQAPPAAPAPATPVATPPAASAPAPPKAPAADPMSSEFLPVTRAEIVDAAGKGNLLSTAFQFGRPSIIPPASDPRTQLIDRALVTNGLLSSEELTEIHRVGDEYEAVKPTEAGMAAAAGLAGEAAVKAYREDKGRRKAQKKAESAERKKQRAEAVKLRRETDIIFLGRGVSGKLHLRLSDESKLAERGLPVMHTPADVAKFLNLTIKQLRWLAFHTDVATRTHYVKFQVPKKSGGVRTLAAPHQKLKAAQHAILANIASRFPVTEAAHGFVAGRGIVTNASPHVGKVAVVNLDLENFFPTVVFPRVRAVFERYGYSGSVATVLALLCTESPRASVTYAGVKYEAATGPRGLPQGAPTSPALSNQVARKLDRRLLGVAAKLGLTYTRYADDLTFSGGEELTSKTGWLLARVRHVAQEEGFTVNEKKTRVMRRGAAQMVTGVVVNDKPSIDRDELRRLRAILHRAKTEGLDAQNREGRPNFRAWLVGKIAFVRMVRPDAGAKLMAALDALG

SEQ ID NO: 6476 - protein, 524 aa, unidentified
  source 1..524: note = Related to PNLP01000016.1; note = Planctomycetaceae bacterium
MSMFDWLFRRNRKTENVPLVPPPAPAPVADVPRAEAKPQAATPSPVDPYGSEFLPITRGEIIDASKKGNLLSTAFQFGRPSVIPPAADPRTHLIDRALVTNGLLTPEDLTEIHRVGDEYEKVKPTEIGMAAAAGLAGDAAVKAYKADKERRKAQKKAESAARKAARIEAVKARRATDIIFLGRGVSGKLHLRLSDEARLAERELPVMHTPADVAKLLGLSIKELRWLAFHTEVATRTHYVKFQIPKKSGGMRTLAAPHKKLKAAQHSILSNIVSRLPVTEAAHGFVAGRGIVSNANPHVGKTVVVNLDLENFFPTVVFPRVRSVFERYGYSGSVATILALLCTECPRATVTYAGVQYEASTGPRGLPQGAPTSPGISNQVARKLDKRLLGVAAKLGLTYTRYADDLTFSGGEALNSKTGWLLAKVRHIAQEEGFAVNEKKTRVMRRSAAQLVTGVVVNEKPSISRDELRRLRAILHRAKTEGLEAQNREGRPNFRDWLIGKIAFVSMVRPDVGGKLKAALDALS

SEQ ID NO: 6477 - protein, 547 aa, unidentified
  source 1..547: note = Gemmataceae bacterium; note = Related to JAIEQO010000648.1
MSLYDWLFRRTPKPDPEPTPEARGADAPRSPSPPPPPQPAQQGVNAPRSPQPPTTPEPQPVTDPYAASDFLPITRGELLKSAQADGNLMRNAWQTGRTSIIPDANDPRTKLIDRALVAHGLLTPEQLIEIHRVGDEYARAKPEGDPIARFAGMAGEAAVQAYREAKARLKEQKKAEAKAREERRAEEVKHRRATDIVFLGRGVSGRLHLRLSDEARLADFGLPVLHTPADVASALGLSIQQLRWLAFHTEAATRTHYVKFEVPKRSGGMRVLSAPHKTLKAAQRWILANVVSRFPVPVAAHGFVAGRGIVSNAGPHVGKAVVLNMDLENFFPSIPFPRVRAAFERHGYSGSVATVFALLCTECPRTTATYAGVKYEVATGPRGLPQGAPTSPALSNQVARKLDARLLGLAAKLGLAYTRYADDLTFSGGPEFQEKVGYLMARVRHLAADEGFTVNEKKSRVMRRSIAQSVTGVVVNDKPSICRDELRRLRAVLHRAKAEGLDAQNRDGRENFRAWLEGMIAYVSMVRPDVGAKLKAEFDRLIGASKT

SEQ ID NO: 6478 - protein, 490 aa, unidentified
  source 1..490: note = Related to NZ_CP036273.1; note = Urbifossiella limnaea
MQPLPPADPYAAPDFLPIARGEIVSAAAGKNLMANAWQTGRTSIIPPADDPRTRLIDRALVTHGLLTPEDLAEIHRVGAEYARLKPSLENVALQAGFAGEAAVQAYREAKERLKQLKREEAARRKNERAEAVQRRRDTDVIFLGRGVSGRLHLRLSDPDRLAEYGLPVLHAPAEVAAALGLSIKQLRWLAFHTEAATRTHYVKFQVPKRSGGVRTLAAPHATLKRVQHWILEHVVSKFPVTEPAHGFVPGRGILSNATPHVGKAVVVNLDLSDFFPSVTFPRVRAVFERHGYSGSVATVFALLCTECPRTSATYAGTPYEVAIGPRGLPQGAPTSPGLSNQVARRLDKRLTGLAAKLGFAFTRYADDLTFSGDPEQAEKVGYLLSRVRHLAAEEGFTVNEKKTRVMRRNAAQTVTGIVVNDKPSVSRELLRQLRAILHRARAEGLDAQNRAGRENFRAWLDGTISFVAMVRPDVGAKLRAEYNALSERSS

SEQ ID NO: 6479 - protein, 533 aa, unidentified
  source 1..533: note = Related to LSTD01000254.1; note = Planctomycetaceae bacterium SCGC AG-212-F19
MGLFDWLFGRPGAKQPPAPAPAPQAAASAAAPGAAKPQTTETKGPKPQPAKAPNLSASDFLPITRIDLKESAEQIERWGPWFGRRDLIPPADNPRTKLIDRGLVTQGLMTPEQLVEIHEVGAAMDRVRPIQFQIQAQIAQSGQAAIEANRQRKAEIKAQKKAASAERKKKRSEAIAQRRATDIFFLGRGVSGRLGERTSDETKLTQLGLPVLATPADLAQALGLPIPKLRWLAFHTEVASRVHYVCFTVPKKSGGTRLLSAPHRTLAAAQQWIFANIVGKLPVEPPAHGFTPGRSILTNAQPHVGKNVVVNLDLEGFFPSITFPRIRSVFFRLGYSPAVATILALLCTECPRKQVTYNGKIYHVALGPRGLPQGACTSPGLSNQATRRLDKRLAGLAKKLGLTYTRYADDITFSGNEELKDKVGYLMARIRHIAEAEGFAINENKSRVLRRNAAQTVTGIVVNDRPGVSRKDLRRLRAILHRARHEGLEAQNRAKRPNFRAWLEGMIAYVSMVRPEVGKRLRDQLAALAPKGA

SEQ ID NO: 6480 - protein, 532 aa, unidentified
  source 1..532: note = Related to NZ_LR593887.1; note = Tuwongella immobilis
MNPLERLLEFLGFTKTEADTSKPAKGKPAPADAKSAAGGSDASGAKKPSGPAVAKTFNLDASDLLPITSEELKSGLRKLLRSGGFRFVGRGMIPHGDERTRLINRALLSEGFLTAEQLEAITQVAVEFEELQKALARIEGQVNKSAKKAVEADKEEKARIKAQKKAEALAKKQKHAADVAHRRETDIIFLGRKVSAKLNDRKGNAELLAGYGLPAISTPAELAAALGLSVAKLRWLAFHTEVATRMHYVQFQIPKKSGGTRLLSAPHQSLAAAQEWIYREIIQKIPVETPAHGFVTGRSIVTNAQPHVGNPVLINMDLEAFFPTITWQRVRSVFHRAGYSPSVATILALICTECPRDTVEYAGKTYYVATGPRGLPQGACTSPGLSNLVARRLDKRLGGLCGKLGLTYTRYADDLSVSGPAEINEKVGYLMARIRHIAEAEGFQVNPKKTRVLRPNTAQLVTGIVVNAKPSLPKKELRRLRAILHQAQKNGLDAQNREQIPHFRAWLAGKISFVRMVRPELGAKLQAQFDAL

SEQ ID NO: 6481 - protein, 536 aa, unidentified
  source 1..536: note = Related to NZ_CP042425.1; note = Limnoglobus roseus
MGFWDFLPKLFKPVPSESPPPSPSPIPAEPVAETFVPVPPMPVAEPPAAPPPGPIAVAPPPAAPSFLPITRDDLLKQGEEVRRTTGWMFFGRRDLIPPTSDPRTLLIDRGMVTQGLLTPDELAEMHRVGDEHAKHADRFRQITIKAGQTADQAVEADRAARVAIKAQKKAAAAAFKQTRADAVAVRRATDIIFVGRDVSAMMNDRSSDAERLKAAGLPVLHTPSDLAAALGLAIPQLRWLCFHTEVATRPHYVQFEVPKKAGGTRTLAAPHAKLAAAQEWVLANVLAKLPTEEPAHGFVPGRSTVTNALPHAGRDVVVNVDLEGFFPAVRFPRVRHLFRRLGYSGAVATLLALLGTECSRKRVVYDKQTYFVAIGPRSLPQGACTSPAVSNQIARRLDRRLAGLAKKLDWAYTRYADDLTFSAPPGHREQVGYLLARVRHMAAAEGFALNAKKTRVQRPESRQAVTGLVVNAAPAVPRDVVRRVRAILHRAKHEGLDAQNRTGHPNFRGWVEGMIAYVAMVKPTQGEALRKQYTAL

SEQ ID NO: 6482 - protein, 353 aa, unidentified
  source 1..353: note = Related to JAFATI010001137.1; note = Planctomycetes bacterium
KATDIMFAGKGVSALLGDRASDADKLAAAGLPVLHTPSDLAAVLGLTIPMLRWLCFHTEAATRIHYIQFEVPKKSGGTRTLSAPHRTLAAAQEWVLTNILSKLPAEEPAHGFVPGRSTLTNAAPHAVRDVVVNLDLEGFFPSIGFARIRHVFRRVGYSGAVATLLALLCTECPRKRVVYAGTPYFVATGPRGLPQGACTSPALSNQVARKLDRRLAGLARKLGLTYTRYADDLTLSSGPGFRDRVAYLIARVRHIAADEGFVVNAKKTRVLRPESRQLVTGLVVNAAPAVPRHVVRRLRAILHRARTEGLAAQNRDGHPNFRGWVEGMIAYIAMARPDTGRILRAALEELPRS

SEQ ID NO: 6483 - protein, 543 aa, unidentified
  source 1..543: note = Related to NZ_JAALJH010000005.1; note = Aquisphaera sp.
MNILRRLLGWILGHTIPPAPPWPKVPAPPPPPSPASPERPSGPEPEMLGAAGPAKPVEKKDRPYGSIPEDYRPISREEILEAAAGRSLFSNVWFGRRDRIPPADDPRTALIDRAMATQGFLSPEQLVEIHTVGHEMERFRPTVEGISHQAGLAGAAAVEADRAERARIKARKKAEAEERKRLRAEGIALRKREDITFLGRRVSGRLGERTSRVEDLERSGLPILATPAEVARAMGLSVSRLRWLAFHAEVASRVHYVQFRVPKKSGGERILSAPHRSLRLAQEWIQLEILRKLPVGPEAHGFVPGRSILTNATPHAGKALVVNLDLEGFFPSIGFPRVRKVFEHLGYSGSVATILALLCTECPRKAVTLDGEMLHVATGPRGLPQGACTSPALSNQVAIRLDRRLAGISAKLGFTFTRYADDLTFSGDAEVEAKVGYLLARARHIAEGEGFAVNEKKTRILRRNNRQEVTGLVVNERPGVPRDEVRRLRAILHHARAEGLDAQNRENRPDFRAWLLGKIAFVRMVRPEVGDRLLAELRQLDAS

SEQ ID NO: 6484 - protein, 536 aa, unidentified
  source 1..536: note = Related to NZ_CP042997.1; note = Aquisphaera giovannonii
MNVFRRLFGWLLGRRLKPAPSLPASRPAAPGSPQSPMTVAPTPAEVVAKKGRSYGLDAGDYLPISREEIKEAARGRSLFANAWFGRRDRIPPADDPRTATIDRAMATQGFLSPEELAEIHAVGEEMERLRPTAEHVGHQAALAGVAAVEADRAERARIKAQRKAEAAERKRLRAEAIALRRREDIVFLGRKVSARLGERASRVDDLQRAGLPVLSTPAELALAMRVSIPRLRWLAFHAEVATRVHYVQFRVPKKSGGERVLSAPRSSLRRVQRWILDQVLKNIPAGPHAHGFVAGRSILTNATPHAGKAVVVNLDLEDFFPSIGFPRVRKVFEQAGYSGAVSTILALLCTECPRKTVTYQGETLHVATGPRGLPQGACTSPVLSNHVAIRLDRRLAGVATKLGFAYTRYADDLTFSGPSEVDAKVGYLLAKVRHIAQEEGFAINAKKTRVLRRNARQEVTGLVVNDRPGVRRDEIRRLRAILHRARTEGLASQNREGRPDFRAWLLGKIAFVRMARPEVGERLLAEFHEIDRGRSA

SEQ ID NO: 6485 - protein, 556 aa, unidentified
  source 1..556: note = Related to NZ_JAHPZK010000060.1; note = Paludisphaera sp.
MSIWQRFLQFIFGERSFRPAEPPPTFSPAVPPSLAERPTTAEAPRLTIPEASADPDFAADAGTHKDGQPKLAGKAVDPLDAGAYLPISREEIKREAKGKNLFNNFAFGNRSIIPPADDLRTKLIDRAMVTHGLLSPEQLHEIHAVGARMDELRPTMAAVEHKAAKAGEAAVEADREARARLKAQKKAEAIERKRLRAEGIAYRRATDIVFLGRGVSGRLGDRTCDASKLEAADLPVIATPTELAAALGVSVPRLRWLAFHNEAATRVHYVQFTVPKKSGGTRTLSAPHRSLAEAQDWIFREILARLPVEPPAHGFVTGRSILTNASPHCGKRIVVNMDLEGFFPSIGFARVRSVFQRLGYSPAAATILGLLCTESPRRSVVYDGVAYHVATGPRGLPQGASTSPALSNQVARRLDRRLSGLSTRLGLAYTRYADDLTFSGDEAFEGRVGYLMARVRHFAAEEGFAVNEAKSRILRQGTAQTVTGLVVNDRPGVRREEVRRLRAILHRARTEGLEAQNREGRPDFLAWLRGKIAFVAMARPETGALLKAELEALLAG

SEQ ID NO: 6486 - protein, 511 aa, unidentified
  source 1..511: note = Related to NZ_JAALJI010000068.1; note = Paludisphaera sp.
MAAPPPTPEASTDPYFSARTDPTKEASPKKVDPLDAGDYLPITREEIKEEAKGKNLFNSFAFGLRSVIPPADDLRTKLIDRALVTHGLLSPEQLREIHDVGARMEAMKPTMAAVEHRAARAGEAAVAADREARARLKAQMKAESAERKRIRDEAISQRKATDILFLGRGVSSRLGDRTGDASKLAEAGLPVVSTPAELAAALGISVPKLRWLAFHNEAATRVHYVQFTVPKKSGGTRTLSAPHRSLAEAQGWILREVLAKLPVEPTAHGFVTGRSILTNASPHCRKRLVVNMDLEGFFPSIGFRRVRSVFGRLGYSPAVATILALLCTECPRRSVVYAGETYHVATGPRGLPQGACTSPALSNQVTRRLDRRLGGLASRLGLTYSRYADDLTFSGDEVLEGRVGYLMARVRHLAGDEGFAVNEAKSRVLRRGTAQTVTGLVVNDRPGVRRTEVRRLRAILHRARSEGLAAQNREGHPDFLAWLRGKIAFVAMARPDVGAALRAELESLLVR

SEQ ID NO: 6487 - protein, 645 aa, unidentified
  source 1..645: note = Related to CP003364.1; note = Singulisphaera acidiphila
MLRRSAVVDSAPETASPRVLFFWPGAVAVRRAESTVVPGVRLQPRASVNTLGRRFEVGQRPVPVLPTPNPSAGDMNLFHRLLRFLFGYEPPARSASQPRPTPAPAPAPEPPTTPDAIAATLTEAFGKTAETTAPALLPDATADPYFAVTADVQSTATNQGKGNGKSSLGLEANAYLPISREEIKKTAKGIDRFGNPWFGRRDLIPPTDDPRTNLIDRAMVTQGLLSPTQLHEIHDVGARMDQIRPSLAAIESRAAVDGAAAVAADREARVLLKARKKAEAAQRKQERIDQVAHRKATDIVFLGRGVSAGLNDRQSDLDALTGAGLPLLSTPADLAAALSLSISKLRWLAFHTEAATRTHYVQFTVPKKSGGLRTLSAPHRTLAEAQRWIFQEIVAKLPVESAAHGFVAGRSIVSNAEAHCRRAVVVNMDLEAFFPSIGFPRVRRVFRKLGYSPAVATILALLTTECPRRTVVYGGTTYHVATGPRGLPQGACTSPGLSNQVAIRLDRRLSGLARKFDLSYTRYADDLTLSGDATLEAKVGYLMARLRHIAGEEGFAVNEAKSRVLRQATAQTVTGLVVNDRPGVRRAEVRRLRAILHRAKSEGLASQNRDGHPNFLAWLHGKIAFVAMARPELGAALRAELDSLL

SEQ ID NO: 6488 - protein, 524 aa, unidentified
  source 1..524: note = Related to JAIEMG010000080.1; note = Gemmataceae bacterium
MGFFSRLIERLFGKTDTGVIVPKQAAPGATAGAAPQAAPPLARPLNLSADNFLPIARDELKEAAKDVTRWGPWFGRRDVIPPADDPRTRLIDRGMVANGLLTQEQLVEIHQVGAEMERLRPLQFGVSNLAAQAGESAVQAERARRTEIKKQKKAEAADRKKRRAEAIVQRHATDIVFLGRGVSARLGERTSDGEKLKSLDLPMLQTPAELASALGIGVPRLRWLAFHAEVARRVHYVGFTVPKKSGGTRTLSAPHRSLAAAQEWILRNILDRLPVEASAHGFVIGRGTLTNANLHVGRAILVNMDLQDFFPSIGFPRVRSVFQRLGYSPAVATVLALLCTECPRRPVEYDGQSYHVAIGPRGLPQGACTSPALSNQVARRLDRRLHGLALTLGVTYTRYADDLTFSGAAEFNARVGYLMARIRHIAEDECFAVNARKSRVLRRNTAQRVTGLVVNDKPGIGRQEVRRLRAILHRAAKEGLEQQNREGRPNFTAWLHGKIAYVSMVRPDLGARFQAQLHAILQGK

SEQ ID NO: 6489 - protein, 645 aa, unidentified
  source 1..645: note = Related to JAJKFQ010000002.1; note = Stieleria sp.
MADKATTEKFELYVVDLVKSGQTFTASDVVIGARARGIDVRHNESRDIIHDLHRRGVLGPAYSRTTVPLTDSTRPFVYHPTNINPSEYRSSFTDVSSSLRSGHRSQPKRGFLGRLIQSLFGGGDDESKSGRKQRSGDQPAPADLSSNPSVPPKSSRRMPQRRKNVTLDLDAKSFLPIDRDELLSSAKKVNLWASPWFGRRDLIPPLDDPRTNLIDRGMVAEGLLTSDELRRIHEVGAEMDFYRPDDLLLRHQAQRSASGAIEAQRQASAERKALKKAEAAERRQQREKEIQYRRANQIDYLGRRVSTQLHLCQSDADKLQAVNLPVLHTTKDLADAMGIEISRLRWLAFHEDVASRIHYVSFSIPKRSGGTRTLSAPLPRLAAAQRWIYAQILRDLPVGDCVHGFVPGRGIVSGAQPHIGQEVLLNMDLEDFFPTIGFARVRHAFHWLGYSPAVSTVLALLCTEAPRREVSYQGTAYQVATGPRVLPQGACTSPAISNLVTERLDRRVIGFANKFGLTYTRYADDMTLSGGTDFAGQIGYAIAKIRHIAEEEGFRVKTSKTRVLRRNAAQRVTSLVVNDKAGVGRRKLRQVRAILHNASKTGLQAQNRDNHPNYRASLEGMIAYIAMTRPDQAATMRAKLDAIAD

SEQ ID NO: 6490 - protein, 547 aa, unidentified
  source 1..547: note = Related to PPHI01000001.1; note = Rhodopirellula baltica
MSMADKATTEAVERFVIELVNCDEAFTAADVTLGARAAGIQVHYSDSRNILHDLHRRGILGTSYQRSSVQLTDGTKPFVYHPVGFTANHYRSNQSSLMASDHPDQVSQPKPGLLARLKQFLLGRGDSDRSDSSKDARSLANQAPATQATRAAQRKNVTLNLNAPSLLPISRKELLAGAKSINLWSSPWFGRRDVIPPIDDPRTLLIDRAMITAGLITPEELARIHEVGAQMDRYRPDELLMRHQANRAGRDAVAEDRRAKAERKAAKKAESEAKRQRRREEIEIRRATRIDFLGRRVSTKLHLCESDEERLNAAGLPILHTTTELADAMGIQLSQLRWLAFHDDVASSTHYVEFDIPKRAGGVRRLSAPLPRLAEAQRWIYSQILRGMPVDDCVHGFVPGRGTATGAAPHVGQDVILNMDLEDFFPSIGFARIRHTFERLGYSPAVSTVLGLICTEAPRRKVSFQGATYYVATGQRVLPQGACTSPALSNLVAGKLDRRILGFAKCIGATYTRYADDLTLSGGQDLANRIGYTIARFVISARTKASG

SEQ ID NO: 6491 - protein, 544 aa, unidentified
  source 1..544: note = Proposed Roseiconus lacunae; note = Related to NZ_VSZO01000001.1
MADQSPNQASNQQPASPNPKLGWLGRIFRSLFGGPTRRPDRSSDSFAAMAQQPRPLPPRRREKVTLDLDAKAFLPIDRDELLSDAKQINLWASPWFGRRDLIPPADDPRTSLIDRGMVTEGLLTPDELTRIHEVGAEMDYYRPAELFLRHQARQAGRDAVELDRQTRAERKARKQAEAEAKRIRRRERVERRFATQIDFLGRGVSTQLHLCESDVDRLKEAGLPVIQTTTELADAMGIEIPRLRWLAFHSHVAERSHYISFRIPKKSGGTRTLSAPLPRLAAAQRWIYSQILRERPHPECVSGFVPGRSILTGAAPHVGSQTVLNLDLEDFFPSIGFARIRHAFQFIGYSPAVATVLALLCSEAPRRKVRFNGGEYYVATGPRVLPQGACTSPALSNLIAAKLDRRISGLASKLGATYTRYADDLTLSGDRDFDDKAAFAMACVRHIAEDEGFRVKLSKTRVLRQNAAQRVTGLVVNDKAGVGRKKLRLIRAILHNAEKTGLNAQNRDHHPNFRASLEGTIAFVAMSNPERAAKLRRQLDAVPD

SEQ ID NO: 6492 - protein, 653 aa, unidentified
  source 1..653: note = Planctomycetaceae bacterium; note = Related to DNWZ01000159.1
MADSNAQKIVTDITRRRAAAGESFSAFDITTEARSQGAFIRHGEARDLVQALFQNGSMGADYRRTVLDLGGGARPFVYHRFDADLTTYRSTASGAAPVSPPANRPGQATPPAVGQGSTSGRSGGLIRRVWNFLGGGTTSDAGNPTTDDATHSGSKTPSPANPDNPKTTGTIRKVLNLTASAFLPIQRDDLIRQASGLSLWSNIWFGRRDMIPPVNDPRTLLIDRGMLSAGMLSAEELAEMHRIGDLYAKHSGEVTRIRSEGALAGQAAVDADRQARAEAKAKKKAEAAERKAKRRAEIEHRRANDILFLGRGVSQGLADRTSDLAKLEKLELPLASTPAELAAVMGTTVSNLRWLAFHADVATRTHYVSFEIAKRSGGVRKLSAPHVRLAAAQRWIYSSILRGVKVHDAAHGFVPERSIVTSAKLHVGQAVLINADLENFFPSIHWTRIRKVFRCLGYSPAVATILALICTECPRREVVYDGQTYYVATGPRGLPQGACTSPALSNLVAMRLDRRLSGLATKFDIRYTRYADDITLSGGDELGRRLGYVMARLRHITADEGFAINEKKTRVQRRHQAQVVTGLIVNDRVSVTRKELRRLRSILHHAATEGLDSQNKHHHPNFRAYMSGMIAYVAATRPALAREMKKQLSQVRS

SEQ ID NO: 6493 - protein, 643 aa, unidentified
  source 1..643: note = Related to NZ_SJPM01000010.1; note = Rhodopirellula pilleata
MDNNARQIVTTITRRRAAAGESFTAFDITTEARGQGAFVPHGEARDLVQALFQGGEMGAAYRRTVIDLGGGARPFVYHRFDVDARTYQTPSGSRPIVPTPTPAAPVPNAPTADTSSSSPPTNQGGLIRRVMNFLGGSARSDVAANNPSASTFGGAAAPPSRRKTLNLDASAFLPITRDEMMRESRTSLFWSGAWFGRLDLIPPTTDRRTLLIDRGMMSAGLLSAEQLAEIHRIGELYSKYAKDLQVIQHAGQVAGQAAVDADRKARAEARQKKKAEAQEKREKRRAEIEHRKRNDIVFLGRRVSGGLADRESDVGKLRSLELPVLSTPAELAAAMDLAISDLRWLAYHADVATRSHYVSFDIQKKSGGLRRLSAPHKRLKAAQSWILENVLGSAVVHDAAHGFVPGRSTITGAKEHIGQAIVLNADLENFFPSIHWTRVRKVFQTLGYSPAVATILALVCTECPRREVQFNGQAMYVATGPRGLPQGACTSPMLSNMVALRLDRRLAGLANKFEMKYTRYADDLTLSGGDELGRRLGYVMARLRHIAVDEGFAINESKTRVQRRHQAQSVTGLIVNDRVSVSRSELRRLRAILHSAKSQGLESQNRDDHPDYRGYLTGLLAYVAATRPALAAEMKRELDSIRN

SEQ ID NO: 6494 - protein, 644 aa, unidentified
  source 1..644: note = Related to JAGQQE010000043.1; note = Planctomycetaceae bacterium
MADAQTNNAVQQAVLDFVRSMTMFTAYDVTLAVRNQGVVARHGEVRDVVHSMFQDGILGAAWQRTAVDIGTDTRPLVYHHFNQDPRTYKSPSTGSAAKPATNSGQSGSPSPGSAASGSGKGFFQRIVGAFFGQGSSPVTPSNHPASGGAQVPSQPLRTPKQRPPITIDLDASAYLPISRSDLLSEAKKTNLWGSPWFGRRDLIPPVEDDRTKLIDRAMLTQGLLTPEQLTEIHRVGAEMDKYRPDQLLINQKSQKAGQAAVDEERQSKAALKKQKKEEAALRKQLHRQAVADRKANDIVFLGRGVSSRLGDRTSDDTKLQAAGLPVMSTPSDLANALSITVPQLRWLAFHSDVASRTHYVNFTIPRKSGGVRILSAPHQRIAAVQQWILAEVVSRLPVEGCAHGFVPNRSILTNARPHVGQQVVLNMDLENFFPGITYPRVRKMFQTIGYSGSVATILALLCTECPRRTVTWSGEVFHVACGPRGLPQGACTSPAISNQVVKRLDRRLQGLARKHNLVFTRYADDLTFSGGSDFDTNVAWVMACVRHIAEDEGLVVNEKKNRVLRRNTAQIVTGLVVNDKPSVSRKKLRQIRAILHRAQQEGLESQNRDGHPNFRAYLDGYISFISMTRPEIAARLKEQLANVS

SEQ ID NO: 6495 - protein, 646 aa, unidentified
  source 1..646: note = Related to NZ_SJPW01000002.1; note = Rubripirellula tenax
MTDSTTRQVVSQLVLNQVAAGAMFTAYDITLQARGRGMQLRHGEGRDLVHELFNTGRMGTDYTRTVVDLGTDANPMVYHRRGDSPRTYQSGSTGATAASAPPGALPTQPFPPAAAPPANTPGLIGRLVKGLFGGGKDQPIVGRVVGDGGNAASGDDVGALALRPPASLDLDASDFLPISRDDLMSAAKTTTLWGNPWFGRRDIIPPIGDPRTKLIDRAMVARGILTPDQLAEIHRIGADMDHYRPTQILIESQAHSAGRSAIEVDDKRKAEEKAKKKAEAKERKEKRQSDIAERKATDIVFLGRGVSGQLHLRDSDAEKLAAADLPILSTPAELASALGLTISKLRWLAFHNDVATRTHYVRFEIPKRSGGTRQLSSPHKLLAEKQRWILKEILNKLPVEDSAHGFVRDRDILTNAIPHVGKDVVLNMDLENFFPSIGFPRVRQVFKGLGYSPAVATILALLCTESPRRAVTYAGQPYLVASGPRGLPQGACTSPAISNQVAKRLDRRVQGLATKFGVAFTRYADDMTVSGGAEMTTRIGYMMAKLRHIAEDEGFVINRSKTRVLRRNTAQIVTGLVVNDKPTVSRTQLRRIRAILHHAHHDGLSAQNREQHANFRAWMQGMIAFVAMTRPELAKDFLAQLQSVRD

SEQ ID NO: 6496 - protein, 522 aa, unidentified
  source 1..522: note = Related to JAEUIP010000375.1; note = Planctomycetaceae bacterium
MANGMLQQLIARMGRIFGSIFCSYKRSPGTQSRATTAPAQGQAVRPASRPEAPPLPPRANKTLDLAASQFLPISRSELLVAAKGTRLWGNVWFGRRDLIPPADDARTLLVDRGMVTEGLITPEELAEIHRVGAEMDLHRPAQAAIQHQTQKAGQAAIDELRAEKARIKAEKKVESAARKAARQSAIDQRRANDIVFLGRRVSGKLGHRESDPQRLQQLNLPVLQTPADVAVALQISISQLRWLAFHAEVAERTHYVYFDVPKKTGGFRRLSSPHAKLAAVQRWILEQVLNKLPTQPAAHGFIAGRNILSNAMPHVNQSVLINMDLENFFPNITFPRVREMFARLGYSGAVSTVLALLCTECPRRAVIFHGATYQVATGPRGLPQGACTSPAISNQVAVKLDRRLQGLASKMELNYTRYADDLTLSGGDALRERVGYVMARVRHFAEEEGFRVNNQKSRVQRRNSAQIVTGLVVNERPTVSREKIRRIRAILHRAQTEGLEAQNRQNHPYFRAWLEGYIAFIA

SEQ ID NO: 6497 - protein, 514 aa, unidentified
  source 1..514: note = Planctomycetaceae bacterium; note = Related to DNMF01000374.1
MDVVSLPDHRPGRSPVSSVDTSKSRRSAPPAPFSFLPKIKSERNFLDLRGAADLWDRGCVVGFWGRLLRLILGQNAGSGLTEQLQASGTAKSRNRSSVFFPAQSLQAPQLLPPASVAETVVGPVGAEGSRIRSTLSVVARREAQQRARDNERRRLREIRRTDRLSRDITYLGRGVSGWLNERISDVARLQSAGLPVLSGPADVAKALGISLQSLRGLAFHAEVTRLTNYLRFTVPKRSGGQRELSVPHRRLAAAQRWILRTILDRLIVSEQAHGFVSGRGVLTNAQQHCGQAVLLNLDVQNFFPSISFARVRRVFMAAGYSKCVATILALVCTECPRREVVFEGRRLWVATGIRGLPQGACTSPALSNLVCLRLDRRLQGLAMKLGLVYSRYADDLTFSGGADLRQRAGAVLKSVGAILGSEGLQVHPWKTRVQPRSTAQVVTGLVVNDRPGVCRREVRRVRAILHRAATEGLERQNRDGHPNFVAWLNGRIGWIGQSRPELGRKLMEELRGLR

SEQ ID NO: 6498 - protein, 468 aa, unidentified
  source 1..468: note = Related to DQCF01000782.1; note = Planctomycetaceae bacterium
MATGFWGRILRALLKSDDSDQSASAASPNVTAADSVVGESTVAAAAGLTRRAFEAPHLLPVGKQSESAGSGRQTQSDDASGSSSGRTSLAVAARREARRRARENERLRLQAIRRTDRLNRDITYLGQGVSGWLNERVSDEERLRQSGLPVLATPADVARALGISLRSLRGLAFHAEVTRLNNYVRFTIPKRSGGVRVLQAPQRRLAAVQQWILREILDRLPVSAQAQGFVRGRSVVTNAALHCGQAVVLNLDVQEFFPSIPFARVRRVFISAGYSKCVATILALVCTECPRQELTFEGRRLWVASGPRGLPQGACTSPALSNLVCLRLDRRLQGLSARLGLVYSRYADDLTFSGPAELRQRVGAVLKSVTGILQAEGLQVHPGKTRVQPRSTAQLVTGLVVNDRPGVRRDEVRRIRAILHRAAREGLQAQNREGHPNFRAWLCGRIGWIGQSRPELGQQFLQQLNALQ

SEQ ID NO: 6499 - protein, 539 aa, unidentified
  source 1..539: note = Planctomycetaceae bacterium; note = Related to JAEUII010000041.1
MSTQDSRGFFGWLRRLLFGDPIPAPKQAAASAATSTHGTAKPVTTAQNPAQQQNAPSLKAGLDASSFLPITRDEIISSTRTRWLWSGAFWGRRDLIPPVSDTRTKLIDRGMLTQGMLTAEQLAEIHRVGLEMDAVRPSMTLIRSEAEKAGAEAVVASREERKKIKAQKKEEAARRKEQRARDIAARFATDITYLGRRVSGRLNDRTSDVAKLEAAALPVLQTPADVAGALGLTIPQLRGLAFHSEVTSRSHYIQFSIPKKSGGVRLLSAPHRRLANCQRWIHTQILSKLEVAAQAHGFVVARSTVTNATPHCGKAVVFNTDLEGFFPSITFPRVRKVFQRLGYSPAVATILALLCTECPRRTVEFGGQTLFVATGPRALPQGACTSPALSNQAALRLDRRFQGLATRMGLTYTRYADDITFSGNEELKSRTGYLMARIRHVVQDEGFRVNEAKTRVQRQSTAQSVTGLIVNERPGVLRSKVRRLRAILHQAKSSGLEAQNRDKHPNFRAWVEGMIAYIAMSRPDTAEVLRQQYAQIRET

SEQ ID NO: 6500 - protein, 537 aa, unidentified
  source 1..537: note = Related to JADZDL010000180.1; note = Planctomycetes bacterium
MLFGGSPRPRPAARTPARPAPGRAASPGGSQPTVQPTVSSASPPRPSGLGKRLQAPDLTPLAGSELKRSLRQRGQSSWSIFGGASWWGRRDLVPPSTDERTNLIDRGMIGRGLTSADEVAELHRVGDEMLQRDPRRDGGAAAGEIAVQKDRAERAQQKQQKREAAAQRRAERAAAVAARRANDIIFLGRGVSKGLADRTGDATRLVGAGLPVLATPADVATALELPIPRLRWLAFHADATAQPHYVRFSVPKRSGGTRDLAAPMPRLKATQDWILANLLAKVPTHAAAHGFVPGRSTVSNAVPHLQALAVINCDLKDFFPTIHVHRVRGCFEELGYSPAAATILALLCTEAPRRLVEYAGRPLHVATGLRCLPQGAPTSPALSNLIARRLDARCLGIARKLGFTYSRYADDLSFSTHEPAALARIGYLLARIRHIARDEGFAVNEKKTRVLRPSSSQRVTGIVVNGAEPRIPRATVRRLRAILHQAEKTGLEAQNRDGHPDFANYLAGMLAWVRMVSPQQAEPLLAAWRRVRRSAAD

SEQ ID NO: 6501 - protein, 536 aa, unidentified
  source 1..536: note = Planctomycetes bacterium; note = Related to JAEUHU010000483.1
MQLLFGAPPRPRPAARPPARPAPAAPNAAAPTSARPEPRPAPPRPADVGHRLEAPNLTPLAASELKRSLRQRGQSSWAIFGGASWWGRRDLVPPSTDERTNLIDRGMVGRGLTTVDELAAMHRVGDEMLRLDPRRDGGAAAGEAAVQADRAERARVKQQKKEEAARRRAERAAAVAARRANDIGFLGRGVSKGLADRSADAARLGGAGLPVLATPADVAAALQLPIPQLRWLAFHAEATERPHYVRFTVPKRSGGTRDLAAPMPRLRATQDWILANVLAKVPTHAAAHGFVPGRSTVSNAAPHLRPLAVVNCDLQDFFPTIHVHRVRGCLEELGYSSAAATILALLCTEAPRRLVEYAGRPLHVATGPRCLPQGAPTSPALSNLIARRLDARCLGIARKLGFTYTRYADDLTFSTTDPEALARIGYLLARIRHIAQDEGFALNEKKTRVLRPSCSQRVTGIVVNGDQPRIPRATVRRLRAILHQAEKTGLEAQNRDGHPDFANHVAGMLAWVRMVSPQQAEPLVAAWRRARRNDAG

SEQ ID NO: 6502 - protein, 576 aa, unidentified
  source 1..576: note = Phycisphaerae bacterium; note = Related to CADCUQ010000908.1
MPLAVGGVGMGWFDWLKPRKTPDEGPPAPSPGLTHGDLSGLVAQPGPPTPGTVPTDPRVVTTRVPTTQEPATPTVASAGTPASASRAARRSPSSPPPESLDYDLGPFAPISQSDLRAQAGKLTNAWRTLYLFGRTSRIPPANDPRTNLIDRAMVSGGLLTPEELAEIHAVGEAYDRARPDLQVELAKAELSAVLPEQERAERKARKRAEAAERKRLRAEAVAERRATDVVFLGRGVSTQLHDRTSDAEALAKLGLPVLSTPADVAAALSVTIPQLRWLAFHSEASTVSHYVRFEVPKRSGGTRQLAAPQPHLAAAQAWVLANVLSRVPPHDAAHGFVPGRSTVTNAAPHVGRAVVVGADLTDFFPTVTFARVRGVFRQLGYSPAVATVLALLCTESPRRTVTYANRPFHVATGPRALPQGACTSPALSNLAARRLDSRLSGIGRKLGFAYTRYADDLTFSGGAEQLAKVGYLLARLRHIAQDEGFAVNEKKTRVLRQSASQQVTGVVVNQRPGVPRDVVRRLRAILHRAQFEGLPAQNRENHPHFEAWVRGMVAYVQMVNPDQARPLREALDALPG

SEQ ID NO: 6503 - protein, 598 aa, unidentified
  source 1..598: note = Related to NZ_CP063458.1; note = Proposed Humisphaera borealis
MGLLNWIKKLVSGKSPGRPSGGQSASDLAREFGQTIDPGLLAGQGSQPPVNQPPTVPPQRPTVVKVPANWISTGQAPSSATNTPNSAAASTIPYASLALRAAVPPAPANRLSPSPAESFDYDLGPFAPISADDLRTGADRLKNNWNNLWLFGRSNRIPPADDPRTKLIDRAMITEGLLTPQELAEIHAVGQAYDAARPDLQVELAKAQVAVTLPEQERAERKARKQAEAAERKRKHAEAVALRKQADIIFLGRGVSNQLHDRVSDVAKLTAIGLPALSTPADVAAAMDLPVSRLRWLAYHSDAATVSHYVRFTVPKRSGGTRQLAAPHDSLAETQQWILANVLSRVPTHDAAHGFVPGRSTVTNAMPHVGKPLVINCDLRDFFPTISFGRVRGIFKQLGYSPAVATIFALLCTESPRQEVVYAGKTFHVATGPRALPQGACTSPAVSNLASRRLDSRLAGICRKLGFTYTRYADDLTFSGDAALNDKVGYLLARVRHIADDEGFAVNEKKTRVQRPHVAQKVTGIVVNDRAGVPRDVVRRLRAILHKAGKEGLAAQNRENIPHFEAWLRGMIAYVHMVNPKQAKPLAEAMGRIAPTTT

SEQ ID NO: 6504 - protein, 518 aa, unidentified
  source 1..518: note = Candidatus Riflebacteria bacterium; note = Related to JACQZM010000063.1
MGFFDWLIELLVGGPSTDRFSSPQPPPRRPPGARQSRRLDLDIEQFTPLSDSEVKKQARTLGRAWSNPWFGRRDLIPPPEDPRTLLIDRAMVGHGLLTPEELVRIHEIGLEMDKVRPDLAMAKVEAQAAVARTVEERRARKLARQQESARLKKLGAEAVAQRRATDIVYLGPGVSRGLADRRSNVEKLAAASLPVLASPADVAQALGLAVPRLRWLAFHSDAASRLHYVRFTVPKKSGGTRELSSPHRALAAAQRWVLTSVLDKVPTLPAAHGFVKGRSTVTNASVHVNRAVVVNLDLVDFFPSITFPRVRGVFQRLGYSPAAATVLALLATEAPRRTVAYAGKTFHVATGPRALPQGACTSPALSNLVARGLDARLSGIAAKLGFAYTRYADDLTFSGPDEVQNLVGYLMARVRHIAGDEGFAVNEAKTRVQRRNTAQQVTGIVVNQRPNVPRTEVRRLRAILHRAATEGLAAQNRQNHPRFAEWVQGMVAYISMVNPAQGKPLAEALARLDAKKGP

SEQ ID NO: 6505 - protein, 518 aa, unidentified
  source 1..518: note = Related to JACPRC010000003.1; note = Planctomycetes bacterium
MGFFDFLRRLFGGGEAGDPPPPLAFPAKALPPKPAPPLPPKKRAPPTSYEADFLPISDKELHAKAATEEVRTSPWWGRTDTIPPADDARTKLIDRALVTRGYLTPEQLEEIHQVGDLMLLKKGDEAMVRQEAKRAVERRKEERAARKAEMKRLAEERRRAHAAEVASRRATDILFLGRDVSGGLADRRSDVEKLRTAGLPILASPAEVAAAMGLTIPQLRGMAFHIDAATVTHYVTFRIPKKSGGMRDISAPKPRLATAQRWLLENVLSKIPVEPPAHGFLTGRSTVTNAAPHVRRAVVVNMDLKDFFPSITFPRVRGIFEKMGYSPAASTIFALLTTEAPRRVAEYEGKRYYVAIGPRGLPQGACSSPALSNLAAGRLDRRLGGLAAKLGWTYTRYADDLTFSGDTIIPKGTKDPKSVAWLLARTRHIISEESFEVNEKKLRVQRRNTAQVVTGIVVNDKPAVPRAERRRLRAALHRARFVGLKEPARVRGEVAYVSMVNAEHGGRLKVRLDALLKR

SEQ ID NO: 6506 - protein, 498 aa, unidentified
  source 1..498: note = Related to JACQFK010000217.1; note = Planctomycetes bacterium
MGFFDWLRNLLFGGMPQKKAVIVRPAQPVFPLRPAPARLPAAAPKAPPPAPRPTADYAAEDFAPISDKELRQKSKSSEVATSPWWGRTDTIPPGDDARTKLIDRALVTRGYLTPEQLAEIHRVGDLMLLKKGDEAILRVQAQAAVARSKEERAALKAEKKRQAEERKKAHAEAVARRKAADIIFLGRGVSGGLAGRTSDEGKLRKFGLPSLATPDQVAAALSIPILRLRWLAFHSEASTVSHYVRFQIPKKSGGLRDIWAPQPKLAAAQAWILENILSKVPAGPVAHGFVPGRSTVTNAAPHVKRTIVVNVDLRDFFPTITFPRVRGLFESLGYSPAVATVFALLCTEAPRREVEYSGRKYFVATGPRALPQGACTSPALSNLAAWTLDRRLGGVAAKLGWTYTRYADDLTFSGDTLVPKGEKNPKSVGWLLARTRHLCEAEGFEVNEKKVRVQRRNAAQTVTGIVVNEKPSTSRAERRKLRAILHHARFEGIEKQNR

SEQ ID NO: 6507 - protein, 536 aa, unidentified
  source 1..536: note = Related to JAGQQS010000445.1; note = Planctomycetaceae bacterium
MLLRLLRFFFGLVRPKSSAERGTHPGALPSSLTGRDLTPPRTVQSATASNPETGSSSPGPSGLNGLDTDKFAPSTVEEAWTATGRADWRSVFLDSRGAIPPSEVPRVQRIDRTMVGMGLISESELAEIHDIGDRMSQYQSDAAFVASSGESAVAQSREERRRQREEKQAAAEARRKQRREQIAQRRANDIVFLGRGVSRGLADRRSNIEQLQEQCLPVLSSPADLAQSMGMSISLLRWLTFHSDAPTRVHYVSFDVPKKSGGMRRLSAPHRKLAEAQHWVLTNILNLLPVHACAHGFVARHSVVTNAELHVGASVVINADLSNFFPAITFARVDGMFQKLGYSPAIATILALLCTECPRQPLQFGETMYYAATGPRSLPQGACTSPAISNQIAGKLDRRMSLLAEKLGWRYTRYADDLTWSVCGEAIPSIGYVLARIRHIVEDEGFELNHAKTRVQRRSQQQSVTGVVVNDRMNVPRPTIRRIRAILHNAKRTGLDAQNRNSHPHFRDWLTGMIGWVHMVNPEQGRRLMSALAELS

SEQ ID NO: 6508 - protein, 536 aa, unidentified
  source 1..536: note = Related to JACMKP010001266.1; note = Fuerstiella sp.
MLIRLLRFLFGWSKPAAPAEVASPREPAPSSLTGRDLSQPASVQSATVPKADSRAAAPPRSNLSGLDTDKFAPITVDEALAATAKADWKSAYFDSRGVIPHPSLPRVQVIDRTMVGMGLISEQELAEIHDIGDRMGQFRSDAEFIAIAGERAVVESREERQRRKELRKAEAEARRNLRREQVVQRRATDIVFLGRGVSRGLADRRSNVELLQNNGLPVLSSPAELAQAMGVSISLLRWLAFHSDAPTRVHYVSFDVPKKSGGIRRLSAPHRKLSVAHHWILTNILNLLPVHTCAHGFVAQHSVLTNAEPHVAASVVINADLSNFFPTITFSRVDGMFRKLGYSPAVATILALLCTECPRQALKFSDTIYYAATGPRALPQGACTSPAISNQIAAKLDRRMSAMASKLDWKYTRYADDLTWSTTGEVTPSVGYVLARMRHIVNDEGFELNHAKTRVQRRSQQQSVTGVVVNDRMSVPRQTIRQVRAILHNAKRTGLDGQNRDAQPHFRDWLTGMIGWIQMVNPEQGRKLRSELAELS

SEQ ID NO: 6509 - protein, 535 aa, unidentified
  source 1..535: note = Planctomycetes bacterium; note = Related to QWOO01000305.1
MLLRLLRFLFGISPPTAPRDVRSSLQERDLSGVPGSTKSTSGSSATSLTTGAGRSAPAGLSGLDTDRFRPQPGTDLTSLGRMTDWQFSAADTRNLIPSEESPQVRAIDRAMVGMGLITETELVRIHDIGRQMAPLLSAASFIQSAGASAVKESREERQRRKAEKKETARLKQIAHLEQVQHRKATDIVFLGRGVSRGLADRRANIEKLQDAGLPVMSSPSDVANAMGLTVSRLRWLAFHSEAPTRVHYVSFEIPKKSGGTRRLSAPHRQLAAAQHWILTRVLNLVPVHENAHGFITQRSVVTNAVPHVNSSIVINADLKDFFPSITLARVDGLFRSLGYSPAVATIFALLCTECPRQTVQMHGTTYFAATGPRALPQGACTSPAISNRITHKLDRRMSAMAAKLGYRYTRYADDITWSTSDESAVAVGYVLARIRHIAEDEGFELNHAKTRVQRRSQQQSVTGVVVNDQLGVARETVRTIRAILHNAERTGLASQNRNQHPQFESWLTGMIGWISMVNPEQGQKLRQHFDKVRGS

SEQ ID NO: 6510 - protein, 539 aa, unidentified
  source 1..539: note = Related to QWPK01000237.1; note = Planctomycetes bacterium
MLIRLLRFLIRLALPTPQPPRDTPSSLAGRDLSGQPGSASRTVSSVANTTVSSSGPAAPKGSSLSGLSTDKFAPMSVADALSATAAADWRSANFDSRSVIPPADLPRIQVIDRTMVGMGLISEQELAEIHDIGREMTQFQSDAAFIHQAGERAVAISREERQRLKEQKKAEAEQRRVLRRQQVAHRRATDIMFLGRGVSRGLADRRSNIEKLQAGGLPLLSSPADLANAMGLTISKLRWLAFHSDAPTRVHYVSFNIPKKSGGTRRLSAPHQQLAAAQHWILTNILNLIPVHQNAHGFVAQHSVVTNAAPHVGSSVVINADLKDFFPSITLARVDGLFRRIGYSPAIATILALLCTECPRDTVTFCGTTYHAAIGPRALPQGACTSPAISNLVAHKLDRRMSAMADKLGWRYSRYADDLTWSIEAEPSPSVGYVLARIRHIVDDEGFSVNHEKTRVQRRSQQQSVTGVVVNDRLSVSRDTIREIRAILHNAKSTGLAAQNRNEHPHFESWLAGMIGWIDMVNPQQGGKLRAELIELLRK

SEQ ID NO: 6511 - protein, 308 aa, unidentified
  source 1..308: note = Related to JACPHK010000356.1; note = Planctomycetia bacterium
MGVAIPKLRWLAFHSEAPTRTHYVYFKVPKKSGGERRLAAPYKQLAAVQRWILDSILNQLPVHDAAHGFVRERSTVTNADLHVGADVVINADLCDFFPTITFYRVEGLFRSFGYSPAVATILALVCTECPRDAVTFSGETYYPATGHRGLPQGACTSPAISSLICRNLDVRFAGIANRMHWRYTRYADDLTFSTSTEHGDKIGYLLARIRHISEDEGFRINAKKTRVQRNHTRQSVTGIVVNDKRSIDRNTIRRLRAILHNAKRTGFAAQNTEQRPHFENWLRGMIAYVAMVNPERGHELREQYEALR

SEQ ID NO: 6512 - protein, 525 aa, unidentified
  source 1..525: note = Planctomycetales bacterium; note = Related to JAGQPR010000143.1
MGLFNWLSNLLGKSPAGNKSSVDRGSVVIPELSEPRPESKKRGPIRLNGLDAQQFAPLEDNEARELAKSLGRSIWNDTFFGRRDLIPPTSDARTLLVDRMMIADGITTADELAEIHAVGLEMDRLRPQLAHAAARADRAVASNRQARAERKARKKSEAADRLRLRAEAIAERKLNSIDFLGRGVSRGLPHRQSDAQLLEQRSLPVLHTPADLAQAMQLTISELRWLAFHSEATERIHYVQFAIRKKSGGVRLLASPHLKLRTTHRWILANILSKIPLDNAAHGFVVGRGIVSNAQPHVGKSVVVNVDLADFFPSITFPRVAGLFRGLGYSGAVATILGLLVTECPRQRVRYAGRELWVASGPRSLPQGACTSPAISNAIAWRLDHRLAAIASKLDWTYTRYADDLTFSTSGDNAEKIGYLLARLRHICENEGFRLNHNKTRVQRRNMQQSVTGVVVNDRCGVSRKVVRQLRAILHNAKQTGLAAQNRDGHPDFQNWLQGMIAYVHMVNPDQALPLKQKFEQIIGP

SEQ ID NO: 6513 - protein, 533 aa, unidentified
  source 1..533: note = Related to SIHJ01000002.1; note = Posidoniimonas corsicana
MGMFDWLSGLFGRASSGRPTAPAAGAASPAPPPVRSSAPEQQPRPRQSGPKRLEGLDASQFAPLEIDDARGQAKRLSRSFGRLVWGNRTDRIPPANDARTLLIDRMMVAEGLVTPEELADIHRVGAEMDRLRPDYDAAHRAGAKAAEQAAASSRQEREQRKAEKKAAAAERKRERAEQIAERRRSDIVFLGRGVSRGLADRQSYPDLLGSFGLPVMATPADVVKAMGFLDIAELRWLAFHTEAATRTHYVQFTTRKKSGGVRVLASPHQKLRRAQGWVLENIIAKIRVDDAAHGFVAGRSTVSNATPHVGQQVVVNADLKDFFPSITFYRVEGFFRRLGYSGAVATILALLTTECPRQQVTYAGQTLWVATGPRCLPQGACTSPGLSNAIAWKLDRRLGGMARGLGWTYTRYADDVTFSASGEPAAKVGWLLARLRHLAQEEGFELNHKKTRVQRQNAQQSVTGLVVNDRVGVSRKTVRRLRAILHNAKQTGLEAQNRDNHPNFTGWVQGMIAYVAMANAEQGASLQAAFDEL

SEQ ID NO: 6514 - protein, 541 aa, unidentified
  source 1..541: note = Related to NZ_CP036278.1; note = Aeoliella mucimassa
MGLFDWISNLFGGSSSTANPPKPESSDSAGPQGPASTSSSSSPAPTPPQPPRPGPPAPPKSKRLEGLDASQFAPIEEAAALRQAKSMRLRFWTSTWFGLRDRIPPASDERTKLVDRLMVADGLATPEELAEIHEVGAEMDRLRPALDDAAKQAGQAVSRNKEDRAKLKAQKKAEAAERKRLRADAIAERKRNDIVFLGRGVSRGLADRESNAEKLEGRGLPVLHTPSELATAIDLPLSTLRWLAYHNEAAEQVHYVQFQVRKKSGGIRVLASPHKKMRRAQQWILDNILTKIDIHEAAHGFVAGRSTVTNAAMHVGQQVVVNVDLQDFFPSVTFPRVEGFFRSLGYSGAVATILALLVTESPRQRVRYAGKELWVATGPRSLPQGACTSPALSNAISWTMDTRLTAISSKLGWSYSRYADDLTFSTAGEASQQVGYLLARIRHITQEEGFGLNRKKTRVQRRSAQQSVTGIVVNDRAGVARKTVRQLRAILHNAKTTGLAAQNREGRPDFEAWLQGMIAYVRMVNPEQAASLTDAYEQLRY

SEQ ID NO: 6515 - protein, 540 aa, unidentified
  source 1..540: note = Related to PZKM01000007.1; note = Blastopirellula marina
MNFFRRLKQWFAPGQERSAQQTPSQLPASVENRDYTSPSPGTPPASQPTTPNRSTSPPSSPQPRPESTLSGLDASRFQPLTQDEAMESTSQPGWRTAYWDPLNVIPSASLPRIRVIDQTMVGMGLIDAEELAEIHDIGEQMAQFRTDYHVIQHAGQAAVQAARNARDARKAEMKRLAAERKQQRQQAVAQRKATDIVFLGRGVSRGLADRRSNIERLQASGLPVLSSPAELAEAIGISVGTLRWLSYHHPASKTTHYHSWKIAKRSGGERTISRPHKKLEHAQRWVLDHLLSKLPTHDAAHGFVPGRSTLSGAVPHVGASVLVNVDLQDFFPTIDFARVAGLFRGFGYSPAVATILALLTTEAPRRMIRSGSETLHVAVGNRSLPQGACTSPAISNLICQRMDKRLSGMAASIGWCYTRYADDLSFSSVEQADKVAYLLARVRHFTDEEGFQIKASKTRVLRRSNQQSVTGIVVNDRPSIDRKTIRQLRAILHRAKSEGLERQNRIGHTNFRGWVAGMIAYVEMVNPQQGRKLREAFGTI

SEQ ID NO: 6516 - protein, 505 aa, unidentified
  source 1..505: note = Related to NZ_CP083740.1; note = Bremerella volcania
MSPPSESGQASEFSPAASRPTTSSPSPPPESELSGLDASRFQPISHDDALEATSDPSWKTAYFDPLNVIPSVSLPRIRVIDQTMVGMGLITAEELAEIHDVGEQMSQFRTDYYAIQAAGQQAVQSSRDAQAARKAELKRLAEQRKQAHEEAVAKRKATDIVFLGRGVSKGLADRRSNIERLQACRLPLLSSPADLADALDVSIGTLRWLAFHHPASRTTHYHWWKIQKSSGGERTICCPHSKLANAQRWILNNILGKVPLHDAAHGFVPSRSTLTGAKPHIGSRVLVNVDLKDFFPTIDFARVAGLFRGLGYSPAVATILALLTTESPRMRLRSGKTTLYVAVGNRSLPQGACTSPAISNLISRRMDKRLFGIANSIGWRYTRYADDLSFSCSDREDKVAYLLARVRHVTSEEGFQIKESKTRVLRKNSQQSVTGIIVNDKASIDRKTIRKLRSILHRAKFEGLEKQNRLGHPNFSAWLAGMIAYVEMVNPEQGNKLRLAYESLG

SEQ ID NO: 6517 - protein, 534 aa, unidentified
  source 1..534: note = Related to QPEV01000010.1; note = Blastopirellula cremea
MNFFRRLTKWITSGRDSSADQPVPSQMPASVENRDYTVPNTPQTPSAPASNPSPPEQPQTSNLAGLDASRFQPLSQDEALDATSQPGWQSAYWDPLNVIPSTSLPRIRVIDQTMVGMGLIDAEELADIHHIGEEMAKYRTDYHVIQHAGHAAVQAARDARAARKAEMKQRAAQRKQEREAAIAERKATDIVFLGRGVSRGLADRRSNVERLQASSLPVLSSPADLAQAMGIPVATLRWLSYHHPASKTTHYHSWQIAKRSGGVRTISRPHKNLEDAQRWILESILAKLPTHDAAHGFVPGRSTLTGATPHVGAKVLVNVDLQDFFPTIDFARVAGLFRGFGYSPAVATILALLTTESPRRVIRSGSETLHVAVGNRSLPQGACTSPAISNLIARRLDKRLAGMARSIEWQYTRYADDLSFSCRESEEKVAYLMARVRHLTSEEGFLVKESKTRVLRRHAQQSVTGIVVNDRPSIDRKTIRQLRSILHKAKSEGLERQNRIGHTNFSGWVTGMIAYVEMVNPQQGQKLREAYEAL

SEQ ID NO: 6518 - protein, 555 aa, unidentified
  source 1..555: note = Related to NZ_CP037423.1; note = Stieleria neptunia
MGLFEILKQIFAPGQRRPGPPRGAPSDPSAIDPGSLTPPRQAEPSPATSSAPLSSATPATTPAPAATSKPAGGLEGLDASRFQPLTPSEALDATAQPGWQTAYWDPLNVIPSTHLPRIRVIDQTMVGMGLIDADELAEIHDIGQRMSKFRTDYHVIADAGQQAVDQSQAARDARKQEMKKRAAERKQAHQQAVAHRKATDIVFLGRGVSKGLADRRSNIERLAASDLPLLSTPADLANTLGISIGTLRWLSFHHPASKTTHYHHWKVPKRSGGERTISRPQKKLESAQRWILESILAKRPTHDAAHGFVTQRSTLTGALPHVGSQVVVNMDLENFFPTIDFARVAGLFRAMGYSPAVATIMSLLCTESPRRVIRSGDETLHVAIGNRSVPQGACTSPALSNLICKRLDNRLVGMAESIGWRYTRYADDLSFSCPIAKDGTDQGAQASAKIGYLLSRVRHFADEEGFRVKESKTRVLKRSTRQSVTGIVVNDRPSIDRKTIRRLRAILHRAKHEGLEAQNREGHPNFAAWLAGMIAYVQMVNPAQGQKLRKQMDLL

SEQ ID NO: 6519 - protein, 542 aa, unidentified
  source 1..542: note = Related to NZ_ANOF01000123.1; note = Rhodopirellula sp.
MGLFRVLKQFFAPGRNPPQDATRAQATAPSSIDHRDLTPPTTPVVTTGPDYVPLNSLPATPPRESSGFDGLDASQFQPLTQDEAMEATAEPGWRTAYWDPLGVIPSADLPRIRVIDQTMVGMGLIDAEELAQIHSLGEEMSRFRTDYYAVQDAGNQAVQQTRDARTARKAEMKQRAAERKKQHDADVAHRKATDIVFLGRGVSRGLADRRSNIERLKSSELPVLSSPADVASALGISVGTLRWLAFHHPASKTTHYHTWTIAKRSGGDRTISRPQKKLAAAQQWILDSLLSQIPVHDAAHGFVPGRSTLTGAQPHVGSQIVVNMDLQDFFPTIDFARVAGLFRALGYSPAVATIFALLCTESPRRVIRSGGETLHAAVGNRSLPQGACTSPALSNLIAKRLDKRLAGTAKSIGWQYTRYADDLTLSTKVNSSKVGYVLARVRHLAKEEGFVVKESKTRVLRQCTQQSVTGIVVNDRPSIDRKTIREIRAILHRAKFEGLEKQNRIDHPNFAGWVSGMIAYINMVNPQQGGKLRRQLDELSMR

SEQ ID NO: 6520 - protein, 544 aa, unidentified
  source 1..544: note = Related to JACKHI010000001.1; note = Phycisphaerales bacterium
MGLFDFFKQMFGGRSVQEKCVRCRQPLRMGALFCGNCKHPRGAPYPIPLAQTKRSDQGAANAPRVRPQNLVGLDADKFKPMTTSEAMATIDNEDSFKSAYLDSLNAIPDASLPRIQVIDRTMVGLGLIAPEELVHIHDVGKAMGELRGDWSSIHARGQQAVQLSREERAARKQQKIEEAARRRQARAEAIARRKATDIVFLGRGVSRGLADRRANVEALKRAGLPVLAAPSDVSVAMNISIPRLKFLAFHSDAPERVHYVSFSVPKKSGGMRLLSAPHQSMDEAQRWILDNVLCKIPTHSAAHGFVTGCSTVTNAEPHVGARTLVNVDLKDFFPSITFPRVMGLFQSLGYSPAVATIFALLCTEAPRRVMKYAGRVFHAATGPRSLPQGACTSPAISNLVARGIDRRLEGIARRLDWTYTRYADDLSFSRKDAGEPHVGYLLARIRHIAQDEGFEVNEKKTRVQRPNQRQTVTGLVVNDKVNVSRKDIRRIRAILHRAKHEGLARQNREDHPYFESWLRGMIAYISMVNPTVGQSMRTQFDALA

SEQ ID NO: 6521 - protein, 544 aa, unidentified
  source 1..544: note = Related to JACMKE010000965.1; note = Burkholderiales bacterium
MGLWNVLARLFGGGSASTNPTPPTQPQDARAPVGMPYGRGSAVNTPPPPPRTLARPGSPSPTRPAPTNLNLDPGQFAPVGAAELKKRAGELRWNWASVNFDRRDQIPSAGDPRTALIDRALVAQGLLTPEQLVEIHETGAQMAELRPELRNLQNIAADAALADEAERRARKEAKKAEADRRRAERAEAIKQRRATDIVFLGRGVSGGLADRRANIERLQALGLPVLATPADVAKALGLEVSRLRWLAFHSEAAAVTHYVRFQIPKKSGGTRELAAPHRDLARCQEWVRIQILDRVDLHDAAHGFVTGRGTLTNARPHLGRAAVVNADLKDFFPTITFPRVKGVFQQLGYSPASATVLALLCTECPRGVVNYDGRELHVATGPRGLPQGACTSPALSNLVARGLDNRLSAFARRLGWTYTRYADDLTFSADGEAMGQTARLLTGLRHIVGDESFVVNEKKTRVQRPKTRQTVTGIVVNRHPNVPRDTVRRLRAILHRAKTEGLTAQNREAHPHFEGWVRGMIAYVAMVNPERGRELLAEFELRKR

SEQ ID NO: 6522 - protein, 544 aa, unidentified
  source 1..544: note = Related to JADJTK010000010.1; note = Opitutaceae bacterium
MGLFSTLFRWLRGGPTLDEARRAAARRVPADRAPEGQPYRAAVPGAGARPPVLPSAQPSSRPAAGKLNLDAGQFTPLSPEEVKKRAASLSWNWSTVNFDRRDQIPSTAEPRTALIDRALVAQGLLTPEQLVQIHEVGAQMAALRPELANIHTIAHNAVAADAAERRLRKERKQAEAAQRRTARATAVAHRKATDIVFLGRGVSGGLADRRANIERLQLLGLPVLGPPGDLAQALGLEVSRLRWLAFHSEASAVSHYVRFRIPKKSGGTRELAAPHRDLARCQDWIRRNILDRVPLHEAAHGFVTKRNTLSNATPHVHRAVVVNADLKDFFPSITFPRIKGVFQQLGYSPAAATVLALLCTECPRTAVKYEERELWVATGPRGLPQGACTSPALSNLVARGLDGRIAGLARKLGWTYTRYADDLTFSTDAEGAPKTAWLLARLRHIVGEENFLVNEKKTRVQRPNTQQSVTGIVVNQHPNVPRETVRRLRAILHRAKTEGLAAQNREAHPHFAGWVRGMIAYIQVVNPERGRELLADFEALPQGR

SEQ ID NO: 6523 - protein, 551 aa, unidentified
  source 1..551: note = Proposed Chthoniobacter flavus; note = Related to SLWZ01000015.1
MIPLGAIAGALVVLLRQLFKGSKPQPRRSSPPPPVPRPGDRPYTPGAPPPIPPAAGAARPAQPSPPRSAPPRSTTLNLDAGQFTPVSAEEAKKQARGIKWNWASVNYDRRDQIPAPTQPRTLLIDRAMVAQGLLTPEQLVEIHDVGAKMAELRPDLAGIGNVADHAVAADQEERRRRKEQKIAESAERQRKHAEAVAQRRATDIIFLGRGVSGGLADRRANVEKLQQLNLPVLATSGDVAKVLDLEISRLRWLAFHSEACAVTHYVRFTIPKKSGGTRELAAPHREMARCQLWIKLNILDRIPLHEAAHGFVAHRGTMSNAVPHVRRDVVVNADLKNFFPTITFPRVKGIFQELGYSPAVATILALLCTECPRQRVTYAGRELHVATGPRALPQGACTSPALSNLAARGLDARLTGLARKLGWDYTRYADDLTFSTSGAPAQKTAWILARLRHIAQEENFTVNETKTRVQRPSAQQTVTGIVVNKRPNVPRETVRRLRAILHRAKTEGLAAQNREQHPHFAAWVGGMIAYMQMVNPERGKKLKAEFDALPK

SEQ ID NO: 6524 - protein, 404 aa, unidentified
  source 1..404: note = Verrucomicrobiaceae bacterium; note = Related to SEGX01000707.1
PSRQAIQAKQQAEAQAAEQALADDDAARAAAREARKAAAAARREQRAAAIAERRRTDIVFLGRGVSGGLADRRANVERLTAFGLPVLASPADIARVLGISVPRLRWLAFHSEASSVSHYIRFTIAKKSGGIRELAAPHRDMAAAQQWILTNILNVPPVRDCAHGFVRGRNVMTNAVPHVRRDAVVNADLKDFFPTVTFPRVKGIFESLGYSPAAATVLALLCTDSPRRLVEYEGEKLHTAAGPRALPQGACTSPALSNMAARKLDARLEGLARATGWTYTRYADDLTFSANGETASRCGGLLQALRRLCAEEGFTVNEKKTRVQRPNSQQSVTGVVVNQRPNVPRTLRRRLRAILHQARTTGLAAQNTENHPNFPMWLRGMIAWVSSTNPDEGRRLLEAFKDLK

SEQ ID NO: 6525 - protein, 528 aa, unidentified
  source 1..528: note = Related to JADLHC010000305.1; note = Planctomycetia bacterium
MGFIDWLRDLFLGPEFRPKDRSQPPPQRPGAVPDPVFPPRNVAIPGQNPLAQRPAPAPRTPPPPPRKLNLTAAAFAPISDAEAKKQGEAARSAFNPWWGRRDLIPPPDDPRTLVIDRSMVAHGFITPQELTGIHDVGRQMEELRPDLNQVEAQANQAVLAAQADREELKKRKKAEAAEKKRRHAEDVLRRRSTDIVFLGRGVSKGLSDRRANVEKLQAAGLPVLATPADVARALGLTVPRLRWLAFHTEASPVTHYVRFEIPKKSGGMRALAAPHRDMARCQQWILANILGKVAPHAVAHGFVKGRSTLTNAAPHCRRDVVVNADLRDFFPTITFPRVLGIFAQLGYSPAAATVLALLATESPRRPVEVDGTTYHVACGPRALPQGACTSPALSNLAARGLDRRLAAIATKLGWIYSRYADDLTFSTSGEAKTGYLLARLRHIARDEGFTVNEDKTRVQRRSDAQSVTGIVVNEFPSTPRKERRRLRAAMHKAKTSGLAPKDLARARGMAAYVAMVNPAQGAKFAALR

SEQ ID NO: 6526 - protein, 529 aa, unidentified
  source 1..529: note = Related to JAIPJY010000032.1; note = Prosthecobacter sp.
MGLLSLIRRLLGRDQPSQPPPIPRPSTSPRHNVVPQVRATSQPPQRKTLSQLDSQVFAGLSGAETKQQAKAMGRPLWSNLFAFGRQSVIPPVSDERTLMIDRAMVGEGLITPEELTAIHEIGLKMEELRPSYEGARHQGQVAVNADKAAKAELKRQKKAEAATRKAEREAAIAQRKATDIIFLGRGVSGGLADRRSHVEKLQEAKLPVLSTPAELATALELPVKRLRWLAFHAEVAVVTHYIRFQIPKKSGGMREISTPHTDLARAQSWILQNILEHVPVSGVAHGFVRERGTLTNARSHTGKDVVLNADLKDFFPSITFPRVRGIFQQLGYSPAVATVLALLCTECPRRTVTYDGQTYHVANGLRALPQGACTSPALSNLCARKLDLRFAALAAKHGWTYTRYADDLTFSTRGEPAKATALILSRLHNIVQDEHFEVNTAKTRIQRRNAQQSVTGIVVNDRCNVDRKTRRRLRAILHQAEKTGLPAQNRIGHDNFAGWVSGMLGYVKMINPQQGMKLFKAWDLLGGQK

SEQ ID NO: 6527 - protein, 528 aa, unidentified
  source 1..528: note = Related to JADJPW010000004.1; note = Verrucomicrobiaceae bacterium
MGLFSFIKSLFGGSSTPPPLPRRETTPVRNAVPQAKTPPQPPKRQTLAHLDSQVFEAISSEAAKKQAKAMGRPLWSNLFAFGRQSVIPPVTDPRTLMIDRAMVGEGLITPEELTQIHEIGEKMAELRPDFNWARHQGQAAVNADKAAKAELKRQKKAEAAKRKADREAAIAHRKASDIIFLGRGVSGGLADRRSHVEKLQEAKLPVLSTPAEVATALELPVKRLRWLAFHAEVAVVTHYIRFQIPKKSGGVRELAAPHADLARAQRWILQNILERVPVSGVAHGFVKGRGTLTNARSHTGKDVVLNADLKDFFPSITLPRVRGIFQQLGYSPSVATVLALICTECPRRTVEYDGQTFHVATGPRALPQGACTSPALSNLCARKLDLRFAALAAKHGWTYTRYADDLTFSTDDEAAKATALILSRLHHIVKDEHFEVNEAKTRIQRRNAQQSVTGVVVNDHCNVPRKTRRQLRAILHQAAKTSIPAQNRIGHDNFTGWVSGMLGYVKMINPQQGEKLFKAWDMLGEKRP

SEQ ID NO: 6528 - protein, 532 aa, unidentified
  source 1..532: note = Related to NZ_JAALXT010000006.1; note = Rubinisphaera sp.
MFRWLLNFLGLAPNPRPTARQRTIADSWTAERTSAAPQSTPARSVSAQKKQTSASPEALNAAQFTPIGDRDLKEQAKNLGSAWSNPWFGRRDIIPPADDPRTQLIDRAMVTHGFLTREELADIHAVGEEMSEYRPDTVLVSHRANQLVAEATADREELKRQKKAEAEERKRQREEEIAERKRTDIVFLGRGVSKGLADRRANVEELQKNNLPVLATPGELAKAMEFPIPRLRWLAFHTVAAERVHYISFTVPKKSGGERVLSAPHRDMAAAQRWILENILEAVPVHEAAHGFVRKRSTVTNAEPHVGQEMLVGCDLEDFFPSITVFRVMGVFEQLGYSPAVATILALLCTECPRRKMIYAGQTFYAATGPRALPQGACTSPALSNLVCRRLDSRLTGLAKQFGANYTRYADDLTFSGSGDVANMAGWVIAKIRHVVADEGFTLNRKKTRVQRPNMRQTVTGVVVNERPGVPRKLVRRLRAILHNAQTTGLAAQNRENHPHFESWVEGMVSYIQMVNPSQGEPLRAALATIRN

SEQ ID NO: 6529 - protein, 507 aa, unidentified
  source 1..507: note = Planctomycetaceae bacterium; note = Related to JADZEF010000026.1
MPIGVQPESSGDERSAPAPTRRRENLAALNAEQFAPLEHDEVREQADQLGSLWGNPWFGRRDLIPPASDPRTQLIDRAMVGQGLLTPEDLVDIHRIGDAMDAVRPDLALAVAEADRAVTRSAEERAALKAEKKAAAAERRRLHAEQVTHRRATDIVFLGRGVSKGLAERTPNVAALQQAGLPILATPADVAAALSISIPRLRWLAFHSVATKRTHYVSFTVPKRSGGVRTLSSPHRSLAQCQEWILRNILDRIPVHAAAHGFVRGRSTLSGARPHVGAEVVLNVDLKDFFPTITFPRVKGVFQQLGYSPAAATILALLCTECPRRPVEYAGEKLYVATGERGLPQGACTSPALSNLVVRRMDARLQGIAQRLGWIYTRYADDMTLSTSGDAAQRLAYVMARVRHIAGDEGFALHAEKTRVQRPNVRQCVTGIVVNERAGVPRETVRRIRAILHRARHEGLAAQNLDGIPHFEGWLRGMIAYIRMVNPRQGAPLQHAFDELMPPGTVR

SEQ ID NO: 6530 - protein, 429 aa, unidentified
  source 1..429: note = Related to NZ_JACHXU010000001.1; note = Rhodopirellula rubra
MSVWDSLRRLIAPPKLPKTSEADRHAMAESFNLHRKRPLPAVRLKEQLDLSWLARRRTAPAAEPFGYLGDGVSYELGQRVTDVERLSSAGLPVLKTPEQLAEAIGFSARRLRWLAYHRDAQASCHYIHFIVEKKSGGVRSIAAPRPQIAACCRWIDREILRLIPPHDAAHGFVLGRSTTTAAQPHVGQDVIVNMDLSDFFPTITFPRVRGWFASLGYSRQTATVLALLCTESPRTPIDMDTSNVNASSIDTVNHSRLWLATGPRQLPQGACTSPAISNLVCRSMDRRLTGLCEKLGWTYTRYADDLSFSTSGKDDSQIGYLMHRVGGIVRDERFAINDSKTRVQRRSGRQTVTGLVVNDRIGVPRETVRQLRSILHHAKTEGLEAQNREGHADFLGWVTGMIGYVGFVDPAKGERLRSQLDQVLKQETT

SEQ ID NO: 6531 - protein, 408 aa, unidentified
  source 1..408: note = Planctomycetaceae bacterium; note = Related to DNPC01000265.1
MWDRLKRLFSGSAKSPRRSAAQFNTRRGNQSDERVLPYWSQRTPLADSAEARFSYLGNGVSHEAADLATDAELLKKLELPVVETGNQLAEAIGFSPKRLKRLAVHSAQTRSCNYFYFTVPKRSGGERLLAAPRPQIDACCRWILREILDKISIHPAAHGFAKGKSIKSNAEIHTQQQVIVNLDLLDFFPAIEFRRVRGLFESLGYNGQIATLLALLTTEASREPVPSPAGTLWAATGPRHLPQGACSSPSISNLICRALDRRLSGLCRSLSWNYSRYADDLTFSASAVAGQRVGYMLHRIRGIVREEGFQVNESKTRVQRPSQAQTVTGLVVNDGVSVSRSTVRMLRAILHNASLHGLESQNRDNHPHFAAWLEGMIGHVVNVDPQHGVKLQRQFRQLKKQQVSHNHE

SEQ ID NO: 6532 - protein, 321 aa, unidentified
  source 1..321: note = Related to JAFLCQ010000046.1; note = Planctomycetes bacterium
LPVLATPADVARWLDLSIPRLRWLAFHSDSTTVSHYVFFTVPKKTGGVRRLSAPHAGMAAAQRKIFQEILPRLRIHDAAHGFVTGRSIRSNATPHVGAHVVVNLDLKDFFPSITFPRIRGLLTAAGYSPCASSILALLCSESPRQVLGLGGQRLFVATGPRALPQGACTSPGLANLAARILDARLAGLVAAWGWTYTRYADDLTFSTQNAQADIGRLLTAVRNIVADEGFTVNEEKTQVQRRSQAQEVTGLVVNQRAKAPRELIRRIRAILHRAEREGLAAQNREGHRDFAAWLGGMIAYIAMTDPATAARYRAQLERVPR

SEQ ID NO: 6533 - protein, 602 aa, unidentified
  source 1..602: note = Related to CP043547.1; note = Planctomycetales bacterium 10988
MLLSSRLFFPLDVSSQKYFFYLPEFREWVVMSFFDWLQKLFGSASPEEQRPIPPRKSPEDPNPVATPEPQPSPTTETLKPSKVADPPARVSKTARAVKITEQEEPPKPPVSSVSGDALAMGELAPLSLDEAKSEAKASNISWRMSGGWDRRDRIPSLENPRTSLIDRAMIGHGLITAEELEEIHRVGAEMDELRPLREHALELARQQVAAEEQDKQKIKEEKKKEAARRAAVRQAEIELAKKTDIVYLGRGVSQGLANRQSNREQLDQLQLPFLDHPDELAKILEVEIPQLRWLTFHNEAAERTHYLQFEIPKKSGGSRILSAPHQALSKTQQWVLTNILQKLPTHEAAHGFVPGRSTVTHANLHVGCDLVAQMDLADFFPSITFPRVRGLFESFGYSPAIATILALLCTEAPRRTIELSGKRYYVAEGPRSLPQGACTSPALSNLIARKLDARLTGMSQKIGWTYSRYADDLTFSWKGSAGENGKQPNYGYLLSQVLAIIDEETFALNEQKTRIQRPSQRQQVTGIVVNDRPGVPRPVVRRLRAILHQAQKTGLAAQNRENHPHFAGWVQGMIAYISMVQPEKGKQLQAAFEQVPKDDAVN

SEQ ID NO: 6534 - protein, 563 aa, unidentified
  source 1..563: note = Related to JADLAG010000600.1; note = Polyangiaceae bacterium
MGLWDKVKTLLGLGDGAQQPGAGEDAGGGQGSSPAAPAQPARPAAAQGSAKPAAAQPPAAVQQFSAAPAPAAAQRPAKQRQKPTDPYDAKGILGLSADEVRKRALKINPYKTAWIGRVDTIPPQSDERTALIDRGLILRGLLTEAQIAEIHRVGDIWLKHHEAARLAGTVAAKTAEKAIADIKREKEARKAEKKRLAAERRERRAAEIARRRAEDIIYLGRGVSAGLADRRAHVEALEERGLPVLSTPGDVARALGLTISQLRWLAFHGDAVERPHYVYFEVPKRSGGKRLLSSPHRSLAAAQAWILHDILERLPVEAPAHGFVQGRSTVTNARPHIGRDVVVNLDLSDFFPTITFPRVRGVFQRLGYSPAAATVLALLCTEPPRRELEYDGQRYWVAVGERGLPQGACTSPALSNQVARKLDRRLAGMCKKHGFEYTRYADDLTFSAPPGKRAEIPMLLARVRHIVTEEGFAINPKKGRIQRAAGRQEVTGIVVNDKLGMPREEVRRLRAILHAAKKTGLAAQNREGLPDFEAHIRGKLAYLQMIDRQRAAPLLAALDALAG

SEQ ID NO: 6535 - protein, 541 aa, unidentified
  source 1..541: note = Related to NC_010162.1; note = Sorangium cellulosum
MGFWDKLKSMLGLGGAEQGERSPGGVEAEQAQGAQAGPAAATQPAARAGQPRVAAGAKPRPADPYDAGGILGLSADELRRRALKINPYQTAWIGRVDTIPPQSDERTALIDRGLVLRGLLTEAQLAEIHRVGDLWLRHKDAAALAGTVAARSADEAIERLKREKLARKEEKRRQSAERKRQRAEAVARRRAEDILFLGTDVSAGLADRRSHVESLAQRGLPVLSTPADLAAALGVAVPRLRWLCFHGEAVERPHYVYFDVPKRSGGTRQLAAPHASLAAAQAWVLREILEKLPVEAPAHGFVKGRSTVTNARPHTRRDVVVNLDLSDFFPTITFPRVRGVFHRLGYSPAVATLLALLCTEAPRRPVEYDGQRYWVAVGDRALPQGACTSPALSNQIARKLDRRLAGMCARAGFTYTRYADDLTFSAPPGKRGDIAMLLARVRHIVEEEGFAINPDKGRIQRAGGRQVVTGVVVNDKPSAPREEVRRLRAILHAAKKTGLAAQNRSGVPDFEAHLRGRIAYVQMIDRERAAPLLAALDALTG

SEQ ID NO: 6536 - protein, 567 aa, unidentified
  source 1..567: note = Related to CP012159.1; note = Chondromyces crocatus
MSFWNKIKSLLGVGANDEPAGEKQRDEPADGGDGQRARTKPVVTASSSVAAKFSGASTPSPPARKPATTPTRPKTTATKQPAKAAPPNSPPTTGVLLGLSKDELRQRALKIDPYRTAWIGRVDTIPPQSDERTALIDRGLILRGLLSEEQIQEIHRVGDLWLRHHDALRLATSKAAKTVELAFEQMKRERAERKVQKQREAAERRRRRVEDVARRRAEDIIFLGSGVSSRLVDRRSHIEALTERGLPLLSTPADVARALGISVPRLRWLCYHGDAVERPHYVYFEVPKRSGGKRLLSAPHASLAQAQTWILRSILDKLPTENPAHGFVAGRSTVTNAREHLGRDIVVNLDLRDFFPTITFPRARGVFQRVGYSPAVATILALLCTECPRREVDYDGQRYWVAIGDRGLPQGACTSPALSNQVARKLDRRLAGMAAKHGWTYTRYADDLTFSAPPGKRSGIPMLLARVRHIVTEEGFTLHPSKGRIQRAARRQEVTGIVVNDKLSVPRDELRRLRAILHAAKTTGLEAQNREQRPDFEAHIRGKIAYVAMVDPEKAAPLRAALDALPR

SEQ ID NO: 6537 - protein, 561 aa, unidentified
  source 1..561: note = Related to NZ_ASRX01000016.1; note = Chondromyces apiculatus
MSFWDRVKAFFGGGKGEGTEAPPYDAPTQRAPAQRAATKGTSGSGTKASQGAATSTSPAASGAPAASRRTFVKWITEAFSTDPAVTTRAIMSMSAAEIRRRALTINPFRTAWIGRVDVIPPQSDERTALIDRSLILLGLLTEEQIVEIHRVGDLWLKHREASRLVALSAARNAEQALADLKRERAARKEQKRRDAVERRRKRAEAIARRRAEDIVYLGAGVSAGLADRRSHIEALAARGLPLLASPADVAKALGVSISRLRWLCFHSDAVERPHYVYFEIPKRSGGKRLLAAPHASLERAQHWILREILDKLPVEPPAHGFVKGRSTVTNARPHVGRDLVVNLDLSDFFPTITFPRVRGVFRRLGYSPAVATVLALLCTEPPRRPVEYEGQRTWVAVGERGLPQGASTSPALSNQVARKLDRRLTGMAEKHGWTYTRYADDLTFSAPEGRRGDLAMLMARVRHIVTEEGFALNPRKGRVQRASGRQEVTGIVVNDKLGVPRDEVRRLRAILHAAKATGLEAQNREKIPHFEAYLRGKIAYVAMIDPAKAAPLHAALEALSR

SEQ ID NO: 6538 - protein, 573 aa, unidentified
  source 1..573: note = Related to NZ_SSMQ01000028.1; note = Polyangium fumosum
MGFWDKVKSFIGTGKPGEGEPGKNEPDDKPKAASASTTSSSSSSSTKSTTTGAATGSATTAVATFTSTSPAPAAKKKDKPKPKDPYDTSGILGLSADEMRKRALKINPYQTAWIGRVDTIPPQSDERTALIDRGLILRGLLTEAQIEEIHRVGDLWLKHNEATSLASTVARKKADEAIEELRRQKAERKAEKKRLAAERKKKHAEAVAKRRAEDIIFLGRGVSGSLGDRRANVESLQKQGLPLLSTPAEVAKALGLPIPRLRWLCYHNDAVEKPHYVYFEVPKRSGGMRLLSAPHEALSKAQQWILQNVLAKLSIEAEAHGFVKGRSTVTNARAHLGRGIVVNLDLSDFFPTITFGRVRGLFESIGYSPAVATIFALLCTESPRRKVVYDGTTYWVAVGERGLPQGACTSPAISNLVARKLDRRLTGMTRKMGWTYTRYADDLTFSAANEVVDDGKGGQKKGRGDLGILLARVRHIVQEEGFAINPKKGRVQHAGGRQEVTGIVVNDKLGMPREEVRKLRAILHAAKKTGLAAQNRENIPHFEAYLQGKIAYLNMVDPERAMQLAKAFLEIPR

SEQ ID NO: 6539 - protein, 566 aa, unidentified
  source 1..566: note = Polyangiaceae bacterium; note = Related to JADJXL010000001.1
MGFWDKVKTFIGPGKPGEGEPKKDDPAPAAKPASTPATTSTSASGKTASASSAVGAVSTFTASTPAKTAAAKPKKDKPKDPYDASGILGLSADELRKRALKIDPFRTAWIGRVDTIPPQSDERTALIDRGLILRGLLSEEQIEEIHRVGDLWLKHHEAANLASTVARKRADEAIAELKKEKAAKKAEKKRLAAERKKKRAADVARRKAEDIIFLGRGVSGKLADRRANVEALQKNGLPILSTPAEVAKTLGLPIGKLRWLCHHNDAVTRPHYVYFEVPKRSGGTRLLSAPHENLAKAQEWIFNNILQKLPTENPAHGFVKGRSTVTNAKEHVGQGIVINLDLSDFFPTIGFGRVRGLFESLGYSPAVATIFALLCTEPPRRKVTYDGTLYWVAVGDRGLPQGACTSPAISNLVSRKLDRRLLGMTRKMGWTYTRYADDLTFSAEMQEIEGGKKGRKDLGMLLARIRHIVQEEGFAINPKKGRLQHAGGRQEVTGIVVNDKLSMPREEVRRLRAILHQAKKTGLEAQNKEKRPHFESYLKGKIAYLNMVDPDRAMQLAKAYMEAGGR

SEQ ID NO: 6540 - protein, 568 aa, unidentified
  source 1..568: note = Related to NZ_CP079217.1; note = Polyangium sp.
MGFWDKVKTFLGNEKPGEGEPKKDDAPPAVKGPATPASSGGAKPAQSAKNAAAPPPVATFTTTQPVITPAPAPATGAKKGKPKDPYDASGILGLSAEELRKRALKINPYKTAWIGRVDTIPPQSDERTAIIDRGLILRGLLSEAQIAEIHRIGDLWLRHREVTSLAESVAKQKASEVIEELRRQKAERKAEKKRLAAERKQKRAEEIARRRAEDIIYLGRGVSAGLGDRRSHIEALGERGLPLLSTPADVAKALQIPVPRLRWLCFHSEAVEKPHYVYFEVPKRSGGTRLLSAPHEALAKAQQWILHNILEKLPVEDPAHGFVKGRSTVTNARPHLGQQVVVNLDLSDFFPTVTFLRVRGFFEKIGYSPAVATIFALLCTEPPRRRVVYDGQPYWVAVGTRGLPQGACTSPAISNGVSRKLDRRLTGMSKKMGYTYTRYADDLTFSAPAPAGEDGDKARNDIGILLARVRHIVQEEGFAINPKKGRVQHAGGRQSVTGIVVNDKLSVPREEVRKLRAILHAAKTTGLAAQNREGIPHFEAYVRGKVAYLHMVDPERAAPLLRALEALG

SEQ ID NO: 6541 - protein, 549 aa, unidentified
  source 1..549: note = Related to JABBJJ010000008.1; note = Pyxidicoccus fallax
MGSFWNRLKGLFTGGDTPGDAAPAQGTTAAPPAGTAAPSTGAPASTATPPQAQAPQAPAVRNPYEANEAILGLSPEEFRKRALKIVPWRTAWIGRVDTIPPQSDERTALIDKGLLLRGFLTREQLAEIHRVGDLWLKHHDADRLAHAAAAKTAEAAVEARRAERKKRKEEKQRQSAERKQQRAEDIARRKREDIIFLGRGVSSGLADRRSNIEALQASKLPVLSSPADVAKALGLSIPQLRWLCFHQEAAEKTHYHYFEVPKRSGGKRLLSAPQPTLKQAQAWILENILEPLPTEAPAHGFIRGRSTVSNAAAHLDRDVVVNLDLKDFFPTITFRRVRGVFRRLGYSPSVSTVLALLCTESPRRQVDYDGKRYWVAVAERGLPQGACTSPALSNQVARKLDRRLRGRMAKLGWEYTRYADDLTFSAPAGKREQVPFLMAAVRHVAEEEGFALNPNKGRVQRVGGRQSVTGIVVNEKLSVPREEVRRLRAILHQAKTTGLAAQNRENRPDFEAWLHGKIAYVCMVDKPKGLKLLEAFEALRSGKQASAGS

SEQ ID NO: 6542 - protein, 534 aa, unidentified
  source 1..534: note = Related to JACPVI010000075.1; note = Myxococcales bacterium
MASFWGRVRGFFGGGQPPSDFETSAPSPGASPVPRAAAPASAASPAKNPYLANEEVLGLSAEELRKRALKITPWRTAWIGRTDVIPPQSDERTAIVDRGLVLRGLLTKEQLAEIHTVGDQWLKHHEAMSMAGALAAKSADQAVEQRRKEKAQRKAEKQKLAQERAQARAAEVARRKKEEVAFLGPGVSSGLSDRRSNIEALAAAGLPVLSTPADVAKALEVTVPELRWLCFHSEAAERTHYRTFEVPKRSGGVRLLAAPKKKLAKAQGWVLRSILEKLPTEKPAHGFVKGRSIVSNAAAHLGRDVVVNLDLKDFFPTVTFPRIRGVFKKAGYSPAVATVLALLCTESPRREVEYEGRRYFVAVGPRALPQGACTSPALSNQVARKLDRRLRGRMAKLGFEYTRYADDLTFSAPPGKREKVGFLKAAVRHLVEEEGFTVHPEKGSVLSSSRRQRVTGIVVNRKLSVPREQVRRLRAILHQARKTGLAAQNREGRPNFEAYLQGMIAWVSMVDREKGQNLARQLAELVVAGRRAAG

SEQ ID NO: 6543 - protein, 535 aa, unidentified
  source 1..535: note = Myxococcaceae bacterium; note = Related to JAIBBR010000058.1
MERDGRYLYNPYSGDSSATALRNAPPAPAPAPVRTTAASTPAPYQTPPPPRTINENSYAANPEILGLSADDLRKRALKIVPWRTAWIGRVDTIPPQSDERTALIDRGLMLGGYLNEKQLAEIHTVGDLWLRHQDATRLAEAAAAEAADDAIEALKAEKARLKAEKKKAAAERRAARAAEVARRRAEDIIFLGRGVSKGLHDRRSNIERLTEKGLPVMSTPADVAAQLGLTVPKLRWLCFHSDAAQTVHYTAFEILKRSGGTRLIAAPRPTLAKAQTWVLRNLLEKLPVEENAHGFVKGRSTVTNARAHVGRDVVVNIDLKDFFPSIGFRRVRGVFKRLGYSPAVATVLALLCTEAPRRKVEYDGHTYFVAVGERALPQGACTSPALSNQVARRLDKRLRSRSQKAGWTYTRYADDLSFSAPAQRPAAAQLQAMVRHVAQEEGLAVNPKKGRVLVRGGRQQVTGIVVNQKTSVPRAQVKRLRAILHQAKKTGLAAQNREQHPDFTAWLKGMIAYVTMVDSAKGHKLKAAFDALSPS

SEQ ID NO: 6544 - protein, 635 aa, unidentified
  source 1..635: note = Related to CP016211.1; note = Minicystis rosea
MASFWDKLKSWIGGGPSSTPPDPSEETSDLARRVEAIVVRRMTRKESFEAIEIADEAASAPEDRTVKGIAAASAVVARLYDEGRFEPLGYTRTKLADGNWLYHLKGADLSKQSATAPAARTTPRSTAPATRTAPQTTPAQTTAPVPAAPAPKAKDPYAASEILGLSADEMRKRALRINPYKTAWIGRVDTIPPQSDERTALIDRGLILRGLLTEKQITEIHRVGDLWLRHHEATRLAASTAAVAAAKQMEDIARERAEKKAQKKREAIEREARRAEDVARRKREDIVYLGVGVSKGLADRRSHVEALLDRGLPVLSTPADVARAMGLTISELRFLCFHAEAVEKPHYIYFEVPKRSGGKRLLASPQPRLAKAQAWVLHEVLEKLPTEDPAHGFIKGRSTVTCAIPHVGRDVVVNLDLSDFFPTITFSRVRGVFERLGYSPAVATIFALLCTEAPRSLVEFEGRRYHAAVGPRALPQGACTSPALSNQVARKLDRRLAGMAKKHGYTYTRYADDLTFSADGKSATDLGMLLARVRHVVSEEGFAINPKKGRLQRAARRQMVTGVVVNDRPSVPREEVRRLRAILHHAEKTGLAAQNRENVPHFEAHLRGRLAYLHMIDPERAAPMLARFEAIVARA

SEQ ID NO: 6545 - protein, 508 aa, unidentified
  source 1..508: note = Polyangiaceae bacterium; note = Related to JADJRH010000011.1
MPPPRSTKPSAGQAPPIQAAAPPPPKPQPEDPLAAEILGLSAQELRKRAIKINPYQTAWIGRTDTIPPQNDERTAIIDRGLILRGLLTPDQITEIHRIGDQWLTHREAAKMAQILAARSVEEALAARRAEREAKKAQKKAESEARKARIKEEIARRKAEDIVYLGAGVSHLLHDRRSHLETLESRGLPILSTPADVARALNLPIGKLRWLCFHSEATEKPHYRYFEIPKRSGGTRKIAAPQPELAKAQEWIFTHILQKLPTEDAAHGFIPNRSTVTCAAPHVGKDVVINLDVKDFFPTITFVRVRGVFQKLGYSPAVATIFALLCTEAPRVETSFEGQTLWAAVGPRACPQGACTSPALSNQVARKLDRRFVGMSKKHGFVYTRYADDLTFSAPEGKRAEIGMLMARVRHILAEEGFTLHPDKGRVQRRQHQQLVTGIVVNQKLGLDRKHIRRLRAILHAAQKTGLEAQNRENIPHFEAHIRGHLAYLHMVAPDKAAPLLQALNSLPK

SEQ ID NO: 6546 - protein, 628 aa, unidentified
  source 1..628: note = Related to JAFEBD010000111.1; note = Deltaproteobacteria bacterium
MSFWKKVKGFFGGGGGDEPPEGLTGHDPKVAAEVIAVLRVRCAAQTSFEAVDIADEVTRDDASRGVAQIRAACAIVEALYESGWFSTLDYVRTGAIYHHTSKAPSSYAPPRGGSTFPPPAPPAPRPAAPPTTPTATNPTAPAAPAVPAVDPLAAEAILGLSPEEFRKRALTIKPYQTAWIGRVDTIPPQSDERTALIDRGLLLRGLLTREQLEEIHRIGDQWLLHHESVKLAEIAAQANVEAYLRAAREEKARLKAQKKAESAEREAVRKALVAKRRAEDIIYLGRGVSGGLADRRAIVEELERRGLPLLGSPADVARALGLTVPRLRWLAFHAEAPSRTHYVYFEVPKRTGGLRLLSAPHDDLKKAQHWILENILAKLPVTDAAHGFVSGRSVVSNAAAHLCRDVVVNCDLESFFPSITFGRVRGVFEAIGYSPAVATILALLCTEAPRTKVTHEGKTYWVAVGARGLPQGAPTSPALSNQVARKLDQRLTGLGRKLGWSYTRYADDLTFSAGPGKREQIGYLLARIRHIAQDEGFAMNRKKTRVQRAARRQEVTGVVVNDKLSLAREELRRLRAIVHGAQKTGLAAQNREGREDFEAWLRGKIAYVSMIDAAKGEKLRAALDAAPP

SEQ ID NO: 6547 - protein, 625 aa, unidentified
  source 1..625: note = Related to NZ_CP012333.1; note = Labilithrix luteola
MSFWNKVKQFFGAGEAPEGPAKTGDALSAHDAALVREVSAIIQIKCQNGELFQAVDVADQGGYAAKGIPQIRAACAVVEALHDTGRFDALGYTRTDAVYHPVGASPDSYVRPRAAALGSPPAPAPRPAPVAQPAPVSAVRQADAKDPLDGGDILGLSAEDFRKRALKINPYRTAWIGRVDTIPPQSDERTALIDRGLILRGMLKPEQITEIHRVGDLWLKHHDAMRIAEIAAQKNADAFLEARRAEKAALKEQKKREADERRAKRKAEIAQRRATDIVFLGRGVSAGLADRRTHIEELARRGLPILSTPQDVAKALGLDVPRLRWLAFHAEAPARTHYVHFEIPKRSGGTRLLSAPHDDLKKAQHWILEFILSKLPVTEAAHGFVPGRSTVTNARMHVGRDVVVNCDLKDFFPSITFKRVRGVFEVIGYSPAVSTILALLCTEAPRTKVVHEGREFWVAVGERALPQGAPTSPALSNQIARKLDQRLEGVCKKIGWSYTRYADDLTFSAESGQRERIGWLLARVRHIAQNEGFALNAKKTRVQRNARRQDVTGVVVNDKPATPREEIRRLRAILHGAKRTGLEGQNRQGHPAFEAYVRGKIAYVSMIDREKGEKLRRELDVITGS

SEQ ID NO: 6548 - protein, 538 aa, unidentified
  source 1..538: note = Related to JACRCQ010000074.1; note = Deltaproteobacteria bacterium
MGFWDKVKAFFVGPPAEPSVADDDSESGSSPPPAKGSRSSTQAPRAPSRAAESAPPQSADSFAAGEILGLSAKDMRARALKINPYHTAWIGRIDTIPPQSDERTALIDRGLILRGLLSKSQIDEIHRVGDIWLRHHDAAKLAEAVAAAKAQRAVDDMRARKAEEKRRKKEEAAQRKALRAEQVQRRREEDIVFLGRNVSASLADRRSHVEKLSEAGLPLLATPSDVAKALGITIRQLRWLCFHAEAALKSHYVYFEIPKRTGGTRLLAAPHRHLAQAQRWVLDNILRRISPSEPAHGFVAQRSTVTAAAPHVGMDVVVNLDLKDFFPTITFPRVRGLFKSMGYSPASATVLALLCTECPRTPVDHEGLRYWVAAGERALPQGACTSPAISNLVGRKLDRRLVGMSTKMGWHYTRYADDLTFSAPAGHREAIGILLARVRHILQEEGFQLHPRKQHIQRAARRQQVTGIVVNHKLAVPREEVRRLRAILHNARRTGLAAQNRDDIPHFESWLQGKIAYVQMVDAELGRKLAEQYRALTG

SEQ ID NO: 6549 - protein, 529 aa, unidentified
  source 1..529: note = Deltaproteobacteria bacterium; note = Related to JADZES010000060.1
MGVWEKLKGLFSRPPPPPSGPGGPATPSSASSLSSPSNLSGAGASGAPASDPYQASAILGLSYDEMRKRAMKIDPMRTAWIGRVDTIPPQSDERTALIDRGLILRGFLTKEQIGEIHRVGDLWLRFHEADRLATTVAQREAGELMKNLAEEKAKKKEEKKRLAAERRAARQQAIEKRRREDIIYLGAGVSSGLRDRRSNLERLNGAGLPVLSTPADVAAALDVSIGRLRWLCYHSDAAERLHYVRFTIPKRSGGQRAIAAPLPDLKRAQAWILESVLEKLEVEPEAHGFVAGRSTLTNATPHLKREVIINLDLADFFPSIGFRRVRGVFEAIGYSPAVATIFALLSTEAPRMEVDYDGQKLQVAVGERALPQGAPTSPALSNRVARKLDRRLRGMATKHGWTYTRYADDLTFSAPTGHQGEVPIMQARIRHIVGEEGFAVNLKKGRVQRRSGRQEVTGVVVNDRPGLPRTEVRKLRAILHQAKKTGLAAQNRQSHPRFEAWLRGKIAYLMMIDPARGKAMAAELDALVG

SEQ ID NO: 6550 - protein, 659 aa, unidentified
  source 1..659: note = Related to JAEUKI010000057.1; note = Myxococcales bacterium
MAGLWDRIRAFFRSGRGGDADAQIEQAVRVALVRRVSGRSVFTPLELAYDIVPREDRSDEVIEAIATALDRLYVRAYFGPFNYARSIDPKSAYRYVYHPAGTRVPGTTPDTTRVRAEPESEPPPPPAPTRSTRASTVSGSTRAPTSVSSRGGSTARGASTTTSGRGAPSSARGAYRTAADPYARPEILTLSAEELRARAVKIDPYKTAWIGRVDTIPPQSDERTAIIDRGLILRGLLSEAQITEIHRVGDLWLRHSEAARLAATTAAKTAEDAVRQMREEKVRKKAQKIKEAAEKKRRYAEGVAKRRATDIIFLGRGVSSKLGDRRSDIEKLDAQGLPVLSTPKDVADALRTTISELRWLAFHSDAAERTHYVTFTIPKRSGGTRSLSAPHEKLARAQKWVLEHVLAKLPTEIPAHGFIRGHSTVTNALPHVKRDVVVNLDLKDFFPTVSFARVRGVLEKVGYSPAVATVLGLLCTESPRQIITYADKPYHVALGPRALPQGACTSPALSNQVARRLDRRLSGLCAKMGWTYTRYADDLTLSADEGHRGELPVLIAKVREIVEDEGFKINPKKGRVQRKSARQTVTGVVVNDHPTVPRDEYKRLRAILHRAKFTGLDAQNKEARPHFDKWVEGKIAYISMVDATKGARLKAAFDAIPKT

SEQ ID NO: 6551 - protein, 611 aa, unidentified
  source 1..611: note = Related to NZ_CP011125.1; note = Sandaracinus amylolyticus
MSFWKKVVDFFTGGPTSIETSAVGTSGSPLEAAIWSAIKSRMAKGESFTPIDVVDDATSSTPGRTVKTITDGIAFVDAFFARGLFAPHGYTRTLTSTPSGQNWLYHPASSAPLVAMPAIVAQPALKASAPAIDPYDVGSLLTLTPAELRTRALKIVPWRTAWIGRTDVIPPESDERTALIDRGLELRGLLTRAQLVEIHRVGDEWLKHKDAPRLAQSRAAKNAEEAVAQLRAERARTKEEKRAASEARKKARAERIARRKREDIVYLGRGVSALLGDRRAHVEKLNALGLPVMASPADVATALGVTIPALRFLCFHAEAARRAHYVQFDVPKRSGGVRRLSAPMPRLAAAQQWVLEHVLEKLPVERPAHGFVPGRSTVTNAREHVGRDIVINLDLESFFPSITFPRVRGLFVGVGYSPAVATILALLCTESARTRAEYDGAKYDVATGPRALPQGACTSPAISNQIARKLDQRLRGLAVARGWTYTRYADDLTFSAPEGKRSEIARLIARIRHVVEEEGFRIQVKKGRVQRAGGRQTVTGIVVNETHKLGVPREDVRMLRAILHNAKKTGLAAQNRDAKPDFEAWLRGKIAYVQMIDRARGDALLRALDAL

SEQ ID NO: 6552 - protein, 531 aa, unidentified
  source 1..531: note = Related to JAGQIZ010000659.1; note = Myxococcales bacterium
MGLWDSVKRLFGGGDAASPDEGKEEREERGGGSAARGGVYRSAPERGEPDAIDPYGKSPVMGYSEDDVRARFFALRRGGISPFFHPDLLPAPDDEFTQLVDRSLVLAGLLTQEELEAIHRTGLEWRKHRHRADHARIVGKAAAGEAVEILKQERAENAKRKKAEARARREARRQAIEQRKREDIIHLGRGVSNRLGDRRSHVEKLQAAGLPVLSGPADIAVALGITIGQLRWLCFHDEASRTSHYHQFTVPKRSGGVRVLAAPMPHLKRAQTFVFDNILRKLEVEEPAHGFIRGRSTVTNARPHVGQDVVVNLDLEGYFPSVTFPRVRGVFEHLGYSPAAATILALLCTECERRPMRYAGQRYHVAIGDRGLPQGACTSPALANQVTKRLDRRLAGLCRAFGWQYTRYADDLTFSAPAGKRAEIPKLLGAVKRLITEEGFTLNPKKGRIQRRGGCQEVTGIVVNDKLGLARTEVRKLRAILHNARKTGLEAQNREGRPHFRAWLQGKLAYLAMIDRDKGTAMLRELEELPS

SEQ ID NO: 6553 - protein, 573 aa, unidentified
  source 1..573: note = Related to JAFLCL010000034.1; note = Deltaproteobacteria bacterium
MFGPHGYTRTLLQTPAGTNWVYHPKSSAPAAVAPVPGAAAVAPRPATASSAGTVRGPLVPQGSRLPASVTAHTASGGAPAKDPYDLGVFLTLTPAEHRARSLKINPYQTAWIGRVDVIPPESDERTALIDRGLELRGLLTRPEIVEIHRIGDLWLKHKDAARLAESIAHKNVEELLAQERIARQLAKTKKKEESAAKRTREAEDVQRRKREDIVYLGRSGLARNVSKGLSDRRSNIEKLAARGLPRLSSPADVARALELEIKTLRFLAFHADAQRHAHYVQFEVPKKKGGTRTLSAPKPQLAKAQKWILEEVLEKLPVDPVAHGFVKERSTVTNARPHAGKAIVINQDLVDFFPTINFARVRSVFQRAGYSPAVATIFALLTTECPRIQATYAGHTYYVATGQRGLPQGACTSPALSNLVASRLDRRLTGYTSKHGWTYTRYADDLTFSSAEEAEPGSPSGVAKLLATLHHIARAEGFTIHPDKGRIQRKSKRQTVTGIVVNEAHKLGVPREDIRLVRAILHNAKKTGLAAQNRDLSPTFEAWLRGKIAYITMVDRARGLAFSEELEHLDLGR

SEQ ID NO: 6554 - protein, 566 aa, unidentified
  source 1..566: note = Related to JAIBCE010000038.1; note = Sandaracinaceae bacterium
MFGPHGYTRTLLQTPAGTNWIYHPKAQAPTALAPVVKAAAAAPVPVAAKGPLVPQGSRLPSSVTGHTASAGPVKDPYDLGVFLTLTPAEHRARALKINPYQTAWIGRTDVIPPESDERTALIDRGLELRGFLSRAEIVEIHRVGDLWLRHKDAARLTESIAHKNVEALLAQERLAKQLEKARKKDMAAAARAKHADDVARRRREDIVYLGRSGLAPGLSKGLADRRSNIERLASQALPRLSSPADVARALEIDVKKLRFLAFHADAQRHVHYVQFEVPKKKGGMRTLSAPKAELAKAQQWILDNVLERLSVEKQAHGFVKGRSTVTNAQPHQGKAIVVNQDLVDFFPSITLRRVRAVFERAGYSPAVATIFALLTTECPRTRATYAGHEYHVAVGPRGLPQGACTSPALSNLVASRLDRRLQGYTQKHGWTYTRYADDLTFSCDLEPAADSGNDIAKLLATLHHVARSEGFTVHPDKGRIQRKSKRQTVTGIVVNEASKLGVPREEIRLVRAILHNAKKTGLAAQNRELSPTFEAWLRGKIAYIAMIDRSRGLALQKELDSLDLGR

SEQ ID NO: 6555 - protein, 548 aa, unidentified
  source 1..548: note = Acidobacteria bacterium; note = Related to JADLFP010000335.1
MFKRLIDKFRQLVSHPDSPEPPMPSHGPSSAPPPREAAPGAPPLPRAAPGADPKPSTLDQYSPPDILGLSKEELRKRALLVNPYRTAWIGRVDTIPPRSDERTALIDRGLVLRGLLNEEQLAEIHRVGDLWLTFHDAERLASAAAGKTADEAIEEARKAKQAAREEKRRQAAERRARRAEEIALFRKTHLAFRGEGVSAGLSDSRSEIEKLEAAGLPVLASPPDLARVLDVSVSRLRWLAFHSEAVTRPHYTYFRIAKKSGGTRLLAAPHKDLEKAQRWIFENILAKIAAEKGAHGFVKGRSTVTNAVPHKGRAIVVNIDLRDFFPSITFPRVRGLFQSLGYSPAVATVLALLCTECPRVEAVLDGKTFYVAAGQRGLPQGAATSPALSNLVARKLDRRLSGLARKRGFIYTRYADDLTFSCGRDKDSELGRFLASVRHILTEEGFTINPKKFRVQRSSARQRVTGIVVNRKLSVPREEVRRIRAILHQAKSAGLAAQNRENLPNFESWLEGKIAYISMVDRARGAVLKAELDRVQRQRPAEDSSSTA

SEQ ID NO: 6556 - protein, 558 aa, unidentified
  source 1..558: note = Related to PABA01000104.1; note = Sandaracinus sp.
MGLWSWLGKVFRRVRAWLAYNPELPPPPPEAPKVDELPPPAGGSGGAGVGYGTATAKTWTTAKAKAQQKKPPPKPKKAVDPWDTGELLTLSPEELRARAMHIQPWKTQWIGRVDVIPPESDERTALVDRGLVLRGFFTEAELAEIHAIGDAWLEHKDAARLARARAAKDVDAALAQLRAEERERKARKKREAAERRERRAREIAERRRTDIVFLGRGVSHSLADRRAHVEKLEARGLPVLATPKDVADALGLPIPRLRFLAHHDEALQRAHYVQFEVPKRTGGMRTLAAPKPDLAKAQTWILEHVLAKVPVHDAAHGFVPGRSTATCARPHRGRAAVVNLDLKDFFPSITFPRVRGVFAELGYSPAAATILALLCTECPRREVRFAGVTYHVAVGERGLPQGACTSPALSNLVARRLDARLAGLAEKRGFAYTRYADDLSFSTGDPKAVAPLLAIVRKIVREEGFRENGKKTRVQRAAGRQTVTGLVVNEPDRLGLPREEVRRLRAILHNAKKTGLAAQNRGGHPDFEAHLRGKIAYLAMVDAPKAARFRAELDALTG

SEQ ID NO: 6557 - protein, 576 aa, unidentified
  source 1..576: note = Sandaracinaceae bacterium; note = Related to JADZAM010000038.1
MLARAKARSHFSAINIDVVVARALSAGERAEIAPWVEQLFRRGVLQGHAYTRTLVRAGDRVIWIYHPQDQAPEPVSPGSPAPSAAAASHAAPRPAAHAAGPLLDAGSLWKLSPDELRARALDVKPYLTAWIGRVDVIPPASDERTALIDRGLVLRGLLTEAQILEIHRVGDLWLEHSDAARLAQLRAYKKADDAILALRARDAELKAEKRKLAAERAQRRREEIARRKNEDIVFLGRGVSERLHDRRADVEKLERLGLPVLATPADLAKALGLRAPELRFLAFHAEATERPHYVQFDVPKRSGGTRRLSAPLPKLAAAQRWILDNVLCKVAPHDAAHGFVPGRSTLTNARPHLKKGVVVNLDLQDFFPSITFPRVRGVFASLGYSPAVATILALLTTEPPRRAVRYAERTLHVAVGSRGLPQGACTSPAISNLACRKLDRRLSGLAAKHGLTYTRYADDLTLSGPKDTHVARLLASLRHLIESESFRVNDKKGRVQRAGGQQTVTGVVVNDKPSVPRSERKRLRAILHQAKKTGLEKQNRAGVPSFEAHLRGKIAYVSMIDGTRGAELAKALDALD

SEQ ID NO: 6558 - protein, 544 aa, unidentified
  source 1..544: note = Related to SHBB01000309.1; note = Sandaracinaceae bacterium
MDALHERGVPGAYDFERTLLSVAGRSVWIYHPIGASPNQPSTPPPPVATPASPTRTKAKQKGKEKALPDPYAAGPLMTLTAAELRARALTIEPWRTAWIGRVDVIPPQSDERTALVDRGLVLRGFFTEEEIAEIHRVGDLWLEHKDATRLAKARAQKSADDAIQALREEAKRERARKKAEAAEKKKQRAAEVARRKAEDIIFLGRGVSGRLNDRRANVEKLAEAGLPVLATPADVAKALGLTVPRLRWLAFHAEASEQGHYVQFEVPKRSGGTRRLSSPKKALRAAQTWVLNNVLARCGTEDAAHGFVPGRSTVTNARPHVGRRVVVNLDLEDFFGTITFPRVRGLFVSLGYSPAAATVLALLTTEAPRREVRYDGKPYRVAVGPRALPQGACTSPALSNLVARKLDRRLTGLAKKHGWTYTRYADDLTFSRDDDTQVGALIATVRHVVTEEGFRINEKKGRVQKSGGQQTVTGVVVNDKLSVPRAEIRRLRAILHNAKKTGLSAQNTSGHPHFEAHVRGMIAYVRMVDPERGAKLAAQLAAVR

SEQ ID NO: 6559 - protein, 556 aa, unidentified
  source 1..556: note = Sandaracinaceae bacterium; note = Related to JACKEC010000023.1
MEIAPYVDGWVEAGLLDKHGYTGTEQIVAGRAVWIYHRVGQPVAGVTPSTRVNAPAPTAPKAAPQKAKKKEKKKRKWFDPWDAGDLMSLTAAELRARAMKIVPWRTAWIGRVDVIPPQSDERTALVDRGLILRGFFTEEQIEEIHRIGDLWLKHKDAAKLARAAAAKSADAAILQLREEAKQKKARLKEEAKARAEKQRADVAHRKATDIVYLGRGVSGQLHDRRSNIERLESQGLPLLAAPADVADALGVTVSRLRWLAFHDEAAPAGHYSFFEIPKRSGGTRLLSAPKAELRAAQSWIHENILKKVALEAPAHGFVPGRSTVTNAAPHVGRDVVVNLDLEDFFPTITFARVRGLFTSLGYSPAVATVLALLTTEAPRRRLTYAGRPYFVAVGRRGLPQGACTSPALSNLVARKLDRRMAGLAKKLGWTYTRYADDLTFSAPAGQRDTVGRLFAHVRHIVQDEGFRVNEKKGRVQRKGGRQTVTGVVVNERLAVPREEVRRLRAILNNAKKTGLAAQNRDDHPHFEAWLRGKIAYVSMVDPDRGAKLAAQLAELS

SEQ ID NO: 6560 - protein, 540 aa, unidentified
  source 1..540: note = Myxococcales bacterium; note = Related to JADJGV010000002.1
MGFWDKVKRFFGGGGALQPDPSAPTAAPPSTPTPSTPAPAPAHTAPAPPAARTAPAPTSTDDSARFRNPAILGLSAAELRKRALRINPYQTPWIGRVDTIPPQSDERTAIIDRGLILRGLLTAAQIEEIHRVGDLWLAHHDAMRLAAAAGAASGEAAVAAERARRAEAKRAKQAAAAARAAARAAAVAARRATDIIFVGRGVSAGLADRRSHVEQLAAAGLPVLAAPADLAAALGLTVPRLRWLCFHADAPAKTHYTYFTIPKRSGGTRKLAAPHRQLAAAQRWIFDQILAKLPITDAAHGFVPGRSTVTNARPHVGQRIVINLDLADFFPSITFPRVRGLFASLGYSPAIATLLAMLTTEAPRVEVEFAGRTHYVATGPRALPQGACTSPTLANLVARKLDRRLGGATRKLGWTYTRYADDLTFSAPAAGSAQVALIFARVRAIVTAEGFAVNEAKGRVQRGGRHTVTGLVVNDRLAVPREQVRRVRAILHGARTTGLAAQNRAGHPDFRAWLQGTIAYIHMVDPARGAAFQAQLDALS

SEQ ID NO: 6561 - protein, 467 aa, unidentified
  source 1..467: note = Related to JABFYI010000076.1; note = Polyangiaceae bacterium
MEELRARAAKVRPWLSPWGWRMDIIPPASDERTSLIDRGLVLNGYFTEAQIQEFHRIGDLWLEHKDTARTIAARALETAKADLEELKRKKLEEKAAKKVAAEERRKAHRAAIEKRRLEDIVFLGRGVSGKLADRRSDVEALQRAGLPVLSSPADVAKALEITIPTLRWLAFHTEAAGAIHYRQFEVPKKTGGVRLLSAPRPKLAAAQRWILESVLAKIAPEADAHGFVDGRSTVSNAKPHVGRDVVVNVDLKDFFPSIHFPRVRGFFETLGYSPAVATVFALLTTEAPRRRVEYAGKPYWVAAGPRGLPQGACTSPAISNLVSRRLDKRLSSMGKKHGATYTRYADDLTLSLDPGRREQIGMLLARIRHIAEDEGFRVHPKKVAIQRSGGRQMVTGIVVNRGLSVPREEVRKIRAVLHAAKRSGLAAQNREGHADFRAHLRGKIGYVMMVDRQKGERLLRELEALAP

SEQ ID NO: 6562 - protein, 659 aa, unidentified
  source 1..659: note = Polyangiaceae bacterium; note = Related to JABFXY010000131.1
MGFWDKVKSFFGGASPPGGGDGGDGGNGDSDEAPPLFNERGLPTDAFTQFVERRVRVRAKKEHLFTRHDIARIVVKKLESPPSAAETFAANAVLKLKKAGLFEELGYECSYSSTVRGEVFHPEGTDPDEYPGAGGGPPSGVRRVQPQPVAPVAPAAPPPPRPATPAAAAPARAPTTPYRSNPFDAGQSLGMSADELRRRAMKIVPWRTPWIGRVDVIPPASDERTALIDRGLVLRGYFTEEQIAEFHRIGDLWLEHKDAASFVAARGKEQAKLDLEALKQKKLQEKAEKKRAAAERRERLREAIAKRRAEDIVFLGRGFSGKLADRRSDVEALERAGLPVLSTPADVARAMELSIPTLRWLAFHSDAAETIHYRQFEVPKKTGGVRLLSSPLPKLAQAQQWILENVLAKIPTGGDAHGFVPGRSTVSNAKPHVGRDVVVNVDLRDFFPSIHFPRVRGLFESLGYSPAVASILALLTTEAPRRRVVYAQKPYWVAAGPRGLPQGACTSPAVSNLVARKLDTRLAAMSAKHGARYTRYADDLTLSLEPGRRDQIGMLLARIRHIAEDEGFTVHPDKVFVQRAGGRQLVTGIVVNRGLSVPREELRRLRAVLHAAKKTGLEAQNRDGLPDFRAHLRGKIGYVMMVDREKGSQLLRALEATPP

SEQ ID NO: 6563 - protein, 469 aa, unidentified
  source 1..469: note = Related to JAEUKE010000177.1; note = Myxococcales bacterium
MSAEELRKRAMKIVPWRTPWIGRVDVIPPASDERTSLIDRGLVLSGYFTEEQIAEFHRIGDLWLEHKDAATFAAQRARAQAKLDLDALKRQKLEEKAAKKQAAAARRAALRDAIAKRRAEDIVFLGRGFSGKLGDRRSDVEALERAGLPVLSTPADVARALGVPIPTLRWLAFHSEAAQTIHYRQFEVPKKTGGVRLLSAPRPKLAAAQRFILESILEKISPGPDAHGFVSERSTVTNARPHVGRDVVVNVDLRDFFPSIHFPRVRGLFEQLGYSPAAATVLALLTTEAPRRRVTYAGVAHWVATGPRGLPQGACTSPAISNLVARRLDKRLGAMATKHGGVYTRYADDLTISLESGRREQIGMLLARVRHIAEDEGFTVHPKKVAVQRAGGRQTVTGIVVNRGLSVPREEIRRLRAVLHAAKKTGLAAQNRDDLPDFRAHLRGKIAYVAMIDRDKGARLLQALEQTPP

SEQ ID NO: 6564 - protein, 550 aa, unidentified
  source 1..550: note = Related to JACQYO010000047.1; note = Deltaproteobacteria bacterium
MLRVAGFWDWLKKAFSDPEAPPGPSSSGSTPTPPSPAPSGAAPASATSTPTSSPGKSNDKSATKGRNYDANPEILGLSEAELRKRALRITPWRTAWIGRVDTIPPQSDERTAIIDRGLILTGRLTEAEVAEIHEVGDLWLKYHGRVELARSEAKKASQRAADQIAADREALKKQKKEEAAARKKARAEAILDRKQNDIVYLGRSVSARMNDRRANVEKLHQLGLPVLATPKDVAQLLEISVPKLRWLSFHAVATERPHYISFHVKKRSGGLRLLSAPHKELKKAQKRIATQILDKVDPGPVAHGFIKARSTVTNATPHVGQDVVLNLDLSDFFPSVTFPRVRGLFQSFGYSPAVATVLALLATESPRRTVKYDNRTYHVAVGERALPQGAPTSPAIANLVARKLDRRLSGLARSAGWSYTRYADDLTLSTRGEARKKTPWMYRQVREIISSEGFVVHPKKGRLQRKGGCQTVTGVVVNHKLGLPRREVRRLRAILHGAKKSGLASQNREGRADFPAYLRGKLAYLAMVDPQKGKKMLAELDTLEGRHRPE

SEQ ID NO: 6565 - protein, 547 aa, unidentified
  source 1..547: note = Related to JACPFK010000116.1; note = Deltaproteobacteria bacterium
MAGFWDRLKQLFGDGPSPKGSDPDAGPPSSSRSPSRDGDPVPPASSKAGAQSPEKGQKSPARSYDANPEILGLSESDLRKRALRITPWRTAWIGRVDTIPPQSDERTAIIDRGLILTGRLSEAEIAEIHEVGDLWLKHHGKADLARAEAKKASSAAIAELHAEREAKRKQKKEEAAERRRLRADGIAERRRTDIIFAGRSVSSRLADRRANVEKLVALGLPVLATPRDVAELLGISVSKLRWLAFHAEATERPHYVTFHVKKRSGGLRLLSAPHKELKRAQKKIATQILDRLDVGPAAHGFVKGRSTVSNAKIHLGQDVVLNLDLSDFFPTISFPRVRGLFQSFGYSPAAATLLALVATEAPRRVIKYEGRAYHVATGPRALPQGAPTSPALANLAARKLDRRLLGLAKSAGWVYSRYADDLTFSTKGEPRKKTPWVFRQISEIVSSEGFVVHPRKRRVQHKGGRQTVTGVVVNEKLGLPRDEVRRLRAILHGAKKNGLASQNRDGRSDFPAYLRGKLAYLAMIDPGRGKKMLRELDVIEGRKPAPT

SEQ ID NO: 6566 - protein, 305 aa, unidentified
  source 1..305: note = Deltaproteobacteria bacterium; note = Related to JADJBV010000001.1
MAFHAEAATRTHYVRFTVKKRSGGERQLAAPHQKLKAVQRQILQKILERLDPGPYAHGFVKQRSTVTNAQAHLARHDLINLDISDFFPTIHWRRVRGLFKSFGYSPAVATILALLVTEAPRTLAEYDGKKYWVAIGERVLPQGAPTSPAISNLVSRRLDLRLAGLAKKRGWRYTRYADDLTFSAGEKKRPDIPWMMRQAKEILAAEGFVLHPNKQRVQRKGRRQTVTGIVVNQKLSVPREEVRKLRAILHGAQKTGLAAQNRENLPHFPAWLRGKLAYLSMVDPAKGKKMLAQLDALEGRRPTPV

SEQ ID NO: 6567 - protein, 545 aa, unidentified
  source 1..545: note = Related to JACKED010000002.1; note = Sandaracinus sp.
MWLYHPEGVDPRGTGKAPAAVLPPSPKAASTTGTAGSTTSATTASNNSSSTGGWKPPAERANDGDPFDTAGTLTLTPEQLHERAKKIVPWRTAWIGRVDVIPPASDERTALIDRGLVLRGLLTQEDIDEIHRIGDLWLLHKDADRMASTLAHKSAEAAIQARRRERAERKAQKKAEAAKKKAARDAAVAERRATDLFFLGEGVSSQLHDRRTEIERLETLGLPILATPADVAAHLGVEVPRLRFLAFHQEAAQTTHYVQFEVPKRSGGTRTLAAPKPGIAAAQERILETILAKLPLDEAAHGFVTGRSTVTNARPHQGRDLVINLDLKDFFPSVTFPRVRGLFRSFGYSPAVATILALLCTESPRRELSYDGRSYQVAVGARALPQGACTSPAISNLVARKLDRRLRGLAAKHGLAYTRYADDLTFSADADKRGELGMTLARLRHVIEDEGFALNPKKVRVQRKGGRQTVTGIVVNEPTKLGLPREEVRRLRAILHAAKTTGLQAQNRAGHPDFRAHLAGKIAYLAMIDPARARTLREALAACTG

SEQ ID NO: 6568 - protein, 396 aa, unidentified
  source 1..396: note = Planctomycetes bacterium; note = Related to JAGQRJ010000919.1
PSDNPPSERGLKAEQREAARRKEAREEAQREARLARVEARREREAALRQRLAREVLYAGEGVSATVAHAASDVARLEAGGLPVAHSALDLAHLLGLDLPALRWLTFHREVARSTHYRQYQVAKRRGGFRTISAPRPKLKAALRAVRERILGRLAVSPQAQAFVPGRSTLTNARPHLRAAVVVKLDVVDFFGSFSFPRVRGWFRARGYSGMVSTLLALLTTEAPRVEVELDGARYYVATGPRVLPQGAPTSPELTNLLALRLDRRLAAYGAKHGWTYTRYADDLTFSRADEPEGCVSRLLGTAEAILRDEGLRLNHDKQCVTRRGRQQRVTGIVVNEVAGLPRRDLRTFRAAVHRVTRDGFKDVHERQRMLGYASYVRMVKPALGERWLEALREVRS

SEQ ID NO: 6569 - protein, 394 aa, unidentified
  source 1..394: note = Related to JAHBXY010000086.1; note = Planctomycetes bacterium
MTEGPRKSVRVEAEEAARRAEAREEARRAARLARAAAVRARRATHAARLTREVLHAGEGVSARLPAARSDAAALERRGLPVMHDAADLATLLGMDMRALRWLTYHRDVATVTHYRQFQVPKAKGGVRTISAPRPALRAAQQAIRQHVLARLEPTVHAQAFVRGRSTLTNARPHLRAAVLVKADIRDFFGAIDFPRVRGLFEALGYSGMVATLLGLLTTEARRVEADLDGQPAWVAVGPRALPQGAPTSPELTNQIARRLDARLAGYARRHGWVYTRYADDLAFSSQDGARERVGRLLGVVRAALEGEGFQLNPDKLVVVRRGRQQRVTGVVTNDVAGLPRATLRRFRAAVHRVTRAGFADPAERARMLGYASYVKMVKPALGERWLRALREVPA

SEQ ID NO: 6570 - protein, 428 aa, unidentified
  source 1..428: note = Related to JAKCFI010000006.1; note = Myxococcus stipitatus
MSWFASTLAWFKRWTRAKPVTRDVSGLDAPTGRDGRPLDVVSETVRLSGPLKPGHLRQIKRDPRLLPKGKRVYARNLKRWMGAGEARRFFSRSMLTRDRSVRDLLPDEAQLARYGLPVWRTEEDVAAALGVTVGRLRHYASHRPRERVRHYVTFTVPKRSGGVRWVHAPKRRLKTLQRRLLMLLVAKLPVSAHAHGFVTGRSVRTGAAPHVGRRVVLKLDLKDFFPSVTLPRVRGLLLALGYGYPVAATLALLMTEAERQPVEVDGTVFHVPVSARVCVQGAPTSPGVCNAVLLRLDRRLAGLAKRYGYAYTRYADDLTFSGDDLGALERVRALAARYIQDEGFTVNRDKTRVQRRGGAQRVTGVTVNAGLGLSREERRRLRAMIHQEGRDGADAERSAYIDGMLAYVKMLNPEHAEKLSRGRKRRGS

SEQ ID NO: 6571 - protein, 428 aa, unidentified
  source 1..428: note = Related to NZ_CP012109.1; note = Myxococcus sp.
MSWLDSTLSWLKARFTRPVTRSTTGLDAPVDAQGRRVDVVSETVVMSGPLKPGHLRQIHRDARLLPKPQRRYTPGRAKWMPAAEARRLFSGTLRTRNRNLRDLLPDEAQLARYGLPVWRTEEDVAAALGISVGMLRHYSIHRSRERVRHYVTFAVPKRTGGVRLLHAPKRRLKALQRKLLEVLVSKLPVSQQAHGFVSGRSIKTGAQPHVGRRVVLKLDLKDFFPSVTSARVRGLFIALGYGYAVAATLAVLLTESERQPVDIEGTVFHVPVGPRVCVQGAPTSPALCNAVLMRLDRRLAGLARRYGYTYTRYADDLTFSGDDLSALERVRALAARYVQEEGFTVNRDKTRVRRRGGAQRVTGVTVNATLGLSREERRRLRAMLHQEGRDGEDSTRRAYLDGMLAYVKMLNPEQAARLVRKRKPRAGG

SEQ ID NO: 6572 - protein, 426 aa, unidentified
  source 1..426: note = Related to NZ_FOIB01000012.1; note = Myxococcus fulvus
MSWFDSTLGWFKGLFTPKPVTRDVSRLDGSARDASGRAADVVRETVATSGPLKPGHRREIIRDARLLPKGRRVYTPGRKPLMTRGEARRFFSTTFRTRNRDVRDLLTDEAQLTRYGLPVWRTEEDVAAALELTVGQLRHYATHRIRERVSHYVTFSVPKRSGGTRLLHAPKRKLKALQRRLLTLLVAKLPRSEHAHGFVSGRSIKTGAAPHVGRRVVLKLDVKDFFPSVTVGRVRGLLLALGYGYPVAATLAVLMTEAERQPVEVEGTVFHVPVGPRACVQGAPTSPGLCNAVVMRLDRRLAGLARRYGYTYTRYADDLTFSGDDVGALEKVRALAARYVRDEGFEVNAAKTRVQRRGGRQRVTGVTVNAGLGLSREERRKLRAMIHQEDGGDAKQRARIDGMLAYVKMLNPEHAARLARRRKPRG

SEQ ID NO: 6573 - protein, 426 aa, unidentified
  source 1..426: note = Related to NZ_JAAIXY010000026.1; note = Myxococcus eversor
MSWLDWFKGLFSPKPVTRDVSRLDAPFERDASDRPPDVVRETVATSGPLKPGHLRQILRDARLLPKGKRVYTKKRKRLFSALEARRFFSTAFRTRNRNVRDLLPDEAQLARYGLPVWRTEEDVATALGLSVGQLRHYSTHRARERVSHYVTFTVPKRSGGQRLLHAPKRKLKAIQRRLLDVLVSKLPVSEQAHGFVTGRSIKTGAAPHVGKRVVLKLDLKDFFPSVTVSRVRGLLLAFGYGYPVAATLAVLMTEAERQRVDVEGTVFHVPVGPRVCVQGAPTSPGLCNAVLTRLDRRLAGLGRRYGYAYTRYADDLTFSGDDVGALEKVRALAARYVREEGFEVNAEKTRVQRKGGRQRVTGVTVNEGLGLSREERRKLRAMIHQEDRDGGDAKRSARIDGMLAYVGMLNPEHATRLARYRKPRGG

SEQ ID NO: 6574 - protein, 431 aa, unidentified
  source 1..431: note = Related to VBLP01000080.1; note = Deltaproteobacteria bacterium
MGSWLRRVFGPGAESPSGDSSGADRADRAGPATASAAAAAGTRRGGPLRPNQRREAVRDERLLPKPEPRRPWRAPKSRPIIPADAGARLFSDSLRTRNRELRTLATDPAQLARHGLPIWDTERDVADALGISLGELRHHAIHRRRERVEHYVTYAIAKRSGGQRIIHAPKTRLKAILRKLHGALVGKLPVSEHAHGFVAGRSVRTGAAIHVGKRVVLRLDLREFFPTVTAARVRGYLIALGYGYPVAATLALLTTEPPRQRVDIDGTIFHVPVGPRTCVQGAPTSPGLCNAILHKLDRRIAGLARRAGFAYTRYADDLTLSGDDLDTAHRLRRRVERVIREEGFEVNPAKTRVMTGRGAQRVTGVTVNRVLGLSRRERRQIRAMVHCGDPDRARQVEGLLAWVEMLNPAQADALRRAPRKPPARPGARPDR

SEQ ID NO: 6575 - protein, 440 aa, unidentified
  source 1..440: note = Related to NZ_JAHXBF010000024.1; note = Hyalangium sp.
MSFFSTLRAWMGSLFGEKPVTREVTRLSSEPETPSAKQGPTKTVLGRAKDTVVEKVVMTGPLKEKHRRLLKRDARLLPKPSRKRRWEKREKVMSQAEARRLFAGTLRTRNRNHRDLLPDEEQLVRYGLPVWRTEEDVAQALGLTVRRLRHFSIHRERDPVSHYITFAVPKRSGGQRLIHAPKSGLKAVQRKLLSLLVEKLPVSPHAHGFVKGRSVRTGAEGHVGKAVVLRLDLKDFFPTVTYARVRGLFIALGYGFPVAATLAVLMTESERQPVEAEGKVYFVPVGPRVCVQGAPTSPALCNAVVLKLDRRLAGLARKHGFTYSRYADDLSFSGPSEETAERLRALAKKIIEEEGFQVNAAKTRLQRRGGRQTVTGVTVNQVLGLSRKERRKLRAMIHQETSRPADAERSARIDGKLAYLSMLNPQQAEALRTRRKGRTS

SEQ ID NO: 6576 - protein, 433 aa, unidentified
  source 1..433: note = Related to NZ_JMCB01000011.1; note = Hyalangium minutum
MSLFPKLLTWVKTVFGQGPRTRQVTRLSSANGGPVDASGRPVDVVTEEVVLKGPLKEKHRRLVKRDPRLLPKPPRKSHWEKRKKVMSAEEANRLFSGTLRTRNRNLRDLLPDEAQLERYGLPVWRSEQDVATALGITVRQLRHFSVHRQRDRVSHYVTFALPKRSGGQRLIHAPKKGLKAVQRKLLSLLVEKLPVSPLAHGFVKGRSVRTGAEGHVGKAVVLRVDLKDFFPSVSYARVRGLLIALGYGYPVAATLAVLMTESERQPVEVDGQVFFVPIGPRVCVQGAPTSPGLCNAVVLRMDRRLAGLARKHGFTYSRYADDLSFSGPEQKTAEKLRALAGKIIAEEGFQVNAPKTRLQRRGGRQTVTGVTVNQVLGLSRKERRKMRAMIHQEASRPADAENSARIDGKLAYLSMLNPRQAEALRTRRKGRTR

SEQ ID NO: 6577 - protein, 436 aa, unidentified
  source 1..436: note = Myxococcaceae bacterium; note = Related to JAEUJQ010000080.1
MSLFDRLWGFFKGLTSKPVERDVTRLPSHDAKDGRAADLTKEVVRTSGELKPHHRRLITRDQRLLPDPSRKAHWGPLGYTARKKVFDASVAGRLFAGTLRTRNRELRTLATDPAQLERYGLPRWEDEATLAAALGLSVNQLRHLSTHRLRERVPHYVAFAIAKRSGGERVIHAPKKRLKAVLRAVHAQLVSKLPVHPAAHGFVKGRSVKTNAEGHVGRAVVVKLDLEDFFPTVTYQRVRGLLVSLGYGYPVAATLAALMTESERQPVELDGEVVHVPVGPRVCVQGAPTSPGLCNAVVRRMDARLSGLAKKLGFTYSRYADDLAFSGDDPKQVDVLIHRATRVIATEGFRVNGKKTRVMRRGAAQRIAGVTVNATLGLSRKERRLLRAAAHREKTSTVDAKEQAVLTGQLAWVQMLNPSQAEALRRRRARAIGPPA

SEQ ID NO: 6578 - protein, 431 aa, unidentified
  source 1..431: note = Related to QFQP01000022.1; note = Archangium gephyra
MNWLRRFFAWLFGPKQVTRDVARLPDHSGGRAPDVLKEVVQTGGPVKPNYRRLAVRDARLLPDRSRKGGWTGLAWRAPTSVMTGKESRRLFSNSLRTRNRNLRTLATDEKQLARYGLPLWRTETELAAALNLSIEQLRHFSIHRVRDRVPHYVAFAIPKRSGGERVIHAPKKKLKAVLRNVNDQLVSRLPVHAAAHGFVKGRSVKTNAEPHVGRAVVVKLDLEDFFPTVTWARVRGLLISLGYGYPVAAALASLMTESERQPVTVDGQTFHVPVGDRVCVQGAPTSPGLCNAVTRKMDARLSGLSKKLGFTYSRYADDLTFSGDDAKQIETLLNRATRIIHTEGFVVNGKKTRVMRSGNSQKVAGVTVNETLGLSRKERRKIRAALHQATPEKRAQLEGTLAWVHMLNPEQAAKLKADAVRAPTSPGPTTT

SEQ ID NO: 6579 - protein, 434 aa, unidentified
  source 1..434: note = Related to MWCO01000010.1; note = Deltaproteobacteria bacterium ADurb.Bin207
MTWLIALMVLAGVFVLLRALARKKQNAIHTIEPGLTQDEPTSDSASGGSKSQLEPKTTQSLRKQTIDERLLPKAPSRGPHHPRSRLFDAASARRRFSHSMRCKNRDLSVLAEDPEQLARHGLPLWRNEAQLAEALGLSVGQLRHLSMHRIAERTPHYITFSIPKRSGGNRLIQAPKRKLKAAQKKVLSLLIHKLPVHEAAHGFRQGRSIRTGAEPHVHRRVVIRLDIKDFFPSLTFARIRGYLIAMGYGYEVATTLACLCSEPQRQPVEVGGEIVHVPVGPRVAPQGAPTSPGLLNAICHKLDCRMQGLARAHGFAYTRYADDLTFSGDYPDRVGKILSRARAIIRSEGFEVNPSKTLVMRRGKAQRVTGVTVNETLGLSRQQRRLVRAAIHQASFVSPMDGTSKARLLGKVAYIQMLNQSQAEPLRRQTEKLT

SEQ ID NO: 6580 - protein, 322 aa, unidentified
  source 1..322: note = Related to NZ_CP011509.1; note = Archangium gephyra
MGFVDWLKGLFRPKPLMRDVSRLDREGGSLDAVQEEVRPESGPLKPGHLRTVRRDPRLLPKPKPKTPLRGKRKKWMAASESRRLFAGTLRTRNRHISDLLPDEAQLQRLGLPVWRDEGEVAVALGVSVKELRFFSIHREAERAPHYVSFSIPKRNGGRRLIMAPKRRLKALQRKLLPLLVDKLPVSGHAHGFRAGRSIRTGAEPHVGKAVVLKMDLADFFPSVTYVRVRGLLIALGYGYTVAATLAALMTEAERQPVEVNGVRLHVPVGPRACVQGAPTSPGLCNAVVRRLDLRLAGLARKHGFSFTRYADDLCFSGAHWRR

SEQ ID NO: 6581 - protein, 429 aa, unidentified
  source 1..429: note = Verrucomicrobia bacterium; note = Related to JAFLEF010000003.1
MSLWRWIKSWFGAAPTRDISRLDTTRSASSATGDVEERIDISGGPLKEHHRRRALRDPRLLPKIKSPARQLGLTKKKAVMSQTEAKRLFGGTLRTRNRQLRDLLPDEEQLKRLNLPLWRTEDDVAQALGISRRELWFFSIHRERERRPHYVTFSLPKRSGGQRLIQAPKRRLKSIQRRLVSLLVSHLPVSEHAHAFRPGRSIRTGAEPHVGHRLLLKLDLQEFFPSVTFARVRGLLISYGYSYPVATTLAVLMTEAERQPVEVDGEVFFVPVGPRHCVQGAPTSPGLCNALLLRLDRRLAGLARKRQLTYTRYADDLTFSGDLDRAQAESLRALATHLIASEGFTVNSKKTRIMASGARQSVTNVVVNQTLGLSRKERRRWRASAHQLSRRPESERAGLRAQLEGRIAFLHMLNPRQAEALARRLPALQ

SEQ ID NO: 6582 - protein, 424 aa, unidentified
  source 1..424: note = Verrucomicrobia subdivision 3 bacterium; note = Related to WRPG01000015.1
MGLLDFIRSLFGPPKRDISRLSGETVAGEDEVDERVDVSGGLLKEHHRRRALRDPRLLPKRKSVGRQLGLAKRKRVLSAAEAERLFSGTMRTRNRRLRDLLVDPEQLKRLGLPLWKTEEEVAAALGISLRELWFFAIHRERETQPHYVTFAIPKRSGGKRTIMAPKRRLKAIQRKLLGLLVEKLPVSEHAHAFRRGHSVRTGAEPHVGKRMVLKLDLKDFFPSVTMARVRGLLIACGYSYPVATTLAVLMTEAERQLVSVEAEVFHVPVGPRHCVQGAPTSPGLCNALVLRLDRRLAGLARKRGLAYTRYADDLTFSGEFDRAAAQQFRQVASRIISEEGFTVNTAKTRLMGRGARQSVTGVVVNSVLGLSRQRRRQLRAMAHRLKLAQRAGTAEGTELARFAGHMAYLAMLNPRQAARIPVVD

SEQ ID NO: 6583 - protein, 421 aa, unidentified
  source 1..421: note = Related to JAFEGM010000010.1; note = Verrucomicrobia bacterium
MSLLAWLKRLFGREVRRDVAQLERGEVDAVAETVDLTGPPLRPHGQRRAWRDRRLVPKRRSLGRALRLTKRQPLLSRTEADRLFSGSARTRDRQLRDLAPDEEQLRRYGLPVWRTEQELANALELTLGQLRHFAIHRERERQPHYFTFAIPKRSGGERHILAPKRRLKALQRRLLEQLFARLPVGEPAHGFRRGRSVRTAAEPHVGQRRLLQLDLQDFFPSLTFGRVRGLLIGYGYGFPVANALALLVTECVRQPVEIDGEIFHVPVGLRHAVQGAPTSPAIANALVLRLDRRLAGLARRFRCRYTRYADDLTFSGELDAAAAQQLRRLAGHIIRSEGFAVNAAKTRSAGPGARHEVTGVTVNEVLGLSREERRCLRAAAHRLHREPDNAELAARLHGQLAYLHMLNPAQAERLRQRLPTR

SEQ ID NO: 6584 - protein, 428 aa, unidentified
  source 1..428: note = Opitutaceae bacterium; note = Related to JACSRI010000083.1
MSLFDWIRQRLLGGARRRDVSRLESGDDALDSVTELVAVRGGPLKPGHRRLALRDPRLLPKPPRAPVRLGKRKKNPFLATAEASRLFSESLLTRNRGLRDLATDEAQLTRLGLPLWRTESEIATALGLTVGQLRHFSIHRERERTPHYVTFAIPKRGGGERLIMAPKRRLKAIQRTLLAQLVDKLPVTEHAHGFRRGRSIRTGAEPHVGRRVVMHLDLKDFFPSVTFARVRGYLVACGYGYPVATTLALLMTEAARQPVSIEGEIFHVPTGLRHCVQGAPTSPALCNAIAAKLDRRLAGLARKFGVAYTRYADDLTFSGDLDAKITGRLLHHVGAIIQAEGFTINSAKTRILHRGRRQSVTGVTVNKDAGLSRTERRVLRATAHRLTTLRREGAPDAAAERVLAGQLAYLAMLNPAQAAAVRNRQGPV

SEQ ID NO: 6585 - protein, 475 aa, unidentified
  source 1..475: note = Related to NZ_CP036275.1; note = Maioricimonas rarisocia
MRVEFFILRIWTRIAAGLSRLPRWAKIPIWIVLAILMVLVLVIGGLLATVFGLIRGILFRIFPPPPSRDVSRLDMDGAELDAIRETIEDEGKPLRESHRRLIYRDPRLLPKPKPPADVWPRPKRKRVMQVEEASRLFSGTLRTKDRNIRDLLADEEQLERHRLPSWQTESDLADALGLTMGQLRHYSIHRESETARHYVQFAIPKRNGRQRIIMAPKTRLKGIQRQLNEQLVQRLPVSPHAHGFRKGRSVRTGAEPHVGRKVLLKMDLKDFFPSVTFGRVRGLLISLGYSYPIATTLAVLMTEAERQPVQLEDRLVHVPVGHRYCVQGAPTSPGLCNAICLRMDRRLAGLARKYGWSYTRYADDLTFSGDDESALCDIRRLARQICRDEGFEVHPEKTRVMRQGRKQTVTGVTVNEVAGLSRKERRRLRAAIHRLKHPSPDRPASMTESQVRGHLAWLHMLNPEQAERLREQWTS

SEQ ID NO: 6586 - protein, 421 aa, unidentified
  source 1..421: note = Related to JACKEU010000003.1; note = Alphaproteobacteria bacterium
MSWWSSLWERLTAWWRGEPTRSVARIGGDADVDQVVETVRLSGTLTEHGRRRVLRDPKLLPKPKTAGWSMGKRPRILTRDEAYRLFGGTLRTRNREIRDLLPDPDQLQRHGLPHLASEVELAALLDVSLTELRFFSIHRVAERQPHHVVFRIPKRGGGFRTITAPKRRLRTVQRRLLARLVDLLPVSDAAHGFRKGRSVATHAAPHVGRKVVVKLDLEDFFHTVTWQRVRGYLIAMGYGYPVATTIAVLVTEAERQPVDLGDRVVHVPVGPRRCVQGAPTSPALCNAIAHKLDRRLLGAARALGFTYTRYADDLTFSGDDATRVSALLGLVRKIVVGEGFRLNDAKTRVMRAGGRQRVTGVTVNQVLGVSRRERRRVRAMIHQHGGDPAWRDRIAGQLGWVGAVNPEQAGTLRARWKRGGG

SEQ ID NO: 6587 - protein, 418 aa, unidentified
  source 1..418: note = Related to DTTU01000358.1; note = Phycisphaerales bacterium
MALFRWIADKLFGPPKRDLSRLENNDVDLVDESVDLSGGPLKPGHHRKSLRDRRLLPKRKASGLSPLKRVKLFSKEQSDRLFSRTMRTSNRNVRDLTEDEDQLHRYGLPLWKSEHDLASALSLSVKELRHFSIHRFQDKVCHYVLFRIAKARGGHRLIMAPKTRLKKIQRELLRQVLEKLPPPPHAHGFVKGRSVKTGASQHVGKKVVVKMDLADFFPSVTFPRVRGLFIALGYSFPVATTLAVLCTECERQRVKQGDDLFHVPVGERHCVQGAPTSPALCNQIARKLDNRLHGLALKLGFTYTRYADDLTFSGDNPEKLKSLLGLTRKIIEDEGFRLHSKKTRILHSGGHQHVTGVTVNQALGLSKKERRRLRAELHQLSLNQQPDPQQIARLKGKLAYLEMLNPEQAARLRAKYPL

SEQ ID NO: 6588 - protein, 452 aa, unidentified
  source 1..452: note = Alphaproteobacteria bacterium; note = Related to JAGOBA010000003.1
MSGFVTFIAVILGVIVYTYLKRANARRKHKRVVEEFKKAPVRDVSTVAGEGDAGLKTETIQIGGPLKPNHKRLALRDDRVLPKPPLGPDYYSKWPRPPRPKYFSERDADRLFGPSLRTSARDVMDLATDEAQLNRYGLPLWRTEAEAAAALGIPHAQFRYFSQHRHREHISHYVAFAIPKRSGGERIIHAPKTKLKAVLRTLDKLLVSKLPVSDHAHGFVRGRSIATNAKPHVGKPMVAKFDIKDCFPTLTVNRVRGLLLALGYSYPVAAALAVLMTEPPRQLVEAEGNIYHTPIGPRVCVQGAPTSPGLCNAILLRLDRRLAGLAKKRGLAYTRYADDMTFSGPEAEIKKLLGIVPKIVSEEGFELNTEKTRLMRQSGRQVVAGVTVNKDMGLSRKARRKLRAAIHHNSQGKLDVTAAARLEGKLGYLHMLNVDQARRLREGRDGTAAQQR

SEQ ID NO: 6589 - protein, 447 aa, unidentified
  source 1..447: note = Related to JABFRX010000136.1; note = Alphaproteobacteria bacterium
MTGILRLLVFIGLFVAVYYGYKAYQRWRHKQTVKEFKKAPVRDVSTVAGEGVASLKTEKINIGGLLKPNHRRLALRDERLLPKPPLGPDYYSKWPRPPKPKYLSENDADRLFSPSLRTSVRDAMDLATDEAQLKRYGLPLWKNEADVANALRISQGQFRYFSQHRHREQTPHYVAFAIPKRNGEERIIHAPKTKLKAVLRALDKQLVSKLPVSEHAHGFVKGRSIATNARPHVGKPMVAKFDIKDCFPTITMGRVRGLLLALGYSYPVAAALAVVMTEARRQPVEAEGKLYHTPTGPRVCVQGAPTSPGLCNAILLRMDRRLAGLAKKRGLAYTRYADDLTFSGPQGEIKKLLGLVPKVAAEEGFAINHDKTRLMRQSGRQAITGVIVNKDMGLSRKVRRKLRAALHHQKLGKADPANTDRLKGKLAYLNMLNPAQAKRLKDVYAPL

SEQ ID NO: 6590 - protein, 452 aa, unidentified
  source 1..452: note = Related to JAFMSC010000026.1; note = Hyphomicrobiaceae bacterium
MPHLTYLQIGVLLLIVGLLLTRGARRWLVLRRWSKAPQRDVSALATTGEAQFKGEAITTAGPLRPGHRRLVLRDKRLLPKPPPDPAILRRWPRPPKPKYLTEQEADRLFSPSLRTSNRNVMDLATDEAQLQRYGLPVWNSEDDVASALSLSLGQLRHLSQHRHRETAPHYITFAIPKRSGGERLIFAPKRRLKAVLRTLDRLLVCKLPKSEHAHGFVRKRSVATNAAPHVGKAVLLHFDIKDCFPTIHFGRVRGLLIALGYSYPVAATLAVLMTEAPRQPVAAEGKLYHVPTGPRVCVQGAPTSPGLCNAILLRLDRRLSGLASKYGFGYTRYADDLAFSGDDATKVARLLKLVPAIVAAEGFAVNPVKTRVMRAGQRQAVTGVIVNKAMGLSRQERRKLRAALHQQGTAGADPGDELRLHGKLAYLFMLNKLQAAALGWRQGMRPTLTNPP

SEQ ID NO: 6591 - protein, 447 aa, unidentified
  source 1..447: note = Related to JAFECH010000062.1; note = Proteobacteria bacterium
MTHLAALVLAYFLVVGIRTAWRNRKRKQAEKKWAQAPQRDVSAVADVGQAEFKQEIIKTSGTLKPNHRRLILRDNRLLPKAPPDPKQRRWPPPPRTKYLTEHEADRLFGPSLRTRNRDVMDLAIDEAQLERYGLPVWKTEDEVAAALSLTPGKLRYFSQHRFRETASHYVTFAIPKRSGGERLIHAPKRQLKAVLRRLNTLLVSKLPVSKHAHGFLQGRSVATNAAPHVGKAVVLHFDIKDCFPSIHYGRVRGLLIALGYSYPVAAALAVLMTESPRQPVVAEGKTYQVPIGPRVCIQGAPTSPGLCNAILLRLDHRLAGLARKHGFAYTRYADDLTFSGNDTKKIAKLLKLVPQIIFEEGFAANTKKTRVMRAGRRQAVTGVVVNKDMGLSRQERRNLRAALHRQNTSPNTNPRERMRLEGKLAYLYMLNRDQASALGWKKPARSV

SEQ ID NO: 6592 - protein, 446 aa, unidentified
  source 1..446: note = Bradyrhizobiaceae bacterium; note = Related to JAFMSG010000097.1
MSSFLFAIAAIAAVIVWQRRKEIVRTLRWKHQPIRNVAALAVTDDASVAEEVITTAGPLKPQHRRLILRDKRLLPKPPLKFDRYVWPRPKQPRVFTKAEAGRLFSATLRTRDRNIRDLATDPEQLARYGLPIWESEADLAAALSISVGQLHHYSIHRERERASHYVCFAVRKRGGGERLIYAPKRRLKELQRRLHDLLVRMLPVSAHAHGFVPGRSIATNAAPHVAKAVVLKFDIKDCFPTIHFGRVRGLLLAYGYSYPLATTLAVLMTEAPRQPFEIGGALYYVPVGPRVCVQGAPTSPGLCNAVMLKLDRRLAGLAKANGFAYTRYADDLTFSGDKEEAVDRLLAWVPRIAEAEGFALNASKTRIMRRGGRQTVTGVIVNKSAGLSRQERRRVRAEIHRLSQSATAPENGATQRLRGKLAYLNMLNPLTTAPLLAAFARLSGRT

SEQ ID NO: 6593 - protein, 428 aa, unidentified
  source 1..428: note = Related to JAAZAJ010000036.1; note = Planctomycetes bacterium
MGLIDWLRALVGKPRQVRRNVSTIAATSGAAPAEQTEEIVQTEPQPMKPLHRRLTFRDARLLPKPKRKSGQFTWPRLKKKRYMQADEACRLFSTALRTRDRSIRDLATDKAQLSRYGLPVWHTEQDIAAALALTPKQLQHYSIHRCRETSPHYVAFAVPKRGGGHRIIHAPKRRLKAIQRKLNELLVEMLPISSYAHGFVKGRSIATNAKSHVGKAVVLKFDLKDCFPSIHFGRVRGLLIALGYGYPVAATLAVLMTEAPRQPVEVDGRLYHVPTGPRVCVQGAPTSPGLCNAVLVRMDRRLGGLARKYGFAYSRYADDLTFSGNDTAAVRPLLGIVPRIVQEEGFTINSGKTQIRRRGRRQRVTGVIVNECAGLSRRERRRLRAAIHNQQRHGAEGKSRRRLGGKLAYLKMLNPTQAGPLIAAFRSA

SEQ ID NO: 6594 - protein, 429 aa, unidentified
  source 1..429: note = Planctomycetes bacterium; note = Related to QQVE01000048.1
MPGGNPVGLLDWLASWFGGRRRYRDVSGLAEADADLTRERVDTGGGPLKPQHLRQAVRDARLLPKPQPTAGMWVPGQKKKVMSQREADRLFSATFRTCNRNLRDLTTDEEQLRRYGLPVWKSEADVARALQISEGQLRHYSIHRQRETSPHYVTFALNKRRGGHRLIHAPKRRLKQLQRTLDALLVKKLPVSTFAHGFRAGRSVASNARQHVGKAIVIKLDLQDCFPSIHFGRVRGLLVALGYSYPVSTTLAVVMTESPRQPVAAEGKIYHVPVGPRVCVQGAPTSPGLCNAVLMRLDRRLAGLAGKHGFTFTRYADDLTFSGDDPAKIKLLLTIAACIVREEGFRLNPQKTRVLRQGARQRVTGVVVNDQPGLSRTERRKLRAAIHRLDPADEAACRRIEGKLAYLQMLNPDQAAPLRSAFVAARGRG

SEQ ID NO: 6595 - protein, 424 aa, unidentified
  source 1..424: note = Related to JAGQOZ010000372.1; note = Planctomycetales bacterium
MGLWNWLKTWLRPHPITRNIANLDGDQAQSVTEVVDTSGGPLKPHHQRLAVRDVRFLPKPQRPSSLPSWSRPAKPVVFSKSDAERFFSASQRTKNRQLRDLASDTDQLQQYGLPEWNSEDEVAAALGLTVSQLRHYSIHRQRETSPHYVMFAVPKRQGGHRIIHAPKRRLKKIQRMLLAELVSKLPVSEFAHGFRRQRSVATNATHHVGKAVVIKLDLADCFPSLHFGRVRGLLIALGYSYVVATTLAIVMTEAIRQSVEAEGKIYYVPVGHRFCVQGAPTSPGLCNAILMRLDRRLAGLAAKHGFQYSRYADDLTFSGDHPAKAPYLVALAGKIIRDEGFRVNRKKTRVLRPSRRQQITGVVVNQHVGLSRTVRRRLRAAIHQLSANDVHARNQIIGKIAYLRMLNPDQAAPLQAALDAKLQN

SEQ ID NO: 6596 - protein, 426 aa, unidentified
  source 1..426: note = Related to WGNR01000010.1; note = unidentified bacterium
MSFLNWLTSLFKPKPPARNISGLAGTDAIEVEEHVDLSGGPLKPKQLRLATQDKRLLPKAKKAIDPRNWVPRKKPKIMPREEADRRFSESLRTSNRKISTLASDVEQLERYGLPIWNSEADIAAALEMSTSQLRHFSIHRQRETSPHYVTFAIRKRTGGHRLIHAPKTRLKRIQRQLNELLVSRLPVSDAAHGFRAQRSVATNAEPHVGKQVVIKLDLADCFPTIHYGRVRGMLISLGYSYEVAAVLSLLCTEAERQPVAADGKTYFVPIGPRVCVQGAPTSPGLCNAVLLRMDRRLAGLAKKFDFQYTRYADDLTLSGDDASKAKVLIRLAKEIVQDEGFRLNSKKTRVVRHGQRQRVAGVVVNDQKGLSRTERRKLRAAIHQLDPADEKSARHLRGKVAYLAMLSEQQAAPLRAALAVKLSGDA

SEQ ID NO: 6597 - protein, 433 aa, unidentified
  source 1..433: note = Related to JAFGFF010000467.1; note = Pirellulales bacterium
MSFLDWLKSLFRPKPATRIVAGLSAADTSADAAKVREVVDTSGGPLKPGHCRRALRDSRLLPKPKPKSQGYVWPRPPKPKYLDRSEADRLFSTTLRCRDRNLRDLLPDPEQLDRYGLPLWQTEADLAEALGISVGMLRHYSLHRIRETTPHYVTFAIPKRSGGERLIHAPKRRLKAIQRRLHELLVSRLPVSAAAHGFRSGRSVATNAHPHINKAVLIKLDLKDCFPSIHFGRVRGLLVALGYGYQVATVLAVLMTEPPRQPVEIDGKLVYVPVGPRSCVQGAPTSPGLCNAVLLRLDRRLAGLARKYGFAYTRYADDLTFSGDDTAKIKLMITLSSKIVREEGFSLNRQKTRVLRRSRRQTVAGVVVNSTVGLSRRDRRRLRAEIHQLSQAAKPPDSHRVQRLAGKLAYLHMLNADQAAPLLVQFARLGDGS

SEQ ID NO: 6598 - protein, 440 aa, unidentified
  source 1..440: note = Related to PSQY01000124.1; note = Proteobacteria bacterium
MPLPAVRPVTGTPPSHSTLPALERARPAQPQTLQPPPTPQLQRAPTPPPQASEPQEAGVEQSQHRRLAVRDERLAQKLVTTQHAVTARRPSKRSFHRDEAARMFSSTLRTQRRGIRDLVTDEQQLVRYGLPIWRTEAELALALQVGLKALRHYTVHRAQDRVLHYVTFAIPKRSGGERLITAPKTRLKALQRRLNALLVSKLPVSEYAHGFRTGHSVLTNAKPHVGKQVVLRLDIHEFFPSIHFGRVRGLFLALGYGYPVATALAVLMTEAPRQPVQIGEVCLYPPCGPRTCPQGAPTSPGLSNALLVRLDRRLAGLAKQRGFSYTRYADDLTFSGDDIAAAHALRLAAARVVREEGFELNVKKTRVARRASRQLVTGVIVNRVLGLSRQTRRRLRAAVHQYLQAHAAGAADPRTLARLDGRIAYLSMLNSEQARRLTMD

SEQ ID NO: 6599 - protein, 419 aa, unidentified
  source 1..419: note = Related to CP036279.1; note = Planctomycetes bacterium Pan216
MGFFSWIWRLLGFAPRRNVSRLDTGDEDVVQEVVDLSGDPFKEHHRRRALRDGRLLPKRRQHTFWGSRKRYLSKEEADRLFSDTMRTCDRKIRDLLPDEEQLARYGLPPWRTEEDLARALGLTLKQLTFYALHRERERFCHYVSYARPKRNGGERIIMAPKRRLKELQRKLVDDLVRHLPVSEHAHGFREGRSVKTNAEPHVRKTVVVKFDLKDFFPSVHVGRVRGYLISLGYGYPVATSMAVLMTEAERQPVEIDGERYFVPVTSRYCVQGAPTSPGICNAILLKLDRRLAGLARSLEFAYTRYADDLTFSGNDVGAVERLRKSVQRIVHDEGFRVNSEKTRVMKRGACQRVTGVVVNDGVGLSRKERRRLRAMAHQLRQSANGEESKAARLRGKIAYLRMLNPTQAGAIERHWSNRG

SEQ ID NO: 6600 - protein, 419 aa, unidentified
  source 1..419: note = Related to JACQGK010000369.1; note = Armatimonadetes bacterium
MSLWDWIKERLFGVPPSRDVSRLEPGSGQRDAVTEAVDTGGGPLKPGHRRRAIRDRRLFPKARTPIGRRPRVMKPHEARRLFSASLLTRNRSIRDLAPDEEQLKRYGLPLWRTEDDLARALELSLGQLRWLSIHRERESCPHYVTFAIPKATGGERLIMAPKRRLRRVQRRLHELLVSRLPVSPQAHGFRPRRSVKTGAEQHLGKPIVLHLDLADFFPTLAWHRVRGLLIAYGYSYPVATVLALLMTEAERQPVEVDGKLFHVPVSPRYCPPGAPTSPGLGNALLLRLDRRLIGLARKFGFAYTRYADDLTFSGEAERKIAYGLVCRVREVVEAEGFSLNDRKTRFMGSGRRQTVTGVVVNRVLGLSRNERRRLRAALHQHRGEPDPQLLGKLAYLWMLNPQQAMALWPADWPRPRRAR

SEQ ID NO: 6601 - protein, 416 aa, unidentified
  source 1..416: note = Related to QWHO01000540.1; note = bacterium CPR1
MSLWKWLSSKLTGKPPRRDVSRLESEDEDQVSEAVDVSGGPLKPDHRRRALRDRRLLPKAQPPVRFGKKKRLMSKAEAQRLFGASMRTRNRTLRDLLPDVEQLTRYGLPVWKTEEELATALGLTQRQLWFFALHREKERAAHYVTFAIPKRGGGERHIMAPKRRLKALQRKLLGLLVEKLPVHEAAHGFRKGRSIKSGAALHVGKKLVLKVDLKDFFPTVTFPRVRGLLIAYGYGYPVATALALLMTESVRQPVEVEGKLYHVPVGPRHSVQGAPTSPGLSNALVLRMDRRLTGLARKFGFVYTRYADDLAFSGDHDHKTGWGLLQRARRIIAEEGFAVHPDKTVLMGSGRRQSVTGVVVNRTLGRSRQQRRRLRAALHRRRQAEARLRGQLAFLWMLNPAQASALWPEEWKKPQS

SEQ ID NO: 6602 - protein, 406 aa, unidentified
  source 1..406: note = Related to JADMJV010000021.1; note = unidentified bacterium
MSWLDWLKQKLLGIPPQRDISRLEGSSEEVREQVDVSGGPLKPKHRRRALRDRRLLPKARAPLGKRPKQMSHSQAQRLFSASQRTRNRQQRDLLCDPEQLQRLGLPGWRNEDDLAHSLGLTLRQLWSYSYYCQAENAPHYVAFAVAKRSGGERIILAPKRRLKALQRKLLDLLAQHLPVSPAAHGFRKGRNTLSNAREHVGQKVVVRFDLQDFFPHCSWQRVRGLLVAYGYSFPVATCLALLMTESERQPVETPAGLVYVPVRQRYCVQGAPTSPALANALTLKLDRRLSGLARKLGFRYTRYADDLTFSSSGLARLGVLKRAVTAIVEAEGFRLNDSKTRVMRQGRRQTVTGVVVNQVAGLSRQQRRQLRAALHQAAGQPDAHLRGMLAYLHGLNSEQARRLQPP

SEQ ID NO: 6603 - protein, 437 aa, unidentified
  source 1..437: note = Related to nan
MRLLILIALGFLFWRLWKLWRQLRLRHQARHPVRDIARLVDDADSDARGDTVERIDMSGGPLKPGHRRRALRDRRLLPKPKRDWSDPKPPKVMSLDAATRLFAGTLRTRDRHARDLDTDAEQLERHGLPPWRSEAEVAAALGIEEKRLRHYAIHRQRERVVHYIAFAIAKRNGGERVILAPKKELKALQRKLNKLLVDKLPVSDAAHGFRPGRSIASNAAPHAGKAVVLKLDLENFFPSLHVGRVRGLLIALGYAYPVAAGLAALMTESERQPVVVDGETFHVPTSSRHAVQGAPTSPGLANALALRLDRRLTGLARAHGFVYTRYADDLAFSSDDVATARQLLKRAESVIRAEGFRVNRAKTRVMTQASAQRIAGVTVNAAPGWSRAQRRKLRAELHRARTSGATDPSLWQKLRGKLAFVRMLNRAQGERMARADS

SEQ ID NO: 6604 - protein, 435 aa, unidentified
  source 1..435: note = Related to NZ_BLJN01000007.1; note = Steroidobacter agaridevorans
MRVLLLLFVIYVFWQIFVRFWPKRATRDLSRLENADDDAADEEVLETVAVDGGPLKEHHRRLALRDARLLPKAKPRAHTWPPKPKPKVMSMDEATRLFAGTLRTKNRKLRDLRSDDDQLRRYDLPRWASEEDIANALGISVARMRYYSIHREKERVSHYVSFAIPKRSGGERIIMAPKRELKKLQRDLDRLLVSKLPVSEYAHGFRKGRSIASNASAHVGRKVVVKLDLKDFFPSLHVGRVRGLLIALGYSYPVAATLATLMTEAVRQPVQVGDEIFHTPVGGRHAVQGAPTSPGLANALTIALDRRLAGAARELGFTYTRYADDLTFSGDDAGKARQLIRTCQRIVHAEGFALNDAKTRVMTQRGAQLVTSVTVNREKGLSRRRRRLLRAELHRAQREGGDATLWRKLRGKLAFVSMLNARQADALAKNVRFPG

SEQ ID NO: 6605 - protein, 436 aa, unidentified
  source 1..436: note = Related to SADD01000012.1; note = Lujinxingia sediminis
MPRAFRRGGTIFRSPRRFSHTVEEAGPERRRSPRRWLTPCASSTRGASMSLWQRLRDWIQPAPPAAKPPEQVSICEEPAHPSPEFNRRFTTSLRSADPSQTRRRTRSGRLRQRGLPVWRCDDDVAQALGLSLSELYHFACHRLADPHLHYVRFTIPKRGGEERPILAPKPRLKAIQRDLLELALHQLPVHRAAHAFLPGRSIATHARPHLQREFLLTLDLHNFFGALHVGRVRGFLMAMGYGWEVASTLALLCTEAPRQAVLVHGERLYTPTASRSLPQGAPTSPMLANAIVCRLDRRLSGLARSLGLNYTRYADDLTFSGDDPTRIASVMRLTHQIIAEEGFELATAKTRIQRRGQRQQVTGVVVNQTPGAPRARRRRLRAAIHRYAQACSRGEDDPLRRRQLEGELAFIHMLNPAQARALAAGLPDGPPVANAR

SEQ ID NO: 6606 - protein, 387 aa, unidentified
  source 1..387: note = Related to NZ_VOSM01000004.1; note = Lujinxingia vulgaris
MNLWQRLRDWMQPAPSPEHPGEISICKEREPPSPGFNRRFTTSMRSARHDELRRRTRSGRLRRLGLPVWRCDDDLARALGLTTSALYHFACHRLADPHFHYVSFTIPKRSGEERPILAPKPRLKAIQRDLLDQALSRLPVHRAAHAFVPGRSIATNARPHLRREFLLTLDLHNFFGALHVGRVRGFLMAMGYGWEVASTLALLCTEAPRQTVLVHGERLYTPTGSRTLPQGAPTSPVLANAIAYRLDRRLSGLARSLGLNYTRYADDLSFSGDDPTRIATLMRLSHQIIREEGFEVAPSKTRIQRRGRRQQVTGVVVNQTPGAPRARRRRLRAAIHHYARACARGDHNPRRRRQLEGELAFIHMINPAQARALAAGLPAAPPAANAR

SEQ ID NO: 6607 - protein, 389 aa, unidentified
  source 1..389: note = Related to NZ_QHKO01000004.1; note = Lujinxingia litoralis
MSLWQRLRDWLHTDTQPDSTPTPAPDSAPPSSPPSATHNRRFTASLRTHTPAQSLRRTRSARLKRHGLPLWRNDQALAADLDLSTPELYHFACHRLADPHRHYISFNIPRRSGASRAILAPLPRLKALQRRLLALALHRLPVHDAAHAFVPGRSIATNARPHLGKAFVLSLDLKDFFGSLHLGRVRGYLLAMGYGWEVASTLALLCTEAPRQPVQVQGEVRWAPVGSRTLPQGAPTSPALANAIAYRLDRRLNGLARSLNLTYTRYADDLSFSGDDPQVLGSLLRLTHQIVVEEGFELASHKTRVQRQGQRQQVAGVIVNQVLGRSRQERRRLRAAIHRYARAQARGESHPAWRLELEGRLAFLHMLNPAQARALSSGLPDEPPGASAR

SEQ ID NO: 6608 - protein, 454 aa, unidentified
  source 1..454: note = Related to QWHC01000005.1; note = Chloroflexi bacterium CFX4
MSRRGGKLCRSLLHGSHSSDKRGNRSITEIVAACLLCGWLFAISLPLPHFRKERTAMTNAADVLQAWRLNWQPDEFEWRSLTWENRVDLNREEREQRKRERARRDRLSFGGRLWGVGQAHRSAELDSERLARYGLPAFANERALAEWLGISLKRLRWYSYDRKVSPIYHYTRYTLPKRGGGQRVILAPKRTLKAIQHKILFELLAKVPNTDAAHGFIKGRSIATNAAPHVGKACVLNLDLKDFFPSITYPRVRGLFVALGYGFTIASVLALLCTESERISVQRGDKTRYVAINARHLVQGAPTSPAIANLMARRLDARLHGLAAKQGAAYTRYADDLTFSAESAEVATRLLRAAKRIIADEGLTLHMGKIRFFRQSARQVVTGLVVNDKVSVPRDLRRRVRAILHRAVQTGLAAQNREGRQHFRAYLHGLIGHIALQHPEQAAQMLAKLREIRD

SEQ ID NO: 6609 - protein, 395 aa, unidentified
  source 1..395: note = Related to JABTTZ010000003.1; note = Anaerolineales bacterium
MTSDALRAWRLSYTDEELQWRSADWRSEQSEWRAEREQQRRERRRRDRRYFGVGLNSQNLSRRALNEKKLTAQNLPILKNEKALAEWLNVELSRLRWYTYNQTTSSVYHYVRYVLPKRSGGQRVILAPKTGLKAIQRKILAEILNKIVLTEPAHGFRKGRNIVTNASPHAGKPFVLNLDLKEFFPSITFRRVRGLFTGLGYGYTIASVLALLCTESDREMIQRPDRPYYAGLSPRALVQGAPTSPALANLAARRLDKRLAGLAVKRGVTYTRYADDLTFSGEDRDVLFKLMKTAGHIIAAEGFTVHPKKTRFYQRGQRQIVTGLVVNDKVNTPRQMRRQVRAILHNAAQTGLNAQNRMNHPNFRGYVLGLIAHIGQTAPDLAATFRGQLVALSDS

SEQ ID NO: 6610 - protein, 395 aa, unidentified
  source 1..395: note = Related to JADYYJ010000076.1; note = Anaerolineae bacterium
MSDQSVLRDWRLNWHDDEFKWRPDQSWARRGQWLEERELARRARRRRDRGFFGDELWGTPLFKALHTPAALERFGLPAFENEAALAIWLGIPLTRLRWYTFSRLGSPVWHYVRYVIPKRSGGERVILAPKRELKGLQRKVLREILEKLPLSEPSHGFRKTRSIVTNAVPHTGKKYVLNLDLKDFFPSITFRRVRGLFVSLGYSFAVGTTLALLCTESDRAVMQRPDQRYYVSLNPRHIIQGAPTSPYLANLIARDLDLRLNGLARKHQVDYTRYADDLTFSGDDLDAILRILSVAKVIIKEEGFVLNPKKTRLYRRSGRQSVTGLVVNEKVNTPREMRRLVRAILHNAQKGGLNSQNQAKRPNFRAYVQGLIGHIGQSDPNRAAALLRQLAAIPD

SEQ ID NO: 6611 - protein, 375 aa, unidentified
  source 1..375: note = Anaerolineaceae bacterium 4572_78; note = Related to NBMH01000138.1
MSTFSSFIKNIKKGFTGKNKKPEKEIQSPKIAVALSSDVSKVPQKLDDVSLPVLRGKYALAKWLGISASRLTWFTYETKYNSVWHYVRHIIPKRNGGERVILAPKRELKALQRRVLDGILNQVPTSPQAHGFVMQRSITTNARPHVNKAVVINLDLKNFFPSVTLPRVLGIFRTLGYNKEVALALARLCTECDREVGPHLDSKYKDKEFFVSVTPRHLVQGAPTSPALSNLVCWKLDKRLNGLAQTYQFTYTRYADDLTFSGDDIQYVELILKVANGIVRDEGFKVNKDKTHVFYPSSRQVVTGLVVNDKVATPRQLRRQMRAIIHNAQFTGLEAQNYEQHPNFRYHLLGVAEFIGSTHPDKAEQMKQIIHALPS

SEQ ID NO: 6612 - protein, 377 aa, unidentified
  source 1..377: note = Related to JACCSL010001044.1; note = Ardenticatenales bacterium
MIDWYQQWRGEVEQRRQERERRRLERPLQDRRYFGEETWGASAEHLKAETDEPCLQHLYLPLLRSEKELAAWLGIPLTRLRWFTRDQPADTVWHYVAHSVPKRSGGQRLILAPKRDLKALQRHVLHHLLNHVSVTEMAHGFVAGRSIISNAQPHVGKEIVLNFDLADFFPSITFPRVRGLFLSLGYSFSVASVLALLCTEHEREAFDHDGTRYFISVGPRHLVQGAPTSPTLANLAAARLDRRLAGLGRVQGFAYTRYADDLTFSGDEVAGAYWLLKSVPPIVREEGFVIHEGKTRLFRQSARQVVTGLVVNEQLGTPRELRRRVRAILHKAHQTGLEAQNHDGHADFRAYLQGLIGFIHEANPAQAAPLRAALAAL

SEQ ID NO: 6613 - protein, 460 aa, unidentified
  source 1..460: note = Related to JACDGC010000016.1; note = Ktedonobacterales bacterium
MANFFRRLFRRNALKSDIVADAPPVTPTIVPTPPEALVMPTAALPLQTPIQVEQVAQAAGAVAYVILPSASAEPTPTPVAVPDATPLPTVTVNGVAYAQDDLDERALRDRATFGDELWGIANGKEANTTDAEKLARLGLPLLLSEQDVADLLGIPLNRLRWFTFDRAADTTWHYVRRVVPKRSGGERVILAPKQELKALQRKVLSDIVGRAPVALAAHGFVPGKSTITNARQHVGKAVVLKLDLQDFFPSITFARVRGLLIALGYAYAVASTLALLCTEYDREEYTRDGTRYFISVGPRHLVQGAPTSPTLANLVSWQLDRRLTGLAGAFDFTYTRYADDLVFSGDNPDVVQKLRFLTERIIRDEHFTVNRKKTRVARQSARQIVTGLVVNEAVATPRDLRRTLRAILHHAEKEGLAQQNREGRKDYPAYLQGMIAYVNAASPRHAAVLRTQLGKLRGQA

SEQ ID NO: 6614 - protein, 420 aa, unidentified
  source 1..420: note = Related to PSQZ01000251.1; note = Chloroflexi bacterium
MEAATAADDIDEVLEGEGQDEDEDGADWFQVSKHGFEVSEDDDDDITLQGPAYSGHTGQRAPQHTADRAYFGEETWGVSARQRSAEIQPAQLARYQLPVLRSEVDLATWLGIPLSRLRWYTHDRPAERTWHYVRYAVPKRSGQGERVILAPRRELKALQRKVLKGIVAKVPVAATTHGFVAGRSTLSNASEHAGKGVVLKLDLKDFFPSVTFRRVRGLFTALGYSYAVASVLALLCTEYDRQPFERSGEQYYISVGPRHLVQGAPTSPGLANLVAWRLDRRLAGLASKRGFVYTRYADDLTFSGEDAEAAARLGAAAARIIADEQFTVNAGKTRLLRRGGRQTVTGLVVNASPATPRELRRRLRAILHNAARDGLDAQNREDRGHYAAYLGGLIAYVGSANPSHGDVLRRQFRRLVTPRE

SEQ ID NO: 6615 - protein, 511 aa, unidentified
  source 1..511: note = Related to CP011509.1; note = Archangium gephyra
MQYEVRLAGYPDLVCLCRAGGGGSRSTGFAVSRSECTFMNLASLLLELKPLLADPEANFDRITELLDRHQGLAEYEVARFYVRRVWQAPVESRLRSMDARERLKGIRQLPLLFSSATAARLLRQRVKDPDTRVAQAARASVRRLGLADVSLPDRRVKPGRSAGSIGRWNPTGWNFGLFGNELYGFSRKAKRPPPRVGELPELRTRADVAELVGVEENALDALMRPGTESGSGYVEFEVPKRTGGVRRISAPRQKLKEVQRALLDKVLARMTPHPAAHGFIEGRSTVSNAEPHVGATAVVRVDIEDFFPTVHYRRVKGLFLAYGYGDEVAGVLAGLTTHRTKLPDGTVAWPGVLPQGAPTSPAIANLVCRRMDARLTALAKKFSAIYTRYADDLSFSFREPPERLGRFFWWLNAILQQEGFAENGKKRRVMRQGSRQRVTGLTVNQKVSIPREERRRFKAILANCRHHGVAAQARGRPDFERWLEGYAAYVRMVHPELGARWQREVKELLAR

SEQ ID NO: 6616 - protein, 475 aa, unidentified
  source 1..475: note = Related to NZ_CP069396.1; note = Archangium violaceum
MNLASLLLELKPLLADPDANFDRITDLLERHQGLAEYEVARFYVSRSWKEPVESRLRSVDPRERSKGVRQLPLMFSGTVAARHLRSRVKDADSRVASAARAAVRKLGLADVAPPDSRVAPSRHHGRRSVGGWNPTGWYFGLFRYETQGWSGSMKRPPPTSGELPRLSTRADVAKLVGVDESELDALMRPGTEAGSGYVEFEVPKRSGGVRRISAPRQKLKEVQRALLDQVLARMTPHPAAHGFIEGRSTVSNAGPHVGSTVVLRVDLEDFFPTVHYRRVKGLFQVHGYGEEVAGVLAGLTTHRPKLPDGTVVWPGALPQGAPTSPAIANLVCRRMDARLTALATKFGATYTRYADDLSFSFRAPPERLGRFFWWINAILQQEGFTENGPKRRVMRQGSRQRVTGLTVNQKVSIPREERRRFKAILANCRRHGVASQARGRPDFERWLEGYAAYVRMVHPELGARWQREVKELLGR

SEQ ID NO: 6617 - protein, 473 aa, unidentified
  source 1..473: note = Related to NZ_JMCB01000009.1; note = Hyalangium minutum
MGMDLVGLLLELKPLMADPEANFKRITALLEQHQNLAEYEVARFYVSRQWLAPVGRMLRSVDPRERHQGTQQIPLLFARATASAQLRRLVKDPDKQVAGAARAAVHKLGLADVAPPDRRFKPPRHPTPQSRGGWNPTGWNFGLPMRWGGRPKKQPPLKGKLPKLSTRKDVAELVGVQEEELAALMRPGTEAGSGYVEFEVPKRSGGVRRISAPRAKLKEVQRAILEKILEQMPTHDAAHGFVKGRSTVSNAEPHTGATVVVRVDLEDFFPTVHYRRVKGLFQAHGYGDEVARTLAGLSTHRPKLPDGTVVWPGALPQGAPTSPAIANLVCRRMDARLTALAKKAGATYTRYADDLSFSFEKPPEKLGRFLWWVNAILQQEGFLENAPKRRVMRKNSRQRVTGLTVNEQVSIPREERRRFKAILNNCRKHGVESQSRGRKDFSGWLRGYAAYVKMVHPELGERWQREVKELLGE

SEQ ID NO: 6618 - protein, 471 aa, unidentified
  source 1..471: note = Related to NZ_JAHXBG010000028.1; note = Cystobacter gracilis
MDLVGLLLELKPLMADPEANFERITELLEQHQGLAEYEVARFYVSRHWLEPVGRMLRSVDPRERLQGTKQVPLIFSRGTASGQLRRLVKDPDERVSRAARAAVHKLGLADVAPPDRRFKPPRTPRPMALGGWNPTGWNFGIRTGRWASPKKAPPLKGKLPKLASRQDVAKLVGLEEKELDALMRPGTEAGSGYVEFEIAKRSGGVRRISAPRARLKQVQRTILEQILSHMPTHEAAHGFVKGRSTVSNAAPHTGATVVVRVDLEDFFPTVHYRRVKGLFQSHGYGDEVASTLAGLTTHRPKLADGTVVWPGALPQGAPTSPAIANLVCRRMDARLTALAKKYGATYTRYADDLSFSFQAPPEKMGRFMWWVNAILQQEGFAENNPKRRVMRRAHRQRVTGLTVNQQVSIPREDRRRFKAILANCRKHGVASQARGRKDFESWLRGYAAYVRMVHPELGARWQQEVKELLGG

SEQ ID NO: 6619 - protein, 480 aa, unidentified
  source 1..480: note = Related to NZ_WJIE01000006.1; note = Polyangium spumosum
MSLVGLLLELRPLLADPDANFDRVSELLERHQGLAEYEVARFYAGRAFVGPVGRLLGSEDPRERLRGVRLVPLLFARANAAQHLRRMVKDADNAVAHAARAAVRTLGLADVSPPDRRAPAPRFPSPTARGGWNPTGWTFGLFRNHYVFRRGAAATTNAPLTAPPKADVPELKSRNDVAKLVGVKASALPSLMRPGTGKGSGYVEFEIPKRTGGLRKISAPRVRLKNVQRAILREVLEKLPTHPAAHGFVEERSTVTNATPHVGASVVVRVDIEDFFPTVHYRRVLGFFMRYYDEKVAAALAGLTTHRSKLPDGTVVWPGALPQGAPTSPALANLVCRRLDARLDALARKSGATYTRYADDLTFSFRDPPARLGRFLWWVNGILQQEGFAENVKKRRIMRKGGRQRVTGLVVAEKPAIPREDRRRFKAILANCRRHGVESQARGKPDFPAWLRGYAAYVRMVHPELGAKWQREVEEILLKK

SEQ ID NO: 6620 - protein, 474 aa, unidentified
  source 1..474: note = Polyangiaceae bacterium; note = Related to JADJXL010000015.1
MSLVGLLFELKPLLEDRERNFDRIVELLEKHRNLAEYEVARFYVSRNWLDPISKRLASIDPRERLRGVRLIPLLFARATAAQHLRRMVKDADMAVASAARAAVHSLGIADVAPPDRRAPPPRYPGPSALGGWNPSGWTFGLHRDHWAFRANRAKAKTPPKADVPPLKTPKDLAALLGVKVTALRSLSRPGTGPGSGYVEFEIPKRTGGVRRISAPRMPLKRVQRTILDQILAKLPAHPAAHGFVEERSTVSNASPHVGAAIVVRVDIENFFPTVHYRRVFGFFFQHYGEEVAKALSQLTTHRPKLPDGTVVWPGALPQGAPTSPAIANLVCRRLDARLAALAKKASANYTRYADDLTFSFRDPPDRLGRFLWWVNAILQQEGFTENVKKRRIMRKGNRMAVTGLVVNDKVGIPREDRRRFKAILNNCRHHGVESQARGKPDFAAWLRGYAAYARMVHPKLGEKWQREVEELLAK

SEQ ID NO: 6621 - protein, 468 aa, unidentified
  source 1..468: note = Related to NZ_CP079217.1; note = Polyangium sp.
MSLVSLLFELRPLLADPEANFERIVLLLERNQDLAEYEVARFYASRTWLGPLGRMMESIDPRERLRAVRLVPLLFARAPAAGHLRRLVKDADSRVVNAARAAVRKLGIADVAPPDSRFTAPRWPRATAVGGWNPTGWSFGLYRSGSEKSPPPATDLPALRSRADVARLVGVDEARLVALMRPGSGPGSGYVEFEIPKRSGGKRLISAPRAELKAVQRAILDKVLSKIPAHPAAHGFVEGRSTVSNAAPHVGTQRVVRVDIESFFPTVHYRRVKGLFEAYGYDEVVAATLAGLTTHRAKLPDGAVVWPGALPQGAPTSPAIANIVCRRLDGRLSALARKVGATYTRYADDLSFSFREPPARVGRFLWWVNAILQQEGFLENLPKRRVMRKGGKLRVTGLSVDEKVSIPREERRRFKAILANCRHHGVASQARGRPDFPRWLAGYAAYVRMVHPELGEKWQREVAELLAR

SEQ ID NO: 6622 - protein, 472 aa, unidentified
  source 1..472: note = Related to NZ_JAHNZT010000024.1; note = Citreicoccus inhibens
MNLVGLLLELKPLMMDPEASFDRIVELLEHNQGLAEYEVARFYVARAWKDAIESRVRSPDARERLRAARLIPLLLDRTSAARLLRRLVKDPDTRVSASARAAVRKLGLADVSPPDSREEPPSHPHPWAIGGWNPTGWSYGLFPETSKAVRKRPPPVTEALPPLRTREDVAKLLGLGTADLDALMRPGAESGSSYVEFEVPKRSGGVRRLSAPRPKLKAAQRALLEQVLARMPSHPAAHGFVPGRSTVTNAQPHVGATVVVRVDLEDFFPSVHFRRVKGLFEAHGYGEEVATALAGLTTYRAKLPDGTVAWPGVLPQGAPTSPAIANLVCRRMDARLAALAAKVGATYTRYADDLSFSFRQPPERLGRFFWWVNAILQQEGFAENGPKRRVMRQGGRQRVTGLTVNERVSIPRDERRRFKAILANCRKHGVDSQARGRPDFRRWLEGYAAYVRMVHPELGETWQREVKELLAT

SEQ ID NO: 6623 - protein, 472 aa, unidentified
  source 1..472: note = Related to NZ_JAAIXY010000002.1; note = Myxococcus eversor
MDLVSLLLELKPLMEDPEAHFSRITELLERHQGLAEYEVARFYVSRHWSEVVTKRLGSVDPRERIQAVRLIPLLFPRVTAAGHLRRRVKDADSRVASAARAAVRKLGLADVSLPDSREEPPRRPSPHALGGWNPTGWHFGLYPRRREDLVKRKPSVTAKLPKLQSRDDVAKLVGVDVAELDALMRPGSGAGSGYVEFETPKRSGGMRRICAPRAKLKAAQRNLLEGLLTHLPTHPAVHGFVPGRSTVTNAEVHVGAHVVVRVDLEDFFPTVHYRRVKGFFEAHGYNDEVSSTLAGLTTWRPKLPDGTVVWPGVLPQGAPTSPAIANLVCRRMDARLHALAKKAGASYTRYADDLSFSFVKPPERLGRFLWWVNAILQQEGFSENAAKRRVMRQGGRQRVTGLTVNQRVSIPREERRRFKAILANCRKHGVESQARGRPNFPAWLEGYAAYVRMVHPELGTRWQREVKELLNP

SEQ ID NO: 6624 - protein, 472 aa, unidentified
  source 1..472: note = Related to NC_020126.1; note = Myxococcus stipitatus
MDLVSLLLELKPLMEDPEANFQRITELLERHQGLAEYEVARFYVSRHWSETVSRRLGSVDPRERLEAVRLIPLLFPRVSAAGQLRRRVKDPDSRVGSCARAAVKKMGLADVSLPDSRIAPPRRPSPRAQGGWNPTGWNFGLFPGLRATPVKRKPADTPVLPELRTREDVAKLVGVEPSELEALMRPGSGPGAGYVEFETPKRSGGVRRICAPRARLKAAQRALLEGLLARMPTHEAVHGFVSGRSPVTNARAHVGNQVVVRVDVEDFFPSVHYRRVKGLFESHGYNEEVASTLAGLTTWRPRLPDGTVVWPGVLPQGAPTSPAIANLVCRRLDARLHALAKKAGGQYTRYADDLSFSFAKPPERMGRFLWWVNAILQQEGFAENSAKRRVMRQGGRQRVTGLTVNQQVAIPRDDRRRFKAILANCRKHGVESQARGRADFPAWLEGYAAYVRMVHPELGERWQREVKELLGR

SEQ ID NO: 6625 - protein, 348 aa, unidentified
  source 1..348: note = Related to JABBJJ010000521.1; note = Pyxidicoccus fallax
SHPHAMGGWNPTGWNFGLSPGMGGRVKRKPPSTGPLPVLHTREDVAKLVGVDAAELDALMRPGSESGSGYVEFEAPKRSGGVRRLCAPRAKLKAVQRAILDGILAHLPTHPAVHGFVAGRSTVTNAEPHVGSTVVVRVDVEDFFPTVHYRRVKGLFEAHGYGDEVSSVLAGLTTWRARLKDGTVAWPGVLPQGAPTSPAIANLVCRRMDARLTALAKRAGAKYTRYADDLTFSFREPPERLGRFLWWVNSILQQEGFAENAAKRRVMRQGGRQRVTGLTVNQQVSIPREERRRFKAILANCRQHGVESQARGRADFAEWLQGYAAYVRMVHPELGERWQREVKELLAR

SEQ ID NO: 6626 - protein, 471 aa, unidentified
  source 1..471: note = Related to NZ_JAAIXZ010000001.1; note = Pyxidicoccus trucidator
MDLVGLLLELKPLLASPEENFDRIVALLERHQGLAEYEVARFYVSRSWLEPVARRLKSVDPRERLQAVRLIPLLFARASAAGQLRRRVKDPDSRVSSHARASVRRLGLADVSLPDTRADPPRFPSATAVGGWNPTGWSFGLYPSMRAPVKRKPAATTALPVLKTRAEVAKLVGVPVSELDALMRPGSEAGSGYVEFDVPKRSGGVRRLCAPRAKLKAVQRAILDNVLAHLPTHPAVHGFVPGRSTVTNAKPHVGSTVVVRVDLEDFFPTVHYRRVKGLFEAHGYGDEVSSTLAGLTTWRPRLPDGTVAWPGVLPQGAPTSPAIANLVCRRMDARLTALAKKADATYTRYADDLSFSFQKPPERLGRFLWWVNAILQQEGFSENAAKRHVMRQGGRQRVTGLTVNEQVSIPREERRRFKAILANCRQHGVESQARGRPDFANWLQGYAAYVRMVHPELGERWQREVKELLAR

SEQ ID NO: 6627 - protein, 471 aa, unidentified
  source 1..471: note = Related to JAKCFI010000010.1; note = Myxococcus stipitatus
MDLAGLLLELQPLMAEPETHFERIVGLLEQHQGLAEYEVARFYVSRHWMDSASKRLGSADPRERLRAVRLIPLLFPRAIAAGQLRRRVKDADSRVAAAARAAVRKLGLADISPPDSRIEPPRHPGPRSLGGWNPTGWNFGLFPADGERVKRKPEVATRLPELRDRADVARLVGLDERELAALMRPGSEPGSSYVEFDVPKRSGGVRRLCAPRARLKAAQRALLDNLLTHLPTHPAAHGFVPERSTVTNAQPHTGANVVVRVDVEDFFPSVHYRRVKGLFEAYGYGAQVASTLAGLTTWRAKLPDGTVAWPGVLPQGAPTSPAIANLVCRRLDARLDALAKKAGARYTRYADDLTFSFPQPPERLGRFLWWVNAILQQEGFSENAPKRRVMRGGGRQRVTGLTVNQRVAIPREERRRFKAILANCRKHGVESQARGRPDFPAWLEGYAAYVRMVHPELGARWQREVKELLGR

SEQ ID NO: 6628 - protein, 467 aa, unidentified
  source 1..467: note = Related to JAACJQ010000343.1; note = Archangiaceae bacterium
MALAELLLDLKELLQKPDENADAIVKLLEQHADLAEFEVARAVAGRAVEVGVERRLKNVDPKERLAAVRSLSGLFPRAPAARLLRKMVKDPSRSVSAAARAGVRRLKLADVALPDSRWTPDRESPLVPGGWNPSGWWAGLFGRSSKPPPKVSLPKLSSRADVAKLVGVTEEELTAFMRPGSASGSGYVEFDVPKRSGGTRRIAAPRAKLRTAQRALLDQVLSKIPLHGAAHGFAIDRSVVTNAQLHVGASIVVKVDLEEFFPSVHYRRVRGLFEAYGYNTEVASTLAGLTTWRAKLPDGRVAWPGCLPQGAPTSPAIANIVCRRLDARLTALCARFGATYTRYADDLAFSFQKQPERLGRFLWWVNSICQQEGFSENDGKRRVMRSGGRRMVTGLVVNQKVSIPREDRRRFKAILHNVKKHGLESQARGREDFKSWLEGYASWVRMVHPELGAKWQREVKALTRGQG

SEQ ID NO: 6629 - protein, 473 aa, unidentified
  source 1..473: note = Myxococcales bacterium; note = Related to JAEUKG010000407.1
MGLGELLVDLSRLLADPAKNAASIYAMLEANAGLAEFEVARFYVADAMTADVAERLKSVDPRERVAAVDLVRLVCPRTSAAKLLRSVIKDPDPTVRKRARATVRRMMITDVALKDPRFKPSPWARGPFAPGAYNPSGWSFGVYGRKQTGSADRGALGAKGLPLLEGADDVARLVGLADGKALRRFMRPGSASGSGYVEFDVPKATGGARRIAAPRAPLRRAQRVILDQILAKVPAHDAAHGFVRGRSTVTNAEPHVGRAIVMKLDLVDFFPSVHYRRVVGLFEQLGYPTEAASALAGLCTWRPKLGDGAVAWPGVLPQGAPTSPAITNLVCRRLDARLSALAKKMGGVYTRYADDLTFSFPAEPERIGRFLWWVDQIALQEGFVENTKKRRVLRRSAQQRVTGVVVNEHPAIPRKDRRRIKAVLANVKKNGLAAEARGNPDFEAWLHGWVAYATMVQPALGARFAAALAGVAP

SEQ ID NO: 6630 - protein, 483 aa, unidentified
  source 1..483: note = Deltaproteobacteria bacterium; note = Related to JACCYD010000544.1
MHTLVDLLIELKTLATATGDANQLARINELFSNPRAPAEFQVGRHFVARLLVPQAEAAMASFDPADRLSAIETCRTVFPRSIAARLLRRVIKDPDPKVRSSAKRAASALRLDDVAPPDIRYRVERDSPLGRHNPTGWAFGIFPTDDHPQRKTKQATRQTALDAHQLPKLANVAAVAQLVGIDPDALVRMMRPGTEAGSGYVEFEIPKAKGGTRRIAAPRTPLRKVQRKILDDILAKLPLHDACHGFVVDRSTVTNATPHARAALVIKIDLKDFFPTVHYRRVKGLFQHLGYNEEVSATLAGLTTYRPKLPNGHVVWPGVLPQGAPTSPALANLVSRRLDQRLSKLAEKYGASYTRYADDLTFSFKTQPELRIGRFLWWVDGICQQEGFSERADKRRILRAKHQQRVTGLVVNQKVNVPREDRRRFRAILHNCAKHGLESQAGSLPPGADFKAYLAGYAAYVHMVDPKLGKQYLAQVAALIGKD

SEQ ID NO: 6631 - protein, 484 aa, unidentified
  source 1..484: note = Deltaproteobacteria bacterium; note = Related to JACCTC010000082.1
MQTLVELLLELKTLAAEPDGPGKLERINAMFANPRAPAELQVGRHYVSRLLVPGVAAQLASLDPAHRHIAITTARLVFPRATAARFLRRLVKDPDLTVRVAARRAVSKLGLHDVAPPDVRYQITSDSAIGGHNPTGWAFGIFPTDDGPRRKPKPATRATALAQHGLPALATRADVAALVGVDPQGLAKLMRPGVGPGSGYVEFEIAKAKGGTRRIAAPRGPLRKVQRVLLDRILAKVPLHDACHGFVPGRSTVTNAGPHQRAAIVVKLDLKDFFPTLHYRRVKGLFQHLGYNDDVAGTLAGLTTYRPKLESGLVVWPGMLPQGAPTSPALANLACRRLDHRLERLAAKYGARYTRYADDLTFSFATMPEVRIGRFLWWVDGICQQEGFTERDDKRRILRAKHQQRVTGLVVNERVNIPREDRRRFRAILHNCAKHGVASQTREHEDFPAYLAGYAAYVHMVDPVLGRRYLDEVARLLAQEPRRG

SEQ ID NO: 6632 - protein, 481 aa, unidentified
  source 1..481: note = Deltaproteobacteria bacterium; note = Related to JACCSS010001187.1
MIGTLVELLVELKTLVASSDKNKLDKVNKLFSNPKAPAEYQVGRHFVASKLEKDVEVQISDLDPRQRKAAVQTVMLAFPRSSAAKLLRRVAKDPDMTVRSAARHTIKTLALNDVAPPDIRYAPDMGVIGHGNPTGWAFGIFAHDWRSDRKPKKPSKVTALDAHKLPKLKSVADVAALVGIELDDLPALMRPGVGPGSGYVEFEIPKAKGGTRRIAAPRAPLRKVQRAILDQIVGKVPVHEACHGFVKTRSTVTNAAPHQGSAIVVKLDLKDFFPTVHYRRVRGLFEFLGYNAEVANVLAGLTTYRPKLDDGTILWPGVLPQGAPTSPAIANLACRRLDHRLDRLAAKYDATYTRYADDLTFSFKTSDLKLGRFLWWVDGICQQEGFNERPDKRRVLRSKHQQRVTGIVVNAGVHVPRVDKRQFRAMLHNCKKHGLESQARGKEDFEAYLRGYAAYVNMVDPPLGKKFIAQVEAVLGGTPGG

SEQ ID NO: 6633 - protein, 482 aa, unidentified
  source 1..482: note = Deltaproteobacteria bacterium; note = Related to JAHBVW010000051.1
MQTLVELLIELKSLADAPHDDGKLDRINKLFANPRAPAEYQVGRHYVSKLLAPSVEANLDSIDPAQRLAGIGTATAVFSRNVAARFLRRVVKDPDGRVRAAAAKAVKHLGLTDVAPPDVRYKIDPDSELGGHNPTGWAFGIHPNDKSRQRKPKKPSRVNALKELDLPRLAGVADVAKLVGVAEGELASLMRPGCGPGSGYVEFEIPKAKGGARRIAAPRTPLRKVQRAILDKVLAKIPLHEACHGFVPGRSTVTNARPHQGAAIVIKLDLKDFFPTVHYRRVRGLFESLGYNEKVASTLAGLTTYRPKIGDKTVVWPGVLPQGAPTSPALANLACRRLDKRLEMLAAKYEATYTRYADDLTFSFKKVPDFRIGRFLWWVDGICQQEGFTERAEKRRILRSKHQQRVTGLVVNKKVKVPRADRRRFRAILHNCAKHGLESQARGHADFPAYLAGYAAYVNMVDPALGRRLLDEVARLLGESRG

SEQ ID NO: 6634 - protein, 510 aa, unidentified
  source 1..510: note = Myxococcales bacterium; note = Related to JADJJK010000006.1
MTQAATSVLSPIELILTLRTLLADRASNATLIGELLERHQDMAEYQIARFYVARHLIPQVEALLSELDPRQRLAGIELVRFGFPRTLAGKLLRRVVKDPDIAVRKRARSTVKRLGLDDVAPPDTRYDARRSSLGRGNPAGWAFGLFRNHARSDWGRRPRPATRVAALGAQGLPPLASSSDLCKLLGVEASALVRFMRPGTQTGSAYVEFEIPKAKGGTRRIAAPRGPLRRVQRVLLDQILSKVPQHEAAHGFIAGRSTVSNARPHQGAALVVKTDLKDFFPSVHYRRVVGIFTMLGYGEPMARALAALTTYRPQLPADEPPPSDAAPSPSDAARPPEPARGRVLWPGVLPQGAPTSPALANLACRRLDVRLTRLAARYGATYTRYADDLTFSFPQPPQFAIGRFLWWVDGICQQEGFLEHPAKRKLLRKKTQQRVTGLVTNQEVHVPRADRRRFRALLHNCKKHGVASQAKGRDDFAAYLAGYAAYVQMVQPELGKAWAAEVARLLGESA

SEQ ID NO: 6635 - protein, 479 aa, unidentified
  source 1..479: note = Myxococcales bacterium; note = Related to JADKKI010000021.1
MNPVELILELRGLLADAQANGAKIRELIESHQDMAEYQIARFYAARHLVPQVEALISEIDPKQRLAGVELIRFGFPRTLAGKLLRRVVKDPDIEVRKRARSTVKHLGLEEIALPDTRYDGARSIRGKFNTTGWAFGLFAEHARRAWNRVPKKATQIAALGAQGLPVLASIADVQALLGVDAAGLARLMRPGTESGSAYVEFEIPKAKGGTRRIAAPRGPLRRAQRALLDQILAKVPQHPAAHGFVAGRSTVTNARPHVGAALVVKTDLKDFFPTVHYRRVIGLFELLGYNEAVAGVLAALTTYRPKLPDGRVVWPGVLPQGAPTSPALANLACRRLDARLTKLAAKYGAVYTRYADDLTFSFSESPKIAIGRFLWWVDGICQQEGFVEHPGKRKLLRAKTQQRITGLVINRAVHVPRADRRRFRALLHNCAKHGVASQAKGRENFAAYLAGYAAYVQMVQPELGKAWAAQVAKLLGEAP

SEQ ID NO: 6636 - protein, 489 aa, unidentified
  source 1..489: note = Myxococcales bacterium; note = Related to JAEUJZ010000173.1
MSLAALLVQLKPLLAAPQENLAAITELLRRHRDLAEYEVARFWVSRFLGPQLEKELRSPDPRVRRRGAEAVRYICTRKTAGHLLRPLIKEADTSVAVRARASMRVLKLDDVALPDSRYPAPKRGRGQLGGWNVTGWCFGLYPHMHRWWRRRGKPEEPTKKTLLEKHKLPKLTSESELRAWLGIQRKKDLLRLLRPGCGTGAPYVEFTIPKASGGSRTISAPRLPLKKLQRRILDEILAKLPVHAASHGFVRGRSVVSNAKPHLGAALVLKMDLRDFFPTIHFRRVVGLFQGIGYAADVAQILAGLCTHRGKLADGYVLWPGVLPQGAPTSPAIANLLCRRLDARLSGLAKQAGGVYTRYADDLTFSFSAVPDKGIGRFAWWVDQICQQEGFVENSAKRRVLQRHNQQRITGIVVNSALHIPRSARHTFRALLHNVRLDGLAAHARGRKDFRAYLLGFASYVRMVQPTLGRALLSDVRAVLKADRSAQKS

SEQ ID NO: 6637 - protein, 488 aa, unidentified
  source 1..488: note = Related to MTCS02000024.1; note = Haliangium sp.
MSLSALLLQLKPLLAAPRENLAAISDLLRRHRDLAEYEVARFWVSRAMGPQLEQELRSPDPRTRRKAAEAVRYACTRRSAGRLLRPLVKEADTGVAVRARTAMHALRLDDVALPDTRYPKPKHAGGFGGYNVTGWCFGLFPHMHRWWRKKANPNQAAKQTLLEKHGLPVLASEAELLSWLGLKRRKDLLRLLRPGCGTGAPYVEFSIPKASGGTRTISAPRASLKKIQRRILDEILAKLPTHAASHGFVRGRSVLSNAKPHVGASLVLKMDLRDFFPTIHFRRVCGLFCRIGYSSEVASLLAGLCTHRGKLADGYVVWPGVLPQGAPTSPAIANLLCRRLDARLTGLARGLGGNYTRYADDLTFSFKAVPERGIGRFSWWVDQVCQQEGFVENTGKRRVLRPQNQQRITGIVVNSGLNIPRAARHTFRALLHNVKHDGLAAQARGRKDLRAYLLGFASYVRMVQPKVGKPLLAEVRAVLKAAGQADKK

SEQ ID NO: 6638 - protein, 481 aa, unidentified
  source 1..481: note = Related to JAEUKH010000021.1; note = Myxococcales bacterium
MNLVNLLVTLRDALVDFEANRQKILTLLKTHQGLSEFEVARYFVAAEAAPRVHKYLASRDPRERRIGVECARFLLPPNDAAAVLRRALVDPDTSTRDRADRLLAQLERQEAPLRARRSTPEAELVDAWGPTGWRFGRLLRNPPARKKAKLAPVPRAVSAVLKSEETFLKAIEVDSVSALQPLYRAGDGPGAPYVRFEIAKRGGGVRAILAPRKALKGVQRALYEKVLSKLATHDAAHGFVPGRSVVTNARPHQGAVTILKVDLADYFPTLHYRRVQGYFARVLKANAKVATLIAGLTTHRDRLADGYVTRPGVMPQGAPTSPALANLVSRRLDERLDGLAKKVGLRYTRYADDLTFSWHEAPPTRQALARVLWWVSQIAREEGFALNERKTRVLRPHQQQLVTGVVVNAGLHVPRALKRTLRAMLHEARVKGVEVAARGRADFYNTLLGHAAWVNAVEPALGARLLAEVKALAAREGAAHV

SEQ ID NO: 6639 - protein, 488 aa, unidentified
  source 1..488: note = Deltaproteobacteria bacterium; note = Related to JACRDB010000065.1
MDLASLLVELKPLIADPDAHWGRIAELMEEHSGLAESEVARHWLAERLAPTLVARSRSRDPRDRLRAVEAARWALPARDLAGVLWRLAKDPFPKVRHRAVSLTRSEGLTDVALPDRLGRGAKPKARMDPFTKKISVVALRDGEAQRGWFLLDPDKVRSLRRGRKSPAKPDLPKLKNPADVATLLGCASDKDLVKLLRVGEGPGSPYVRFTIPKATGGERVITAPRPALKRVQRALLDKILAKLPAHPSAHGFVAERSVVTNATPHKGSALVVKMDIEDFFPTLHYRRVEGFFRQYYLGPVAKLLAGLTTHRTRLEDGYVVFPGELPQGAPTSPALANLLCRRMDARLTGLAAKVGARYTRYADDLTFSWPVDPEVPLGRFFWWVDQVLQQEGFAENAGKRRVLRPHQRQLVTGVVVNHTLHLPREVRRRFRAILHNCQKHGVESQARGREDFRDYLRGFASWAAMVDPAEGRRFQEEVRALLGAAVTP

SEQ ID NO: 6640 - protein, 489 aa, unidentified
  source 1..489: note = Related to JAEUKA010000036.1; note = Myxococcales bacterium
MSLSNLLLELIPLCESLDDNWEQVVSLLDAHQDLAEYEVARFYVSRFTSRTIQQLVRSDDPRQRVKSAHMVRLTCTQRQAGQFLRLLIKDPCARVRSAAHRAMRGLRLDDVALPDSRIKKPHPYRGQLLGGWNPSGWSYGLFGNMWSIRQYRKQSRKPKTTLADLGVPKLETRKDVLSWLKLGSIRDLRKLLRAGSGPGSPYVSFTIPKASGEPRTITAPRLTLRRVQRQILDELLSKLPTHTAAHGFVKKRSVVTNAKPHEGAQLVVKLDLKDFFPTISYHRIRGLLCRYGFSPEVADTLAGLTTHRAVLSDGYVVWPGVLPQGAPTSPVLANLICRRLDSRLSGLAKRMGARYTRYADDLTFSFAKGLDHKNDLGRFLWWVNQVCQQEGFAENVGKRKILRPSAQQRITGVVVNSGLSVPRAMRRTFRAILHNCRMHGLDSQARGRRDFRAYLLGYASYIQMVQPSLGKRVLAEVRALLTASDRPST

SEQ ID NO: 6641 - protein, 487 aa, unidentified
  source 1..487: note = Myxococcales bacterium; note = Related to JAEUKB010000029.1
MSLSSLLLELIPLCESLDDNWEKVLALLDAHKDLAEYEVARFYVSRLASRQLDQLVQSPDPRRRTQAAHFVRLCSTQRQAGRYLRVLVKDPNGRVRSAAHRSMRALRIDDVALPDGRFRPSPHRQALGGWNPTGWSYGLFGNMYFVRQQKGKQRKPKPTLSDLGVLKLQTRKDVLQWLQIPSLTDLRKLLRAGSGPGSPYVSFTIPKSSGEPRTITAPRMTLRKLQRKILDDLLSKLPTHAAAHGFVKKRSVLTNAKPHQGAKLLIKLDIKDFFPTISYYRVRGLLRGYGLSFEVCDTLAGLMTHRPVLSDGYVVWPGVLPQGAPTSPTLANLICMRLDARLSGLAKKVGARYTRYADDMTFSFASGMDNHSDVGRFLWWVNQICQQEGFAEHVSKRKVLRPSSQQRVTGIVVNSGLSVPRQLRRTFRAILHNCRTHGVASQARGRRNFRAYLLGYASYLRMVSPELGTRALTEVRALLGSDESSSS

SEQ ID NO: 6642 - protein, 492 aa, unidentified
  source 1..492: note = Related to JADZFZ010000500.1; note = Deltaproteobacteria bacterium
MDVATLVSALMPLLDDPVGNSARILKLLRDHRTLADYEVARFLVAKRTEPFVCELLQSQDPKSRRTAVRWVGLTFARAPAARVLRDATKDRAKMVRQAAFRATRELRLDDVALPDTTDHAAWVHEAPQQRRMNPFTGEEMVVRGSPPRAARQRGYDVSGWRFGLYPTVNRRRDPKPAFSALRSREDVERVLGVSRAQLSRMIRPGHGSGRPYVAFEIPKATGGVRTLHAPRPALKRVQRLILERLLAPLEVHAAAHGFVRGRSTITNAIPHVGARIVVKMDLIDFFPTIHFGRLVGLFQHYGASVDAARTLAAVVTYRPTLPDGRVSWPSVLPQGAPTSPVLSNLVCRRLDSRLTALAASVAAHYTRYADDLTFSFREEPTKGLGHFLWWVNQIIGQEGFRENLGKRRILRPTGQLRVTGLVTNSGLSVPRDARRRFRAILHDCRQRGVTAEATGHEEPRAYLLGFSAYVQMVQPATGAKLRAEVLALLARR

SEQ ID NO: 6643 - protein, 490 aa, unidentified
  source 1..490: note = Related to JABFRG010000829.1; note = Polyangiaceae bacterium
MDIATLVATLIPLLGDPEGNGDEIVRLLDRGRALADYEVVRFLVAKRTESFVRRLLEDPDPRVRRTGVRWVELTFARSPAAKSLRDATKDRAKVVRQAAFRATRALRLDDVALPDLRVPFRSLPGESRTAINPFTQKPMVLEASASRQRHRGFNPTGWRFGLYPVPRRPRRPSPELSALKSRRDVEVLLGVTGEELAPLLRPGAGRGCPYVAFEVPKASGGTRILHAPRAALKRLQRILLKQLLAPLELHPAAHGFVPGRSTVTNAAPHVGARILVKMDLVDFFPTVHFGRLVGLFEHYGCAREAAEVLATIVTFRPVLPGGRVAWPSVLPQGAPTSPVLSNLVCRRMDARLAALATKVGAVYTRYADDLTFSLREAPSQGLGHFLWWVNQIIGQEGFVENLRKRRVLRPAGQMRVTGIVTNTQLSIPREARRRFRAVLHDCERRGVSPETTGHEEPRAYLLGFAAYVAMVQPELGAKLRTKVRALLARP

SEQ ID NO: 6644 - protein, 490 aa, unidentified
  source 1..490: note = Polyangiaceae bacterium; note = Related to JACKEA010000006.1
MDVATLISKLYPLLDDPVANSSTILSLLRRGGGLAEYEVARSLVSKRTEPMVRQMLADPDPVVRRRAVRWVQLTFAYSPAVRIVRNAAKDRSRMVRSAAFRAARALRVTDVALPARRLAKVPATTQREGINPFTRERMVIAARSPSVREIRGYAPAGWHFGLFRARPPSRRPAPPLAALKGRQDVLELLGVSEQEVTRLLRPGSGPGTSYVAFEIPKASGGVRTLHAPKHVLKRLQRKIATELLDPIEPHAAAHGFVRGRSTVTNAQPHVNARLLVKMDIADFFPTVHYGRVVGLLEHHGAGKEAAKLLAAITTYRPKLPDGRVSWPSVLPQGAPTSPVLSNLVCRRLDARLTALAARLGATYTRYADDLTFSFQGDPEQGLGRFFWWVNQILHQEGFIENIGKRRVHRPSGQMRVTGLVTNQGLSVPREERRRFRAILHACEQRGVSSETTGHSEPRAYLLGFAAYVEMVQPEVGKKLRAQVKRLLAKS

SEQ ID NO: 6645 - protein, 486 aa, unidentified
  source 1..486: note = Myxococcales bacterium; note = Related to JAEUKI010000052.1
MDLAKLLFTIKPLLADPRANLAKIVELLEKHNDLAEYDVARFYVSKSVRPAIEEKLSSPDPRERTAATKSIPRLMGKSEGAALLRRVYKDASPTVRAAARSGVSMLGIEDVALPDSRFPAPRNNWQRQGGWNETGWAFGLADSRARKPNRRVPEDIASIRKVFKELQTSDDVAKKLGMKKAKELKALMRPGQQAGSGYVEFTVPKATGGLRTICAPRAPLKRVQRTILRELLAKVPTHDAAHGFINGRSVVSNARPHEGAKIVVKIDLKDFFPTVHFYRVAGTLRYLGMGEAAASTLAAIVTHRNKLPDGTVVMPGALPQGAPTSPAITNIVCRRLDARLDALSKKVGAKYTRYADDLTFSFRDEPEKGLGRFLWWVDQVIQQEGFVQNAPKRRILRGSNQQRITGVVVNDGLSVPRDARRRFRAMLENIRRTSVDEQARGKADFKAYLKGFASYVKMVQPEVGKKLLAEVHAVLAEDVRKRDAAK

SEQ ID NO: 6646 - protein, 480 aa, unidentified
  source 1..480: note = Related to JAGQIK010000067.1; note = Myxococcales bacterium
MNLPALLLELRPLVADIDKNWDRIVELLSTHKRLAEYEVARFFVARHVESRVTELLRSRDPQQRARGVKMLELAYPSTRAGKHLRHLVRDADVEVARDATEAVSNLDIDDVALPDFRLKPPRDPRHGWGGWNQSSWRFGFPLADWVRRKKRVGPKKLKLPKIADKAALFELLGIADEKHYKRLIRPGAQSGAPYVEFTVPKRSGGERIISAPRAELKRVQRTILDKILAKIPVHDAAHGFVPGRSTVTNAQPHVGASLVVKIDLTEFFPSIHFRRVYGLMGYYGYEHEVATALAALMTHRIKLDDGKRMVETGLVPQGAPTSPALANIVCRRLDARLSGLAQRAGARYTRYADDLTFSFADAPPDKGLGRFLWWVDAVCQQEGFVENAGKRRVLRPSHQQRVTGVVVNSQLSVPRSERRRFRAMLHNCRHKGIASQAKQHGRDEAEFRDYLTGFASYVKMVQPELGNKLAGEVADLLKGA

SEQ ID NO: 6647 - protein, 478 aa, unidentified
  source 1..478: note = Related to PVNK01000310.1; note = Enhygromyxa salina
MLLPNLILELRGLLDDPEAKLERIVERLRAHDDLAEYEVARHYVAKRLEPVIRAWLASPDPRVRVEAIAAVRQTFSKPAAAKVLRHLVKDATLSVRGAARRAVAELGLDDVALRNTTMREPRRSSWPGGWNPSGWQFGTGRNRGRPKLAPAPVRAGLPALADVDALAVWLGYEGAGELRRFMRPGSETGSPYVDFEIAKARGGQRTISAPRAPLRAIQRKIYAELLAKVPVHDAAHGFVVGRSTLTNAAPHVGAGLLIKTDIREFFPSIHYWRVRGLFFSLGYGEEVAWALAALCTRRPVIDPEGERRVAWPGLLPQGAPTSPALANLVCRRLDARLSGFAAKIGARYTRYADDLSFSIHDPGRAQGLEVGRVLWWIDQILQQEGFAEHPGKRQVLRPHRRQLVTGIVVNDHPTVPRDARRRFRAILHNVARRGLASEARGRDDFADYLRGFAAYVEMVQPELGARWVAEVDALLQSA

SEQ ID NO: 6648 - protein, 473 aa, unidentified
  source 1..473: note = Related to JABJWV010000001.1; note = Pseudenhygromyxa sp.
MLLADLILELRELLVDPRANFEVIIDRLAAHDDLAEYEVARQYVVPAIEGLIRERLDDPDPQVRVQAIVAVRQCFSRSAAAKLLRHLVKDANLSVRGAAREAVSSLGFDEVALPNADFNPRHQRWNLGGWYFGTGDWRRPGLAPQAVRAALPSLPDVAALASWLNIDDPAELRRFMRPGSDTGSPYIDFEIPKAKGGVRVISAPRAPLRAIQRKIYAELLAAIANHDAAHGFIAGRSTVSNAAPHVGARLVLKTDIREFFPTVHYWRVRGLFRWLGLGSVAGELAALCTRRPVVERNGQRMVVWPGVLPQGAPTSPAIANLVCRRLDARLQGLAERLDARYTRYADDLTFSFHGSDGGGEPGVAVGRVFWWIDQILQQEGFAEHAGKRQVLRPGGRQLVTGIVVNERQSVPRPVRRRFRAILHNCKRDGLASQAHGRDDFADYLRGFAAYVQMVQPQLGQRWVAEVEALLAGR

SEQ ID NO: 6649 - protein, 481 aa, unidentified
  source 1..481: note = Related to NZ_PVNL01000057.1; note = Enhygromyxa salina
MLLANLIFELRPLLDDPEANLRQIVARLRAHDDFAEYEVARHYVAGKLEGVIRSWLANPDPRVRAEAIEAVRQVFSRPAAAKLLRHLVKDATISVRGAARRAVDELGLDDVALRNTSLAVPRSPRGRGGFNPTGWEFGTGAHRGRPRLEPAATRAGLPTIPDLAALTSWLRIDADGLRRLMRPGGHTGAPYVDFEIPKARGGRRTISAPRAPLRAVQRQILAEILSKVPTHDAAHGFVPGRSTVTHATPHVGARLLLATDIRDFFPTIHYWRVRGLFFTLGYGEAVAGALAALCTRRDVINPEAEAPTRRVVWPGWMPQGAPTSPAISNLVCRRLDARLSGLAAKLGARYTRYADDLSFSFHDPELVERLEIGRAFWWIDQILQQEGFAEHLGKRQILRPHRRQLVTGLVVNDHLTVPRDARRRFRAILHNCKQRGVASEANGRDDFPDYLRGFAAYVHMVQPKLGARWVAEVDALLVDHA

SEQ ID NO: 6650 - protein, 496 aa, unidentified
  source 1..496: note = Related to NZ_ABCS01000168.1; note = Plesiocystis pacifica
MLLANLILELRPLLADPQANLPQITAKLREQEDFAEYEVARHYVAKKLEPTIRAWLDDPDPRVRLEAIAAVRRTFSKPAAAKVLRHLVKDAHLRVRGVAREVVFELGLDDVALRDTTFRVPRNPAGGGGWNPSGWHFGTGSHRGHPRLAPEAVRAGLPDLPDLPALLRWLSLDDEAALRRLMRPGSAAGAAYVDFEVPKKSGGTRLISAPRAPLRAVQRKLLADILAPVPCHDAAHGFVPGRSTVTHAAQHVGAKLLLQTDIRDFFPSIHFWRVRGLFFTLGYRGDVARALAALCTRRPVIAATRTDERRVVWPGVLPQGAPTSPALSNLACRRLDARLSGLAARLGARYSRYADDLSLSFHDDEALAKLDVGRAFWWIDQILQQEGFAEHPKKRRILRPHRRQQVTGIVVNEHLAIPRDERRRFRAMLHNCRAHGLDSQAKVWAQARGHDPEHEGLRADFLAYLRGYAAYGAMVQPKLGARWLAELDAMVQPDTP

SEQ ID NO: 6651 - protein, 454 aa, unidentified
  source 1..454: note = Related to JACSRE010000167.1; note = Myxococcus sp.
MNPVEAILELERLKATKPVDLAAVARVLEGVEGLAEEDIVGTVAFELISPRAVFTLLKSPEPSERLAGVELVARLGRLHAGSFLRHVVKDPDPRVASCARRHLTRLRLPEVGLPLPLPSFARAFARPSWTVAGWRFGAAPRFSDARYPVRADLSSAARAEAHLRVPLASLPSLRRYAEFTVPKRRGGVRSLAAPHLALKQVQRRLLDAVLSRLAVHRASTAFSSGSSVVTNAAAHVGRAMVIKLDLQDFFPSIHEERVRGLWGALGADRQVAHALARLTTYRPRLASGSLSTVAVLPQGAPTSPAIANLIARRLDARLAGLSKKWKASYTRYADDLTFSFAEEPRQVGRFLWWANAICQQEGFVENASKRRVMRATGRQQVTGLVVNQRVTLPRHVRRSFKAIIHNCERHGVASQARGRPDFEQWLLGFAAWAAVAQPDVGVDWLRRVKQVLGR

SEQ ID NO: 6652 - protein, 516 aa, unidentified
  source 1..516: note = Related to CP025958.1; note = Gemmata obscuriglobus
MSASQSAPAWLLLPLPANADADAILIATIEQYATSLPQEFKKLHDALDEVRALASYEPAVNRSNTLVWEKLETLLTAPEGTARIALIRYAREHMPERACARVLRRLAKDADMNVRRTVAKAIRKAKIQEVAIPAKKDGDWDPSGWLLPDEVSKVTRHKTGKRAQERSGVPALTKLAELRKLLGIKSTNQLGFFLLASDHKGGPYTTHKIPKRDGSDRQICAPKKQLKWVQKQILKHILSKVPPHPAAHGFVSGRSTVSNATPHVGAELVVKFDLKDFFPTVHYFRVMGLFASLGYPVGNCMFGTDDGANQIAPVLARLCCYTPDPKQWGSAALPQGAPTSPAISNLVCRRLDARLQGLAETNHGTYTRYADDLTFSFPKAEGMNLGRFRWWVDQVCQQEGFVVNQEKFRVIRDSQRQVVTGIVVNDAVRAPRELRREIRAILHNCETKDLESQAKRHPRFRGNVPAFSQYLRGIAAYLNMVQPEHGAALLRRVNELLGGPIEGDTPSQDQGKAGDA

SEQ ID NO: 6653 - protein, 515 aa, unidentified
  source 1..515: note = Related to NZ_JAGKQQ010000001.1; note = Gemmata sp.
MSAPRSAPAWLLLPLPANADTDAGLIATVEQYCATLPEAFKKLHDALDHVRALASYEPAVNRANVLIWEHLEALLSATEKKARLELIRYARDHFPERACSRVLRRFAKDPDMEVRRVVARAVRKAKIEEVAIPAQKDGDWNPTGWLLPSEGLKITRHKPGTRTQERSGVPILGKLKDVRKLLNIKSPNQLGFFLLASDHKNGPYTTHTIPKRDGSERKICAPKKQLKWVQKQILKHILSKVPPHPAAHGFVNGRSTVSNATPHVGAELIVKFDLKDFFPTIHYFRVMGLFASFGYQVDNCMFGTKDDAKQIAPVLARLCCYTPDPTQWGTATLPQGAPTSPAISNLVCRRLDARLMGLAKANKGTFTRYADDLTFSFPKAEGMNLGRFRWWVDQVCQREGFVVNQEKFRVIRDSQRQVVTGIVVNDALRVPRELRRELRAILHNCTTHDIESQAKRHPKFNGNVPAFTQYLRGIAAYLNMVQPEHGGALLRRVNELLGGPIEGADETPDVKAGDE

SEQ ID NO: 6654 - protein, 516 aa, unidentified
  source 1..516: note = Related to NZ_CP053452.2; note = Frigoriglobus tundricola
MSASPSPPAWLLLPLPANAAHDAALLASVEEHCTKLPRDFAKLQKALERVRYLASYEPAVNRANALVWEQFEALLSAPEGRDRIALVGYARNHMPVRALARVLRRLAKDPDMTVRGQIAYLIKRSKIREVALPAKKDGDWNPTGWMLPAERGRPSRITRHKTGKSVQARTGVPLLAKLAQLRALLNIKSPKQLGYFLLASDYKNGPYTTHVIPKRDGSDRKICAPKKQLKWVQKQILKHILSKVPPHPAAHGFVNGRSTVSNATPHVGAELVVKFDLKDFFPTVHFFRVMGLFASIGYPVGNCMFGTDDDSNQIAPVLARLCCYTPNPKLWGSATLPQGAPTSPAVSNLVCRRLDARLAGLAEANKGTYTRYADDLTFSFKSAEGMKLGRFRWWVDQVCQQEGFTVNQQKFRVIRSSQRQVVTGIVVNAGLRVPRELRRELRAIVHNCEKQGVESQAARHPNFGGNVGAFTQYLRGIAAYLNMVQPDHGAALLRRVNELLGPAADADDAEAKGGGA

SEQ ID NO: 6655 - protein, 515 aa, unidentified
  source 1..515: note = Related to JAIOPV010000289.1; note = Planctomycetes bacterium
MSATTRTGPEWLFRPLPANADHDDAVIKKVEQHCSKLPNEFLKLQKTLDDVRAFSSYEPCVNRANELVWEQFEALVTNPDGKCRRLLIGYATAHMPERAAARVLRRLAKDPDMEVRNHVSRALRKSKIREVALPHKKGGDWDTSGWLLQSEETKVTRHKPGKRTLEKNELPVLTNLAQLRKLLNIKSTNQLGYFLLASDNKDGPYTTHTIPKRDGSDRKICAPKKQLKWVQRQILKHILSKVPPHPAAHGFVNGRSTVSNAGPHVGAELVVKFDLKEFFPTVHYFRVIGLFASMGYPVGNCMFGTEDKSNQIAPVLARLCCYTPDPKKWGSAVLPQGAPTSPAISNLMCRRLDARLGGLAEANKGTYTRYADDLTFSFPKAEGLNLGRFRWWVDQVCQQEGFTINQQKFRVIRDSQRQVVTGIVVNDKLQVPRELRRELRAILHNCEKTSVEEQAKRHPRFTENVGAFSQYLRGIAAYLNMVQPEHGAALLKRVNDLIGKPEGETPPKEGEQSKN

SEQ ID NO: 6656 - protein, 509 aa, unidentified
  source 1..509: note = Related to LR594584.1; note = Gemmataceae bacterium
MSATHTGPEWLYRPLPANADFDPAALAKVEEHAAALPAAFAKLQTALDAVRALASYEPCANRANELVWERFEALVADPDGHHRAALLRYAVAHLPERAAARVLRRLAKDPDVSVRTRVARALRASKIREVALPHREANNWDTSGWVLRTEDTKVTRHKTGTRALEKAGLPVVTKLADLRKLLNIKSTNQLGYFLLATDAKDGPYTTYTIPKRDGTDRTICAPKKQLKWVQRQILDHILSKVPPHPAAHGFVPDRSTVTNAGPHVGAELVVKFDLKEFFPTVHYFRVIGLFASMGYPVGDCMFGTADTSNQVAPVLARLCCYTPDPKKWGTAVLPQGAPTSPAISNLMCRRLDARLAGLAEANTGVYTRYADDLTFSFKSADGLNLGRFRWWVDQVCHQEGFTVNQAKFRVIRDSQRQVVTGIVVNEKLQVPRELRRELRAILHNVEKTSVAEQAKRHPRFEGNAGAFAQYLRGVAAYLNMVQPEHGAALLKRVNELLGTGDADGDPTPS

SEQ ID NO: 6657 - protein, 521 aa, unidentified
  source 1..521: note = Related to JAIEMG010000136.1; note = Gemmataceae bacterium
MASVVAEIIRERWFQLQIRANAMNVIERAPAWLLRPLPVHAVADDKLNDRIDKLAAKLPESLPRLQAVLDGVQMYREYEPAVNRASAHVWNVLDQLFAADADSVRVSLLVFAEAHMVEPARARIYRRLVKDPSTKVRNRARRLVQRCDLHEVALPLQKDGDWDPTGWLRGVVDRRLSRHAQGKRVQERHDVPVIGTLAQLRKLLGIRSSRQLGYFLLASDADGGPYVRFTIPKRDGREREICAPKKQLRWVQRQILDKVLAQVPVHDAAHGFIVGRSIVTNASQHKGAEIILKFDLTDFFPTIHYYRVLGFFASLGYSVGNGRFGTNDSSKQVAPTLARLVCYTPDPQQWGDARLPQGAPTSPAISNLVCRRLDARLAGLAKRNEAVYTRYADDLTFSFRKATGDLGRFRWWVDQICHQEGFLVNQKKFHVIRASQRQLVTGIVVNDELHVPRDERRRFRAILHNCKTHGLDSQARGHAQFAEYLRGFASYIHMVQPDEGAELLQAVEELLGPETGEDGVP

SEQ ID NO: 6658 - protein, 495 aa, unidentified
  source 1..495: note = Related to LSTD01000300.1; note = Planctomycetaceae bacterium SCGC AG-212-F19
MADVLDVPEWLLRPLPANASADAKLHAEIGRLASNLPASLAEIAKALEAIKNYSEYDAAANWASAHVWQAVAKFSAADLPGVRVGLLKFAAAHMVAKAQAQICRRLAKDPAVAVRRRARKLVENAGFHEVALPDTADGPWDATGWLRGSATGVLSRHKQGTKIQAERGLPKLSTVGELRNLIGIKSERQLGWFLLATDAEDGPYVKFTIPKRDQTEREICAPKPQLRWVQRQILDKILAKVATHDAAHGFIPGRSIVTNAAPHTSAALILKFDLKDFFPTIHYYRVMGLFTSLGYTVGRAKFSAKDDAREVAPTLARLCCYTPDPHQWGSALVPQGAPTSPAISNIVCRRLDARLRGLAERNKGVYTRYADDLTFSFLKDEVELGRFRWWVDQICHQEGFFVNQAKFRVIRCSQRQVVTGIVVNDALRIPREERRRFRAIVHNCKKHGIEAQARGHKKFLDYLRGYASYINMVHPEEGAELLEEVEALAGPETGE

SEQ ID NO: 6659 - protein, 493 aa, unidentified
  source 1..493: note = Related to JAEUIF010000053.1; note = Planctomycetia bacterium
MDPLPAAPAWLLRPLPAHAVEDEKLHARIDKLCQRLPAGLAELGVALKAVEMYREYDAAANHASIHVWRLLDQFYSSPASVRSQLLNFARQHMVPQAQHRILRRLAKDPSLALRRSVRRLIERGAVREVALPLEADGDWDAQGWLRGNSLPLTRHRQGRQAQTDHGVPRLAKLADLRKLLDIRSAKQLGWFLLATDADNGPYTTFKIPKRSGSERLICAPKPQLRWVQRRILDKILAPVAPHNAAHGFIPERSTVTNAAVHTGAAVVLKFDLTDFFPTIHYFRVVGLFASLGYHVGDGRFSSDDDSKNVAPTLARLCCYTPDPQDWSAAKLPQGAPTSPAISNLCCRRLDARLQGLAERNGGKYTRYADDLTFSFEKPELALGRFRWWVDQICHQEGFFINQAKFRVIRASQRQVVTGIVVNDELRVPREERRRFRAVLHNCRQHGVKSQAKGHKRFKEYLRGFASYVHMVQPEEGAELLRQVDELLGAEGQS

SEQ ID NO: 6660 - protein, 475 aa, unidentified
  source 1..475: note = Related to JAGQQD010000096.1; note = Planctomycetaceae bacterium
MADSPVLSIPTWLLRPLPINSKRDSKLESQIEKLAKNLPGSLAQLTTELSKVKMFREYDSAANLASRHVWVSRYHFLNSSLDEDRKALLEFAQLHMTPTAKARIIRRLSKDPQMGVRRAVHRIIQKAPPYEVALPEARDGNWDASGWTRGVQPGRLMRVRRGQKKTQKEWGLPGLSTVKQLRTLLGIKSEKQLGYLLLATDEGGGPYTRFSIQKRNGSDREICAPKPQLLWVQRKILHEILDKVPLHESAHGFVRGRSTVTNATPHRGAAFVLKFDLENFFPTVHYYRVMGLFANLGYSMGNGRFEARDKSRQIAPVLARLCVFVEDPNAWGTGFMPQGAPTSPAISNLVCRGMDARLAGLAEQVGGVYTRYADDLTFSFPETSPVNVGRFRWWVDQICHQEGFFLNQSKFRVIRRSQRQTVTGIVVNDELRVPRRERRRFRAILHNCKAQGVESQARGNPAFRDYLRGFASYLN

SEQ ID NO: 6661 - protein, 506 aa, unidentified
  source 1..506: note = Related to NZ_CP042425.1; note = Limnoglobus roseus
MTDTPTWLLHALPANAVVDEKLNATLSALAAALADNRDKPLVTAGLLTEIQGHLAHAQPFAAYEAAVNGIAGQVWQLFEAVHQRQNRPAKLAFLNLVVRHLTPGALAQLCRRWAKDADPAIRRAVGRVIETGAIHEVALPATKDGAWSPAGWRKGTVEVDLSRHKVGTAVQEANSVPPLANLRQLRELLGIRSAKQLGYFLLASDKDDGPYTRFTVPKRGGGERVICAPKPQLKWVQRRIHERILSGVPLADAAHGFVPGRSIVSNAAAHVGAAVVVKFDLKDFFPTIHSYRMIGLFARMGYSVGTAKIATADESASVAPVLARLCSYTPDPRAWGKAHAPQGAPTSPAVSNLICRHLDARLGGLARKLGGVYTRYADDLTFSFAATGIDLGRFRWWVDQVCQQEGFVMNADKFRVIRRSQRQLVTGLVVNDGVRPTREQRRAFRAVLHNCRRNGVVTEARGDPRFSQYLRGFASYLHMVRSTEGADLVRQVAELLDPPGGGEDKP

SEQ ID NO: 6662 - protein, 521 aa, unidentified
  source 1..521: note = Deltaproteobacteria bacterium; note = Related to PCBK01000175.1
MREDTQSTSSVVLHEAELKNKLPIGATFDSALLEQISTLADQLPDSMSELYKVLSDIDMLVEFDAARVFVVRLVLARLRVLTHAEEKQRLALLDMARDYMTTDECVPVCRRFAKDPSAHVRGRVKTLIRTKKPKDVALPLEEGERWDASGWSKGINADPEQETSPLFKHERGSRIQRKHGVPEIETVKDLRTLLKIKSEKQLGYLLLSNELEDGSGPYTLFEIPKKDKSPRLICAPRQPLKGIQRRILDRILSGVPPHETAHGFVPGRSIVTNAAVHQSKEIVIKFDLENFFPSMHYYRVMGLFAQLGYDVGEGFFQSDDESEAIAPVLARLTTYTSNPKEWGRGYLPQGAPTSPYIANLICRGLDARLSGLARSLDGDYTRYADDMTFSFAELPRTKIGRFRWWVDQICQQEGFAVNQKKFRVVRRSQRQMVTGIVVNDTLRVPRKERRRFRAILHNCERYGLESQARGRKDFPAYLQGYASYINMVHPDEGRKFIEQVEHILQLDREGKLPIEKDPENG

SEQ ID NO: 6663 - protein, 489 aa, unidentified
  source 1..489: note = Planctomycetales bacterium; note = Related to JAGQPF010000642.1
MAATKSSIPAWAYRPLPLNAQPATELIQQLDKLEQGLPGSSWEILRLVGEQDGSATYEAVANRAMEIIWTHLDECIANDPHTVRQFAASHLPIRVRNRVLRRLAIHPSFSTRRSVRYQINESAVREVALPSAPDGEWNAEGWLLNSNSSTLMRPRKLKAPDPRLPKLKNVKAVMKELGIVSNRQLGWMLLATDEDGGPYHTFEIGKRNGKARKICAPCWQLRRVQQRILHNILDHLPPHPAAHGFVKGRSVVTNAAPHLGKPLLLKFDLLDFFPTIHYHRVIGLFASMGYGMTSPFFDTENRSRNVAPVLARLCTYTEDPRVFRDGTLPQGAPTSPAISNLICRRLDARLDGLARKHGAAYTRYADDLTFSFDQDEISVGRFRWWVDQICHQEGFLVHQAKFRAIRSSQRQSVTGVVVNERMRVPRDLRRRFRAILHNCRKRGVAAEARGDAGFPSYLLGMASYMYMVNPDEGGPVLDEVRKLLAEQGN

SEQ ID NO: 6664 - protein, 495 aa, unidentified
  source 1..495: note = Related to PBBL01000083.1; note = Myxococcales bacterium
MASHRDRYDDRPPLPVGAETNPEDLARVAELAARLPGSVSALSDFLQARDSYNDFDPTRLAANDAILARLGAFHLAAEGTHRQLLNYAQAYMAPSEVMAVCRMVLRGGSTRLRERCVDLLRGAQPDGLTLPARQGGAWDWTGLLRGVERGRLFAKQPSQRLLERNGLPQLTTVGELRAMLKLSSPELLGYLLLSTSGSGGPYATFTRPKRSGGERLICAPNPTLKQAQRAVLENILARVPVHDAAHGFVEGRSTVTNARAHLGRELLIKFDLRNFFPSITYYRVMGLFAHLGYYLEGGVFSSRDSSRAVAPTLARLTTYTPPGATWRASYTPQGAPTSPIISNLICRRLDARLYGLAARIGATYTRYADDLTFSMNALPESGLGRFRWWVDQICVQEGFFINHSKFRVIRKHQRQQVTGIVVNEALRVPREERRRFRAILHNCRTQGVESQARGRAGFREWLLGYASYMNMVNPTRGGQALAEVQALLAAEGPST

SEQ ID NO: 6665 - protein, 473 aa, unidentified
  source 1..473: note = Deltaproteobacteria bacterium CG2_30_63_29; note = Related to MNYG01000250.1
MHDEVLLGRVRSLVAALPGSLSELGACLAEVESFAEFDSAAVLAAQAFDARLDDLLRRPPKGLFEFMRSNLPVDQQLQVCRRLVKHPNLPTRRRAVTLLKRLRPDDVALPLSAKGEWNWRGWTRGTEPGRLFKHRRGVKRQAEVGVPQLKDLEALRRRLAIDSLKQLGWFMTATAGEGAPYCSFEIPKRSGGLRRIDAPRGQLRALQRTVLHEILSKVAVHEAAHGFVPGRSTLTNAAPHLGRKLVLKFDLRNFFPTISYWRVVGLLASLGYDVGTGLNVVEDSSRAVAPVLARLLTFRDDAKLFGAGYAPQGAPTSPAISNLVCRGLDGRLSGLAARIGGTYTRYADDLTFSMDAEPAGGLGRFRWWVDGICQQEGFLLNREKFRVLRASRRQQITGIVVNDSLRVPREVRRKVRAMVHNCQKNGVEAESKGDPGFVDRLRGLAAYIHMVHPEEGRPLLDAIKLFGEGGEDD

SEQ ID NO: 6666 - protein, 424 aa, unidentified
  source 1..424: note = Related to JADZDZ010000133.1; note = Candidatus Sumerlaeota bacterium
MLDKLLPYLQIFIPLSVILLFIAQFLEKRKNETRQAAPPRRIGERSASSRRPTRSFPPAPVNAGVNTTNPRCPNKRHAYIRAPRRPQSDPSAAARFGIPALMNRGDVAKWLGMSWKHLVWLCNLFHNWDRKGVGHYHAWKVPKRAGGERVITAPKPYLRAVQRKILADILSRIPIEPQAHGFARNRSTVTNASVHIQRPIVVKLDLVDFFPTITYRRVRGVFGTLGYSEEVSGVLARLCTIAPTDMLPLANDLRRSLLLRRRHLPQGAPTSPALSNLVCRRMDRRLAGLCAKFNAVYTRYADDLTFSGDEKFAAALGDFFDIACRIIALEGFRINWAKRRIMRKGARQLVTGVVVNRRTTLPRGERRHLRALLHHWRTKGDFTAPPHVENKVAWLGGKLAYFSMIDPAKGAPMLAQFKALARGR

SEQ ID NO: 6667 - protein, 435 aa, unidentified
  source 1..435: note = Related to VGYW01000017.1; note = Planctomycetes bacterium
MFQWSFRPLKYSAQESDVKPSPPPASRIPDSRFQITDCRLRSGESSAVNAFWIIGALIAAWLVLRWLTGRGTARPAGDPFVTKRNPKTGEPVPPGSGKGRERLRATATHRPQLLAENGLPNIARRDDLARALGITRGTLDWLAFPDDREQPPHYSAFAVPKRSGGYRVLYAPKPKLKAAQHWIRKEILSKTFAEDPAHGFVAGRSIHTNAQPHAGKDIVVTLDLDNFFPSVTYRRVRGIFQSLGYGEEVAIPLAMLCTVKPAEKVREFVGGQRHRMLPQGAPTSPALANLACRHLDLRLAGLAKKFGCTYTRYADDLTFSGDDTFRRSLKRFLKLLHQIIAKEGFKLKKGKTHFARRGARQEVTGLVVNDGPRVPRAYRRRLRAILHNARRGGLEAQNREKHPHFRQALRGRIEFVRSTHPDLAEKLIAELNAIG

SEQ ID NO: 6668 - protein, 388 aa, unidentified
  source 1..388: note = Planctomycetes bacterium; note = Related to VGYV01000061.1
MSVFWIVVALIAAWIVLRALTGRRTARVVGDPFVRMRNPKTGEPIPPGSGKGRMRLRATAAHRPELLAENGLPNLASREELAAALGIPRGTLDWLALPERKKEPPHYTAFAVPKRSGGYRVLYAPKAKLKAAQHWIRREILAKTFAEDPAHGFIAGRSIHTNAAPHTGKDIVVTLDLDNFFPSVTYRRVRGIFQSLGYGEEVAIPLAMLCTVKPAAKVREFVGGQRHRMLPQGAPTSPALANLACRHLDLRLAGLAAKFGCTYTRYADDLTFSGDAAFERSLKRFLPLLQKIVKAEGFKLKKDKTHLARRGARQKVTGLVVNDGPRVPRAYRRRLRAILHNARKTGLDAQNRDKHPHFAHALRGRIEFVRSTHPQLAAKLLAELRSLG

SEQ ID NO: 6669 - protein, 369 aa, unidentified
  source 1..369: note = Related to nan
MTERRAAMGFFDWLTRRLLGRGKPAAPPEERLGRKRLRATAAHRPDLLAQNGLPSLASRDDLAAALGISRGVLDWLAFPERKEEPPHYVAFAVPKRSGGYRVLYAPKAKLKAAQQWIRREILAKTFAEDPAHGFVAGRSIHTNAQPHAGKDIVITLDLQDFFPSITYRRVRGIFQSLGYGEEVAIPLAMLCTVKPAEKVREFIGGQRHRMLPQGAPTSPALANLACRHLDVRLAGLAAKFGCAYTRYADDLAFSGDATFERTLKRFLPLLHQIVKAEGFKLKKGKTHLARRGARQEVTGLVVNDGPRVPRAYRRQLRAILHNARKNGLEAQNREKHPHFAHALRGRIEFVRSTHPQLAARLLAELKALA

SEQ ID NO: 6670 - protein, 369 aa, unidentified
  source 1..369: note = Related to nan
MGFFDWLTRRLLGAGRPTPNRPEWAEVSEEAGRSKRLRATAAHRPQLLAQNGLPPLATRDDLARALGISRGALDWLAFPDKAKEPPHYSAFAVPKRSGGYRVLYAPKGRLKKAQQWVYREILAKVKPSAAAHGFAKGRSIHTNAAPHAGKDIVITLDLQHFFPTITYRRVRGIFQSLGYGEEVAIALAMLCTVRPAEKLRGLLGGQRHRMLPQGAPTSPALANLACRHLDARLAGLARKFGCTYTRYADDLTFSGDAAFERTLKRFLPLLHQVVKKEGFELQKGKTHFARRGARQEVTGLVVNDGPRVPRAYRRRLRAILHNARKTGLEAQNRDKHPHFAHALRGRIEFIRSTHPQLAVKLLAELKALR

SEQ ID NO: 6671 - protein, 370 aa, unidentified
  source 1..370: note = unidentified bacterium; note = Related to JABMQU010001270.1
MGFLDWLAGLFGGGPTESGGRSWGVFEPPPPRERRKKLRATAHHDPDRLAAQDLPSLRDCAELAGFLGISPNTLRWLTHVDEGDEPEHYVAFAVPKRSGDYRVLYAPKAKLKQAQRRVYDAILSRVPLPDAAHGFVPKRSILTNAEPHAEQYVVMNVDLQDFFPSITYRRVRGIFQALGYGEEAAIPLALLCTVKPAGKLLEYMGHVRHRQLPQGAPTSPALANLACRRLDARLGGLARAFGATYTRYADDLTFSGDDAFSDALGRFVRHARTIIADEGFRVNARKVHIARKGRRQQVTGLVVNDAPSVPRRYRRELRAILHNARTTGLDAQNRHNHPDFARHLRGRIAFVRTTHPGLADQLQRTLDSLL

SEQ ID NO: 6672 - protein, 355 aa, unidentified
  source 1..355: note = Related to JADFXM010000017.1; note = Candidatus Riflebacteria bacterium
MQTILWLLILLAFLKVVSNIKQRIRIFLNGDFNRLHKLGLPQIEDFSQLANFLKISETELNWLIDKSSANPQTGISRHYVLKEISKKNGKKRLLHIPKAKLKEVQWIILDKILNLLSYHPAAHAFCFRKSIVTNAENHLGKAIVIRADLKDFFHTIRTHRVRAIFRRLGYSYKVAYSLALLCTSRLPNSQKRALPQGAPTSPAISNLIAFSLDRRLTGLALKLGFTYTRYADDLIFSGNRKIVKALLKNLKKIVSSERFILNKEKLLIARAERRQKVTGITVNQKLSIPRNERKKMRAILHNSLKTGLEKQNLIQHPNFKEHLRGKLSFFKMVNPDQARPLIESFNKTVKKELAS

SEQ ID NO: 6673 - protein, 327 aa, unidentified
  source 1..327: note = Related to JACPCR010000136.1; note = Planctomycetes bacterium
MAAWLAITPAKLRWLAWPRSHAPHGVRKRYFGPPDPVQHYYEAVRIKPDGRKRYLGCPKRELKEVQRKILRGILEKLPPPPRAHAYCRGRSSLTNAREHVGHAVVVHLDLSHFFNSINVRRVVGLFAALGYPRPVAVTLGLLCTYQVHPEVGWEFFNRYRRVVHRGLPQGAPTSPALSNLICQRLDRRLSGLARRFHARYTRYADDLTFSGNRDFAKGLENFLKMARRIIAEERFVLSERKLRIARKGSRQCVTGIVVNDQPGVGRTQRRRLRAILHHCGRGRPEEQNRGKEENFRGYLQGWVSYVGMVNPAQGQKLQSALERVRWP

SEQ ID NO: 6674 - protein, 400 aa, unidentified
  source 1..400: note = Planctomycetes bacterium; note = Related to SOJX01000071.1
MVKYRSPPFFYEGNVGFLKWLKNVLFGGGEEERFKSFEKEIYIERVSYRGAGKKEVSRPRRNVRASEKIPPGGDRKLLNELGIPILAGNPDIARRLGVSTGELCWLAFPKRFDTVDHYREFHIPKLNGGERRILAPKKKLKAAQRWILKNILTAERVRGLVHENVHGFRRGKSVATNARPHVGAEVVVHLDLTDFFETITLPRVRGIFRKLGYSHVAATTLAILCTVYIGRVDETKTGSRKQVLPQGAPTSPAITNLVCNKLDRRLAGLARRYGVKYTRYADDITFSGGKSFCNALRRFLPTVRRIIREERFTINEKKVHVARKGARQSVTGIVVNQQMNIPRSERRRYRAILHQLRKIPPGTEKPKKLNAHLSGVAAYLSMINPEAGRKMHEEVKSVFN

SEQ ID NO: 6675 - protein, 347 aa, unidentified
  source 1..347: note = Planctomycetes bacterium; note = Related to JACRIJ010000080.1
MGLISDFFKNLFGSPVENKGGENEPTQKSAGNDSGPSELTRLEMNRLPLIAGRAELLQELQISDKELDWFVKHPEWHYTVVSIPKKSGGARTIYAPKKRMKRIQRWILSEILSKARVEGSAHGFAKGRSITTNAFPHTGTEIIVNIDLENFFDSVKLWRVYCAFRNFGYSGELSSIFARLCCVKGALRQGLPTSPALTNVVCAMLDRRLNGLAVKFGCTYTRYADDMTFSGDLKFKASLSRFIPILKKIIRGEKFKINRSKMRITRKGSQQKVTGLVVNEKVNIPREKMRLWRAIIHNCRIKGLESQNRDKHKHFAAHLKGLVSFAAQVAPAKSERMREELSQVTKP

SEQ ID NO: 6676 - protein, 348 aa, unidentified
  source 1..348: note = Planctomycetes bacterium; note = Related to WSZJ01000110.1
MGFFDFLKDLFNPVKGGTGGPKPAGNSPARALAPRKTYASPGGPRPLAPGLPQLPTPASLAALLRIAPEKLAWLAKEKGRHYATWKIPKAKGHRTIEAPKKQLRAAQRAIHREILSKVAPNAAAHGFCTGRSPRTNAEPHVFRKLVVKLDLRDFFWQVKRNRVAGQFRALGFPPDVAAILWRICCHRGRLPQGAPTSPALTNIVCRRLDARLSGLAKKYKARYTRYADDLTFSFDAPNLAVQEPLRAIRTILSEEGFSLAREKTRFLRRMSRQTVTGITVNSKLSPSREEVRSLRALLHEARTKGPKVANRNQEEAFGARVRGRIEAVRAIDKSKGEKLLADYRRVAW

SEQ ID NO: 6677 - protein, 340 aa, unidentified
  source 1..340: note = Planctomycetia bacterium; note = Related to JADLHC010000024.1
MGLFDFLKDLFNPVKGPPPGKGGPPVSRPGSGGRPVRPLAAGLPPARDTGELAAILRTTPEKVAWLVRETGRHYATWQVPKAHGRRTIEAPKKQLRGVQRAIHREILSRVSPAEAAHGFRKGRSPRTNASPHVAKEMVIKLDLRDFFWQVTRNRVAGLFRSLGYPEDVALVLWRLCCHKGRLPQGAPTSPAITNLVCRRLDARLAAAIRSMNGDYTRYADDLTFSFREARLPMPRLARFLRRIISDEGFRVAPEKTRFLRRSSRQAVTGLTVNAKLSPPRREVRALRALLHEARLRGPEAANRDHLKGFSAVVRGRIEAVRAIDRAKGEKLLAEYRRVSW

SEQ ID NO: 6678 - protein, 342 aa, unidentified
  source 1..342: note = Planctomycetes bacterium; note = Related to JACPRD010000106.1
MGLFDFLRDLFRPVKRPAPDPPPPAGAKAKGPPNRGASPPPAGLPPIESLAVLAGRLGIPQKDLAWLMKPRAKHYHTHEIPKADGRVRKIESPKSRLKKAQRWILREILDRVPAAPAAHGFVKGRSPATNAAPHAFKAIVAKLDLRDFFWQVTLRRARGIFEALGYSGDVAKALARLSCRDGRLPQGAPTSPALTNLACRRLDRRLEALARAFGASYTRYADDITISHRTGCAPLDRLLAWTKTILREEGFHLAPEKTRIVRRGSRQTVTGLTVNARVSPPRGTVRALRALLHEAKTKGAAAANRDGLPHFAAHVRGRVEAVRAVDRAKGEKLLAAWRSVNW

SEQ ID NO: 6679 - protein, 412 aa, unidentified
  source 1..412: note = Planctomycetes bacterium; note = Related to JAFGQW010000342.1
MSLKRWFGRWLATAEHRLERQRAEKRRAGPPPWRYPDPFTGELITPPDDGDRDRLAAAGLPVLSTLEDLSRATGLSWQRLLWLAAPSSAYAGGSPHYTFFTVPKARGEPRIILAPKPALKSVQRWILRNILNRIPLADPVHGFRRGHGTRTNARVHCGKDVVATFDLEDFFHTVTYRRVRGLFRSLGYSTELSVLLGLLTTFRPAAFPYDYMRHVPTLVWLKSMSTARRSWRGHPTTPPFLPQGAPTSPALSNLVARHLDRRLAGLARRLGAAYTRYADDLTFSGHAEFRHGLARFLPLVKRIVREEGFYLATGKQRIRRKGGRQVVTGVVVNRRTNVPRETYRHLRVLLHKAAVHGPESVRLEPAAPTDPGVLRPHLEGWVAWVSHLNPARGARLRRTFEAIAWPAPSGEA

SEQ ID NO: 6680 - protein, 322 aa, unidentified
  source 1..322: note = Planctomycetes bacterium; note = Related to JACPRC010000174.1
MLGITLRDLAWLASAAPLSPPHYVLAVRKKRNGGKRLILMPKKRIKAVQREIHRRILSRHAPSPWAHGFATGRSIRTNAAPHVGKEVVAKFDLREFFHSITFPRVRGLLRQLGYAPDVARTIALLCTFHPGRIRERMRPGGVSYADLAAAFRAPGRYGFRRILPQGAPTSPALANLAARGLDRRLAALAKRFRADYTRYADDLTFSGGAEFHRDLPRFIPLLRSIVRDEGYFLAREKTRVIRRGNCQRVTGLVVNEKPNVPRGTYRELKAILHNCVTKGPESQNRAKVRDFRAHLAGRIAFVKSVHLRHGMRLEETFSRIRW

SEQ ID NO: 6681 - protein, 402 aa, unidentified
  source 1..402: note = Deltaproteobacteria bacterium; note = Related to JAFDLY010000161.1
MDDGYQFKNKRVFLENLRRINQRAGVEPEIIDLIEVRFWGNRIEINDKELQGFLHKNPHLDQRVLNFLASYFLEMKRRGLRCIFTPSHLAHLLEISLKRLHWLADDKRSHYTCFSVKKRGGGVREVFAPKPNLKAVQRQILDDLLHRVRLNSHAEGFRKRRSILTNAKRHVGKKVVIKMDVKDFFPSITFERVLGMFVSLGYPRQVAVLLTRLVTHNGKLPIGAPTSPAISNIVSRRLDRRFSRLGEKAGFDYSRYADDITISSNNKGVNRMIPFFKEILREEGFEANEAKMRILRSGGRQKITGIVVNKKPNLDKHEIRKLRAVIYNCSHKDLRQEAKRWAENEKGLTNPSSYGLREFRSSLKGKVNFVRMVNPETGKRLIEALDYKGSSFFQTPPKAEVI

SEQ ID NO: 6682 - protein, 406 aa, unidentified
  source 1..406: note = Related to QMMZ01000129.1; note = Deltaproteobacteria bacterium
MEQKMDHRYLCNNKEKFIKNLRLFNQRVEVEPEIVDLIEAYARLRLDQGKEIRYYGNRISSKNKELQEFLDKNRHLDHRILNFLASYFLEMQKRSFRCVFTSSHLAHFLKISTKRLNWLANDRIKHYTCFNIKKRDGNKREIFAPMPYLKGVQRKILDDLLQRVGLNSHAEGFRKRRSILTNARRHIGKKVVIKMDVKDFFPSITFKRILGMFISLGYPRQVSLLLTRLVTHNGRLPIGAPTSPAIANIVSTRLDKRFSRLGDKMGFDYSRYADDITVSSDNRGINKMIPFFKEIIREEGFEINETKMRVLRNAGRQKITGIVVNEKPNIDKKEIKKLRAVIYNCHHKDIKHEVKKWAKKEKSLNNPSDYTLSEFKSSLLGKINFVKMVNPKIGNRLLKQLGQLSI

SEQ ID NO: 6683 - protein, 404 aa, unidentified
  source 1..404: note = Deltaproteobacteria bacterium; note = Related to JAFDLJ010000099.1
MYDRRLCENKDVFINNLRATNERAEVEPDIVDLVEAYARLRLDQDNELRFYDNKIWINDKELEQFLDKNRYVDHRVLNFLASYFLEMKKRGLKCILNSSHLAHILRVPRKKVNWLANDRADHYVCFHTKKRDGSKREIFAPKPYIKKVQRQILDELLHRVRLNFRAEGFRKKRSVVTNARRHISKEVVIKMDVRDFFPSINFKRVLGMFVSLGYPRQTSLLLTRLVTHNGRLPIGAPTSPAISNIICRRMDKRFSKLGRKMEFEYSRYADDITISSNNKKITGMIPFFKEIMGEEGFVVNEAKMRILRSGSRQKITGVVVNKKSNIAREEIKKLRAVIYNCGHKDIKQEMIKWARNEKKLANPYGYTLSQFKLSLLGRIGFVKMVNPGIGNKLLQQFDTLSLNA

SEQ ID NO: 6684 - protein, 415 aa, unidentified
  source 1..415: note = Related to JACNHB010001573.1; note = Deltaproteobacteria bacterium
RQKMAGGLHCKDKESFIKHLRIINQRAGVEPDIIDLIEAYAGLRLNQDEEVRFFDNAVNIKHIKDKEIKEFFDKNRRLDHRILNFLASYFIEMKKRGLKCILNSSHLVHLLELSINEINWLANDGKNHYRHFTRKKRDGGTRDIFTPRARLKEVQRHILDDFLHRVRLNSHAQGFRRKRSIITNAARHIDKNIVIKMDAKEFFPSITFQRVSGMFASLGYPRQVSVLLTKLVTHRGRLPIGAPTSPAISNIVCRRMDKRFARLGEKMGFDYSRYADDLTISSNNKKLTKMIPFFKEIMRDEGFEVKEAKMRILRNSGRQKVTGIVVNKKRNIERKEIKKLRAVIHNCKHKDIRQEAITWAKREKKLDDPYAYTLREFKSSLLGKINFVKSVNPEMGGKLFQQVTALQFPEPRKMG

SEQ ID NO: 6685 - protein, 404 aa, unidentified
  source 1..404: note = Desulfobacterales bacterium; note = Related to JAFGES010000121.1
MIDKTLAGKKQECIKNIRFINQRAEVEPEILDLIEAYAGLRLEEDNEVLFYGNKITGKNRELNEFIDKNRHLDPRALNFLASYFLEMKKRGLKCIFSSSHLSHFLKISTKKLNWLASDKEDHYISFSEKKRGGGIRQIFAPKSTLKGIQRQILDFLLQSVPLNSHAEGFRKKRSIVTNAKRHIGKKVVIKIDAKNFFPSITFERVLGMFVSLGYPRKVSLMLAKLTTHQGRLPTGAPTSPAISNLISRRLDKRLAGLGEKMGFDYSRYADDMTISSNNKNASRMIPFFKEIIREEGFESNEAKLRILRSGGRQKITGIVVNQKVNVDRKQIKKLRATIYNCRHKDIKQEMIKWAKKEKNLKNPYGYTLKEFRASLLGKINFVKSVNAKAGKKLLKQLDELSLKT

SEQ ID NO: 6686 - protein, 402 aa, unidentified
  source 1..402: note = Related to JAIOSW010000149.1; note = Desulfobacula sp.
MDKKKSCGNKKQYLKNLRLINQRANVDPEIIDLIEAYARLRLDYDKEICFYSNKTSSDKLELNKMLAKNRHLDPRCLFFLKAYFIAMKNKGLTCLINSAHLAHLLNVSIDHLIWLSNDKSNQYTRFHIKKSSGAKREILAPKPKLKIVQRQILDNILQKIQLNSHAEGFRKKRSILTNAKRHIGKKVVIKMDVKNFFPSITFKRVLGLFIALGYPHQVSMTLTKLMTHDGKLPTGAPTSPAISNILSTKLDKRFANLGEKTDFDYSRYADDISISSNNRNITRMIPFFKKIVQEEGFEINEAKMRILRNGGRQKIAGIVVNQKLNIEKREIKKIRAVLFNCRNKDINQEIKKWAQKEKGLKASLFYTIDEFKSSMLGKINFIKMVNPQTGQNLLDQLNDLNA

SEQ ID NO: 6687 - protein, 407 aa, unidentified
  source 1..407: note = Related to VMSU01000220.1; note = Desulfobulbaceae bacterium
MALCTKQETYLNNLKTINTQAGVEPDLVDIIVAYARLRLERNLAITFYQEGIEKKTTKYPSLRTIIDKNQEADPRALNFLAAYYLEMDRRNLLCIFNRQHLAVTLGVSISNLEKQASTASSKYSHFFAPKKSGGQREILAPHPELKALQRKILDSLLDKVPLNAHAEGFRRKRSIVTNAQRHPDKKIVIKIDIKDFFPSTTANRVFGMFAALGYPKNIAAILTDLTTYQGRLATGAPTSPAISNILCRRLDKRFARLGQANDFSYSRYADDLTISSNHPKVTTMIPFFRQIVSEEGYTVNEKKLRIMRSGSRQQVTGIVVNQKLNIPRHEIRKLRAVIHNCKQKSLKVEIHKWAKLEKNHPNPTLYTEDDFEKSLSAKIHFVKMVNPSAGTKLLVDFKSLGLRTVVA

SEQ ID NO: 6688 - protein, 404 aa, unidentified
  source 1..404: note = Related to JADGBM010000020.1; note = Desulfobulbaceae bacterium
MALCREKEQYLKNLRLVNLRADVDPELVDLLVAYAGMRLENNRDVNFFQDDVKERAGKHPYLLRFLQKNKETDPRALNFLVSYFLELKTRGIPCVFNRQHLADTLGISLVAMDELAQNSPKYYTRFSAAKKNGAQREILAPKAELKTVQRKILDFLLIKVPLNNHAEGFRKNRSIVTNAQRHTDKKVLIKMDIKDFFPSTKAKRVFGMFFSLGYPEGVASTLTNLTTFKGRLATGAPTSPAISNVLCRRLDKRFARLGEKCDFSYSRYADDLTVSSNNTNLAGLLPLFKEIVLEEGYELNENKLRIMRSGSRQKVTGVVVNIKPNIDKNEIRKLRAVVYNCRHKDINKEIYKWAQMEKSHPEPSQYTLDTFKRSVSAKINFVKMVNHKAGEKLLADFKALSWPG

SEQ ID NO: 6689 - protein, 438 aa, unidentified
  source 1..438: note = Related to nan
MPNLASHVPVLSQVRDNSIKCPGIIFFPKNNLKIMTECTEHSIFLRNLVEVNQRAGVDSEVLDLIESYARLRLGRNREVDFYNCSRPVSEKDQDLRAFLEKNKNLDERTRNFLVAYYQELKDRHLCCIFSSDHLAHLLQTSLPRLHALTRDSRNYHVFTIKKSSGADRIIQAPHKQLKTVQRKILSTILHPVPLNKYAEGFRKKRSILTNATHHVNKKVIVKLDIKDFFPSIDSNRVFGMYLHLGYPRRVAQLLTDLSTVQKKLPTGAPTSPTIANIISRRLDKRFVRLGMKTDFTYSRYADDITISSDTDNILKMIPFFKEIIHDEGFTVNEGKIRILRSGSRQSVTGVVVNEKPNIKRREIKKLRAVLHNSKRGSLHKQAAIWAMREKGLKNYRSYSVVDFYQSLLAKIHFVRMINEKAGNTLLADFYRIPWPVIT

SEQ ID NO: 6690 - protein, 319 aa, unidentified
  source 1..319: note = Desulfobacteraceae bacterium 4484_190.1; note = Related to MVDA01000360.1
MEMKNAGLTCLFTCSHLSHILDVPLKRLRFLARDNGSYYKFSIPKANGTKRVIMAPKPDLKVVQRKINHLILQKVRLNNRAEGFRKKRSIVTNSLHHLQKKVVVKMDIRDFFPSIDFERVFGVFCSLGYPRGVSLLLTDLSTCQRVLPTGAPTSPAISNIICRKLDKRLVLLCEKSGFEYSRYADDITVSGNSEQVVKMIPLYRRIIVDEGFKVNEEKLRITRSGRRQKVTGIIVNRKMNIDRREIRKLRAVLNNCRHGSIEEQADMWASREKKCTAPFNYPVEKFKKSLHARISFVKMVNPQMGHRLLDEFHSVFSAG

SEQ ID NO: 6691 - protein, 404 aa, unidentified
  source 1..404: note = candidate division NC10 bacterium; note = Related to PQAM01000010.1
MARWDEDKEAFIRNLIQVNLRAGVEPELVDLLAAYARIRLQQGDKVTFYSEDADLPGSRRKAVRALLEANRHLDPRALSFLSTYAEAMVQRGLIPILTRTHLAKLLEVSENELSDLATCTDRYYDVFSIPKANGQRRKIQAPRPPLKEIQQRIAALLERVKLHPDAHGFRGERSILTNARLHLDRQVVINLDVKDFFPSITFERVLGCLGSLGYPHGVALLLTQLTTYHDVIPTGAPTSPILSNLICRRLDLRLSRLGDQLNFRYSRYADDMTISSEDGGIVRRLPFFKEIIREEGFEVHEEKIRVMRKGSRQQVTGVIVNEKPNLPRQELKKLRAVIHNCLTADLETQRIRWALTEKGLQDPDGFAMEAFRRSLCGRVSLARMVNPRAGVQLLDMLKRVEWRI

SEQ ID NO: 6692 - protein, 391 aa, unidentified
  source 1..391: note = Related to JAAYUU010000189.1; note = Deltaproteobacteria bacterium
MECSHEEFVSNLVEINQRAGTAPELIDLLGAYTRLCLKRSKEIEFYSDSLTLSTNKAAIRKFISQNRHIDPRSLSFLVSYAEMMLDRNLPFIFNIAHLARFLDLDKENLLRLIQNKESYYHSFYIPKSHGGKRHICAPKAELKAIQKGILTEILEKVFVHPCANGFRRGRSIVSNAQNHVGQEIIIKMDIKDFFPSITFARVKGVYLDLGYPEGTAEALTELSTYKGRLPMGAPTSPYLSNIVSSRMDRRFAGLAQKMDFHYSRYADDLAFSSNDPTFNRWIPFFRHIIEDEGFEVNEKKVAIARKGGRQKLTGVVVNRKINTQRDEYKRLRAVIHNCLNGDIQEQMKRWGVSELDRFKNSLRGRISFVRMVNREKGNKLLSGFERISWPA

SEQ ID NO: 6693 - protein, 391 aa, unidentified
  source 1..391: note = Related to JACQXB010000006.1; note = Nitrospirae bacterium
MKCSDEQFISNLIELNEKAKVAPDLIDIITAYARLCQRYGKEVKFYDKNPAISTNKPTIKDFIDKNPHLDKRSLSFLVSYAEMMRKRGLPFIFNITHLANFLEVEDVRLKQLIKYKEKSYHNFYIPKSNGGKRLISAPTDHLKTIQRKILKDILERVSLHPSANGFRIGRSVTTNAEKHTGQEVVIKIDIKDFFPSITNQRIKGIYVNLGYPDGVAETLTGLSTYKGRLPMGAPTSPYLANIVATRLDRRFANLSKKIDFVYSRYADDLAFSSKDKTFARSIPFFKKIIQDEGFEVNEEKVVIARKGGQQKVTGVVVNRKVNIEQKEYKRLRAVVHNCVNGDLREEMKKWGASSLNEFKSTFLGHINFVKMLNNEKGYRLLDGFRQISWPV

SEQ ID NO: 6694 - protein, 376 aa, unidentified
  source 1..376: note = Bacteroidetes bacterium RIFCSPHIGHO2_02_FULL_44_7; note = Related to MEOY01001140.1
MANCPDERFISNLIELNKRADVDPEIIDLVAAYARLCLKDGKELNFYKEYLALSTNKPTIQRFIEKNASLDKRSLSFLVSYAEMMRKKRLPFLFNRAHLAIFLGTKEGEIEAIIQNKESYYHTFFIPKRNGDERRITAPKDRLKEIQKTILRKILEKVSVHFAARGFKRRSSIISNAHGHIGQEILVKMDIKDFFPSITYERVKGIFINLGYPEGVAEALTELTTYKGRLPMGASTSPYLSNIIAIRMDKRFTGLAKKMDFTYSRYADDLAFSSKDGNLKRHIPFFKEIIKDEGFEVNEQKVVIARKGGQQKVTGVVVNRKVNVEKREYKRLRAVIHNCKKGNLKTEMAKWGASNPGEYELPRSKLTGYQKNVNCC

SEQ ID NO: 6695 - protein, 880 aa, unidentified
  source 1..880: note = unidentified bacterium; note = Related to JABMMJ010000725.1
MKKEKQATRTLSNPIQNDVLKNRLQSIFRSFRKADRTDIKSVEDALDRLQFLAFPEFYQACLFLLCIECERCVEANVPPSVIRAERIVQAVEAKAAAGMQGRLAYWINQKLTTSYPLGLVQRLTAYSHKINESRNTQCITLVDAGRHEEALAVAESIEDTEQQSKALCAIAADFARLSQKETADPLFKRALDLIEIFYAYTFEDADESGYGGDYDEYLQVKGKCTRYMVGKMAEIGWFKRAEELSNNIEDEWLRSEAFCNIAKDLAASGHLSESFEAAARSGPHQSIALGCIAETIAKSGNFFQALNVFSKANDLAAEQQGLWKSKCLLSVAAGLVIIGTKNKARKVAEQASEVIIDSIKFYEDDVNQPADMRIRFVMDLMEVGGFETGIKVQIEPIHETLDLLAQYKSWFRVLDRIFSSGSIDALLFKCYLNGFASSAVFGNNRALMMRLIREACHMVSSDEKPEVFLALSNELALLGINDMRDDAIVRAIVAGSDHLRMQREEYIKNPTPSLPDNQPHAEEPLIPEEWPQENTRISNILGISVEMLRLVRLKVIRAQGYDAFRIPKRRKGFRVIHSPHSDLAHIQRRIKECILDPAPGLPSCVTAFRPGVSIRDNAMVHCDKAVVVKFDLEDFFPSISFTRVMGIFHSLGFPTNEARMLANLTTVHLDVSSSGPVVKSVSRSAEAFYQTKHLVDLLHEYPVNIRLLAYRWNYGKISRALALRMLRKRRRRGLPQGASTSPQLANLAAVRLDLRLRALGESMGFAYTRYADDLTFSSNERLAKVDALTSLVDEIVVDCGFRLNGRKTKIMRAPATRRVTGLIVNTTTPKVPRSMLRKVRAMLHQQAGGKLSEADIHRLRGYLSFVRMIDKEQADLLLDC

SEQ ID NO: 6696 - protein, 384 aa, unidentified
  source 1..384: note = Related to JADLCW010000072.1; note = Thermomicrobiales bacterium
MPANRALGLPAIEHRRGNTPKRGIAPTTQQESRWRSGSSIRIRWTGDARVRSGDGFVEPLDFRSLDSADDVARMTGLDIEEIRAIAWRTEAPRGGWYRRTLIPKRQGGFRLISTPIPRLAAAQRRILAAIGPHFPVHPAATAFRLGMSVRVNAACHTGRPIVVRIDLADFFSAVRFGQIHRAFECAGCTHEAARILASLTSDVAATVRPRGHRTLVVAGRGGLPQGACTSPVLANAICWDLDEDARTLGRRLGFTYTRYADDLVFSAGNSRAPVDTLIRETRRIIQAYGFHVNEAKTRVMRAGGRQVVTGLVVNGSEPRVPRPDLRRFRAFLHHCETEGLDVMSERIGKDALNYARGYLAWVHMVSPEQAARFRARHPWLGGHG

SEQ ID NO: 6697 - protein, 310 aa, unidentified
  source 1..310: note = Related to NZ_LGTP01000055.1; note = Roseobacter litoralis
MNAAEDSLDLQDISSFLGFAPQHIFYLVEDPDKFYTTIRIPKNSDPLTYRTLDIPYSELKGVQRVINRKILQKLPLNDCAFSYVSGKSIYAAAHEFCGGKAVLKMDIADFFPSITGQRVLGLFKSLGFNQSISYILSQLCLRNNCIAQGAPTSPAVSNLIMRRFDRQMEKLAASWEMSYLRYSDDVFLYKNKNFNHPKLAFYVTRIIEQNGFAVNQSKTRFHPRGQPRITLGLLTHGDKPSIPGPARRQYRAAFHRASRDFEWAYHNEARLKGILEWYKSVHGKDDAYNHYSSIHKNINTLKIHTSYRSQ

SEQ ID NO: 6698 - protein, 310 aa, unidentified
  source 1..310: note = Related to NZ_FOTF01000017.1; note = Loktanella salsilacus
MNAAEDSLNLRDISSFLGFAPQHIFYLVENPDKFYTTIRIPKNSKPHSFRTLDIPYTELKGVQRAMNRKILQKQPLSECAYSYVSGKSIFSAAREFCGGKAILKMDIQDFFPSITGPRVVGLYKSLGFTDSVAYILSQLSLRNNSIAQGAPTSPAISNLIMRRFDRHMENLATSWEMDYLRYSDDIFFYKDRNFNHPKLEELATQIIEHSGFTVNVAKTRYHPRGVPRITLGLLTHGDRPRIPGPARKQYRAAFYRASRDFEWAYANKSRLKGILEWYKSIHGKDDVFNQYSAIYRNINTLKIHTSYRSQ

SEQ ID NO: 6699 - protein, 324 aa, unidentified
  source 1..324: note = Related to CP054599.1; note = Pseudosulfitobacter pseudonitzschiae
MRFIAWHREREEVGMGAADDCQDLASIADYLGFAPQHIFYLVEDPDRCYVSIEIPKNSDPTKLRKLDIPISELKGVQRAINKKILSEFPVDECVHSYVPARSILTAAREFCPGRAVLKMDIEDFFPSITFVRVLGLFKALDFSDSASFILARLTTFADRLAQGAPTSPALSNLIMRGIDFRLKRLAATWEVKYLRYSDDIFFHKEKNFNHPKLTAYLSKVIEDGGFTANNKKTKYHPKGLPRTTLGLLTHGEKPKIPGSQRRIYRSMFFKASRNIHWAHENREKLRGIIEWYKCVYGRDDTYTQYRAILDNEARLRIHDTYQSK

SEQ ID NO: 6700 - protein, 310 aa, unidentified
  source 1..310: note = Related to NZ_FQUV01000014.1; note = Litoreibacter ascidiaceicola
MDAAALCLDLETLSGFLGFAPQHIYYLVESPESYYTTISIPKKSDPMKVRQIDIPFSELKGVQRAINKKILSELPMSDNVHSYVQGRSILTATKLLCPGRAILKVDIADFFPTITYRRVFGLFRRLGYNDAAAFILSRLCTKDDKLSQGAPTSPAISNAIMAGLDKRMERLAETWELKYLRYSDDMFFHKERNFNHTRLADVASSVVESSGFIINSSKTKYHPKGLPRITLGLLTHGPEPRIPGPQRKKYRAAFFRASRNINWAYERQAQLKGMLEWYKCVQGRSDEYIQYQAIFENIERLKIHDSYRSR

SEQ ID NO: 6701 - protein, 306 aa, unidentified
  source 1..306: note = Related to JAHBZD010000048.1; note = Xanthobacteraceae bacterium
MIAAQIQTLEDLSGALGFAPQHLFWLAGNSDALYKEFDIPKRTGGVRRISTPIAELKGVQRTILQRVLQLHAVSDANFAYVKGKSAVAAARRLAGEKSLFKLDIREFFPTITARRVFGLYRSFGFPNPTAYLLTSLTTYRGSLCQGTPTSPYIANLICRGMDTQLSGLASSWGLEYIRYSDDLFFYRNRIFNWSKFEGVVTRIVVQNGFHLNANKSRFYRAGKDRLTLGLETGQRQIRLPRATRRLHRAAFHKASMSPRWAADNLPQLNGMLSWHRAVHGKDDTASAYGRVLQIATSIKHHDPYST

SEQ ID NO: 6702 - protein, 308 aa, unidentified
  source 1..308: note = Related to NC_023065.1; note = Magnetospirillum gryphiswaldense
MTTAALSLELRELSSELGFAPQHVFYLVKCADELYFDIEIPKRTPGEFRKISVPRTELKGVQRAILRKILSSHEPSEFAHSYIKGKSVISAAKKLLGEKAVLKVDLKNFFPAISARRVFGLFRALGFSNKKAFILTKLTTYKGTLCQGAPTSPAISNLVCRSLDKNINALAISWKLNYLRYCDDIYLYHRINFNSDKLLTRLRRTVNDHGFSLNEDKTRYYAAGNPRITLGLSTHGRVLRLPRAMRREHRAAFHKASTSPTWAEANLSKLRGMAEWHKAVYGSDATYKHYREIIKNVPLMKVHEPFAI

SEQ ID NO: 6703 - protein, 302 aa, unidentified
  source 1..302: note = Candidatus Obscuribacterales bacterium; note = Related to JAIELX010000020.1
MISSVDDFASRIGLSEFCLKRLILRSESFYSSFSLPGRSGRRHNISSPATELKTVQRWILKNVLSRFELHEACVEGRSRSTPNADSFVLKASLKSFFATLNRARVEGLFRSLLFPESVAVSLARLTTFLNALPQGAPTSVYIANLICRRLDRRVNGLCGVRNWSYRRDCGDIVICGQGRVTDKVLEQLTQIAREEGFDIEIHKRTSCNGATDGDSKTGPVTGRVSSQGADLSFRRLRRTKSQRRIVGRPARKQSRARSSFASRLPELCGLDRSFTGSARQKRVRAELRLLFNSAVGNSSNTR

SEQ ID NO: 6704 - protein, 323 aa, unidentified
  source 1..323: note = Candidatus Melainabacteria bacterium; note = Related to JADJWK010000004.1
MSIRFGIAERLVLLLVIKMIETSRSIKMDNLLETLEISELELKRYALRAEKNYHELHRLKKSGKTRRVVAPSAELKGLQRKISRRILRHHDLQDSCTGYRPGHSIVTNARPHTGKRFVLNIDLKDFFPSISFNRVVGLYQNLGMDRNAARLLARATTYKGALPQGAPTSPDIANLVCRTLDKRLEGFCKIRQWSYTRYCDDITISGDTCTDGAMDTLRTIIESEGFRINEDKTRMRMSHQRQTVTGVVDNERPNLEISERRKLRTICHQLRWNPESFEGLGKKLMGSLSFANMIGGLLRKSEFQSAWRLLKKKHHEARHASTT

SEQ ID NO: 6705 - protein, 366 aa, unidentified
  source 1..366: note = Related to JACKCM010000002.1; note = Candidatus Obscuribacterales bacterium
MFRQPDVVGNFQLTIKLLGLGSNSVMHESSNAGNERLERILPSGVKESFPVFYFCEFVHRREAGVLPVPYMYDIQTVAQLANALDSSEFELLRFIYRAEEFYTRFRKKKSTGDMRTVAAPRKPLKAVQKAIVKKFLADIPLPDECTGFRPGMSILSNAQPHCKKRFVFNTDLEDFFGSISSERVLGLYLRLGFSFPVACVLTELTTYIGCLPQGAPSSPYLANLIAYSMDADLADFCAANEWSYTRYCDDITISGNGNFSLADMRTISDIVEVEGFRMNIKKTRFHKHNSKQMVSGLVVNEKPSLPRAKRRKIRAIFHQAEVEPERYGNRVKELENHLSILSMLDPQSKEVEKYRTVLNRLISQAK

SEQ ID NO: 6706 - protein, 305 aa, unidentified
  source 1..305: note = Candidatus Obscuribacterales bacterium; note = Related to JAIERK010000069.1
MTTIRRMDIFELVEQLETSELHLRHLATRSERFYREFVVAKKSGGGRKIVAPSDDLKDMQKKIAVLLLNKVDLHEACTGYRNGKSIIDNAQPHVGQHFVLNMDLKDFFPSISSNRVTGLFYNLGWERPVAMLLARITTYKGSLPQGAPSSPAIANLLCRRLDTRLSNFSRVRGWQYTRYCDDLTISGQGTPDSDTDTIYSIIESEGFTVNLDKTRTRFKHQRQVVTGIVVNQEVRIPREQRRLLRAICHQMSMEPESFRGVSNQVLGQLSFAQMVEGQNAPETYRESAQCLLDAKKLARQAGATY

SEQ ID NO: 6707 - protein, 318 aa, unidentified
  source 1..318: note = Related to DNIL01000199.1; note = Armatimonadetes bacterium
MLIASSCRQREPLTACDGHPTLRGGARMLQTTDDLAALLGVETATLVKLADPARTRWRHHTVPKRSGGTRHLFEPPHALQVVQRAIGRKILDRYTPHDAAKAFRRGASVVDHAHQHVGQAFVYSTDLRDFFPQINIRRVRGMFLSLPGLDCSPSVAELLARLLCWRGCLPQGAPTSPAIANLIAYRLDLRLTNYCQRRGWTYGRYADDITISGRGRFTARDQRWVEGCLAAEGFPVNPAKTDLRRQHERQTVCGLLVNDRVRLPRQTRKQKRATAHALTQSTDPETRTAQAHGNLGWLKMVGNEQALVTQFQVAVDKS

SEQ ID NO: 6708 - protein, 300 aa, unidentified
  source 1..300: note = Related to JAIEQI010000031.1; note = Candidatus Obscuribacterales bacterium
MPSLSKTLPTIATLLDLAEFLSVSEFELKSFCLRPKKFYNTFERPKRSGKGCRKICAPSEKLKSVQKIIKEKILDCVDAHESSTGYKRGVSIVENAQVHVGKRALLNLDIENFFSSISMPRVIGLFASLGYTEDVAIMLGRLCCFEHALPQGAPTSPSLANLICHKLDRRLKGLAFKSHMQYTRYCDDITLSSDENISGKFVEVVKEIIKDEGFSVNEDKTRVLSQRSCQIVTGLTVNQKVNLPREKRRLIRASFHRASQQTALTDAEQKRLEGLASFMQMIEQHCQKQRRRVSPTDIKS

SEQ ID NO: 6709 - protein, 360 aa, unidentified
  source 1..360: note = Related to DPCG01000093.1; note = Lentisphaeria bacterium
MGILSWMFGIKSKKYNYSKVEKALGPWQPYAGSSVIHGTMLPKSFTIPPALKKKRDEPDLTTFSSALFPYWLRIDPSLAGFVLMKINSGEMYRQKEIPREGKAPRIISVPAPVLKFIQKRILARMLEQIEIHPAAHGFVKGRTIFSAAEPHVGKRIVLSIDLRDFFGTISFKRVAGMFKAYGIAKKQAFLLAGLCCCQKKLPQGAPTSPAISNIVCRRLDSRLAGLCKKYDFSYTRYADDLIFSGDERMLRFLKVFKEIVQKEGFAVADEKTFIRRSGSRQKVLGLNVNSKVSVPRKARRLIRAMVHRQAQEGSPDGEMVDFLLGHAAFMKPAHPEQSAKLKETLDKTWKAYLVSCIANK

SEQ ID NO: 6710 - protein, 348 aa, unidentified
  source 1..348: note = Lentisphaerae bacterium GWF2_49_21; note = Related to MHBH01000069.1
MGLLNWLFGKKSHKYNYGRVEKILGPWKTYSGTLCIPGTKLPKSFTVPPSLKKNKDDAEQTTLSAALFPYWLRIDPSLAGFVLSKIKSEEMYKQKEIPREGKAPRIISVPAPILKFIQKRILARMLEQIEIHPAAHGFVKGRTIFSAAEPHVGKRIVLSIDLRDFFGTISFKRVAGMFKAYGIAKKQAFLLAGLCCYQKKLPQGAPTSPAISNIVCKRLDSRLAGLCRKHNINYTRYADDLVFSGDGRMLRFLKVFKEIVQKEGFAVADEKTFIRRSGSRQKVLGLNVNTKVSVPRKARRIIRAMVHKQSQEKKPDDEMIAFLLGHAAFMKPVHPEQAAKLKNILENL

SEQ ID NO: 6711 - protein, 348 aa, unidentified
  source 1..348: note = Related to RFGW01000551.1; note = Bacteroidetes bacterium
MFKYLKNILGVKSRKKYNFFRINRILGDWQPYSGSKCIKDTKLPKYLDLPKDVEKWGDYSGQVPLSTVIFPYWLRLSSEIAGFLVKQVNSGKLYNDIEIPREGKDPRKISSPHPLLKFFQRRILTRLLEQMEVHPAAHGFIKNRSIFTALEKHTGKRVVISLDIRDFFDTITFKRVCGLFKGYGIKEDKALLLAGLCCRNGRLPQGAPTSPMISNLICKKMDSRLTGLAEKNGFSYTRYADDLIFSGGENILKFLPIIKQIIKEEGFTPAEEKTKIRRSGSRQQVLGLNVNSKVSVPKKVRRLIRAMVHRQALSEGRNHEMLSFLYGHIAFMSNKHPEQAEKLKRQLI

SEQ ID NO: 6712 - protein, 350 aa, unidentified
  source 1..350: note = Related to JABIYZ010000168.1; note = Lentisphaerae bacterium
MLNLLRKLFHLPPARRRFPSQAIEDVLGPWEPYAGDDVLPRSRLPARLELPPAVAEWGDVPGARRLDRVLFRCWLRLDPTLVGFLLSQIQQGELYTVHEIDRPGKAPRRIAEPDRVLKFVQRRILERVLEQMEIHPAAHGFVKGRSIFTNAEQHTQKAIVIALDARDFFPTITFKRVNGMFIKSGFAADTAGKLAGLCCFRGRLPQGAPTSPMISNLICRRLDGRLSGLLTKFGGTYTRYGDDMTFSGPEQILSLLPLCRRILAEEGFELAPEKVRICRRGSRQTVTGLVVNDKVSVPRRVRRYIRAMVHAQSRSDHPDEDMVRFLRGHLSFMRPAHPDQAERLLQQLNT

SEQ ID NO: 6713 - protein, 361 aa, unidentified
  source 1..361: note = Related to MWEK01000004.1; note = Planctomycetes bacterium ADurb.Bin069
MDFVAYLIMDLIRLLTNRKEKPYDRKRVDKTLGPWSAFKGPSAECIPGTRLPRKIVWHRPRLLFGRKREEIDFAIGVMTHWLRLEPKLMRFIAYFLRDTEKYKVREIPRPGREPRRIEEPMALLKFVQRRILRRILEQTDLPDCVHGFVRGRSIGTAAAPHAHKEVVVCCDIENFFPTITVRRVWGVFRSLIVNPRVSNLLAALTTYQGRLPQGAPTSPMIANLVLRRLDRRLAALTRSRGIEYTRYADDMIFSGGPDTPKILKAVRAFVAEEGFTLNEKKTRILRRGRRQEVCGLVVNERVGIPRLWRRRLRAEVHRLATGRDGAKAAPARLRGELAFLQCFHPEEAGKHARKLLALLKQ

SEQ ID NO: 6714 - protein, 358 aa, unidentified
  source 1..358: note = Related to JAAYDY010000039.1; note = Phycisphaerae bacterium
MGLLDFLRNLLSPQRGSDESPALNHSDTRPKTADASPSQAEAPATPAVRIRRRRPLLPRQLGSPPTFRRLMAALRLSHVRVRRVMHSKAPYHTFTIAKHNGSLRDIAAPCRSLRHIQRRILRRIVEPLDTHLAVHGFRRGRCSLTGARRHVGKEAVLAMDLQDFFPSITSQRVYGLFRKLGWPPNLASVLTRLSTWQGRLPQGAPTSPALANLIARRMDRRLAGLARHRGIYYTRYADDLTFSGPADAVRSAIPAIRMIVKEEGFRPAEHKTRLMRCGRRQVVTGLVVNRQVSVPRDYRRRVRAALHGIRTGRTTFATPADRATTLRELEGHVQYIRSIRPEHGDPLAADLYAAETGQ

SEQ ID NO: 6715 - protein, 347 aa, unidentified
  source 1..347: note = Related to JAFGPY010000175.1; note = Planctomycetes bacterium
MGFLDFLRDLFSPKSSPGEHPSSARPGERTRHKKGVRSAPLLPESLGARPTFHCLVGTLGLNHVRVRRVMHSPHAYHTFTIAKRGGKLREIAAPCRSLKHIQRRILHRIVEPLDRHAAVHGFRRRRCSLTGARRHVGKEAVLAMDLQDFFPSITSQRVYGLFRKLGWPQNLASALTRLTTWQGRLPQGAPTSPALANLIARRMDRRLAGLGRHRGIYYTRYADDLAFSGPAEVVRSAIPSIRTIIQEEGFRLAEHKTRLMRRGRRQVVTGLVVNEQVSVPRDYRRRVRAALHNLRTGRTTFAAVAERAAALRELEGHVQYIRSIRSEHAKHLEADLYAAADGIQRCL

SEQ ID NO: 6716 - protein, 370 aa, unidentified
  source 1..370: note = Related to JAADGH010000108.1; note = Planctomycetes bacterium
MGFLDWFLRKIIKPKVLDGWARARRRGQINALRKKRERARAICMLPQDGRLPTRKARNPMTGRTIEVEYDDGLKGIAKALGLKPSRVAKLSFSPKKLYTTFTRPKPAGGERTIHAPVRSLKYVQRRILDRILNWVDLPDCVHGFRRYRSLATGAAEHVGKEMVLRMDIEDFFPSIHFGRVLGLFRSLQFSTKHAFILARLTTADGVLPQGAPTSPAIANAVCRRLDRRLMGAAQKQGISYTRYADDMTFSGPAEEVKRLVPFVRKVVGEEGFTVADKKVRLMRRGRRQIVTGVVVNDKLSVPRYYRRWLRATIHHLRTRGATPDGLTAAQLRSSLLSHAHYIKMVNADQGNRLLADLREVLGQQGGKGNR

SEQ ID NO: 6717 - protein, 302 aa, unidentified
  source 1..302: note = Planctomycetes bacterium; note = Related to JAFGGJ010000038.1
MGILDWLARLLRGGGESPFAAGRKGPRLGLKLNRLWHLARNVEGHYSEFDLEMPGGRKRRIEAPDGKLRWVQRKILRNVLDRQEQGPCCHGFRKKHSIATNAAGHVGKEMVLAVDIEDFFPSITFPRVYGLFKSMGFDRGRSALLAKLTTRNGTLPQGAPTSPAIANLLCRRLDRRLGGLAAKARMTYTRYADDLTFSGSADAAKYLRLIVEIVKEEGFALNPAKTRMMRRNRRQEVTGLVVNDKVGLPREWKRNLRAALHHLRTGRPASDGPEKIHGKLAFLKMVHPEQYVRELAALKALS

SEQ ID NO: 6718 - protein, 494 aa, unidentified
  source 1..494: note = Related to NZ_JAKZKW010000001.1; note = Fundidesulfovibrio sp.
MSDLEQLLVGLDAESASGRMHAIQRSTAYDKPTRSAFLLKALEHWDRKVREKSAKILLKIGGDLELAAVCSAVDSRKVPLLRLIPWLARRNHALTTRTIYNLTQHSHKVISEAASKYLIKMDTTEALFYRWSKQSRIPKKLAAQIEACACERVASVLSDIPVSVIHTLRGKFLRYPLLKKYYHDKYSDSRPQSSKETVSPKAPKVQSEYVQSWNKLGIDWRIAGWIVRNWSDLDDVGYFEFKIPKKNGTERIISAPVTPLKIAQRVVLDKILSTVPQHDACHGFRKNFSIITNATKHTGKDVVIRIDLKDFFPSIKPARIAGIFRSLGFSDFEIRFLTRVTTRGGGLPQGAPSSPCLANIVARRLDSRLNGLAASVGGTYTRYADDLIISGHKNVVSILPAVKSIIQEEDFGIASEKLRIARKGAQQKVTGLIVNQCVNAPRELRRKLRAVFHKQSKGEVPYWGNKPMSESQMRGYQAFLSSIEKSKTDQHEKL

SEQ ID NO: 6719 - protein, 451 aa, unidentified
  source 1..451: note = Related to JAGOOG010000002.1; note = Deltaproteobacteria bacterium
MTKKANNNASDMFGAVAEKRYSAVKRVSKLPVEEALPILKKGLKHWDRKLRNMCSREIVRKLGGKAASIVLPLYVKGLLSRSSSYEQLLRKEDATLTGYVLRRSRRKDSLGQVCKGLYSQTKHYKRIQEKQTKRDQELLADNDRAGQTWVAQKISPWDLLKERFSILKELKENTAQFVLGHWYRNNTFDDLYDTFEIPKRSGGKRKIEAPKPALKLAQKAILEKLTSDVRLHDSCHGFRRAHSIVSNAKPHVGKAVVVNLDIKDFFPTISAARVFGIYRSFGYKNEEASFLTALSSFNGRLPQGAPTSPMLANIACIRLDYRLSGLSNTIGADYSRYADDLTISGPESITKYIALIRKIVEEEGFALALPKLRIHRRGARQEVTGLTVNDRVSVPRVIRRRIRAALHHVNQGKEATWKGEPMSLESLTGHINFIKSVHPDLGQALFNSLPQ

SEQ ID NO: 6720 - protein, 340 aa, unidentified
  source 1..340: note = Firmicutes bacterium; note = Related to JAGFXW010000209.1
MDKRSSAADRKGNDFVEPNGDLVKSAGNGWLFDLSRELDISCRDLGWLHGTWGTWNQWYKTYTVPKKTEGFRVICAPQGLLLAVQRKINDVILKEVVLSSCCHGFVKERSIITNAAAHVQKEVLLSLDIKDFFSTITANRVFGVFKSLGRSPEEARFLTRLCTYNGCLPQGAPSSPAIANRACNHMDKRLAKLAEYHRAAYSRYADDLTFSGDKPVLRLLPLIKAIVAEEGFAIAEHKTRVAKQNQRQVVTGLTVNSEIKVRRPEKRRIRAILHHAACRRSTTSHQVPIGVQEIRGYYSFLKNVEPEYAAKLYLDLHEKYLMLDLAPETNPFWLSQRSSR

SEQ ID NO: 6721 - protein, 324 aa, unidentified
  source 1..324: note = Planctomycetes bacterium; note = Related to JACOTF010000024.1
MIEILEYILAPIGGLIVLVVIAISIFRFTRATNGHFWHWLRAMLGWGKDIREVAARLGMTEQELRNVSPSFREVFVPKKRGGQRRLLVPDADLKSLQRRILHRLLKKLRAHPAAHGFERGRSIVTNALPHKGQRVVIKIDLVDFFTGTKANRIEQYFRRIGWNADVAALLTRLCTAEGSLPQGAPTSPRLSNLVNFNMDSRIARVVQQRNGQYTRYADDITISFPEDYPSRIRGVIQRVKRIVKQFGYRIHVRKKLQILRSHQQQRVTGLVVNRKVQLPRKVRRWLRAVQHRLKTRGSSTLTAKQLAGWRGMQIMIEQQRQRTG

SEQ ID NO: 6722 - protein, 324 aa, unidentified
  source 1..324: note = Related to VGZI01000118.1; note = Planctomycetes bacterium
MIELFEYIAASAGALVILLTVAVTALRFNYAINGRYWHWLRALFGWGKDIRELAGRLGMTEQELRNTTPSFREVFIPKKRGGQRRLLVPDAGLKTLQRRILHRVLKKLRAHPAAHGFERGRSIVTNALPHRGQRVVIKIDVVNYFTSTTAKRIEDYFRRIGWNADVAALLTRICTAEGGLPQGAPTSPRLSNLVNYNMDSRIARAVQSRKGQYTRYADDITISFPENHPKQVRGIIQLVKRLLRQCGYRIHVRKKLRILRSHQQQRVTGLVVNRKVQLPRKIRRWLRAVEHRMKTKGSASITPVQLAGWRGVQAMIDRQREGSG

SEQ ID NO: 6723 - protein, 330 aa, unidentified
  source 1..330: note = Related to JACPPF010000124.1; note = Planctomycetes bacterium
MNTLFADANVVLLWGLALGGGFVVLVASLWVSYRVVRATNARPLEWLRVRLGRGKDLTTLAARLGVSVQELQGVELFYRESLIPKKRGGQRRLLIPDQPLKAMQRRVLRRLLRRLRAHPAAHGFEQGKSIVTNALPHVGQCVVIKMDLVDFFPSTTAQRLDAYFRRVGWNAQAAALLVRLVTHAGVLPQGAPTSPRLSNLVNFNLDARIARFVAKRKGAYTRYADDITISFPKDHPRKVRGTIQKVKRIVRDFGYRIHVRGKLQILRKHQQQRVTGLVVNARAQLPRKLRHWLRAVEHRLRTRGEASLSPQQLAGWRALQGMIAKQAKTD

SEQ ID NO: 6724 - protein, 361 aa, unidentified
  source 1..361: note = Acidobacteria bacterium; note = Related to PSRB01000276.1
MRPVRPVRPREPKAPWAFAPAKQGVAGPEYSGPVFLVNSLFTFPSRLFPRRRRLASLVKKWLRSVWRLFRVKKRTADELARRLDVSLAELLDWTPSYRETIISKKRGGTRRLLIPDAKLKALQRRILHKVLRRLRVHPAAKGFERGQSIVDNAGPHVGRSVVIKMDIVDFFPSCKAEEVTAYFRKIGWDEAAGVILTKLCTHEGRLPQGAPTSPRLSNLINWPLDARIARWVAYRKGAYTRYADDITISFPKDYPRKVRGVIQQVRRAARKLGFQIHEQGKLRILRHHQQQRVTGLVVNEKLNLPRRLRRLLRAVVHHLQTGKPASMTAEQLAGWQALANMVAKGAAKYPAPASPKSPGKP

SEQ ID NO: 6725 - protein, 351 aa, unidentified
  source 1..351: note = Related to NZ_JACHGY010000001.1; note = Algisphaera agarilytica
MMQRHVFAHAEQGGPIPGNPAKGFLWLFAIIFAVLTVVVICVAIVLWLQRLALLPKPHETHRTDRRRTRLGRGKDLAELARRLDTSAQKLQTANRRYHRFTTAKKRGGTRVLHAPNPELKHLQRLIHRRLLRKLQVHWCATGFEPGVSIAHNAAFHAGQAVVIKLDLKDFFPNTTAERVEHYFRRIGWDAESAALLTELCTHEGGLPQGAPTSPRLSNLINHVMDAQILRYVEAHHGTYTRYADDITVSYPEDWPKYVRGTIQHVRRTAKRHGYTVHTRGKLRVVRRHQQQRVTGLVVNDRVNLPREKRRWLRAVEHRLKTQGRASLTAQELEGWKALSQMVDRHANPEAG

SEQ ID NO: 6726 - protein, 348 aa, unidentified
  source 1..348: note = Related to JAHQVV010000229.1; note = Phycisphaeraceae bacterium
MGTQSIELLAGIDPLAKVCFVSCGVPLITVVVILLVGSKRGWFKPYKETHKVERKRAAKGLGKDIEALGHRLQTPPDELRNFEPKYRLASISKKRGGRRRLDIPDHKTKTLQRTILRKLLRNLKTHSCAMGFDPGISIAHNAAVHTGQAVVIKLDIKDFFPATTKERVEQYFRRVGWDGECAALLTGLVTHNDGLPQGAPTSPRLSNLVNYVLDCQIQRYVLKHKGTYTRYADDITVSYPEDWPKYVRGTVQKVRRVCRRHGYTVHTRKKLRIVRRHQQQRVTGLVVNEKVQLPREKRRWLRAVEHRLSTTGEASLTEEQLAGWEALQQMIDQQARPGRGSMNEGDPE

SEQ ID NO: 6727 - protein, 338 aa, unidentified
  source 1..338: note = Related to PAIY01000242.1; note = Phycisphaeraceae bacterium
MGNFGRKRNADIFTWLVLCLLAIILIFAFPIFILIELINCFFPDRLAKKRYRHVFRHICGMGLKSDELARRLGMTVEQIQATPQDYTTRKIPKRSGDQRELNIPNEQLKSLQRCILKGLLSKLKTHPAAMGFEEGYSIAHNAMLHTQQAVVIKMDIKDFFPSITAATIEFYFREIGWNKRAAFLLSELCTHAYQLPQGAPTSPKLSNLVNYMMDYQIEQAVKHYHGTYTRYADDITISFPKDYPKHVRGIMQKVRCITKFHGYELNHKKTHILRQHQQQRVTGLVVNDKVNLPREKRRWLRAVEHRLQTQGKASLTQEQLDGYKALQQMIASQTQPKA

SEQ ID NO: 6728 - protein, 371 aa, unidentified
  source 1..371: note = unidentified bacterium; note = Related to WGMU01000064.1
MFRRSGRFVTASDSRVRVRQFRAEIPDTKQDVTGTGLPVPVFPSGGVMLAFNLLSQLVSFALVVACLFGVGVCLHIRYRRVTNSNLRHWLRARRGQGLGIDELARRLDVSEDELRSVDVGYREAFISKRSGGSRRLLIPNSELKRLQRTILRRLLGRLRTHDAVTGFERGLSIVENAAPHVGQAVVIKLDVTDFFPSTRADRIDAYFRRVGWDAECAALLTRVTTHEDGLPQGAPTSPRLSSLVNFGLDRAIERFVCDRRRGVYTRYADDLTISFPKDYPRRIRVVVQFIARRLRCDGYALNRSKIRILRQHQQQRVTGLVVNDCVNVPRHIRRKLRAVEHRLNTGRSATMTREQLAGWKALLQMVEQRRP

SEQ ID NO: 6729 - protein, 336 aa, unidentified
  source 1..336: note = Related to JABMPE010000648.1; note = Rhodopirellula sp.
MIDAVFNGIEIAAKACLSITGVIFLAVGVLIAYFLWNLSTLKRARPANLKHWNRVRRGDGFGVEELARRLGVTSDELAAVSPNYTERFIEKRSGGTRRLLVPSPELKELQQKILRRLLARLSVHPAATGFEPGTSIVHNAAQHVDQAVVVCMDVSDFFPQTSEARVTAYFQRIGWNRETAELLTRLTTWEGGLPQGAPTSPRLSNLVNHVLDARIERFVECRKGNYTRYADDISVSFPKDYPKRVRGTVQVVGRHLKAFGYQLNAKKTRILRQHQQQKVTGLVVNDRVNVPRNIRRKLRAVEHRLNTGQRATMTREQFNGWKALLAMVEQQRDGSQ

SEQ ID NO: 6730 - protein, 372 aa, unidentified
  source 1..372: note = Related to JAIOPE010000166.1; note = Planctomycetes bacterium
MAELKKTEPKKTSKWSGCLAIALGLAVVGWCLYSIVRGVVGLFHMGPVTFGVVAGVIGLVIAWFVARSWWRKGGRNAVRRAFWIAPGVAELARRLDVTPERLRTFSPVYREVRIPKRSGGVRVLHVPDANTKSLQRKILHRLLARLKSHPAAYGFEAGRSIAHHAAQHTKRAIVLHFDVVDFFPSTRAERIERMFLRLGWNREAALVLTKLTTHKGGLPQGAPTSPRLSNLVNAGLDRALTKRVGELRGRYSRYADDISVSFPKDRRGSVERTKARVMHELCLRGYEMHVRKKLSVRRAHQRQVVTGLVVNEKVALPRHLRRKLRAARHHLATGRPATWTDEQLRGWAAFEKMVRDQGAPPPQDGDGTTPKA

SEQ ID NO: 6731 - protein, 345 aa, unidentified
  source 1..345: note = Planctomycetes bacterium; note = Related to JACDGX010000179.1
MTVGCWFALLVMLGSVVGAILVTPWSLAATPAAVALLLTFHGLRHRYGAYPWRRLRAHLGYGHGIDELARRLDRPAAELRSAAPVYRAVDIPKRRGGTRRLHVPDAATKALQRGILHRLLKRLRAHGAAHAYERGRSIATNAAQHVGRAVVLKMDVVDFFASTSAARVERYFRRIGWNREAAALLTRLTTHEGGLPQGAPTSPRLANLVNRHFDVLIDRTTRRFRGTYTRYADDLTISFPEDWPRKMRGMVQRVRKVAKAFGYRVHGKPKLGIFRAHQRQLVTGLVVNQRVALPRETRRWLRAVKHRARHGKATITSAQIAGWDAYAAMIGGATSPAPGPADRGG

SEQ ID NO: 6732 - protein, 348 aa, unidentified
  source 1..348: note = Related to JAGQPJ010000270.1; note = Planctomycetales bacterium
MRDTRGPVWKLLTAIGMVLALLVLIPLFVAALILALPFVVILSGYSRYRLATNGRPIRWLKLKLGWGLGVRELARRLEMPADELRRFQPVYRVARIPKRSGGQRTLFIPDAATRALQRRLLRRVLRRLKAHPAACGFEAGRSIVDNARPHVGQAVVIRLDVVDFFPSTTAARVERYFRAIGWNRAAAELLVRLTTHEGGLPQGAPTSPRLSNLVNYFLDVKLDRHAQRRRGAYTRYADDITISFPRDHGRRARGTVQYVRRLLKAHGYQLHRDKKLSIRRRHQRQQVTGLVVNETVQLPRATRRRLRAVLHHHETGRPATMTLEQLQGWAALQAMILRQRDGNPDEAS

SEQ ID NO: 6733 - protein, 351 aa, unidentified
  source 1..351: note = Related to NZ_CP036267.1; note = Thalassoglobus polymorphus
MPAKATFQMATGCCLSAATAVVTFFWLLNSDSQISFAIMSVLLVAICATMLFGWWTAFLQLTSKHPWHWIRTKFGWGFEIEELANRLGYSVNELTEHQPQYVSAFIPKRSGGTRELRIPDKKTAEIQKRILQRLLSKLRSHPSACGFETGKSIVHNALPHVGKAVVIKLDVIDFFSSTTASRVEAYFCRIGWNRKSAKLLTKLTCDQDALPQGAATSPRLSNLVNYLLDEQLVRCATKYRGEYSRYADDITYSFRKDSPKRMRGIIQRTRHLLNRSGYQLNTEKQRILRQHQRQTVTGLNVNTKVSLSRKLRRELRAARHRLENGKESTWTAEQLQGWAALEHMIQEQTKS

SEQ ID NO: 6734 - protein, 351 aa, unidentified
  source 1..351: note = Related to NZ_SIHI01000018.1; note = Thalassoglobus neptunius
MSARSTFQMTSGCGCTLMVLAGGILLANQASGAVVIFVLSVISVFVFAGWLTALFQMTSGNPQHAIRSWMGWGLTVSELARRLDLSEQQLINHFPKYIDRPIPKRSGGTRILRIPDATTADIQKRILQRLLPLLTSHRCATGFEAGLSIVDNALPHVGQAVVIKLDLVDFFPNTHRDRLELYFRRIGWGKEAASILVRLTCDEEGLPQGACTSPRLSNLVNFLMDEQLDRLAKSRKGVYTRYADDITFSFPKDYPQRVRGIILKTRWIVRRFGYQLNSKKQLILRQHQRQSVTGLNVNTKACLPRELRRRLRAARHRMKTTGSATWTEEQLQGWASLESMVESQTASESER

SEQ ID NO: 6735 - protein, 331 aa, unidentified
  source 1..331: note = Planctomycetales bacterium zrk34; note = Related to CP050848.1
MISQHFIAVSGSDIFQWAWKLMLLVFVIYIIRVLLDLRALKHAGNRKTARRVARGQGLDMAELARRLDIAERDLELFKPVYRSATIPKRRGGTRKLRIPDPPTRAMQRRILHRLLKRLQAHPAACGFEPGKSIVDNALPHVCQRVVIKLDVVDFFTNTTAPRVQRYFQWVGWNRPAAEWLAMATTDEGGLPQGAPTSPRLSNLVNFYMDVQLSKFAARRKGEYTRYADDITFSFPKDYPRRVRGVIQFARRILRSKGYELNGRKLRALRRHQQQRVTGLVVNDTANLPRRTRRWLRAVEHRRRTGGQPTLSDDQLAGWQALRHMINTQRTG

SEQ ID NO: 6736 - protein, 344 aa, unidentified
  source 1..344: note = Related to NZ_CP017641.1; note = Fuerstiella marisgermanici
MVSVPFLIGLSVAAVVAVLIGLRLGRKRDSSFDSDWPNDSPGPLAQERTAQPSAQTKKSKKQPGYAARFDLAELARRLDVPEQQLLAAEPTYRIAKIAKPSGGTRRLEIPDDDTKALQRCILRRLLATLNAHPLACGFEEDTSIVDAALPHQNRAAVIRLDIRRFFESTSADRVQNWFIAIGWQPGAAEVLTRLTTNDGHLPQGAPTSPRLSNLINSPLDEGLLRLAKQYGGAYTRYADDITLSFNFDRGRKLRGIIQAARRIVKSYGYTLHGGKKRKVLRRHQRQQVLGLVVNEQVALPRSKRRWLRAVRHRIENGGEASLTAAQLKGWESFCSMVQEQRDEG

SEQ ID NO: 6737 - protein, 329 aa, unidentified
  source 1..329: note = Related to DUCQ01000262.1; note = Fuerstiella sp.
MFSVPVLIGLAISAAAVVLFGLVAATRRRAAHGHDRGTPHPLPPERGRSSPLPQYDLSELSRRLGVSRAVLERFETGYRIAEIPKPRGGVRRLEIPNEETKKLQRTILRRLLTALDVHPFACGFEPGTSIVDAATPHEGRLVVVKMDIRRFFESTTAARILEYFQRIGWDAASAEVLQRLTTYNGHLPQGAPTSPKLSNLVNAPLDEALLRLARRHNGAYSRYADDITMSFDIRRGRVVRGLTQVVRRILKSYGYTMHGGAKLKILRQNQRQQVLGLVVNEKTALPRKTRRWLRAVRHHARVGRPVSLSKQQLDGWESFLKMVETQRDE

SEQ ID NO: 6738 - protein, 342 aa, unidentified
  source 1..342: note = Planctomycetaceae bacterium; note = Related to JAGQQL010000145.1
MLTIPVLIGIAVVGGLAILIGMIVGTRQQHRSDDDASAPPAGNRPATESPSGNVPQRDTSTASLTLTDLSARIGISVDDLQNHQPVYREVRISKPHGGVRCLEIPDDRTKELQRTLLHRLFAGIRAHNCACGFEAGTSIVNAAVPHVRKRVIVKLDVRRFFESTTAKRVSAWFRSIGWDDEATAVLTQLTTHNGHLPQGAPTSPRLSNLVNAPLDEGLLKLATHHGGDYTRYADDITMSFHIRSGRRIRGIIQATRRILRSYGYKLHGGRKQQILRRHQRQQVLGLVVNDQAALPRHTRRRLRAIRHRTSQGIAPTLTPAQLEGWEAFRTMVETQRQPSSDH

SEQ ID NO: 6739 - protein, 340 aa, unidentified
  source 1..340: note = Related to JAGQPY010000452.1; note = Planctomycetaceae bacterium
MFTVPVLIGIAVAGLIAILIGIILGSRKPSPEQTAERQDETVSSTDSASKSSTSPAAPPLKAVSGGLEIRDLEERTGLSADELRSLKPEYRVVEIAKHGGGKRRLEIPDERTKEIQATVLRRLFSAIRSHSAACGFERATSIVNAATPHVGRRVVIKLDIRRFFQSTTDDRVLAWFQSVGWSQEAAQLLTHLTTWDGHLPQGAPTSPRLSNLINAPLDEALLRLAEKHKGAYTRYADDITFSFNFRSGRRARGIIQAARRILRSFGYAMHGGRKLKVLRKNQRQSVLGLVVNDRIALPRHKRRWLRAVRHRRDQTGQCSLSDQQLQGWESLQQMIENQRD

SEQ ID NO: 6740 - protein, 313 aa, unidentified
  source 1..313: note = Planctomycetaceae bacterium; note = Related to JAGQQE010000041.1
MAWIIAAAVAMAIAVAFVLLKSTQDSKSTPPRRKPEPFTLADLLERLQLTEEDARQLESPQWRKAFIPKSSGGTRLLEIPDDVTLALQRRILHRLLSGLKSHPAAIGFENGKSIVDAARPHSGKQFVIRIDIERFFESTPVTRVEEYFRFIGWTDDAIRLLTTITTCEGHLPQGAATSPRLSNLVNIRMDHALQNVAERFHGHYTRYADDITFSFHFRSGRKARGIVQVIRRILRQSGYRMNSEKTRILRAHQQQQVMGLVVNEKVAIPRSRRRQLRAARHRVRQGKPATFSPEQLQGWTAFEKMVEDQASID

SEQ ID NO: 6741 - protein, 306 aa, unidentified
  source 1..306: note = Related to JAEUIH010000049.1; note = Planctomyces sp.
MNSLMIVVAFIVSLVVVATGLLVRRIIRNLRNRFTLADLVNRLGMTAEEWSQLKPPTYRTAMIPKRNGGQRMLEIPDPDTMVLQRRILRRVLKRLRSHRAAIGFESGKSIVHAASPHIGQAVVVRVDIENFFQTTTERRVGEWFRAIGWNQEATEFLLMILTHNGHLPQGAPTSPRLSNLVNARLDAGLNRIAQSYGGAYTRYADDITFSFPVDQPRQIRALLQMVGRYLKQAGYQMKNSKTRILRAHARQSVLGLTVNQKVALPRSMRRRLRAIRHQQSQGKPTTMTAAELHGWTAFEQMIASQK

SEQ ID NO: 6742 - protein, 302 aa, unidentified
  source 1..302: note = Related to JAGQQI010000087.1; note = Planctomycetaceae bacterium
MAYVIAGIVVVIAAAGLAAAMRFRKPRRSYTLGNLIDFLELTPDDARVLKQPSYSSHRIPKRSGGYRLLEVPDEQTKMLQRRLLRRVLSKLSAHPAAVGFETAKSIVDAARPHTSKGVVIRIDITDFFQSTTTERVAAWFRGIGWDADSVDFLTKFVCHDGHLPQGAPTSPRLSNLINAGMDTVLQRIATERGGTYTRYADDITISFRRLSGRRARGVVQHVRRTLTAFGYRVNTRKTRILRNHQQQTVTGLVVNRTISIPRKQRRKLRAIRHRIANGQPATMTTDQLAGWDAFLAMVEQQR

SEQ ID NO: 6743 - protein, 396 aa, unidentified
  source 1..396: note = Related to WTPX01000039.1; note = Alienimonas chondri
MNDGAAYGRMDRHEVEPAPIRPYSAWRDLIALLLTGCGCFSILFVLGLTAAMFGPPLAQRIAPWLTVPILFAIGINLAQWYFFKRLKRVDRYSLFRAKHRIRAARGKGMDIEELARRCGLTTHLLQNHEPKYREAEIPKRSGGVRRLHIPDPATMDLQRTLLRKVLAKLHADPAACGFEKGKGIVDHAAPHVGRAVVITCDLKDFFPSVTAKSVDYYFRRIGWNAEAAALLTRLTTHAGEGGEPGLPQGAPTSPRLSNLLMHGVDYALAKSAARRGFRYTRYADDLAFSSAEDDSQAVRELLQQIDRVVKRAGFRLNPRKTRILRQHQRQMICGLVVNDRLNLPRKVRRELRAALHRRRTGMHATYTDEQLAGWAGVLTMVARGPRAEPGVPRGVG

SEQ ID NO: 6744 - protein, 384 aa, unidentified
  source 1..384: note = Related to CP036265.1; note = Alienimonas californiensis
MVSSDTPPPDSNASGLGCGGIVWSALAAVLLLTGLTAVAVLAVRAFGALVAALGASALIAIGLNFAQWYFLKRLKRVDRYSLFRLGHRWRAWRGKGFDIEELARRCGLTAHRLQNHQPSYHTATIPKPSGGERTLTIPDPATMDLQRTLLRRVLARLHADPAACGFERGKGIVDHAAPHVGRAVVATCDLKDFFPSVTAKSIDYYFRRVGWNAEAAALLTRLTTSEGGLPQGAPTSPRLSNLLMHGVDYALAKAAGRRGFRYTRYADDLAFSSAEDDGQAVRDLLRRVEAVVRRGGFELNSKKTRVLRRHQRQMICGLVVNDRLNLPRKIRRELRAALHRRRVGREATYTAQQLAGWAGVLTMVARGPRAFHGETPPDSAPSSA

SEQ ID NO: 6745 - protein, 574 aa, unidentified
  source 1..574: note = Planctomycetaceae bacterium; note = Related to PAPJ01000007.1
MNDGIILALDGGEALCFISLVIFMIVFFVAVIQFFNKLKILVPDGQRSISKAEYLERKRKEAITKYGKPSDKSRIYRLVPELEKLDPQWDPSYEIVRIPKRSGGVRELQIPDELTKKIQYALYHKLFSYYIVHPAACGFVKGKSIVDNARQHVGQEVIVKLDIREFFPNTKKMRINRYFVTTGWTPDAADLLTKLVCYEQGLPQGAPTSPVLSNIVNKSMDDRLFSLSQSFNANYTRYADDITFSMEKYNRELVHALLQRVGVILRIYGYNLNRKKKRIIRRHRRQEVTGLVVNSKVNLSRKRRRWLRSIQHRIKTGQKLTVTMAEYRGWISLLNMVDPESNLIHLHKQLVKTDAPVLTPMSDPNDNSPTAELQGSDVDRSSRDENKTRVSSEMLDDNASELRTVDEDNPTRPSGSQDETHTADTSSTRAPLNNDQHEEQSELPELQSSPDNSGVFHEDRLEDKVQALKVAKPYSTEAKSLISEFTKSSYTIQLQLESSKRTFSFRLPEGYQKGRTVTGSLSDGTEVELYFHDSLAETVENAEFPLKSEVTIEVIQWNATFKRVEAIVTGGLFH

SEQ ID NO: 6746 - protein, 365 aa, unidentified
  source 1..365: note = Planctomycetaceae bacterium; note = Related to JABHSU010000643.1
MQNSNMLVADGAGAAICFGILLLVLAFIACVRFLNGHAKNVIQDKVVNLDGFKRLSRVQKALLAQRKREAAPEAYGSVSGTSRIYKLVPELEGLGSEWTPSYQVARIPKRSGGFRELQIPDSQTKKIQLALYHKLFANYETHPSVCGFVKGRSIVDNARPHVGHEVVIKLDIKEFFPNTYRIRVNRYFSETGWDPAGADLLTKLVCYGMGLPQGAPTSPVISNIVNKAMDIRLFALAEKFNANYTRYADDITFSLKSYDRNVVHRLLQHTGVILRDYKYTLNKKKKRIIRYHRRQQVTGLVVNDKVSLPRRRRRWVRAIQHRLKTGKDTTVSFSEYQGWISLIKMVDPASPLLIVHQEIIQNRMA

SEQ ID NO: 6747 - protein, 577 aa, unidentified
  source 1..577: note = Related to PBCP01000062.1; note = Planctomycetaceae bacterium
MPASGTETNLIIWGLAATIAAGFILLARYRQHVSANDRKRGSNSAGSRKPSRYGRQNSYGKSAQGPLSDVDRLYRLIPGIQELVKSGGTQYTNSRIPKRSGGFRDLDVPNQATKKVQHALYHKLFSKYRIHESACGFVKGRSIVQNALPHLRHEVVVKLDIREFFPNTSRLRINRYFRSTGWTSKAADLLTSIVCYKQGLPQGAPTSPVISNIVNKTMDWRFAALADAFGAQYTRYADDITFSLKSYDRGKVHRLIQNAGMVCRSYGYKLNNKKKRIIRSHRRQEVTGLVVNEKINLPRSRRRWLRAIQHRLRNGLETTVTNSEYEGWMSLLKMVSPESPLLESHQQLILEGILHRKNQSTLTEEKKHADSQLESETAQSGADVVTTVEIRSEGSDDQAGNTSPTSLDTNSEPEADGSIQLAADKREPQGGSKTHDTIANGVESQAESDGVPDSKSDLFYEDRLIDFVQRLKNAKPYSAEAREIENDFAGAKYATVVELESYKRTFSFKLPAGYQKGRTVSGRISDGTAIQLYFADQLSDPIEAAAFPFKGEVSIEVIQWNSTFKRIEALATGGMFD

SEQ ID NO: 6748 - protein, 560 aa, unidentified
  source 1..560: note = Related to NZVD01000016.1; note = Rhodopirellula sp.
MIVRGIDVGLCACLFSIAFTIVIVLGIKRLTSPKRNRMKKTGQSKRRRSPYRPAKANQTSSPKHPKSDVDRVFRLIPEFEKLDPEWRPSYSITHIPKRSGGTRQLQVPCQTTRQIQVALYRKLFARYETHPKACGFISGKSIVDNAKPHVGNDVIVKLDIKEFFPSTSRRRILNYFRTTGWTNKASILLTQLLCYEQGLPQGAPTSPVISNIVNKSMDRRLDSLANEFNASYTRYADDITFSMAVYHRDKVHALLQSTGAILRTYGYKLNNKKKRIIRGHRRQEVTGLVVNDVVNLPRSRRRWLRSVQHRISTGMHTSITPSQYQGWISLLQMVSPDSPIIARHKELLAAGMLKSNGKSGIKETGGHEESVLDETTDRISAANSNSPQTDIADSLNESESTSIVSSDGGSESESLSETPLKEVTQELELESQHAVGGSADELFHETRLTDKIYALKEVRPYSDQAKQLQEEFKGSQHTTSVILESLKRSFSFKLPEGYQKGRTLSGLLPDGTEIELYTTDISAELFDQVDLPIQGDAVIEVIQWNNTFKRVEAILLDGLM

SEQ ID NO: 6749 - protein, 552 aa, unidentified
  source 1..552: note = Related to PBHI01000033.1; note = Planctomycetaceae bacterium
MVDVLVNGFGIIFLIFIFVGICRVAELVKDSASHKKTGSRTSRGRGYRGRRFLKKSTEKSERSKPARIHKLLPGLSKLGEDWQPVYTVTHIPKRSGGTRELHVPXQTTKAIQSALYHKLFVNYKNHPAACGFIRGKSIVDNAMPXVGKEVIVKLDICDFFPSTSQYRVRKYFASTGWDDSAAGLLTRLVTYQGGLPQGAPTSPVVSNIINKTMDRKLAYVAETLKADYTRYADDITFSLTSYDRRDIHRLLQWTGAVLRTYGYKLNNKKKRIIRKHRRQQVTGLVVNDKVSVSRQTRRWLRAIQXRLAKGDAITISKSQYQGWISLVHMVSPGSPIIAKHRMLVESGVLNPEPKAVETSKKKLPENTEKINSEPTTSATMQRTRSEAVDPXEPHLSTSDVVETELXGDADIAAVDTTPNIDNSKXDSEEELFHTDRLVDYLXALKMAKSYSAEAKKLESEIQGXTHTAIVKLESSKRTFSFRLPEGFQKGRTVSGALPDGTEIELYFRXTLAEDXEAADLPXXGEVVIEVVQWNGTFKRLEXIVXGGLFHNX

SEQ ID NO: 6750 - protein, 573 aa, unidentified
  source 1..573: note = Planctomycetaceae bacterium; note = Related to DQCQ01000231.1
MVSSPNTVSGVDRLSEMLGMSVQELENFSPQYKHAVIKKRSGGNRLLQMPNDETKRVQRLLLDKLIGRYKTHASCCGFSKGLSIIDNARPHVGRETVIKLDIQDFFPNTTVDRIHEFFCKTGWTDDAADVLTKLVVFDEGLPQGAPTSPAVSNVVNCFMDLRLDALAKKYGMTYTRYADDLTFSSEIYSRRDVHKILRITGVILKSCGYSLNKKKKRIIRKHRRQSVTGIVVNERLNIARPTRRLLRSVHHRLESGGNSTLSENEFNGWISYLHMVNPKDPLVTSVFGESDSDKSKRRRSPKYVKQNASQSASSNSGQFNPIADISFRPINRGDVSTLSQLGLSPTSNAVTPSEYFSAQLFYNFGKNVNVVARRRNLKRKTVWKHLAHAVEHSLVACHDLISKEDLSQLLSQLKQHSPTAIPSVGDAYRMCMGQIDYGRIRVGLAECRRRKRKLQSDRGNEIITKLNNFSSTREEAVLKTVFGKRLNCSCAVESVSITANADLPPDYTEGRTVHATLPEDPSISLTLFTPAAQNDNVDSLSSAQNVFVRGAIQGMDDASGCIELLTEELQLRT

SEQ ID NO: 6751 - protein, 558 aa, unidentified
  source 1..558: note = Related to DTSG01000044.1; note = Planctomycetaceae bacterium
MSPLFVADNPRRIAGSLLIICHATAIIDSGGGEYMDEFLEALFSLQIVSLITVLLIILFFFRKKNSDATRGSYRTQRSRKTREQRRRKLTVRDLGMKLEMSKSELVRHNVQYETTTIPKRSGGKRILHVPDRASKHLQRTLLKQLIERLPIHDDVHGFRKGRSIVDNAAEHIGQEVIVKLDIVDFFPATNSERVESAFKGAGFDKSSAKLLTRLTCYEGGLPQGAPTSPALSNYVNKNMDVKLADAALRRSARYTRYADDITFSFPEYSREKIHELLISTGKILQYYGYRLNDRKKRIIRQHRQQLVTGLVVNERVNLPRKTRRWLRAVKHRMETGGEATLTAAEFRGWLSLLKMVDPAAPLLNFLDGLNSREEIIDKPLPKNGDLKKLVGRQSQNVKTVEIPVTTPGSDIADDALTDNAQQETLRDSEVVNARNANTGVENVSLVAMVEALNQTDNYTESRKTAELQLAGKEYLLEISATSVGRTFSFSLPVAYQNGQTLRATLRNEGLALELYCDEQVGSELASIQFPKNLKVLVRVVQWNAIFKRIEAVVLQASR

SEQ ID NO: 6752 - protein, 321 aa, unidentified
  source 1..321: note = Related to JABHUV010000311.1; note = Planctomycetaceae bacterium
MSRLQRANADRKRERPKLTLADLVARLGMSKADLVEHEVQYRATTIPKRSGGKRVLHVPDRLTKTLQRKLLYQIIGRLPLHDNVHGFRKGHSIVDNAANHTGQEVILKLDIVDFFPSTSSKRIAGAFEGAGFDKSTAVLLTGFTCWEGGLPQGAPTSPALSNYVNKNMDKKLAAAASGRGARYTRYADDITFSFQRYSRDNIHQLLISTGKILQYYGYRLNNKKKRIIRRHRQQLVTGLVVNDRVNLPRKTRRWLRSVKHRMETGGQATLSSAEFHGWLALLRMVDPDSALLEFVDVQNANKKNMARSRMKDSNSQSVVAG

SEQ ID NO: 6753 - protein, 517 aa, unidentified
  source 1..517: note = Related to JABHTD010000124.1; note = Planctomycetaceae bacterium
MLDSIGEVLFSPLVVTAIIVLVLILRCFKGRGGRRELSIGDLADRLKMSKTNLVQHDAQYRTATIPKRSGGKRILHVPDDATKQLQRKLLQQLIERLAIHDCVHGFRKGHSIVDNAAEHTGQAVIVKLDIIDFFPSTNSDRVKNAFRGAGFNKSAATLLTGLTCHEGGLPQGAPSSPALSNYVNKNMDEKLAEAANKRGAVYTRYADDITFSFVTYSRHNIHNLLIATGKILRHYGYRLNNKKKRIIRQHRQQLVTGLVVNERVNLPRKTRRWLRAVKHRMETGGEATLTNSEFRGWLSLLKMVDGDSPLLTFLDSPKPKAEESVTRTRHIGDNISDSDGHSSLSDSDSSVVHQGKSATEGESLPTNTPPETPPVVASGTILPTDGRRQFLRLARLGADGNLALLQLVEALNQTEKYSTNRNEAEKDLVGSEYLIDISVSSIGRTFSFSLPEDYQDGQTLKGTLRDGGLSLELYCDKLVGSELAGLSFPTRLKVLIRVVQWNSIFKRLEAIVLHTTL

SEQ ID NO: 6754 - protein, 328 aa, unidentified
  source 1..328: note = Related to RFKR01000219.1; note = Deltaproteobacteria bacterium
MVRRPGGLELAENQLEVTEPARGVRHLQGGRGTGRCSFLSTSTRFAVGLFDWFRKRKDEGLDTGELARRLGVSESDLDCSPRYNVRTIPKRNGGRRRIAEPSRELKQLQRVILRRLLSRLKAHPAAHGFEKGRSAVTHSANHCGKKLIVVLDIEDFFRNTTERRVRDYFRSIGWNEKASELLTRLTTFEGGLPQGAPTSPRLSNLVNYTMDLRLSRFCDMRSITYSRYADDLCFSTDDESWTGQLLRTVPEILSDFGYRVNRAKTRFLRAHQRQLVTGLVVNEKVNLPRSTRRWLRAVEHRMLLGGTPTISEQQFRGWLAYRQMVERR

SEQ ID NO: 6755 - protein, 307 aa, unidentified
  source 1..307: note = Related to JAGOCE010000260.1; note = Candidatus Ozemobacteraceae bacterium
MSILDWVSGLLGTGSSGTGDSRRNEGNDLRELARRLGVSVEELTSIRPAYREIRVKKRSGGTRLLLEPSPELKKIQRCILHKLLKRLSSHESVHGFESGRSIVTNAQQHANKDLVICVDLKDFFQKTQVRRIREYFTFIGWNTDAADMLMHLTAWNGGLPQGAPTSPRLANLVNHALDARLEGLAKHHGGTYTRYADDLTFSFPTRKELPKKETGTFLEMVSRIVKENGYSMHGKEKLRVMTYARCQSVTGLVVNQKVDLPRRTRKWLRAVEHHRVTGKPATLSDEQLNGWRSLRQMIIDQRRERSR

SEQ ID NO: 6756 - protein, 326 aa, unidentified
  source 1..326: note = Sedimentisphaerales bacterium; note = Related to JAFGPC010000052.1
MGFWDWLRQLLQGPGPQERKPDLTPPVDGKKLEELAKRLDFSVDQLHAVQVSYRQFSIPKRSGNGFRTISVPNPELKEMQRRILRRLLGRLQTHPAAMGFEPGQSIATNAAYHVGADVVVRMDIRDFFGATVTNRVRAYFYGIDWGKEATDVLVRLCTYERGLPQGAPTSPRLSNLVNFELDARLDGYAQKIGARYTRYADDITFSFNFAEIKQTLTGQNSKILEHIKDKSKSSYVIHQTIRMTKRILFEYGYQIHTKRKLNIRRKHQCQKVTGLVVNHKVALPRKTRRRLRAVEHHLANDRPATLTHEQLAGWKALQYMIETQTK

SEQ ID NO: 6757 - protein, 326 aa, unidentified
  source 1..326: note = Related to JACZKQ010000026.1; note = Phycisphaerae bacterium
MGFFDFLKRLFSSEPERRAPRLVAPEPGLGPDELARRLGLSVQQLESTPCDYHEFAIRKRSGGTRQITAPNRQLKTVQRKILKRLLGRLCCHPCATGFEKRHSIVTNAAVHVGADAVLRMDMIAFFRMTTAERIRGYFYGIGWGKEATDLLIRLCTHNGALPQGAPTSPRLSNLVNIEMDTRLACWARKIGAAYTRYADDVTFSFPDLDASAPGPAFDQNPKTLESIRRDEGDALITSTIRMTKKVLGEYGYELHNKRKLNIRRRHQQQRVCGLVVNEKVALPRRTRRWLRAVRHHHATGRRATLTAQQLAGWDALEHMIALQAEE

SEQ ID NO: 6758 - protein, 326 aa, unidentified
  source 1..326: note = Related to JAFGBA010000254.1; note = Sedimentisphaerales bacterium
MGLFDRIKSMLGGGAKASVNTDRWNLDELARRLDITPDELQNIKPIYNKFTIPKRSGGKRTILAPAPELKQLQRRILRRLLARLRTHPCAMGFEKGRSIVTNARPHVQADVVIRMDIRDFFGKTSAQRVNAFWRFIGWDKPCADILTRLCTHDGALPQGAPTSPRLSNLVNYGLDARLEKWGQPIGAIYTRYADDMVFSFSRVTISNMPAFKNWSRFYDSPTEALDDFLRKAVTSTIRVTKKILKDYGYKIHHHKKLSIRRKHQCQKVTGLVVNEKIALPRQTRRWLRAVEHYHTAGKPSTLTPQQLQGWRALRNMVEQQPATDFT

SEQ ID NO: 6759 - protein, 1908 aa, unidentified
  source 1..1908: note = Planctomycetes bacterium; note = Related to JACRUV010000373.1
MGILDLLFQIGDRPGHLDISELARRLDMSVKALRETPLEYKRFRIAKRSGGKRTIKAPNPNLKAVQRRILRRLLAKLTAHPAATGFERGESIATNAVRHTGCEAVLRLDIIDFFHNTTVQRIRRCFHRIGWNRNAANLLVRLCTLDGGLPQGAPTSPRLSNLVNYPIDIRLNAWAEKNNVNYSRYADDITFSFERETEDDIGTAIRLTRTVTKEYGYRIHRDRKLSIRRKHQRQMVTGLVVNQGVALPRKTRRWLRAVEHRLDTGQTASLSKEQLAGWRALERMIDLQAGRRAKTHRDSPTARPPKKRAPETDDMVRAQLQLAREQLLDLTMRNRLLNFQRTRRTTIRIIDELPGQLWELFVEKQKKLAFLAAEEHELFQAAGDDLPPTDEPGEEEPDEDAIPGDLAKLFHQPRPETALEDGQTELPARYTDLFLQTDLRDEDLQINLLRIDQQSHSALEERGVNLLFLAMGFLEWRPDDDEPKTRRAPLVLVPAGLERASARRRFKLRALDDDPILNPCLVQKLREMGIGLPAEPQSWVDFDTETFLRDVGKAVAEMPGWQVHEDVYLGFFSFTKYLMYLDLDPANWPEGRRLLENRILRTVCGDAESIEQMGSWPDVASEDRERDPAETYQVLNADSSQQKAILAAREGRSIVIEGPPGTGKSQTITNIIAECLAAEKRVLFVSEKMAALEVVKRRLDATGLGDFCLELHSTKANRRNLATELGRVLDKGRRTARDEMGDGERLRLLKRRISAVAAAVHDRHDPLGMSPYEAVGRFSLLADVPDCFCDIPGWQDWDRGQLEEMKGRLDRLGRQEQNVGPREDHPWRGVRRTHVSSQDRRDAERHCTRLAGMLADLPRFLKAVADDIQTPVPGSLDDASKALEAARLVADSPGPPRRLLLGSEWEGDRPDRKAFLGLATEFFEGQDWMATRYREGALNGVNWEGMHRRCLRYWASPLRWFRPQYWSDRGLLKGFRESSYRPDFAAQAADLKRLADLAKLKMEIDSRREDGIRYFDEAWQGSASAWGRLSAMADWLTRFRTLHRDGWLGDKAVTTASYAGDHAATAKKARALGEKLDAFHSGLDELNGLLDLSADEMFDVPVLQVDFDVIESRFKRMAAAGEELVVWTQYQEALQQCEDSPLKSFLESAMEDDRPMDSSVRPLAIEKQFLRLWIEDCFERREELRQFNCGDHEAAILDFAKLDVDWIRQSRQRLHGRLSSRRPDGRMQAAPSSQMGIVQSEVRRKRGGRPIRKLLADAADVIPRLKPCFMMSPLSVAQFLDPAGIDFDVVIFDEASQVEPADALGAIARGRQLILVGDPNQLPPTSFFHSGPAPRSSADAEDAVGLVDMESILDRCAVVLSNCRLRWHYRSRHESLIAFSNREFYDSRLVVFPSCHTGDAELGLKTIFHPQDRYGRGKGQTNREQAARVTDFVFEHARRRRDVSLGVGAFSRRQQQAILDEIEKRRIEDNSLEAFFDRNRPEPFFVKNLETIQGDERDVILLSVGYGRSRPAERLSMNFGPLNQAGGWRRLNVLITRARRQCVVFSSILGEDFDLSATQARGVHALKGYLDFARDGMLPPTVDEAEEDSSALERAIYNALVAAGHTVCRRVGCGADAIDLAIEDPLRPGRYLLGIECDGAKYRDTVTARDRDRLRQQVLEGYGWRIHRVWSAAWFLSPRKEMERLTAVIAAARAGTLQARFLPIASAATQEIDDEMDLIPADDSSPIPVKAYRRYRPRRRRSSERFYTDSLTELAALVTEVVEVEGPVHEDQVSRRMLDIYRFSRGGSRIDEKISSAVRVAVYGGKINRRGDFLWPADMETPPLRRRDDDDIRDIDLICHAEIRRALRLLLETQFGMSRNDLTTQAARLFGFQVSGSRIRDRIGQAIQGLLESGKVAESGAILNVSSQ

SEQ ID NO: 6760 - protein, 319 aa, unidentified
  source 1..319: note = Related to JABGPF010000087.1; note = Phycisphaerales bacterium
MGLFDWIKRLLGIAPKPKNMFVEVDFRGRPQRQSTPEKPLGDLMELSRRLAKPVTDMQLTPVRYDKFTIPKRSGGQRQIMAPCPKLKEMQSRILHRLLGGLRAHRSAMGFERDRSIVTNALPHVGAAVIVRMDIRDFFPSTDAARVHAYFRGIGWDTEVVDLLVKLTTLDGGLPQGAPTSPRLSNLLNYLMDARLDGLARSQGGVYTRYADDMTFSFPTDKGNHKTAIVSATKDIVGEYGYRLHLRRKLSIRRSHQQQLVTGLVVNEKPALPRKLRRKLRAIRHRLETQGQATLTEQQLAGWDALTQMIETQRTPKNKQ

SEQ ID NO: 6761 - protein, 309 aa, unidentified
  source 1..309: note = Phycisphaerae bacterium; note = Related to JAIORC010000001.1
MGLGDFFRRLFSVSNDEMFAQDLLPSQGSRDVSSKGKLGVNELARRLGISVEQLQAVPIAYSEFTIPKRSGGKRTILAPRDELKSLQRKILRRLLGRLRCHSAATGFQRGQSIVTNARPHIGAAVLLKMDIKEFFPSTTADRLKKYFKYIGWDKQACKLLLEWTTHKGALPQGAPTSPRLSNLVNFAMDARLAGLAKKFNAAYTRYADDMTFSFATDDRQSIYGAIASTKKIVGQCGYKLHQKRKLRLARKHQRQCVTGLVVNEKLALPRRTRRWLRAVEHRLATGGQASLSPAQLAGWKALQAMIESS

SEQ ID NO: 6762 - protein, 311 aa, unidentified
  source 1..311: note = Related to JAAYZK010000376.1; note = Planctomycetes bacterium
MGLWDALRSLLGFNARRPARPDPGLPATRAMAEPGRDTGQLAQRLGVPLGYLETIQPQYRTFTIPKWSGAPRTILAPQDDLKQLQRTILRRLLGRLASHRAVTGFERGHSIVTNARVHIGAAVVIRMDLKDFFPTTKAARVGEYFRLIGWNDEAAALLMRLCTHGGSLPQGAPTSPRLSNLVNYRMDARLAALAAKLGAAYTRYADDITFSLGQDCRWLAAAAIRGTKAIVADYGYTLHQKRKLIIRRRHQSQRVTGLVVNERVALPRSTRRRLRAIRHCLDTGRPATLTASQLAGWDALEHMIRTQSRSE

SEQ ID NO: 6763 - protein, 370 aa, unidentified
  source 1..370: note = Chloroflexi bacterium GWC2_73_18; note = Related to MGMJ01000134.1
MGFFKDLGKKLEEARRLAEELQQQAQEQAQKLGQQAGVPIPGAPAQPPGTGAPGQPAWGGQPAQEARGGAAPAPTMAPGEREPARRSPPPARFGPDELARRLGTTVDALRAVQPDYTAFSIPKRSGGQRRILAPDPVLKSLQRQVLRRVLGRLRAHPAAMGFERGRSIVTHARGHSGRAVVVHMDIQDFFPSTRAVTVREYFRQLGWDDAAVDLLAKLTVWEGSLPQGAPTSPRLANLVNRRLDARLAGKAARLGATYTRYADDITFSFPTADPKAVIDAIRLTRDTVAREGYALHLRRKLHVRKQHQRQLVTGLVVNRGVGLPRERRRWLRAVEHHLSTGKPATLTQAQLAGWYALAHMIETQRNAPPS

SEQ ID NO: 6764 - protein, 322 aa, unidentified
  source 1..322: note = Planctomycetes bacterium ADurb.Bin126; note = Related to MWDR01000017.1
MGLGDILRRIFLGKDASPASPRAHVNPYAHRPDSISDVPVRDQPSRDLHELSQRLGMDAGELAACPIEYSVFRIPKRSGGTREISAPSASLKTFQRIVLRRLLARLKVHPAAEGFERGRSIVTNARRHVGRSVVLHMDIQDFFGRTTERRVRDYFRGIGWDKQAAALLTRLCTHGGALPQGAPTSPRLSNLVNYVLDTRLHALAARMGAAYTRYADDLTFSFEADRPGAVGSVIRAAKGIIDEYGYRLHTRRKLHVRREHDRQVVTGLVVNRKVQLPRPTRRRLRAVRHHLATDRTATLTPAQLAGWDALQSMIRTQADAAS

SEQ ID NO: 6765 - protein, 331 aa, unidentified
  source 1..331: note = Planctomycetaceae bacterium; note = Related to JAJFUU010000041.1
MGLWQIIRGLLGSSEANPYRAAGAPDGPVGRGSAAAAPSPPKRSRRRPPKFFLADLALRLGRDSNALSQIAVEYETFSIAKRSGGRRTIHAPQPGLKALQRDILRKVLGGLKAHPAVNGFRRGRSIVTNALPHVGHSVLVRLDIRDFFPSTTARRVEEYFRFIGYDDSSAALLTRICTHQGALPQGAPTSPCLSNLLNYRLDARLSALAAKMGATYTRYADDMAFSFSEPADAARVNMLVSAAQLVLSGFGYRTHHRRKRSVRRRHMAQCVTGIVVNDKANLPRATRRRLRAVRHHLMTGKEASLTAAQLAGWDALQHMIKVQSVPPSVPQ

SEQ ID NO: 6766 - protein, 305 aa, unidentified
  source 1..305: note = Related to DNAS01000030.1; note = Phycisphaerales bacterium
MGLGEWIGRLFGGKSQDRGGSVAPGRLVLVELSARLGVSVAELQAARVEYAQFTVPKRRGGQRKISAPSDGLKTLQRRILYRLLGRLKSHPTVQGFERGRSIVTNAVPHVGRAVVLRMDIRDFFPTTTAKRVEMYFRRTGWDAESAALLTRLCTHEGGLPQGAPTSPRLSNLVNHPMDARLEALAATAGATYTRYADDLTFSLPQDTPGTTARLIGSTKAILRSYGYRLHQDKKLRIWRRHDRQMVTGLVVNERANLPRRLRRKLRAIEHHLLTGRPATLTADQLNGWKALQNMVDAQALPPAQE

SEQ ID NO: 6767 - protein, 322 aa, unidentified
  source 1..322: note = Related to WGMA01000015.1; note = Phycisphaera sp.
MGLFGFIKGLLGGGAGDPRKDPTASFKRERPPTSERAAPPRRRGSRRPRDIAALAAWIGVGERELTRVSPSYQTFFIPKRNGDRRRIDAPSAELKTLQRRINRKLLRRLKTHRAATGFERGRSIATNAAAHTGNAVVVQMDIRDFFPSTTTQRVLDYFRAIGWEDDAARLLVDLTTHEGGLPQGAPTSPRLSNLVNHQLDARLDRLAARCHAAYTRYADDITFSFADGDPLVVRRVIRATKSILAEHGYRIHHRRKLHIRRRHERQVVTGLVVNDRANLPRHTRRWLRAVEHRLMTTGSATLTESQLAGWRALRQMIDRERG

SEQ ID NO: 6768 - protein, 316 aa, unidentified
  source 1..316: note = Related to BJHL01000001.1; note = Phycisphaerae bacterium
MLAWLFQLLLRSLIGTSPRRHFRLAESYREPSPNRYKPKWVKQRTLADLAKRLNVSIETLQSHKPTYAQLSIPKKSGGTRMLHVPDAATKRLQRALLRRVIGPAKSHDAAMGYERGRSMVDHAKRHADRAVVIGIDLQNFFPSTRAAWVRDYFIAAGWDKEAAKLLTHLTTHENALPQGAPTSPKLSNLVNHLMDARLTGLARHFGARYTRYADDIIFSLPTDDSLLVKSLVNLAMHVIANCDYRPHWKKKLFIRRSHQRQQIAGLVVNNGPPRLSRETKRWLRAVRHRLANGKQATLTPSQLAGWDAFEHMVENT

SEQ ID NO: 6769 - protein, 319 aa, unidentified
  source 1..319: note = Phycisphaerales bacterium; note = Related to JAIEUA010000002.1
MGLIQWIAGFLFGRPNEPISQAQIDAAFPKRRRVRRLSFEELSRRLDVNEATLKGFRPRYTRFQIPKRAGGSRRIDAPDAATKKLQRAIDKRVFGGVRLHAAAMAYVRGRSYVHHAALHADRAVVVSMDLENFFGSIRRWRVEALARWLGWDEEAAGRIADLCTLDGRLPQGAPTSPRLANILSIPMDRRLAGLARSRGAVYSRYADDLVFSFDADEQDVVHEVVHIANLIIWESWGFEMEVHHKRKLHIRRAGWNRQEVCGLVVNDGPPRLPRETRRALRAMRHRLENGGDADATPTQLAGWESLERMIQRQGSSTPR

SEQ ID NO: 6770 - protein, 351 aa, unidentified
  source 1..351: note = Related to JADLCM010000016.1; note = Phycisphaerales bacterium
MGLFRWLKKKLAPPDPFAAFESPAARSNAAGGVPGGVEDAAGAARRSPLRRSRAPHRDGRDAGIGAARFGLDELARRCAGPGIDPLTVEPGYRTFTITKRNGRPRRIDAPDESTARVQRAILRRVLGGIPSHGAAHGFERGRSVVTNASVHVDSAVIVKMDIRNFFGATRAERVLGFYRRFGWDEASAARLTELTTLRGGLPQGAPTSPRLANLVNYRLDASLHALADSVGARYTRYADDMTFSMDEDDASILNSIIGITRDALIDFGYEIHWRKTLHLRRTHQRQTVTGIVVNDGVSLARDTRHWLRAVEHHLRTGRAATLTPTQLAGWRAYEAMIDRGVNDDGTIADEG

SEQ ID NO: 6771 - protein, 317 aa, unidentified
  source 1..317: note = Phycisphaerae bacterium; note = Related to JAAYCJ010000271.1
MGLFSFLHGLFGGGRYGSEDLAQRLGLMVKWLDETKPHYQRFTIPKRAGGIRDIDAPNDELKKLQRLILHRVLAGLKAHPACNGFERHRSIVSNARVHARPDVVLRMDIRDFFGSTGAARVKRYCRAIGWDRRASNLLVKLCTWQGGLPQGAPTSPRLSNLVNYQMDARLAGLAQSIGARYTRYADDITFSFRADEANEARSSLARNPKTLDPAECRDDHRLPTAFAIRMTKAILADYGYKIHHKRKLHIRRKHQRQDVTGLVVNHKVNLPRRTRRWLRAVEHHLATGRPATLSAAQLAGWHALQHMVATQSQPGSP

SEQ ID NO: 6772 - protein, 389 aa, unidentified
  source 1..389: note = Related to nan
MPWGPDPASLFVDSTRARRHDVPAALAAPFAGRRTALRRPGPVAGLETQLPTWHVGQGGAGAGRKARARPRAPFTAADPMGLADLLRGLFGRSGPEPDRGAGIDELARRLGVSVEALQATPVAYRSFTIPKRSGRGERRIDAPEPALKALQRRILRRLLGRLKAHPAATGFERCHSIATNALCHTGQAVVLRMDIRDFFPSTREARVHRYFQKIGWNRDASGLLTRLCTYRGGLPQGAPTSPRLSNLVNVLLDTRLEALAKSIGAAYTRYADDLVFSFAKDERVSIHAAIQTTKTILEDEGYALHQDRKLQIMRRHERQRVTGLVVNDGVRLPRETRRRLRAVEHHLRTGRPATLTAAQLAGWEALRSMIDRQVDAARGGGGAGEGRGV

SEQ ID NO: 6773 - protein, 306 aa, unidentified
  source 1..306: note = Related to JAGNEZ010000007.1; note = Phycisphaerae bacterium
MGILNWLLGRRLRARRPAEYGPPRFGLADLVRRLGLSEAELRAVRASYREFEVPKRSGGTRRLAAPEPALKALQKRILRRALGRLKAHPAATGFERGHSIVTHALFHAGKAVVVRIDIQEFFASTAACRVEDYLRRIGWDAEATAALVKLCTHNGGLPQGAPTSPRLSNLVNRGLDARMQRLAAGLSACYSRYADDLTFSFDRDQSSADVRRLIGGAKAIITACGYRMHLKRKLHVRRCHQRQQVTGLVVNGQPSLPRETRRRLRAIEHHLRTGRPASLTPEQLAGWDSLRSMIETQRAQSPGGTG

SEQ ID NO: 6774 - protein, 324 aa, unidentified
  source 1..324: note = Related to WJLR01000725.1; note = Armatimonadia bacterium
MSGGPCAGHFGGAGARPRPQSLHKGGSTVGLWDRIRRLLGGGTPGHDLPSLAERLELTVDELRAVEPRYRTFDIPKRSGGHRTIDAPDDRLKELQRRVLHRVLHGLRAHPAVHGFEDGRSIVTNARLHVGKAVVITLDILDFFSNTTSRDIYRYLRFVGWSRSGAREIVRLTTYEGVLPQGAPTSPRLSNLVNYRMDARLAGMANSFGGDYTRYADDLTFSLTSDERVAVQGLIRTACEIIRDEDYEPHADKLTVRRRHQRQEVTGLVVNERIHLPRETRRWLRAVEHRLRTTGSCSLTEAELDGWLALTSMVHEQGEGVGVPD

SEQ ID NO: 6775 - protein, 300 aa, unidentified
  source 1..300: note = Hyphomicrobiaceae bacterium; note = Related to JAGRKV010000051.1
MAGLFAWISNRLDPGRSVEDLARWLKIEVADLQSVEPNYTTFRIPKRSGGFRTIEAPDERLKEVQRLILRRVLGGLKAHPCALGFERGRSIVTHAQAHVGKALVIRLDLVDFFPNTQADRVLEYFRSIGWNRRAAQLLVKLTTNNRHLPQGAPTSPRLTNLVNYKMDARLLAMARKVGGTDATYTRYADDLTFSVAHEGEHTSRDIIRGASTIVRDTGYLLHRKKKTHILRSHQRQTVAGLVVNDKVDLPRETRRWLRAVEHRERLGREATLTPAQLSGWRSLRHMIDTQRDPPARVRRR

SEQ ID NO: 6776 - protein, 309 aa, unidentified
  source 1..309: note = Planctomycetes bacterium; note = Related to JACRIL010000082.1
MGLMDFIRRRFGGGSGRSSLPAPDVGMDEKHLAGRLGVLPGKLELLNPTYKVFEIPKRGGGRRKIEAPAPMLKEMQNLILRKLLRRLKAHPCAYGFERGRSIAGNAAVHAGKAVVVRLDLKDFFPSISADRVRRYFRRIGWNGPAAELLVKVCTHEGRLPQGAPTSPRLSNLVNYSLDAGLLSAAKKYRADYTRYADDITFSFAIDDPGRIRSLIGSAKAVLSGEGYRINLHKKLRVARSHQRQKVTGLVVNSGVKLPRATRRRLRAIRHRLAAGKQATLTAAQLAGWTAFEAMIAAHDDPAAAGGQAS

SEQ ID NO: 6777 - protein, 317 aa, unidentified
  source 1..317: note = Related to NYZD01000065.1; note = Planctomycetaceae bacterium
MGVFDLIRRFFSNRDYDIPRDDPRQVPHDLSLEVRYPPALSVATLAERLGIAEGRLRNIEPNYNTFSIPKRSGGTRRIHAPSRELKAAQRRILRRLLARLNAHPTVCGFERGQSTVTHALLHAQQAVVVRLDIKNFFTSTDASHVAKYFRQIGWNREAIRLITVLCTHDGALPQGAPTSPRLSNLINYRMDARLAGLAQNQGAWYSRYADDLTFSFAEDSGERIHTVIRGAHRIAEQHGYEIHQRRKRHIRRRHQQQLVTGLVVNQTVRLPRHIRRWLRAVEHHRRTGKPTTLSDSQWQGWQAYAAMVERQSGATPQ

SEQ ID NO: 6778 - protein, 318 aa, unidentified
  source 1..318: note = Planctomycetia bacterium; note = Related to JAEUIE010000005.1
MGLFNWISKLFRRTLPPSVFKYPEPRWDKKELLRRLNLNEINLIYTVRGFNPRDTNLLAPHLIPLGYWWHKIPKRSGKPRMLYSPNPRLKLLQKLLLRKVFAKLAVHSACKGFRRGQSNCTHARLHVGKAVVVRIDIKDFFHSTSGNQVYDFFRRIGWNHEAASLIQAICTRKNRLPQGAPTSPILSNLVNYRMDARLAGLAGKSQAIYSRYADDLIFSFEQDNRRFIRGVIRRVVSILFESGYTINRTKLNVMRQHNRQVVTGLVVNRKVHLPRSTRRWLRSVEHHLNTGKSATLTREQLAGWKAYQQMIQTQSTGN

SEQ ID NO: 6779 - protein, 323 aa, unidentified
  source 1..323: note = Planctomycetaceae bacterium; note = Related to JAAYAY010000070.1
MGFLSWLLWGSGKSVGDLAEWLGVDVRQLKRLKPEYREFTIPKRSGGVRRIAAPSDELKRMQRRIGRRLLRGLRAHEAAHGFERNRSIVTNARVHCGQDVVVRMDLVDFFPSTSARRVHRYFRRIGWNRPAARLLTRLCTHEGGLPQGAPTSPRLSNLVNYRLDARIAGLVAALGGRYTRYADDLTISFAAEDAEDDWVIRSGPALPFVLEGHPEKIRYLRSFIRRVAGQEGYRVHRRKKTSVRRRHHRQMVTGLVVNEVVNLPRETRRRLRAIAHRAEQQKRPLLDADYRPFSYGRRQPTLTPAQLEGWEALQAMIVRQRVE

SEQ ID NO: 6780 - protein, 331 aa, unidentified
  source 1..331: note = Planctomycetaceae bacterium; note = Related to DUDC01000032.1
MTMGLIGWLLWGRGHGVGELARRLDIERRDIRRFQPQYREFTISKRSGGRRKIFAPNDELKKLQRRILRRLLARLRAHPAAHGFERRRSIVTNASAHQDQDVVMRFDLVDFFPSTSEHRVKRYFRRIGWNRPAAKILTRLCTYNGGLPQGAPTSPRLSNTINYLLDSRLAGMINAIGGAYTRYADDITISFSQEAEEDWGIRSGPAPPFTLRKHPEKIRYIRAFVRRAVREAGYQVHRGKKMNVRRRHHRQEVTGLVVNDHVNLPRKTRRWLRAVEHRARLLSQDREQSRYVMRKRPTLTPLQLAGWRAYRAMVLNGTGKTANATATRSHK

SEQ ID NO: 6781 - protein, 392 aa, unidentified
  source 1..392: note = Planctomycetes bacterium; note = Related to JACRUV010000658.1
MIRRPGPDGLAERRRVGHLYFRRRRAGPQIQVADTKQDSQGAAKANGRRGALCFAKDLFPFSTQYSRRSVMGFLSWLLWGRGFGLGELARWLDMDARELRRFQPEYRRFTIPKRSGGTRRILAPDDELKKLQRRILRRLLARLRAHPAAHGFERGRSIVTNARAHQGQEVVARFDLVDFFPSTSIQRVKTYFRRIGWNRRCAKILTRLCTHEGGLPQGAPTSPRLSNLVNYRIDARLAGMADALGGVYTRYADDITISFPKDEPEEEWVMRAGEPPPFSLARCPKKIAFMRAFVRRVVGEEGYRVHRRKKQSVRRRHHRQMVTGLVVNDGVNLPRKTRRWLRAVEHRAKMAKETPFDFANPSAKRPTLTPSQLEGWRAFQAMIANQSTGGEE

SEQ ID NO: 6782 - protein, 339 aa, unidentified
  source 1..339: note = Related to PBFX01000035.1; note = Planctomycetaceae bacterium
MGIRDPVVKLFDWIVNGTGHGTTELARRLGIPEQELRTVDPVYHAFSIPKRSGGTRKILAPEPRLKRFQRLLLRRVFAKLSVHPAATGFEPGRSIVTNARTHQGQAVVLRFDLIDFFSSTSTKRLRKYFRQIGWNRPASKLLLRLCTQQGGLPQGAPTSPRLSNLLNYRLDARLAGLIVKLRGRYTRYADDITISFATRDLHAAGKSDFPARNSAGGTPNHPTQTPTGQDTIRSITRAVQKVIESEGYRMHHRKKLSVRRQHQQQVVTGLVVNQRVNLPRSTRRWLRAVEHRTQMSQPLSLTSYQPGSYSRRKSPTLSPAQLEGWRSFRAMVQRQAIDD

SEQ ID NO: 6783 - protein, 328 aa, unidentified
  source 1..328: note = Related to MHYN01000254.1; note = Planctomycetes bacterium RBG_16_64_12
MGLIGRLIGWLTKGRGHGVEELARRLDSDLLDLSRFQPDYRPFTIPKRSGGQRRILAPERHLKRLQRRILIRLLARLRAHPAATGFERGKSIVTNARAHQGRAVVLRFDLVDFFPSTTAERLRKYLRRIGWNRPATEILLRLCTYEGGLPQGAPTSPRLSNLVNYRLDARLAGMAARLGGVYTRYADDLTISLPDEEQEKDWTIRSGPPPLFGLETNRDKIRFLQAFVRRVVEEEGYRLHRRKKLSVRRRHHRQEVTGLVVNDRVNLPRSTRRWLRAVAHRARLARQEGPGPSRPPSGGLPKRPTLTPAQLQGWQALESMIARQRTEG

SEQ ID NO: 6784 - protein, 327 aa, unidentified
  source 1..327: note = Pirellulales bacterium; note = Related to JAFGAY010000394.1
MGWLDRWFPGEGHGIDELARRLHVDPEQLRRTAPRYREFSIAKRRGGRRRILAPQTDLKNLQRRILRCILARLKSHPAAMGFERGRSIVTNALPHQGQAVVLRLDVKNFFASTRAGRVRRYFRLIGWNRPAAALLTRLCTHEGGLPQGAPTSPRLSNLVNYPLDARLSAMCERLGAVYTRYADDITISLSDEKEDRPLRNPPPRRGNVSPPPLSSEPNRLRYLRHFVRRVFDQAGYTLHWRKKASIRRRNHRQLVCGLVVNHRANLPRETRRWLRAVEHRTLLEKQAKTAPLSSLDRGRRKSPTLTQTQLDGWRALRLMITQQMEEG

SEQ ID NO: 6785 - protein, 365 aa, unidentified
  source 1..365: note = Related to JACOUH010000027.1; note = Planctomycetes bacterium
MKDLQRRILRRLLKRLRCHAAARGFQPGESIVTHATLHAGRAVVLRLDLRDFFPSTGSSRVYQYFRRIGWNRPAARLLTNLCTHQGGLPQGAPTSPRLSNLLNYRLDARLAAMAARLGAHYSRYADDITLSFGQDDRDRIRYIIRFVKRAAADEGYRVHGRRKLRIRRRHQQQRVTGLVVNAGVRLPRQTRRWLRAVEHHLRTGRVATLTPEQFAGWQAFRQMVEGRPRTASPAPLPPPLVPVPVELDGAWVLVALQKNGHAIPVNMPAEGIGPAEWTFASGELRIAQGDHEERADCSVDASTEPPRITIRPAGQEAGTAQGIFRLEGDKLTICVSEEGQPLPSAIPSVPGTGWTVYHLRALARR

SEQ ID NO: 6786 - protein, 305 aa, unidentified
  source 1..305: note = Planctomycetes bacterium; note = Related to CP066225.1
MGIFNKLKSLFSSNSSEPQHQTPTTPARFNLLDLEHRLDISHRQIKLIPLDYHTFTVPKSNGHKRLITAPNPELKKLQRTIAKRLLTKLAVHPNAVGFRKNHSVVTNAKAHTNSPMIIKLDIRNFFQSTPAQRVNHYFRFLGYDADSAQLLTSITTHIDHLPQGAPTSPILSNLLNYKLDTALTTLAQNHKAIYTRYADDITFSLDTKDSEAARNLVNAAAYLLHQFGYKLNNRKKRIIRNHRQQRVTGLVVNEKVNLPRETRRLIRAIQHAHDNNKPTTHSPQQLQSLKAYHQMIITQSEFETH

SEQ ID NO: 6787 - protein, 301 aa, unidentified
  source 1..301: note = Related to JAEIOG010000060.1; note = Phycisphaerae bacterium
MGLFDKIKGLFGSGSSGGVSGLTIDDLAQRLDMPVERLEGVEISYHSFTVPKSNGHQRRITAPDDKLKQVQRAILKRLLNKLAVHPNATGFRKGYSVVSNARLHVGSEVIVKLDIRNFFESTKINRVNKYFKFIGWDRKTANLLTELTTYKGGLPQGAPTSSALSNLLNYKLDSSLTTLAKKKGARYSRYADDMTFSLDGSDSKVINSIIWGAESALHDLGYRLNNRKTKVIRKHRQQRVTGLVVNEKVALPRKTRKLIRAIEHSQQNGRPSTHSADQLRSLKAYQAMVEKQGEDGELDEG

SEQ ID NO: 6788 - protein, 312 aa, unidentified
  source 1..312: note = Related to JAGKQQ010000001.1; note = Gemmata sp.
MWPIFTPLWRTLSGGRSAPEAGIAPLPFESNWAERLARLGLSPENQRAIVASGALHPHLHYWRFQKPKRAGGRRAIAEPDRRLKRLQYAIVSWCFSAERSHPAAIAYQKGRSTADHIWAHAGAEIVITADIRDFFPSTRAERIETWWRERTDSDTARLLTLLTTDRDGLPQGAPTSPGLSNFVNTELDARLTRHAAPSGARYTRYCDDLAFSWPISSGPPSGFERGVRAALHEFGYTLHPEKGWRVSHRRDEPEIVGAVLTRSGGVRLPDRLRRVIRALARSASPGDVPKLAGYRGYAAQVTNRPGRRNPKT

SEQ ID NO: 6789 - protein, 309 aa, unidentified
  source 1..309: note = Related to NZ_LR593886.1; note = Gemmata sp.
MWPIFTSLRRTLTGGRSGRTGDRPPVSSEADWAERFARLGLPPETLRNIIAADSLHPYFRYRRFHKPKRDGGRREIAEPSPRLKRLQREIITQYFATEQPHPAAVAYQRGKSTADHVWAHAGAEIVITADIRDFFPSTRADRVEMWWRERVDSETARLLTLLTTDCGELPQGAPTSPGLSNFLNTEMDAKLTRRATGACARYTRYCDDLAFSWPTGFGPPSDFERGVRATLHEFGYELHPKKGWHVHRRGDEPEVTGAVLTRSGGVRLPARIRQMMRALARRATSADTERLKGYRGYAAMIATRPRRRG

SEQ ID NO: 6790 - protein, 316 aa, unidentified
  source 1..316: note = Related to JAIOHM010000031.1; note = Anaerolineae bacterium
MNNPLSTLWYKLTNNWVAIYRQRYGYSDDYLTLGQMLGWGAIGALNVPQVPYPTLLRVLRRNSIYPDFRYRHFTRPKADGSLRELVEPDEKLKRIQRKILKTLLKNALIHPSAVGFRRKKSTADHAWAHAGAATIITADIEDFFPQTKTYRVEAWWKSYFIEQPEAESAARLLTLLTTYKGSLPQGAPTSPALSNILNYEMDAALERRVVASGGQYTRYCDDMAFSWGGIGDVPADFETAVRSIVQEYGYHLHRWEVWNAHDEPELTGIILARHGGVELPDDVQQTIRRLARSTSASDMARLQGYRAYESMVKKRR

SEQ ID NO: 6791 - protein, 327 aa, unidentified
  source 1..327: note = Anaerolineae bacterium; note = Related to JAHBVJ010000016.1
MLNDLPNTLRRLVGLPPAYRYTSPARNEGEWSMVTLCYRLGLKVEDAHQIMDSAAFPSGFRYREFTIPKRDGSPRQLLEPGPKLKQVQRRILTMLLRKAQPHHAAYGFRRKKSIADHAWAHANSRIIITADIQDFFPNTTRQHVKQWWHEQGFSTPEVRLLTALTTLHGSLPQGAPTSPPLSNLVNAQMDTALERHIQASGGIYTRYADDLCFSWPEGYAPPADFEFAVRSVLHEYGYALHPDKGWQVWDRDEEPTITGVVITKHGSVDIPDSMKRIMRTLQQHGTAADDTRLQGYQGYQRMITREPRPEKASAGLGKAPIKSPRLR

SEQ ID NO: 6792 - protein, 304 aa, unidentified
  source 1..304: note = Anaerolineae bacterium; note = Related to JAFGMM010000127.1
MWHRLPYALRKLRQTLIPIRYEPPDYALWNLQARLGLTPAEVSRLAMPGPFPPRFRYRHFTVPKKDGGRREICAPGPRLKEVQRQILRAYLDPRAPHPAAMGFRRALSIADHAWAHAGAAIIITADIEDFFPSTRARRVAAWWAAQGFNDAEVHLLTRLTTYRGSLPQGAPTSPALSNLVNAELDAALHRRAQQSGGVYTRYCDDLAFSWPDGGRPPADFEPAVRAALLGAGYRLHSGAEKGWQMWARRDEPEVTGLVLTRRGGVALPPPLYARMRSLARSDDPHDAARLAGYKGYELMIRKRR

SEQ ID NO: 6793 - protein, 316 aa, unidentified
  source 1..316: note = Related to JADZFG010000029.1; note = Anaerolineae bacterium
MLNKLPAPLRNLFGLYTSYMQPVKHPGEYALYMMAYRLGLNRYPVYRFLEPGPLPPYYRYRHFTVPKQDGTRREIVEPGPNLKAAQRRILQLYLNNRKPHPAALGFRRKKSIADHARAHAGAALIITADVEDFFPNTSRQRIKSFWRQQGFSTLEVRLLTALTSYRGALPQGAPTSPPLSNLVNYELDAALDRRVKPSGGTYTRYADDMVFSWPDLASPPADFEQTVRALLREVGYTLHPRKGWHVWVRRDEPLVTGVILKRDGSVDLPDSMRRIMRELARSDDPNDRARLAGYQGYEAMITGDATPVSRRKAQGR

SEQ ID NO: 6794 - protein, 318 aa, unidentified
  source 1..318: note = Chloroflexi bacterium; note = Related to JAADYZ010000077.1
MLRDILPAPIVDLLTQSLGVSLRRPRGFSPPAGDTWIIYHFFRYTLAMRDEDARAFLAGGKPPKGFTYRHFTVPKKDGSDRQLVEPGYALKAVQRRILRLLEARGVTNPAALAFRKGRSIADHAWTHAGAAIIITADIEDFFLSTSHRRVREVFHSIGYVDDRAHYLTRLTTYRGSLPQGAPTSPILSNLVNAEMDKQIARRTSESGGRYTRYADDMAFSWPDRFRPPGDFEQTIRGILREHGYRLHPRKGWRVWLRRDEPELTGLILTRRGGVDIPDSMKVIMRELEKGQSEDQAQRLSGYEGFRHMVQATRRRYRA

SEQ ID NO: 6795 - protein, 314 aa, unidentified
  source 1..314: note = Chloroflexi bacterium; note = Related to JAADYX010000020.1
MTRLDQILPDTLVRVLRMIATGYEHIPYRGHDDPYRSIYWMVGYRVGIDPPTIRAIMEGGDLPAVWRYRHFTVPKKDGSPRQLMEPGRDLKAAQRELLRRLNSLDPHPAALGFREGLSIADHAWTHAGARTIITADIEDFFPSTQATRIYDFWVRQRWVYDEIAARFLTRLTTYRGGLPQGAPTSPALSNLVNVGLDTKLAARARSAGATYTRYADDLVFSWPDEGRPPADFQHGVHAALHEFGYRLQPRKGWRVWHRRDEPEVTGLILTRGGSVDIPDSMKALMQTLERTATTEEDFQRLAGYEGYRQMVVRE

SEQ ID NO: 6796 - protein, 302 aa, unidentified
  source 1..302: note = Related to JAFGFI010000446.1; note = Anaerolineae bacterium
MASVLARLMGIFSVSTTKMCREDIFETPQVFRLSLLMDVPSATLLRFRSGWPGGRYYYRPLRCEKRDGSPRHIYAPSPPLKALQRALLSYLNSLTVHPAALGFRRGFSIADNARAHQGQAVVVTADIEDFFDSTPAQRVRDFFRAEGWDTTAVSILTRLCTFHSVLPQGAPTSPVLSNLVNTHLDADLTRVILQSGGRYSRYGDDLTFSWSTRAVPSGFEATARAILLSYGYHLNAQKGWRIWRVYAGDVAYITGIRLGLDGRLHPSSEIQQNMRELRHQRNDPVAAARLQGYQGFIKMLRS

SEQ ID NO: 6797 - protein, 313 aa, unidentified
  source 1..313: note = Related to NZ_JAALJI010000003.1; note = Paludisphaera sp.
MSPWRPLGRLIPTALRSILPRFEHDSGAMGRLSTILGLSEDELRAFRLGPRYHYRPFTIPKPDGRNRRLLAPSAALKRLQRSLLDEYLGRLPVHPCATAFHPGASTVRHALPHARGTRIATVDLRDFFESTTAARVRRFFVSKGWRGESLGVLMRLCTYRGCLPQGAPTSPCLSNLVNERLDDRLRVLARRSGGRYTRYGDDLAFSWVERPMPAGFQRSIEAALERSGYSIQPRKGWLVREARGRPQVTGVVLAGDGRLHVPWRYRLRTAWLRWRGFWSRDPHVRAQWRGRQAYRRMVERGKAGPRRRPGRSS

SEQ ID NO: 6798 - protein, 313 aa, unidentified
  source 1..313: note = Related to NZ_CP011273.1; note = Planctomyces sp.
MNPGHPLSYLVPPTLRRLLTPAGPSSAHAQALAQLLGVAEDELDAIRLGRRYHYRPIRGAKPDGRERRILAPSPPLKRLQRRLLDEHLGRLPIHPCATAFHPGASPVFNALPHARGATIVTLDLRDFFEATRAWRVHRFFREQGWSGEPLRVLMRLCTFRDGLPQGAPTSPCLSNLVNVRLDEKLRRLAARSRGIYTRYADDLTFSWVDGGMPGGFQRAVENVLEREGYEIQPRKVWRVSRARDRPRVTGLVIAGDGRVRVPWRFRVRTVLLRWRSWLTGDPVARARWRGCQGYLRMVDRSREGARSRPRKGG

SEQ ID NO: 6799 - protein, 300 aa, unidentified
  source 1..300: note = Related to MKTT01000068.1; note = Planctomycetales bacterium 71-10
MTPRHPLVRLLPPWGRDVDEALQREAVADLLGVAVDELDAIRMGPRYHYRPLAGTKPDGRERRILAPSPALKKLQRRFLDAYLVDQEVHPAAMAFRPGGSTLAHALPHARSRLIAAVDLRDFFESTRGGRVARWLAAQGWDREATRILMRLCVFRDALPQGAPTSPGLSNLVNRRLDERLDGLARRTGGVYTRYGDDLAFSWPDERLPGGFTASVEDVLARSGYEVQPRKGWRVGAARDGFEIVGLVLAGDGRVRVPRALRWRAALLRWRAALVGDPATTRRARGLAGYLKMVDRAPRTR

SEQ ID NO: 6800 - protein, 301 aa, unidentified
  source 1..301: note = Related to JAEUIF010001079.1; note = Planctomycetia bacterium
MDLNPGELLTRLLPNCLLGQAATPSAQRLADLLGIDVRELPAVRLGPRYHYRPFTIRKPDGRERRLLAPSPALKVLQRRLLDRYLAALPLHAAATAFHAGASNVLNARRHAHGRLIATVDVRDFFESTRAARVRAFFVRQGWHDAELHTLMRLCVYRNGLPQGAPTSPCLSNLVNRPLDERLENLARRMQATYTRYADDLTFSWDRDHLPDGFRPAVEDALHAAGYEVQPAKGWRIHGIGDRPVVTGLVLAGNGRVYVPWSLRWRLWRWRWQAWWSGDASAPLRLHGLESYVRSCAAVPEA

SEQ ID NO: 6801 - protein, 398 aa, unidentified
  source 1..398: note = Anaerolineae bacterium; note = Related to JAFGLD010000107.1
MEHLLSRFIPRSLRNLLPRQSSPSVSAMEMRLVGLLGVWPSEFSTIRLGRKYHYRPFSVTKRDGRERRILAPSPPLKKLQRMLLHRYLDTLPVHPAAMAFRRGCSIVDNAQRHAGQKLVATLDLVDFFESTTADRVRGFFLKQGWHGEALSMLMRLCVYRNGLPQGAPTSPALSNLVNYEMDERIADLARRADAVYTRYGDDLTFSWRTEHIPAYFVPALVSILTDAGYAIQPRKPWRVRPMSDEPKVTGLVLGRNGRIRAPLNLQWEVVKLRWHLFWHSGDAHARARLQGYQAFLQALEVKYDNHNHINWPDNLPGLRWEIFKLRWRLLLRPGDSDARSRLAGYQSLLYYYQANRKNSASTYRYISEGNDDYNDYDDEDDYDDFEDYDNDDLDELPF

SEQ ID NO: 6802 - protein, 300 aa, unidentified
  source 1..300: note = Related to JAFGMS010000346.1; note = Anaerolineae bacterium
MHNPLAHFVPRCLRELLSIPSTQASEWEAQLAYWLQVPVGELPNIRMGPRYHYRPFSITKRDGRERRILAPSPALKQLQHRLLHNYLYTLPVHPAATAFQRGCSIMDNARRHAGQTLIATLDLVDFFESTTADRVRRFFVRQGWRGKELAVLMRLCVYRDGLPQGAPTSPCLSNLVNYDLDEQMASLAQRADAIYTRYGDDLTFSWRNDRVPAYFEPKLRGILTDAGYAIQPRKAWHIQHINAGPQITGLVLGHDGRIQIPRRLYWEAFKLRWRLWWRPDPHTAARLQGYESFFNTPGLR

SEQ ID NO: 6803 - protein, 301 aa, unidentified
  source 1..301: note = Candidatus Uabimicrobium amorphum; note = Related to NZ_AP019860.1
MVKYSWQKILRDILPQKNIMAANTDDTNLEMLSSIFAIRIDILQEVSRSIHRHYTTFEISKKNGGTRNIYAPNPTLKKVQYEIFHYLQNFAIHPTATAFIPGGSIIVNARQHLNQELFLTVDIKDFFTNTSTKRVRNFFRDQGWEKQSLDMLVSLCTYQGGLPQGAPSSPQLSNVINMELDEEIYQAASASSATYTRYGDDITFSWSTSCMDSGLKNKVTQILTNFGYEISPQKGWQLFCAEQQPEIVGVVMGSDGKLRVPQRIHEKLDKLHQKNNPDLQGQIRGYENYIKGVESASVSIA

SEQ ID NO: 6804 - protein, 319 aa, unidentified
  source 1..319: note = Related to JAFGWW010000022.1; note = Planctomycetes bacterium
MGLFDFIGKFLGTSAPETASTKAASNAPASPYANQNYYIKKAVYLKYYLGQNENQLKEFRPEYNTFQIPKRSGGARTINEPKPETKALQHKILRMLRNGNTHKCAVGFRRGRGIVHNAIPHVGKAVVLKMDIRNFFPSVTREKCVTAIMQTGWEKGAAEILADICCLNGGLPQGAPTSPLLSNIANTRLDCRLYGLAKKLSTGTQKVDYTRYADDITFSFATDEPGLVRGVITLIFQILHEEGYQVNKKKTRVMRQHQRQTVTGLVVNETINIPRKQRRKIRAAMHRISVGEEPTLTNEQLQGWMGMLSLVQKGKEEYL

SEQ ID NO: 6805 - protein, 323 aa, unidentified
  source 1..323: note = Anaerolineales bacterium; note = Related to JAEURL010000499.1
MNWLSQLTRGLRRERTPADLARWLGLPEAELRPWLASGPAWARGYEYRRFTIPKRRGGVRVIDAPTEKLKDLQRRVLRRLLAPLAPHAAATGFRRGHSIVDNARPHTGQAVVINLDLADFFPSIAAARVDALFRAVGWNAEAARILTAICTLDGALPQGAPTSPALSNLVCRRLDARLAALARSQGGAYTRYADDLTFSFPAFGRNRRLRRHAGRPTPGRRPAPSWVTPRSLLGWVRAILEAEGFRIQFKKQVRVQRPHQRQTATGLVVNQAVNLPRATRRLIRAMQHHERLGRLDAAGRRRLRGLEALAGMVARQREEPQRR

SEQ ID NO: 6806 - protein, 319 aa, unidentified
  source 1..319: note = Anaerolineales bacterium; note = Related to JAGOBN010000015.1
MSLFNWIKQALGRARSPADLARWLQLPEAELRLWLDQRPAWTRGYEYRSFTLPKKRGGTRVIDAPTEKLKALQHRILRRLLNPLRPHPAATGFVPGLSIVDNARPHAGQGVVINLDLENFFPSITPARVEAVFRAHGWDAEAARILTAICTYENALPQGAPTSPALSNLVCRKLDARLAALAEYFDGAYTRYADDLTLSFPSFGRNRRLRRHAGRPTPGWRPKPGPAAPRTLLTWVRAILEAEGFRIQLKKKVRVQRPHQRQTATGLVVNEVVNLPRAVRRRIRAMQHRERLGQLDEAGRQRLRGWEALAHMVANQREG

SEQ ID NO: 6807 - protein, 323 aa, unidentified
  source 1..323: note = Related to JADZEK010000016.1; note = Anaerolineales bacterium
MNFLKAFGRLGGRERGLAELARWLGLPETELRPWLSSAPAWARGYDYTRFTIPKRRGGARTIDAPGDKLKALQRRVHQRLLAGLKLNPAATGYVRGRSIVDNARPHTQQAVVINVDLADFFPSITADRVKAVWRAHGWNDEAATALTHICTLDGRLPQGAPTSPALSNLVCRRLDKRLSELARRCAGAYTRYADDLTLSLPSLGRNRRRRPGPPRSGPAQPRLAQRARHSRKIITQLREIIEAEGFRIQWKKRLRLQRAHQRQTATGLVVNAVVNLPRATRRLIRAMQHRDRLGQLDEAGRRRLQGLVNLQQMVLKQRNSTGR

SEQ ID NO: 6808 - protein, 348 aa, unidentified
  source 1..348: note = Anaerolineales bacterium; note = Related to JADLEU010000283.1
MLRRPGTAAAAEVGLLDYVQQAELPGFLMPVFASLNRLLKRARSPKDLARWLDVPEGELRGWLSGPAPWARGYDYDHFTIAKRRGGTRTIDAPGDKLKVLQRRVLHRLLGPLPARPEATGFVRGRSIVDNARPHVGQGVVVNFDLADFFPSITANRVEAAWRALGWDAEAATILTRICTLDGRLPQGAPTSPALSNLVCRRLDARLGALARSLRGQYTRYADDLTFSFPGLGRNRRRRPGPPRSGPARRRPRGPSRRVLATVRDIVMAEGFAIQWKKRVRIQRAHQRQTATGLVINRKVNLPRATRRLIRAMQHRRRLGRLDDAGRRRLRGLEALAAMVDRQRAAPGR

SEQ ID NO: 6809 - protein, 317 aa, unidentified
  source 1..317: note = Related to JACPWC010000114.1; note = Chloroflexi bacterium
MNLFKSLFNTVSGGRSPADLAKWLDLPEAELREWLTNKPAWARGYEYARFSIPKRRGGVRAIEAPNKKLKALQRRILRRLLNPLKFHPAATGFVPGRSIVDNARPHAGRGVVINIDLAEFFPTITAERVTQVFRSLGWGAEAATILTNICAYEGRLPQGAPTSPALSNLICRKLDERFSALVKRYKGQYTRYADDITFSFPGLGRNKRLRPKPKGRPPLARPAQGGPGRTLLTLIKTIVEEEGFRIQMKKKVRVQRPHQRQTATGLVVNRQVNLPRTTRRLIRAMQHRQRLDQLDAEGQRRLKGLEALMDMVSRQRG

SEQ ID NO: 6810 - protein, 336 aa, unidentified
  source 1..336: note = Acidobacteria bacterium; note = Related to JACQNR010000440.1
MVQNADRKKAGRAVRREYPVVGVFKSIARILDRGRGPDKLAAWLGLRQDEVEAWAQGRPPEPSGREFYYNRFTIPKRDGRTREIDAPSDALKSMQRRVLHRLLNPLPAAAESTGFVRGRSVVHNAQPHTDQDVVINIDLENFFPSITAQQVRASLVACGWSNTSADILTNICTYQGRLPQGSPTSPPLSNMVARRLDARLAGLVKGYDGHYTRYADDMTFSFPAFGAALDWKASTAVKQARCKLLSMIQMIIEEEGFKIQRKKRIRIQRAHQRQTATGLVVNSRVNLPREFRRRIRAAEHREKLGKLSAEDKARLRGWQSWRAMVSHQGAQAASPP

SEQ ID NO: 6811 - protein, 791 aa, unidentified
  source 1..791: note = Related to JAFUWU010000052.1; note = Oscillospiraceae bacterium
AAKLAGLPEDIAREDVSIAGLDGLRLSWGETLFAPDLAAITPLTDQAGRFAGSVLGCEAPAWCFLPVGRMATRLRFSSELESMPESMRRQLADAYIETHPQKVAPGQGGMHWLTAKSFECPEWEDLCALQTSKPTPELLQAMANTRQRRAVKEAMRYLRLFRDRNYENCVTRFMGTELWRKAGGVRLHQDLAEDLEKFLGMPGAVLSAPERQRFAAAAILDAEDREELARNFSRLIGSRVPAEFVLEHVCAGGRKDAVQLLLDSAPDAIRRRYIIDFIGTHLWERAGGASLHEDFAQDLAQALASPSRQLAESELCRMALRMADERHDASLVAAVLPALTRSDKTWAAAEQGVETPLLVEAVRAIDESDILDRVLSFAKQPDIELAAHDALLQFLMFDEEILEEHLWRAEHRCSAKRLPECETTLAQLTAIAIREHGNLRRMARLLSAHAEKCGLKGRQAEGLVAQALRSAARLVSRHGRHRAAALELLSCIGLECATALKYVLANLDRKAGSGRELDHVYHLWELPKKSGGKRTICAPPMPLKIVQRAILHRLLEPLGAHKAAYGFVPGRSIGQNAALHVGSEVVANTDISSCFPSVRWQLVLGVLRRDLGKTLLSGTVSLVTDICTGQGGLPTGAPTSPAILNRVLLKTDEILTAAAARRGCTYSRYADDLTFSGGRGAVEMLGVARSTLERIGLKLDPKKTNIFRRGRRQTCTGLVVNDKVAVPRAIRRRLRAAVHAVEQGREPAWHGREDTVAALGGRLNFLASVQPEKAAPLKERLARALHGGKDR

SEQ ID NO: 6812 - protein, 1108 aa, unidentified
  source 1..1108: note = Related to JAGZDF010000029.1; note = Sutterella wadsworthensis
MTANGEARFAEVIKAFPTLSEAEVLRLSYAFFKSEPENQAILLSIAKRGALASVAQDIEAQYPPSSEAATYLLKGETLVLPGFCTALPTEIQLRYLLAKWAHSSTPNVLQLVQKLSSFKGLKSLMLQAELQVLVGYLKAHSIWVTKCEPEATLLLPKDLISGFMHGDVADEFFLGGSALQHLEDLANCGLRSILVSVNNAWEKLEFDKLNELFERVPNALIDHPLQPDLQAALKKRMISSSKHTLAKRLKRKKNQTWNFMDQRVATALSHLLGFKVPRWAIGDHEAFSQILVDQNLLQCFDDRQLQKLINEIGMPVMTACAAQSATQKLVKNYPEAYAPLPLSTIWRAVNREDMFKVVGWPKITLESLTLALNAGIAQQKLVWLSGYMKAVDASQKEAIQTLLLTKHLKLAARVIESTDPCWLQVPIKACVENGLWSVVLQADAKRVMDEVPRRFLVDKVLGNCRRKAFSRDPFDRIYDDQLLEAYRALTSNTALRRHFVTSLLERSWCTDHKGTGYLILGGRRFSYVALATELLRCTAFVGDRDYRKEVVVQGLKSAKSQSHRQTLLRLIQQDVIETDMPEAWIKAVLSWPKEVLKTLLPKMTGKLLDAYVDRVGVRGLNACYATSPKALSSRHFFALRVTRLKKGGVWPEDRLLKRDDHGYDEVIETASNFLGIREARCLDMCLERMADKGEAVLQYLCEHAKDVMSHELTRWVDVVLARYAIAPEARLKALTSDVTTADVKFWPQQGPDGDEGDVYAYLRVHHSLKALSEVWSARGVVPDNVRTIMASKWPNDAAWFELMLVLGPSYVSLIRQVMGMMDFKAPFGSRFDAHYRHSTIPKKSGGVRDIYAPERALKALQTLINVKLLQPLGAHDAAFGFVPGRNITGNAERHVGQSIVTTADIHSCFPSVGRGLVVHALKRDLGERLSYGAILKIADICLSQGVLPTGAPTSPALLNRVLLRTDELLTDAATSKGCTYTRYADDITFSGGEGAVNLLGVAKGVLKPIGLMLDPKKTNVFRRGRRQCCTGLVVNDRVSVNREKCRRLRAAVHALEMGRPLLWDGKPETVAQLRGRLAFLASVKAEEGARLMARLEAALRQKTTVCAQ

SEQ ID NO: 6813 - protein, 1226 aa, unidentified
  source 1..1226: note = Related to JAKNCT010000004.1; note = Mesosutterella sp.
MKNFRQAKDESSFSLEIRDAVNSLDFAIPRALPRGDPFAPSVPEEYWKKIRSAVEQLWPARVRPLFKGKDEARAYQEAWISAAYSPFWDCLRISALWCAGQPGRQALLEAVRQADAVPRQYPPAASPLLKAVERGPHNPYLDEESALDKYREVFPIGSFTPPIDTCMKLGRLVVESRRKRPACVSAWDVFRCLPPTLPHLSCRWLTRTLLGFADACARLGIRIKKIPAACAAFLGRDASIAIRSPAVRSFFLLPPKKDFSIDVRAPAGMTLLGYLFYAFSKTGEYEAVFIVSESLLRAFSGEPKLLRRFKESPGYQLFLKAAVQEEPTPKGRRDWLGERRSLEGNPRVGALLRHLFGKILPGWNRSGQASFLVELAKGARANCYFPREYQRFLLLVSSERQKRRLEESGHWLQLFDLEDGCRKGAANWKFILLQESWDTVWNAKDRLQEELTAEKDASAYLRFVARHHPSGDLSLDFYNNKKIKERFIYDFHGSPLWEKAGGACLEPQQAEALCFAWGSASFRGRAGSLAPALEEVGPYCLEDLLALMLTPAGLRRCRGALLRVLPRASADAVRHIADRCEEGDVLRAIALHGPEEARVPAALRAYDQLAPGKAAALGRKLFLAGLPVRLAPGWLDRGSWSAEKLFLALCELCGDPDRAGLRQALEACAPEPAGSRRLSRKARLIVARLAARAARRFEPGEAGAAPGALSAREVGLAEWLLREARCCAWGAASYNGPGQSIAPALNEIGPNCREDLLALMLTPAGVRRGGGALLRVLHKAPAEAVLEIIDHCTDVEVLQAIALHGPKEARVPAARQAFDRLRPQKAIELAKKFFLAGLPVRLAWGCRDVKSWTREKLFLALCASCDKRDANELCEVLDVFARSFQGPDAEAAARGTLEEVARLAARAGRLLVSAEAGLVAGLWPGKQARIVKWLISAMDWKAAPGCRLQKSYRRFHIPKKHGGKRLISEPIKKLKFLQRGVLERLIAPLGAHPAAMGFVAGKSIADNASVHSGQPVVAVADVHNCFPSVAWPVLYRVLERDLGPRLGAPACALIADLCTLDGGLPMGSPASPALLNRVLFKADEILASEAKRKGCRYTRYADDLAFSGGEGAVGLIARAGSVLSAAGLRLDPKKSSVFRRGRRQVVTGLTVNAKPDVSRDYRRRVRAAADRWRKGLEPSWLGCPVTREQLLGRIAFVNMTSAEEAVRLRKWMREGDRLRGKKGKAA

SEQ ID NO: 6814 - protein, 999 aa, unidentified
  source 1..999: note = Related to RGQD01000262.1; note = Betaproteobacteria bacterium
MTAPDPRQRRAEDLCALLEQQGADLFAAPRMAGLDPYAHDFGACWLSEFSAGLAPLWPACLSLFGRQLPKQAVLQQCWSVAMERPLWLGMLYRAACAAGLSPAASPLLWAEASRLKAITAARWRTDAMAVALMAADAAAVVVPDLGPQTALKGSLRLRYRLAHLCATGAALQGLIDAAAHQSGVTDYQRRVELARAVHGAQSGGRRWRPLREVEYLLLTPKSRQLVIGTPALWPLLLGAALQRLAALPDHLAGRIAERDSLSRWLASMMLALRERRLDQAGADIARLDDSALLRQLVLVLRREQAGLRRLDADFGLATLHGSDGRAWAPMEAVALARLSSLCGRAMPVWWAMSAGKVAQQLAVGALQSSELPLHDLVLLRRGWCEADELLLIAAGKGGLLLADAVGWRSAPLTDLVRVANEPGKFGNFGRQKLADRLLALPDARPWLLCMAGPQAPVLRALADRAISDCAQTFARSWGRFVSSSIGTPEWQGVIDAVQDQPGTYPLVFMYGLALLADGRTPVAPQGFGQAMLASLCVAVGDGAAPLSSSAGLPGPLPEQAAQAAALSLSTQRLLRHLLPAVLRWLELDPQATDGLVDEGPEPLLMALAAHPESPLPLLDRLRFSSRPVLQRAAWRQRLHRVSSLDDLRDLTLHLPPQVGLLPWRTRWLSLAADDALQRAVTLLACARRNGWWLRALHKHLGEPLWLDGLQGAITLLKGSAAREAAMLELVRAVGAELAPPLMAVFAAARRSAAPGHKLDASYTRSLRPKKSGGQRVILAPGRALKRVQRAVLDHLLLPLGSHACACGFVPGRSICDNAAPHVGQPVVVNADVSNCFPSVKWPLVLGALRRDLGHSLAPVAVSMLVDICTAEGGLPVGAPTSPTLLNRVLWRSDEVLAQAAEQRGLRYTRYADDLTFSGSDTAVQMLGVARRTLAQIGLALDPKKTNIFRRGRRQMVTGLVVNQQVSVPRHIRRRLRAAVHRVEQGGVAQWDGAEQSAAA

SEQ ID NO: 6815 - protein, 977 aa, unidentified
  source 1..977: note = Betaproteobacteria bacterium; note = Related to RFVU01000247.1
MLDVLKLLNAQQDRLRTTLTELDPLAPQFAETAWQAIAALAEPLWQPLRQMVDTERDVYVLQQAWAVCWKSRLHVALLYRAGMANPATREEALRLRGITLERWQKPLSPKDDVRQHDLVAFLMAADETEAGVPHLGRNAYYKGSIRLRYALAHAYRSGAALPALLHLASVQACVTAYQRRIEFSRVVQQGAIDGRMWRRLGATEYALLSLSAQELLVDAPATWPQVLLRPLNDGNFLQLAAQLTEERKRLNGLLSDLMHAIRMRHLGKADAILAQVPDTPLAHALSQRLKREPWGLDDAMTHPSMRPAFGPWVPMSKASLARLRPWAPQALPAWWGLSATEVAQAIGSGELVPQEPASAITRYITRQDLAPLQRTWTRDEQLTIIKAGAGNLLPMAAPAWDDVPLHELVPTLQAMRFGTHSILARRLAALPDASEWIALMADAPDADHARKLRELAQAAIDTCWHGNRISCWSEWIVSAWGCAGWDRVQQIALAHTTPLKAAVAMFASSRMPLLPGEFQAVLARSLHHAELLPPRPLPWIRRWLSYDPLAARALTLHAPLLWLERLARNVATPTQTLDALLACQYESVVRMAWRNRLKRVTRTEELAELAMRRPKGAGPAGSVYRWLQLPGADRNATLVLIHRHDVRRLRLLHEEWGSTTFDAACQSAQQQLISRADAGEPQARREAAMLELQTRLGLDFAEHMHQVLMLLTRDAPSGHKLDASYRSFEIPKRHSGMRRISAPHASVKAAQRIVLNAQPHVGQPVVVNADIRNCFPSVRWQLVLGTLRRELGRQLSPTAISLLTDLCTAQGALPVGAPTSPALLNLVLRRTDEVLSHAAQRVGAQYTRYADDLTFSGDHRAVGLLRLAKRTLGCIGLELDPRKTNVFRRGRRQMVTGLVVNDRVSVPRALRKRLRAVVHSAEQGIAPHWNGRACADDLSDVRGWLAFMGLLHAPQAARLRARLNAAAPLDQGVRDAY

SEQ ID NO: 6816 - protein, 461 aa, unidentified
  source 1..461: note = Betaproteobacteria bacterium; note = Related to RFZY01000240.1
RRWLSYDPLAARALTLHAPLLWLERLARNVATPTQTLDALLACQYESVVRMAWRNRLKRVTRTEELAELAMRRPKGAGPAGSVYRWLQLPGADRNATLVLIHRHDVRRLRLLHEEWGSTTFDAACQSAQQQLISRADAGEPQARREAAMLELQTRLGLDFAEHMHQVLMLLTRDAPSGHKLDASYRSFEIPKRHSGMRRISAPHASVKAAQRIVLDKLLQPLGAHLAACGFVPGRNIAHNAQPHVGQPVVVNADIRNCFPNVRWQLVLGTLRRELGRQLSPTAISLLTDLCTAQGALPVGAPTSPALLNLVLRRTDEVLSHAAQRVGAQYTRYADDLTFSGDHRAVGLLRLAKRTLGCIGLELDPRKTNVFRRGRRQMVTGLVVNDRVSVPRALRKRLRAVVHSAEQGIAPHWNGRACADDLSDVRGWLAFMGLLHAPQAALLRARLNAAAPLDQGVRDAY

SEQ ID NO: 6817 - protein, 498 aa, unidentified
  source 1..498: note = Comamonadaceae bacterium; note = Related to JAJTGH010000210.1
SFRQVVARSLHHIELLPPRPMLYIKRWIARDPASATALADHGPVHWVQRLVANTTTPLAALDALIASEGLPAPLRRLAWRNRIARTRDAQTLAELSARMPANTGHFDQLNQWMVQGTQASTAMALVLTARRDGPRLLQLHQRFGDEVFITACREAAQLLRQMAQDPTSGTRQSGRHDAAALELLGHLGAQAAPHLMPALALCRSQQPAGCKLDGAYAQHRIPKKNGTLRLIHAPHPALRKAQRLILDQLLAPLGAHPAVCGFVADRSIVHNALPHVGQAVVVNADIKNCFPSVRWPLVLGALRRELGHSLSPAALSLLVDLSTAGGALPVGAPTSPALLNLVLRGTDETLHSSAERAGLRYTRYADDLTFSGNSQAVGLLRLAERTLAQIGLTLDPAKTNVFRRGRRQMVTGLVVNNQVSVPRAARRRLRAAVHRVELKEQPHWNGQPQSMAALRGRLAFVSMVCKPQAQPLVDRLQRALAQDERPDSEPPSPQGSLA

SEQ ID NO: 6818 - protein, 821 aa, unidentified
  source 1..821: note = Related to JAJTFN010000084.1; note = Verrucomicrobium sp.
MALRPARGNLPLPTLEVLRPILLKSFGPQGGRRSFLNSIPRVSGLATCLEEGFLQGLSPLSRTEFDELPSAVRRWFLGCPALVSVGLDEGFRRDVASHPDSPEMVALEHWEQKVLPKALHAMRSGILSEADGFPAGFFRNPLALRQQEPIRQALRSRKHLFGPSADFLGQELPQAAIRRFDPRTRRLLQFHGARADQRLLGGPGDDLESLLQLVRDTTVGQLADAIHQCSSEGPLLDLVRLHPTEPAVREAMERVLGIPGLRWGLLRMLGRPVLQAAGEDALVSILRANPDVVTCCDVELANRPEFGRALVRCFRSRDGAARVLHRLPGRAVSALLSETHPVVGLGGEIAQAGARSRNRPTRCAILALLVRHAPRLIEGTYGWVIPAGIHQDVARRALYHRRHGGLGALFRFTDRKGRPHWQETVRKTGATPALRRVLRRDRPDLIPELHRWDALRALKTPGFRRRLVAFLEGDFEVDLGLAPAALRHLVPWVRKRWIRQPTVALAYEIALALSPRDARYLLALCTQRAGIGLMPPGGTAFDSLYRTVHIPKRSGGTRALQVPNPSLKRLQRRFLAHGFDAIPLHDAAHGFRKGRSILSNAGPHAGKPCVVNVDIEGFFPGTTYRNILRACSELADGALSPAARHVVADLCSYQGALPTGAPTSPAIGNIVLRAADAAISKAVHRFGVAYTRYADDLTFSGGTGCVGALRFVEKVLGELGYRLNAKKTNIFRRGRRQMVTGLVVNQAPHLPRRTRRLIRAAAHRAATGGEIQWNGRPMSRPELEGRIAFLKMVHPEEARELLGRLGGDGAPGGVPGGKGSA

SEQ ID NO: 6819 - protein, 1037 aa, unidentified
  source 1..1037: note = Related to DNQI01000253.1; note = Verrucomicrobiales bacterium
MGVDPKVDRAALALASSKMQVDVSAATLKLEDEAVSDVDEIHARLAEILISNGTNGRRLREEARDLARDRQRCWRGRAKSRGISVDGYARNLIASAPRHCLCELIFVYLDAEKASEEGFSKEVAEYLKRSRTRRSNLFRQLLETNRVPTSGALLRVLEFSAGKITPVLAGEAFEGKCPEKEIAPRLSALYQYARSPEEADAFCMKFGHAVFDREKFDSLSRKLKSRILSQKKLSRRLLTSDFRREIENDPLSHPDTPESLHLAATPKRNREAFRRIASGSWQHEEVEELILSGAVHQFASRIDKLLARKASWVEHSRSSGRYSWDAESGWKTNPFELVSSPTSKTVREAIEAIRPLALHDDLFILQLETLDERAKFLGDLPSGRRRRICQRLGEKPYLEILEKAVGLDRGLAEKLLRCREKSRETLREQFIPRRSSETAMIDLWLECFDSQEIFREFFKLKRLQGRWRTVLEYFVRAPYTHLGTWRQKEKRGTKGPLPSRFLNAVLESGGDWRTFQTVMTRLKAEDLARLVEHAPDRMLTWLTGISEGLSSGNRNQEFACFLDAMVPAIPKRLGDVLPREMSDTMFRTTLEKLAGPIRRGVLTPSGYRWLLNRNTRGGDPAWLELLEASRERNLSPSEDPALHVLASGILALGGRDRFRVLFEAYPTLYFGEALERLDLWTVVRQTFDHPSLARWLERKTERSKLVVLIPKVRREYRSRPTVAAALEVALRFSLSDARYLKWLALKRWQARPCAEGTAFDDLYRTHRLPKRAGGSRVITAPEPRLKRLQRRLLRNGFDELPQHSASHGFRQGRSIVSNAVAHTGREMVVRADITSFFPSTGYAHVLRSCRLLADGQLSEGAVRLVAEVCCYAGALPTGAPTSPVIGNLVLKPVDASLEAASKKLGIIYTRYADDLAFSGDDGTQKILPFVRKVLSDYGYQSDPKKEHIFRRGRRQVVTGLVVNEKAHVPRRIRRRLRAAVHHASHGKNPHWHGHKMNETELLGRLAFLQQAHPEEASELRTQLQQREHQRDRKGQEE

SEQ ID NO: 6820 - protein, 305 aa, unidentified
  source 1..305: note = Planctomycetes bacterium; note = Related to RFON01000065.1
MSDLREMDHLRAIAWAGRGATNLQAGCLLDSRYRTYELPKRSGGVRIITAPDPRLKRLQRRLLVGAFEAVPLHDAVHGFRSGRSIATNAARHVGQRLVVNVDIAGFFPNTKFQQVLSACKRVDGGRLSPYAARLLAEICCYAGALPTGAPTSPAVANIVLRPADTAIANAAATHGISYTRYADDLTFSGEGDAKRIIPFVRRVLAQAGYRLDQRKTQLYRRGRQQLVTNLVVNERVNLRRSDRRRLRAAVHHRCVGRPAEWHGRAMDDHALEGRIALLAMVDRKEADLLLARLRSQASGWRSRDA

SEQ ID NO: 6821 - protein, 940 aa, unidentified
  source 1..940: note = Gammaproteobacteria bacterium; note = Related to JABITJ010000441.1
MSSRFSLPSLLLSSNEDSYFAFLRALPVEQNLTSQDILALCKKLDWRSLDSASKCQALLTQLVKDSSADFEELAHDIDISSQSFWRNLLACSEASTRPGLQFLIEANEAWGNEVLGSNQAKIMDDLPANKIVNALMTLLVDPARLTSTQLGLIAPRQRAACLHHYLRQRVPAARKKKNLELLPIFRSARKIYGPEANPRVVLLAVQRALIRQSLSAKKIGKREFLMLDDGLQSALTASPVLLDRFVASQYRHVLISMRRQIVRVKKLPILDLTHTIQSLESGNLSNKLIPALEFWRFVRPDFSKLVVNSLLKIADTSEITQSTALAQWCGTTSYDMSIGFLSVLSAFAPLEKFLSYPDRTRRDIAYKMNAKLLLLVLRAGPVPEIGHVAKLAAKKPGILRAWLTEWDRWQKDEDISYGMSLMSEIIANSRQVDVHWRVLERQIASLPLSTLSIFLSSDNSKFHNGTRNQSRLIKLMLQSWRRGQKHDNAQRLLKICRRHGRTILEVAGDSLTAMEIRCIAGSKYLGELRKIIASRSQKIPGWRQFVTVSLLKAERAPYLLNRIIEGNPHLVAEAFHVRPDLVRWKDVELVDPNDLVHAATHSKKFARKLDLRLTDRRRRSLLPVIRALYGNKPRSCAAYELAMLTELKLSRTFVSLALMLAHANQVPEGNTFNAFYKTYKLPKKSGGSRTITAPSTMLKAVQRGLLKKAIAPMDNSPSATGFRKGSSIVKNAQEHVNQKIVVNVDITAFFPNTRYSLIRQVAAQAVDGHLSPIAQWLLAEICSYQGALPTGAPTSPAVGNIVLKRADATIAKAAEHRRIKYTRYADDLTFSGEDGVVDILPLVVRTLGAWGYELDNKKTNIFRRGRRQIVTGLVVNEKPNMAKPLRRRLRSAVHRRLSGRQPSWHGKPMSDSELLGRIAFLAQTQPAEAKKLRDQLEAVQ

SEQ ID NO: 6822 - protein, 1327 aa, unidentified
  source 1..1327: note = Planctomycetes bacterium; note = Related to QWPT01000007.1
MLVVVEVAKWRTQKEANMLNGYRRPNSMASQQGEQCIQSVPFCSTLPNITSGLKHWEMDCVRPSTYFKSIALQLWTELQIDKNFAKELQRNHRSANGLQCVRYLHATAKSDADRALTWLFATHLLPSWKLPQPMLPMLLAQLQREYKDVALVQAIMRMADQSVKAGEAGRAFDHELDHEFDHAPEALVFVDSADAHLFLEAANKKCSADAPLWMCLSTCVRPDRNAANGACACPCHALEPLSQLRRLYSLLARAHRRVPQGKNAFELETLLSVTDLSTPNPTAHGPVDLRQTSHVAHNRIDRFGLDFIINQLPFGSVIAGPLRRAMLDTVFLGEFAPFLDSIANEAPPAGRMRQLTDRQISHAHSLRVRHRNEWDSAIGATLDLVTARSTDAIPADSNAIQEDCWNHLRIVDAILHEANPRRRIGEYLRRIVAREGPALQPDAATKCQPTEPLLEAMELIGRALILRELRSTVGGPKPLTSTSTMGLLGRFAMPSESISNSLKLNLPDPPIAATPSAPEGPWYRRQANDPKHTNLDSIKHCLRCLYGCRSDAIMLSIASVFDGPTKAVAMATSGNWLKPGALARWMRTSSIPSSNRFDFVRQLTLTHGDKLDKLLPMFARERTWDDHRPLFKGQQRPTNATEQWLVQSIELPPKSLALLSPRARKAYLANFIRRYGDLATKFLAPNFQSRIQREKNGQLDFAGNALGTVACAVNELPWRTVRAALPLHVIETVISESKFGAARVPASVPPSVPPSVPLADVKKLFSYHGESALVVWARAWHRIVSSAATTQSGKARATKALIRNISKGKFNLQCFCELASQPPSASKSKKRFVSDFATTILAIPAIVQALVSQSKSLDQTWFLLQNSRGHALADLPRSQLENFVLSIDSDLRDISDGPPGDSPADAKKLNRPYRKALRSPLNFVAQFVDVIARRLCTVSASDDAAITAQKIDLARLLLRVIATRELRAPASVETIELLTQRLSTRRDAQLTRKAAQGRCKPLKEPAEETTVLAVALELAKQGLADEFQQVLMITRTASLDDRYRAHRIPKKRGGMREIHQPDADLMRLQRKVLARFLARAPISEHAHGFVRGRGILTNALEHTGKRVVLNVDIRNFFGSLPIEHIRAALNQTRLRSQVPKTENQGWAVRDRESLSPAALDVLVKIVTRAGSLPQGAPTSPAITNIALRHTDGILAKACRRIGVSYTRYADDLTFSGADGPVQGIVPFVRELLTRIGLELHPDKTHVYRSGRQQLVTGLVVNSWPNLPRRDRRRMRAAAHRLGTTGKALRWKGSPMSLAGFQGRLSLLNMVDESRADSLRLLAKMEPR

SEQ ID NO: 6823 - protein, 321 aa, unidentified
  source 1..321: note = Planctomycetaceae bacterium; note = Related to PBOU01000026.1
MPTALTPPTLPDSXRPLAAEAGSKYHVYPLVSGKRVKKTRWIEAPDTELKAAQRWLLDNRLYHLAPTSFAHGFVPGRSILTNASHHVGRRWVVTTDIRNFFPSITASRVNDCLAGLDLXTEDRRTVVQLVTRRGRLPQGAPTSPHLANLVARTLDLRLAGLAQSHGWTYTRYADDLTFSAGSPDAPDSHRDLLPPRELLWIIKRIVTDEHFQLADDKTHVMPHHQRQTVTGLVVNQRVSLPKPRRRILRAMLHRLDTSGPEALDLHQLQVAQGHLALARLIDPGGYEQACRDLSXLIRQAIHPEPTSCKXESGTDFATTID

SEQ ID NO: 6824 - protein, 317 aa, unidentified
  source 1..317: note = Planctomycetaceae bacterium; note = Related to PBOJ01000102.1
MSTITSFTLPTSLQALAPGVGKRYHVYPLVSGNNKKKKRWIEAPDSELKAAQRWLLDNWLYHLPPTGFAHGFVPGRSILTNAAEHVGRRWVVTADVRDFFPSITAGRIATCLAELELDAADRSTVVQLVTRRGRLPQGAPTSPHLANLVARTLDLRLSGLARQHDWTYTRYADDLTFSAGSPTSPDTGMPPHELLWAIERIVSDEDFQLAADKTHVMPHHQRQTVTGLVVNQRVALPKPRRRTLRAMLHRLETSGPETLDLRQLQVAQGHLALSKLIDPDGYDLACRHLGELIRNSVAGSALGTAVDSGSTATTRLD

SEQ ID NO: 6825 - protein, 345 aa, unidentified
  source 1..345: note = Planctomycetaceae bacterium; note = Related to PADE01000125.1
MSTRAQRAHPGPLFLLRDRTDPRCHRRALIDAHRKHRPNPLTTTLTSLPDSLLALAGDTERRYQVYPLVNGSKRRWIEAPDRELKAAQRWLLDHWLYQLAPTDAAHGFVRGRSIVSNAGHHVGRDWVVTADLSNFFPSIGADRVSQVIAGLDLNANASDAVVRLVTRRRRLPQGAPTSPHLANLVARRLDLRLIGWARRGGWNYTRYADDLTFSGEGNPRTLLLTVERIVQDEGFTLAPGKTHVMPRHQRQLVTGMVVNERVTLPKPRRRLLRAMLHRLQTTGADAVDPGQLQIAQGHLALAHFVDPERFQAECRALADLLRGEASPQADTPNPTVCTPIDKKVD

SEQ ID NO: 6826 - protein, 312 aa, unidentified
  source 1..312: note = Planctomycetaceae bacterium; note = Related to DLVN01000025.1
MPTEYMSDFMPTTLPCPPAAVLALADSAEQRYRVYPLMSGSKRRWIEAPDQELKTAQRWLLDQWLYQLAPTDAAHGFVPGRSIVSNAARHVGCAWVVTADLRNFFPSIGASRVAQVLTEFEQPADVTAALVRLVTRRQRLPQGAPTSPQLANLVARRLDLRLLGWARRSGWNYTRYADDLTFSGAGNPRPLLEALKQIVRDEGFTLAPGKTHMMSHHQRQVVTGMVVNERVALPKPHRRLLRAMLYRLETMGVDKVDPQQLQVVQGHLALAHFVDPARFEAECRALATLLREASSSLPATASSSFVPAVTKT

SEQ ID NO: 6827 - protein, 307 aa, unidentified
  source 1..307: note = Related to JABJEN010000114.1; note = Planctomycetaceae bacterium
MNRSAFDPGVNETSGDLIDLVESLNVPLQRLSEIAATANERYDVYPLVIGKKKRWIEAPRDKLKQLQRRLLDSVFYRLVPHESAHGFVRGRSIVSNARRHCGRRWVVTMDIRDFFPSIGAERVNRQLLSLPMTDAEREIVVKLVTRNARLPQGAPTSPHLANLVSRRLDIRLRRLADEAGWTYTRYADDLAFSGEGRPKQLIRIVEQIIQDEGFQPARQKTRVMSRHQRQIVTGLIVNEKVALPRPKRRLLRAMLHRLRSTNEPLSSLPDIRVIHGHLALATFIDPDGYRETCNQVAQLIEGRCSFV

SEQ ID NO: 6828 - protein, 307 aa, unidentified
  source 1..307: note = Pirellulaceae bacterium; note = Related to JADHUC010000127.1
MGNALSESENGRTAGDSIRLAEILSAPPERLNEILASADELYRVYPLIKGRKKRWIEAPRSELKRLQRRLLDSVLYRLVTDESAHGFVRGRSIVTNARRHCGRAWVVTMDIRDFFPSIGAERVDRQLVSLPMTEVERENLVRLVVRNGRLPQGAPTSPHLANLVSRRLDLRLKRLAETTGWTYTRYADDLTFSGEGKPGKLVQIVENIIVDEGFQPACRKTRVMSRHQRQVVTGLVVNDKVALPRPKRRLLRAMLHHLSSANQDSVCLPDIHVIHGHLALAALVDPDGYRLTCRQVAQLVENRYDDA

SEQ ID NO: 6829 - protein, 354 aa, unidentified
  source 1..354: note = Opitutae bacterium; note = Related to PBMI01000048.1
MTKANLPTNGCDDLANLLDLDPNRLTQLAGEAVNLYERFPLKTRRRRPRWIEAPKPFLKLVQRRLLDRLLYATPPHSAAHGFYPELSILTNARIHVGSAWVVSYDLEDFFPTTDLDKVRSVLNKRYDVEEGVLESIIRLTCRNGNLPQGAPTSPHLANLAFYQGDELLSELAKQHDLGYTRYADDMTFSGKELPAELDDEVRQIVHRVGYRLAEKKTKRMGRHQCQKVTGLVVNEGVRLPRKQRRRLRAIRNDIAMMGMESALARSGYGSVCQLQGHLAFERMTNKSNGVSRGLQNLRPKNALAGQPPVEPEDKDGGLPPPSCPSVRRRQSADHGGTPQQMPDSELESTVQTVG

SEQ ID NO: 6830 - protein, 306 aa, unidentified
  source 1..306: note = Opitutae bacterium; note = Related to JABJCN010000134.1
MRTTETHSVIVQDMDIYPEADAVPPPLTSADLAKSLHLSEERLVSLLSSAEKSYNRFPLKCGRRRPRWIEAPNPFLKHVQRCLLDKILYTVVPHPSAHGFQPGRSIVSNARMHSCREWVLSMDMKDFFPTTDIHMVEKMLQEHFNFTQETIEAILRLTCRRNALPQGAPTSPHLANLVFMEGDRRLTAMAIEHGMTYTRYADDMTFSGDTLPEDIEEQVELIAQEAGYRISRHKTRRMGQHQCQKVTGLVVNEGVRLPRGKRRRLRAILNDVRKNGMDAALARSGFRSADELSGHLALARMVGTVQ

SEQ ID NO: 6831 - protein, 312 aa, unidentified
  source 1..312: note = Related to PBMT01000070.1; note = Proteobacteria bacterium
MLKDLQHPLELSTAELQPFASRIGFPTDVLFDILSKKEDQYYRFPISKRNGKNRWIEAPKNELKSIQKQLLLQILYEQKAHSAAHGFVPNRSILTNAKPHVGQNWVVNFDISNFFSSTQIHLIHKVLQTYPTLSKREQHIIFTLISKDNTLPQGAPTSPHIANLVLYDFDHFISDYAQKHQLAYTRYADDLTFSGDQIPKELPLIVKKRLKEDGYHLAQHKTSWTGKHKRQLVTGLVVNDKINLPRPMRRQMRAIIHSIKTNGSIKAFATSSWSSDQLYGRIALQAMWDSEAAEKQLRELLGAQELDWTAYI

SEQ ID NO: 6832 - protein, 391 aa, unidentified
  source 1..391: note = Related to BK058704.1; note = Siphoviridae sp.
MPVIDKVDEFKMMFNGVKDPVGIFDFCGVNAERALTEKSKDAELVEKLNQFLDGQFFTSHSIDRLARVVGEGTDIIRLAKVGYRGSIYMLNESVDQFAELSEAIGFPKEIIQQYVSDTASHYSRFFIWKDEAKTKKRWIEAPDDTLKQMQEAILRNILYKIAPTKFAHGFICGRSIVTCAKAHTGKKFVLKLDLKNFFPSITREMLLGAMAPYINESNFKFVLPAMELCLMEGRLPQGAPTSPAASNIVARQLDLLMYGISSQFGCEYTRYADDLIFSSNERDIYTMIPIIKKAIAKFGLVVNEKKVKVLKSHQRQTVTGLVVNSDGQTSVARRKRMKLRAFIHHILTGRYPLDRVNFARLKGNITFIAMANPNQGRWFLEKWDEIQAMRG

SEQ ID NO: 6833 - protein, 308 aa, unidentified
  source 1..308: note = Myxococcota bacterium; note = Related to JAHJLU010000432.1
MFGWWRRRKERRQLTEKLLFINRNIAPHYHSFPLKKATGGYRTIEAPVEELKEAQRLILKRYYYGLECSTAAHGFVRGRSITTCARHHCDRLVVVAVDIKDFFPSITRDMVEKITRDMVPELAKNKELFDLVLGAITSNDALPQGSPASPTLSNLVFNGIDNQLVSLACAFKARYSRYADDLFFSSRYNRNLPGIISSVERILNAHGFSINRKKVRVMRRGQRQVVAGLIVNGKTPAVGREQLRSLRAAIHLLEKELQGAGPQSPSVAKLMESIQGKISFFHMVNPQSVRRLARTFKAICRQQAARSS

SEQ ID NO: 6834 - protein, 308 aa, unidentified
  source 1..308: note = Planctomycetes bacterium; note = Related to JACPTZ010000105.1
MVDLLPLLVKEGAMEESRYRMYRIRKANRRFRTIMEPDPALKSLQRSILRWLMARRIRASKYAHGFVKGRSTTTNAALHVGKRVVVRIDIQDFFPTITERQVKYALTREGLLSDDAARIADLCTVEGKLPQGAPTSPFLSNMIFRVLDYRLAGLAKKWGATYSRYADDLIFSSDRDDLQAIYHPVASILEEDGFEVNPDKFRVYRSTRRQRVTGIVVNHHPTLPRESRRRLRAALHHVRRSIVTGEEVPAERLDSIEGSAAYLTGIDRERGRRLLVEVRDLKALLALRTRMVSRRRPRRTSGIAAAPS

SEQ ID NO: 6835 - protein, 320 aa, Proteus sp.
  source 1..320: note = Related to JAEHOZ010000020.1; note = Proteus mirabilis
MNAAPLLVSFYTLSKFLDALPEKHRNSYQRQIENLFAQSLPPCVSEICLAVLFGYSVDFVYALSKNQHKFYRSFQIRQGRKTRTIHSPRVALKVVQKWLGVHLSDAITFEPHVCGFVKGKSFADAAKIHQGAKWVYSVDIENFFPSITILQISNALEKLGYTKESAELLANICSLNSTLAQGSPASPVISNIVMKDIDLQLKELADKYELQVSRYADDIVFSGTEPFNEGIPKDLNTLFNSTSFTLNKNKTYFSDSEKGQRLKVHGLLVKKDKIRLTKGYRNKIRAFRHMLEKEKVSENDLQRLKGHLTFAEFIERKNQV

SEQ ID NO: 6836 - protein, 320 aa, unidentified
  source 1..320: note = Related to NZ_ML064597.1; note = Parashewanella spongiae
MNAAPLLVSFDTLKKFLDALPEKHRKSYQQQIEKLFTQSLPPSVSETCLAVLFGYSVDFVYALSKKQHKFYRSFKIKQGKKVRIIHSPRVALKVVQKWLGTHLSNAISFEPHVCGFVKGKSFADAAKIHQGARWVYSVDIENFFPSITVVQISGALEKLGYSEESAKFLANICSLNGTLAQGSPASPVISNIIMKDIDQRLIELAEKYVLKVSRYADDIVFSGKEPFSTDIPNELSSIFGLTPFLLNKNKAYFADSQKGQRLKVHGLLVKEDKILLTKGYRNKIRAFRHMVAQGKVSEGDLPRLKGHLTFAEFIERNNQV

SEQ ID NO: 6837 - protein, 320 aa, unidentified
  source 1..320: note = Related to SIHM01000015.1; note = Alteromonas sp.
MNAAPLLVSFNSFNKFLEALPVNHRTACKQELEEIYGKSLPIGISEVCIAVLFGYSLDFVYALSKKQHKFYRSFQIKQGKKTRTIHSPRVALKVVQKWLGAHLSSALVFEDHVYGFVKGKSFVDAAKSHQGAKWVYSVDIENFFSSITDLQISEAFKELGYSHGSATLLSNICSLNSKLAQGSPASPVISNLVMKDVDAGLKAMANKYGLQVSRYADDIVLSGKAEFKSEIAGELHSIFEATTFSLNTDKTYFADAEKGQRLKIHGLLVKEDTVILTKGYRNKIRAFRHMVEQGKVSADDLPRLKGHLKFAEYVQRQNDT

SEQ ID NO: 6838 - protein, 372 aa, unidentified
  source 1..372: note = Related to VFRR01000008.1; note = Maribrevibacterium harenarium
MQKRSGEELSRGCASCPFAKARHRNTDGQTSIRASPGWTFVHRCKFFEKYSVMNAAPLLVSFNSLSKFLDALPEKHRENNGDQIESLVDKSLPPVVSETCLAVLFGYSLDFVYALSKKQHKFYRSFKIQQGKKVRTIHSPRVALKVVQKWFGAHLSNAVSFESHVCGFVKGKSFADAAKIHQGAKWVYSVDIEDFFPSISTFQISNALESVGYSKDAAQLLADISSLNFKLAQGSPASPVLSNIVMKDIDKQLKELANQYDLQVTRYADDIVFSGKGVFQEALPTELEAIFEGTTFSLNKNKTYFADSEKGQRLKIHGLLVKEDKITLTKGYRNKIRAFRHMVEQGKVSEDDLPRLKGHLRFAEFIASKNEN

SEQ ID NO: 6839 - protein, 321 aa, Vibrio sp.
  source 1..321: note = Related to NZ_CP025796.1; note = Vibrio owensii
MNAAPLLVSFNSMDKFIESFPRSQVEKYRQNIQFLYENSLPPAVSAPCLAVLFGYSTDFVYALSKNQYKFYRTFQIKHGKKLRTIHSPRVALKVVQKWLGYHLSSAISFDSHVCGFIKGRSFVDAAKMHEGAKWVYSVDIADFFPSVSSEQVTEALVSIGYFSESAELIANLCSLDEVLPQGSPASPVLSNLVMKDMDKELLHLADKHGLKVTRYADDIVFSGRDNFIEELPEALDSIFEQSTFSLNRDKTFFADAEKGQRLKVHGLLVKDDQVTLTKGYRNKIRAFRYMLDQGKVSEEDIPRLQGHLKFFEFINEKNKND

SEQ ID NO: 6840 - protein, 321 aa, Vibrio sp.
  source 1..321: note = Related to RDPS01000003.1; note = Vibrio anguillarum
MNAAPLLVSFNSMNKLIESLPLSQVEKYQQNIQFLYEKSLPPVVSVPCLAVLFGYSTDFVYALSKSQYKFYRSFQINHGKKLRTIHSPRVALKVVQKWLGHHLSGAISFDSHVCGFVKGRSFVDAAKVHEGAKWVYSVDIVDFFSSISKQQVSEALVNIGYLPESSELIANLCTLDNVLPQGSPASPVLSNLVMKDIDRHLQYLADKYGLKVSRYADDIVFSGTDAFSDELPLDLEALFEPTAFSLNRDKTFFADADKGQRLKVHGLLVKDDKVTLTKGYRNKIRAFRHMLEQGKVCEEDMPRLQGHLKFFEFIESKNINQ

SEQ ID NO: 6841 - protein, 339 aa, unidentified
  source 1..339: note = Related to PGZF01000003.1; note = Gammaproteobacteria bacterium HGW-Gammaproteobacteria-15
MDACPSSKLIYEICVMNAAPLLVSFDSIDKYLEALPEKHRTAHSAALSDLFSRGIPPITSAYCLAILFGYSLEFIYAMTKRPDKFYRVFSIKNGKKTRRIQAPKVALKVIQKWFGAHLSNNLTFHPHVYGFVKGRSFVDAAKHHIGARWVLAVDIDNFFPSISKERVLLSLIAQGYSNDASKLISDLCCLNDSLAQGSPASPVLSNLCMQSIDDSLIKLSEKYKVTVTRYADDITFSGIGEFDEGLKRDLQELIKSSGFQLNDDKTYFADSTTGKRLKVHGLLVKEDSVRLTKGYRNKIRLYKHLQKSGRISEDDYHRINGHINFADFIDSMSGIKDAI

SEQ ID NO: 6842 - protein, 321 aa, Acinetobacter sp.
  source 1..321: note = Related to JAEDYI010000001.1; note = Acinetobacter bereziniae
MNAPPLLVSFASIDKYLEALPPQYKTQYEDEIKRLYTNGFPPIVSKLCLGVLFGYSSDFIYILAKKPSKFYRSFTLKQGKKTRKIFAPKVGLKVIQKWFATHLSNVIEFHPHVLGFVKGKSFADAAQLHIGARWIFSVDIVDFFPSISKEAVIEALIQTQYYTSKAAELISDLCCLNDALAQGSPASPVLSNIVMKPFDEKLLELSKKYNIVVSRYADDIVFSGKDEFDTNLHKDLNELFAESCFTLNSQKQYFADRNKGQRLKVHGLLVKDENIALTKGYRNKLRAYKHMLNTGKVSEKDVERLVGHVKFSEFIESKNVN

SEQ ID NO: 6843 - protein, 318 aa, unidentified
  source 1..318: note = Related to JACBJC010000018.1; note = Serratia fonticola
MNAAPLLVSFLKVETYIRALPIKQSEQYKDEIITLVEKKLPPVVSPYCLAVLFGYSLEFVHALSKNQHKFYRRFEIRQGRKTRKIDAPKVALKVIQKWFGFHLSSALEFEPHVFGFVKGLSSAKAAKLHVGARWVYSVDILNFFPSISQIKIKEALIKEGYTDNGASLLIGLCCLDGALAQGSPASPVLSNIFMRDIDKKLSELARKYLITMTRYADDIVFSGRDNFPQKLKDEVSQLIIEAGLVLNENKQYFASVDKGQRLKVHGLLVKEEAVRLTKGYRNKIRAYNHMLANGKISEKDIPRVLGHLKYAKFIDNLN

SEQ ID NO: 6844 - protein, 316 aa, unidentified
  source 1..316: note = Related to NZ_WRPA01000017.1; note = Shewanella insulae
MKAAPLLISFHELGSYIEALPESQKRRYADEISKLAEAKLPPVVSPYCLAILFGYSREFIHAMSKQQHKFYRTFTIHKGRKRRTIQAPKVALKVIQKWIGYHLCQAIQRPEHVFGFIPGCSAKMAAEQHCNALWVYSIDIKDFFPSISDELVESALQELGYSEMGSKLITSLCCFNGVLAQGSPASPTLSNLIMIKVDDDLRKLSEELNISVTRYADDIVFSGKNEFPEGLGGQISNIFQDAGLELNEEKEYFADSRKGQRLKVHGLLVNSDKPRLPKGYRNKVRAYKHLLNSGKVSEGDLKRLLGHVNYANSIES

SEQ ID NO: 6845 - protein, 320 aa, unidentified
  source 1..320: note = Related to nan
MIAPPLLVSFSDINSYVNSLSEENQALHENNIRSLFDQNLPPIGSISTLSTMFGFSPRFVAMLLSDVSKQYRTFEIRKGKKKRKIQAPKVGLKVIQKWFGHHLSGALVLDDGVYGFVPNRSAIDAASKHCTASWVYSFDIKDFFPSTTRETVLSALVELGYVEESAELISQLCCLDNKLPQGAPSSPALSNLVMRRIDTELARFADENNLTYTRYADDIVLSGKEECPESLSEAVRSAFKDTDWELNPNKEYYADVRKGQRLKVHGLLVMGEKPILTKGYRNKLRAYNYMIENGKAKEKDLPRLKGHIEYARLVDRWNNG

SEQ ID NO: 6846 - protein, 320 aa, unidentified
  source 1..320: note = Related to NZ_KB893650.1; note = Kangiella aquimarina
MNAPPLLVSYSTVESYLSALSQDSVSSYQKEINDLVARGLPPVVNTKLLGLLFGLSNKFITSLLIDKKRHYRNFNLRKKGKVRTINAPKMSLKVIQKWFGSHLASSIDYASYVYGFIPGRKALDAAKVHCGSRWVYSIDIEDFFPSTPSELVYESLKSLGYTELGSKIITEICTLDGYLPQGAPSSPALSNLVAKNLDRHLYKLSTDLGVKYTRYADDIVFSGAEDFPKNLPEIIIEIFADTPWSLSERKNYFADTLLGHRLKVHGLLVKEDAVRLTKGYRNKIRAYKHLLEQGKIKDSDLQRIKGHLTYAKLIDNDSEL

SEQ ID NO: 6847 - protein, 327 aa, unidentified
  source 1..327: note = Related to JAFEDC010000007.1; note = Proteobacteria bacterium
MIAPPLLVSYSSLNEYLEALGPELSYQYKTEITQLFEKRLPIVVSFRCLSVLFGFSTNFVYKLAQQNWKFYRTFTIRKGKKKRTIQAPKVALKVIQKWFGYHLSEVLSFDKYVHGFVPGRSAIGAANVHTNARWVYSVDIENFFPTTTKKVIKESLISIGYSFEAADLIANICCYKDTLAQGAPSSPVISNLVLKELDKQLKTIADSNQIRFTRYADDIVFSGIDKFPTEIKDQISDLFKETCWKLSPEKEYLAESPMRLKVHGFLVHGEKARLTKGYRNRIRAYKHLLNAGKIRNEDLGRIVGHVKYAESVIKAQKPGLCPDSAHS

SEQ ID NO: 6848 - protein, 317 aa, unidentified
  source 1..317: note = Related to JAFIUX010000008.1; note = Nitrospira sp.
MLAPPLLVSYTSPEDYLIALDPGLRRLHQSKIKRLLEQGLPPVVSSRCLGVLFGYSTKFINAMAQQNWKYYRSFTIRKGKKKRKIQAPKVALKVIQKWFGHHLSESLSFDDHVFGFVPGKSAPFAAKQHTNARWVYSVDISNFFPSTPKDVISTTLVDIGYSEKAAKLMSGLLCHRDYLAQGSPASPILSNLVFRELDKQLKEIAGNNRIRFTRYADDIVFSGVDQFPENIKEQVNNLFADSCWVLSKEKEYFSEIPKRLKVHGLLVHRDRPRLTKGYRNRIRAYKYLLETGQIEKRDLSRIMGHLNYAKSIDTQEK

SEQ ID NO: 6849 - protein, 317 aa, unidentified
  source 1..317: note = Related to PGFZ01000010.1; note = Methylovulum psychrotolerans
MKAPPLLVSYSSIDDYLSAISPEDREQYEKQIRSLVCKGLPPVVSSQCLANLFGYTNTFVHSMASKNWKYYRGFSIRKGKKKRYIQAPKVALKVIQKWLGFHLAKSINYNDFVYGFVEGKSAIDAAACHTNATWVYSVDIKDFFPSTSKETLISNLESLGYSRKASALIASLCCYEDYLAQGSPSSPVLSNLVMRDIDLELYKISMIHGVRLTRYADDIVFSGQSEFPESLKREVKSLFVDTCWSLSEQKEYFAQIPKRLKVHGLLVHQNSPRLTKGYRNKIRAFRHLLEAHKVHEKDIKRLTGHIKYAESVDRHKN

SEQ ID NO: 6850 - protein, 319 aa, unidentified
  source 1..319: note = Related to VENC01000012.1; note = Marinobacter adhaerens
MIAAPLLVSYNSLEDYLSCLSSEMREEHEQQIRWLVDQKLPPVVSSRCLSVLFGYSAKFVNAMALNNYNYYREFTIRKGNKRRKIQAPRVAIKGIQKWFGHHLSEVLPVEDYVYGFIPGRSAVDAAAQHCGASWVYSVDIENFFPSTTDDVVIKALMEIGYSEKGARLITRLCCYGDRLGQGAPSSPVLSNLVMKPIDIQLKNIAENLGVKLTRYADDIVFSGQGKSPVELRDRVLDVFKDTCWDLAENKEYFSNSDLGQRLKVHGLLVNGEKPRLTKGYRNRVRAYRHLLENNRVKPEDKRRLIGHIKFAESVESWKE

SEQ ID NO: 6851 - protein, 319 aa, unidentified
  source 1..319: note = Related to CP064972.1; note = Holophagales bacterium
MKPPPFFVSFRTAADYRAALGDGVAELYWPDIGHLGERRLPPVVSVRALACLFGVSSKFVGALRRNPERYYRSFVIRTGRKKRQIHSPKVGLKVFQKWFGTHLAAALEFDPWVFGFVPGRSAPMAARVHARARWIYSVDLADFFPSVSRTRVVGALQGLGYPGHGAELAASLCCYGEGLAQGSPASPVLSNLVFREQDQQLHELAREFGARLTRYADDIVFSGQAAVPAGLPDRVKAVVTAGGWDLNDAKEELAESPIRLKVHGLVVHGDRPRLTKGYRNRIRALRHLSAVGKVRSEDAARVAGHLRYADSIDRLSEEE

SEQ ID NO: 6852 - protein, 322 aa, unidentified
  source 1..322: note = Related to JAGQSE010000087.1; note = Acidobacteria bacterium
MNTPPLLVVFPGLESLGAALARDTHRIYWSDVERLVERGLPPAVSVRVVACLFGFSARLVGAIQRSPERYYRIFKIPKGKSSRQIEAPRVALKVIQKWFGSHLAAACPLDDCVYGFVPGRSAPLAAKQHCGASWVYSLDIRDFFPSVSSGMVSEALRLKGYPDHAASLMAKLCCYEGRLAQGSPASPALSNLVFAPVDQLLAEIARANACTYTRYADDITFSGRTEVPARLQEEVRKALQEGGWQIAGHKEHLARAPRRLKVHGLLVNGRFPRLTKGYRNRLRALEHLLGQGRLDEAKEMEVRGHLAYARSVESLQKSSDGG

SEQ ID NO: 6853 - protein, 323 aa, unidentified
  source 1..323: note = Nitrospirae bacterium; note = Related to JADFXO010000295.1
MRTPPFLLSFSSLEEYLRALSDSDRAEKGSEINNLVAQQLPPVVSKKCLATLFGFSNSFIDTLHRRTERYYRIFEIPKGKKKRIIQAPRVALKVIQKWFAHYLANSLNLHEAVFGFVKGRSAVQGAALHCGAHWIYSVDIEDFFPTTSIDKVISSLTNLGYGYPGAALIAKLCCYEGNLAQGSPASPVLSNLVFREIDEELFTLSKQNGICYTRYADDIVFSGINSFPDHIREEVISIIQARGWKLSIKKIHLAKRPYRLKVYGLLIHGERPRLTKGYRNRIRAFKHLFADGKIPEDEISKIRGHLSYAHSIEEFEMMPKDDL

SEQ ID NO: 6854 - protein, 319 aa, unidentified
  source 1..319: note = Related to JAHJTB010000218.1; note = Proteobacteria bacterium
MNAPPLLVSFSSTMEYREALSHELRGLYWETIEKLISKKLPPVVSIRCLSILFGYSPRFLGAMYQFTERYYRTFTIKAGKKKRTINAPKVALKVIQKWLGYHLGESLSFCDHVYGFIKGKSAIQGAYVHCGASWIYSVDIENFFQTTNIEKVKSALNGIGFQERGSEVISKLCCYSGNLAQGSPASPILSNLVFTNTDNDLARLANKNGLLYSRYADDIVFSGKEDVPADLSNDVKSIITRSGWKISEKKEYLAKRPHRLKVYGLLVNGDYPRLTKGYRNRIRAFKHLVENEKIADENKKRLLGHLAYAKSIDNFSNKY

SEQ ID NO: 6855 - protein, 322 aa, Pseudomonas fluorescens
  source 1..322: note = Related to QFOU01000006.1
MQSPPLLVSYPELEDFIKALPNDYAADTKQVLRHLHSLSLPSVTSITSLAVLFGFSPRILASMTNQPEKFYRVFRIHKGKGKYRTIQAPKVALKVIQKWLSHHISEAITYPKYVHGFVPGRSHITAAQAHVGANWVYSIDIENFFPTTSESKVEAALRGIGYSESGSKLISKLCCYTKNLSQGSPASPVLSNLVFKDLDSRIAELSSQIGVNYTRYADDLVFSGQGEFPEALLPVKAWISEAGWSVSKDKEHFAQLPKQRLKVHGLLVHESSPILTKGYRKKIRTYKFLHENNRIREDDKNRILGHLSYAKLVDSFSNQTEE

SEQ ID NO: 6856 - protein, 325 aa, Citrobacter sp.
  source 1..325: note = Related to NZ_LT556085.1; note = Citrobacter amalonaticus
MKTPLPLFFTFADAEQLLKALSKPLRDRYSAELLRLQQLGLPPLVSWSILSVAIGVSPQFITSILKNKSKYYRVFPISKGKGKKKRIIEAPKVSLKIIQSWFAYHISLNGNITLSKSAFAFIPGKNGIYEAASVHCGAKWIMSIDLRDFFHTITSEAVVLALTEIGYREDQASKLSDLLTLNQRLPQGAPSSPVISNLVFSKTDFKINELIADLNVKYTRYADDLTFSSEDESFDINSLKERIVQILVSDNWIVADEKLKIAKAPNRLKVHGFLVHEIKPRLTKGYRNKIRAYKHLLNTGKVVLEDLDKIKGHINYSDYIDRLNE

SEQ ID NO: 6857 - protein, 325 aa, unidentified
  source 1..325: note = Related to AP022438.1; note = Raoultella planticola
MKTPLPLFFTFTDAEQLLKALSPSLRDRYSAELIRMQQLGLPPLVSWSVLSVAIGVSPQFITSLIKNKIKYYRVFTIPKGKGKKRRVIEAPRVSLKIIQAWVAYHLSLNENISLSESAFAFIPGRNGIYEAASKHCGAKWVLSIDLRDFFHTITSVLVSAALVKIGYKADQANKLSDLLTLNQRLPQGAPSSPVISNLVFKSTDLKINELIVGMNVKYTRYADDLTFSSEDEGVDIELLKENVLRVLNSDGWVVAEEKLKISKSPNRLKVHGFLVHEIKPRLTKGYRNKIRAYKHLLQTGKIIEGDLDKIKGHVNYSAYIDKLNE

SEQ ID NO: 6858 - protein, 325 aa, Salmonella sp.
  source 1..325: note = Related to AAIGLR010000001.1; note = Salmonella enterica
MKTPLPLFFTFTDAEQFLKALSTPLRDRYSAELIRLQGLRLPPLVSWSILSVAIGVSPQFITSLIKNKSKYYRVFSISKGRGKKKRIIEAPKVSIKIIQSWVAHHLSINHSLGISENAYAFIPGKNGIYEAASKHCGAKWILSIDLRDFFHTITSDIVISTLVEIGYRADQAAKLSELLTLNQRLPQGAPSSPVISNLVFRSTDLKINELISNTGIKYTRYADDLTFSGDDETFDIEELKDNVVELLLSDNWVVAEEKLRIARIPNRLKVHGFLVHENKPRLTKGYRNKIRAYKHLLRTGKIVEKDFDKIKGHVNYSEYIDRLNE

SEQ ID NO: 6859 - protein, 332 aa, unidentified
  source 1..332: note = Related to NZ_CM001857.1; note = Musicola paradisiaca
MKTPLPLLFSYEDEAQFLRSLSSGLRNRHSEEVRRLVAIGLPPVVSWSVLSVAIGVSPHFLNSIIKNKCKYYRSFTISKGKGKKKRLIEAPRISLKLIQAWLAYHLSRNSADYISENSYAFIPGVNGIYEAAKRHCGSQWVLSIDLKDFFHYVNSNKIMPALLDLGYRTEQAAKIIDIVTLQDRLPQGAPSSPYISNIAFKPTDELIERIITGRGVSYTRYADDLTFSGCDAEFNIDGFKGEIINALKSHGWIVALDKVKISKKPNRLKVHGFLVHNQKPVLTKGYRNKLRTYRHLMQAGTIKPDDLDKIKGHLNYGYYIDRLNSQEVEFSC

SEQ ID NO: 6860 - protein, 329 aa, unidentified
  source 1..329: note = Related to JABLUT010000044.1; note = Pantoea agglomerans
MKTPLPLLFSFENETQFLSSLSLGLRNRHAEEIRRLLALELPPLVSWSVLSVAIGVSPHFLNSIINNKVKYYRTFTVSKGRGKKRRLIEAPRVSLKLIQAWIAHSLSHMSRQYISEHSYAFIPGVNGIYLAAKKHCSSQWVLSIDLKDFFHSITAEKIIPALIEMGYRAEQASKIIDLITLNERLPQGAPSSPYFSNVSFRPTDDLIVRMIDGQSIKYTRYADDLTFSGVDLDFDVEKFRDDIIAVLHEHNWEVALEKVRISKQPNRLKVHGFLVHNDKPVLTKGYRNKIRAYRYLMLSGAIKPDDICKVKGHLNYSDYIDRLNASEEV

SEQ ID NO: 6861 - protein, 325 aa, unidentified
  source 1..325: note = Related to JAAQVS010000001.1; note = Morganella morganii
MKTPLPLFFSYPDAEQLLKALSQSLRVKYSSELARLEQLKLPPLVSWSVLSVAIGVSPQFITSLIKNKSKYYRVFSISKGKGKKKRTIEAPKVGLKIIQAWIAHHLSINTFLDISDSAYAFIPGKNGIYQAAKKHCNSKWVLSIDLKDFFHTITLDKVILALIDIGYHAEQASKLAEILTLNQRLPQGAPSSPVISNLVFKSTDACINEFIVEDNISYTRYADDLIFSGVNEDFDIDSLKDNIIVLLQSKGWIIAEEKLHIAKVPNRLKVHGFLVHGNKPRLTKGYRNKIRAYNHLLHAGRISEKDIDRIKGHVSYSAFIDSLND

SEQ ID NO: 6862 - protein, 327 aa, unidentified
  source 1..327: note = Related to NZ_CP082360.1; note = Klebsiella sp.
MKTPLPLLFSYNDAQQFLGALSPEVRDVYSPEINRLFDRGLPPVVSWSVLSVAIGVSPHFINSIIKNKDKYYRIFPIAKGKGKKVRIIESPRVGLKIIQSWLAHHLATNDNIPVSDSAYAFIPGKNGIYEAAFRHCNAKWVLSIDLRDFFHSIDFDRVINGLRNTGYTFEQSGKIAAIVTYKNRLPQGAPSSPVLSNIVFKDTDDKINDIIADKKIIYTRYADDLTFSSDDLSIDVENLKQNIINLLENENWTIATEKLKISKIPNRLKVHGFLVHDVKPRLTKGYRNKLRTYEHLLRNGKIIESDLNRIRGHVNYGKHIDKLNDEN

SEQ ID NO: 6863 - protein, 327 aa, Enterobacter sp.
  source 1..327: note = Related to NZ_KN549084.1; note = Enterobacter asburiae
MKTPLPLHFSYDSLDQFLAILSPGLRQRHAEELRRLDDLKLPPVVSWSVLSTAIGISPHFINSLIRNKNKYYRVFTIAKGKGKGKRVIEAPKVSIKLIQAWLAFHLSNNDNLGLCDAVHGFIPGQHGIYEAAKKHCGCDWVLSIDLKDFFHSISHRRVVNAFENLGYTVAQAEKIADITTYNAHLPQGAPSSPVISNLVFNDTDNAIIRFLDGKGICYTRYADDLTFSGSDISYDVEKLKTEMLQLISNDGWIVANEKTHIAIAPNRLKVHGFLVHAVTPRLTKGYRNKIRAYTHLLNSGKVDPEDLDVIRGHVNYGRYISKLNNGN

SEQ ID NO: 6864 - protein, 321 aa, unidentified
  source 1..321: note = Related to NZ_CP009801.1; note = Yersinia intermedia
MRTPPPPLLVSFKSTQNLLDALPSAISEKYKTEINELLDKMLPPVVSVAVVSIIFGVSSNFIASILRNPIKQYRVFTIKKGKKKRRIESPKIGLKLLQSWIGANLSNKKLLSDSVYGFVPKRNGVFEAAQKHCLAKWVYSIDLRDFFPNISSRRIKNELEKLGYSKHAIELISTICTYEDRLPQGSPASPVLSNLVFRETDKNLEELAKMLDIRYTRYADDLVFSGLGVIPENLQNKIKKILIDDDWVLAEEKEHLSKLPNRLKVHGLLVHGDKPRLTKGYRNRIRAYKHLLELEKIKEVDLYSCKGHVSYANSLDKFTDK

SEQ ID NO: 6865 - protein, 320 aa, unidentified
  source 1..320: note = Related to DOQQ01000002.1; note = Comamonas kerstersii
MKALSPPLFVNFSSLDEAFQAFSYPENIQDWRALTQRNLPPVISTQFLSLLFGVSPNFISSITRKPNKNYRTFIIKKGKKERVINSPKIGLKLFQTWIGHHLSRAVLLEENVCGFIPGKNGILEAASQHSAAGWLYSIDLRDFFSKINSERVKSALLDLGYPEDSAKLITSLCTLNGCLPQGSPASPVLSNLVFKSTDQIFIDLASKLNIRYTRYADDLVFSGNNNQPENLPQIIKEILNNENWEIAPEKEENLKAPYRLKVHGLVVNGLTPRLTKGYRNRIRAYKHLKNTNKIKDNKEKIQGHLAYADQVDKFFAQKIS

SEQ ID NO: 6866 - protein, 320 aa, unidentified
  source 1..320: note = Related to FCLB01000008.1; note = Serratia marcescens
MKTSPPPLLVSFKSAKNLIDALPPSVSEKYEDEIKYLTEKNLPPVVSVAVVSIIFGVSSNFVASILRRKESQYRNFTIKKGTKRRKIEAPKVGLKIFQSWIGHNLSSALIFPKCVFGFIPDMNGVFEAADVHCESKWVYSLDLRDFFTSISREKVKSELINLGYSAHSAELITILCTYQGRLPQGSPASPVLSNIVFQKTDSRLLKKSEELGIKYTRYADDLVFSGINPMPAALPELIKEVLLDEGWTIAEEKEHISCLPNRLKVHGLLVHGEKPRLTKGYRNRIRAYKHLLNSGKVKDADLDMVNGHISYAENLERFNN

SEQ ID NO: 6867 - protein, 359 aa, Pseudomonas sp.
  source 1..359: note = Related to FTMP01000014.1; note = Pseudomonas alcaligenes
MHRRAPAKRQRLLRIRCLSAGGNNESQDSFACMGTPPPPILVSFRSFDDLLEALPVDGREEYRQELQQLYDKVLPPVISISILSVLFGLSASFIASMLRRPHKHYRHFVIKKGRKRREIYAPKVGLKLFQRWIGHHLAEALNYPDCVLGFVPHKSGVFSAANTHCSARWVYSLDLKDFFSQVTGERLSAPLIGLGYSQKSTSIILKICLFNGFLPQGSPASPVLSNLAFEPTDRELSNLAKQHGVRYTRYADDLVFSGEALPPEGFEAQVKEILAVNNWEIAKEKEHFAALPARLKVHGLLVHGARPRLTKGYRNKIRAYRHLLNTGRVKPGDLARVKGHVSYSDCLDHFVENGAFEPK

SEQ ID NO: 6868 - protein, 300 aa, unidentified
  source 1..300: note = Related to DMTT01000123.1; note = Idiomarina loihiensis
MNHGDTVNQINEIERLLAIGLPPVISLSSLATMLGVSVNIIQYIVRHPSKLYDAFELKKGRKVRQISAPRVALKVIQSWFSVHLAKVIPYPNSVVGFRPGVPGVFEGASRHCQASWVLNLDIKDFFDSINRERLKRPLLELGYTEKSADLVLDLCTLSDQLPQGAPSSPPLSNLAFMRTDKQLEEVCSRFKVKYTRYADDLIFSGEGEFPEGFDTEIKDVLAGNDWEMAESKEQLVFAPKRLKVLGLIVNDAVPKLTKGYRNKVRAYKHVLSTKGSEADNFAVLQGHIAYHDSLVKFNSD

SEQ ID NO: 6869 - protein, 393 aa, unidentified
  source 1..393: note = Related to JAIENL010000062.1; note = Burkholderiaceae bacterium
MLNACLCWQGRKNGKFSFGGSASARACITPISEDYVQKEACRKAGAPSNHPPFGRLHQRRLFSLAFAVKALPPPLFVSFASLSEALEAMPVVYRDGIRAVMQPLVDQGLPPVLSSGVVATLFGVSTTFIRAIANSPARYYREFTIRKGKKLRKISAPKIALKLIQSWIGTHLSHSVVLSNCVLGFVPGHNGVIEAAARHCSAKWVYSLDLRDFFPSIDSNRVIQSLLKLGYPESASILITQLCTLGGSLPQGSPASPVFSNLVFIQTDVELNAMAEEFGVRYTRYADDLVFSGEGELPADLQTRVRDCLDKHAWHIAPEKEKVVKLPHRLKVHGLLVHGSEPRLTKGYRNRIRAYRHLVLAGKVTAEDQAKIAGHISYAQQVESASGSQMAPS

SEQ ID NO: 6870 - protein, 306 aa, unidentified
  source 1..306: note = Related to NZ_CP017476.1; note = Hydrogenophaga crassostreae
MDEALEAMPERFREGIQQVMQPLVERGLPPALSVGVVATLFGLSIPFIRAISLNPGKYYREFTIRKGKKDRRISAPKVALKLLQSWIGTHLSHSVKLDDCVFGFVPGRNGVIEAARRHSEARWVYSLDLRDFFPSVKIDRVESALVELGYSINSASFIATLCTLNQALPQGSPASPVLSNLVFANTDKALVQIATEEGVRYTRYADDLVFSGQGIVPPLLQDRVCACLVDHGWEIAPEKESLVELPKRLKVHGLLVHGVTPRLTKGYRNRIRAYRHLFAAEKIQPADLDKVKGHLSYALQVEKVPQ

SEQ ID NO: 6871 - protein, 320 aa, unidentified
  source 1..320: note = Related to JAGNNA010000003.1; note = Reyranella sp.
MKAPPLLVSFSAVEDFVASLPDAVREAHEPEILKLHSAGLPAVISVRAISTLFNISAEFVNAISRTPQRHYRKFQIRKGKKTRDILAPRVALKVIQRWIATHLAASIRLPSCVFGFVPGKSVIDAASVHCDATWVYSLDLRDFFPSITARQVYDAIRSLGYSEDAASLVMQLCTLNGSLPQGSPASPVLSNLVFRDTDVLLSSLAAARSVRYSRYADDLVFSGLAPAPADLQTTVKAVLLDAGWKLAIEKEHLAALPNRLKVHGLLVHGSSPRLTKGYRKKIRAYRHLTRVGKVKPADASRIAGHLAYASSIEKFTKSKE

SEQ ID NO: 6872 - protein, 319 aa, Chromobacterium sp.
  source 1..319: note = Related to NZ_JYKA01000004.1; note = Chromobacterium subtsugae
MNTPPLPLLVTFSSLPDLLLALQLEEEDHERKTQIEALHRKSLPPVTSTLALSTMFGISLNFIHALARHPEKNYRKFKIRKGKKNREISSPRIALKLIQRWFAQHASSALVFPEYVCGFVPGINGVTEAAKRHCNAKWVFSVDLRDFFGQVSRARIHNKLVALGYPESGADLICQLCLLDDKLPQGSPASPFLSNLAFQETDEKLNLIASKFKCRFSRYADDIVFSGKNEFDPIIEKEVKELLEQERWVLAEDKTEISQLPHRLKVHGLLVHGDKPRLTKGYRNRIRAYKHLLSNERIRADDINKVKSHISYANIIDSI

SEQ ID NO: 6873 - protein, 369 aa, unidentified
  source 1..369: note = Related to RQIZ01000001.1; note = Paraburkholderia tropica
MRIALECEGRGQKGACRTTADPSNRPPFGRRHNESHHSFALPVNTPPLLVCFPSLDTASNALSERTRQAYGEEFRGLIERRLPPAVSIRIVATLFGFSPSFVGAMVRRPGRYYRVFEIRSGTKIRKIQAPRVALKVIQQWIGGHLAVAIPYRSSTFGFVPGRSHIDAAGQHCGAEWSYSIDIKDFFQSTSEEAVRRALMELGYSEHASHLVSSLCCVGGYLAQGAPSSPALSNLVFLNYDIQFEQYAAEHGLTYTRYADDIVFSGRGEIPASLPELAKRTIESGGWQIAPEKEKTQRRPYRLKVHGLLVEGISPRLTKGYRRRIRALRHLMEHGRVAADQLAKVAGHLNYAEQVASWARKSERSSEVDE

SEQ ID NO: 6874 - protein, 328 aa, unidentified
  source 1..328: note = Related to NZ_JJMR01000016.1; note = Burkholderia sp.
MNTPPLLVTFPSLDFFVSALAEDTRSLYEAEIRGLVELGLPPVVSLRTIAVLFGFSPSFVGTLAKRPARYYRVFEIRTGKKVRFIQAPKVALKLIQRWIGGNLASTFNYLDSTFGFVPGRSHIDAAARHCESNWAYSVDIKDFFRTTSAARVRTALLKLGYSGRAADLTVALTCYEGFLAQGAPTSPVLSNIVFREYDQLLEELACELNLTFTRYADDIVFSGTGAPIAELKDRVRSIIESGGWKISEKKEKLFQKPYRLKVHGLLVDGTVPRLTKGYRRRIRALKHLLSQGKVPPKQLRKVQGHLNYAQQVDSWLASQAATDGDESS

SEQ ID NO: 6875 - protein, 366 aa, unidentified
  source 1..366: note = Related to JAEDZZ010000001.1; note = Burkholderia oklahomensis
MRIALICEDHGQKGACRTAAAPSDRPPFGRRLNESNLSFALPVNTPPLLVNFPSLDFLLKALAEETREIHADEIRFLIERQLPPAVSTRVIATLFGFSPLFLSAIARRPDRYYRQFEIRSGAKLRQIQSPKVALKLIQRWIGGNLATSLTYPDCVYGFVPGRSHIEAAAKHCGADWVYSADVKDFFQSTSFDAVQRALTEVGYQPKAAQLVATYSCFKGFLAQGAPSSPVLSNLVFLPYDRQLLEYAVQCDITYTRYADDVVLSGRGQPPEDLKAFIHQTIEAGGWVLSERKEKLSVKPHRLKVHGLLVDGDSPRLTKGYRHRIRALTHLLEKGSVSPETMSKVLGHINYAKLVAEKGRDEGQGGD

SEQ ID NO: 6876 - protein, 328 aa, unidentified
  source 1..328: note = Related to NZ_RBXL01000001.1; note = Thiocapsa rosea
MNTPPRLILFSSLDKYLQALGDGFDEAHVDAIRCLDSKGYPPVVSIRALSVLFGYRSQFVGAMLNRPQHYYRRFQIRSGKKQRRIDAPRVGLKIIQKWFGHYLARAITMPDVVVGFVPGRSILHGAAMHCRAKWVFSTDIKDFFQSTPTAIVKNALVDIGYTEHGAEIASGLSSLNGVLAQGSPASPVLSNLAFLKVDRQLQEYCHERGLVYTRYADDIVISGAGKPSPNISSDVRGMIETGNWQLSEEKTTLLSLPNRLKVYGLLVDQARPRLTKGYRRRLRAIRHLVDSGKIDAQNDPKAYERACGHLAFAQSVEDFSDRVQKDST

SEQ ID NO: 6877 - protein, 320 aa, unidentified
  source 1..320: note = Related to NZ_CP073100.1; note = Luteolibacter ambystomatis
MNAPPLLVSFDSLHRLFLACGVEDNSSAASSLSALVEIGFPPIVSKATLGVLFGYSPRFIGAMCKNPDRYYRTFYLPKGNGKFRRIDAPRVALKVIQKWAGFHLANNLKLSPSVVGFIPKISAIDGAARHCSQDWVFSTDIENFFQTTAQSRVTQSLIKFGFPAEGAELFSKLSCLNGNLAQGAPCSPVLSNICFSEFDVLIENYSLDNELVYTRYADDIVISGRGNPPPDLENKILEIVTAAGWSISSSKTRFSRRPNRLKVYGLLVSGDVPRLTKGYRNRIRALRHLENSGKLSPESEDVALGHLSYAKSVERFGLGS

SEQ ID NO: 6878 - protein, 324 aa, unidentified
  source 1..324: note = Related to NZ_BCNS01000018.1; note = Marinobacterium profundum
MNIPPLLFSFTTLDQLISSLDEETRHSKENEIASLFKNKLPPLVSIQVLSTLTGFSIPFIYSMTNKPEKYYRTFIISTGKKKRIIHSPRVSIKIIQKWLAHHISSSVNFNECVYGFVKKKSHILAASKHCGSDWVYSVDIKDFFPSTTIEKVRLGLIDIGYSEKAADLISKISSFESCLAQGSPLSPCLSNIVFKNVDNNLCEIAKNYELTYTRYADDIVFSGTGNKPSQLSSAIKDEIESAGWKLAPGKEFYSDRKDHLKVHGLLVNSNRPKLGKRYRNRIRAYEHLLRNDKISPADKPKIMGHVSYRDSVDTLGKKEDTTPA

SEQ ID NO: 6879 - protein, 377 aa, unidentified
  source 1..377: note = Related to CABVLY010000035.1; note = Burkholderia anthina
MRGGNGDRLRTAVCCARVCITLTCEDPSTEGRLPNGGRSFESPAVRQAASTKATSFALPVNTPPPLLYFGSVDELIAALSPVTRERYEYQIRTICDLNLPPAVSIHVIATLFGYSPSFVVALLKRPERYYRIFTIRSGKKRREIVAPKVSVKIIQRWIGGNIERHIEWLPCVFGFVSGRSSIDAASIHCGADWVYSIDLRDFFPSTTRATVQAALTDIGYEPHCAELIARLSCYGGRLAQGAPSSPVLSNLAFMRFDQRLMELSNAFDVKYTRYADDMVFSGNGTFPAALKGEIEAVFRDSDWKFAGDKEYFAEKPSRLKVHGLLVDGGVPRLTRGYRNKIRAFRHLMSTGRVREKDVSKISGHIAYANLVLRKAGR

SEQ ID NO: 6880 - protein, 362 aa, unidentified
  source 1..362: note = Related to NZ_CP034197.1; note = Ralstonia solanacearum
MCITLICEDRTIEGRLTNGGRSFESPAVRQAAATKATSFALPVDTPLPLLFFESIDELVGALSPLTRERYEPEIRRLFDARLPPAASIHVVATLFGYSPSFVVALLKRPERYYRTFYIKSGKKVRLINAPKVSIKIIQRWIGGNIARNVQWLPCVFGFVPGKSSVDAARVHCEADWVYSVDIKDFFPSTRSESVQVALIKLGYKPHAAELIARLCCHGGRLAQGAPSSPTLSNLVFQPFDEQLQRLADTLNVKYTRYADDMVFSGENAFPEKLKNGVSEIFLKSDWVFAQEKEYFAKRPTRLKVHGLLVDGRVPRLTRGYQNKIRAYRHMLEAGKVAKTDIERIRGHVAYADLIEKKTNLTK

SEQ ID NO: 6881 - protein, 325 aa, Azotobacter beijerinckii
  source 1..325: note = Related to FNYO01000057.1
MRLPHSLLSNPFFQFSRLSDLLAVLGNEVGELEIEEIEHLCSIGLPPVTSENVICAVFGFNPGFVWSLLNKKHKYYRRFEIPKGQGVRVIYAPRLGLKVIQKWLSLRLSEFWVPDDSVYGFVVGRSHVDAAARHCGARWAFSCDIENFFPSTSQASVERALIGIGYKEKSAKLIAEVCCYQGALAQGSPASPVLSNICAAGLDKKMLAVRDKYGCVYTRYADDMVFSGEGEMPRELEADVLSCFDGEEWEVAEGKTYSAVYPGRIKVHGLLVGGGVPRLTKGYRNRLRAYRHLLERDAVVKNASVVMGHLAYEDFVRRKALPESE

SEQ ID NO: 6882 - protein, 322 aa, Pseudomonas sp.
  source 1..322: note = Related to PTLV01000220.1; note = Pseudomonas oleovorans
MRLPQSLISSPLFQYHRVSDLLAALDGEIDDEEVSEIQRLSNLGLPPITSANCLAAIFGVNPKFIWSLCNRRSRHYRHFSIPKGSGMRDIHAPRVGLKLIQKWLSVRLSQFWGEREGVYGFVTGRSHVDAAAQHCGSDWVLSCDIENFFPSTTELFVIQSLEAIGYRHSSAALIASLTCYQGGLAQGSPLSPILSNICFNFLDIKFLVLRDSISGVYTRYADDIVFSGRGGFPEGLLEQIRNCFKGTPWCLADNKNYKAIRPCRLKVHGLLVDGDKPRLTKGYRNKIRAYSYLVDNKKITKHESIILGHLTYAEFVTIHQQG

SEQ ID NO: 6883 - protein, 343 aa, Azotobacter beijerinckii
  source 1..343: note = Related to NZ_FOFJ01000068.1
MRKQLEALLSMRLPPYFFSNPYVVFPTLSDFIKSLEGEITDTELQEVNRLAALNLPPVVSGSVVAAIFGVNPGIVWAIINKPHRYYRTFNIPKGNGQREIHAPRVVLKIFQKWLSVRLADAWRPADCVYGFVAGRTYIDAAIKHKNAKWVFSCDIQEFFPSTPSIYVKECLQRLGYNHDQAALVSSLCCFRGGLAQGSPASPVLSNICADDLDKQLLRVAEKYGCNYTRYADDVTFSGSAEVPSGLTDDVAGVFHASPWELAPGKTKLSVSPARLKVHGLLVHTGTPKLTKGYRNKLRAYRHLAAHGKLTKNLSKVNGHLSYAADVDRRVAADNIEVENLFGP

SEQ ID NO: 6884 - protein, 323 aa, unidentified
  source 1..323: note = Related to NZ_SPUM01000038.1; note = Massilia horti
MRLPLHLQSSRYFTFGTLQEFIKASGTSTDAEIAEYERLEALGLPPISSRHSLALMLGVNPALIWSFEARPHRFYRTFHIAKGRSTRRIDAPRVGLKIVQKWLSAQLQAAYSPPEHVYGFVPNRSHVQAASIHCGAEWILSADIADFFPSTPFALVEANLKRLGFNEYAARTIASLSCLDGALAQGAPTSPVLSNICFDEMDKALLALATKHQARLSRYADDIVFSGSGEVSETLISEIRDLFVQSPWELSERKFVLSRRPNRLKVHGLLVEDKRPKLTKGYRNKLRAFRHLLANGRVRSAKDVEIMAGHLAYSDFVEKSFET

SEQ ID NO: 6885 - protein, 371 aa, unidentified
  source 1..371: note = Related to NZ_JAGIXE010000037.1; note = Acidocella facilis
MQHAHCAKTNDRRMPSFGRCSFETQPKRRHLDESQLCYMRLPHQLLESPFFLFSRVEELVEAIGLETGDDEAIQLRALSERGLPPVTSVHCLATMLGVNPGLVWSLINRPHRYYRTFEIPKGRGTRRITAPRVALKVIQKWLGYHLARAASTPPHVYGFVPGRSHIEAAHVHRGAEWALSVDIANFFQTTPSSLVINTLEHLGYGVGAPLLASLTCYLGFLAQGAPSSPVLSNLCFAATDEVLVRLSERYGCKITRYADDVVFSGQGGMPGGLRSELRGIFAATPWKLSPEKESVQPIKGRIKIHGLLVDGPHVRLTKGYRNKLRAYEHILLTRGGEATDRHVLSGHVQYGHHVEAILERLALSRANESPD

SEQ ID NO: 6886 - protein, 375 aa, unidentified
  source 1..375: note = Related to WMBU01000038.1; note = Rhizorhabdus histidinilytica
MRLPQHLLASPLFVFKNAEELIGAMGDRSTPEAIGDIRTLSAQGLPPVVSEEALAAMVGINSGLVWSFLNRTWKHYRTFEIPKGNGVRQINAPRVALKIVQKWLSVNLAKFYEAPEHVFGFVAGRSHIDAAMRHIGAKWAFSADISDFFPSTPEAMVAEALQTIGYSDQSSRIIARLGCLGGRLAQGAPTSPLFSNLCFRQMDSAVLELSHKYECRLTRYADDLVFSGQGDFPNTIRDDLTALFANGPWHLAPQKMLVQPLKGRIKVHGLLVNDSGVRLTRGYRNQIRAYAHLLATRGDQAMEAPKLIGHVEHARHVQRVTGSPSGISKNEGVERERIIIPPGIILPDRQPSADDRRPEAQNESFVGWLKRILNF

SEQ ID NO: 6887 - protein, 325 aa, unidentified
  source 1..325: note = Related to NZ_JAIZQS010000002.1; note = Burkholderia cepacia
MRLPLPLLNSQYFQFSSFAELRTALGDSVSSEELQEAARIVLGGLPPITSRLTLAAMLGVNPGLIWSFENRPQRYYRSFSIPKGRTTRQIDAPKVALKLIQKWLSVQLARTFEPADHVYGFVGGRSHVQAAAQHVGAQWVFSLDIQDFFPSTPIRLVVESLKSLGFGSDGASLLSRLACLRGALAQGAPSSPILSNICFQQMDGQLAQIAQNVGARLTRYADDVVFSGIGEMPPTLENDVRAIFTDSPWTLAEHKIRIAQVPDRLKVHGLLVHGAQIRLTKGYRNRLRAYRHLLHEGKIRDDDLAKVCGHLSYAASVERESDGTS

SEQ ID NO: 6888 - protein, 324 aa, unidentified
  source 1..324: note = Related to NZ_CADFBE010000001.1; note = Burkholderia gladioli
MRLPPSLLNSQYFLFSNFAELRKALGDSASSEELEEAARLVLAGLPPITSRLTLAAMFGVNPGLIWSFENRPRRHYRSFSIPKGRTTRQIDAPKVALKLIQKWLSVQLARTFQPADHVYGFISGRSHVQAAARHVGAQWVFSVDIQDFFPSTPVDLVATALEALGFGRDGAVLLSRLACLRGGLAQGAPTSPVLSNICFQHIDGHLVQIAHNAGARLSRYADDIVFSGIGDIPPMLENDVRTLFDGSPWTLAEQKIRTVRAPDRLKVHGLLVHGAQVRLTKGYRNRLRAYRHLLGEGKIQEADLAKIRGHLNYAASIERDGDEI

SEQ ID NO: 6889 - protein, 313 aa, unidentified
  source 1..313: note = Related to NZ_CADFGI010000002.1; note = Paraburkholderia sp.
MYTSLGELSRALGDAARPEELAEIERLVLLDLPPVSSRIQLATIFGVNPGLIWSFENRTRKHYRSFFIPKGQTTRRIDAPKVALKVIQKWLSVHLSHGFKPADHVYGFVSARSHIQAATLHVDAQWVFSVDIQDFFPTTPIQLVSDSLEAIGFGRDGAMLVARLSCLAGFLAQGAPTSPVLSNICFRLIDEALIAIAARYSIRLTRYADDIVFSGTEEYPAQLETDVRALFSVGPWTLAEHKVRVNKLPERLKVHGLLVHGPKIRLTKGYRNKLRAYRHLMTHEKVAEADIAKIKGHLNYAASVDKFRDASED

SEQ ID NO: 6890 - protein, 324 aa, unidentified
  source 1..324: note = Related to CAJNAS010000001.1; note = Paraburkholderia domus
MRLPQPLLDSQYFLFSSFAELSKALGEAAHPGELAEAERLVLRGLPPVTSRMALATMFGINPGLIWSFENRPRQHYRSFSIPKGRTTRQIDAPRVALKLVQKWLSVHLSRAFQPAEHVYGFVSNRSHVQAAARHVGARWVFSVDIQDFFPSTPVDLVAESLQTIGFGHEGARLLSRLACLRGALAQGAPSSPVLSNICFQHVDEQLILIASRYGVRLTRYADDIVISGTDELPPTLENDVRALFSQGPWRLADQKTQIAQLPDRLKVHGLLVHGEKIRLTKGYRNRLRAYRHLISRGGIQDADLAKVKGHLNYATSVDKEGGDA

SEQ ID NO: 6891 - protein, 303 aa, unidentified
  source 1..303: note = Proposed Ferrovum sp.; note = Related to JAAGNS010000286.1
MDELLKASAGAVPEAEMNEARRLVNLGLPPVTSRMALATMFGISPGLIWSFESRTRKHYRTFFIPKGSGKRRIDAPRIALKIIQKWLSVHLQKCYQPPEHVYGFVSAKSHVAAAARHCGASWVFSVDLKDFFQSTPEVVVINSLERMGFAVNSATLLAKLSCLNGTLAQGSPSSPVLSNICFEHVDEQLLKISKMYNVRLSRYADDITFSGTGVFPAALPEEVLGVFEEGPWRLAEQKTDLAMLPNRLKVHGLLVHGNHVRLTKGYRNRLRAFRHLLKNHKVSDMDLARVQGHLEYSEFVERF

SEQ ID NO: 6892 - protein, 321 aa, unidentified
  source 1..321: note = Related to JAJTWT010000001.1; note = Pelomonas sp.
MRLPHPLLNSQFFQYASLSELLKATERALSESERELMLQLSGKGLPPISSRAALAAMLGINEGLIWSFEARPGRHYRTFYIPKGKDVRRIDAPRVALKIVQKWIGFQLAKAYLPPEHVCGFVEGRSHIDAARIHCRATWVFGVDIQNFFPTTPIDVVARALLDIGYHELGAVLISRLCCFENALAQGAPSSPILSNMCFASYDQRLKAIADRYGARLTRYADDIVFSGQDDFPVALKEEVLGIFASGPWALSNQKIKLAVWPQRLKVHGLLVHGDQLRLTKGYRNRLRAYEHLLAAGKIRAESISVVRGHLGYKDQVAKRA

SEQ ID NO: 6893 - protein, 321 aa, unidentified
  source 1..321: note = Related to MWOL01000027.1; note = Rhodococcus sp.
MRLPQPLLDSQFFQFSSLAELLKATGELVPPSEQVQMRRMVDRGLPPITSRAALSAMLGINPGLMHAFITWPQRYYRTFEIPKGRRGVRRIDAPRVGLKIIQKWVAERLQNCYERPEHVYGFVSGLSHVHAAAQHCEATWTFGVDIKDFFQTTPINVVTKCLLQIGFDENGAAVVASLCCLNGVLAQGAPSSPVLSNICFLHVDQRLAELAAEFGVRLTRYADDIVFSGMGEFPERLQTELFAIFSSGPWRLSERKTRLDKLPNRLKVHGLLVHGERARLTKGYRNRLRAYDHLERTKGEDVEDADVIRGHLSYGKFVESL

SEQ ID NO: 6894 - protein, 320 aa, unidentified
  source 1..320: note = Desulfurellales bacterium; note = Related to SSEM01000053.1
MRLPQPLIESKFFQFERLADLERAIGEHGSALELAEIRRLTNLGLPPIASSSTLATMLGVNRGLIWSLVNRPRRYYRRFSIPKGKEERIIHAPRVALKIPQKWIGVQLSNYFRAPAHVFGFVPHRSHVDAARVHLGAKWVLSLDIENFFPSTPQELVEQALVNIGFGEAGANLIASLACFNGFLAQGSPCSPTLSNYCFSPWDESLALLAAREGVRISRYADDIVLSGHGTPLDGLQEQIAATLANSPWRLSQRKISLSVAPARLKVHGLLVSGDRVRLTKGYRNKLRTFEHILQTRENLDAKFERKVRGHLAYGKFVEA

SEQ ID NO: 6895 - protein, 326 aa, unidentified
  source 1..326: note = Related to PTEU01000002.1; note = Ideonella sp.
MRLPHLFLDRLCFGLSGPEELLRVLGPLASPGEDECIRRLCALDLPPVSSPRALAAMLGVSEGLVWSMLHRQHRHYRHFSIPKGRGSRDITAPRVALKVIQKWLAVRLQAKYYRPGHVFGFVPGLSHIDAARQHLGARWVCSFDIENFFPTTPEGLVAARLVDLGFPESGAGIVARLACFSGVLAQGAPTSPVLSNIALCDIDQRLSLLAERYSLRLTRYADDIVFSGLEAVPDQLAREVYELFAASSWRLSEAKTERVEIPSRLKVHGLLVHGEEVRLTKAYRNRIRAYRYLMERNGIQQADLPKVKGHLSFAESVRKAGGASFG

SEQ ID NO: 6896 - protein, 326 aa, unidentified
  source 1..326: note = Related to CP034464.1; note = Undibacterium parvum
MRLPQPLLDSPYFQFSTVNELCKAAGDPDSAEVMEIRRLDALNLPPVSSRQILGLMFGLNSGLIWSFQSRTHRYYRTFNIPKGNRQRRIDAPCVGLKAIQKWLATQLQGAYKVPDHVFGFVAGRSHIDAASVHAQAVWVLSVDIRDFFQTTPKSLVKTRLLELGFLEKGAELIASLCCLRDNLAQGAPTSPLLSNVCFIHVDQQLSYLADKYNLRLSRYADDIVFSGKGQCPDTLRDELESLFIGSTWVLAPEKTELVSLPKRLKVHGLLVHGENIRLTKGYRNKIRTYKHLLATKGAELTNSEKIKGHISYEKYVDLVVDAQRNT

SEQ ID NO: 6897 - protein, 314 aa, unidentified
  source 1..314: note = Related to NZ_LDJG01000072.1; note = Stenotrophomonas nitritireducens
RRTFYRRSTKEKLCYMRLPQLLQESQFFLFSGVEELLSALGSVIDPAEKQEVLRLADLGLPPISSKDALATMLGINPGLLWSFENRPQKHYRVFTIPKGAGRERTIVAPKVALKVLQKWLSIQLQRNYVPPNHVFGFIPGRSHIQAAQKHLCARWTYSVDIENFFPTTSRDVVCEVFLQLGYSPESSQMLAGFCCYKGFLAQGAPTSPVVSNLAFRNIDERLVQLAERFGVRLSRYADDIVFSGIHDFPDELRIDVDRIFGDSPWRLSPDKTEFDQLPRRLKVHGLLVHGERVRLTKGYRNKLRAYAAVSLYTS

SEQ ID NO: 6898 - protein, 323 aa, unidentified
  source 1..323: note = Related to MDDY01000002.1; note = Xanthomonas arboricola
MRLPPLLLESQFFLFSSLEELLAALGDSVAELEKEEVARLAALGLPPISSRDALATMLGINPGLVWSFEHRSAKHYRRFTIPKGAGQERVIIAPRVALKIVQKWVSVQLQRAYAAPQHVFGFVPGRSHIDAAKQHRLAEWTYSVDIADFFPSTPLRTVTAVFNRLGYGDEVASMLASLSCYQGFLAQGAPTSPVISNLALHEVDRRLIDISRSFDVRVSRYADDIVFSGQNGFPEELVDEVNEIFIDTPWTISQGKTELNRLPRRLKVHGLLVHGAQARLTKGYRNKLRAYAHLIKNGLIQEGHKLRVKGHLRYGEQVKEAAD

SEQ ID NO: 6899 - protein, 323 aa, unidentified
  source 1..323: note = Related to NZ_MOYM01000001.1; note = Stenotrophomonas sp.
MRLPLFLQDSQFFLFSSVEELVAALGDSVAVVDKEEVKRLAELGLPPVCTREVLATMLGINPGLLWSFEYRPDKHYRIFRIPKGARGEREIVAPRVALKILQKWLSVLMQRHYAAPDHVFGFVSGRSHLEAAKVHRMAHWTFSVDIANFFPSTPAYVVAEAFESIGFGAESAEMLARLTCYRGFLAQGAPTSPVMSNIALRAVDEKLSDISRRFGARLSRYADDIVFSGVEEFPEGLRAEVADLMTDTPWELSAEKTEFNQLPGRLKVHGVLVHGPQIRLTKGYRNKLRAYAHLSKRGRIRQDDLLRVAGHIRYGIQVEEVAD

SEQ ID NO: 6900 - protein, 331 aa, unidentified
  source 1..331: note = Related to NZ_VOHK01000004.1; note = Luteimonas marina
MRLPHSLLESQFFALTSAKELVIAMGDSLSEEESDELHRLAGLGLPPVSSALALSTMMGINPGLLWSMLSRPTRHYRRFTIPKGRSERVIFAPRVALKIIQKWLSIHFEKRFTPLPHVYGFVRGKSHIQAAKIHTTAQWVYSTDIEGFFPSTPIGLVVEALMSLGYNADSAEMLAKLCCINGHLAQGSPASPVISNIVLRHIDAGLQRIAGDFGCRLSRYADDIVFSGAQTPPADLGDVVPELFLDTPWRLAPEKTHISTAPRRLKVHALLVHGAEVRLTKGYRNRLRAFRHLIKNGRVREADLKRIQGHLHYADHVAAESVVNGDGSAIP

SEQ ID NO: 6901 - protein, 348 aa, unidentified
  source 1..348: note = Related to NZ_KI535289.1; note = Agrobacterium sp.
MSLTRGPSNRESSSRHLTKDSFAKMRLPHHLVESLLFQYETVDDLVLSLGSEVTPAEVLDIRRLVALGLPPVISRDVLATIIGVNPGLIWSMERRPRKYYRYFPIKKGVGERHIFAPRVALKIIQKWLSYQFARTYLAPPHVFGFVAGRSHLQAANAHCGARWVHSVDIRDFFPSITANVLSSKLVELGYNDLSSDFITKFCCLNGQLAQGAPTSPTLSNLVFRAMDNRLVEIAERFGARLSRYADDIVFSGTQQFPEDLPACVEEIFVGQPWQLAPEKTETAILPHRLKVHGLLVHGHKIRLTKGYRNRIRAYEHLQANGRIIDEDARRVGGHLMYARQVESFIVPD

SEQ ID NO: 6902 - protein, 324 aa, unidentified
  source 1..324: note = Related to QFOR01000002.1; note = Shinella sp.
MRLPHPLVESLLFQYEAVDDLILSLGSDVTPDETADIRRLVALGLPPVISRDVLATIIGVNPGLIWSMERRPHKYYRYFSIKKGIGERRISAPRVALKIIQKWLSCQFSKVYVAPQHVFGFIAGRSHLQAAHVHCSANWVYSVDIRNFFPSITANVLSGTLMDLGYSAPSADLIVKLCCLNGQLAQGAPTSPPLSNLVFRGMDSGLLEIAQRFGARLSRYADDIVFSGTEQFPQNLPATVAEIFAGQPWHLAPEKTEIAILPNRLKVHGLLVHGDQIRLTKGYRNRIRAYEHLQANGRILEGDAARVGGHLMYARQVKNFIAPD

SEQ ID NO: 6903 - protein, 320 aa, unidentified
  source 1..320: note = Related to WIFE01000020.1; note = Rhizobium laguerreae
MKLPRHFVESTFFMFESAAELVTALGPRVGLGDVAEIHRLAQLGLPPIISRDALAVMIGVNPGLIWSFEKRPGRYYRHFQIPKGSGVRNIAAPKVALKAIQKWLSIHFEKCFMPHTHVYGFVPGRSHLQAASVHCGAKWVFSVDIRNFFPSTSAHLVKRALTTLGYSAESSDFLTKFLCLAGGLAQGSPASPVLSNMAFIEVDALLAAMAANYGARLSRYADDIVFSGVNEFPPDLPVQIAQLFARLPWNIAPEKTETAIAPQRMKVHGLLVHGDQIRLTKGYRNRIRAYQHLMTSGKIRDDDWRRIKGHLMYARQVSSS

SEQ ID NO: 6904 - protein, 322 aa, unidentified
  source 1..322: note = Related to NZ_LMNG01000030.1; note = Methylobacterium sp.
MRLPQTLLNSIFFTFALEQEFVSAFGTSLQAIERSEIERLAALQLPPITSEDALALMIGVNPGMIWSLVNRNYKYYDSFVIKKGAKERRISAPRVSMKLIQKWISLHLENAYDPPDHVYGFVAGRSHLDAASKHCEAQWIHSFDIRNFFQNTPSNVVENSLLEIGYKEPSTDIIVPLCTLAGFLAQGAPTSPVLSNMAFKKVDAQLAEVAAAEGLNLTRYADDIVFSGIKAPNSALIEIIKRILAQTPWSLAEEKSHFSEAPNRRKVHGLLVHGNKPRLTKGYRNRIRGFEHAMHKGKIKPEDLIRIKGHLNYAAYVEKKFI

SEQ ID NO: 6905 - protein, 323 aa, unidentified
  source 1..323: note = Related to NZ_CP010735.1; note = Phaeobacter inhibens
MRLPQHLSSSPFFSFSEKDDFFKAIKTVVDDDELERIHLLIARGLIPITSKEVLATMLGVNPGIIWSMVNRPHRYYRSFSIPKGKEKREILAPKVSLKVIQKWISVQLQNNVTFLDHVFGFIPGLSHIDAASQHTEASWIYSIDLEKFFPSTPQSWVEASLGILGYDIKSASLVGDLCCYGGALAQGAPSSPVLSNISMSGVDGSLSALAAELGVRVTRYADDITFSSIYEFPEALPARLSALFKDTPWSISSKKTHLAKSPGRLKVHGLIVNDGQVKLTKGYRNKLRAYKHVIEKNKCRDKDTARLSGHLRYAAQIERHNGE

SEQ ID NO: 6906 - protein, 322 aa, unidentified
  source 1..322: note = Related to NC_003911.12; note = Ruegeria pomeroyi
MRLPHQLTGSRFFSFSDEGEFLKSVSAVVDEEEFVRIGSLVQAGLMPITSKEVLATMLGVNPGIIWSLENKPERYYRRFKIPKGKGEREIVAPKVGLKVIQKWFSVQLQDCARIDDHVFGFVPGRSHIDAASVHTNANWVYSIDLTNFFPSTPINWVASSLINIGYDADSADRISKLCCYRGALAQGSPASPVLSNISMRGIDAALGALAAEMDVRVTRYADDITFSAAGEFPQVLPERLESLFSQTPWKISQEKTYFSEAPVRLKVHGLVVNGNTVKLTKGYRNKLRAYRHVLQTNRCRQEDLARLSGHVRYASQVSSRDD

SEQ ID NO: 6907 - protein, 325 aa, unidentified
  source 1..325: note = Related to NZ_FNEJ01000006.1; note = Salipiger marinus
MRLPHNLVESQFFIFSEREDFLKAVDSVVDHEELQRINKLIEGGGMPITSKEVLATMFGVNPGIVWSFINKPDRHYRKFSIPKGKGKRSILAPKVGLKVIQKWISYQLQGKARFPDHVFGFVPGRSHIDAAVRHTSARWVYSIDLEDFFPSTPRSLIASSLCSFGYDFKSSELISKLSCYDGGLAQGAPSSPVLSNIAMFEVDTALAELAEELGIRITRYADDITFSSEGVYPSSLPERLSTIFYSTPWKISKKKTYFSVAPKRMKVHGLIVNCGEVKLTKGYRNKLRAYRHVLQSGLCKKEDACRLEGHLNYYSQVIKHRDSST

SEQ ID NO: 6908 - protein, 305 aa, unidentified
  source 1..305: note = Related to JAAFAL010000034.1; note = unidentified bacterium
MGKKLKRGEAEEIQRLAALGLPPITSRWCLGTMLGVNAGIFRSMELRPHRYYRNFRLASGNKVRNIRAPKAGLKVVQRWIAHNLANAYVAPDHVYGFVSGRSHIDAAMQHVNASWVVSVDISDFFPSTPVSVVRSRLLSIGYQEVAANLITSLVTYEESLPQGAPTSPVLSNICFGPSDLKMAAIAEHYDARITRYADDIVFSGETGIPHADILVSVRDHFERTCWDINERKVRISQAPNRRKVHGLLVHGGSVRLTKGYRNRIRAYKHLLNTRSDIPQEDYHSIMGHVSYADHLAELVGKSDSN

SEQ ID NO: 6909 - protein, 322 aa, unidentified
  source 1..322: note = Related to JAIUPC010000007.1; note = Proteobacteria bacterium
MRLPHNLLENVGLLTDGPKELIASLGEGCGVEEADEIVRLFSLGLPPVTSLKALAVMTGYNPGFIWSLVDRPEKYYRVFDIPKGRQLRRIEAPRVALKLIQKWFSLHFERQWKPHDAVHGFVRGRSHLSAARKHVTAEWVVSVDIENFFPSTLKTDVRAALVRLGYRSEESLATIERLCCRYERLTQGAPSSPVVANIALDLLDQKIAAIADHHGVIFTRYADDIVLSGRDRAPANILEELTAIFEGTSWRLSAQKQSVSHLPDRLKVHGLLVHGEHVRLTKGYRNRLRAFRHLSDRGAIREADQRRIRGHLNYSQQIERGG

SEQ ID NO: 6910 - protein, 321 aa, unidentified
  source 1..321: note = Related to JADCJU010000004.1; note = Roseomonas sp.
MGLPHHAVYSQMLCAGSEQDLLLGMGAFCSSAEAEEISRLTALGLPPVTSLEALAVMTGFNPGFLWSLQNRPDRQYRVFSIPKGKTFRQIEAPRVGLKFIQKWLSIHFEHKWSAHPAVHGFVKGRSHITAARVHLNAQWVISVDLENFFPSTKVDTVEKALRKLGYKTDASISILSSLLCFKLRLSQGAPTSPVISNIALSDIDDKISLIAQNCGARYTRYADDIVLSGTLSPPENLLLAIKNVFEKTCWRLAERKTSTVQLPQRLKVHGLLVHGEKIRLTKGYRNKIRAFNHLFEKDAVKAEDAQRIRGHVNYSRQIERV

SEQ ID NO: 6911 - protein, 322 aa, unidentified
  source 1..322: note = Related to NZ_CP041191.1; note = Labrenzia sp.
MRLSHKYIEKIALVAGSAEDLITALGNSCSPEEKAEIQRLVDAGLPPVTSSDALSVMTGFNPGFIWSLVSRPEKQYRVFKIPKGREERQIEAPRVALKLIQKWFSVHFENKWVAHSSVHGFVRGRSHISAAKSHLGAEWVASVDIRNFFPSTTASEVDNALRDLGYGDESIKLLKRLCCFGGRLSQGAPTSPILSNIALHRIDLDASNVAIELGAVYTRYADDIVFSGKGLPPPDVLEKLEKLFTGTCWQLSERKRHIAQLPGRLKVHGLLVHGDKVRLTKGYRNRVRAYKHLVSKGRINLDDRNRIGGHINYAKQIDEASD

SEQ ID NO: 6912 - protein, 325 aa, unidentified
  source 1..325: note = Related to NOXU01000023.1; note = Niveispirillum lacus
MRLPHNLIERLTLVAGSPDELCSALGDAAGGEEVAEIGRLSAAGLPPITSLNALSVMTGYNPGFVWALANRTARYYRVFEIPKGRGTRQIEAPRVALKLIQKWLCHHFSAKWQPLDAVHGFVPGRSHLTAASVHLRAEWILSIDLENFFPSTPIDQIRGSLRKLGYQDGDGLELIANLLSFRGRLSQGAPTSPVISNIALSDIDGILSDIARNFRIRFTRYADDITFSGISGVQLPDELLASVREQFVGTPWRISERKIHIAKSPARLKVHGLLVHGDELRLTKGYRNRLRAYRHLMQLGRIDASDLGKVTGHMNYASQIERLKS

SEQ ID NO: 6913 - protein, 323 aa, unidentified
  source 1..323: note = Alphaproteobacteria bacterium; note = Related to JADLAT010000006.1
MRLPHHNLESVCFLFEHFSELIKAMGDKCPPEEAIEIERLFNLGLPPVTSENALATMLGYNPGFIWSLLNRTSRYYRQFDIPKGAGTRKIDAPKIALKAIQKWLSYHFQKKWIPNEHIFGFLPGKSHMDAASKHLSSKWVYSIDIQNYFPSISTVRVRDALENLGYSTEPSLKIIPTLCCLRGSLVQGSPASPVLSNIVLKNLDEELANFAREKNWKFTRYADDIVFSGIDDINESDFIPIKLFVNQDGWMISDKKTYLARHPNRLKVHGLLVHGDTIRLTKGYRNRIRAFRHLLNADKIKEQDLAVIRGHLNYSAQVDDFQL

SEQ ID NO: 6914 - protein, 319 aa, unidentified
  source 1..319: note = Related to JABJKH010000091.1; note = Rhodospirillaceae bacterium
MRLPQPQLESIGFLFEAPSELIQAMGNECSPDEADEIRRLYGLGLPPVTSQESLSVIFGYNPGFIWSLLNRTPRHYRHFEIPKGAGHRQIEAPRVALKAIQKWLSHHLQRAWTPNENVFGFVPGRSHIDAAAKHLSSEWVFSVDLENFFPSVSIRRVKEALRTVGYQTDKSVEILSTLCCLDNHLVQGSPTSPVLSNIVLKNVDQQFASIAAEKKIVFTRYADDIVFSGSGDIPHQTLTQIKSVVSDDGWTLSERKERLSETPNRLKVHGLLVHGRKLRLTKGYRNRIRAYRHLLKNEKIKEEDLSKIKGHLNYASQVE

SEQ ID NO: 6915 - protein, 323 aa, unidentified
  source 1..323: note = Related to CP045631.1; note = Roseibium aggregatum
MRFPHPDFSELCLFAQTPDILIKALGDFSDDEERQLILEYCAQDLPPVTSVISLAVMTGFNPGFIWSIVSRPHKHYRSFPILKGKNAPPRIINAPKVGLKAIQSWLSIHWVRKFDHHPNSFGFIPGRSHAHAARCHVGAEWVFSVDIKDFFPSIQEDRVLKALQCLGYKAGDGTTLLTRMLCLDGALSQGSPASPVISNMILRGLDERLLALSLELGIVFTRYADDIVFSGKGQPPKALLEKVVNEVNGDGWTIAEDKLYTSILPARLKVHGLLVHGASVRLTKGYRNRIRAYRHLLAEGKISKDDLSSVLGHVSYADFVEKL

SEQ ID NO: 6916 - protein, 337 aa, unidentified
  source 1..337: note = Related to NZ_FREX01000003.1; note = Pseudovibrio sp.
MRLPHPRTEQLGFLAETPKEVCKLIGASCGEDEQKLIQQYYELGLPPVTSVNAISVMFGYNPSFTWSLLKNSHKFYRVFEIPKGPKKRNISAPKVSLKVIQKWLATHFYNKWERPDYVFGFVRGKSHIGAAQEHIGANWVISVDIEDFFPSIRWTRVYDAITDLGYQDDFSKQALTLLSCYYGSLAQGAPTSPILSNIIMGPLDKKIFELARHNSATYTRYADDIVISGKDGEPNSLLEQVCTLIESDGWKISVQKKKIQKSPNRLKIHGLLVNDKNVRLTKGYRNQIRAYKHILNNNSIDDESKNKLRGHIAYADHVATYSEQLPPPSTPSSKLPV

SEQ ID NO: 6917 - protein, 326 aa, unidentified
  source 1..326: note = Related to NZ_AXZR01000004.1; note = Sulfitobacter pontiacus
MRFPHPDLEKICFIAEDPDTLIKLLGEHCTADEAALIQQCCASRLPPISSPDAIATMFGYNPGFVWFMLTKTNRLYRTFFIPKGKGERQITAPRVSLKLIQRWLNFHWSAAWVAPDCVHGFVSGRSHVTAATEHCNAKWIVSADIEDFFPSVKTARVRQALAELGYANMDSLALLGKLVCLNGALTQGAPTSPLLSNIVLGQLDRNLTTLAEELNLVFTRYADDIVFSGKGEMPEGIDKKIKAIIEQDGWTVAEKKFEVAKAPSRLKVHGLLVHGGKVRLTKGYRNRLRAFRHVLSNGKASEKDVPKLSGHVAYADFIDLQHRKPD

SEQ ID NO: 6918 - protein, 329 aa, unidentified
  source 1..329: note = Related to NVXB01000069.1; note = Hyphomicrobiales bacterium
MKPPHPSSFSVGFLTESSDELIRIIGNRVTEEESQLIRQYFDLKLPPITSVPALSGMFGLNEGFIWSVINRATKHYRRFEIPKGRTTRTIFAPKVGLKMIQKWLSIHFQECWSSPRSVFGFVPGRSHLAAAAQHLGSEWVMSIDIKNFFPSTSTQKVEAALGRLGYNDEFSRMAITKLTCLRGGLAQGAPSSPILSNIVLHDLDQRLSQYTEANDLVYTRYADDIVISGNDSPPNDIIDDVRSMVKDDGWEIAESKTSLDRIPNRLKVHGLLVHGKQIRLTKGYRNKIRAYQHLLANNKITDEDFSKISGHIRYASSVEKFDTHPDNYD

SEQ ID NO: 6919 - protein, 492 aa, unidentified
  source 1..492: note = Related to RPGP01000001.1; note = Desulfobacteraceae bacterium Eth-SRB1
MKINFNEDILLWAIGVLQPASASDALKFISYIYPEIKPLPLVKEIDQVLSRYRDLGIVVRVHGKSRLYSLTYAGNAKLSLKLRRHRDKARLFLLKDTRKCNMVLSGEEKKESVGASPTSDGSSTLQDFARPIKSAAAPRYPRHNGRFYWSRISKQLNFQVGLNFSSPDIFLKYYSFPSLKAIHNISPDPAEGNDLSVTDFALSVGVSPRLITSLLHATHKYYRQFNIGKRGGGKRTISAPRTFLKVIQYWILDYLLYTLKSHPICHSYQRGKSIITNASPHINSEYVANIDISDFFGSINQTMIIDLLRKNGFGEQLSKTIARLTSLNNGLPQGAPTSPILSNAYLYSFDETAAQIAQNTGLHITRYADDIAISGKKKDSIINVITLFKQELSAKGLELNAKKTRVASRGGQQRVAGVVVNDKALPPRKLRRRVRAMFHQADNYPEEHVEKYNTLRGYLSYFNSFPALKGGPELESYKEILKSLSNNVQPGA

SEQ ID NO: 6920 - protein, 493 aa, unidentified
  source 1..493: note = Desulfobacterales bacterium; note = Related to JACQWO010000092.1
MRVTLNENILLWAAAVLQPASAADVRSFIASIYPEISLLPNIGEIENIFSTWREEGYLQRVHGKSRLYSATYKTNLKLSVKLRRSRDKSRLFLLKSTRAANVNVSGVREQDSVGDSPSTEGSIILQEGAWPIKPAAAPRVPRTTGRFYWPRISKQLSIEVGPSFSSPDTFFNYYSFPSIKTIHEASHKPASEKDLSITDISLAIGISPRLITSFIHAPENHYRQFKIGKRGGGERVINSPRTFLKVVQYWILDYLLHSLPCHPNCHSYQKGKSILSNSLPHVGQKYLANIDISNYFPSINEKMVFSLLRDNNFGEQLSKAVARIVTLENGLPQGAPTSPIISNAFLCNFDEIMTQRALSFNLVYTRYADDMTISGENKENIISLIKNLSANLKDMGLSINEKKTRIASQGGQQKVTGIVVNEVSQPPRTYRRNIRSMFHHAERNPELFADNIKVLKGYISYLQSFPNMQGKKEIFRYKNVCKTIEKNFVQQSH

SEQ ID NO: 6921 - protein, 483 aa, unidentified
  source 1..483: note = Nanoarchaeota archaeon; note = Related to JAHJDK010000078.1
MSARFNWRIILWALGVVQPATAKEIRELLLKVFPDAGRIPSQDEFKVYLNLWEKERLVGVVNRKSAHYSLTSRGNYRMGSDLRYNRDKVRLFLMKEARRNRIYLSGEQIKELVGDSPTVIGSREIYKRHRPIIAALPCFGRNYWPMLLGQLLADPLKNGSPDNHLALYSFPSFESLISSYDRFSRIKKPSLHLLALAIGISPRLISYIIYKRPEHYRQFEIGKRGGGTRNICSPRVFLKTIQYWILDYLLFALKIHPSCNSYQKGKSIITNASDHVGKNYVANIDIKDFFNSISERSISKFLCNQGYDAGFSELISKLVTLNDGLPQGAPTSPHISNAFMYQFDEKIFKFCEKLKMVYSRYADDMTISGSNKKDIIRGIGFAKQYLDSMGLSLNESKTRIASKGGQQKVTGIVVNSHISPPRMFRRKIRAMFHNAYKNPKEYRDKQGQLKGYLCYLCAFPGVLTAKDKEIYVRTINRLSSFAE

SEQ ID NO: 6922 - protein, 442 aa, unidentified
  source 1..442: note = Related to JACXUH010000041.1; note = Betaproteobacteria bacterium
MEPIISRWLEERCIVRVHGKSRLYSISHVGNDKLSIRLRRHRDKARIFLLKSAHDASFQVSGEAHQELAGDSPAVNSSGNTQEGTWPISSASDPRVPRVPVRTYWPRVVRQLDFKVGSVPRSPDTHLTYYSFPSVQSIHDASERCAPPNDLSISDLGIALGVSPRLLTSFIHKPSRHYRQFEIGKRGGGNRVISSPKLFLKVIQYWLHDYFLYRLQIHDSCHSYQKGKSILSNAEPHVGKHFVANIDIENFFGSITKDMVSQLLRNNRFGEHLSNSVARLVTFNDALPQGAPTSPTISNAFLYDFDETMAAWSIIEGLTYTRYADDMTISGNDREQILDAIRLAERLLNEIGLRLNSKKTRIASKGGQQKVTGVVVNEKPQPPRDLRRRIRAMFHQAKMSPDEFRQKLPMLRGYLSYLSSYPALRNSEELNSYINVLKKISQ

SEQ ID NO: 6923 - protein, 502 aa, unidentified
  source 1..502: note = Related to NZ_KB822693.1; note = Marinobacter sp.
MSIQFNDQLLLWGLGVLQPAAPQEVLSFLKLVYPTVEQWPDELYLNDRFFHWEELGYIVVLNKKYSMYSLTALANMRMDVKLRRQRDKARISLLRAAYDANVSRPGVMDQDLDGASPSSEISSTLQEGSRPVGSGSKPSRTEPTRLRTRTYWSRVSEQLSVQVGLDFHSPGIPSFQYRYCSFPTLKAVHQASLGESSENDMSISELGLAIGVSPRLLTSFLHKPENHYRHFSLPKKGGGERDIAAPRFFLKTIQYWIKSYVLCHLKVHNTCHAYTSGKSINTNAKPHVGKAYVANVDIENFFGNITKEHVFRILEKNGVGRKLATAVSGIVTLNRVVPQGAPTSPVISNAVLYEFDKAMSKISVDKGLDYSRYADDITFSGESRSDIEYIVSKCRELLSAEGFNLKDKKSRVASKYASQRVTGLVVNEKVQPPREYRRKLRAIFNNALINPQEYVDRLDELYGYFGYLSSFDGARNARQIRKDRIAIYRVSRLARIKKSKDE

SEQ ID NO: 6924 - protein, 302 aa, Nitrosomonas sp.
  source 1..302: note = Related to SSFV01000001.1
MSLSQLALAIGISPRLLTSFTHRPENHYRFFDISKKGGGKRQIASPRFFLKTVQYWIKSYILCHLKIHDSCHAYLVNKSIITNAEKHARKEFVANIDIEDFFGSIKTDHVFQLLKKNGIGEKLSKAVAHLVTLDGKLPQGAPTSPTISNAFLYEFDNSLSKISNEAGLEYSRYADDITISGSSRSAIESVIFGCRNHLWSNGLKLNENKTRIATSHSSQRVTGLVVNEKIQPPREFQRRIRAIFHIVNKNPESYIERISELRGYYNYLLSFDAIKNSRHLQRYRMVINKLKAAARNNSSSLI

SEQ ID NO: 6925 - protein, 499 aa, unidentified
  source 1..499: note = Gammaproteobacteria bacterium; note = Related to PALV01000013.1
MSVKFNNRLLLWGLGAVQPATPSEVIGFLKLVYPDVTAWPDRNFLRIIFNEWLDRNYVIELNKKYEIFSLTSAGNHALGYKLRVHRDKARVTLLRAVYDANLASLGDVAQDSDGDSPSSEASSALQEGSRPVNSGSEPSRTESTRLRARIYWPRVSEQLLSVGLDRHTSNIPSYRYRYCSFPTLRAIKQASNDNSDTQDLTISQLGLCIGVSPRLLTSFVHKPENHYRTFRIGKKGGGSREISSPRFFLKSIQYWIKSYILSQFNAHNACHSYRIGKSIITNANEHARKSYVGNVDIEDFFGSVDKKMVFECLRKHGYGSELSRSIAGLVTFNNSLPQGAPTSPEISNAILFDFDERLFAAASDVGVTYTRYADDITLSGGSKQVVAQLIRECEEGLKAHGMRLNSKKTRIASIRSSQVVTGLVVNEKVQPSRAYRKRIRAIFHQAGINPSQYVGRLKQLQGYYSYLSAFDSLKDSKQLREYREVIRKLGISSKEKVDG

SEQ ID NO: 6926 - protein, 484 aa, Desulfovibrio sp.
  source 1..484: note = Related to ATHV01000015.1
MKKNELQILLWSIGILQPASPTLVRHFLQEMLPKAFNNTTTQKIKEKFSWLQKNGFLAYALDGVDYIYSLTREGELALGPGIRKSRDKIRLFLLRDSASYIQDSPSSPERGLELTGDSPVVETRYVLQGRRPIAPAAGPGVRRYWPSTFKQLKGFAGPKPRSEFYPFDLYSFASIDELNAAVGTECDRNSLSLIHLALSIGVSSKLLFAISNNSRRYYRSFEIRKASGGMRTIHAPRIFLKTIQRWIVDYFLFQLPCHPGCHSFQRGKSIISNAAIHVGKKYVGNIDIADYFKSIKSEHLVHKLSKFFGIGLSRAISLICTHDDFLPQGAPSSPILSNFYLFDFDKEISLLCEQNELSYSRYADDITISGKEKNSIYNAINYSKYLLKKHNLTLNYQKTRVSSRGGQQNVTGVVVNQKINPPRSLRRNIRALFHNAQKNPMQYTDKIEMMRGYLSYLNMYESQKNIINKSRYEHIIDAIAAVKE

SEQ ID NO: 6927 - protein, 480 aa, unidentified
  source 1..480: note = Related to WYDS01000022.1; note = Halodesulfovibrio sp.
MSNKVHPYYYLWALGIIQPATPTQVQHVLEKTFVESGVKFNLNEIVQCFENCLKGKIVLKASEWNDSLFSLGPNAYMLLPNRLRFNKDRTRLFLLKKARIASRRASGHLDLDADGASPSDKRSFKIQVPRPIKPLGLAPAQFYWSGAYRQLTSTAGPNSTLPEVRLPFLSFESINLIKSINESTKTTPFSITGLALCIGISPSLLVSTIRNIEKQYQTFEIEKHSGGTRTITAPRVFLKTIQHWLADYLFSTLPVHDVCHAYRSKRSIISNAEKHTNQKFVAKIDISNFFGTITSEMLIKKLSPFCSVEEATVFSRIVTLNGSIPQGAPTSPCLSNFILFDADGIIAKECQKVGVNYTRYSDDLTFSGENRGQLLEIISFTENVLKEYGFELNPSKTHIMTSGMLQNVTGVTVNEKVQPPRKVRKKIRAMFHQAEQSPENFKDQLENLAGYVSYLNAYPELKDSQTLRHYKEVLVKLSTL

SEQ ID NO: 6928 - protein, 459 aa, Desulfovibrio sp.
  source 1..459: note = Related to MLBG01000117.1
MKTELSTQIYAWALGIMQPASATIVKHFMQMALPDSCQDLETKDVKVQFAKMLKLGLISQSSEKIDYVYSLTWLGNLSMNNKLRVHRDKARLFLLKDAAQAAHKERFSEGRGLELTGDSPVMDLSSDKQSRRPIGQVVDSADLAYWSSTFKQLKHSAGPLPRSSFSTSFGLYSFASCNELQLACHNICPNTFDLDISSISLCIGISPSLLVSMSNKPEDHYRTYEIGKKNGGTRIIHSPRIFLKTVQYWIKDYILHSLNIHDSCHAYQKNKSIQTNASMHLNKKFLANVDIKNFFGSISQEKLQNTLATRYSKKMSQCISRLCTINNLLPQGAPTSPVLSNFYLSEFDAKVETFCHHLQLDYTRYADDLTISGNYKDNVLKAIDFAKDTLNLYELKLNDSKTRVASKHGQQKVTGVVVNEKMQPPRKFRKKIRATFYQAKKILAIIPTRKKSCEDILVI

SEQ ID NO: 6929 - protein, 491 aa, unidentified
  source 1..491: note = Related to CP038027.1; note = Brevundimonas naejangsanensis
MTQILNAPSIIMALGVLQPATTFEVVGFLKTMLPHAGTLPQPDEVLEFFKEREAAGHVLRVARGDGGTSLYALTLAGHRYLNVRQRQVRDKLRFYLLRDARQARRRSSDGEASRLVGASPTLDTSSPIKGSVANKYGHHVPPGRTYWPRISRQFGVSTGLSASSSDTFPEWLSFRDQRQCELATNFGEGQFELDFEGLAACLGVSPKIISQIASSPNRHYRSFEIAKKSGGSRTISSPRVFLKVIQWFLLDFILTSLPVHHAVHSFSFGRSVVTNAQTHEGQAFVGSLDIEDYFGSVTTSAIFELLVGSGFRNHEARLIARLSTKDGGLPQGAPTSAVLSNAVLYPFDEQINKECARAGLTYTRYADDITISGADRRELLRVMALAEGLLAKHNLHVNKEKTRVVSQGSQQRVTGVVVNQTAKPSRYFRRLVRAKFHNAALSEDHNKVKVEQLSGYLSYLQMFPSLKGSKLFETLAHDLSRARQKDPPMLI

SEQ ID NO: 6930 - protein, 374 aa, unidentified
  source 1..374: note = Related to JAFLCS010000004.1; note = Caulobacterales bacterium
MVGDAPTLESSSSIKGCAANNFGHSVPRVRTYWPRISRQFDRSTGLSAPSSDTFPEWLSFRNRRQCELAVGIERGQFKLDYEGLAASLGVSVKIVSQVSRRPARHYRSFSIQKKSGGERKISSPRVFLKVMQWFLDDFILDGLPVHSSVHSFVTGKSVATNGKLHVCQSYVGSIDIENYFGSITKAMVQRLLLENGFLDDEVSLISALTTLNDTLPQGAPTSATLSNAILYGFDCDMAMSCEEAGLVYSRYADDITISGSSREAVERALSRAKRQLANRSFRTNPSKTRIVSDRARQVVTGVVVNAVAQPSRTYRRNVRAKFHNAAKQKTPAGVEIRALAGHLAYLKMFSSLTGSRQIAALERDLRKVRAKKQE

SEQ ID NO: 6931 - protein, 488 aa, unidentified
  source 1..488: note = Related to NZ_CP031417.1; note = Pseudolabrys taiwanensis
MKKVLNAKMALLALGVLQPASAREVRAFLKFVFPESGTLPDVEEFEQFLREQESVNRVVEVERRTMAYYSLTLLGSLYLPPDIRKKRDKFRAYLLRDARRGRFIESRELGTELAGVSPASDTSTIVKGRAANNLGRSSFGRRFANGQAYWPRIQGQFITRTGPTRRSRDTFPNLLSFQDLDQAKRANGNVFCFDYSGIGLCLGLSPQLVWNISRRQSSHYRAFPVAKKGGGTRLIESPRVFLKVIQWFLNDFVLHRLPVHDAVHSFRFGRSIATNAECHKRSMFVGNVDIENFFGTITEGAIISLLTRNNFAPLEAMAIAKLCPNWGALPQGAPTSPIISNALLYDVDKKMSAVCEARGLAYTRYADDISISGPRRRDIADAIRIFEAAISDFGLKINQEKTRIAHRSGQQRVTGVVVNEFAQPSRAFRKLVRAKFHAASVSPDKGVRMIPELGGILGYLKIFPSMQQRREIASYGAIIKFLKSQRTE

SEQ ID NO: 6932 - protein, 547 aa, unidentified
  source 1..547: note = Related to NZ_JACSDK010000013.1; note = Pelagibius marinus
MRTEEPTVWPFPSVKRRTLLRALLYGAASGAALGTLGLSPRAGELASEEIVLTMLGILQPASAEEVFCILELLHDAAAAEGMALDLERPRAGEISEAVEALQRQGAILPVQANPVRRYSMTAAGNRRLSPRLRATRDTTRLFLLHGPRARIMEMSREGREGESGGASPPSNLRSLIDSLGRPLGSTEDDGNQPPTRAWPVARHRLWSRHCRTSPLALSRDTSLRFLSFDSLEQLRLAGGTSGMVSRLRLSPQGIALSLGVSLQFLRWLRDTRYDRHYRSFAIPKRGGGKRWIESPRIFLKVTQRFVLHHILSGQPVHDTVHSFVPAVQAGELRNSITNARRHLAKPYVAKIDIKDFFGSLRGYLVDQAFQDTALLNADARRLLSSLCTRRNALPQGAPTSPMISNLILRRFDENMARLCSELDLVYTRYADDITISGAVREDVELAAWFARKGLTGEPLTLPVNEDKSRILSAGQQQRVTGVIVNERGLPPRRMRRRVRAMFHQAALDPARLREERARLGGYLAYFRAFPDYPSGELARYARVLAQK

SEQ ID NO: 6933 - protein, 499 aa, unidentified
  source 1..499: note = Related to NZ_JH767528.1; note = Catenovulum agarivorans
MSLATIQIGCNFPPELNLDKDKTTVVYWIAAILQPSDKSTILTFLKSIQDHIWENISQDDITHSLNYLCKQQYLLKLSIGLTDYFSINPAKHIKLSINERLNKDRIRFFLLNCGKADKFQTVRRNCKIKVDGVPPSFEERLPIQLRVEIRGRRSQPIISSWVSLLESTLFTVSPSTTQLSPTHKSLSYPNYNFIDHIDADLSPHMTVRHILAADLGISVQLISRILANKTQYYRSFEIIRKNGNKRLIEAPRTYLKVLMRYINHHLLTGLAIHDSVHSYRQGKSFLTNAQIHVAKQYVFNLDIENYFGCINKRQVRELFSINDFTASAATLLSELCTFNDRLPQGAPTSPIISNAILFKIDQSMHRYCEKNNLCYTRYSDDITLSGNSRQSIVKAKSRLIAMIHGAGFKINDKKTRLMPYHKQQLVTGVVVNKEATPARNELRRIRAKFHQAACSSQLPYATRSQLLGYISYLSHFEKYRNSELLHKYSRIIENVSFVA

SEQ ID NO: 6934 - protein, 485 aa, unidentified
  source 1..485: note = Related to SRHQ01000067.1; note = Methylorubrum sp.
MTVTLNRGFILWAVGVLQPVASGELLYYMEHVFENAGALPSENDLHSYLVEAANVGQLIRIMREPDLFSLTIQGNSYLSRSQRMSRDRERIFLLADAWNGRKLTSREEQTTESGGVSPPLLQRTTLEGTGANECGPSVPRGRTHWPRYSKQLTKTTGSSSSSRDTFINFLSFNDATQVNLARRASGRAIQPDAVNLALMIGLTPRLISQIIVRPDRHYRSFPIKKRTGGAREIHAPRVFLKTIQRFIVDYIFHVLPQHDAVHSFRNDRSILSNAQCHVGKQWVAGIDVENFFGSITERHINSHLSSIGLDAPSARTLAKLATLNGVLPQGAPTSPILSNSVLYNFDELMSAEAEKQSLVYTRYADDITISGSSIDCIRSLIACATLLLNDMYGLVINDKKTRVLSRRSRQVVTGVVVNDVALPPRDLRRRMRAASYNATKVEGVNVEALNMLRGYLGYFQEFPDLVDNKEFTDFRKNLGNIRARF

SEQ ID NO: 6935 - protein, 489 aa, unidentified
  source 1..489: note = Related to VXOZ01000123.1; note = Chloroflexi bacterium
MDSFIGHQTTLWAIGVLQPVSASELVDYFKALLDDAGDLPDSRELQRFCRDASKRGLVVRVRRRPDLFSLSLKGNRRLSREQRLLRDRARLLLLKETKKSRVHVSREVQATELGGASPSEDASSTSQGGSANKSRPLVPRGLACWPRLSKELLIRPSPASRDTPLDLLSFMTWAQVAIACGKTQEELTLDCHSIGMMLGVSPKLIQQLAWDPEHHYRSFEIPKRAGGLRTIDSPRVFLKVIQRFLADYILVHLPISSAVTSYRIRMSIQENARPHVGAEYVANSDIENFFGSIKHGPIVNLLMHNGLRASSAKLIGDLVTKNRSLPQGAPTSPPISNAFLYIFDEFMLSYCHTEKVSYSRYADDITISGNNRSAIEDALAMAKTKLLVEYGLRLNMAKTRIASKHGQQKVTGLVVNERISPPRVYRRRVRAIFHKARLNKQVNVEEFRRLRGYLSYLKSFDALRHSSEVQEHESTLSKLSIRSTNADTV

SEQ ID NO: 6936 - protein, 486 aa, unidentified
  source 1..486: note = Sphingomonadales bacterium; note = Related to SSDV01000007.1
MKTKLNTSNLLWVIGVLQPVSAEEITSYLATVFDDAGTMPKGTDIHKFCREQTDKKHLIRVAREPDLFSLTLLGNQYLSDDLRKSRDRSRIYLLKEAYKARLKMLRGVKATGLDGAAPSADVRPSKKGPEANKLGPVVPSGQAYWPRFSRQLSEQTGSLPTSRDTPLPFLSFANREQLAVAIRSKGEAGSINFTSLGLMLGISPKLIQQIAHHPDRHYRSFQLKKASGGMRNIESPRVFLKVIQRFFLDYILSDLPVDDNVYSFRKNYSIAHNAERHVGKQFVANIDIKNFFGSITSEKILSLLRKHGVEQRSAVLISALVTKEGILPQGAATSPLLSNSLLLEFDSRMSRLAENACANYSRYADDVTFSGNDRDVIANLIKTAEIELLHDYGLQLNKDKTRIATQRSQQKVTGLVVNEKVWPSRKFRRQIRAAFNNARKQEAVDKKRLEKLAGYLGYLRSFDVMKGSPDLVRYSSILASLTVAPD

SEQ ID NO: 6937 - protein, 480 aa, unidentified
  source 1..480: note = Related to NZ_LAVN01000001.1; note = Burkholderia gladioli
MKNARINESLLLWAVGVIQPASPGEVIAFIERVTQSQFPPGVLEGVTAQCSHYVARGLLREVNKRRNWYSLTYEAELRIPKRLRRRRDRIRLFLLKGARAARMRAVGVPHTQKSVDVSSTSRTSGGEDIQEVPRPTKSFGRGERAQERFPWPRIFEQISDGSGSATGTPTHSDSSNATNPLAFYTFSGRHRAAADNPYPLNVRELGLAIGVSARLLTSIGKFPNRHYRRFQIPKANGTNRDIASPRIFLKTIQYWIKDYLLYRLPVHETCYSFISGVSIEDNAACHAGKNFVATIDIRDFFGSITLENVQTVMRRAGHTISLARIVAKLVTLDGSLPQGAPTSPIISNSYLFDFDRAMSMWCAKRGCSYTRYADDITISGETRSEVQRCVDHAEYRLNRYGLRLNEGKTRLQSRGARQVVTGLVVNELAQPSREQRRMVRAMLHRYQTGIMREPTDIARLRGWISYFHSFEHLREKFPRI

SEQ ID NO: 6938 - protein, 477 aa, unidentified
  source 1..477: note = Related to QVIO01000003.1; note = Duganella sp.
MSHTRINESILLWAIGVIQPGSPAEAIEIIEKATKSKLPPGSAEGITLQCEHYVQRGLLRLVHKKKNWYSLTHLGDVSIPKVLRRRRDRIRLFLLKNTWQSRIADVGAPVMQKSVDVSSTMQNSGEYVQEVPRPTKSCNRGERGHERFRWPRIYEQMTKGSGSANGAPTPPVTPNPLTFYTFSGKHRGEIENPYPINARELSLAIGISARLITSIAKIPEKHYRRFKIPKANGSFRNIASPKLFLKVIQYWLKDYLLFRLPIHETCFSFIKNVSIEDNASPHTKMAYVGTIDIEDYFGSIKVTAVQSVLKRAGFTASASRIISKLVTLDDALPQGAPTSPIISNTFLFRFDEFISRWCKTHECTYTRYADDVTISGMNKSSVLQCIDRAEILLNRYGLKLNSKKTRIQSQSTRQVVTGLTVNELAQPSREQRRKVRAMLHNYQIGKLNDPKEIQRLRGWISYFRSFDHLKEIFQMPA

SEQ ID NO: 6939 - protein, 485 aa, unidentified
  source 1..485: note = Related to PGES01000001.1; note = Janthinobacterium sp.
MSLPRINESLLLWAVGVIQPTSPLEIVQFIEYVTRGTVPPGTLEGIEQQCQHYTKRGLLRSVSTRHNWFSLTYAGDVSIPKEMRRRRDRMRLFLLKKCWQSRIHHVGVPRSQKLIDVSSISQHSGKDIQEVPRPTKSSNRGERGRERFRWPRIFEQIPIGSGSAIGTPTPPPPNTLTFFTFSAQHRSEAAGNPYPINAKELALGIGVSARLLTSIAKTPEKHYRKFQIPKADGSHRNIASPRLFLKILQYWIKDYILFRLPIHQSCYSFLPGVSIIDNATPHIGKNFVATIDIENFFGSITQQGVQSLIVRAGYTAALARIISKLATLDNTLPQGAPTSPIISNSYLFRFDQSISAWCARLGCTYTRYADDMTISGTDRVTVNNCLERATNLLNRYGLKLKSSKTRIQSRGGRQAVTGLVVNEIVQPPREQRRLIRSMIDRYRRDLLDPADLTKLRGWVSYFQSFHHLKNKYNYDEISDLEKDKI

SEQ ID NO: 6940 - protein, 519 aa, unidentified
  source 1..519: note = Related to VMKF01000002.1; note = Geobacter sp.
MAIAINQNLLLWAVGTIQPANSDEVAGFISHVTQDSIPEDIPFFFRDQLRRLAIEGLVVQVSQREGLFSLTERGNDRLSSELRRLRDRIRLFLLKKAKNVRKAPLGDRQQMGGASPSGSEKILLKEVARPIRTTALPHGRTNWPRIGKQFLHRNVERSPSIPPTPTFPANRVRFYCTDGPFDGTTSEVNWLALAIGISPRLITSFIHKSEKHYRHFPIAKKNGGVRNIDAPRVFLKTVQHWILDYILVDLNSHAKCFSYRRGFSIEDNAAIHSQQGFVYNIDIENFFGSISTSAVNQTLTKQGIPPKLAKLLSYLCTFKGSLPQGAPTSPVISNSYLYDFDVFIDRICYQLGCNYSRYADDITISGNEFSKVGECIAAAEQQLRLFRLKINTAKRRVQSKNTRQLVTGLVVNTDPKPPRTYRRQIRAFFHQIKNVPNVDPKGQLCKMYGYYSYLSSFKALSENKELIGYRRQILEFKSIHFPIMHMHSKDMEELDLFTQPATITETDSFFELPAEPAPN

SEQ ID NO: 6941 - protein, 498 aa, unidentified
  source 1..498: note = Related to FNKY01000001.1; note = Nitrosospira multiformis
MTVRVNSQLIMLSLGIIQPASPSAVAKFLSMSLLENSAPIEEQILMPLFEKWGAEGLIVRVHTKLKLFSLSSKGNHILTKEMRHLRDNTRLFLLKELRDGTLAPLGELGKEELTDASSVSLIDLVIQEEERPINPAVTLGKAQSDGRVYWPLLAKQLFVGSIPQSPSPRFRYGSFQSLDSCHMAHPYGAQENDFNLIDLSLCIGISPRLLSSFLYSSEHHYRLFDIAKKNGGTRTIRSPRVMLKTVQYWILDHLLHKLPIHDSCKSYRKGLSIFDNAKSHCDQNYVGNFDIKNFFPSITTTRLTNHFRLHGFPENASRLIAKLLTVNNELPQGAPTSPVVSNSYLFKFDEVVSNFSKNLELNYSRYADDVTISGAKRSDIHAVIAFSTNELARYELLLNPKKTRIAGRGSRQIVTGLVVNKVAQPPRTYRRQVRAMFDNAINNPEEFRSRLSELSGHLSYLGSFENLQNSQSIERYKETLKKLRTHLSVNNLYPSPQQ

SEQ ID NO: 6942 - protein, 487 aa, unidentified
  source 1..487: note = Related to NZ_JAAOLY010000027.1; note = Janthinobacterium lividum
MAVRLNPQASLLSLGIVQPASPAEVANFIEQSLLKGKSKVDLNELTLLFERWKTDGLIQRVHARENLYSLSATGNHSLSKEMRHLRDKTRLFLLKDLRNGSIRLPEEAKSELADVSSASLNDLVSQEEQRPISALTPLRSTHRREPAYWPLLGKQLLVGSTVRSSGTRFRFGSFPSLKACHAAHKNGADGTDFNISDLALGIGISARLLSSFTHNARKHYREFEIPKKTGGVRRICAPRTMLKVVQYWILDHILYKLPVHSACYSFKEGVSIYDNAVVHLKSNYVGNFDIKDYFPSITMDMLKDFLITNGYGQIASNIISRLTTFEGSLPQGAPTSPLISNAFLSGFDEEISVYVAENGMQYTRYADDITISGADRGKILSAIEFATEKLKDLNFLLNEKKTRIAGRASRQVVTGLVVNEIVQPTRSYRRQVRAMFHHASKYPEEFQARTKQLGGHLAYLMSFENIRETAAISEYKRILVSITNPSP

SEQ ID NO: 6943 - protein, 499 aa, unidentified
  source 1..499: note = Proposed Superficieibacter electus; note = Related to PQGD01000012.1
MEESTNYKLLVWGLSVIQPATPNEVLNYLTSTLNDNGLLPDVEKMIHYFELLDQLGYIHQVSKRNNLYSLTPRGNERLTPALKRLRDKIRLFMLDNCHSISKLGVLASTDTENMGGDSPSLQLRHNLKEVPHPSLSWAAGTLPSSPRQAWVRIYEQLNIGSMSSDEASTPTTARNAPLSFVGRLGFSLNYYSFNKIDEPLFNNDGVTAIASCIGISPGLITAMVKSPKRYYRTFNLRKKSGGFRSILAPRKFIKTIQYWLKDHVLNRLKIHSSCYSYRSGVSIKDNAINHVKKKFVASIDISDYFGSINKKMVKDCFYKNNIPDHIVNTISGIVTYNDVLPQGAPTSPIISNAILFEFDEEMTAHALTLDCIYTRYSDDISISSDYKENIAILINIAEANLLSAGFTLNRQKQRIASDNSRQVVTGILVNESIRPTRCYRKKIRSAFDHALKEQDGSQLTINKLRGYLNYLKSFETYGFKFNEKKYKETLDFLIALKQS

SEQ ID NO: 6944 - protein, 353 aa, unidentified
  source 1..353: note = Related to NITF01000014.1; note = Cronobacter sakazakii
RQAWVRIYEQLNIGSMSSDEASTPTTARNAPLSFVGRLGFSLNYYSFNKIDEPLFNNDGVTAIASCIGISPGLITAMVKSPKRYYRTFNLRKKSGGFRPILAPRKFIKTIQYWLKDHVLNRLKIHSSCYSYRSGVSIKDNAINHVKKKFVASIDISDYFGSINKKMVKDCFYKNNIPDHIVNTISGIVTYNDVLPQGAPTSPIISNAILFEFDEEMTAHALTLDCIYTRYSDDISISSDYKENIAILINIAETNLLSAGFTLNRQKQRIASDNSRQVVTGILVNESIRPTRCYRKKIRSAFDHALKEQDGSQLTINKLRGYLNYLKSFETYGFKFNEKKYKETLDFLITLKQS

SEQ ID NO: 6945 - protein, 499 aa, unidentified
  source 1..499: note = Related to DACSPQ010000008.1; note = Serratia marcescens
MEESTNYKLLLWGLSVIQPATPNEVLNYLTSTLNDNGLLPEVERMVHYFELLEQHGYMHQVSRRNNLYSLTPRGNERLTPTLKRLRDKIRLFMLDNCHSISKLGMLASTDTENMDGDSPSLQLRHNSKEVPHPSLPWAAGALPSSPRQAWVRIYEQLKIGSMSSNEASTPPKRKISSLPSIGRLGFSLNYYSFNTLDDHLFNNDGVTAIASCIGISPGLLTTMIKSPKRYYRTFNLQKKSGGFRPILAPRKFIKTIQYWINDHVLNRLKIHSSCYSYRKGVSVKDNAINHVGKAFVASIDISDYFGSINTKMIKSCFYKNNIPEHVINAISGIVTYNDVLPQGAPTSPIISNAILFEFDAEMTYLALRHNSIYTRYSDDISISSDKKENIDELIRVAEANLLSVGFKLNENKRRVVSRNNRQVVTGILVNESIRPTRTYRKKIRSAFDHALKENDNNQLTINKLRGYLNYLKSFESYGFSFNEKKYKDILDFLLTLQQR

SEQ ID NO: 6946 - protein, 717 aa, unidentified
  source 1..717: note = Related to LS483483.1; note = Klebsiella oxytoca
MPGNKGELINIRNKGDGNTFNIIQINGGNAPDISKQLGFLGLDIIDNTKKSLVSEFSSGNNNVLLCYPNKEDKILEPIIEKIKAGLSNIGANIFEGSGKTQLPDVQGYPHIAEIDFIKNLKCDSIIIFVLDELTLSQLTLLSYYKIESNIQHVDIIAIPSDSIFNYDKFLSNGLIQYCDDNNCKVIKLSTLDDAEVERVIARVKNRKMIQARRGIMLTKADAYDFNHKLFIWALSVIQPASPYEVISYLSIILNDNGVLPAKDKINEYFKALASSEYINQVSKKNNLYSISLNGNEQLSPELKKLRDKLRIYLLDKTRVVSKVKVLASTESKKMGGASPSSQLRFVLKDAPHPSVPWALGALPNHPRNTWVRIAEQINFGSMLSEASNTETHVNQTQHTIFPLNYGSYNSIDYNLIGNTGPTILASLIGVSPHLIAIMSMNPDKYYRSFKLNKKSGGHREILAPRKFMKVIQYWITDYFLFRLKIHASCYSYRKGVSIKDNAINHLNNEFIANIDVIDFFGTINKDMVQKCLIKNKIDIKLATAITEIVTFKGFLPQGAPSSPQISNAILFDFDNKISEACYVIGCVYTRYADDITISGSNRNNVIKMVKSAMQWLNESGFSVNDKKTRISSKNSRQIVTGILVNDVIRPTRKYRKRVRAAFDHALKDNDHSKETIYKLSGHLNYLKSFQQYGYEVNTIQYELILKYLKRKNILIKI

SEQ ID NO: 6947 - protein, 496 aa, Escherichia coli
  source 1..496: note = Related to MOFU01000029.1
MLTKADSYDFNHELFLWALSVIQPASPLEVISYLSIVLKDNGLLLTKDKTSEYFKALANEGYINQVSRKNNLYSISLNGNEQLTPELKKLRDKLRIYLLDKTRVISKVKGLASTESKKMGGASPSLQLRFVLKEVPHPSVPXXRNTWVRIAEQINFGSMLGEASNADTPPQKVQHAIFPLNYGSYNSIDYNLIGNTGPTILASLIGVSPHLIAIMSMTPDKYYRSFKLNKKSGGYREILAPRKFMKVIQYWITDYFLFLLNTHASCYSYRKGVSIKDNAINHLNNDFIANIDIIDYFGTINKDMVQNCLIKNKIDIKLATAITDIVTYKGTLPQGAPSSPQISNAILFDFDNEISEACYLTGCVYTRYSDDITISGSIRKDVVKMVELATHLLNEFGFSINNKKTRIASTNSRQVVTGILVNDVIRPTRKYRKRVRSAFDHAIKDNDCSKETIYKLSGYLNYLKSFQQYGYEVNTIQYELILKYLRRKGIYNNHCI

SEQ ID NO: 6948 - protein, 498 aa, unidentified
  source 1..498: note = Related to AP021929.1; note = Klebsiella pneumoniae
MEVNTNFRLLLWGVSIIQPSSPDEVLGYLKAVLNDDGLLPEIEVMEDYFDKLKKIGYIEQVSKRNNLFSITPQGNEKLPPRLKKLRDKIRIFLLDKCYIQSKLERLASTETEKMSGDSPFLTLRHILKEVPHPSLPWATGTLPSRPRQAWVRIYEQLKIGSTFGDEASTSITDTSPSEVKKNILSLNFYSFNNLEHNYFNNNGVTIISSCIGVSPGLLTSMIKSPEKYYRPFELTKKNGKKREILAPRKFIKVTQYWIADHLLNRLKIHSSCFSYRKGVGIKDNAYNHVGMKFVANIDITDYFGTINKTMIKKCLLDNKIPISIVEVISGLITYYGYLPQGAPTSPIISNAILHDFDESMCESALHFDCVYTRYSDDITVSGNSREKVFLLTRVAAKLLERRGFSINEEKTRILSTNNRQVVTGILVNESLRPTRKYRRNVRAAFDQAIKTMDTSDDTLNSLKGHLNYLNSFKQYGFKFDHEKYQLIINELIKNKDIN

SEQ ID NO: 6949 - protein, 486 aa, unidentified
  source 1..486: note = Related to NZ_JADTXJ010000009.1; note = Serratia ureilytica
MLLWANSIIQPASPFEISQYLKIILADDGALPDLEYLKQYFKELQKNGYVEVVSIKNELYSLTPAGEDKLSANLKKLRDKLRIFLLDKCRESSKLETLASTETKNMGGEPPSLQLRPYIKEVPHPSLSWASGTLPSRPRQAWVRIFEQLRIGSMSSSQASAFSKNTGLFTPEKKYVAAPLFYSFKSLNNPLFDNNGVLTIASCLGLTPRLISSMIKSPERYYRFFEMKKNNGGVRKISAPRKFLKVTQYWINDYFLNRLKIHSSCFSYRKGVSIRDNAYPHQNSKFVANIDIENYFGSINKTMIKGCLLRNNISEHLVNTIAGLTTLFGTLPQGAPTSPNISNAILHDFDEIMTGHAIVRRCVYTRYSDDITISGNEKHLVEELVGLAGNKINAIGFALNNSKYRLLSYNNRQTVTGILINGHLRPTRKYRRKVRAIFDQALKSNDRNPLTLSTLMGHLNYLQSFKKYGFRFEEEKYLFIIHKLKN

SEQ ID NO: 6950 - protein, 494 aa, Enterobacter sp.
  source 1..494: note = Related to NZ_CP045769.1; note = Enterobacter cancerogenus
MSNSINFRLLLWANSIIQPASPLETLNYLKLLLADGETLPDIESIRLYFRELQKIGYLEVVSIKNELYSVTPAGEDKLTANLKKLRDKLRIFLLDKCHESTKLETLASTDTKNMGGESPSLQLRPYIKEVPHPSLSWASGTLPSRPRQAWVRIFEQLRIGSMSSSKASSFSNSIEFLNTEKKHIAAPLFYSYKSLNNPLFENNGILTIASCLGLTPRLISSMIKNPEKYYRFYEMNKKNGGVRKISAPRKFLKVTQYWINDYFLNRLKIHSSCFSYRKGVSIHDNAYPHQDSKFIANIDIENYFDSINKTMIKNCLLRCNISENLVNAISGLTTLYGTLPQGAPTSPSISNAILHDFDEAMTNQALVRNCVYTRYSDDITISGNKRYLVEELVGLARNKINNLGFTLNNSKYRLLSYNNRQAVTGILVNGPLRPTRAYRRKVRAIFDQALKSNDRNPLTLSTLKGHFNYLKSFKKFGFSFEEDKYLSILDKLSK

SEQ ID NO: 6951 - protein, 495 aa, Enterobacter sp.
  source 1..495: note = Related to NZ_CP087390.1
MSNSINFRLLLWATSIIQPAAPSEILYYLRLILTDDGALPNIDSLKQHLKELHKIGYVELVSIKNELYSITPSGDEKLSANLKKLRDKLRIFLLDKCHKSTKLGVLASTDTKNMDGAPPSLQLRPYIKEVPHPSLSWASGTLPSRPRQAWVRIFEQLRIGSMSSSQASILSKDSDSLIPEKKIIAAPIFYSYKSLNSPLFENNGILTVASCIGLTPRLISSMIKNPDRYYRIFDMRKKSGGVRKISAPRKFMKVTQYWINDYFLNRLNIHSSCFSYRKGISIHDNAYPHQNNKFIANIDIENYFGSINKTMIKNCLLRNNISEHIVNTIAGLTTLYGTLPQGAPTSPNISNAILFEFDELMTNQALVRDCVYTRYSDDITISGDNRHLIEELVSLAKNKINSMGFTLNNAKYRLLSYNNRQAVTGILINGPLRPPRAYRRRVRAIFDQAIKSNDQTSLTINALKGHLNYLQSFKKYGFSFEETKYSLIIEKLTKK

SEQ ID NO: 6952 - protein, 497 aa, Escherichia coli
  source 1..497: note = Related to NZ_NRWV01000070.1
MSNSINFRLLLWATSIIQPATSAEILYYLKLVLADDGALPDVESLKQHLKELKKHGYVEIVSVKKELYSLTPAGDEKLSANLRQLRDKLRIFLLDKCYKSTKFGLLASTDTKNTGGESPSLQLRPYIKEVPHPSLPWASGTLPSRPRQAWVRIFEQLRIGSMSSSQASTLSEDSNNHNFGDSFVAAPTFYSYKSLNHPAFENNGVLTIASCIGLTPRLISSMIKNPERYYRVFEIPKKSGGARKISAPRKFMKVTQYWINDYLLNRLKIHSSCFSYRKGTSIHDNAYQHRNNDFIANIDIENYFGSINKTMIKNCLLRNNLSEHIVNTIAGLTTLYGTLPQGAPTSPNISNAILYDFDETMANQAKARGCVYTRYSDDITISGNDRYSVEELVGIAKNKIFSLGFKINESKYRLLSYNNRQLVTGILINGPLRPPRLYRKKVRAIFDQALKSNDCRTSTLNTLKGHLNYLLSFKVYGFEFDEEKYQLIIDKLTKEVH

SEQ ID NO: 6953 - protein, 495 aa, unidentified
  source 1..495: note = Related to JACVBT010000006.1; note = Pantoea sp.
MTISINFRLLLWATSIIQPANANEILSYLKLVLKDDDALPDEASIKKYLKELREIGYLELTSVKGELYSITPIGDEKLTANLRQLRDKLRIFMLDKCYKYSKLMLLASTDTKNMGGDSPSLQLRHDLKEVPHPGLSWASGTLPSRPRQAWVRIFEQLQIGSMSSSQASNLKDDSQNPPSSFSFTPAPTFYSYKSLNNPLFEENGVLTIASCLGLTPRLISSMIKNQEKYYREFDLSKKSGGIRKISAPRKFMKVTQYWLNDYLLNRLKVHSACFSYRKGVSIHDNALQHVDKKFVANIDIENYFGSINKTMIKSCLLRNNFSEHLVNTIAGLTTLYGTLPQGAPTSPNISNAILYEFDQTMANQAMVRKCVYTRYSDDITISGDSKSAVKELINLARLKISSLGFNLNDHKFRLLSYNNRQLVTGVLINGALRPPRKYRRKVRAIFDKALKTNDTSLLTINTLKGHFNYLSTFKEYGFKFEEEKYLSIINYLQKK

SEQ ID NO: 6954 - protein, 477 aa, Aeromonas sp.
  source 1..477: note = Related to NZ_CP038513.1
MANLVNLKTYLWALATIQPASPQEAHAFLKIVTNIEPDIYTEEDLNDAINRSMKLELIECVSKKHNIYTLTIKGGDFLGKKLRLLRDKNRLFLLKTVKDASLKIKDSPEQNKASVSSATMFRSTVKVAPWPENSLVSGPLPQNQRVFWPRVSEQLRIGSNAGGSFLNLNYYSKNKLPNINDDFSAVDLFSELIGISPRLLSSFIKAPSRHYRTFTLQKKSGRGHRTINSPRVFIKTVQYWICDYFLYKLNQHELCFSFRKNLSIKDNARIHLGSRYILCLDIDSFFDNIKTEHVHSCLIENGFSEDISSFISRVVTLDGCLPQGAPTSPIISNSYLYNFDKVISDFCGQNGMTYSRYADDLTIGSTDYTQLKSCIPLISKQLAKFELKINERKTRIISNNNAQIVTGVCINNERLRPSRKFKKEVRAAFNNAKLNNDKSSLPRLYGYLNYLSSFDNGDTPHNISEYKSIIDSIKKAL

SEQ ID NO: 6955 - protein, 477 aa, Aeromonas sp.
  source 1..477: note = Related to NZ_CP033604.1; note = Aeromonas veronii
MASLVNLKTYLWSLATIQPASPEEAHAFLKLVTKVESDIYTCEDLNEAILRAIKLNLIECVSKKHNLYSLTVKGGDFLGKTLRLLRDKNRLFLLKSVRDANLKIKESPEQNMVSASSTITFRSTLKVAPWPENSLVSGPLPQNQRVFWPRVSEQLKIGSNSGDSFLKLNYYSKNRLPEINENFSPVDLLSELIGISPRLLSSFIKAPSNHYRTFTIEKKSGRGHRKISSPRVFIKTVQYWIYDYFLYKLNQHECCFSFRKNLSIKDNAKVHLGKKYILCLDIDSFFDNIKTADVNSCLIRNGIPSDISSIISGIVTLNGSLPQGAPTSPIISNAYLYEFDQKMYEFCVRNGMTYSRYADDLTIGSTDYTQLKSCIIFISEQLTKLELTINERKTRIISNNNAQVITGVCINNEQLRPSRKFRKEVRAAFHNAKLNNDKGSLPRLYGYLNYLSSFDSGDTPHNISEYKSIIDRIKKAL

SEQ ID NO: 6956 - protein, 483 aa, Vibrio sp.
  source 1..483: note = Related to NZ_AP019654.1; note = Vibrio panuliri
MANLVNLKTYLWALGTIQPASANEAHQFIKLMTNVTSDVYSESDLDDAIKRSLSLGYIENVSKKNELYILTAKGGEFLGKNLRLLRDKNRLFLLKSIRSATFQSKDSPEQDVAGVSPPKVFRSSLKAAPWPENSLSPGALPQTQRVFWPRVSEQLQIGSISGESLPSIKLNFYSKNKLSDINDNTTAIDALSESIGISPRLLSSFIKAPSSHYRTFSLQKKSSSGTRIINSPRAFIKTVQYWLHDYFLFRLKLHDCCFSFRQKVSIKDNAKVHLNSNFILCLDIESFFDNITTENVYSCLVRNKIDENIASVIAGITTLDNSLPQGAPTSPIISNAYLYDFDQSMLELCAKNKMTYSRYADDLTFGSNDYMSLKDLIPTIAESLRSYRLRINKKKTRIISSNNSQVITGVSINNGVLRPSRKLRKEIRVAFYQAKTNKNVDALPKLYGYINYLKSFEDGDTDYNLELYQGTIDELKGITKQSR

SEQ ID NO: 6957 - protein, 493 aa, unidentified
  source 1..493: note = Related to PIZK01000029.1; note = Alteromonadales bacterium alter-6D02
MLGENSMSSELNLKAFIWGLGVIQPATPEEVQNFILQVLLKQSNKEFDMQITAQKLLDEDYIRCVSKKNKLYSITHEGDEFLGNKLRALKDKERLYLLKSTRDVNFSGKGASERNSGGASPLKQASSSTKVSPRPEISLSPGPQPQIQRNLWPRVYLQLNIGSKPEAPLNSINLNFYSANSIPSKFDNLDHAILTTSELIGVSSYLLKDFCSNTQKYYRYFEIPKKSGKGVRVICAPRAFLKTVQYWILDYFLLRLKQHESCYSYRKNKSIKDNANAHINKKFILCMDIESFFDNISIKQVVQCFTENSISPHLAILFAKLVTLNGSLPQGAPTSPIISNSHLYEFDDYISKYCAENSLSYSRYADDLTIGSDDYDALKKMEKLITEELGSFGLIINKGKTRIISFNSCQIVTGVAINNGELRPTRKHRKEVRALFHRAEIERSVELLPKLYGHLNYLKSFRNGDSPKNIQKYQSIIDRLKLLRNIEGFGSET

SEQ ID NO: 6958 - protein, 483 aa, unidentified
  source 1..483: note = Related to MBSN01000054.1; note = Alteromonas macleodii
MSSELNLKTFIWALGVIQPATPNEVQNFITHMLLKQSNKEFDIETTVKKLINECLIRCVSKRNKLYSITHEGDEFLGNKLRALKDKERLYLLKSVRDVTFVGKGASERNTGGASPLKQARSSTKVSPRPEIPLPSGPLPQNQRNFWPRVYWQLNIGSKPEAPLTSTHLNFYSANSIPRKFDSMADAIIKISELVGVSSYLLKDFCNNTEKYYRDFEIPKKSGKGVRVICAPRAFLKTVQYWILDYFLIRLKEHESCYSYRKNKSIKDNASVHLNRKFILCMDIESFFDNISVKQVAKCFVENKIEPHLAALFANIVTFNGTLPQGAPTSPVISNSHLYEFDELISKYCVDNNLSYSRYADDLTIGSDDYDSLKKVETLISEKLSSYTLKLNKKKTRIVSSNSCQIVTGVAINNGELRPSRKHRKAVRALFHKAEVEKSVELLPKLYGHLNYLKSFNNGDTPKNIQKYQSIIDKLNNHKNIGSF

SEQ ID NO: 6959 - protein, 484 aa, unidentified
  source 1..484: note = Related to NZ_LSNE01000017.1; note = Paraglaciecola hydrolytica
MIDVMNSKVFVWALGVIQPAKPEEVLDYLLKVFASEKQKDFKVEIGPTLSIVLEQGLVHCVSKKNNLYSVKHAGDDFLGNKLRVLKDKERLYLLKSMRDVNFLSKGASERNMGGVSPPGRLRSSTKVSPRPEVPLSLGPLPQNQRNFWPRVYQQLGIGSKTEAPLQPINLNFYSVNTLPEIKSRSEAIFAASELIGVSSYLLRDFCNSKEKYYRKFEIAKKSSNESRVINAPRVFIKTTQYWIQDYFFYRLRQHDSCFSYRKKVSIKNNASVHLNKKFILCLDIESFFDNITKMQVISCIAKSKVNVHLAELFADIVTLNGCLPQGAPTSPIISNSHLYEFDEKIFEYCSSAGMSYSRYADDLTIGANKYDSLKTLEKVVKTELETLGLSINRKKTRIISSNSCQVITGLAINNGEIRPTRKYRKEIRALFYKADDAIDIELLPKLCGHLNYIKSFKNGDTKKNIEKYQLIIDKLKKSKNIQTF

SEQ ID NO: 6960 - protein, 479 aa, Vibrio parahaemolyticus
  source 1..479: note = Related to NZ_MISS01000101.1
MESTINLKAYLWALGVIQPANPEEVHDFLKFMNNNTNDIYSSSDIDDAVAFSLEHKLIEIVSKKNNLFVLSLNGSEFLGKKLKLLRDKNRLLLLKSLRNDSLDREESPEQKMDGVPPSSMFRLSLKDAPRPEESLSSGPLPQSQRFFWPRVSEQLQIGSNSGDSSTRIRLNYYSRNKIPANTEQSAYECLAELIGVSPRLLSSMAKSPKKHYRTFTMAKKSGGTRLISAPRAFIKTIQYWITDYFLYRLKTHERCFSYKKGLSIKDNARLHLNKKYILCLDIESFFDNINQKDVINLLINSGIENKLSIAMSFLLTLNNTLPQGAPSSPLISNAHLFDFDKKITEIANNSNVTYTRYADDLTFSCDQKSTLEKIKVIVNEKLNEIGLNIKNDKTRILSEHNSQIITGIAVNNNNLRPSRKFRKKVRVLFYQAKINNDVSQIPTLRGYLTYLKSFENGDTPENYKSYEGTINYLQKIQKA

SEQ ID NO: 6961 - protein, 487 aa, Vibrio sp.
  source 1..487: note = Related to VIVA01000006.1; note = Vibrio crassostreae
MMASPMNSAINIKAYLWALGVIQPATPEEIHNFLKFINRSEEEIYDADTISDTIKYSIDNGLIETVSKKNELYVLSLVGGEFLGKKLRLLRDKNRLLLLKSLRNDSFKKEGFPVQEMVGVSPSETQRLSLKAAPRPEESLSPGPLPQNQRFFWPRVSEQLKIGSTSGNPSPSIRLNYYSRNKISNNSNVTTIDSLAELIGISPRLLSSIVKSPEQHYRAFSMQKKSGGLRSINAPRAFLKTIQYWINDYFLYRLKIHSNCISYRKKVSIRDNAAIHLNKDYVLCMDIDSFFDNIKTNGVYTLLVNSGIDESLSRTISFLTTLNNKLPQGAPSSPLISNAYLYDFDSKIHDLCSKMGICYSRYSDDLTFSGDNKEKLEALVPEIIEQLDCFNLKIKKSKTRIRSRNSNQMITGISINNGILRPSRKFRKKIRAAFFKARSNNNIGAISTLTGYLNYLKSFEAGDTEYNISEYQKTIEHLKALKNSIKT

SEQ ID NO: 6962 - protein, 482 aa, Vibrio parahaemolyticus
  source 1..482: note = Related to JACBTA010000009.1
MENIINVKAYLWALGVVQPASPTEVHDFLKYINRSEKEIYDESSIKEVIEYALNNHFIEKVSKKNNLFILSSYGAEFLGKRLRLLRDKNRLLLLKALRNDILKKEGLFEQNLDGDSPSPMFRSTSKVAPRPEESLSPGPLPQNQRFFWPRVSEQLKIGSFSEGPSNFHPINLNYYSKNKLDSASNLSPVNVLSELIGISPRLISSMVKSQDKHYRTFSMPKKSGGYRKINSPRAFLKTVQYWIGDYFLYRLVNHENCFSYKKGVSVKDNASVHLGKKYILCMDIDSYFDCINVHSVFKLFVRSGIDEGLSDLMSKLVTLNGTLPQGSPVSPLISNSYLYDFDVFISDFCSSYNITYSRYSDDLTFGGDDKSDLEAIIGIVKKSLSEFNLNIKDNKTRLLSENNTQIVTGVAINNGVLRPSRRFRKTVRAIFHNALVTESVGSILMLSGYLHYLKSFESGETPHNIKAYEDIIEKLKSKYVSV

SEQ ID NO: 6963 - protein, 483 aa, Aeromonas sp.
  source 1..483: note = Related to CP038441.1; note = Aeromonas media
MDENFNPRPFLWAIGMAQPTTLDYAHAFLKKVTQSESDLLTIEEINNFSKFALDAGLIEVVSKKNKLYSLTNEGGVFIGKGLRLLRDKNRLLLLKSFRRAKLTQESSPTGNLAGAAPVVRNSSALKAAPRPEVSLASGPLPQNQRNFWPRVSEQFNIGLIVGELSPSINLNFYSRNSFPEVSDSISAIDALSLCIGVSPRLIGSMCHAQSNHYRTFTLMKKSGGTRTINSPRAFLKTVQYWIKDYLIYKLPVHDACFSYRKGLSVKNNACVHLNKKYILCVDIDNYFGSIKTEFIHAMLHKFDFSMELSEVLSQLMTLDGSLPQGAPTSPDISNSFLYDFDVTVSDWCSAHNVSYSRYSDDLTFGLDSIDIIGDLKDFVINSLLRLGLRLKEEKTRVMSCNNRQMITGVVINNGTPRPSRKFRKMVRAAFFNAQDLGDVSSIKKLRGYLNYLSSFEGGDTSENIAKYSKIISSLEEIKIKMTN

SEQ ID NO: 6964 - protein, 486 aa, unidentified
  source 1..486: note = Related to JAJSLX010000004.1; note = Marinibactrum sp.
MALTINKDIIVWGLSVIQPASISELRGFLCAVTQDENVVPDGDYLAVTVKELILIHNVLKVATKPARYSVTHKGGIRLTKKLRYLRDRMRLFLLKDSAYGRFHLSSDVLDQNLDDASSSSSIGLKYQDAQRSNSFLAADQKAIWPLVSEQFQIGSTSASDDKNTPTYADLDCYSFDSAYFEGSLKNTSDLSEAIGVSIRLITSICKKKEKHYRSFEIPKKRGGTRPIDSPRTFLKVIQKWINDYFIYDLKQSNYCYSYKKGVSIKSHAQCHEKQNYVACVDIEDFYGSLTKDHIYNLLLKNNKAHSIAKVVSDLCTFNNKLPQGAPTSPILSNAFLYDLDNYLVSECEGLNVTYSRFADDITISSDSKENLIRLISMIKNCLRSLGLSLKDSKTRILHKSQKQLVTGLVVNEIAKPARTYRRRIRAIFHKAKLYPDSFKGKEKVLQGYLSYLSSYNCLSSDTQSDYKQTILNIKNLTSSSNRDKNS

SEQ ID NO: 6965 - protein, 475 aa, unidentified
  source 1..475: note = Related to NSDJ01000001.1; note = Rahnella variigena
MTVSIRRDILTWAVAVIQPATISDIYNFLTTVLKDKDAIPSRDAIMIEVLALIELNDIARVSQKPTRYSITAKGNNRLNKRLRHLRDRMRLFLLKNAYRGSLKKPSAIFDEETNDVSSFIRKAVEIKDAQRPNSSLVADQTAVWSLVSEQFSIGPNEVADGVLLIPTFYSFDANYFDGELRSIVDLSEAIGISIRLITSIVKNKQKHYRTFTVIKKSGGERVIDAPRTFLKVIQRWLSDFLLDKLPVHDFCFSYKKGQSIRNNAQIHVGKKFVLNIDIKDFFGSITKKMICITLIESGFEHKLAKIVSELCTYNDRLPQGAPSSPILSNSILYKMDCFLTEQGALFDYNYSRYADDITISSNDRLTMELGRETIFRCLNESGFDINGGKTRVAATNSRQIVTGLVVNKRVQPTRVYRRKVRAMFDYAKKNPDSFTDKYSMLTGCFYYLMSFGCIGHSKINEYKNTLSLLREISKR

SEQ ID NO: 6966 - protein, 498 aa, unidentified
  source 1..498: note = Related to QBMB01000082.1; note = Burkholderiales bacterium
MSVFINTRLIRLGLGCIQPASAEDVSKFLAQTLGTEGAPIPPESIQSIFDDWASQQDVVCVHQRQHLYSLTRKGDNALDLRERRLRDKTRLFLIKELRAATLKRPEAEEPEKADDSSAVAIDSATQGERPKGAAANPRAAPGVGRAFWPLLSKQLFVGSSPQASGLRFRFFSFPSILDCCKAAGGTSIPEDGVGVNEISLALGISPSLLKSFLARPEHHYRVFEIPKANGKMRQINAPRTMLKVLQYFFVDYLLDRLAVHPAATAYWRGSSVRKNAERHARQRYVANIDVTNFFPSLSTGFVIRSLCAAGLKPDTAALVARLSSYKGGLPQGAPTSAALSNIVMYGFDKKLSEACASLGVNYTRYADDMTFSGLELGAIQQSIKLANESLAEIRLKINDEKTRIYGPSTRQVVTGVVVNDWPQPSRVERRRLRAELHHAKLSPATFVAKYQQLQGRAAYVLSYAGEERPVGALSRGYVEEALFDVRRLHRLMSQTGGA

SEQ ID NO: 6967 - protein, 495 aa, unidentified
  source 1..495: note = Related to NZ_SCML01000017.1; note = Hydrogenophaga sp.
MSVNVNTRLIRLGLGCIQPASADDVSKFLALSLEVEEEPISPEAIQIILDEWSSQKDVVCVHLRQRLYSLTRQGDGRLTPKERHLRDKTRLFLLKELRAATLRRPEAEEPEKADVSSAVFIDSATQEERPKGAAANPRVAPGAGRAFWPLLAKQLFVGSSPSASGLRFRFCSFPTISDCCKAAGDDSIPADGIGINEISLGLGISPGLLTSFLARPERYYRVFEIPKANGKSRQIQAPRTMIKVLQYFFLDYLLNWLEAHPTATAYSRGSSIRKNAQVHTEKKYVANIDVSNFFPSLTIGIVAKSLVAAGLSSNTAVLVARLSSYKGGLPQGAPTSAALSNIVMREFDASVSESCNSLGVSYTRYADDMTFSGMELDGVKQAICFAKERLTEMRLTLNDQKTRIFGPGTRQVVTGVVVNDWPQPSRVDRRRLRAELHQAKISPANSVAKYQQLLGRAAYMLSYAREERPVGAISRAYVEDALAGVKMLRHFTHNE

SEQ ID NO: 6968 - protein, 516 aa, unidentified
  source 1..516: note = Related to JAFLDL010000015.1; note = Candidatus Accumulibacter sp.
MSVGVNQSFVRLALGCIQPASAEQIAAFISSSLPTGAHPLHAEKIREVLDGWASSGDILCVHKRYLLYSLTRQGDGKLSAPERKVRDRTRMFLLKDLRSASLRASEVWGIEQADDSSAVSHGMAVQEDERPIGAAVSPRRRDGRAYWPLLSKQLLVGSSSPSSDTRFRFLSFSSVRSCSQACGYADIPEGGIGLNEISLALGVSPRIVGLLLRRPESHYRVFQIPKAGGGLREIHAPRTFMKVTQHFILDYLLRRLKVHPAATAYSIGCSIRHNAEIHVRRRYVANIDVTNFFGSLSTSVVYDRLIAVGLMKNTAAFIARISSFMGGLPQGAPTSAALSNICLYAADDVLQAESTVRQVTYSRYADDITFSGDDLGAVQACMAIARRELSALGLTLNTDKTRVFGPSSRQVVTGVVVNEHAQPARKERRRLRAMLHHAGTAPDEFVAQFDILQGKSSYMLSYSTPERGIGALPEKYVEDALAAVRAARKKGLPAADESSLSSAPFDNENRGRDAIS

SEQ ID NO: 6969 - protein, 490 aa, unidentified
  source 1..490: note = Related to PBZA01000066.1; note = Sutterellaceae bacterium
MTVRVYPQLIRLALATIQPASAETVVRFVQSALDSQEQLLDLSEVQKLIENWEELADVVCVHKRYQLYSLTKRGANKLSKTERQLRDKTRLFLLKELCVSKLKSPEVQETEKADASSAVVIEPVLQEDKRPISPAVPPRPARSSGRGYWPLLSKQLFVGSSTLTSGPRLRFLSFQSEKSCVLACGTKDSSEFGIGVNEIALSLGISPGLLTSMQHKPEKHYRTFEIPKSNGKPRLITAPRTMMKVVQYFFLDYVLRSLPVHTSATAYQRGCSIRQNALQHLRQRYVANIDVSDFFPSLTTAVVTQKLVEGGLKINTALLVAKLCSYDDGLPQGAPTSAAISNIVLFDFDTAMSEYAGLHGLTYTRYADDISISGSEKSEIEKAISVAQKLLSGIGLKLNDSKTRIFGPSSRKVVTGVVVNEWAQPSRKQRRNLRAALHQASLHPERYVDKYHQLQGKAAYMLSFATPEHSVGGLSSEFVHNAIAEIKKRI

SEQ ID NO: 6970 - protein, 506 aa, Pseudomonas sp.
  source 1..506: note = Related to NZ_AJXE01000028.1; note = Pseudomonas stutzeri
MAIMINSRIVRLALGCIQPADANAVIAFLMKAFKYDTNLISESAIQEIFDQWSTDGEVACVHKKSKLYSLTRLGDSRLNREERRLRDRTRLFLLKELRSAKLHLPEAGEPEKADVSSAVIVDQPVQEDERPTGAARPPRVARRAARACWPLLAKQLFVGSSSRASGPFFRFLSFPTVKACAQANGLAEIPQDGIDISEISLAIGISPQLIGLLIHRPERHYRTFEIPKANGKVREIQSPRTMMKVVQYFLLDYLLYKLPVHVSATAYSRGCTVKANAAPHVGKKYVANIDVEDFFPSIKWQLVHKMLALGGLEDKTAYLIARMTSYQGGLPQGAPTSAHLSNVVLYPFDKEMSGFCESVDVNYTRYADDITFSGSDKNVVWSAVERARQLLTDLGLEINKEKTRVFGPSSRQVVTGVVVNKWAQPSREKRRKLRAELHQAKMNPEKYAARADEIRGMSAYMLSFASEERAVGGLSRGYVESSLAKLTEYINEMKAKESAIAPPSAP

SEQ ID NO: 6971 - protein, 506 aa, Pseudomonas sp.
  source 1..506: note = Related to JAAQXA010000034.1
MAININQRIVRLALGCIQPADAGAVIKFLSKAFNYNTGYFPEGSIQDIFDEWASDGDIINVHKRTKLYSLTRQGDSRLNREERRLRDRTRLFLLKEMRSAKLHLPEAGEPEKADVSSAVIVDPPLQEDERPTGAARPPRVARRAGRACWPPLGKQLFVGSSSRASGPYFRFLSFPTIKACAQANGLDEIPKDGIDIGEISLAMGISPQLIGLLIHKPERHYRTFEIPKANGKVRAIQSPRTMMKMVQYFILDYLLYKLPVHISATAYSRGCTVRANAEVHVRKKYVANIDVENFFPSIKWQLVQKVLVMGGLEDKTAYLISRLTSYQGGLPQGAPTSAHLSNVVLYPFDNEISNFCESVGVSYTRYADDITFSGDDKDSVRSAVEKSTKLLSLLKLEINKDKTRIFGPSSRQVVTGVVVNEWAQPSREKRRKLRAELYQAKLNPGKYASRADELQGMSAYMLSFAGENRPVGGLSQGYVESSLARLTAYINAMKEQESSTVPPSAP

SEQ ID NO: 6972 - protein, 495 aa, Pseudomonas sp.
  source 1..495: note = Related to NZ_WTFT01000007.1; note = Pseudomonas izuensis
MAIIVNVQLVRLALGCIQPADANSVSKFLGASLIGDDNLLSPSVIQTVFDGWIADGDVVSVHKKSQLYSLTRQGDKKLNPKERKVRDRTRLFLLKNLRAAKLHLPEAGESEKADVSSAVIVDQPLQEDERPTGAVCPPRVARRADRACWPLLAKQLFVGSSSRASGPFFRFLSFPTIKACAQANGLDSIPSDGIGLNEISLALGISPQLIGLLIHKPERHYRTFQIPKSNGGTRNIQSPRTMMKVAQYFLLDYVLYRCPVHVSAMAYSRGCTVRNNAEVHVGRRFVANIDVENFFPSLSRKIVFRELIASGMETNMASLVSRLTSYNDGLPQGAPTSAALSNIALYRIDDEVFNYCQSIGVEYTRYADDITFSGESLEAVQGAIEKIKALLNSIGLVINKSKTRIFGPSSRKVVTGVVVNEWAQPTRKSRRKLRAELHQATLNPEKYAGQIDVMRGKAAYMLSYAGEGRPVGGLPRGYVESSLAKLAAYIKEHKG

SEQ ID NO: 6973 - protein, 334 aa, unidentified
  source 1..334: note = Verrucomicrobia bacterium; note = Related to VBQC01000296.1
MLPALYPFGTAQRWLEVAPAFFDETGVAQAQQLLEKGVIPVQLGPEIAIYLGVSPKLVSHMVIRPSRYYNTFEITKKNGSRRLITAPRVFLKTVQRYVLDCILSQVQPHDAAVGFRRGRNCGDGARRHVGRPYVWNIDLADFFPTITKQLVVGVFRDIGYPDAAALFLGGLCCLERRLPQGAPTSPALANLVAIPIDIELTAIAESAGMLYTRYADDMTFSSTTLISADFRARVTNAVESFGFSLRATKTRLMGPATRREVTGLTINQQVSIPRHRRRQLRAYFHHISRSPEQYAEQRQQALGYARWLYDYHREEGSNALRIVANIPIPPTNQF

SEQ ID NO: 6974 - protein, 333 aa, unidentified
  source 1..333: note = Deltaproteobacteria bacterium; note = Related to DNJA01000297.1
MSVHPFLYPLGTAERWISFLSSCLDLSKNDLSKAKVLLNKQLVPVIHGPELGIYLGVSPKLVSAMVIRTSRYYRGFKIKKPSGGNREIWAPRVFLKTVQRYVLDCMLAPIVPHEAATGFRRDIGIRDGAQRHVGRPFLWNIDLKDFFPSINQSQVTGLFSQLGFPHQASYFLSGLCCLRGKLPQGAPTSPAIANLILFPTDTEIGTLARRNRIIYTRYADDLTFSGTHPISDEFRREVGVLIESAGFRINKSKSRLMGPRCRREVTGLVVNRKVSIPRETRRKLRARFHRVSVHPERFTKQKGKLLGYASWVSQYRPKEGHRYRAIAEAIPSE

SEQ ID NO: 6975 - protein, 342 aa, unidentified
  source 1..342: note = Related to NC_016631.1; note = Granulicella mallensis
MITPLVSFTSFAQFEQALRDSRVSAHSGASFSNSLEVDRLVKSARELYGRGLPPIVSSRTFSLLFGVSPRLISAMTKSPEKYWRTFEIKKRSGKGRNIAAPRVFLKTVQRFLLRFVLEKIPIHPNAFGFAPGKGIFKHAERHLKARFVLTLDIADFFPSISWTQVRDIFANIGFPDGVPSLLADLCTRNKVFPQGAPTSPYLSNLIFLKTDEALTEAANQFEMRYSRYADDLTFSCDSQPSDEARLAFEQIIRDAGFRIQHSKTRLRGPSQAREVTGLLVNEKIQPSRHTRRLLRAKFHNLLRSTSLEQETLPSLGGWASYVNSYDVVKGEEYLSIVRSKAR

SEQ ID NO: 6976 - protein, 332 aa, unidentified
  source 1..332: note = Related to CP011392.1; note = Dehalogenimonas sp.
MNSLPLLVSLEHTPDVIAALNSEFNMTEIETRRAISLLDKGLPPLFRPEVIAYLFGVSHRLVSNMSRFSDNYYRCYKIPKKSGGFRNIETPRIVLKVIQRWINTSILSKIVVPEYITGFAEGRNIFVNGHIHIGTRNMLVIDIADFFPSVFGRKVMYIFRNLGFPVQVARLLTGLCLYQKRLPQGAPTSPALANHAFHSVDVTLEELASEWGCNYSRYADDIAFSGERFFEDSDLHKIEDILEQHKFRINHNKSHISGSGSRKMLAGLVISEKCIPPRKKRKIWRAIFHNAANNPAILRDKLPYLRGVACFVKQYDEELYQKYRIIIDSVAP

SEQ ID NO: 6977 - protein, 337 aa, unidentified
  source 1..337: note = Related to JACPQM010000002.1; note = Chloroflexi bacterium
MNPLPLLVSLPREPESIDVLAGELDLTPDERSLAVSLYSRGLPPLVHRKCLPYMFGVSPRLIAAMQKRAEHYYRRFTINKQGGGTRAIVAPRRFLKLIQTWINGHICSKERMPECVMGFVRGRSIFDNGRAHCKNKNVMVVDVKDFFPSVTLQQVEAVFASFGFPEEICRQLGGLCTLDGGLPQGAPTSPALANLVFLSVDERLSRQAAEWNCTYTRYADDIVFSGARHFISEDVACLREILRQGGFTINDRKTRIVGQGGRQTVTGLVVNGKALPPRSKRRRWRAMFHRAANHPHEFFDRARSLAGIAAFVNQYSSERATEYGRIAQEVREKSQHR

SEQ ID NO: 6978 - protein, 319 aa, unidentified
  source 1..319: note = Related to JAGQPF010000708.1; note = Planctomycetales bacterium
MQYLASELKWYDNSLESALALYRRGLPPLVTLPTLAFLFGVSPSLVASIVAAPEAHYRHFTIPKATGEPRSISTPRVVLKTIQRWIHDWILPHANLHRDAHAFRKSRSIFSNAQSHVGQVNLLAVDLADFFGSVRFEQVAAIYEDLGFPWVVAAQLASLSTLGGSLPQGAPTSPALANAVFHDIDVMLAEFANGRTASYSRYADDLAFSSTYHRFSVSDVDAVSGIVGVGGFRLNPRKTQIVGGGYRHQVAGLSVASHPQPPRWKRRRWRAMFHQASVDPSSFQNEAAKLAGVASFVNQYRPDLAESYMEIAIRASRTP

SEQ ID NO: 6979 - protein, 433 aa, unidentified
  source 1..433: note = Related to QFWV02000004.1; note = Oceaniradius stylonematis
MPPKRLFDLGHALKAVFTSKTGSCCRCQLAPTTSLKILPTLKRYFARNKEACPKRKLQFSVNGGCRPYRPPVHCRCXLGISPKTIFSIRHRPQKHYRSFPLKKKDGSKRDIDTPRTYLKVIQWWILDNILNQVEFAEYVFGFVAGRSAVQNAEYHLGAKHVLNTDIRQFFPSITIDQVQAIFRSFGYQDDVTNMLSELCCLDGHVPQGAPTSPAIANLVLQELDMELSVLAERAGHRYSRYADDLTFSSQSWIERDFLNLVESAVQVAGFELKPEKTRFSGSEGRMEVTGVVINEKPQPTRLWRKRARATLHKLSLLPRLTRRELSYLQGVVGMAGQFPKSAQMQQLSESARLVIEKKSATIIGVGTKPTLPNGLTFRQAEALASLAPRRTNIEIALRLGASVAAVKKRLQEAYKKIGVNDRQEAMIWATRNL

SEQ ID NO: 6980 - protein, 407 aa, unidentified
  source 1..407: note = Related to JAGRMS010000295.1; note = Pseudooceanicola sp.
MPTRSYYFPKDFLHLEEILRAEPDGFPDEQATRFRDLGLPPIPTMGALPLFLGISPKTIFSIRHLPKKHYRSFLLKKKDGSKREIDTPRTYLKVIQWWILDNILSHAEIAANVFGFVAGRSAVQNAEYHLGAKHVLNVDIRQFFPSIKLDQVRTIFRSLGYQDDVANMLSELCCLDGHVPQGAPTSPAIANLVLRELDIELSNLADAAGHRYSRYADDLTFSSQSRIESEFLNLVESAVQVAGFELKPEKTRFSGFEGRMEVTGVVINEKPQPTRVWRKRARATLHRLSLSSRMTRRELSYLQGLIGMANQFPKSPQMQQLSESARLIMEQKSQTIIGRGTKPTLPNGLTYRQAEALAGLAPRRTNIEVAVRLGTTEAAVKKRLQEAYRKIGAADRQEALIWAVKNL

SEQ ID NO: 6981 - protein, 393 aa, unidentified
  source 1..393: note = Rhodobacteraceae bacterium R_SAG4; note = Related to JAAZTG010000053.1
MEKILQAEPGGFSEEEAEQFRELGLPPMPSVGALPLFLGISPKTIFSIRHSPKKHYRSFPLTKKDGTKRDIDTPRTYLKVIQWWILDNILNHVPIAENVFGFVAGRSAPQNAEYHFGAKHVLNVDIRQFFPSITIDQVQEIFSSLGYEENVAGMLSELCCLDGRVPQGAPTSPAIANLVLRKVDTDLSALSTQAGHRYSRYADDLTFSSQSWIDRNFLNSVQKIVEGAGFELKPEKTRFSGSEGRMEVTGVVINEKLQPTRVWRKRTRAKLHRLSLSVRLTRREISYLHGVIGIAGQFPKSTQMQQLSESARIVIEQKSQTVIGIGNRPTLPNRLTIKQAEALAALAPGRTNSEIALRLETTEVAIKKRLQEAFRKVGVFERNQAFKWAQTNL

SEQ ID NO: 6982 - protein, 407 aa, unidentified
  source 1..407: note = Related to NZ_QDFI01000072.1; note = Phycocomes zhengii
MPTRSYYFPKDFAHLEEILRAEPGNFPDDETARFRELGLPPIPTTGALPLFLGISPKTIFSIRRRPRKHYRSFPLKKKDGTKRDIDTPRTYLKVIQWWILDNILNHVEIAENVFGFVAGRSAVQNAKYHLGAKHVLNVDIRQFFPSITIDQVREIFVSLGYKEDVAEMLAELCCLDDRVPQGAPTSPAIANLVLRGLDEQLSRLADEAGHRYSRYADDLTFSSQQRIEPAFLDSVQQEVEQAGFELKPEKTRFSGFEGRMEVTGVVINDKMQPSRVWRKRTRAKLHRFSQATRLTRRELAYLQGILGMAAQFPESIQMLKLSKDAAGLIEAKSHTVVGRGESPVLPSGLTLRQAEVLAQLAPKRTNIEIAMRLGTTESAVKKRLQGAFRKIDVTERHTAERWASENL

SEQ ID NO: 6983 - protein, 393 aa, unidentified
  source 1..393: note = Related to NZ_JAEG01000002.1; note = Ciceribacter selenitireducens
MEQILWAEQDGFSEEQAMHFRNLGLPPIPTVGSLPLFLGISPKTIFSIRGKPRKHYRSFPIRKKDGTPRYIDTPRTYLKVIQWWILDNILNHVQIADNVFGFVSGRSAVQNAEFHLGAAHMLNIDIEQFFPSITIDQIRAIYGSLGYGAEVANLLAELCCLDDRVPQGAPTSPALANLVLRDLDKELSRLALQTGHKYSRYADDLTFSSSHRIETEFLDAVQTAVEQEGFNLKPGKTRFSGLGGRMEVTGVVINEKTQPSRVWRRRTRATLHKLGNSPRLTRKNVSYLLGIKGMAKQFQNSPQMQRFSLDVEQLLEAKSQTVIGKGTRPILPNRLTIRQAETLAALAPRRTNMEIAMRLETTEAAVKKRLQEAFKKIGVVDRTEALNWATHNL

SEQ ID NO: 6984 - protein, 407 aa, unidentified
  source 1..407: note = Related to JACFOS010000001.1; note = Bartonella sp.
MPTRSYYFPDDFQHLERILFEEYGNKYEDELSFYRKRRIPPITNTGIFPIFMGISPKIIFSILKRPEKYYRSFSIQKKDKTKRLIDTPRTYLKVIQWWILDNILNHIDVAPNVFGFVIGRNVFQNAEFHLGAKHILNVDIKQFFPSITNEQVKNIFSSAGYKEDVADMLTCLCCYKGRVPQGAPTSPALANLVLRQLDKSLSSIAEENNFKYSRYADDLTFSSLEQINVNFLNDVKEIIEREGFNLKPEKTRFVGSGGRMEITGIVINKKMQPDRIWRKKTRATLHQFKYKTRLTRRDISYLFGIKGVTKQFPDSPQMQLFLKEADNIIQEKSETIIGRSNNPILPHGLTLRQAQVLVELRPQIKNIEIAKRLNISEAAVKKRLQEAFKKIGVTNRRDAEIWAKSNL

SEQ ID NO: 6985 - protein, 407 aa, unidentified
  source 1..407: note = Related to PCOI01000001.1; note = Ochrobactrum sp.
MPTRSYFFPPDFSHLEEILRAEPEGLPDDLQNYFRGKSIPPIPSEAALPRFLGISPKTIFSIRRNKEKHYRVFGITKRDGTRREIQTPRTYLKVIQWWLLDNILDNAKVADNVFGFVAGRSAIKNAQYHYGANHILNVDIQHFFPSITQAQVVSVFEEIGYGKDVSRYLAELCCFRERVPQGAPTSPAIANLVLAALDKELTIIAENANCRYSRYADDLSFSSTELIDARFLNEITNAVAQAGFTLKKTKTRFAGKGERMEVTGVVINEVIQPTRDWRKKVRAKLHRLSAISRLVRADVNFLYGIRGMAAQFPESPQMTALASKAEELCRSRAHTVIGHGPNPLLPNGLTLSQAEVLANLRPRNTNYDIAIKLGSSEAVIKKRLQEAFRKIGSADRTQAERWAKENL

SEQ ID NO: 6986 - protein, 407 aa, unidentified
  source 1..407: note = Related to NZ_AYPY01000034.1; note = Rhodobacter capsulatus
MPTRSYYFPQDFKHLEEILRAEPDGLPDEVCEHFRARGLPPITSEGALPRFLGISPKTIYSIRLNSRKHYRKFDLKKRDGTVREIHSPRTYLKVIQWWLLDNLLNRVKLADNVFGFVSGRSAVQNAEYHKGSTHLLNVDIQQFFPSITQEQVEDIFGRLGYGPAVAKMLADLCCMNRRVPQGAPTSPALANLVLEDLDKALADLAARFGCRYSRYADDLTFSSHVRIDEALLVEVTATVQKAGFQLKEAKTRFAGCGDRMEVTGVVINDVLQPPRDWRKKTRATLHKMGSRGRLTRADIYYLYGIRGMAAQYEASQHMQALRVAAEGLMKAKSHTVIGFGAKPSLPNGLTLRQAEALAELGPRRTNSEIAAKLETTEAAIKKRLQEAYRKLGVADRAEAERWAKKNL

SEQ ID NO: 6987 - protein, 407 aa, unidentified
  source 1..407: note = Related to NZ_LPZR01000055.1; note = Tistrella mobilis
MPTRSYYFPKNFTHLEAILRAEPDGFPDEQAIRFRDLGLPPIPTAGTLPIFLGISPKIIFSIRRRPRRHYRSFSLIKKDGTERTIDTPRTYLKVIQWWILDNITSQVEISRNAFGFVRGRSAVQNAGHHLGAQHILNVDIRQFFPSVKIAQVFEIFMSIGYNEEVAEMLSELCCIDGHLPQGAPTSPSIANLILRDLDENLCNLADRSGCLYSRYADDLTFSSHSRINDNFLESVRKEVENSGFKLKSEKTRFSGRGDRMEVTGVVINEKLQPPRDWRKLTRAKLHKLDSSNRLTRRQLSYLQGVMGMAPQFPDSPQIQQLSEKARLIAEQKLHTIIGHGPRPILQNGLSLRESEALAALVPSKTNLEVAIQIGINEVVLEKRLERAYKKIGAENRQQAISWADQNL

SEQ ID NO: 6988 - protein, 407 aa, unidentified
  source 1..407: note = Related to JAAMCC010000006.1; note = Agrobacterium tumefaciens
MPTRSYYFPSDFRHLDEIIKLEVDGLSSADLDHFRNLNMPPLLRAGTIAIFLGISPKTIYSIRRNQSKHYRSFCMKKSDGSLRNIDTPRTYLKVVQWWILDNILNKVVFNSNIFGFVPGRSAIQNAQYHMGAQHLLNVDIQDFFPSISIERVRAIFSTLGFNEEVATVLSELCCLHDRLPQGAPTSPAIANLVLRDLDSDLSRIAEAEWYKYSRYADDLTFSSMTKIEDTFLDQVYEAVNRAGFALKPAKTRFSGRGGRMEVTGVVINEKLQPSRDWRKTTRSKLHRLRDAARLTRKEVAFLFGIKGMSVQFPDSPQMQSLAFEAENILKQKSHTVIGRGKQPVLPSGLTLRQAEVLIKLRPHKTNAELAYELGTTEAAVKKRLQEVFKKVSVTDRIEAKQWADENL

SEQ ID NO: 6989 - protein, 345 aa, unidentified
  source 1..345: note = Related to NZ_CP045420.1; note = Maribius sp.
MPTRSYYFPTEFSHVEQIIRAESTADRETSFAEFRHLNIAPIFSGYELANILGIGPGLLIGILRNPHQNYRQFPVVKKGGGTRQVSSPRTYLKVIQWWILDNILTHLETPDIVFGFKRGTSINWNARHHLGSRHFLNVDIASFFDSVTEVSVYDLFSRLGYADSVSSVLCQLCCLNGSLPQGAPTSPAIGNQILKPLDNSLCELSSEHGIKYSRYADDLTFSSRDFIAQDFLDAVRLRVAEIGFELKDEKTRWRGPGARTEVTGLVVTDFVQPPLKWRKQCRATLHHLGKKERLEQKDIRYLEGILGYASSFEDARQMQALKATTARLLEEHRFPFTEVDRKNTR

SEQ ID NO: 6990 - protein, 339 aa, unidentified
  source 1..339: note = Related to QKMF01000007.1; note = Pelagimonas varians
MPTRSYFFPPDFQHIEAILRSDDPMADELQFEKFRERGVAPLLTEFDIATVLGIGPKLIVSMLKKPNRHYRTFPLTKKDGSERQISAPRTYLKVAQWWILDNIVSRVPASENVFGFCRGRSIQDNARYHLGSTHILNVDIKSFFDSVTFSQVLLVFKELGYSQPAAKTLAGLCTLNGKLPQGAPTSPNIANMVLSKVDRELEALASSVGSKYSRYADDITFSADDYISEQFQVRVEDVVKSAGFELKASKTRYAGTGSRREVTGLICGTFVQPPIEWRKLNRARLHNLGKKPVLEKSDIAYLLGLRGYSMQFPDAVQMQALLAGADKLLLSTKKPVPET

SEQ ID NO: 6991 - protein, 334 aa, unidentified
  source 1..334: note = Related to VHLH01000001.1; note = Pararhizobium sp.
MPSRSFFLPPDQLANAAVLAEANPPERHDEIMRLASRGIAPLVDEVSLAELVGVTPSLIFSILIRKDKHYRSFCLPKANGSTRIINSPRTYLKVIHWFILDNILSKVKNNDCVTAFISGRGPYFNAQMHSGAHHIFQTDLEEFFPSIKVQNVYRMWLSIGYNQEVAEQLSNLVTYRGELPQGAPTSPAISNIVAGNLDKRLLKLAYEYGYKYTRYADDITFSSKERIPLEFADAVNEQIVLGGFIESRRKRRFKGFGAAMNVTGLNINDFPQPPREWRKRTRALFHRAKLDAAFAKENRGKIAGSLGVLHAAGLPSQHPLILNGKEALLNSKNY

SEQ ID NO: 6992 - protein, 344 aa, unidentified
  source 1..344: note = Related to VZUL01000002.1; note = Neorhizobium galegae
MPPRSYYNEPRPSDYVAFAKAFFPDELQAASEFAETRGLPYINSSAHIAAYLGVSASLLRQVIHKPAYHYREFPIKKASGADRIVSTPKTYLKVIQWWIADNILNKIQLSDSVHGFRRGKSYFTNASVHLNSKHILNVDVESFFDSITFAQITNVFNSLGYTEAGSLTLATLTSKNGIAPTGAPTSPMIANAILRSLDSHLEAFAAKSNLLYTRYADDLTFSSPEWIDQSVVDAVTKYVESQGFKLNAKKTKFMGPGDRMEVTGLVTNAGLNASKEWRNWARGFLHRVSREPAKHIGEIERVRGVYGVLRQLDPEKHKKLTVAAEQAMGHLADVKRALAGSKQS

SEQ ID NO: 6993 - protein, 341 aa, unidentified
  source 1..341: note = Related to JACHXX010000002.1; note = Rhizobium laguerreae
MPPRSYYNAPRPSDYVAFATAFFPEDSDNAGKFADQFGLPYLESTRHLAGYLGIAPSLIRQIIHRPAYHFREFKLTKSTGEERLISTPKTYLKVIQWWIADNILDKIDLSDNVHGFRKNRSYISNAIIHRDSRHILNVDVKSFFSNIKIDNIFNVFSALGYGDAGSLLLSTLTSKDGMAPTGAPTSPMIANAVFRDIDTQLSKFSQQMGLLYTRYADDLTFSSMEWIEHDVLEAVSQIVESGGFNLNSAKTKFMGPGDRKEVTGVTVNAGLNTSKEWRNSVRGYLHRAFSNPADYIADAAKVRGIYGILLQFDPTKAKRLTQTAEQTMLRLLKAQRDSASS

SEQ ID NO: 6994 - protein, 344 aa, unidentified
  source 1..344: note = Related to CP061772.1; note = Ochrobactrum sp.
MPPRSYYNSPRASDYIAFARAYFPDEQEQANSFVNTYNLPYISSSHHIAAYLGISSALVRQIMHNPNYHYRVFPIQKSSGDPRMISTPKTYLKVMQWWINDNILNKIQLSESVHGFRKGKSYITNARVHFGARHILNVDIKSFFDNITTPQIANVFSSIGYCESGSLTLAALTSKQGKAPTGAPTSPMIANAIFLKADEQLIEFARSKGLRYTRYADDLTFSSDHRIDEEVVGKVNAIVKSSGFQLNDKKTKFMGPGDRQEVTGIIINERMNLSKEWRNFARGYIHSILSNPSGNIQEMGRLLGIYGVLLQVDQNKESNLTKNAYKAIRILKDTEQTTTHAEPS

SEQ ID NO: 6995 - protein, 338 aa, unidentified
  source 1..338: note = Related to JABBGK010000003.1; note = Rhizobium sp.
MPPRSYYKEPRVSDYIAFADAYFPEERNLAAEFAERTRLPYVESSKHLAAYVGVSPSLLRQIMHKPSYHYREFPLHKADGSERKISTPKTYLKVVQWWVLDNILARQALDECVHGFRSGRSYVTNARVHQNSRHILNVDIKSFFDSIKMSQVANVFLSLGYSEAGSLTLTALTTKDGVAPTGAPTSPMIANLIFRDADLALAEFAEANGLIYSRYADDLTFSGQHRIPDEAVAKIAEIVNAAGFELNIKKTKFMGPGDRQDVTGVVVNSGLNAPREWRNWARGYLHRVRLNPDKSAEELGRVRGVYGILRQFDPERTKSLTRAAFETLEALKQYRTEP

SEQ ID NO: 6996 - protein, 335 aa, unidentified
  source 1..335: note = Related to WBWH01000007.1; note = Brucella intermedia
MPPRSYYVDSRISDYIAFASAYFPEEKALAVEFAERTGLPYIESSMHVAAYLGVSPSLIRQIMHKPSYHYREFTLKKTDGGERKISTPKTYLKVVQWWILDNILARQPLGECVHGFRSGRSYVTNAQTHEKSRHILNVDIKSFFDSIKISQVSNVFASLGYSESGSLALTALTTIDGIAPTGAPTSPMIANLIFRDADVSLVAFAQANGLIYTRYADDLTFSAQHRIAEEIVDQIAEIVDAAGFRLNTKKTKFMGPGDRKDVTGVVVNSRLNAPREWRNWARGYLHRIRLNPTENAGEVRRVRGIYGTLRQFDPEHATSLTRIALQTLNVLKQAR

SEQ ID NO: 6997 - protein, 364 aa, unidentified
  source 1..364: note = Related to VFUS01000001.1; note = Mesorhizobium sp.
MAALQPRAEFSSASYKARTKQSQDWCCRMPPRSYYNSPRIDDYLAFARASFPEESEAAGAFANRTGRPYLENEIHLASYLGISPSIIRQILHRPRFHYRTFILKKADGTNRIIRTPKTYLKVMQWWINDNILITKEMAEAVHGFRKGRSYITNAAAHAGAKHLLNLDISRFFPSITAQMIVGVFRNLGYSAAGSDFLARLTSLDDEAPTGAPTSPLIGNLILDNFDQTVSELSAARNITYTRYADDLTFSARTRIDNEFLKEVTAFVESSGFDLNPKKTRFLGKGDRMDVTGVVINEGLNLPVEWRNWARGYLQRAIRNPVEFVQHHPAIAGIFGVLKSIDPDEQRHLTQKAKSALTAIRSAGA

SEQ ID NO: 6998 - protein, 336 aa, unidentified
  source 1..336: note = Related to JAIUGX010000003.1; note = Mesorhizobium sp.
MPPRSYYNSPRVDDYLALARAFFAEDADAAAAFAEVERRPYIESETHLASYLGISPSIIRQILRHPKFHYRTFKLKKADGTNRIICTPRTYLKVIQWWISDNILYTEQPDVSVHGFCKGRSYITNASAHSGAKHLLNLDIRKFFPSITEEMIVGVFRTLGYSPAGASLLARLTSLNGEAPTGAPTSPAIGNLVLAEFDKAVSAAATANNILYTRYADDLTFSSQNRINEDFLATISTLVQSSGFELNLKKTRFLGRGARMDVTGLVINQGLNLPIEWRNWARGYLQRVVRNPAAFIDHRSTIAGILGVLKSIDPTEDRGLTQKAKSALRAIQEQAS

SEQ ID NO: 6999 - protein, 338 aa, unidentified
  source 1..338: note = Related to NZ_CP049037.1; note = Pseudohalocynthiibacter aestuariivivens
MPPRSYYIEPKQSDYLAIAKAFFPEELNDARDFVEQTGLPYLKTSAHVSSYLGVSPKLVRQILHKPSYHYRFFEIPKSDGSLRAITTPKTYLKVVQWWICDNILNQMPLHDCVHGFRSGRSYLTNAKAHFGQKHFLNVDIESFFPSIGADLVEATFLEMGYHSDGASVLRDLVTLGGAAPTGSPTSPMIGNLVLAKFDALLTEYVADRGFVYTRYADDITISSKHWIDDEVLGDISALVQKFGFRLNERKTKFMGPGDRQEVTGIVLNSSPNIPRNWCNSVRGYLHRVKLAPHKHVDEHAKVQGILGTLLAADPEAERKITKAAREAAHLVMLERLMQ

SEQ ID NO: 7000 - protein, 333 aa, unidentified
  source 1..333: note = Related to DQCL01000311.1; note = Octadecabacter sp.
MPPRSYYLEPQKTDYLAFAKAYLSDEYGIAKAFIDEKGLPYIRNADHLAAYLGVSPSLVRQILHKKEYHYRQFPLPKADGPPRLISTPKTYLKTIQWWIGDNILSHVALGDEVHGFRQGHSYVTNARVHLGCNHILNMDIEQFFPSITKPMTTSVFTSLGYGKEGAGVLAELCTLDGSTPTGAPTSPAIGNMVLVDFDRAMTKLAGENTLKYTRYADDLTFSSNEWISPEFALQVEEVLKGYGFAPKGTKTKFMGRSDRMEITGVTINEGTNPPREWRNWARGFLHRARMNPHQYAHEWKKIAGIYGTLKSMDPDEDKLLTKRAKQVLNLVRS

SEQ ID NO: 7001 - protein, 344 aa, unidentified
  source 1..344: note = Related to NZ_CP080493.1; note = Pseudochrobactrum sp.
MPPRSYYHSPRHSDYLAYFTAYFPNELQVCRAFLEATNYPYIGNIHHLAAYIGVSSALLKKIISNVNYHYSDFTIPKGGGKERVIYSPKTYLKVIQWWICDNIFSNLKFNESVYGFVKGRNYIDNAKKHFGRKYILNVDVKNFFDSISTEDVKKIFLKLGYPISSSEILSKLCTLDNRLPTGAPTSPVIANLYFKDIDNILELESIKNGWIYTRYADDLTFSANTKINFDFLETLKNVLDEYHLKLNDKKTKFMGPGSRQEITGIVVNSVIGMPKYWRNKTRGFLHNVRKDPSNNLDKIQEVKGLYGVLIYLDPEKNRSITKQAYEVLGILKSHKKPLHETKHK

SEQ ID NO: 7002 - protein, 338 aa, unidentified
  source 1..338: note = Related to NZ_QDKO01000009.1; note = Caulobacter sp.
MSPRTYDLITNPKYIDFISESVRSGCSLEDVKFPVPSVSLPALNKAEDISYYLGISPELIWTLIRSPRYKYNTFSVRKKSGGSRVISAPRTYMKVVQWWINDVILSKFPQRDNVFGFVPGVSYVDNAAYHHGAVTMMNVDIKNFFPSIKSEDVLVCFMKIGYSKQVALGLSALTTYAGFLPQGAPTSPNLSNIVFSEFDEKISNICKLYNLKYSRYADDMTFSSIGRVPKDFHRIISRELFPKFLLNDEKTQYMGAGDKKEVTGLVLGRDGPAISREKLNGLRGWLHQIIANPEQYVDDLDRLSGTLAMVRMVGGRGTGPILLQGGRAMQAIEQSLRI

SEQ ID NO: 7003 - protein, 598 aa, unidentified
  source 1..598: note = Related to NZ_UIGE01000001.1; note = Brevundimonas diminuta
MTFPADFRRVTTREALITAIGTDEATFEAILAFDPPRTREEQIEALQRAADAASIEDIPVFLRHDIPKRNRRRGHRTVWEPLLGKPGYRTLARRLETFFRIALPGYPHDAVYGYRPGRNIRENASAHAGRSALLNADLENFFPSITTDRVAALFTKLGLVPDVAELLARFVTIGGGLPLGLPTSPVISNAVALPLDLACAALASGANATYTRYADDLTFSGDDQLPAIDALRSVVEAQGFVLAEDKTRRSKIGQAHYVTGLSISDPAQPHVPRERKRRLRQELYYAGKFGIADHFRHRGVNDARVIQQEVNRVDGLVRFVAHHEPAMAPRLRTQWRKALQDEGMKPSFAPRGQHRAPFFIFVDEAEFDRGGQKVLAIGMAVSQHGPRMAIEAGQVLEAALADMYLDGDPAALRKRGLHFVDATEDLRIAYVRRLEGMRFEGYVAFADCDDPSRYEETYLRLLGAIIERRLKAAESQLASFYIEQNEKVSAHRVKGLIQDAFDRLKARDDRRPVDFAVQFVSKPHLGISAPDFLLAVLGRYLKSKAAKPGKPEPRDRLMFERLRDKYRLILDVTTWTEYSRRRPILPWSDQTPPSDDGA

SEQ ID NO: 7004 - protein, 594 aa, unidentified
  source 1..594: note = Related to NZ_CP066026.1; note = Brevundimonas diminuta
MTFPADFRRVTTREALITAIGTDEATFEAILAFDPPRTREEQIEALQRAADAASIEDIPVFLRHDIPKRNRRRGHRTVWEPLLGKPGYRTLARRLETFFRIALPGYPHDAVYGYRPGRNIRENASAHAGRSALLNADLENFFPSITTDRVAALFTKLGLVPDVAELLARFVTIGGGLPLGLPTSPVISNAVALPLDLACAALASGANATYTRYADDLTFSGDDQLPAIDALRSVVEAQGFVLAEDKTRRSKIGQAHYVTGLSISDPAQPHVPRERKRRLRQELYYAGKFGIADHFRHRGVNDARVIQQEVNRVDGLVRFVAHHEPAMAPRLRTQWRKALQDEGMKPSFAPRGQHRAPFFIFVDEAEFDRGGQKVLAIGMAVSQHGPRMAIEAGQVLEAALADMYLDGDPAALRKRGLHFVDATEDLRIAYVRRLEGMRFEGYVAFADCDDPSRYEETYLRLLGAIIERRLKAAESQLASFYIEQNEGLGAQGQRADPGRLRPSQGARRPSPGGLRRPVRLEAASGDQRAGFSARRSRSISQVESGETGQAGAARPADVRALARQISADPRRHDVDRVLAATSYPSLVRPDPAER

SEQ ID NO: 7005 - protein, 589 aa, unidentified
  source 1..589: note = Caulobacterales bacterium; note = Related to JAFLCT010000140.1
MAFTPDFRRLSNREAVRGALGVSEDVFQAVLTFSPEAVVGKPEMEGGFYLASSITIPVFFRHDIPKRNPARGVRTVWEPSIEVKSVYKALARRLDLFFRAHLDGFPHDAAYGFRVGRNIRENAAPHAGHRHLVATDIEDFFPSISVDRIQGLFNELGCRKDAAQALAQFVTIGGELPVGLPTSPVISNAVALPLDRDLAALAATTGSTYTRYADDIALSGDVEPPSSEEIGRVLEAQGFCLAESKTRRSKIGQAHFVTGLSISDPVRPHVPRRTKREMRQTLYYAKKFGLDDHLGYRGYSDWRTAQTEINRLDGLVKFIGHHEPTLASSLKRAWSEILRDSGNQASFEPRNQHREPFTIFVDEAEFERNGRPVLALAMAATQHPNVIHDDSDRVLQAYLSDLFADGRPEVIRKKGLHFVDATEDLRRSYVEAMRSMPFEGYVAFVEYDGAADYEAAYLCLLEAMTPRRLMAAESQMASFIFEENDKVSRTAIETCVIAVHSALVERCDRHPKCIGIDYASKPHAGIALSDFLLGVLGRYLRSEPPAPNATSRDRLRFEQLRDKYRVILDVTNGREYSRRRPIAPWADPF

SEQ ID NO: 7006 - protein, 583 aa, unidentified
  source 1..583: note = Related to JAHXZL010000012.1; note = Sphingomonas sp.
MTNREALIAAIGTDLATFDAVLDFVPPPRRVGSEAPETEKVQVLEIPVFLRHDIPKRRRKGEFRTAWEPVLAKSEYKALARRLDSFFRLTLAGFTHDCAFGFLPGRNIRENATVHSGHRHLLGVDVQDFFPTITRARIERLFTEVGVETSVAELLARFVTIGGSLPLGLPTSPVLSNAVSLPIDVACDALAARRGAVYTRYVDDMSFSSDDELPDVEDVRRILAENGFGLSERKTRRSRIGQAHYVTGLSVSDGVGPHVPRERKRRLRQELHYARKFGLADHLRHLGVNDDRVIQQQVNRLDGMVRFVVHHEPRIAPRLRTEWRALLKDNGMSPSFVPRGQHRAPFYMFIDEAEFDRDGERILALCIAITQHGPLIAGEGAAILAAAMTDPFSDGNVDALRRRGLHFADATEDLRLAYVTRLASMRFEGFVAFADLPDPAAYEETYLRLLGAMIERRLMAAESQYAYVFCEANDKVGRGGIEECVATAQRRLKDRDDRRPVGVGVEFVNKPHLGISVPDFLLGVLGRYLRSPPVPDGRPERRERLMFERLRDKYRLILDLTDWTEYSRRRPIRPWNDAGNDAP

SEQ ID NO: 7007 - protein, 581 aa, unidentified
  source 1..581: note = Related to NZ_BLAI01000019.1; note = Rhizobium dioscoreae
MSFNYDFSRITSRGSLLAALSIDEALFTQVLDFVPPPPAWSVPPSPPDEISKLMVPAFLRHDIPKRNTKRGHRTVWEPVLAKGTYKALGRRLDSFFRHKLDGYPHKSSFGYRPGRNIRENAAVHRGKKFLLSLDLQDFFPSISRSRIASTFEHLGIAPDIAALLARFVTISDALAMGLPTSPTISNAVALCLDQALEELALRSGAVYTRYSDDISISSDNALPDLALIAQIVSDNDFKLADEKTRLSVRGQAHYVTGLSISDPNQPHVPKAKKRRLRQELYYARKFGLGQHLHRQGINDPTVVQQEVNRLDGMIKFVGHHEPKLSSVIKQEWCEILTAADMKPSFAPRGMHRAPFVLVIDEAEFSRDGQRYLALCIVVSQQMDRVAEETGRVLSNALNDLWGDGNRNAMLARGLHFTDATKDLQLAYIKELATMPFEGYVAFCEYDGPKNYQAAYLRLLSAMIPRRLMAAESQYAAVLVEQNSKVSQTAITERISEVAADLKRTNNRRPKDTLSKLLSKPNPFLSPPDFLLGVLGQYLKSKPAAPEPRERLSFERLRDKYRLILDLDARAEYSRRRPIAPW

SEQ ID NO: 7008 - protein, 581 aa, unidentified
  source 1..581: note = Related to NZ_CM002025.1; note = Agrobacterium tumefaciens
MAFVYDFTRITTRDALLDALAIDGALFDQILAFEPPPPAWLESKSVRDSIGTISIPAFFRHDIPKRNASRGHRTVWEPALAMGSYKALARRLDDFFRYKLVGYPHDSSFGYRPGRNIRENAAPHRGKKFLLSMDLESFFPSISGTRVAGLFETLGVQPNVANLLARFVTLGNGLAMGFPTSPVISNAVALPLDQALQQLARSTGWTYTRYSDDISVSSDNSFPEIDQISGVIFDNGFQLAEGKTRWSRQGQAHFVTGLSISDPAQPHVPKAKKQKLRQELYYAQKFGLADHIQRKGVNDPKIMQQEVNRLDGLVKFVSYHEQKLSPRLKEQWHKIITVADMKPSFEPRKMSRVPFALIIDEAEFPRGDRRYLALCIVATQHVDKVIGSTRQVLTTALNDLWADGNRQSLLARGLHFTDATKDLQLAYIKELMTIPIEGYVAFCELHSHQNYETVYLRLMAAMMPRRLMAAESQKASIMVEQNSKVSQTLVNRCIADVFAELKRTNNRRPRDLTINFVTKPNPILSPPDFLLGVLGQYLRSKPAEPEPRERLNFERLRDKFRLILDLDNDIEFSRRRPISPW

SEQ ID NO: 7009 - protein, 591 aa, unidentified
  source 1..591: note = Related to PBXY01000014.1; note = Sphingobium sp.
MYALHFSRLKTRDDVISALTIDEALFDKIIAFEPPPPAAPRSAEPPVPKPEAAVQTIVLREPPVFFRHDIPKKNKARGHRTVWEPVNSMPAYKALARRLEAFFTMLPDYPHECAYGYRPGRNIRENASAHSGNKFLLSLDIKDFFPSITVERVRWLFEAMSIEAYVADLLARFVTIGGALPLGLPTSPVISNMIALPLDDLLRDLAGQYEAVYTRYSDDITFSGNGDLPDIEEIRPVLAAFDFAIADRKTRRSKRGQAHFVTGLSISDPAQPHVPADKKRSLRQTLYFAGKFGLAEHFQHRGINDQKVIQREVNRLDGLVKYVAHHEPRMATSLKEQWRQILADSGMKPSFTPRGQYRAPFYLLVDEAEYRRGDDKMLGLAMAVTQHPQRLADETNGILTRFLADLWSDGNDTALRKNGLHYTDATEDLRSAYVKQLATMPFEGYVAVGPLDADAGYEASYLRLLKALISRRLMAAESQFAFLIIEKNGKVAQDAIKACVQEAFDALKLADNRRPTAFGVNFVAKPNALISVPDFLLGALGKYLQSNPAAPGRPEPRERLLFERLRDKYRLIVDVDPWTEFTRRNPVKPWS

SEQ ID NO: 7010 - protein, 582 aa, unidentified
  source 1..582: note = Related to JAIQWW010000020.1; note = Phyllobacterium sp.
MEYWHDLSRLESREQLITALGIPAALFDAILAFEPPIIGCPVSDPTITTEIGIPLFIRHDIPKKNKTRGNRTVWEPLLNKSHYKALARRLGSFFRLKLDQYPHDSVYGYMSGRNIRENAKAHTGHRVLLSIDIQDFFPSITTESVCRLFQSLGVNATVSGLLSRFLTIGTTLPLGFPTSPIISNAIALPIDLELKALADLIDATYTRYADDLSFSSNGKIPDVEEVRAILGSNGFKIADAKTRQSKIGQAHYVTGLSISDPLRPHVPRERKHSLRRELYFARKFGLADHLRHRGVNDDSVIQQEINRIDGFVKFVAHHEPRMAADLKTGWREILLANGAKPSFTPRGQYRAPFYIFIDEAEYVKTGHKILALGMTVTQHAQELISQTSEVLSSARADLWAAGNTEILLKKGLHFSDATEDLRLEYVKRLAAMPFEGYVAFAPCKSPADYEATYLRLLSALIPRRLMAAESQFVFIYCEENSKISRDEAKAKIQRAFDDLKASNNRHPKGFAVEFVSKPNLGISAPDFLLGVLGTYLRSEPSPLGKPEPRERLMFERLRDKYRLILDVETWTEYSRRRPIEPW

SEQ ID NO: 7011 - protein, 584 aa, unidentified
  source 1..584: note = Related to NZ_LMRE01000023.1; note = Methylobacterium sp.
MKFHYDFRRLRDKQQLLDFLGITEAFFELVVSFEVPTDPPPPPVYAGGIEELSIPPFLRHKIPKKNKNRGCRVVWEPLLFKTTYKTLGRRLNNFLVNFLSNYPHPAAYGYLGGRNIKQNAAAHCGHKFLISADIVDFFPSITCERIKNLFIDLELVPDVAIALSRFMTISGALPLGLPTSPILSNAIFLPVDIELQYLASQAGATYTRYSDDLSFSSDRKLLILEQIGKSLQDNGFKIAEEKTKISRLGQAHYVTGLSITDPNGPHVPRDKKRRLRQELYYAKKFGLNDHFKHQEVTDAKAQQHNVNRLDGLVKFVSYHEPKHSARLKSQWSQILISSGSRPSYEPRRQKRVPFCICIDEAEFQFSQGVVLALGMSVSQHQDELDMAAAEVLDKWLSDFWAAGNQRVIEKRGLHFVDASEDLRLQFVTRMQALPFEGYISFGRLLSPAYYEETYLRLIESIIRRRLMAAESQLALFVIEENSKVSNQSVRAAIDRAYDELKSSNNRRPRAIIVQFRSKPDLSISFPDFLLGVLGKYLRSRDQKLGTPIPRDRLLFERLRDKYRLILDADTGFEFSRRREIQPWI

SEQ ID NO: 7012 - protein, 575 aa, unidentified
  source 1..575: note = Related to NZ_LMNB01000001.1; note = Methylobacterium sp.
MRTKQQLLNFLGLPEEVFEFVVNFEPPPDPQPPPIVVEGVQQISVPPFYRHKIPKKNKNRGYRVVWEPQIARLEYKALGRRLGSFFKHFLTNYPHPAAYGYLGGRNIRQNAAAHCGHRFLLSTDIASFFSSISIGQIKGLFLDLGICADVAVPLSRFVTIGGVLPLGLATSPVLSNAIFLPADTQLQALADRVGATYTRYSDDLSFSSNGNLPPIEDITKCVQIHGFRLAEGKTKTSEHGQAHYVTGLSISDPSSPHAPREKKRRLRQELYYAHKFGLNSHFQRIEAATTKDQQQNVNRLDGLVKFVAYHEPRQVGRLKPVWANILASSGARPSFEPRRRNGPPFCISIDEAEFQNDQGTVLALGMVVSQHQDQLVSAASEVLNRWLADPWAVGNRLAINKRGLHFTDASEDLRAEFVIRMQTLPFEGYISFGQLSDSSEYEATYLRLVGSIIKRRLMAADSESVLFLIEENSKISQNKVLFLIDQEFNELKLSNNRRPNKITIQFRHKPDLNISFPDFILGILGKYLRSKDAKPNAPMPRDRLLFERLRDRYRLILDADTKAEFSRRRPIEPWM

SEQ ID NO: 7013 - protein, 584 aa, unidentified
  source 1..584: note = Related to VFUO01000004.1; note = Mesorhizobium sp.
MTSLYDFSRITTREALTAVLGIDETMLDLVLTFQPPIDSPTAKNSPEAIKTITIPVFLRHRVPKKNRNRGFRTVWEPILLKSSYKGLARKLDAFFRHHLVGYPHESAFGYRPGRNIRENAQVHAGSARILSLDLADFFPNISKGHIKKLFLAMGVNATVSDLLSRFVTIEGALALGLPTSPVLSNAIALPIDLDLGILADQSNARYSRYADDITFSGNGELPTLERIEDCLRQHGFQIAEGKTRWSKRGQSHYVTGLSVSDPAQPHVPRDRKQALRQQLYYMEKFGIDDHFRRIGTNDSDVIQQALNSIDGMVKFVAHHEPCIAAPLKMQWNEILRVNGKKPSFKPKKQNREPFYIFVDEAEFKRAGTTVLALAMSVSQHEERIVQETREVLEAEMQDFWAAGNIDALRKRGLHFADATEDLRHSYVKRLASMPFEGYVAFHPCADPRNYEDTYLRLLGAMISRRLIAAESQFVCLYFEENSKVSQEAVRSLVQCAHDQLKRANNRHPKLCVVKFVSKPNFGISVPDFLLGVLGKYLHSKPAAAGGPEPRDRLMFDRLRDKYRLILDLSTWTEYSRRQPIEPWQ

SEQ ID NO: 7014 - protein, 584 aa, unidentified
  source 1..584: note = Related to WNKS01000001.1; note = Rhodoblastus acidophilus
MAYTYNFSDIRTREALLAVLGIDETMLDLVLSFQPPIDPPTVTIIPDVISTLQIPVFLRHRVPKKNRARGFRTVWEPILLKSTYKGLSRKLDVFFRHHLAGYPHESAYGYRPGRNIRENAQVHVGSARILSLDIADFFPSISKERIEQLFLGMGMNAAISDLLSRFLTIEGTLTLGFPTSPVLSNAISLPIDLELSSVARQFDARYSRYADDITVSGNGDLPSLEAVEDCLCRHGFQLAPGKTRFSKRGQSHYVTGLSVSDPVQPHVPRDRKRALRQQLYYMTKFGVDDHFRRLGINDPKVAQQAINSIDGMVKFVAHHEPRIAAPLKSLWNEILRVNGEKPSFTPKRQDRKPFYIFVDEAEFERAGTKVLALAMSVSQHEEQIFQETNEVLEAELGDFWAAGDINALRKKGLHFADATPDLRQSYVKRLAALPFEGYVAFHPCDDPCNYQSTYLRLLGSMISRRLIAAESQLVVICFEENSKVSQKSIKELVQFAHDELKRVNNRHPISCVVQFVSKPNLGISVPDFLLGVLGKYLQSKPANAGRPEPRDRLMFDRLRDKYRLILELPSWTEYTRRHPIEPWQ

SEQ ID NO: 7015 - protein, 583 aa, unidentified
  source 1..583: note = Related to NZ_CP042906.1; note = Hypericibacter terrae
MSFKYDLTQLQNREQLINFLGLSKDVFEDVLDFDPTGSNFSQFSEKESSLIELPLFFRHEIPKKNRQRGYRTVWEPTFLKSPYKALARRLNNFFAHKLEGFPHAQTYGYISGRNIRENAQNHCGHTHLVSIDLEDFFPSIKASRIATFLRTTGITPTVADLVSRFVTIEGSLPLGLPTSPTIANAICLPMDIELEALAQKLGATFSRYADDISFSSDGTFPSLRELMACIRQHNFEIAEAKTRTSKLGQAHYVTGLSVSDPAQPHVPRKKKRRLRQELYYADKYGLDDHLHHVGLGNSRFAQQEINRLDGLVKFTAHHEPRLSAHLKTTWAKILQTSGHRPSFAPKNQHRLPFYIYIDEAEYARPSGDRLLALAMAVSQHQEQINRATQDLLETTLSDVWAAGNLDAIAKKGVHFSDATEDMRLAYIDRMRLLPFEGYVAMARLPSAADYEVVYLRLLNAMIKRRLMAAESQFANLVFEENSKVRQEAIRKTVTDTYDALRESNNRHPEYCSVEFAGKPNFGLSIPDFLLGVLGKYLTVGPQQDGKPAARYVLLFERLRDKYRLILDVDNWVEYTRRRPIIPW

SEQ ID NO: 7016 - protein, 583 aa, unidentified
  source 1..583: note = Related to JAFKFG010000017.1; note = Alphaproteobacteria bacterium
MTFRYDLRLLNSRKSLLAFLGVDEIAFEKVLSFDPVSAQMSIGIEDDIHFLEAPLFLRHKIPKKNRARGYRIVWEPTAFKSEYKALARRLSNFLSHRLNGFPHSRTFGYIGGRNIRENARDHCGHRHLISFDLENFFPSISAARITKLLISTEIDPGIADLLSRFMTINGSLPLGLPTSPTLANAICLPMDIELQLLAQQHLATFSRYADDINFSSDTSLPPLEKFATLVKSNGFEIAKSKTRISKLGQAHYVTGLSISDLAHPHVPRHKKRRLRQELYYAQKYGLEDHLVRRGINDHQLIQHEINRLDGLVKFIAYHEPQLSAKLKTNWADILQESGRRPSFSPKNQARPPFCIYVDEAEYVRPDGTRLLAMGMAVSQHQDRVVQAAKDVLEETISDQWAAGNKPAIVKRGLHFADAHPDLRLAYIRRMRSLPFEGYVVMARLDSTASYEGTYIRLLNAIIRRRLMAAESQAALLVFEKNDKVSQVTIRQAVMQSYESLRKSNNRRPVGCYIDFVSKPDLGMSVPDFLLGILGRFLRSGPGKMEDQFDRDRKLFESLRDKYRLILDADSWVEYSRRREISPW

SEQ ID NO: 7017 - protein, 587 aa, unidentified
  source 1..587: note = Related to NZ_JIAX01000009.1; note = Ahrensia sp.
MAFNYDLRRIKTKEQLLTYIGLEEMFFDRALTFNVAEYEALMAEPVVEMGIKELYLPTFSLHEIPKRNPKRGKRTVWEANSHINDALKGLSRRLTLFFETVVPGFPHPQNCGYVRGRNIRENAQFHIGAKYLLKADIENYFPSISIGRISTFLERLGVASEVAKLLSNFLSIDGKLPLGLPTSPIIANAISHIMDIDLNSLAEKHGAIYSRYADDLTFSSEGELPTEMAISEIVELHDFTLALDKTRLSKRGQNHYVTGLSVSATDAPHAPKRMKRSLRQELHFSKKYGLDDHLEHLGLSHHFARQSYINHLDGRVKYIAFHEPNLASKIVPLWQEILEESGDSPSFKPKNQNRKPFQFYVDEAEFELNGIKYLALGMSGTQHQDHLNDVTEKVLEDYLADPWSDGNREKIDKKGMHFTDTTEDLRKIYLSALQPLPFNGYIVFGKLTADYQDCYLELLRFVLKRRLMAAESRAAYFHFEQTSKVSKDAITKTVDDVWKELLRENNRCPEYVVIDIVDKKYFGVAVPDFMLATFCRYLTTNLSENDYRRKANMFEMLRDKIRLIVNADTGEEFGRRNPLVNPDIENL

SEQ ID NO: 7018 - protein, 587 aa, unidentified
  source 1..587: note = Related to NZ_QKZJ01000005.1; note = Celeribacter halophilus
MAFDYDLRRIKTKGQLLTYIGLEEYFFDKALDFSVTEYEARMAEYSNKTDIGSLFLPLFWKHEIPKRNPKRGNRVVWEADSHINNALKGLARRLTLFFGTVIPDFPHPQNCGYVRGRNIRENAQFHIGAKFLVKADIEDYFPSISFERVSKFLENLGVNAGIARQISNFLCIDGKLPLGLPTSPIIANAISHLMDFNLNSLAQTHGSVYSRYADDLTFSSDDTLPSEDDISKVVEHHGFALAADKTRHSKRGQNHYVTGLSVSESDAPHVPRRMKRSLRQELHFSKKYGLNDHLGHLGLRGQPERQSYINHVDGRVKYIAFHEPGLAATIVPLWQSILEESGEGPSFKPKNQNRVPFQFYVDETEFTLDGVKYLALGMSASQHQDHLNDTTQNLWEDYLANPWSDGALDQIYAKGMHFTDTTEDLRRTYLSALQPLPFNGYIVFGKLTSDYQETYLTLLKFILRRRLMAAESRAAHFYFEQTSKVSKDSLTRTVNAVWQELRNENNRRPEYVVTEIVDKKYFGIAVPDFMLAVFRRYLTTTPSEKDYRRKANMFEMMRDKIRLIVNADTGEEFGRRNQLANPNIEDL

SEQ ID NO: 7019 - protein, 587 aa, unidentified
  source 1..587: note = Related to LIKT01000008.1; note = Phaeobacter sp.
MAFDYDLRRVKTKDQLLTYIGLEDIFFTNASDFDVHKYEARLAEPLVEMGIAQLHFSPFYKHEIPKRNPKRGSRVVWEASGHLNNALKSLARRLTLFFEMIISNFPHPHNCGYVRGRNTRDNAQFHIGAKYILKSDIENYFPSISLRRLISFFESLGVNSGIAMQLSHFLCIDQKLPLGLPTSPIIANAISHFMDIDLNGLADKYKAVYSRYADDLTFSSNGNLPQVSEVSEIVARHKFQLSSDKTKYSTRGQNHYVTGLSVSEENAPHAPRKMKLALRQELYFSKKYGLNDHLDHLGISDSYQRQSYINHLDGRVKYVAFQEPRLASKIGPLWQEVLEDSGEAVNYSPKNQHQTSFQFYVDETEFTLDGEKYLALGISASQHQEQLNNVTKRIWEDYIANPWSDGDLDAITKNGIHFTDTTEDLRRTYLTALQPLPFTGYIVFGKLGVDYQGCYLSLLKTVLKRRLMAAESRGAYFYFEQTSKVTKSAITETVKAAWSELKNDNNRHPEFVATEIVDKSYFGIAVPDFMLAVFRRYLMADSKDKQYRRKVNMFEMLRDKIRVIVNADTGEEFGRRNPIRNLDIENT

SEQ ID NO: 7020 - protein, 589 aa, unidentified
  source 1..589: note = Related to JAKRFC010000017.1; note = Epibacterium sp.
MAHDYDLRLISTKAQLLTYIGVEEEWFDVACGFDVAAYDQALCQDTESEIGIYHHHPFTRHEIPKRNPARGKRVVWEAERYLNNTYKGLARRLTRFLETAITGFPHPQCFGYVRGRNIRDNAGRHVGATLLLKADIKDFFPSIDKARVEKLFVDLGVNSEVATQLTSFLTIEGKLPLGLPTSPIIANAICHGMDGDLSKLATNSDSTYSRYADDISFSTNVTLPKAEAISVIVARYGFELAKDKTRVSKRGQNHYVTGLSISDPRAPHAPRSMKRNLRQELYFARKFGLDDHIRSLGITEGDEIQRYINHLDGSVRYVAFHEPTKARDLLVQWYAILEESGSSPSFEPKNQHDAQFCFFVDETEFEWNDKKYLALCLSATQQQDVINTTTERILKDYLANPFSDGDREAISRHGMHFYHATEDLKSLYFRALQKLPFQGYIVFGEQSGTYEADYTKLLSQIIKRRLMAAESKAAFLCFEQNSKVSKHAIEEVVRRSWEELDRTNNRRPKYATVEMVDKSYYGVGVPDFLLGVFRKYVSGVPAASPPQRQHNMFEGLRDKIRVIVNADTGEEFTRRHPFDNFSINDLRER

SEQ ID NO: 7021 - protein, 571 aa, unidentified
  source 1..571: note = Related to JAGHQQ010000003.1; note = Thalassospira sp.
MERFIGVKSDLLDLVLDFDSESSNSFSEQNSRIYMLSMPLFICHKIPKKNPNRGERVVWEALMDLRDVYKSFSRKLDIFFQKQIETYPHSCSYGYLGGRNTRGNAEKHVGKKYLLNADLCNFFDSISADKVRLLFVSCGVDEKISQILSRFLTISSRLPMGLSTSPVIANVLAHKMDCELSDLAEKFNCQYSRYVDDLTFSSDEILPEISHIEEIVARHNFSLAHEKIKFSKSGQAHYVTGLSVSDTEAPHVPRKIKKDLRKSLYYMDKFGIYDHFGRLGIHEHENVQREVNRIDGLVHYVSYHEPRKSFEINAIWQKILRDSGFRPYFSAHKQEYEVFNIIIDEAEFSHNGTNYLALAASVTNKQREIDNSIFEILDNFLSNPWSDGKVDLIKERGLHYVDCTEDLKKEFIQCLQILPFNGYISINAVGESNYRDRYIENFKNIIMRNYYKIDRSIVFVSIERNSKISNDDIYGVVDYVNSYHLNDKRVILPKGNVSFVGKECLGVSVPDFLLGCFAGYIKDNQTVSGGAKSRKFLQFEMLRDKIKVVSDLTTNQHFTRRNPFSKSKLKI

SEQ ID NO: 7022 - protein, 583 aa, unidentified
  source 1..583: note = Related to JADGCJ010000180.1; note = Magnetococcales bacterium
MNQKDMPRGFDRNRIKFDFRVLKDLNTLKLFIGVDNITESFINTKHEVHRWFIQHRIPKKNTTSHDKYRIVWQPINGAERLYKTLNRRFEIFIRDIDRRYPHPCSYGYVRGRNTLDNAKLHIGASVILHADISNFFHSIKIDRIKKLFISYGIDATIANYLSEIVTLNGSLPLGVHTSPMLANVCCLDLDDKLYKLSQRYSCAYSRYADDISISGSDLPSKDEVEMIFSEEGFVLSQNKFSISKLGQKHFVTGLSVSDPLTPHVPRQIKKSLRQELYYCNKFGVIGHLERIYDGSFDFIQKNINRIDGFVRYVSFIERKPNFKADWMAMLSQENLRINYRNKSNEQSNECVIYIDETKFEFNGASYLAIALVQTSNFDLIESESRRIYEEYIADPFAAGRKDNIAKNKIHFTDVHPDLQGRYIDWLYGIAFDAYIAFCKEESANYQSLYLSLLSRILPDRLRHLRNHNVKLILEQNPEVSSESIKNKVFGIDNYLKLQQIRSAKTSVIVGSKQEYYGFSVPDFVLGLSARYAISNSGKQQNDSSNPPARDTLLFEKMRDKIRVVYDVDAKRKYTRHRPFVPFQ

SEQ ID NO: 7023 - protein, 581 aa, unidentified
  source 1..581: note = Deltaproteobacteria bacterium; note = Related to JADJEE010000002.1
MLDLRNMRDASDLAKYLGISEGRARQLLVASPEEVFKTYEIPKRGNRGVREIWEVTETWAADMYKGLARRLNALFVGALAGFPHPSAHGYVAGRSTWTNALAHLGQRRVLCTDIRAFFKSIQHERVRQLLLRCGLNNEAAAALSRILSWDDHVPLGLHTSPIVANAVCHDLDARLRALAPAGRYTRYADDLFFSGPELPTRNDVAAALAADGFEIAPRKWGLAKAGRGLYVTGLSLEHGDRPRAPRSMKRRLRQDLHHADRYGLRQHLGRRGYPSFQSGINKIHGTIQYLRGIERDLGDRLNKEWMELLGREGVAVAYPTQERLAGRTVLFLLDESVPPDRDVLLLCLTVVEDVEWVSAEVQRFLDDRIADTMTAESERAVLKQRGLHWNELTPDNRTRATELLRTLPFRSFVAYAALPKQDKASYAETYARTLAQLLRDRMIRYDGCTLKIVGEENPRVGRRLLSEIANSIFSELECLGARRPAAVPSCEVLSKGSNPALPLPDLVLGVLGDFALSIVRSEREEVGDGKKKRRSGDQASIRFEQISHKVKAIYDLQSGVVYSRRNPFTAWPLDNASTGGE

SEQ ID NO: 7024 - protein, 595 aa, unidentified
  source 1..595: note = Related to NZ_CP060731.1; note = Pseudoxanthomonas mexicana
MSLDDYIPQLARPANVEQLAKALGVATQIFTFIADNSEPERIYRRHLIPKRAVRALPSVPVEDARGIVTLSLDSFDLSKYRVVWEAHSPVIKHAHKSAARVLERYLSRPGALFPHEAAFGYVKGRSTRHNARRHVGAKRLLSADIQDFFPSITLARVELALEAAGLQPAVTNALGRFLTIEGSLPLGLNASPMIANLVATPLDHDLSALAKEWGLTYTRYADDITLSGDGELPTREIIETVLKRHFFRLNKSKFRTSKLGQKHYVTGLSVADKAAPHAPRAMKHKLRQELYYIEKFGFLEHLSRGGEGGTEQHNVNRLDGTVNYVSSIEPRLAHRLRAAWKKVCDENDIAKSFEPRPVIQLRPASWFVDEAEIVHPDGTRLLALCLADVLEPGRLDTELRTLFAEEAGDAFGTADPLSIIQKGLHWSDATWSQREAVVKLIAASPVRVMVAMAPLTSPSEYTTTYTDLLCEILETALKIADDAEIAIHVEENRSKVSKADVQGAVTRAYTELETKNQRRPLQAPEVNIVSKGATPCCCVPDTVLGALHRYAVSRKDGKEGSLAVTLFERLRNHYSVIFDHHANKIYHHRSPFKRW

SEQ ID NO: 7025 - protein, 371 aa, unidentified
  source 1..371: note = Related to CP059266.1; note = Pseudoxanthomonas sp.
MGSAQPGHQACPQVCRTGTGALPLPARLPVSHEAAFGYVKGRSTRHNARRHVGAKRLLSADIQDFFPSITLARVELALEAAGLQPAVTNALGRFLTIEGTLPLGLNASPMIANLVATPLDHDLNALAKEWGLTYTRYADDITLSGDGELPTREIIETVLKRHFFRLNKSKFRTSKLGQKHYVTGLSVADKAAPHAPRAMKHKLRQELYYIEKFGFLEHLSRGGEGAPNSTTSIVWMARSTMYPASNRVWRIDCALPGRRYATRMTSPNHLSLGPSSSCDLLRGSLMRPRSSIRMAHGFSRSALPTFWSLAGWIQNYGRCSPKRPEMRSGQPIRCLSSRRGCIGVMRHGPSVRPWSSLSPPHLSGSWSPWRR

SEQ ID NO: 7026 - protein, 595 aa, unidentified
  source 1..595: note = Related to NZ_MADO01000098.1; note = Xanthomonas translucens
MSLDNYVPQLSRPSSVEQLAKALGVATQIFTFIVENDDPERIYRRHLIPKRAPRRLPLVPVEDAGGIVEVSLDSFDFSRYRIVWEAQNPVIKVAHRSAARVLERYLSRPGSQYPHEAAFGYIKGRSTRHNARRHSGAKHLLSADIKDFFPSITLARIELALEQAGLNSTVCNALARFLTIKGSLPLGLSASPMIANLVATSLDHDISALAKEWGLSYTRYADDITLSGDGPLPAREIIENILKRHFFRLNKAKFRTSKKGQKHYVTGLSVADKVAPHVPRVMKRKLRQELYYIRKFGFLDHLSRSGGRGTEQHNVNRLDGTVNYVSSIEASFGYKLRSDWKGICEDNGISRSFEPRPVINLRHASWFIDEAEIIHPDGTRLLALCLADVLEHDRLNVELVTLFAEEAGDAFGTADSLSIIRKGLHWAEATWSQREAVVKLLAVSPFRAIVAVAPLPNPQEYSRVYTDLLKQILATALKTSDDAAVNMYVEENRSKVAESEVQIAVKTAYFDLEEKNQRRPLKLPCVNIVPKGATPCCCVPDILLGALHRYAISKKVDAESGLAVTLFERLRNRYSVIFDGHAEKIYHHRSPFKRW

SEQ ID NO: 7027 - protein, 571 aa, unidentified
  source 1..571: note = Related to JALBDV010000008.1; note = Stenotrophomonas maltophilia
MARQIFEFIADNENPELIYRRHLIPKRAARPLPSVPIESMDGGVEFSLSGFDLSRFRVVWEAENPVIKHAHKSAARVVERFLTRPGTGFPHSASFGYVKGRSTRHNASQHIGRKYLLSADIKDFFPSITAARVQLALEEAGLKAVAAEALSRFLTVQGSLPLGLNASPVVANLVALPLDKELDEFARKLGLSYSRYADDVTLSGDQMLPSKDEVDQIFKRHFFRMNRVKFRTSKRGQKHYITGLSVADKFTPHAPRAMKQKLRQELYYIDKYGFSDHISRSRCGGTEQHNVNRVDGMVSYISSVEPRHSYRLRLMWKRLRTANNIERSFEPRPVIRFRQASWFVDEAEFTHPSGVPLLAVCLADVLDSARLDEVLASFIEEEAGDAFGSVDEVSIVRKGIHWVDATWSQREGLVKILAEAPIRAMVAFAPLRNGEDYSKVYLALLRKILGTALKVADDAIVKIYAEENRSKVRKSDVVDAVSSVHSMLADKNERRPLKVPEVNVVPKAFLPSCCVPDALLGALARYATSRSESDRGGLSVTLFERLRSRYSLIFDEYNSKVFHSRSPFVRW

SEQ ID NO: 7028 - protein, 595 aa, unidentified
  source 1..595: note = Related to VCME01000027.1; note = Xanthomonas hortorum
MSLDNFYPDLTRPSTVPQLAKALGVPLDIFQMIMDCSDPSLIYRQHFIPKKVCSIMPGTPVANSDGTIEIVLPNHDLSRYRVVWEPTNNVVKFAHRSAAGVLERFVSRPNSQAVHPCAFGYVKGKSTRKNAQQHLGKYFLLSADIKNFFPSVSVARIEVALRVIGIKDEVVESLAKFFAIENSLPLGLNASPIIANLVAKPLDEDLLSLAEGFNCSYTRYADDLTFSGNESLPKKEDIEFILRKHRFKANQSKFRYSKRGQRHYVTGLSVADVHSPHAPRKMKKRLRQELRFIEKFSLDDHFSKIKKSGERQHEINRIDGTVSYVASIERKLGADIRIQWKAICDKEQVGRSFEPRPTTLLRSAVWFIDETEFDARDGTKLLALCLADVLDPQRLNIDLLTLFSDESGDAFGLGAAAGKMIHDGLHWVDSNLTQREKVVNVLSISPIRVMVAMDSVEGATYQNVYLDLLRRLINVNLRGADDARVHIVIESNKSKVPRQLVIQAVRDECALLEAANQRRPLEIPSINVEGKDWTPAMCVPDVFLGVLAQYANSKQKGQGEFIVSLMERLRNRFAVVFDEHEGAIYHSGNPFRRWS

SEQ ID NO: 7029 - protein, 503 aa, unidentified
  source 1..503: note = Related to NZ_FNPT01000014.1; note = Lysobacter sp.
MNIDRFIHAHAPSFIHENAYGYIKYRSTRANASRHKGAKIIVSADIKEFFPSISIGHVEHALRKTGMKKETASLLAKFLTINNSLPLGLNASPTIANLVANPIDIEFTNLAKRINCTYTRYADDLTFSGDNTLPSHDEINGILGKFGFRSNERKFRASKRGQKHYVTGLSVADPKQPHVPRGLKRKLRQELYYIQKYGLKNHVEKSDSESTQRIINRLDGTISYVTSVESQLTRKLRSAWTSICQTEKVGRSFEPRPLHILRDAYWFIDESEIPRPDGSTCLALCCVELSANTIQADEASLTSLIEKETSDAYQTAKSSLHWAESTLSQRERIVDTLMPRLFSTFVVLENLSDEPYKDTYIRALKLVIDPILRRSDDAIVEIMIEANPSKISQQSVTSSIKDSYLRLVELNERRPVEMPKIRVEKKGARPALLLPDIMLGALSTYAKFQPGSNSTLEYSFFEKLRTKYTIIIDTAEKKLYHRKNPFTPWHTRNNTKIQPSKAE

SEQ ID NO: 7030 - protein, 573 aa, unidentified
  source 1..573: note = Related to NZ_JAKWJS010000001.1; note = Dyella sp.
MNTAPPGSQQLFRLADVRTIDQLARALGVPLQIFQDVIACEDPQQIYALHAIPKRHPRNPEDYRIAWECRQEPVARSHKAVARRLDDFARRRPISYPHAAVHGYVRGGSTRSNAQPHCGARVAIRADIENFFPTITLERIEAMLRTIGMQAAPAKALARFVTIKGALPLGLAESPVISNLVCLGLDKDLQSLAEERGVRYTRYADDITFSGDANLPSREQLRATLAKHGFRLSERKFRKSKRGQAHFVTGLSISERDYPHVPRKLKRMLRMELHFCERFGIGFHAEKINEDFRKTYLRLEGMVKYVAYIERRKSKEINDQWQRVLAVHRGPTSHAKIESRKRDDRFVIADETEFTVDGVKYLAFCCVRIANLERVEEAIQILLGDYLTKPGAKGDLDVLQAVGIHYTDAHFDLRTKTLDLMTDFLSWSASIHFARLDSSSKYKDTYLKLFADSIRQELITSDEWTLHILVERNDKVKLPSLTRVMEAEYQRAATDGARRPSSLPSVQRVEKASTSSLTLPDFVLATFRNYAQLVPDDRVLDFERIRDRVRYIHDADRGVYYTRKKPFVGIGSA
